United States Patent 8,362,325 (NUCLEOTIDE SEQUENCES AND CORRESPONDING POLYPEPTIDES CONFERRING MODULATED PLANT CHARACTERISTICS) - sequence listing, part 3

SEQ ID NO: 3957 - DNA, 2601 bp, Sorghum bicolor
  misc_feature: Ceres ANNOT ID no. 6034070
  misc_feature: Encodes the peptide sequence at SEQ ID NO 3958
  misc_feature: Up-regulated in shoot tissues in response to aminocyclopropane carboxylic treatment
  misc_feature: Up-regulated in root tissues in response to methyl jasmonate treatment
  misc_feature: Up-regulated in shoot tissues in response to methyl jasmonate treatment
  misc_feature: Up-regulated in shoot tissues in response to salicylic acid treatment
atgctgctgggcgggatcatcgatgggctgacgggggcgaacaagcatgcgcggctcaagggcacggtggtgctcatgcgcaagaacgtactcgacctcaacgacctcggcgccaccgtcatcgacggcatcagcgagttcctcggcaagggggtcacctgccagctcatcagctccaccctcgtcgacgccaacaacggcaaccgcgggcgtgtcggggcggaggcgaacctggagcagtggctgacgagcctgccgtcggtgacgaccggcgagtccaagttcggcgtcacgttcgactgggaggtggcgaagctgggcgtgccgggggcggtcatcgtcaagaacaaccacacgtccgagttcttcctcaagaccatcacgctcgacgacgtccccggacgcggcaccgtcaccttcgtcgccaactcgtgggtctaccccgtcggcaagtaccgctacagccgcgtcttcttctccaacgatacgtacctgccgagccagatgccgccggcgctgaagccgtaccgcgacgacgagctccgcaacctccgcggcgacgaccagcagggcccctaccaggagcacgaccgcgtgtaccgctacgacgtctacaacgacctcggcgagcctgacggcggcaacccgcgccccatcctcggcggctccgccgaccacccctacccgcgccgctgccgcacgggccgcaagcccaccaaaaccgaccccaactcggagagccggctgtcgtcgctgctggagaagatctacgtgccgcgggacgagcggttcggccacctcaagatgtccgacttcctgggccacgccatcaaggcgatcgcgcaggggatcatcccggcggtgcgcacgtacgtggacaccagccccaaagagttcgactcgttccaggacatcatcaacctgtacgagggcgggatcaagctgcccaagatccaggcgctcgaggacatgcgcaagctcttcccgctccagctcgtcaaggacctcctccccgccggcggcgactacctgctcaagctccccatcccggagatcatcaaagagagcaaggatgcgtggaggaccgacgaggagttcgcgcgggaggtgctcgccggcgtcaacccggtggtgatcacgcgcctcacggagttcccgccgaagagcacgctcgaccccagcaagtacggcgaccacaccagcacgatcacggcggagcacatcgagaagaacctggagggcctcacggtgcagcaggcgctggacggcaacaggctctacatcctggaccaccacgaccggttcatgccgttcctgatcgacgtcaacaacctggagggcaacttcatctacgccaccagggcgctcttcttcctgcgcgccgacggcaggctcgcgccgctcgccatcgagctcagcgagccgtacatcgacggtggcctcaccaaggccaagagcaaggtctacacgccggcgtccgcaggcgtcgaggcctgggtgtggcagctcgccaaggcctatgtcgccgtcaacgactccggctggcaccaactgatcagccactggctgaacacgcacgcggtgatggagccgttcgtgatcgcgacgaaccggcagctgagcgtgacgcacccggtgcacaagctcctgcacccgcacttccgcgacaccatgaccatcaacgcgctggcgcggcagacgctcatcaacggcggcggcatcttcgagctgaccgtgttcccgggcaagtacgcgctggccatgtcctccgtggtgtacaaggactggaacttcacggagcagggcctccccgccgacctcgtcaagcggggggtggcggtggaggacccgtcgagcccctacaaggtgcggctgctgatccaggactacccgtacgcgagcgacgggctggcgatctggcacgccatcgagcagtgggtgggcgagtacctggccatctactacccggacgacgccgcgctgcgtggcgacgaggagctgcaggcgtggtggaaggaggtgcgcgaggtcgggcacggcgacctcaaggacgcggcctggtggcccaagatgcaggccgtgtcggagctcgccagcgcctgcaccaccatcatctggatcgcgtcggcgctgcacgccgccgtgaacttcggccagtacccgtacgcggggtacctgccgaaccggcccacggtgagccggcgccggatgccggagcccggaagcaaggagtacgaggagctggagcgctacccggagcgcggcttcatccacaccatcacgagccagatccagaccatcatcggcatctcgctcatcgagatcctctccaagcactcctccgacgaggtgtacctcgggcagcgcgacacccccgagtggacctccgacgccaaggcgaaggcggcgttcaagcggttcagcgacgcgctggtggcgatcgagggcaaggtggtgggcgagaaccgcgacccgcagctcaagaacaggaacgggcccgccgagttcccctacatgctgctgtaccccaacacctctgaccacagtggcgccgccgctgggctcaccgccaagggcattcccaacagcatctccatctga

SEQ ID NO: 3958 - protein, 866 aa, Sorghum bicolor
  misc_feature: Ceres ANNOT ID no. 6034070
  misc_feature (170)..(844): Pfam Id: Lipoxygenase Pfam Desc: Lipoxygenase
  misc_feature (52)..(158): Pfam Id: PLAT Pfam Desc: PLAT/LH2 domain
  misc_feature (2)..(866): NCBI GI: 18481649 NCBI Desc: lipoxygenase [zea mays]
  misc_feature (2)..(866): NCBI GI: 12620877 NCBI Desc: lipoxygenase [zea mays]
  misc_feature (1)..(866): NCBI GI: 2506825 NCBI Desc: lipoxygenase 1
  misc_feature (2)..(866): NCBI GI: 73920226 NCBI Desc: lipoxygenase 2 (lipoxygenase l-2)
  misc_feature (6)..(866): NCBI GI: 8515851 NCBI Desc: lipoxygenase [zea mays]
  misc_feature (1)..(866): SWISSPROT Homolog: EC 1.13.11.12 Lipoxygenase 1
  misc_feature: Useful for making plants with altered lignin content
  misc_feature: Functional homolog of the protein sequence given in SEQ ID NO 13126
  misc_feature: Up-regulated in shoot tissues in response to aminocyclopropane carboxylic treatment
  misc_feature: Up-regulated in root tissues in response to methyl jasmonate treatment
  misc_feature: Up-regulated in shoot tissues in response to methyl jasmonate treatment
  misc_feature: Up-regulated in shoot tissues in response to salicylic acid treatment
MLLGGIIDGLTGANKHARLKGTVVLMRKNVLDLNDLGATVIDGISEFLGKGVTCQLISSTLVDANNGNRGRVGAEANLEQWLTSLPSVTTGESKFGVTFDWEVAKLGVPGAVIVKNNHTSEFFLKTITLDDVPGRGTVTFVANSWVYPVGKYRYSRVFFSNDTYLPSQMPPALKPYRDDELRNLRGDDQQGPYQEHDRVYRYDVYNDLGEPDGGNPRPILGGSADHPYPRRCRTGRKPTKTDPNSESRLSSLLEKIYVPRDERFGHLKMSDFLGHAIKAIAQGIIPAVRTYVDTSPKEFDSFQDIINLYEGGIKLPKIQALEDMRKLFPLQLVKDLLPAGGDYLLKLPIPEIIKESKDAWRTDEEFAREVLAGVNPVVITRLTEFPPKSTLDPSKYGDHTSTITAEHIEKNLEGLTVQQALDGNRLYILDHHDRFMPFLIDVNNLEGNFIYATRALFFLRADGRLAPLAIELSEPYIDGGLTKAKSKVYTPASAGVEAWVWQLAKAYVAVNDSGWHQLISHWLNTHAVMEPFVIATNRQLSVTHPVHKLLHPHFRDTMTINALARQTLINGGGIFELTVFPGKYALAMSSVVYKDWNFTEQGLPADLVKRGVAVEDPSSPYKVRLLIQDYPYASDGLAIWHAIEQWVGEYLAIYYPDDAALRGDEELQAWWKEVREVGHGDLKDAAWWPKMQAVSELASACTTIIWIASALHAAVNFGQYPYAGYLPNRPTVSRRRMPEPGSKEYEELERYPERGFIHTITSQIQTIIGISLIEILSKHSSDEVYLGQRDTPEWTSDAKAKAAFKRFSDALVAIEGKVVGENRDPQLKNRNGPAEFPYMLLYPNTSDHSGAAAGLTAKGIPNSISI

SEQ ID NO: 3959 - DNA, 2667 bp, Sorghum bicolor
  misc_feature: Ceres ANNOT ID no. 6034072
  misc_feature: Encodes the peptide sequence at SEQ ID NO 3960
  misc_feature: Up-regulated in root tissues in response to methyl jasmonate treatment
  misc_feature: Up-regulated in shoot tissues in response to methyl jasmonate treatment
  misc_feature: Up-regulated in shoot tissues in response to salicylic acid treatment
atgttctggcacggggtcgcggaccggctgacggggaagaacaaggaggcgtggaacgagggcaagatccgcggcacggtgaagctggtgaagaaggaggtgctggacgtcggcgacttcaacgcctcgctgctcgacggcgtccacaagatcctcggctgggacgacggcgtcgccttccagctcgtcagcgccaccgcggccgaccccagcgatggtggccgtggcaaggtggggagggcggcgcacctggaggaggccgtggtgtcgctcaagtccaaggtggacggggagacggtgttccgggtgaacttcgactgggacgagtcgcaggggatcccgggcgccgtccgcgtcaggaacctgcagcacgccgagttcttcctcaagacgctcaccctggagggcgtccccggcaggcaggggggcaccgtcgtcttcgtcgccaactcatggatctacccgcacaagctctactcccaggaacgcatcttcttcgccaacgacacctatctgccaaacaaaatgcctgcggctttggttccttatcggcaagatgaactcaagattctccgtggtgatgatactcctggaccatacaaggagcatgatcgcgtctaccgttatgactactacaatgaccttggtgacccagacaagggtgaagacaatgctcggccgatccttggtggcagccaacacccatatccccgtcgctgcagaactggtcggcacccaacagaaaaagacccaaattcagagagcaggcttttcctgttgaacctgaacatctatgtcccgcgtgatgaacgctttgggcatctcaagatgtcagacttccttgggtactcactgaaggcaatcgttgaggctgttcttccaacattagggacttttgtcgatgatacaccaaaggagtttgattcattcgaagatatcctcggactctatgaactgggtccagaagcacccaacaatccactagtagcagaggtcaggaagagaatccccagtgagttccttagaagtattctgccaaatggtagtcatgaccaccccctaaagatgccccttccaaatatcatcaaatcagatgtattgaaaaaggctccagagttcaagtttggctggaggactgatgaagagtttgcgagagagacacttgcaggcgtgaacccagtaatcatcaaacgtctgacggagttccctgctaaaagtaccttggacccaagtcaatatggggaccataccagcaagatcactgaagctcacattcagcataacctggaaggcctgtcggtgcagaatgcactgaagaacaacaggctcttcatcctagaccaccatgatagtttcatgccttacctcaacaagatcaacaagttggagggaaacttcatctatgcaagcaggaccctactgttcttgaaggacgatggcaccctgaagcccctggccatcgagctgagcctgcctcaccctgatggtctgcagcacggtgcggtcagcaaggtgtacaccccggctcacactggcgtggagggtcacatctggcaacttgccaaggcttacgcctgcgtaaacgactctgcctggcatcagctgatcagccactggttgaacacacacgcggtgatcgagccgttcgcgatcgcaacaaaccggcagctcagtgtggtgcatcctgtgcataagctgctgagcccacactaccgtgacacattgaacatcaacgccctggcacgccagacgctcatcaacgccggtggcatcttcgagcgcaccgtgttccctggaaaatacgcgctggagatgtcctccgacgtgtacaagagctggaatttcaacgagcaggctctccccgcagatctcgtcaagagaggtgtggctgtaccggatcagtcaagcccatatggtgtccgactactgatcaaggactatccatatgccgttgatgggctcgtgatctggtgggcgattgagcggtgggtcaaggagtacttggatgtctactactctaacgacggtgaggtccagcgtgatgtggagctgcaggcatggtggaaggaggtgcgtgaggaggcgcacggcgaccttaaggatcgagactggtggcccaggatggacaccgtccagcagctggctaggtcgtgcacgaccatcatctgggtggcatctgcgctgcacgcagctgtcaactttgggcagtatccatacgccgggtacctcccgaaccggccgacggtgagccggcggccgatgccggagccgggcagcgatgagtacaagaagttggaagcggggcagaaggaggccgacaaggtgttcatccgcaccatcaccagccagttccagaccatcctgggcatctcgctcatcgagatcctctccaagcactcctccgacgaggtgtacctcggccagcgtgacgagcctgagcgatggacgtcagacgccaaggcgttggatgcgttcaaaagattcggaagccggctggtggagattgagaaccggatcaagacgatgaacgacaacccgaccttgaagaaccgaaaggggccggtggaaatgccgtacatgctgctgtaccccaacacgtcggacgttaccggcgagaagggcgaggggcttactgccatgggcattcccaacagcatctccatatga

SEQ ID NO: 3960 - protein, 888 aa, Sorghum bicolor
  misc_feature: Ceres ANNOT ID no. 6034072
  misc_feature (177)..(865): Pfam Id: Lipoxygenase Pfam Desc: Lipoxygenase
  misc_feature (58)..(165): Pfam Id: PLAT Pfam Desc: PLAT/LH2 domain
  misc_feature (1)..(888): NCBI GI: 84626285 NCBI Desc: lipoxygenase [zea mays]
  misc_feature (1)..(888): NCBI GI: 84626287 NCBI Desc: lipoxygenase [zea mays]
  misc_feature (5)..(888): NCBI GI: 73920878 NCBI Desc: probable lipoxygenase 4
  misc_feature (5)..(888): NCBI GI: 88657483 NCBI Desc: dual positional specificity lipoxygenase [oryza sativa (japonica cultivar-group)]
  misc_feature (46)..(888): NCBI GI: 115454789 NCBI Desc: os03g0700700 [oryza sativa (japonica cultivar-group)]
  misc_feature (19)..(888): SWISSPROT Homolog: EC 1.13.11.12 Lipoxygenase 1
  misc_feature: Useful for making plants with altered lignin content
  misc_feature: Functional homolog of the protein sequence given in SEQ ID NO 13126
  misc_feature: Up-regulated in root tissues in response to methyl jasmonate treatment
  misc_feature: Up-regulated in shoot tissues in response to methyl jasmonate treatment
  misc_feature: Up-regulated in shoot tissues in response to salicylic acid treatment
MFWHGVADRLTGKNKEAWNEGKIRGTVKLVKKEVLDVGDFNASLLDGVHKILGWDDGVAFQLVSATAADPSDGGRGKVGRAAHLEEAVVSLKSKVDGETVFRVNFDWDESQGIPGAVRVRNLQHAEFFLKTLTLEGVPGRQGGTVVFVANSWIYPHKLYSQERIFFANDTYLPNKMPAALVPYRQDELKILRGDDTPGPYKEHDRVYRYDYYNDLGDPDKGEDNARPILGGSQHPYPRRCRTGRHPTEKDPNSESRLFLLNLNIYVPRDERFGHLKMSDFLGYSLKAIVEAVLPTLGTFVDDTPKEFDSFEDILGLYELGPEAPNNPLVAEVRKRIPSEFLRSILPNGSHDHPLKMPLPNIIKSDVLKKAPEFKFGWRTDEEFARETLAGVNPVIIKRLTEFPAKSTLDPSQYGDHTSKITEAHIQHNLEGLSVQNALKNNRLFILDHHDSFMPYLNKINKLEGNFIYASRTLLFLKDDGTLKPLAIELSLPHPDGLQHGAVSKVYTPAHTGVEGHIWQLAKAYACVNDSAWHQLISHWLNTHAVIEPFAIATNRQLSVVHPVHKLLSPHYRDTLNINALARQTLINAGGIFERTVFPGKYALEMSSDVYKSWNFNEQALPADLVKRGVAVPDQSSPYGVRLLIKDYPYAVDGLVIWWAIERWVKEYLDVYYSNDGEVQRDVELQAWWKEVREEAHGDLKDRDWWPRMDTVQQLARSCTTIIWVASALHAAVNFGQYPYAGYLPNRPTVSRRPMPEPGSDEYKKLEAGQKEADKVFIRTITSQFQTILGISLIEILSKHSSDEVYLGQRDEPERWTSDAKALDAFKRFGSRLVEIENRIKTMNDNPTLKNRKGPVEMPYMLLYPNTSDVTGEKGEGLTAMGIPNSISI

SEQ ID NO: 3961 - DNA, 819 bp, Sorghum bicolor
  misc_feature: Ceres ANNOT ID no. 6034082
  misc_feature: Encodes the peptide sequence at SEQ ID NO 3962
atggccgcgaactcccccttcgactgcgtgctcctagacctggacgacaccctgtacccgggcaacaccggcatcggccccgccctgaagcgcaacatcgacgagttcctgcaggccaagctcggcgtctcggcggagaaggccgccgccatgcgcgtcgagctcttccgcacgcacggcagctccctcgccggactcatcgcgctcggctatgacgtgcacccggacgagtaccacagctacgtgcacggcaggctaccgtacgacatgatccccgccgacccgcagctggcgcgcctgctgcagagcatcccgcagcgcaaagtgctcttcaccaactcggaccgggcgcacatgaagcgggcgttggagcggctgggcgtggacgaggccgtcttcgacgccgtcgtgtgcttcgagaccatgaacccgcacctcttcggcggcgaggccagagaggagcgcgtcgacggcggcgaccacccggtcgtggtcctcaaaccggcggtggacgccatcgtggcggggctgcgcgccgccggctccaacccacgccggacgctcttcctggacgacagcgagaggaacatcaccgctgggaaagcgctcggcctccgcaccgccctggttggcaagagggtgaggagcaaggacgcagactacgcgctggagaacatcggcgcgctccggcgggtcatcccggagatctggggcgtcgtcgccggcggcgagagtgaacgatcggaccacagcattgacaagatgccgatgaggtccgacctggactccatcatccagcccacgtccatccaggcctaa

SEQ ID NO: 3962 - protein, 272 aa, Sorghum bicolor
  misc_feature: Ceres ANNOT ID no. 6034082
  misc_feature (7)..(213): Pfam Id: Hydrolase Pfam Desc: haloacid dehalogenase-like hydrolase
  misc_feature (4)..(251): NCBI GI: 8885554 NCBI Desc: ripening-related protein-like; hydrolase-like [arabidopsis thaliana]
  misc_feature (4)..(251): NCBI GI: 32815949 NCBI Desc: at5g59490 [arabidopsis thaliana]
  misc_feature (8)..(252): NCBI GI: 57899696 NCBI Desc: ripening-related protein-like [oryza sativa (japonica cultivar-group)]
  misc_feature (3)..(239): NCBI GI: 92873585 NCBI Desc: had-superfamily hydrolase subfamily ia, variant 3 [medicago truncatula]
  misc_feature (3)..(240): NCBI GI: 30697236 NCBI Desc: haloacid dehalogenase-like hydrolase family protein [arabidopsis thaliana]
MAANSPFDCVLLDLDDTLYPGNTGIGPALKRNIDEFLQAKLGVSAEKAAAMRVELFRTHGSSLAGLIALGYDVHPDEYHSYVHGRLPYDMIPADPQLARLLQSIPQRKVLFTNSDRAHMKRALERLGVDEAVFDAVVCFETMNPHLFGGEAREERVDGGDHPVVVLKPAVDAIVAGLRAAGSNPRRTLFLDDSERNITAGKALGLRTALVGKRVRSKDADYALENIGALRRVIPEIWGVVAGGESERSDHSIDKMPMRSDLDSIIQPTSIQA

SEQ ID NO: 3963 - DNA, 837 bp, Sorghum bicolor
  misc_feature: Ceres ANNOT ID no. 6034087
  misc_feature: Encodes the peptide sequence at SEQ ID NO 3964
atggcggccgcgtcgctgctgagccgggtgcggtggctcctggtggagcacccggcggtggcctcgttccgctggcagccaggccgcacggtcggcgcgacggcgtccttcgcggccgccgtcatctgcggctacctcgccgcggtgctcgtcctccgccgcctcgtcctgccgcgcgtcccgccgctccctccgccggcgctccgcgcggcatccgccgcccacaacgcggtcctgctggcgctctccgccgccatggccgccgggtgcgcgctctccacggccgccgcggcgccggcgccgcgaaggtgggcgtggcccttctgcttcccgccgcggggcgccacggaggcgtcgggcccggtcttcttctgggcgcacgtcttctacctctccaaggtgtacgagctcggcgacacgctgctcatcctgctggcccgccgcccgctcacgctgctccacgtctaccaccacgccgtcgtcgtcgccatgtgctacctctggctcgccacgcgccagtccctgatgcccatcgcgctcgtcaccaacgccggcgtgcacgtcgtcatgtacgcctactacctctcctgcagcgtggggctgcgctggcccaaccgctggaagcgcgccgtcaccgagctgcagatcgtgcagttcctcttcagcttcgccgcctccgtggtgatgctgtggctccacttcaccgccggcggctgcgaggggatggccggctgggtgttcaacgccgtcttcaacgcgtcgctgctcgcgctcttcctcaacttccacggcgccgcctacaaagccggcaagggcaacaagggtaaagcagaatga

SEQ ID NO: 3964 - protein, 278 aa, Sorghum bicolor
  misc_feature: Ceres ANNOT ID no. 6034087
  misc_feature (4)..(279): Pfam Id: ELO Pfam Desc: GNS1/SUR4 family
  misc_feature (12)..(274): NCBI GI: 124359716 NCBI Desc: gns1/sur4 membrane protein [medicago truncatula]
  misc_feature (5)..(273): NCBI GI: 57282652 NCBI Desc: long chain fatty acid elongation enzyme [gossypium hirsutum]
  misc_feature (12)..(274): NCBI GI: 92871736 NCBI Desc: gns1/sur4 membrane protein [medicago truncatula]
  misc_feature (23)..(278): NCBI GI: 28829059 NCBI Desc: similar to involved in synthesis of 1,3-beta-glucan, a component of the cell wall, and elongation of fatty acids up to 24 carbons; fen1p [saccharomyces cerevisiae] [dictyostelium
  misc_feature (23)..(278): NCBI GI: 28829059 (continued) discoideum]
  misc_feature (22)..(267): NCBI GI: 28828933 NCBI Desc: similar to gns1/sur4 family protein [schizosaccharomyces pombe] [dictyostelium discoideum]
MAAASLLSRVRWLLVEHPAVASFRWQPGRTVGATASFAAAVICGYLAAVLVLRRLVLPRVPPLPPPALRAASAAHNAVLLALSAAMAAGCALSTAAAAPAPRRWAWPFCFPPRGATEASGPVFFWAHVFYLSKVYELGDTLLILLARRPLTLLHVYHHAVVVAMCYLWLATRQSLMPIALVTNAGVHVVMYAYYLSCSVGLRWPNRWKRAVTELQIVQFLFSFAASVVMLWLHFTAGGCEGMAGWVFNAVFNASLLALFLNFHGAAYKAGKGNKGKAE

SEQ ID NO: 3965 - DNA, 1113 bp, Sorghum bicolor
  misc_feature: Ceres ANNOT ID no. 6034099
  misc_feature: Encodes the peptide sequence at SEQ ID NO 3966
atgatcagcaggcagctcgtgctgacctacctctacctgctgatctacatctgcctctcgtcgggcgtcatcctgttcaacaaatgggtcctttctccaaagtacttcaaattcccctttcctatcacactcacaatgattcacatggcattttctggaatcgtgactttcttccttgtccgagtttttaagattgttagatatgccacgtgtgtaattccaattagtgccttctttgcttcaagtctgtggtttggcaacacggcgtacttgtatatttccgtggctttcattcagatgctcaaggccttgatgcctgtagcaacatttataatggctgttttgtgtggtactgacaaattaagatgggatctcttcttgaacatggtattggtcagtgttggtgttgtagtttcatcttatggcgagatccactttaatgtgattggaacgttataccaagtaactggtatctttgcggaagccctcaggctggtcctaactcaggtccttctacaaaagaagggcttaaccctgaatcctattacaagcttgtattacatagccccttgcagtttcatcttcctgtttattccatggtatttgctggaaaagccagaaatggacgtgtctcaaattcaattcaactattcaatatttttcctgaatgcactttctgcattcgcattgaacatatccatattcttagttattggaagaactggagctgtcaccattcgggttgctggtgttctgaaggactggatacttattgctctctcaactattatcttccctgaatctgttattacaagcctcaacataattggatacgcagttgcgctatctggtgttgtcctgtacaattatttgaagatgaaagatgtcaaagcaaaccagcttccagcagacaatagttctgatagggctacgaaggacaagaagtctttaagtatattcaggcctgacaattccatggacaacaatgatgggactgtagtaggaggcctggcatcagaagctgcggcagttgatgaggaagcccctttgatcccttctgcacgcctctcctatgttacacggacccaaacaggcagcttcattaacagataa

SEQ ID NO: 3966 - protein, 370 aa, Sorghum bicolor
  misc_feature: Ceres ANNOT ID no. 6034099
  misc_feature (150)..(290): Pfam Id: TPT Pfam Desc: Triose-phosphate Transporter family
  misc_feature (1)..(366): NCBI GI: 15221115 NCBI Desc: phosphate translocator-related [arabidopsis thaliana]
  misc_feature (1)..(366): NCBI GI: 8778534 NCBI Desc: f21d18.5 [arabidopsis thaliana]
  misc_feature (67)..(366): NCBI GI: 5733885 NCBI Desc: ests gbt22141 and gbh37217 come from this gene. [arabidopsis thaliana]
  misc_feature (8)..(307): NCBI GI: 20147279 NCBI Desc: at3g14410/mln21_19 [arabidopsis thaliana]
  misc_feature (8)..(307): NCBI GI: 9279588 NCBI Desc: phosphate/phosphoenolpyruvate translocator protein-like [arabidopsis thaliana]
  misc_feature: The sequence is a functional homolog of SEQ ID NO. 360 in the 11/188,298 US application
  misc_feature: The sequence is a functional homolog of SEQ ID NO. 484 in the 11/188,298 US application
MISRQLVLTYLYLLIYICLSSGVILFNKWVLSPKYFKFPFPITLTMIHMAFSGIVTFFLVRVFKIVRYATCVIPISAFFASSLWFGNTAYLYISVAFIQMLKALMPVATFIMAVLCGTDKLRWDLFLNMVLVSVGVVVSSYGEIHFNVIGTLYQVTGIFAEALRLVLTQVLLQKKGLTLNPITSLYYIAPCSFIFLFIPWYLLEKPEMDVSQIQFNYSIFFLNALSAFALNISIFLVIGRTGAVTIRVAGVLKDWILIALSTIIFPESVITSLNIIGYAVALSGVVLYNYLKMKDVKANQLPADNSSDRATKDKKSLSIFRPDNSMDNNDGTVVGGLASEAAAVDEEAPLIPSARLSYVTRTQTGSFINR

SEQ ID NO: 3967 - DNA, 840 bp, Sorghum bicolor
  misc_feature: Ceres ANNOT ID no. 6034113
  misc_feature: Encodes the peptide sequence at SEQ ID NO 3968
atggccatgccgttcgcgcgccgcgacatcgaggcggcgggcgccggcgcgggccccggcagcgatgactctcctgccgcgaagaagggcaagccggagctctcaggggcgcgcccggctttgacgaggtccgaggcgctcgcgttcgcggccgtgctcgcgctcttcaccgccgggatcttctgcgtcttccttaccgcgccacgcggcgagttcgggcagatcctccgcctcccgcgcagcctctccgacgtccgccttctcaaagacaatcttgctgtatacgcgagggattatcaaacaaattttatattgggttattgctcaatatacatcttcatgcaaacattcatgatccctggaacaatattcatgtctttacttgctggggctctttttggagtgattaaaggtggcattttggtagttttcactgccacagctggtggatcgtcctgctattttgtctccaagctgattggcagacccttggttagttggttgtggcctgaaaaactgagatatttccagtcagagattgctaagaggagagaaaagctattgaattatatgctttttctgagaataactccaactttgcccaatacattcataaatatggcgtcacccattgttgacatacctttccatattttcttcgctgcaacactagttggtcttattccagcatcttatattactgtaaaggctggtagagccctaggcgatctgaaatcagttagggagttgtatgactttaagacattagtggttctgttccttattggatctgttgctgtcgtgccaacaatcctgaaaaggaagagaacatacgaatga

SEQ ID NO: 3968 - protein, 279 aa, Sorghum bicolor
  misc_feature: Ceres ANNOT ID no. 6034113
  misc_feature (119)..(240): Pfam Id: SNARE_assoc Pfam Desc: SNARE associated Golgi protein
  misc_feature (45)..(279): NCBI GI: 115460234 NCBI Desc: os04g0592600 [oryza sativa (japonica cultivar-group)]
  misc_feature (45)..(279): NCBI GI: 116311043 NCBI Desc: osigba0142i02-osigba0101b20.17 [oryza sativa (indica cultivar-group)]
  misc_feature (7)..(236): NCBI GI: 51997111 NCBI Desc: gtk16 protein [gerbera hybrid cultivar]
  misc_feature (12)..(275): NCBI GI: 436224 NCBI Desc: kiaa0033 [homo sapiens]
  misc_feature (20)..(275): NCBI GI: 62858679 NCBI Desc: loc549709 [xenopus tropicalis]
MAMPFARRDIEAAGAGAGPGSDDSPAAKKGKPELSGARPALTRSEALAFAAVLALFTAGIFCVFLTAPRGEFGQILRLPRSLSDVRLLKDNLAVYARDYQTNFILGYCSIYIFMQTFMIPGTIFMSLLAGALFGVIKGGILVVFTATAGGSSCYFVSKLIGRPLVSWLWPEKLRYFQSEIAKRREKLLNYMLFLRITPTLPNTFINMASPIVDIPFHIFFAATLVGLIPASYITVKAGRALGDLKSVRELYDFKTLVVLFLIGSVAVVPTILKRKRTYE

SEQ ID NO: 3969 - DNA, 513 bp, Sorghum bicolor
  misc_feature: Ceres ANNOT ID no. 6034114
  misc_feature: Encodes the peptide sequence at SEQ ID NO 3970
atggcgaccctctccatggtctccgtccccgtcgcaccctcctccctctccctctccacccggggccgcacctcctccgtatccttacccgctaagaagggaggaatcggtcatggtggcttgcggatcgagtgcatccgtattggtggtgttgagattccaaaccacaagagggtggagtactcactgcagtacatccatggcattgggcggtcacgctcacgtcagatcctcttggacctcaatttcgataacaagatcaccaaggacctctctgaggaggaggtcatcaccctccgtaaggaggttggcaagtacatgattgagggagaccttaaacgtttcaaccgtgtggcgattgagaggttgaaggagattaggtgctacaagggcatccggcacaagcttggacttccagttcgcggccagaggacaaagaacaactgccggacactcaagggaaagagggcttcagttgccaagaagaagtcacctgcctcccaggatgaataa

SEQ ID NO: 3970 - protein, 170 aa, Sorghum bicolor
  misc_feature: Ceres ANNOT ID no. 6034114
  misc_feature (47)..(151): Pfam Id: Ribosomal_S13 Pfam Desc: Ribosomal protein S13/S18
  misc_feature (6)..(163): NCBI GI: 1107483 NCBI Desc: 30s ribosomal protein s13 [arabidopsis thaliana]
  misc_feature (41)..(163): NCBI GI: 7573457 NCBI Desc: ribosomal protein precursor-like [arabidopsis thaliana]
  misc_feature (47)..(163): NCBI GI: 76587160 NCBI Desc: ribosomal protein s13 [thermoanaerobacter ethanolicus atcc 33223]
  misc_feature (47)..(163): NCBI GI: 114845405 NCBI Desc: ribosomal protein s13 [thermoanaerobacter ethanolicus x514]
  misc_feature (47)..(163): NCBI GI: 32363349 NCBI Desc: 30s ribosomal protein s13
MATLSMVSVPVAPSSLSLSTRGRTSSVSLPAKKGGIGHGGLRIECIRIGGVEIPNHKRVEYSLQYIHGIGRSRSRQILLDLNFDNKITKDLSEEEVITLRKEVGKYMIEGDLKRFNRVAIERLKEIRCYKGIRHKLGLPVRGQRTKNNCRTLKGKRASVAKKKSPASQDE

SEQ ID NO: 3971 - DNA, 807 bp, Sorghum bicolor
  misc_feature: Ceres ANNOT ID no. 6034115
  misc_feature: Encodes the peptide sequence at SEQ ID NO 3972
atggcgcccgcctcgctcccgctctccgtctcgtgcgcgcccggatcctcgtgcccgctggccgtcaccagccccggctccagcgtcgccgccgcctcgtcctcccaacttcccgcgtcgtcgcggagcagcgagcgcaggagagtgccaggcctcgcactccccgcggcaccgggtgtcggcggtaggaagggcggcggcaggtggagagcaggcatatcgtccttctcctccttcctgccgccgttcttcacagggaataagggggagaaggacgctgagaaggcggcgaggctcaaggaggagctcctcgacgccatcgcgccgctggagcgtggcgccgaggccacgcccgaggacaaggagcgcgtcgagcagattgttcagcagctggaggcggtgaaccaggtgaaggagccgctcaagtccgatctcctcaacggcaaatgggagcttctctataccacctccacaagtatactgcaaccacagagaccaaagtatctgaggccgtttgggaaaatttaccaagcaatcaacgccgacactttgagagcccaaaatatggaaacgtatccttactttaatcaggttactgccaacttggttcctctgaatgctagaagagtggcagttaaatttgattacttcaagatatttagtttgataccgatcaaagcacccggaagtggtaaaggtgaacttgaaattacttatcttgatgaagagctcagggtttcgagaggcgacaagggaaacttgttcgtactgaagatggtcgacccaacatacagggttccattataa

SEQ ID NO: 3972 - protein, 268 aa, Sorghum bicolor
  misc_feature: Ceres ANNOT ID no. 6034115
  misc_feature (97)..(258): Pfam Id: PAP_fibrillin Pfam Desc: PAP_fibrillin
  misc_feature (68)..(268): NCBI GI: 92868144 NCBI Desc: pap fibrillin [medicago truncatula]
  misc_feature (68)..(268): NCBI GI: 92873786 NCBI Desc: pap fibrillin [medicago truncatula]
  misc_feature (51)..(268): NCBI GI: 58652088 NCBI Desc: at3g26080 [arabidopsis thaliana]
  misc_feature (100)..(215): NCBI GI: 22297962 NCBI Desc: fibrillin [thermosynechococcus elongatus bp-1]
  misc_feature (100)..(215): NCBI GI: 16329838 NCBI Desc: fibrillin [synechocystis sp. pcc 6803]
MAPASLPLSVSCAPGSSCPLAVTSPGSSVAAASSSQLPASSRSSERRRVPGLALPAAPGVGGRKGGGRWRAGISSFSSFLPPFFTGNKGEKDAEKAARLKEELLDAIAPLERGAEATPEDKERVEQIVQQLEAVNQVKEPLKSDLLNGKWELLYTTSTSILQPQRPKYLRPFGKIYQAINADTLRAQNMETYPYFNQVTANLVPLNARRVAVKFDYFKIFSLIPIKAPGSGKGELEITYLDEELRVSRGDKGNLFVLKMVDPTYRVPL

SEQ ID NO: 3973 - DNA, 1449 bp, Sorghum bicolor
  misc_feature: Ceres ANNOT ID no. 6034116
  misc_feature: Encodes the peptide sequence at SEQ ID NO 3974
atggcgtcgtggttggagcagctgcagcgcgagcttgccggacgcggcctcgcagtcgcctccatccccggcaagggaaggggcctcatcgctacccgcaccttcttcccaggggatgtcattctcaatcaggaaccttacgcttctacgcctaacaagattttagttggatcgagctgtgatcattgtttcacctctggcaacctgaggaagtgctctatgtgtcaagttacttggtactgcagcaccaattgtcagaaagaagaatggaaactacatcagctcgagtgtagagcaatggcagcgcttacagaggatagaaagaagatgcttactcctacaattcggttaatggtgcggctggtactaaaaagaaaactacaaaatgagaaggtcattccatcctcaagtatagataactacaatctggttgatgccttggagtctcatatatggaaggttgatgaaaatcatcttgtgctctatgctcagatggccaatcttgtgagccttattcttcctttgattgagcttgaccttaaggaaattgcacacactttttctaagtttgcctgcaatgcgcataccatatgtgaccctgaacttaggcctcttgggactggactgtaccctgtcatatccattattaaccacagttgtgtaccaaatgcagtattgatatttgatggtcgtacagcatatgttcgtgcattgcagccaataggcaaaaatgaagaggtatctataagctacattgagactgcagcagtcaccaagaagagacacaatgatctgaagcagtacttcttcacctgctcatgtccacgttgtgtcaagggttctgaggaggatgctctacttgaggggttcaggtgcaagaaccaaacatgtgatggttttctcctgccagactcaggtaaaaaggcttatacatgccaaaaatgtagtgtttctagagacgaggaagagatacaaaagatgagaagcgaaatactacagttatcggataaagcatcttcatttctttcatcaggaaataaggctgaagcaggttctgtctacaagacaatcgaacaattagagcagaatctgtaccatgctttctcaaccactttgctgcacacgtgtgaaacactcctgaagatatatatggaattacaagattggcggactgcattggcatactgcagattgacagttcctgtttatgaaagagtttatccaccttttcatccgatgattggattgcaattctatacttgtggaaagcttgaatggttgcttgagtgcacagaggatgcactaaaatctttaaccagggcaacagatatacttaaagtaacacatggcacaaaatcccagttcatgaaggagctctttggcaagctagaggaagcaagagctgaagtttcttttaggatatcctccagacatggacatgatgagtaa

SEQ ID NO: 3974 - protein, 482 aa, Sorghum bicolor
  misc_feature: Ceres ANNOT ID no. 6034116
  misc_feature (60)..(97): Pfam Id: zf-MYND Pfam Desc: MYND finger
  misc_feature (151)..(476): NCBI GI: 115454843 NCBI Desc: os03g0704200 [oryza sativa (japonica cultivar-group)]
  misc_feature (5)..(478): NCBI GI: 30680137 NCBI Desc: zinc finger (mynd type) family protein / set domain-containing protein [arabidopsis thaliana]
  misc_feature (16)..(288): NCBI GI: 68226703 NCBI Desc: set and mynd domain containing 2 [homo sapiens]
  misc_feature (8)..(288): NCBI GI: 30840984 NCBI Desc: set and mynd domain containing 2 [mus musculus]
  misc_feature (16)..(288): NCBI GI: 55666049 NCBI Desc: otthump00000061067 [homo sapiens]
  misc_feature (5)..(478): SWISSPROT Homolog: EC 2.1.1.43 Histone-lysine N-methyltransferase ASHR1
MASWLEQLQRELAGRGLAVASIPGKGRGLIATRTFFPGDVILNQEPYASTPNKILVGSSCDHCFTSGNLRKCSMCQVTWYCSTNCQKEEWKLHQLECRAMAALTEDRKKMLTPTIRLMVRLVLKRKLQNEKVIPSSSIDNYNLVDALESHIWKVDENHLVLYAQMANLVSLILPLIELDLKEIAHTFSKFACNAHTICDPELRPLGTGLYPVISIINHSCVPNAVLIFDGRTAYVRALQPIGKNEEVSISYIETAAVTKKRHNDLKQYFFTCSCPRCVKGSEEDALLEGFRCKNQTCDGFLLPDSGKKAYTCQKCSVSRDEEEIQKMRSEILQLSDKASSFLSSGNKAEAGSVYKTIEQLEQNLYHAFSTTLLHTCETLLKIYMELQDWRTALAYCRLTVPVYERVYPPFHPMIGLQFYTCGKLEWLLECTEDALKSLTRATDILKVTHGTKSQFMKELFGKLEEARAEVSFRISSRHGHDE

SEQ ID NO: 3975 - DNA, 2409 bp, Sorghum bicolor
  misc_feature: Ceres ANNOT ID no. 6034119
  misc_feature: Encodes the peptide sequence at SEQ ID NO 3976
atgcacccattctgctgcgcgccgctcgtgcccgtatcgcccgcggcctctgccgcctccgccggggccgcgtcctccgcggtggcgggcgccccggccatgatgccgccaccgcagcccccgccggtgccgcctccgccggctcgaagcaactctgcccccatcggtgagaggcgcgcgcgcgcggcgggggtcagcggtggcggcggaggaggcggtacctcgccgcccgagggggtgaagctgaacgagatcgtcggcggcggcatctcgggaatcctgtacaagtgggtcaactacgggcgcgggtggaggccgcgctggttcgctctccacgacggcgtgctctcctactacaagatccacgggcctgaccgcatcatcctatcgcgcgagaccgagcggggcgctaaggtcatcggcgaggactccctccgccgcctcaaccgcacctccgcatcctcgccgtcccactccaacggccaccaccaccctcgaaaacccatcggcgaaatccacctcaaggtgtcaaccgtgagggagagcagatcggatgacaagagattctccatcttctcggggacgaagacgttgcacctgcgagcggagacccgggaggacagagctgcgtggcttgaggcgctgcgagcgaccaaggacatgttcccgaggatgtcctccagcgagatggtcggacctggggacaccgcagcggcagtggccgtctcaaccgagcgcctaaggcagcggttgcagcaggaaggggtcagcgaggcggccattgctgacagcgagaggatcgtgcgagcagaatttgaggctctgcacaagcagcttgtgctatccaagcagaagaatgcgctcctcgtggaaactcttcgccagctagagacagaaaaggttgatttggagaatacccttgtcgatgagagccaaaggcagtcgaaagagtatggatctgcttctaaaccaaggcatgagaagtatagtgaaggaagtgctagcgaatctgatgattataatgaaccacatgatcctgctgaagagactgacgatgatgagaacctttattttgatacaagagattttctatcctcaagctcttttaaaagtagtggatctgattaccaaagatctgaagctggttcagatgatgaagatgattatccaatggatgggattgatccttccatgaagtctattggaattagttatccatatgtaagaagacggaagaagctgccagatccagttgagaaagaaaagggtgtaagtttgtggtcaatgatcaaggacaacataggaaaggatcttacaaaagtttgtctgcctgtttacttcaatgagccactctcatcgttacaaaaatgttttgaagatcttgaatattcctaccttattgatcgggcatctgaatgggggaaaagggggaatagtcttatgaggattcttagcgtagcagcatttgctgtttctggatatgcctcgacagatgggaggagctgtaagccttttaatccccttcttggggagacatatgaagcagactatccagacaaaggcctccgttttttctctgaaaaggttagtcatcaccctatggttgttgcatgccactgtgagggaactggctggaggttttgggctgatagcaacctaaagagtaaattctggggtcgttccattcaactcgatcctgttggtgcattaacactggagtttgatgatggtgaagttttccaatggagcaaggtgacaacttcaatttacaatctcatattgggcaagctatattgcgatcactatggtactatgcgcatacaaggtaatcgcgagtattcatgtaagcttaagttcaaggagcagtcaattatagatcgcaaccctcaccaggtgcaaggtgttgttcaagatagaaatggtcgaactgttgctaccctatttggaaaatgggatgaaagcatgcactatgtaatgggtgattgttttgggaaaggcaaaggaactgaacagttttcagaggctcatttgttgtggaaaagaagcaaaccacctaagtttcccactagatacaatctcactcgctttgcaattacattgaatgaacttacccctggattgaaggaaaaacttccaccaacagactcaagattacgaccagaccagagatgtttggagaatggtgaatatgaaagggcaaatgctgagaagttgaggcttgaacagagacagcggcaggcacgaaagatgcaggagagcggatggaagcctcggtggtttgcaaaggataaagatactgacacataccgttacctcggtgggtactgggaatccagagaaaagagcagctgggaaggctgccccgacatcttcggacaagtccctaacgatctgatgataactgactag

SEQ ID NO: 3976 - protein, 802 aa, Sorghum bicolor
  misc_feature: Ceres ANNOT ID no. 6034119
  misc_feature (378)..(781): Pfam Id: Oxysterol_BP Pfam Desc: Oxysterol-binding protein
  misc_feature (88)..(220): Pfam Id: PH Pfam Desc: PH domain
  misc_feature (76)..(797): NCBI GI: 22654958 NCBI Desc: at4g08180/t12g13_20 [arabidopsis thaliana]
  misc_feature (76)..(797): NCBI GI: 42570131 NCBI Desc: oxysterol-binding family protein [arabidopsis thaliana]
  misc_feature (76)..(797): NCBI GI: 42572843 NCBI Desc: oxysterol-binding family protein [arabidopsis thaliana]
  misc_feature (17)..(797): NCBI GI: 78440948 NCBI Desc: oxysterol-binding related protein 1 [petunia integrifolia]
  misc_feature (87)..(791): NCBI GI: 18087546 NCBI Desc: at1g13170/f3f19_19 [arabidopsis thaliana]
MHPFCCAPLVPVSPAASAASAGAASSAVAGAPAMMPPPQPPPVPPPPARSNSAPIGERRARAAGVSGGGGGGGTSPPEGVKLNEIVGGGISGILYKWVNYGRGWRPRWFALHDGVLSYYKIHGPDRIILSRETERGAKVIGEDSLRRLNRTSASSPSHSNGHHHPRKPIGEIHLKVSTVRESRSDDKRFSIFSGTKTLHLRAETREDRAAWLEALRATKDMFPRMSSSEMVGPGDTAAAVAVSTERLRQRLQQEGVSEAAIADSERIVRAEFEALHKQLVLSKQKNALLVETLRQLETEKVDLENTLVDESQRQSKEYGSASKPRHEKYSEGSASESDDYNEPHDPAEETDDDENLYFDTRDFLSSSSFKSSGSDYQRSEAGSDDEDDYPMDGIDPSMKSIGISYPYVRRRKKLPDPVEKEKGVSLWSMIKDNIGKDLTKVCLPVYFNEPLSSLQKCFEDLEYSYLIDRASEWGKRGNSLMRILSVAAFAVSGYASTDGRSCKPFNPLLGETYEADYPDKGLRFFSEKVSHHPMVVACHCEGTGWRFWADSNLKSKFWGRSIQLDPVGALTLEFDDGEVFQWSKVTTSIYNLILGKLYCDHYGTMRIQGNREYSCKLKFKEQSIIDRNPHQVQGVVQDRNGRTVATLFGKWDESMHYVMGDCFGKGKGTEQFSEAHLLWKRSKPPKFPTRYNLTRFAITLNELTPGLKEKLPPTDSRLRPDQRCLENGEYERANAEKLRLEQRQRQARKMQESGWKPRWFAKDKDTDTYRYLGGYWESREKSSWEGCPDIFGQVPNDLMITD

SEQ ID NO: 3977 - DNA, 2178 bp, Sorghum bicolor
  misc_feature: Ceres ANNOT ID no. 6034123
  misc_feature: Encodes the peptide sequence at SEQ ID NO 3978
  misc_feature: Down-regulated in shoot tissues in response to aminocyclopropane carboxylic treatment
  misc_feature: Down-regulated in shoot tissues in response to methyl jasmonate treatment
atgaggcgggtggcgccggcgatgatcgccgccggcagcgctggcggcgaggagacggcggaaggtgcggtggtggagaagacgctgctcaacggcgacgtctaccgcggcgggttctccggcggctcgccgcacggcaagggcaagtacgtgtgggcggacggctgcatgtacgagggggagtggcggcggggcaaggcgtccgggaagggccgcttctcgtggccgtcgggcgccacgttcgagggggagttccgcagcggacggatcgaggggcagggcgtcttcgtcggccccgacggcgcaacctaccgcggcgcgtgggtggcggaccggcgccacggcgtgggcgcaaagagctacgccaacggggactactacgagggccagtggcgccgcaacttccaggacggccacgggcgctacgtctgggccaacggcaaccagtacgtcggggagtggcgcgccggggtgctctccggccgcggcgtgctgatctgggccaatggcagccgctacgacggggtctgggagaacggcgtccccagggggacaggcgtcttcacgtggcccgacggcagccggtacgtcggctcctggcctgggagctgcgtcgacctgccggctataagcggcacgttcttcgcgccagtcggcgctggggctactggtcttgtgaggaagaggtcctccgtggagggtgtgggggagaaggctaccccgcggatctgcatctgggagtcggagggcgaggccggagacatcacctgcgacatcgttgacgcgctcgaggcgtccgtgctctacaaggaggccgccgctgtcgccgggggaccaacgtacatgcggaaactaccgcagaggaatacccggcgagcagccagcggaatcccacgctgggcttcgtcggcggccaccacgccggagagtaagcgacccgggcagacgatctccaagggacacaagaactacgagctcatgctgcagctgcaactgggtatcaggcattccgtgggaaagtcttccgctgttccgatgcgagcactggaacagggcgattttgacccaggggagaagttctggacacggttcccaccagagggttcgaaggtcacactaccacattcaactgcagagttccggtggaaggactactgccccatggtgttcaggcatttgaggaagttgtttgctgttgatacagcggattacatgcttgcgatctgtggcaatgatgctctgagggagctgtcttcacccggaaagagtgggagcttcttttaccttacccaagatgaccggttcatgattaagactgtgaagaaatcagaagtcaagctgctaattcgaatgttaaatagctactacaaacatgtcaatcgatacaagaactcgttaatcacgagattctatggtgtacactgtgtgaagccccttaacggacaaaaggtccgattcattgtcatgggtaatctgttctgttcagaataccagattcatcgccgttttgatttgaaaggttcatcctatggacgaacagcagacaagtttgaagatgagattgatgagacaactacactgaaggacttggacctcaattttgtcttccggttgcagcgatcttggtacaccgatctccatgaacaactgagacgagactgcgattttttggaatcggaagggattatggattacagtttcttagtaggagttcacttttgtgatgacatctctgcctcaaagatgggatcgtctacttttactgcttctccaaagcttttaacaaagagtgagtcatttcaaggttgtggcacgccagagctctgcttctcggatgatgactttgatatcattcctgattgccgtcggaaacctttgattagactgggtgcacacatgccagccagggcagagcaagcatccagaaggagtgaatttgatccgcttctccttaccggcgggggattcctattcccaaaccagaccggtgaagtacacgacgtgattctctttttcgggataattgacatcctccaggattacagctttagaaagtgggctgagcatacttacaagtcgttacagacagatcccaactcgatctctgccgtggacccaaagctctactcgaagaggtttcaagacttcatcggcagaatttttgtggaagatggctaa

SEQ ID NO: 3978 - protein, 725 aa, Sorghum bicolor
  misc_feature: Ceres ANNOT ID no. 6034123
  misc_feature (406)..(721): Pfam Id: PIP5K Pfam Desc: Phosphatidylinositol-4-phosphate 5-Kinase
  misc_feature (35)..(57): Pfam Id: MORN Pfam Desc: MORN repeat
  misc_feature (58)..(80): Pfam Id: MORN Pfam Desc: MORN repeat
  misc_feature (81)..(103): Pfam Id: MORN Pfam Desc: MORN repeat
  misc_feature (104)..(126): Pfam Id: MORN Pfam Desc: MORN repeat
  misc_feature (127)..(149): Pfam Id: MORN Pfam Desc: MORN repeat
  misc_feature (150)..(172): Pfam Id: MORN Pfam Desc: MORN repeat
  misc_feature (173)..(195): Pfam Id: MORN Pfam Desc: MORN repeat
  misc_feature (46)..(656): NCBI GI: 3702691 NCBI Desc: atpip5k1 [arabidopsis thaliana]
  misc_feature (309)..(651): NCBI GI: 87162536 NCBI Desc: phosphatidylinositol-4-phosphate 5-kinase [medicago truncatula]
  misc_feature (54)..(585): NCBI GI: 140065036 NCBI Desc: phosphatidylinositol-4-phosphate 5-kinase [medicago truncatula]
  misc_feature (31)..(724): NCBI GI: 33354203 NCBI Desc: phosphatidylinositol-4-phosphate 5-kinase-like protein [oryza sativa (japonica cultivar-group)]
  misc_feature (278)..(573): NCBI GI: 73621405 NCBI Desc: phosphatidylinositol-4-phosphate 5-kinase 1 precursor (1-phosphatidylinositol-4-phosphate kinase) (pip5k) (ptdins(4)p-5-kinase) (diphosphoinositide kinase)
  misc_feature (25)..(665): SWISSPROT Homolog: EC 2.7.1.68 Phosphatidylinositol-4-phosphate 5-kinase 2
  misc_feature: Down-regulated in shoot tissues in response to aminocyclopropane carboxylic treatment
  misc_feature: Down-regulated in shoot tissues in response to methyl jasmonate treatment
MRRVAPAMIAAGSAGGEETAEGAVVEKTLLNGDVYRGGFSGGSPHGKGKYVWADGCMYEGEWRRGKASGKGRFSWPSGATFEGEFRSGRIEGQGVFVGPDGATYRGAWVADRRHGVGAKSYANGDYYEGQWRRNFQDGHGRYVWANGNQYVGEWRAGVLSGRGVLIWANGSRYDGVWENGVPRGTGVFTWPDGSRYVGSWPGSCVDLPAISGTFFAPVGAGATGLVRKRSSVEGVGEKATPRICIWESEGEAGDITCDIVDALEASVLYKEAAAVAGGPTYMRKLPQRNTRRAASGIPRWASSAATTPESKRPGQTISKGHKNYELMLQLQLGIRHSVGKSSAVPMRALEQGDFDPGEKFWTRFPPEGSKVTLPHSTAEFRWKDYCPMVFRHLRKLFAVDTADYMLAICGNDALRELSSPGKSGSFFYLTQDDRFMIKTVKKSEVKLLIRMLNSYYKHVNRYKNSLITRFYGVHCVKPLNGQKVRFIVMGNLFCSEYQIHRRFDLKGSSYGRTADKFEDEIDETTTLKDLDLNFVFRLQRSWYTDLHEQLRRDCDFLESEGIMDYSFLVGVHFCDDISASKMGSSTFTASPKLLTKSESFQGCGTPELCFSDDDFDIIPDCRRKPLIRLGAHMPARAEQASRRSEFDPLLLTGGGFLFPNQTGEVHDVILFFGIIDILQDYSFRKWAEHTYKSLQTDPNSISAVDPKLYSKRFQDFIGRIFVEDG

SEQ ID NO: 3979 - DNA, 1422 bp, Sorghum bicolor
  misc_feature: Ceres ANNOT ID no. 6034145
  misc_feature: Encodes the peptide sequence at SEQ ID NO 3980
  misc_feature: Up-regulated in root tissues in response to aminocyclopropane carboxylic treatment
  misc_feature: Up-regulated in shoot tissues in response to salicylic acid treatment
atgcagcggcggcgggcccacacgtgggcgggggtggggaagacggcgcaggcggcggcggcgcacgccgcgctcttctgcttcactctcctcctcgcgctcatggtcgacggacgcaccacgtactcctggtggataatattcattccactatggctctttcatggaattgttgcacgcggaaggttttcaatgcctgccccttcattgcctcatggccgtcattgggcaccctgtcattcgattgttgcagcacctttactaattgcgttcgagctgcttctttgcatatatcttgaaagcataagagttagaaatcatccgtctgttgatctgaagatcgtgttccttcctttgttggcctttgaagcaattatccttattgacaattttagaatgtgtagagctttaatgcctggagatgaagaaagcatgagtgatgaagctatttgggagacacttcctcatttttgggttgcaatttcaatggtgtttcttatagctgctacaacattcacccttctcaagctgtctggcgatgttggtgctttgggatggtgggatttgtttataaattatgggattgcggaatgctttgcatttcttgtctgtacaagatggtttaatcccatgattcataagtctcccactcatggggaggctagctcatcatcagcggcaattagataccgtgattgggaaagtggtcttgtcctcccatcactagaagatcacgaacaagagaggctttgtggtctccctgatattgggggccatgtaatgaaaatacctcttgtggctttccaagtattgctttgtatgcggttggagggcacaccagcaagcgctcgctacatcccaatatttgctcttttctcgccactatttattctgcaaggtgctggtgtccttttctctctagcaagattagtggagaaggttgttctgctattgcgtaatgggccagttagtcctaattaccttacagcctcatcaaaagttcgcgattgctttgcttttcttcatcgtggttcaaggcttcttggttggtggtctattgatgaagggagcaaggaagaacaggcccggttgttttatactgaatctactgggtacaatacattttgtggctatccaccagaggtggttaggaaaatgcctaaaaaggacctcgcagaagaggtttggaggctacaggcagcgttgggagaacaatctgaaattaccaagtgtaccaaacaggaatacgaaagacttcaaaatgagaaggttctttgtaggatttgctacgagggagagatatgcatggtgctacttccctgccggcacagaactttatgcaagtcttgcgctgagaaatgcaagaagtgtccaatctgccgtgtgccaattgaagagcgcatgcctgtatatgatgtttaa

SEQ ID NO: 3980 - protein, 473 aa, Sorghum bicolor
  misc_feature: Ceres ANNOT ID no. 6034145
  misc_feature (426)..(460): Pfam Id: zf-C3HC4 Pfam Desc: Zinc finger, C3HC4 type (RING finger)
  misc_feature (9)..(473): NCBI GI: 22330616 NCBI Desc: zinc finger (c3hc4-type ring finger) family protein [arabidopsis thaliana]
  misc_feature (189)..(473): NCBI GI: 140058201 NCBI Desc: zinc finger, ring-type [medicago truncatula]
  misc_feature (156)..(473): NCBI GI: 6714286 NCBI Desc: f15h18.5 [arabidopsis thaliana]
  misc_feature (372)..(472): NCBI GI: 115479109 NCBI Desc: os09g0410400 [oryza sativa (japonica cultivar-group)]
  misc_feature (405)..(471): NCBI GI: 47680378 NCBI Desc: x-linked inhibitor of apotosis protein [canis familiaris]
  misc_feature: Up-regulated in root tissues in response to aminocyclopropane carboxylic treatment
  misc_feature: Up-regulated in shoot tissues in response to salicylic acid treatment
MQRRRAHTWAGVGKTAQAAAAHAALFCFTLLLALMVDGRTTYSWWIIFIPLWLFHGIVARGRFSMPAPSLPHGRHWAPCHSIVAAPLLIAFELLLCIYLESIRVRNHPSVDLKIVFLPLLAFEAIILIDNFRMCRALMPGDEESMSDEAIWETLPHFWVAISMVFLIAATTFTLLKLSGDVGALGWWDLFINYGIAECFAFLVCTRWFNPMIHKSPTHGEASSSSAAIRYRDWESGLVLPSLEDHEQERLCGLPDIGGHVMKIPLVAFQVLLCMRLEGTPASARYIPIFALFSPLFILQGAGVLFSLARLVEKVVLLLRNGPVSPNYLTASSKVRDCFAFLHRGSRLLGWWSIDEGSKEEQARLFYTESTGYNTFCGYPPEVVRKMPKKDLAEEVWRLQAALGEQSEITKCTKQEYERLQNEKVLCRICYEGEICMVLLPCRHRTLCKSCAEKCKKCPICRVPIEERMPVYDV

SEQ ID NO: 3981 - DNA, 849 bp, Sorghum bicolor
  misc_feature: Ceres ANNOT ID no. 6034156
  misc_feature: Encodes the peptide sequence at SEQ ID NO 3982
atgccgccagccagtagcctcagcgccgaccagctcagcttcttcgaggccaatggttacctcgtgatggactcgttctcgagcgcggaggaggtgcgggagatgcgggaccgcatggccgagcttgtagctgggttcgatggcgccaactccgccgtcttctccaccaaggatcatcgccagttgaaggatgattacttctttaaaagtgcagagaatatctctttcttctttgaggaaaaggcgtttggagatgatggatgcttgaaacagccaaaagaactttcaattaataaagttgggcatgcattacatgaacttgatcccgtgttcaaaaagttttctttctcggagagtgttgcaagcttgttctcttctttaggctacaagaggcctgcagtcattcaatctatgtacatctttaagcaaccaggtattggtggtgaggtggtgccgcaccaggataatacattcctttacacggaacctcgaacatgcacagggttgtggcttgcacttgaagatgcaacaatgaacaatggttgcctgtgggcaattccaggatcacataaaaagggtttggtgaggcgtatgatcagagatgaaaatggtacacattttgatcggccctccccagcctatgatcagaaagaatttgtgcccctggaagtaaaatctggtgatttggtagttatacatggagatcttatacatcagagttttgagaacctttctccagcgtcaagacatgcattgagcttacatgtagttgatactgaaggatgtgaatggtccaaagacaactggatacagaggaaaacggcccctgagccgctttatgtgtcttag

SEQ ID NO: 3982 - protein, 282 aa, Sorghum bicolor
  misc_feature: Ceres ANNOT ID no. 6034156
  misc_feature (13)..(251): Pfam Id: PhyH Pfam Desc: Phytanoyl-CoA dioxygenase (PhyH)
  misc_feature (15)..(278): NCBI GI: 115372127 NCBI Desc: phyhd1 protein [stigmatella aurantiaca dw4/3-1]
  misc_feature (145)..(280): NCBI GI: 115454869 NCBI Desc: os03g0708100 [oryza sativa (japonica cultivar-group)]
  misc_feature (7)..(280): NCBI GI: 25058918 NCBI Desc: lrrc8 protein [mus musculus]
  misc_feature (7)..(280): NCBI GI: 55249997 NCBI Desc: zgc:101639 [danio rerio]
  misc_feature (18)..(280): NCBI GI: 116128648 NCBI Desc: ensangp00000010487 [anopheles gambiae str. pest]
MPPASSLSADQLSFFEANGYLVMDSFSSAEEVREMRDRMAELVAGFDGANSAVFSTKDHRQLKDDYFFKSAENISFFFEEKAFGDDGCLKQPKELSINKVGHALHELDPVFKKFSFSESVASLFSSLGYKRPAVIQSMYIFKQPGIGGEVVPHQDNTFLYTEPRTCTGLWLALEDATMNNGCLWAIPGSHKKGLVRRMIRDENGTHFDRPSPAYDQKEFVPLEVKSGDLVVIHGDLIHQSFENLSPASRHALSLHVVDTEGCEWSKDNWIQRKTAPEPLYVS

SEQ ID NO: 3983 - DNA, 1155 bp, Sorghum bicolor
  misc_feature: Ceres ANNOT ID no. 6034157
  misc_feature: Encodes the peptide sequence at SEQ ID NO 3984
atggccgactgggcggggctccacgaggacctgctcgacctcgtcgtcgtgcgcctctcgtcgctcgacctcctccgcttccgcgccgtctgcggctcctggcgcaccgccacagctgccttcaccgcccgccgcggcttcccgcgccccgaccgcccctggctgctcctccccacggatgtcagcgccgacctcgccctcgaccgcggccgcctaatcgtgtgctccgaccgtgaggtctccgtgggcaccctcccagcgcgcctgggccgcgtgaacccgcgccagttcgttcccctcggctccgcgcgcggggcgatagtcgccgcggacgaccgtggcgagatgcatctgctcgacctcgtttccggcgcgcgcaagccgctcccagccgttgccacgctccccctcgtcgcccgcgtcgtgggcctccaggtccagcacctcggcggtggcgtcctcccaatcgacgccgtcatccagaaggccgtcccggtgcccacccccggcggcggcgtcatggtcctggccatctaccggcagctgaaccatcgcaaccagtgggctacggcgcggccgggcgaccacgcgtggaagtccgtggcgccgaccagcatcccctccgtggtcgacgtggtcgtccaccggggccagctctacgccaacacgaggtacgggatgatgtacgtcttcccagagctgtacgacctcaactccgccttccccgagatcatcccctccgtgacgcgccgcccgaacgcgtacgtggagcgcagcttcctggtggagtccccccgcggcgagctgatgcaggtggagctgcttcgccccgtgacggccgctggaggggaaggcttcgtggtgcgcgtgctggacgagtgcggggagacgtgggaggacacggaagacatcggcgacgccgccgtgctcgtggacgcggcgggcgccgtggccgcgtccaccagggtgtgccccgcgctgaggcccaacaccgtgtactatgccgtggacctggagggggagacgcgggtgtgggcgtacagcctcgcgggcaagcacaagcgcatcgaggtcgtggaggtgctgccgaccgccgacgggtacagggcgccgtgcttctggttcgcgccggtgtactcgcagcggcagccgtga

SEQ ID NO: 3984 - protein, 384 aa, Sorghum bicolor
  misc_feature: Ceres ANNOT ID no. 6034157
  misc_feature (1)..(132): NCBI GI: 115434942 NCBI Desc: os01g0183800 [oryza sativa (japonica cultivar-group)]
  misc_feature (118)..(370): NCBI GI: 90265108 NCBI Desc: h0806h05.3 [oryza sativa (indica cultivar-group)]
  misc_feature (167)..(348): NCBI GI: 38345646 NCBI Desc: osjnbb0028m18.9 [oryza sativa (japonica cultivar-group)]
  misc_feature (167)..(348): NCBI GI: 116317894 NCBI Desc: osigba0102o13.13 [oryza sativa (indica cultivar-group)]
  misc_feature (167)..(341): NCBI GI: 38345140 NCBI Desc: osjnbb0050n09.7 [oryza sativa (japonica cultivar-group)]
MADWAGLHEDLLDLVVVRLSSLDLLRFRAVCGSWRTATAAFTARRGFPRPDRPWLLLPTDVSADLALDRGRLIVCSDREVSVGTLPARLGRVNPRQFVPLGSARGAIVAADDRGEMHLLDLVSGARKPLPAVATLPLVARVVGLQVQHLGGGVLPIDAVIQKAVPVPTPGGGVMVLAIYRQLNHRNQWATARPGDHAWKSVAPTSIPSVVDVVVHRGQLYANTRYGMMYVFPELYDLNSAFPEIIPSVTRRPNAYVERSFLVESPRGELMQVELLRPVTAAGGEGFVVRVLDECGETWEDTEDIGDAAVLVDAAGAVAASTRVCPALRPNTVYYAVDLEGETRVWAYSLAGKHKRIEVVEVLPTADGYRAPCFWFAPVYSQRQP

SEQ ID NO: 3985 - DNA, 1581 bp, Sorghum bicolor
  misc_feature: Ceres ANNOT ID no. 6034166
  misc_feature: Encodes the peptide sequence at SEQ ID NO 3986
atgactgcctcctcctccaggctcctaaagctcactctgagctcctatttcctccgctcctgccgcatcgcttccagctccctactccccaccaccttccgcggccacccggggccgctccactccctccgcttctgctccgcggtccccgcggttgtcgatgtcgccgccgaccctgccgtggcggctgtatccgccggccacccgtggccggagtggggcgacttcctcgataagctgcgggccaaggggtacttcgagcaaggcgtgccctcctccggcgtgagttctggcgagggagccgccggagttagggatgctgcggttgcagctgcatctgaggacgcagcagcggctgcttccggtaacactgtggtggctgcggtggatagcgcggtgtccttggaagacatttatcgtttcagggacgagaacagggtgaagaatgcttgcctcaaatttgcgcgcgatcgcttcgatctcctcagctcgcttccgaagcaggatattcaagctattgtcaagtgtggctgtcctaataaaaatcggaagcccgtcaattctgcaaaaaggttgagagagtttgtgcaggtcaaagaagaagatgcatgcagcatttgcaaatttcgtgaatcctgtgataaagcttttatcactccagatgccgaggctgaagttaagactgttgatgttgttcgcatactgctaagttatgcaatggataaaaacctttcaggagaaaactcagttatcgaaagcgtgcaagaatctgcaaaaaagcttctctcaaagcttactgaacttagcgacacaaaaatcgacgagtctcttccgaaacctgcatctcaagctcctaggaaggctcagggctcagatgggaaggggagagaaacgacggcagttgaaatgaagaagggcgactggttgtgcactaactgtaacttcttaaattttgctcgcaatgttcgctgtcgtgaatgcaaagcagatggaccaaagaagatagaagtagccatggctgaaatgaaaatgggcgattggatctgcacacagtgtcagtttatgaacttctctcgcaacaatatttgttttaaatgtgaagaacctcgcccgaagaggcaactcaatcctggagagtgggagtgcccctcatgtgactatgttaacttccgacgcaacattttgtgcaagaagtgcaatcaggaccggcctgaggatgatacccaggatagtcagctgggattgagaaaaacgagaggggctggcaagagtagaagattcgactatattgatcagaagagtgacaatgattatgatgcctctccctatgaagggttccgcaagcgtggggcaaggttccgcaagcgtggggcaagcatgaggaaaccggaccagagaagaaccactgccaagagcagtggctttgacgatctggaggatggtctccttactgccaagagtagaagggctaaggaagacgaggatgacgaagtcttgccgtacgaaggtgtgcgcaagcatgttgtgagcagaagggcaacgccttctcagaggaggttcacggctgcccgtaaccagtaa

SEQ ID NO: 3986 - protein, 526 aa, Sorghum bicolor
  misc_feature: Ceres ANNOT ID no. 6034166
  misc_feature (304)..(333): Pfam Id: zf-RanBP Pfam Desc: Zn-finger in Ran binding protein and others
  misc_feature (343)..(372): Pfam Id: zf-RanBP Pfam Desc: Zn-finger in Ran binding protein and others
  misc_feature (134)..(452): NCBI GI: 18409643 NCBI Desc: zinc finger (ran-binding) family protein [arabidopsis thaliana]
  misc_feature (134)..(410): NCBI GI: 91176378 NCBI Desc: zinc finger, ranbp2-type [medicago truncatula]
  misc_feature (120)..(480): NCBI GI: 34393925 NCBI Desc: arp protein-like [oryza sativa (japonica cultivar-group)]
  misc_feature (142)..(371): NCBI GI: 92891175 NCBI Desc: zinc finger, ranbp2-type [medicago truncatula]
  misc_feature (141)..(372): NCBI GI: 37542393 NCBI Desc: znf_rbz domain protein [arabidopsis thaliana]
MTASSSRLLKLTLSSYFLRSCRIASSSLLPTTFRGHPGPLHSLRFCSAVPAVVDVAADPAVAAVSAGHPWPEWGDFLDKLRAKGYFEQGVPSSGVSSGEGAAGVRDAAVAAASEDAAAAASGNTVVAAVDSAVSLEDIYRFRDENRVKNACLKFARDRFDLLSSLPKQDIQAIVKCGCPNKNRKPVNSAKRLREFVQVKEEDACSICKFRESCDKAFITPDAEAEVKTVDVVRILLSYAMDKNLSGENSVIESVQESAKKLLSKLTELSDTKIDESLPKPASQAPRKAQGSDGKGRETTAVEMKKGDWLCTNCNFLNFARNVRCRECKADGPKKIEVAMAEMKMGDWICTQCQFMNFSRNNICFKCEEPRPKRQLNPGEWECPSCDYVNFRRNILCKKCNQDRPEDDTQDSQLGLRKTRGAGKSRRFDYIDQKSDNDYDASPYEGFRKRGARFRKRGASMRKPDQRRTTAKSSGFDDLEDGLLTAKSRRAKEDEDDEVLPYEGVRKHVVSRRATPSQRRFTAARNQ

SEQ ID NO: 3987 - DNA, 1107 bp, Sorghum bicolor
  misc_feature: Ceres ANNOT ID no. 6034170
  misc_feature: Encodes the peptide sequence at SEQ ID NO 3988
atgaataagcggccccgcgacgaccactcctccttcgcctccgcgcccaagcgccagtacggcgcaggcggagggtatggcgcgcagcaggggtactcggaggagcggaacagcgcgcggcgggtggccgaccactacagcgcgaggtccaaccagacgctcgaggaacgcgagaacagccccatcatccacctcaagaagcttaacaactggatcaagagtgttttaatccagctgtatgcacgcccgggcgactgtgttcttgatcttgcttgcgggaagggaggtgatttgataaagtgggataaagccaaggttggctactatgtaggagttgatattgctgaaggctcgataaaagattgcatgactcgctataatggtgacacagatcaacaaagaaggaaaaagttcagtttccctgcacggcttatttgtactgattgctatgaggctcgtctggatgaatatttatatgaggatgctccatttgatatatgtagctgtcagttcgctttacattattcatggtcaactgaagcacgcgctagacaagccttggcaaatgtgtctgcattacttcgtcctggaggcatttttattgggacaatgcctgatgccaatgtcattatcaaaaggcttcgagaatctgaagggttggaatttggaaacagtgtttactggattagctttggtgaggagtatgctgaaaagaaattccctgcatccagaccctttggtatcaagtacaagtttcacttagaggatgctgttgattgcccagaatgggttgttccattccatctcttcaaattattggcagaggagtatgatctcgagctggttctgatgaagaacttccatgaatttgtacacgagtacctgcaaaaaccagagtttaccgagctgatgcgtaggcttggtgcccttggtgatggaaggcaggaccaaagtacactgtcacaagatgagtgggaggtttcctatctctatcttgcatttgtcctgcggaagcgagggcaaccgcctgcccaacgaagagccaacaacgcaaacagagggaagatgttcctcaccgagggtgacatcgaggttctcgggatataa

SEQ ID NO: 3988 - protein, 368 aa, Sorghum bicolor
  misc_feature: Ceres ANNOT ID no. 6034170
  misc_feature (29)..(340): Pfam Id: Pox_MCEL Pfam Desc: mRNA capping enzyme
  misc_feature (88)..(202): Pfam Id: Methyltransf_11 Pfam Desc: Methyltransferase domain
  misc_feature (88)..(200): Pfam Id: Methyltransf_12 Pfam Desc: Methyltransferase domain
  misc_feature (1)..(368): NCBI GI: 75134719 NCBI Desc: mrna cap guanine-n7 methyltransferase (mrna (guanine-n(7)-)-methyltransferase) (mrna cap methyltransferase)
  misc_feature (7)..(363): NCBI GI: 42572501 NCBI Desc: mrna capping enzyme family protein [arabidopsis thaliana]
  misc_feature (17)..(340): NCBI GI: 19075210 NCBI Desc: mrna cap methyltransferase [schizosaccharomyces pombe]
  misc_feature (17)..(340): NCBI GI: 3646451 NCBI Desc: spcc330.10 [schizosaccharomyces pombe]
  misc_feature (33)..(310): NCBI GI: 141796089 NCBI Desc: similar to rna (guanine-7-) methyltransferase [danio rerio]
  misc_feature (1)..(368): SWISSPROT Homolog: EC 2.1.1.56 mRNA cap guanine-N7 methyltransferase 1
MNKRPRDDHSSFASAPKRQYGAGGGYGAQQGYSEERNSARRVADHYSARSNQTLEERENSPIIHLKKLNNWIKSVLIQLYARPGDCVLDLACGKGGDLIKWDKAKVGYYVGVDIAEGSIKDCMTRYNGDTDQQRRKKFSFPARLICTDCYEARLDEYLYEDAPFDICSCQFALHYSWSTEARARQALANVSALLRPGGIFIGTMPDANVIIKRLRESEGLEFGNSVYWISFGEEYAEKKFPASRPFGIKYKFHLEDAVDCPEWVVPFHLFKLLAEEYDLELVLMKNFHEFVHEYLQKPEFTELMRRLGALGDGRQDQSTLSQDEWEVSYLYLAFVLRKRGQPPAQRRANNANRGKMFLTEGDIEVLGI

SEQ ID NO: 3989 - DNA, 684 bp, Sorghum bicolor
  misc_feature: Ceres ANNOT ID no. 6034176
  misc_feature: Encodes the peptide sequence at SEQ ID NO 3990
atgccgcctaaatccgatagcgttgaaggaatcgtcctgggtttcgtcaatgagcaaaacaggccattgaattcacagaatgcagctgatgcactacagaagtttaatcttaagaagactgcagtacaaaaggcactggatgcattggctgacagtggacagatttccttcaaggagtatggcaagcagaaaatttacattgctcggcaagatcaatttgagattccaaatggtgaagaacttgaggagatgaagaaaagaaatgccaagttacaggaagaactcgcggatcaaaagaaagcaattagtgaggttgaatctgaggtacgaggtctgcagtcaaacttgacgctggcagagattacgtcaaaggagactaaattacaaagcgaagtccaggaaatggaagagaaactaaataaattgcggagtggtgttaccttggtgaaacctgaagacaggaagatcattgagaattcctttgctgagaaagttaaccaatggaaaaagcggaagaggatgttcaaggagctttgggataatattactgagaatagcccaaaggatcagaaggaatttaaggaagaacttggtctcgagtatgacgaagatgttgatgtgaacctgcagtcttactctgatatgctagcaagtctaaacaaaaggcgaaaaatttcccgctga

SEQ ID NO: 3990 - protein, 227 aa, Sorghum bicolor
  misc_feature: Ceres ANNOT ID no. 6034176
  misc_feature (7)..(176): Pfam Id: TBPIP Pfam Desc: Tat binding protein 1(TBP-1)-interacting protein (TBPIP)
  misc_feature (1)..(209): NCBI GI: 50344904 NCBI Desc: zgc:86785 [danio rerio]
  misc_feature (10)..(209): NCBI GI: 16506273 NCBI Desc: nuclear receptor coactivator gt198 [rattus norvegicus]
  misc_feature (10)..(209): NCBI GI: 77628027 NCBI Desc: proteasome (prosome, macropain) 26s subunit, atpase 3, interacting protein [rattus norvegicus]
  misc_feature (10)..(209): NCBI GI: 25092696 NCBI Desc: proteasome (prosome, macropain) 26s subunit, atpase 3, interacting protein [mus musculus]
  misc_feature (10)..(209): NCBI GI: 7706577 NCBI Desc: tbp-1 interacting protein [homo sapiens]
MPPKSDSVEGIVLGFVNEQNRPLNSQNAADALQKFNLKKTAVQKALDALADSGQISFKEYGKQKIYIARQDQFEIPNGEELEEMKKRNAKLQEELADQKKAISEVESEVRGLQSNLTLAEITSKETKLQSEVQEMEEKLNKLRSGVTLVKPEDRKIIENSFAEKVNQWKKRKRMFKELWDNITENSPKDQKEFKEELGLEYDEDVDVNLQSYSDMLASLNKRRKISR

SEQ ID NO: 3991 - DNA, 648 bp, Sorghum bicolor
  misc_feature: Ceres ANNOT ID no. 6034177
  misc_feature: Encodes the peptide sequence at SEQ ID NO 3992
atggcaactgctcctgtgacatcctccgctaccgcgaactctgcttgcatgcggttgcctagcatgcccctgaggcttgcaccggccaccatctccttcccctctcgttcatggtcagccgcactaacctcatgcactggattgttgcggcgctctgacgtggttgccgccgcagggcaccagaagttgatgggatctttgaccagcaacgagggcctcaggtttggggtggttgtggcacggttcaacgaggttgtgacaaacttgttactgcagggtgcccttgaaacttttgagcgatactctgttaaagcagaaaatataacagttgttattgttcctggaagctttgaagttcctataacagcacaaaagcttgggaaatctggaaaatttgatgcgattctgtgcattggagctgtgattagaggtgacacaacccattatgatgctgttgcaaactcagctgcatcaggtgtactcaatgctggattatctgctggtgttccttgtgtatttggtgttctaacgtgtgaagacatggatcaggcgctaaaccgtgctggtggcaaggctggaaacaagggtgctgaagctgctcttactgccattgagatggcctctctgttccggcatcacttaggctga

SEQ ID NO: 3992 - protein, 215 aa, Sorghum bicolor
  misc_feature: Ceres ANNOT ID no. 6034177
  misc_feature (70)..(213): Pfam Id: DMRL_synthase Pfam Desc: 6,7-dimethyl-8-ribityllumazine synthase
  misc_feature (2)..(214): NCBI GI: 38345388 NCBI Desc: osjnba0067k08.17 [oryza sativa (japonica cultivar-group)]
  misc_feature (4)..(214): NCBI GI: 5532606 NCBI Desc: 6,7-dimethyl-8-ribityllumazine synthase precursor [spinacia oleracea]
  misc_feature (21)..(214): NCBI GI: 33312438 NCBI Desc: 6,7-dimethyl-8-ribityllumazine synthase precursor [nicotiana tabacum]
  misc_feature (21)..(214): NCBI GI: 5532608 NCBI Desc: 6,7-dimethyl-8-ribityllumazine synthase precursor [nicotiana tabacum]
  misc_feature (62)..(214): NCBI GI: 9954993 NCBI Desc: chain t, crystal structures of a pentameric fungal and an icosahedral plant lumazine synthase reveals the structural basis for differences in assembly
  misc_feature (51)..(214): SWISSPROT Homolog: EC 2.5.1.9 6,7-dimethyl-8-ribityllumazine synthase, chloroplast precursor
MATAPVTSSATANSACMRLPSMPLRLAPATISFPSRSWSAALTSCTGLLRRSDVVAAAGHQKLMGSLTSNEGLRFGVVVARFNEVVTNLLLQGALETFERYSVKAENITVVIVPGSFEVPITAQKLGKSGKFDAILCIGAVIRGDTTHYDAVANSAASGVLNAGLSAGVPCVFGVLTCEDMDQALNRAGGKAGNKGAEAALTAIEMASLFRHHLG

SEQ ID NO: 3993 - DNA, 2103 bp, Sorghum bicolor
  misc_feature: Ceres ANNOT ID no. 6034185
  misc_feature: Encodes the peptide sequence at SEQ ID NO 3994
atggagccctcgccggcgcaagcgggcgcgtcggaccgcgaccgctcgccgcctccacctccgcctccgccgtcccagtcgtcgaccgcagcgtcgatctcatcgccgctcgccgtcgtctgcagtttctggaaagattttgatttggagaaggaaagaagcggtttggatgagcaaggtttaaagattgcggagaatcaagaaactagtcagaagaacaggcgtaagctcgctgagaacacgcgggatttcaaaaaggcatcttcagatgagaagctcagtttattcaattctttgctgaagagttatcaagaggaagttgataacctcacaaagagagcaaagttcggagaaaatgcatttctcaacatctatcagaagctctatgaagctcctgatccatatccagctcttgcttcaatggctgatcaagaccagaaattatctgaactggagactgaaaaccgtaagatgaaactagagcttgaagaataccgtgctgaagctgcgcacttgaagaaccagcaggcaacaattaggcgacttgaagagcgtaatcgccaactggaacagcagatggaggagaaagtaagggagatggttgaaatgaagcagcgaagcatggctgaggatagccagaaaactctagaagccctgaaagatagggaacggtcgctgcaggaccaactaaggcaagctacagaaagtgtaaagaatatgcaaaaactacatgaatcggcgcaaagccaattgtttgagcttcgcactcaatcagaggaggatcgagctgcaaaggaggctgaagtcagccttctgatggatgaagttgaaagagctcaagcacgattagtcagtcttgagcgggaaaagggggatctacgttcacagttgcagacaactaatgaggatgcaagcaaaagtagtgactatttggaatcaagtgatatacttgagagttccttgaacgccaaggagaagattatctcagagttgaatgcagaacttcgcagcattgaaaatactttatcaagtgagagagaaatgcatgtgaatgagcttaagaagttgacgactttactcactgaacaggaaagtgctcttatggagttgaagaaagaactccaggaaagacctacacaaaaaatggtagatgatctcaagaaaaaggttcagattttgcaggctgttggttacaactccattgaagctgaagactgggagctagctaccaatggtgaagaaatgagcaagttggaagcattgcttctcgacaagaaccgtaaaatggagcatgagctaacacaactgaaggttaaaatatcagagaagacaagtcttcttgaggaagctgaaaaaaagattgctgaactaacttcaaaggtcgaagagcaacaaaagctgatcttgaaacttgaggatgacatactaaagggctacaattcaactgataggaggggctcactcttgaatgactgggatcttcaagaaatcggctcaagtgaagcatctgagggctctgatccaaggcatgcatcagcagatcaagatcaaagttcgatgctcaaggtcatttgcaatcagagggatcgtttccgtgcacgtctgcgtgaaactgaggaggaactgaggagactgaaagagaagtatgagatgctgactgttgaactggaaaaaactaaagctgataatgtgcaactgtatggaaagattcgatatgtccaggactatagccatgacaagattgtttccaggggaccaaaaaagtatgcagaagatcttgaaagtggttcttctgatgttgaagcaaagtacaagaaaatgtatgaggatgacataaatccatttgctgctttttcaaagaaggaaaaggatcaacgatataaggaacttggtttaagagacaaaatcacacttagtagtggtcgttttctccttggtaacaaatatgcacggacgtttatattcttctacagcatcggattgcatctccttgtatttacattgctgtacagaatgtcagctttgagctatctcaacacaacaactcagcatgatgagatcattctggatgctggcaatcagacgctatcgcacatgctttag

SEQ ID NO: 3994 - protein, 700 aa, Sorghum bicolor
  misc_feature: Ceres ANNOT ID no. 6034185
  misc_feature (447)..(680): Pfam Id: CASP_C Pfam Desc: CASP C terminal
  misc_feature (1)..(661): NCBI GI: 115454903 NCBI Desc: os03g0710900 [oryza sativa (japonica cultivar-group)]
  misc_feature (23)..(696): NCBI GI: 92893109 NCBI Desc: prefoldin [medicago truncatula]
  misc_feature (141)..(700): NCBI GI: 11994111 NCBI Desc: casp protein-like; ccaat displacement protein-like [arabidopsis thaliana]
  misc_feature (43)..(673): NCBI GI: 19343976 NCBI Desc: ccaat displacement protein, isoform c [homo sapiens]
  misc_feature (43)..(673): NCBI GI: 31652238 NCBI Desc: ccaat displacement protein isoform c [homo sapiens]
MEPSPAQAGASDRDRSPPPPPPPPSQSSTAASISSPLAVVCSFWKDFDLEKERSGLDEQGLKIAENQETSQKNRRKLAENTRDFKKASSDEKLSLFNSLLKSYQEEVDNLTKRAKFGENAFLNIYQKLYEAPDPYPALASMADQDQKLSELETENRKMKLELEEYRAEAAHLKNQQATIRRLEERNRQLEQQMEEKVREMVEMKQRSMAEDSQKTLEALKDRERSLQDQLRQATESVKNMQKLHESAQSQLFELRTQSEEDRAAKEAEVSLLMDEVERAQARLVSLEREKGDLRSQLQTTNEDASKSSDYLESSDILESSLNAKEKIISELNAELRSIENTLSSEREMHVNELKKLTTLLTEQESALMELKKELQERPTQKMVDDLKKKVQILQAVGYNSIEAEDWELATNGEEMSKLEALLLDKNRKMEHELTQLKVKISEKTSLLEEAEKKIAELTSKVEEQQKLILKLEDDILKGYNSTDRRGSLLNDWDLQEIGSSEASEGSDPRHASADQDQSSMLKVICNQRDRFRARLRETEEELRRLKEKYEMLTVELEKTKADNVQLYGKIRYVQDYSHDKIVSRGPKKYAEDLESGSSDVEAKYKKMYEDDINPFAAFSKKEKDQRYKELGLRDKITLSSGRFLLGNKYARTFIFFYSIGLHLLVFTLLYRMSALSYLNTTTQHDEIILDAGNQTLSHML

SEQ ID NO: 3995 - DNA, 1581 bp, Sorghum bicolor
  misc_feature: Ceres ANNOT ID no. 6034205
  misc_feature: Encodes the peptide sequence at SEQ ID NO 3996
atgcaccgccgccttgccaccgcggccgcagcgccagcgctccggcggttctcgcaccacagcgcgcctccccggcctgacccaaggctcgccttcctccgctccgaggtcgacgacctcgacctttccccctctcataaaccatcgccacggcctccccatagagaggaatgccaggtgttagaagagctaagaagtggccttgctagagctggagacgctccggcagctgtggatatagcgcatccgtggccggagtgggttgcgctgatggagctcctcctccgtcggggccacgtggacccctccgccttcgcctctgcctcgctgtcttctaaggacgccaacgctgtccgcactgcgtgcctccaattcgggcgccagcggccggagctcatcaggcatatatcaagatggaatattcaggttgccatgcgatgtggttgtcccagcattgacaggaaggttgtaaactctgggaagcgactgcgggcttatgtaggacttgatgaaggagaggtttgcagccaatgcaatttaagaggaagttgtgatagggcatatgtaaaggctcggaaagaggaagttggaagaactgtggatgttatgcgcatccttttgacttatggtcttgacgttattaccggcaatgtagagaatagagcatgcctgaacaaaactgtcaaggaatcaataaagatcctactaaacgaggttgtcgaggtcgattctaggggacctggttccagcactgtgaaagctgcacaacgcaaaggtcaatctgctgtacccatgaagcagggtgattggaattgtcccaaatgtgactttctgaactttgcaaagaatatcaaatgtttgcgttgcgatggggaattccaagagaggtatcagttgttgcatgaagaccaagagcatctacctctcaaaaagggtgactggatatgcaaaaggtgcaactttttgaattttgctaagaacacaagatgcttgcaatgccatgagaaaccaacaaaccgtttactcaacccaggagaatgggaatgtgtctcgtgtaactatgtgaacttcaagaggaatggattctgcttgaaatgtggctggaaaaggccaaagtctctaaacaatcaagatactattgaatcacgtcatgacttagagcatagtaagacccccagtatttcatttgttcaagacggcgtccagctgaagaggtggcaaagtccgcaaaagagtgcttcaccatctgacgaagattcagatttctggagcgcagacgatgaaggaggtgatagcagggataatgatgcactcctgcaacagaaggactacagatttcttgacagttttcccattgtcgggggcaggactgctaattcccaagatcgtcttgcaagggagaagtggaaggacgaaatgtccaggagaaacaaaggccttcaaactaaggaatcacaagaaagcgttcggccttgtagccccggccgtcttccaagaagcatggaactggttgagtctgatgatgatatcgcttcttggttttcgggtgggaataatattaggaacttggacaagacataa

SEQ ID NO: 3996 - protein, 526 aa, Sorghum bicolor
  misc_feature: Ceres ANNOT ID no. 6034205
  misc_feature (266)..(295): Pfam Id: zf-RanBP Pfam Desc: Zn-finger in Ran binding protein and others
  misc_feature (310)..(338): Pfam Id: zf-RanBP Pfam Desc: Zn-finger in Ran binding protein and others
  misc_feature (67)..(478): NCBI GI: 18409643 NCBI Desc: zinc finger (ran-binding) family protein [arabidopsis thaliana]
  misc_feature (112)..(487): NCBI GI: 92891175 NCBI Desc: zinc finger, ranbp2-type [medicago truncatula]
  misc_feature (51)..(368): NCBI GI: 91176378 NCBI Desc: zinc finger, ranbp2-type [medicago truncatula]
  misc_feature (112)..(343): NCBI GI: 34393925 NCBI Desc: arp protein-like [oryza sativa (japonica cultivar-group)]
  misc_feature (85)..(343): NCBI GI: 18700082 NCBI Desc: at5g17790/mva3_140 [arabidopsis thaliana]
MHRRLATAAAAPALRRFSHHSAPPRPDPRLAFLRSEVDDLDLSPSHKPSPRPPHREECQVLEELRSGLARAGDAPAAVDIAHPWPEWVALMELLLRRGHVDPSAFASASLSSKDANAVRTACLQFGRQRPELIRHISRWNIQVAMRCGCPSIDRKVVNSGKRLRAYVGLDEGEVCSQCNLRGSCDRAYVKARKEEVGRTVDVMRILLTYGLDVITGNVENRACLNKTVKESIKILLNEVVEVDSRGPGSSTVKAAQRKGQSAVPMKQGDWNCPKCDFLNFAKNIKCLRCDGEFQERYQLLHEDQEHLPLKKGDWICKRCNFLNFAKNTRCLQCHEKPTNRLLNPGEWECVSCNYVNFKRNGFCLKCGWKRPKSLNNQDTIESRHDLEHSKTPSISFVQDGVQLKRWQSPQKSASPSDEDSDFWSADDEGGDSRDNDALLQQKDYRFLDSFPIVGGRTANSQDRLAREKWKDEMSRRNKGLQTKESQESVRPCSPGRLPRSMELVESDDDIASWFSGGNNIRNLDKT

SEQ ID NO: 3997 - DNA, 1839 bp, Sorghum bicolor
  misc_feature: Ceres ANNOT ID no. 6034213
  misc_feature: Encodes the peptide sequence at SEQ ID NO 3998
atggcgactatggggagcctgatcgggctggtgaaccggatccagcgcgcgtgcaccgtcctcggcgaccacggcggtggcgccggcggcgagggctccctctgggaggcgctcccctctgtcgctgtcgttggcgggcagagttccgggaagtcgtcggtgctcgagagcatagtggggagggacttcctgccccgtggatctggtattgtcacgaggcggcctctagtgctgcagctccacaagacagatggtggtcacgaatatgctgagttcctccatgccccgcggaagcggttcaccgactttgctgctgtgaggaaagagattgctgatgaaacagatcgcataactgggaaaactaaagctatttcaaatgttcccatccatttgagtatatattcgccacatgttgttaacttgacacttattgatcttcctgggctgacaaaggtcgctgtagaggggcaagcagaatctattgttcaagatattgaaaacatggttcgatcttatgttgacaagccaaattgcatcatcttggctatctccccagctaaccaagatatagcaacgtcagatgctatcaagcttgctagggatgttgatccttcaggtgacaggacttttggagtcttaacaaagcttgatttgatggacaagggtaccaatgccgttgatgtacttgaagggaggcaatatcgcttacaacacccctgggttggaattgtcaaccgctcacaagctgatatcaacaagaatgttgatatgctctcagcaagacgcaaagaaaaagagtactttgagagtagtcctgaatatggtcacttggcacataaaatgggtgcagagtatcttgccaagcttctgtcacagcatttagaggctgtgatcagggccaaaattccaagtattatagccatgattaacaaaacaattgatgaaatagaagcccagttggatcgacttggtaggccaatcggaggtgatgctggggctcagttgtacactatcttggatatgtgtcgtgcatttgaccgtgtctttaaagagcacttagatggcgggcggccaggtggagatcggatttatggagtctttgacaaccagttacctgcagcactgaaaaagcttccatttgaccgacatctgtcaatgcaaaatgttcgtaaagttatttcagaggctgatggttaccagccccacttgattgcccctgagcaaggatacagaaggcttatagatagttctctaagctactttaagggtccagctgaagcgtctgttgatgcggtccatttggtcttgaaggagcttgttcggagatcgattgcagcaacagaggagttgaagcgattcccaacacttcaatcggatatagctgctgctgcaaacgatagcctggaaagattccgtgaggacggacgaaagactgttcttcgtctagtagagatggaagccagctacctaacagtagagtttttccgcaaacttcctactgaaccagagaaagcagctgataagaacactccagtgagtgatagatatcaggacaatcatctcagaagaatcggatcgaatgtgtcatcttacatcaacatggtctgtgagactctgaggaacacaattccgaaagccattgtacattgtcaagtgaaagaggcaaaaagaaatttgcttaaccgtttctatgctcatgtgggaagcaaggagaagaaacagctgagcgcgatgttggacgaggaccctgctttgatggagaagagggatgccttggtcaagaggctagagctgtacaaatcggcaaggaatgagatcgactcggtcgcatggaaatga

SEQ ID NO: 3998 - protein, 612 aa, Sorghum bicolor
  misc_feature: Ceres ANNOT ID no. 6034213
  misc_feature (41)..(216): Pfam Id: Dynamin_N Pfam Desc: Dynamin family
  misc_feature (225)..(511): Pfam Id: Dynamin_M Pfam Desc: Dynamin central region
  misc_feature (516)..(609): Pfam Id: GED Pfam Desc: Dynamin GTPase effector domain
  misc_feature (39)..(217): Pfam Id: MMR_HSR1 Pfam Desc: GTPase of unknown function
  misc_feature (70)..(612): NCBI GI: 115454939 NCBI Desc: os03g0713100 [oryza sativa (japonica cultivar-group)]
  misc_feature (1)..(612): NCBI GI: 92891191 NCBI Desc: dynamin central region; dynamin; dynamin gtpase effector [medicago truncatula]
  misc_feature (1)..(612): NCBI GI: 6651403 NCBI Desc: dynamin-like protein 5 [arabidopsis thaliana]
  misc_feature (4)..(612): NCBI GI: 19569772 NCBI Desc: dynamin-like protein c [arabidopsis thaliana]
  misc_feature (1)..(611): NCBI GI: 11991508 NCBI Desc: dynamin-like protein dlp2 [arabidopsis thaliana]
MATMGSLIGLVNRIQRACTVLGDHGGGAGGEGSLWEALPSVAVVGGQSSGKSSVLESIVGRDFLPRGSGIVTRRPLVLQLHKTDGGHEYAEFLHAPRKRFTDFAAVRKEIADETDRITGKTKAISNVPIHLSIYSPHVVNLTLIDLPGLTKVAVEGQAESIVQDIENMVRSYVDKPNCIILAISPANQDIATSDAIKLARDVDPSGDRTFGVLTKLDLMDKGTNAVDVLEGRQYRLQHPWVGIVNRSQADINKNVDMLSARRKEKEYFESSPEYGHLAHKMGAEYLAKLLSQHLEAVIRAKIPSIIAMINKTIDEIEAQLDRLGRPIGGDAGAQLYTILDMCRAFDRVFKEHLDGGRPGGDRIYGVFDNQLPAALKKLPFDRHLSMQNVRKVISEADGYQPHLIAPEQGYRRLIDSSLSYFKGPAEASVDAVHLVLKELVRRSIAATEELKRFPTLQSDIAAAANDSLERFREDGRKTVLRLVEMEASYLTVEFFRKLPTEPEKAADKNTPVSDRYQDNHLRRIGSNVSSYINMVCETLRNTIPKAIVHCQVKEAKRNLLNRFYAHVGSKEKKQLSAMLDEDPALMEKRDALVKRLELYKSARNEIDSVAWK

SEQ ID NO: 3999 - DNA, 2235 bp, Sorghum bicolor
  misc_feature: Ceres ANNOT ID no. 6034216
  misc_feature: Encodes the peptide sequence at SEQ ID NO 4000
atggcgttcctcgcgcgggctctccgccagtccaactcgcgcctatcgtcgcgctgccccgccgtggcagcgtcctgccgctggatctccccgaccgccgccgcgggatcgccggaggccggcgcggcggtggcgccggccgacccggagctgcctccgccgcgggagcccgttggcggcgcccgcgtggagcttcctcccaacccggaggacgcgctcgaggtgttcgtggacggccacgcggtgcggatccccaaggggttcaccgtgctccaggcctgcgaggtcgccggcgtcgacatcccgcgcttctgctaccatagccgactctccatcgctgggaactgccgcatgtgcctcgtcgaggtcgagaagtcgcccaagcccgtcgcttcctgtgccatgcccgcgcttccagggatgaagattaagacaaacaccccagtggcgaagaaggcaagggagggtgtcatggagttcttgctaatgaatcatccactggactgcccaatctgtgatcagggtggggagtgtgacctccaggatcagtctatggcatttggtgctgaccgtggtcggttcactgagatgaagcgatcagttgtggacaagaatttgggtcccttggttaagacagtgatgactcgttgcatccaatgtacaaggtgtgttaggtttgctactgaggttgctggagttcaagaccttggtatgttaggtcgtggcagtggtgaagaaattggaacatatgttgagaaacttatgacaagtgaactatctggaaatgttattgatatctgccctgttggggctcttacatccaagccatttgcatttaaagctcggaactgggaattgaagggcaccgagactattgatgttactgatgctgtgggatccaacataagagttgacagcagaggacctgaagttatgcgcattgttccacgtctcaatgaggacattaatgaggaatggatatcggacaaaacacggttttgttatgatggtctaaagaggcaaagactaaatgaccctatgatccgtggtcctgatggcaggtttaaggccgtcacgtggcgtgatgctcttgcagttgttgctgaggttttgcatcaagttaaaccagaagaaataaccggagttgctggaaaactttctgatgcagaatccatgatggcactgaaagattttgttaacagaatgggttcagataaggtgctatgtgagggaaatggtcccaatcctccagcagatctgcgatctaactacctaatgaatactagcatcgctgggcttgaaaaggccgatgtcttccttttggttggcactcagccaagggtggaagctgctatggtcaatgccaggattcggaagactgttaaagcaacacaagcaaaggtgggctacattggtcctccagctgacttcaactatgaccatgatcatcttggcacaggaccacagacccttgttgagattgcagagggacgtcatcctttctgttcagtactgcaatcagccaagaaccctgtcatcattgctggagctggattatttgaacgtgaagaccaggatgccctattctcaactattgagactgtagccaagaagttcaatgtgacaagaccagactggaatggacttaacgtcctgttgctccatgctgcacaggccgcagctcttgatcttgggcttgttgctaatccttccgagagcatcaagtcagcaaagttcttgtatctgatgggagctgatgatataagcctggacaagcttccagacgatgcatttgttgtttatcagggacaccatggtgacaaggctgtctatagggccaatgttattctgccatcttcagcattcagtgagaaggaaggcacctacgagaatactgaaggttgcacccagtggaccatcccagctgttcccacggttggtgatgctagggatgactggaagatcatccgcgctctttctgaggttgctggggctcagctgccttatgacagcctctcagctgtgagggaccggattagtacggttgcaccaaatttagtacacctagatgagagggagccatccacaatctcagctgaggttaagccgccagtaaagcaacaagtcagctcgacaccattcaaaactgttgtagaaaacttctacatgactgatgcaatcactcgagcttcaaagattatggctcaatgcagtgcaaccttgctgaagaagtga

SEQ ID NO: 4000 - protein, 744 aa, Sorghum bicolor
  misc_feature: Ceres ANNOT ID no. 6034216
  misc_feature (342)..(662): Pfam Id: Molybdopterin Pfam Desc: Molybdopterin oxidoreductase
  misc_feature (75)..(139): Pfam Id: Fer2 Pfam Desc: 2Fe-2S iron-sulfur cluster binding domain
  misc_feature (8)..(744): NCBI GI: 758340 NCBI Desc: 76 kda mitochondrial complex i subunit [solanum tuberosum]
  misc_feature (37)..(675): NCBI GI: 24111441 NCBI Desc: at4g37510/f6g17_160 [arabidopsis thaliana]
  misc_feature (37)..(737): NCBI GI: 34485506 NCBI Desc: nadh:ubiquinone oxidoreductase 78 kda subunit [chlamydomonas reinhardtii]
  misc_feature (73)..(737): NCBI GI: 27807355 NCBI Desc: nadh dehydrogenase (ubiquinone) fe-s protein 1, 75kda (nadh-coenzyme q reductase) precursor [bos taurus]
  misc_feature (73)..(737): NCBI GI: 21704020 NCBI Desc: nadh dehydrogenase (ubiquinone) fe-s protein 1 [mus musculus]
MAFLARALRQSNSRLSSRCPAVAASCRWISPTAAAGSPEAGAAVAPADPELPPPREPVGGARVELPPNPEDALEVFVDGHAVRIPKGFTVLQACEVAGVDIPRFCYHSRLSIAGNCRMCLVEVEKSPKPVASCAMPALPGMKIKTNTPVAKKAREGVMEFLLMNHPLDCPICDQGGECDLQDQSMAFGADRGRFTEMKRSVVDKNLGPLVKTVMTRCIQCTRCVRFATEVAGVQDLGMLGRGSGEEIGTYVEKLMTSELSGNVIDICPVGALTSKPFAFKARNWELKGTETIDVTDAVGSNIRVDSRGPEVMRIVPRLNEDINEEWISDKTRFCYDGLKRQRLNDPMIRGPDGRFKAVTWRDALAVVAEVLHQVKPEEITGVAGKLSDAESMMALKDFVNRMGSDKVLCEGNGPNPPADLRSNYLMNTSIAGLEKADVFLLVGTQPRVEAAMVNARIRKTVKATQAKVGYIGPPADFNYDHDHLGTGPQTLVEIAEGRHPFCSVLQSAKNPVIIAGAGLFEREDQDALFSTIETVAKKFNVTRPDWNGLNVLLLHAAQAAALDLGLVANPSESIKSAKFLYLMGADDISLDKLPDDAFVVYQGHHGDKAVYRANVILPSSAFSEKEGTYENTEGCTQWTIPAVPTVGDARDDWKIIRALSEVAGAQLPYDSLSAVRDRISTVAPNLVHLDEREPSTISAEVKPPVKQQVSSTPFKTVVENFYMTDAITRASKIMAQCSATLLKK

SEQ ID NO: 4001 - DNA, 2946 bp, Sorghum bicolor
  misc_feature: Ceres ANNOT ID no. 6034218
  misc_feature: Encodes the peptide sequence at SEQ ID NO 4002
atggaggtgccgccggagatgctcgacgccctcgcgggctggttcgcgcagtcgctctcacccgacgccgccgcgcgccgcgccgccgagcagagcatctcctccgccgcctcttccccgggcttcgcgctggcggtcctcgccctcgcggcctccccgcaccacaacctccaggcccgccaagccgcctccgtccagttcaagaacctgctccgccgccggtggcccaagcccgacgccgacgccgacgacgccgccgaccacctccccgcctccgactgcgccatgatcaaggcgcacctcctccagctcctcctcaccgccccgcccctcatccaggcgcagctctccgaggcccttgccgccgccgcggcctccgatttccccgccaggtgggagtcgctcctcccgtccatcgtgtcctccctcggcactgccgtcaacgcgggggacatcgccgccaccaactccctcctcgccgccttggtgtcgctcttctcccgcttccgcaacgcattcgacaataatgccctccgcctcgacctcaagtactgccttgacatctttgctcctccactcctcgaggtcttcctcttcgcctcccgccgccttcaggccgccgccaccacggccaacccgctggagatccgccccgtgttcgagtgccttcgcctctgctgcgagatcttctactcgcttaactccatcgacctgcctgagttcttcgaggataacatgcgccagtggatgacagagttccgagctttcctcaccacatcctactcaccgcctgtagaggcagatggtgccccggatgcgctccgtgctgctgtctgtgataatctgcagctttatatggagaagtacgaggaggagtttaggggatacctgaaggagtttgttgaggccgtgtgggggctcctcatggtgcagaccacatctccatcccgtgcacagcttgccgttactgcgataaggttcttgactacagttgctgagagcgtgcaccatgccctatttgggagtcctgaggcaatgaagcagatatgtgatagtgttgtcgtgcctaatttgcgcctgcgggatgaggatgaggagttgttcgagggcaactgggtggaatatgttaggcgtgactctgagggtagtgatgcagatacgcttagacgggcagcgtgccggttgctgcgaggccttgcagcgaactaccgggagcaggtggctgcacttgtgtcagcacaggtccagcaaatgttggctgcatatgctgctaatcgggcaaacaactggaaggagaaggatgctgcaatataccttgttattgctcttatgcagaagcctggtgccacaggtggcggcacacccgtggttgacatggagagcttctttacatctgtgattgtgcctgagctccaggcccctgattggcagtctgagccaatgttgaaggcaactgtgctcaggttcttgaaggagttcagggatcagatccccaaagccactgcactggcactcctaccaagtgtggtgaggtttctgacgcatgagtccaatgttgttcattcatatgctgcaacttttatcgagaacctgttgatcatcaaggacgctgtcccggtaccagggttgaccacagtgaccaggtctccacgttatgttgctgctgatatcaatccatttgccccacagatcattcagaacctgtccacagcactaagtttccctgattcatacgagaacccctacctgatgaagtgcctgatgcgggtgcttgggattgctaatatagctggtcaaattgttcatgagatcactgctcgacttgtgggtattctcatggaagtgtgcaataaccccaagaaccctgacttcaaccactacttgtttgaggctctggcagcagttattggccggactggtgagcaggacccagcactactccctgcttttgaggccagcctcttcccagtgctccagaggatattggttgaggacatctcagagttctggccatatgcttttcagatatttgcacaactcgtcaatttgagccaaccacctctctcgcagaattacatgcagctatttggtgttcttctcagtaatgccacttgggaccggccaccatgtgttcctgccttggttcgcttgctgcgagcgttccttaggaaaattccaaatgagctaaaccaagagggcaggcttccaaatatcttggcaatatcccgtagtctcctctcacgcagcagcactgaagattctgcattctacatgctgaacacaatagtggaaaatgttggttttgacattctgaacccatatataagtgagatatggagtgctttgtttactcggctgcagggtagacaggcagtgaaatttgtgaactctcttgtggttttcatgtcactagtgctggtcaaatatggatcaagtgttcttgtcagttctgttgatgcaattcagccaaatcttttcacccaaatccttcagcgattttggattcccaacctcaaattgatcaaaggtgctcttgaagttaagttgacagcagttgcttcgacaaagttgctttgtgagtctgcggtgctgttggatgctgctgcagcccagtcgtgggggaaattacttgacagtattgtctcactgttgtccagaacgaatcaagatggggcacaacaagagcaaaatgatggtactgatgcagtggatattcagaagtcaagttattctgtctcatttgtacggcttcaatatgctggaaagagtgaagatgacctattgaaagaagtaaatgatacaaaacagtttgtggtcacatccttggccacactttctgcccaatttcctgggaggtttggtcctgtcattgagcagcatgtggacccagcgaacaaaagtgtgcttcttcaactttgtgcagcctacaatgccaacattgtctag

SEQ ID NO: 4002 - protein, 981 aa, Sorghum bicolor
  misc_feature: Ceres ANNOT ID no. 6034218
  misc_feature (165)..(528): Pfam Id: Cse1 Pfam Desc: Cse1
  misc_feature (529)..(972): Pfam Id: CAS_CSE1 Pfam Desc: CAS/CSE protein, C-terminus
  misc_feature (29)..(107): Pfam Id: IBN_N Pfam Desc: Importin-beta N-terminal domain
  misc_feature (440)..(981): NCBI GI: 115435528 NCBI Desc: os01g0235400 [oryza sativa (japonica cultivar-group)]
  misc_feature (1)..(765): NCBI GI: 92897784 NCBI Desc: importin-beta, n-terminal [medicago truncatula]
  misc_feature (1)..(952): NCBI GI: 24266849 NCBI Desc: cellular apoptosis susceptibility protein [oreochromis niloticus]
  misc_feature (1)..(952): NCBI GI: 20138049 NCBI Desc: importin-alpha re-exporter (chromosome segregation 1-like protein) (cellular apoptosis susceptibility protein)
  misc_feature (1)..(952): NCBI GI: 80479124 NCBI Desc: cse1 chromosome segregation 1-like protein, isoform a [homo sapiens]
MEVPPEMLDALAGWFAQSLSPDAAARRAAEQSISSAASSPGFALAVLALAASPHHNLQARQAASVQFKNLLRRRWPKPDADADDAADHLPASDCAMIKAHLLQLLLTAPPLIQAQLSEALAAAAASDFPARWESLLPSIVSSLGTAVNAGDIAATNSLLAALVSLFSRFRNAFDNNALRLDLKYCLDIFAPPLLEVFLFASRRLQAAATTANPLEIRPVFECLRLCCEIFYSLNSIDLPEFFEDNMRQWMTEFRAFLTTSYSPPVEADGAPDALRAAVCDNLQLYMEKYEEEFRGYLKEFVEAVWGLLMVQTTSPSRAQLAVTAIRFLTTVAESVHHALFGSPEAMKQICDSVVVPNLRLRDEDEELFEGNWVEYVRRDSEGSDADTLRRAACRLLRGLAANYREQVAALVSAQVQQMLAAYAANRANNWKEKDAAIYLVIALMQKPGATGGGTPVVDMESFFTSVIVPELQAPDWQSEPMLKATVLRFLKEFRDQIPKATALALLPSVVRFLTHESNVVHSYAATFIENLLIIKDAVPVPGLTTVTRSPRYVAADINPFAPQIIQNLSTALSFPDSYENPYLMKCLMRVLGIANIAGQIVHEITARLVGILMEVCNNPKNPDFNHYLFEALAAVIGRTGEQDPALLPAFEASLFPVLQRILVEDISEFWPYAFQIFAQLVNLSQPPLSQNYMQLFGVLLSNATWDRPPCVPALVRLLRAFLRKIPNELNQEGRLPNILAISRSLLSRSSTEDSAFYMLNTIVENVGFDILNPYISEIWSALFTRLQGRQAVKFVNSLVVFMSLVLVKYGSSVLVSSVDAIQPNLFTQILQRFWIPNLKLIKGALEVKLTAVASTKLLCESAVLLDAAAAQSWGKLLDSIVSLLSRTNQDGAQQEQNDGTDAVDIQKSSYSVSFVRLQYAGKSEDDLLKEVNDTKQFVVTSLATLSAQFPGRFGPVIEQHVDPANKSVLLQLCAAYNANIV

SEQ ID NO: 4003 - DNA, 807 bp, Sorghum bicolor
  misc_feature: Ceres ANNOT ID no. 6034228
  misc_feature: Encodes the peptide sequence at SEQ ID NO 4004
atggggtacgcgcagctcgtcatcggccccgctgggagcggcaagtcaacttattgctccagtttgtacgaccattgccagactgtgggcaggacaattcatattgtcaatctcgatccagctgctgagcactttgactatcctgtagatatggatatcagagagctgatttcattggatgatgttatggaggacattgggctggggccaaatggtggtctcatctactgcatggagcacctagaagacagcttggatgattggtttgatgaacagctagagaactacttggatgatgactatcttgtgtttgattgccctggccagattgaactcttcacgcatgttccagttttgcggaactttgttgagcacctgaaacgaaaaaatttcaatgtttgcgctgtttaccttcttgattcacagtttgtcagtgatgtaacgaaatacatcagtggttgcatggcttctctatcagctatgattcagcttgaacttcctcatatcaacatcctttcaaagatggatctagtctccaacaaaaaagaagtagaagagtacctggacccgaacgcacaggttcttctttcacagctgaatcgacagatggcacctcgatttggcaagttgaacaagtgtttagctgaactggttgatgattacagcatggttaatttcataccacttgatttgagaaaggaaagcagcatacaatatgtgctgtcgtatatcgacacctgtatccagtacggggaagatgctgatgtgaaggtcagggactttgagcccatcgaagacgaagactaa

SEQ ID NO: 4004 - protein, 268 aa, Sorghum bicolor
  misc_feature: Ceres ANNOT ID no. 6034228
  misc_feature (7)..(250): Pfam Id: ATP_bind_1 Pfam Desc: Conserved hypothetical ATP binding protein
  misc_feature (3)..(268): NCBI GI: 55250644 NCBI Desc: zgc:101903 [danio rerio]
  misc_feature (1)..(257): NCBI GI: 74703889 NCBI Desc: transcription factor fet5 (factor of eukaryotic transcription 5)
  misc_feature (3)..(268): NCBI GI: 42538980 NCBI Desc: similar to riken cdna a930018b01 [rattus norvegicus]
  misc_feature (3)..(268): NCBI GI: 21410245 NCBI Desc: protein x 0004 [homo sapiens]
  misc_feature (3)..(268): NCBI GI: 37183274 NCBI Desc: prya1876 [homo sapiens]
MGYAQLVIGPAGSGKSTYCSSLYDHCQTVGRTIHIVNLDPAAEHFDYPVDMDIRELISLDDVMEDIGLGPNGGLIYCMEHLEDSLDDWFDEQLENYLDDDYLVFDCPGQIELFTHVPVLRNFVEHLKRKNFNVCAVYLLDSQFVSDVTKYISGCMASLSAMIQLELPHINILSKMDLVSNKKEVEEYLDPNAQVLLSQLNRQMAPRFGKLNKCLAELVDDYSMVNFIPLDLRKESSIQYVLSYIDTCIQYGEDADVKVRDFEPIEDED

SEQ ID NO: 4005 - DNA, 4239 bp, Sorghum bicolor
  misc_feature: Ceres ANNOT ID no. 6034229
  misc_feature: Encodes the peptide sequence at SEQ ID NO 4006
atgacggcaagcaatctgttacggactgaaggctttcctggaaatatgggaaaaagatgtggtttaattcctgcgagaagtcttgggtcaagaagattgcgaatgactcaacactgcttccatcaacagcatatttgttggccacgtctacaaagagttatgactcgtaatatccgattgccatcatctcctggggccgtggcatccaaggggtttgacagtccattagttgagaaacctgatactgcgttggatgttggaattattcacctgtaccgtatcccatttcttcaaggaagtgaaaccatggagctgctcaggaaagtgaaggcgaaggtttctgctaatattgttgatatactgactgagcagtgcttcaacattcaattggacaatccactcactcctgagaagctttcaacgcttcattggctcttagcagaaacttatgaacctgagaagttgcaaactaggagctttctggaggatgaagaatctagaaattcttgtactgtcattgttgaggttggtccccggatgacattttcaacagcattctcgaccaatgctgtctcaatttgtaaatctctctcgttagtagaagtaacacgactggagagatcaagaagataccttttgtgccttgagcctggtagtgacccacttgatgaaagtcagctcaaagaattcactgcattggttcatgatagaatgacagagtgcatttatcccaacaagctcacatcatttcaatcagatgtagttcctgaacctgttcatgttgttccagtcattgaaaggggagaaaaagcattggaagaaataaatgtgaggatgggacttgcttttgataaacaagatattgactactatacacacctcttcagagatgatattaaacgcaatccaactaccgtggaactttttgatattgcacaatccaatagcgaacatagcagacattggttttttaatggaaagcttgtaatagacggagagatcatgccagccactttgttccagttagtgaagagtcccctgaaagccaaccccaataactctgtcatcggattcaaggataactcgagtgcaataaaaggattcccagtaaatcagctacgcccaacaattccaggtttcacttcaccattatccattatcatgcgtgagctagatattttattcacagcagaaacccataattttccatgtgctgttgcaccataccctggagctgagacaggtgcaggtggacgtataagggacacacatgccactgggaagggttcatttgttgttgcatccactgctggttactgtgttggtaatcttcgaattgacaattcaaatgcaccctgggaggacccttcattttcttacccagtgaatctggcctctccattgcaaattcttgttgatgctagtgatggtgcatctgactatgggaacaaatttggtgagcctctaattcagggatataccagaacatttggaatgaggttgctaaatggggagcggcgtgaatggttgaagcctataatgttcagtggagctatagggcaaattgaccatgcacacatatcaaaggatgacccagaaattggcatgctagttgtgaagattggtggtccagcgtaccgaattggcatgggtggtggtgctgcctcgagtatggttagtggccagaatgatgcagagcttgatttcaatgcagtacagcgtggagatgccgagatggcacagaaattgtatcgtgtagtcagggcatgtgcagaaatgggagagagcaatcctatcatcagcattcatgatcagggtgcaggaggaaattgtaatgttgtgaaggaaataatatatcccaagggagctgaaattgatatccgttcaattgttgttggtgatcatacattgtctgtcttggagatatggggtgctgagtaccaggaacaggatgcactacttgtgaaacctgagagcagaagcctgttagaatcgctttgtgagagggaaagagtttcaatggctgtcattgggaaaattgatggctgtggaaaaattgtgttgattgatagcgctgctgtggagcattcaaagctgaatggcctccctcctccaacccctgttgaagaacttgagcttgaaaaggttttaggagatatgcctcagaagacctttgagttcaggcgtgtttctcaagtcacagagcctttagacattgcacccggggttacactactagatgctctgaagcgagtattaaggctcccatccgtttgttcaaaacgtttcttgaccactaaggttgataggtgtgtgacaggtcttgttgcacaacagcagacagttgggcctctccaactcccgcttgctgatgtggctgtgattgcacagacgtacacagacctaacaggtggtgcttgcagcattggagaacaaccaataaagggtttgcttaatcctaaggccatggccagacttgctgttggggaggccttgactaatcttgtttgggctaaggttacatcacttgctgatgtcaaagcaagcgggaattggatgtatgctgcaaagcttgatggcgaaggtgcagatatgtatgatgcagctgttgcattggctgactgcatgattgaacttggtattgcgatagatgggggcaaggacagtctttccatggcagctcaatgtgatggtgaagtcgtcaaggctcctggaaatctggtcatcagtacttacgtgacatgtcctgatataacattgacagtaacccctgatttgaagctcggtaaggatggagttcttctgcatattgatcttgctaaaggaaatcgccgtctcggtggttctgctcttgcacaagcatttgatcaaattggaaatgattgcccggacattgatgatgttctgtacttgaagaaggtatttgaggccattcaggaattgctcagtcaacgtcttatttcagcaggtcatgacataagcgacggtggccttattgtgagtgttcttgagatggcatttgctggtaactgtggttttaagctcgacatagacttagaagataggagccttattgaaggactttttgcagaggagcttggcctcattattgaagtacactcaaaatatctcaacattgtgaagcaaaagcttgaaatagcaggcatttccgctaatgttattggagaagttactacttcaccagaaatagaagtttttgttgatggtaatctgcatctcaaggaaaaaacttcggatctcagggatctgtgggaggaaacaagcttccagcttgaggagctacaacgtctgaaatcttgtgtcaaacttgagaaagaaggactaaaatgcaggacatcaccatcatggtctctgtcttttacccccaaattcacagatgggaaactgctgactgcttcctcgaaaccaaaggttgccatcattcgtgaagaagggagcaatggggacagggagatggctgctgcattccacgctgctggatttgaaccatgggatattacaatgtcagacctcttggctgggaagtcttctctcaaggagttccgtgggattgcgtttgttggtggtttcagctatgcagatgtgctggattcagcgaaaggctgggctgcatcaatcaggtttaaccaacccctcattcagcaattccaggacttctaccataggccagacacatttagccttggagtatgtaatggttgtcagcttatggctcttcttggctgggtgccaggaccacgtgttggaggttctcttggtacaggtggagatatgtcccagccgagatttattcacaatgaatctggtcgttttgagtgccggtttaccagtgtgtccattggcgattctcctgctattatgttcaaagggatggaaggttccaccttgggtgtttggagtgctcatggcgagggaagagctttcttcccagatgaaaatgttctagctactgttgtgaagtctaatctggttcctgtgcggtattgtgatgattctaacaatattactgagacctatcccttcaatcctaatggttctccactaggtatagcagccctttgctcacctgatgggaggcacctggctatgatgccgcatccagagcgttgcttcatgatgtggcaatatccctggtatcccaaggaatggcaggttgagaagagtggccccagcccttggctgcgaatgttccagaatgctagagaatggtgttcgtag

SEQ ID NO: 4006 - protein, 1412 aa, Sorghum bicolor
  misc_feature: Ceres ANNOT ID no. 6034229
  misc_feature (533)..(691): Pfam Id: AIRS_C Pfam Desc: AIR synthase related protein, C-terminal domain
  misc_feature (929)..(1075): Pfam Id: AIRS_C Pfam Desc: AIR synthase related protein, C-terminal domain
  misc_feature (348)..(523): Pfam Id: AIRS Pfam Desc: AIR synthase related protein, N-terminal domain
  misc_feature (49)..(1410): NCBI GI: 145337526 NCBI Desc: catalytic [arabidopsis thaliana]
  misc_feature (122)..(1412): NCBI GI: 18071664 NCBI Desc: formylglycinamide ribonucleotide amidotransferase [vigna unguiculata]
  misc_feature (97)..(1412): NCBI GI: 27883937 NCBI Desc: phosphoribosylformylglycinamidine synthase [glycine max]
  misc_feature (97)..(1142): NCBI GI: 27883939 NCBI Desc: fgam synthase [glycine max]
  misc_feature (620)..(1411): NCBI GI: 115441519 NCBI Desc: os01g0888500 [oryza sativa (japonica cultivar-group)]
  misc_feature (88)..(1410): SWISSPROT Homolog: EC 6.3.5.3 Phosphoribosylformylglycinamidine synthase
MTASNLLRTEGFPGNMGKRCGLIPARSLGSRRLRMTQHCFHQQHICWPRLQRVMTRNIRLPSSPGAVASKGFDSPLVEKPDTALDVGIIHLYRIPFLQGSETMELLRKVKAKVSANIVDILTEQCFNIQLDNPLTPEKLSTLHWLLAETYEPEKLQTRSFLEDEESRNSCTVIVEVGPRMTFSTAFSTNAVSICKSLSLVEVTRLERSRRYLLCLEPGSDPLDESQLKEFTALVHDRMTECIYPNKLTSFQSDVVPEPVHVVPVIERGEKALEEINVRMGLAFDKQDIDYYTHLFRDDIKRNPTTVELFDIAQSNSEHSRHWFFNGKLVIDGEIMPATLFQLVKSPLKANPNNSVIGFKDNSSAIKGFPVNQLRPTIPGFTSPLSIIMRELDILFTAETHNFPCAVAPYPGAETGAGGRIRDTHATGKGSFVVASTAGYCVGNLRIDNSNAPWEDPSFSYPVNLASPLQILVDASDGASDYGNKFGEPLIQGYTRTFGMRLLNGERREWLKPIMFSGAIGQIDHAHISKDDPEIGMLVVKIGGPAYRIGMGGGAASSMVSGQNDAELDFNAVQRGDAEMAQKLYRVVRACAEMGESNPIISIHDQGAGGNCNVVKEIIYPKGAEIDIRSIVVGDHTLSVLEIWGAEYQEQDALLVKPESRSLLESLCERERVSMAVIGKIDGCGKIVLIDSAAVEHSKLNGLPPPTPVEELELEKVLGDMPQKTFEFRRVSQVTEPLDIAPGVTLLDALKRVLRLPSVCSKRFLTTKVDRCVTGLVAQQQTVGPLQLPLADVAVIAQTYTDLTGGACSIGEQPIKGLLNPKAMARLAVGEALTNLVWAKVTSLADVKASGNWMYAAKLDGEGADMYDAAVALADCMIELGIAIDGGKDSLSMAAQCDGEVVKAPGNLVISTYVTCPDITLTVTPDLKLGKDGVLLHIDLAKGNRRLGGSALAQAFDQIGNDCPDIDDVLYLKKVFEAIQELLSQRLISAGHDISDGGLIVSVLEMAFAGNCGFKLDIDLEDRSLIEGLFAEELGLIIEVHSKYLNIVKQKLEIAGISANVIGEVTTSPEIEVFVDGNLHLKEKTSDLRDLWEETSFQLEELQRLKSCVKLEKEGLKCRTSPSWSLSFTPKFTDGKLLTASSKPKVAIIREEGSNGDREMAAAFHAAGFEPWDITMSDLLAGKSSLKEFRGIAFVGGFSYADVLDSAKGWAASIRFNQPLIQQFQDFYHRPDTFSLGVCNGCQLMALLGWVPGPRVGGSLGTGGDMSQPRFIHNESGRFECRFTSVSIGDSPAIMFKGMEGSTLGVWSAHGEGRAFFPDENVLATVVKSNLVPVRYCDDSNNITETYPFNPNGSPLGIAALCSPDGRHLAMMPHPERCFMMWQYPWYPKEWQVEKSGPSPWLRMFQNAREWCS

SEQ ID NO: 4007 - DNA, 945 bp, Sorghum bicolor
  misc_feature: Ceres ANNOT ID no. 6034238
  misc_feature: Encodes the peptide sequence at SEQ ID NO 4008
  misc_feature: Down-regulated in shoot tissues in response to aminocyclopropane carboxylic treatment
  misc_feature: Up-regulated in root tissues in response to salicylic acid treatment
atggataggaaccaggaactggaagaggtggtcccaaatgacttggaccctcttcttgggagggagaacagggagtctgagtcatcggtggagctgtcaccgccacagccagcaactgtgagcccgccggagattgaggatgaagagactgacggctcttctgctgcgtgctgccgcatttgccttgaggctgagtctgagataggtgatgagctaatatcaccttgcatgtgcaagggaactcagcagttcgttcatcgttcttgccttgaccactggcggtctgttaaggaaggatttgcattttcacactgcacaacttgcaaagctcagtttcatcttcgagtggagacctgggaggataactcgtggcataaaatgaagttcaggatctttgttgcaagggatgttctactcgtctttcttgctgtacagcttactattgctattatcggtgcaattgcatactttctagacagggatggaagtttccggaacagcttcagcgatggttgggaccgcttcttgtcaaagcacccaataccattctattattgcataggtgttgtggttttctttgttctgcttggattctttgggctgattgtacactgctcatccttcaacgataaccaggatccatgcctggctgggtgccggaactgctgctatggttggggcatcctggactgcctgcctgcttccttggaggcatgctttgccctggttttggttttcatcgttgtgtttgctatccttggcatcgcctacggcttcctcgctgcaaccatggcggtccagaggatctggcagaggcattatcacatcctgacaaaaagggagttgacaaaggaatacgtggtggaagaccttcacggcaactacacggcgcctaagcttgatccggagcacgaggaacggctgaagatgctgaagcttctctag

SEQ ID NO: 4008 - protein, 314 aa, Sorghum bicolor
  misc_feature: Ceres ANNOT ID no. 6034238
  misc_feature (58)..(108): Pfam Id: zf-C3HC4 Pfam Desc: Zinc finger, C3HC4 type (RING finger)
  misc_feature (1)..(314): NCBI GI: 40253895 NCBI Desc: zinc finger (c3hc4-type ring finger) protein -like [oryza sativa (japonica cultivar-group)]
  misc_feature (12)..(314): NCBI GI: 140040744 NCBI Desc: zinc finger, ring-type [medicago truncatula]
  misc_feature (34)..(314): NCBI GI: 53791481 NCBI Desc: zinc finger (c3hc4-type ring finger) protein -like [oryza sativa (japonica cultivar-group)]
  misc_feature (47)..(203): NCBI GI: 41052575 NCBI Desc: zinc finger (c3hc4-type ring finger) protein-like [oryza sativa (japonica cultivar-group)]
  misc_feature (1)..(208): NCBI GI: 42734483 NCBI Desc: riken cdna 2900024d24 [mus musculus]
  misc_feature: Down-regulated in shoot tissues in response to aminocyclopropane carboxylic treatment
  misc_feature: Up-regulated in root tissues in response to salicylic acid treatment
MDRNQELEEVVPNDLDPLLGRENRESESSVELSPPQPATVSPPEIEDEETDGSSAACCRICLEAESEIGDELISPCMCKGTQQFVHRSCLDHWRSVKEGFAFSHCTTCKAQFHLRVETWEDNSWHKMKFRIFVARDVLLVFLAVQLTIAIIGAIAYFLDRDGSFRNSFSDGWDRFLSKHPIPFYYCIGVVVFFVLLGFFGLIVHCSSFNDNQDPCLAGCRNCCYGWGILDCLPASLEACFALVLVFIVVFAILGIAYGFLAATMAVQRIWQRHYHILTKRELTKEYVVEDLHGNYTAPKLDPEHEERLKMLKLL

SEQ ID NO: 4009 - DNA, 2991 bp, Sorghum bicolor
  misc_feature: Ceres ANNOT ID no. 6034244
  misc_feature: Encodes the peptide sequence at SEQ ID NO 4010
atgggggtgggaggcggaggggaggccgccgcggcgtcggcggcgccggcggaggaggcggcggcggcagggaaggatggggaggagggtacccggtggaccatgaaggagaagctgatcgccgctgcggtgctgctgtggatgctggtggccgcgacgatcggggtgttcctgcactggagcatccgccacgcggcactgcgcaaggaggaggaggggctcgtcagcatgtgcgaggagcgcgcgcgcatgctgcaggaccagttcgccgtctccgtcaaccacgtccacgccctcgccatcctcgtcgccaccttccactacgagaagcacccgcccgcgctcgaccaggacacgttcgcggagtacaccgccaggacgtcgttcgagcggccgctactgagcggggtggcgtacgcgcagcgggtggagcatgccgacagggagggcttcgagcgccagcaggggtggatcatcaagacgatgaagcacgagccgtccccggtgcaggatgagtacgcgccggtcgtctactcgcaggagaccgtctcctacattgaggggctcgacatgatgtccggcgaggaggaccgtgagaacattttgaggtcaagagcatcggggaaggcagttcttacgagaccattccggctcatgtcgaatcacctgggtgtcgtattgacttttcctgtctatcatgtggatcttcctcctgatgccaaggaggaggaacgtgttgctgccactgcaggataccttgggggatcatttgatgtagaatcattagtggaaaatttgttgaggcagcttgctggcaatcaggaattggtggtaaatgtttatgatgtcacaaacagttcagaccctcttgtcatgtatggatcggaagttcctcttggcatcccctcaccatggcacatctgcatgctagattttggcgatccgttcagaaagcatcatatggtttgcagatacagaaacaagcctcctctcccatggtctgcaatttctacgccatctggtgtctttgtcatatgtatgcttgtggggtacattgtgtttgccgcttggagtcgttatgataatgttaaggaagattgccggaaaatggaggagctgaaaaaacaggcagaagcagctgatgttgctaaatctcagttccttgcaactgtttctcatgagatcagaacgcccatgaatggagttctaggaatgcttgatatgctgttagacactgacctaacgtcaactcagagggattttgcacaaacagctcaagtctgtggaaaggctttaatatcgctaatcaatgaagtgcttgacagagcgaaaattgaagccggaaagttggatcttgagtctgtaccatttgatctgagatccatccttgatgatgtcatcgcattattttcttcaaagtcaagagagaagggaattgagcttgctgtatatgtctctgaacgagttcctgaaatcttgttgggtgatcctggaaggtttcgacagataattacaaatttagtgggcaactcaattaagttcacagaacggggacatatttttgtacaagttcatctggcagatcactcaaatcttgcaacagaatccgaagttgagccagtggctaatgggatgaatggacataaagatgagaaaactgctgtagcaaccggtgtttctctcaacacgctaagtggttttgaagctgctgatagccgaaacagttgggaaaacttcaagcttttgctttcttatgagaaaaatgagatgccctatgaaagtgtatctgataaagttactcttgtagtaagtgtggaagatacaggaataggtataccattggatgcccaagccaaggtgttcacacctttcatgcaggctgatagttcgacttccaggacatatggtggtactggaattggattgagcatcagccaatgtcttgttgaactaatgggtggtcagataaactttgtcagccgaccacaagttgggagtacattcacatttactgcagttctccaaagatgtgacagaagcgctattggtgacagtaagcctgttatgttgcaccctcttccatccagtttcaaaggtttatctgcactattggttgatacaagaccagtaagagctactgtaactaagtatcacttgcaaaggctgggaattgcctgcgatgttgttgctaccattgatttggctcttggtgtgctgtcagggcgaaatggcagttccctaaccagcacgaagcaaccatgcatgttattgattgagagtgattcatggggcttcaagattgatgtttctttaagatctagactcctggagatgaagcaggatggtcacacaaatctattacccaaaattatccttcttgcagctgcagaatcgagcaaactcaaagcacactatgcagttgattctgtgatcacgaagcctctgaaagcaagcgcacttgcagcttgtctattccaaacacttggtatcacacagtcaagcaatgagagacgcgacaactcaggttctcttcacgggttgcttcttggcaagaacatattggtggttgatgataacaaggtaaatcttagagtggctgctggcacattaaagaaatttggagcaaaggtggagtgcgtggagagtggaaaagatgctctcgccctcctacaagtcccatataagttccacctttgtctcatggacattcagatgcccgaaatggatgggtttgaggcgacccaacaaataaggacaatggaagcgaaggcaaatgagcaggcagtcgcctgtgacgattcagaaacagacggcgcgacaagggcggcaaaatggcacctgcctgttcttgcaatgaccgccgatgtcatccaggctacccatgaagagtgcacgaagtacgggatggatgggtacgtcacaaagcccttcgaggagaagcaactctttcaggcgttgcagaagttcttggaccccggcatgtccagctaa

SEQ ID NO: 4010 - protein, 996 aa, Sorghum bicolor
  misc_feature: Ceres ANNOT ID no. 6034244
  misc_feature (111)..(322): Pfam Id: CHASE Pfam Desc: CHASE domain
  misc_feature (495)..(675): Pfam Id: HATPase_c Pfam Desc: Histidine kinase-, DNA gyrase B-, and HSP90-like ATPase
  misc_feature (851)..(987): Pfam Id: Response_reg Pfam Desc: Response regulator receiver domain
  misc_feature (383)..(448): Pfam Id: HisKA Pfam Desc: His Kinase A (phosphoacceptor) domain
  misc_feature (1)..(996): NCBI GI: 89242033 NCBI Desc: histidine kinase [zea mays]
  misc_feature (1)..(996): NCBI GI: 89242035 NCBI Desc: histidine kinase [zea mays]
  misc_feature (1)..(995): NCBI GI: 89242037 NCBI Desc: histidine kinase [zea mays]
  misc_feature (1)..(996): NCBI GI: 118790698 NCBI Desc: tpa: histidine kinase [oryza sativa (japonica cultivar-group)]
  misc_feature (42)..(990): NCBI GI: 118790708 NCBI Desc: tpa: histidine kinase [oryza sativa (japonica cultivar-group)]
  misc_feature: The sequence is a functional homolog of SEQ ID NO 5 in US patent 7026530
MGVGGGGEAAAASAAPAEEAAAAGKDGEEGTRWTMKEKLIAAAVLLWMLVAATIGVFLHWSIRHAALRKEEEGLVSMCEERARMLQDQFAVSVNHVHALAILVATFHYEKHPPALDQDTFAEYTARTSFERPLLSGVAYAQRVEHADREGFERQQGWIIKTMKHEPSPVQDEYAPVVYSQETVSYIEGLDMMSGEEDRENILRSRASGKAVLTRPFRLMSNHLGVVLTFPVYHVDLPPDAKEEERVAATAGYLGGSFDVESLVENLLRQLAGNQELVVNVYDVTNSSDPLVMYGSEVPLGIPSPWHICMLDFGDPFRKHHMVCRYRNKPPLPWSAISTPSGVFVICMLVGYIVFAAWSRYDNVKEDCRKMEELKKQAEAADVAKSQFLATVSHEIRTPMNGVLGMLDMLLDTDLTSTQRDFAQTAQVCGKALISLINEVLDRAKIEAGKLDLESVPFDLRSILDDVIALFSSKSREKGIELAVYVSERVPEILLGDPGRFRQIITNLVGNSIKFTERGHIFVQVHLADHSNLATESEVEPVANGMNGHKDEKTAVATGVSLNTLSGFEAADSRNSWENFKLLLSYEKNEMPYESVSDKVTLVVSVEDTGIGIPLDAQAKVFTPFMQADSSTSRTYGGTGIGLSISQCLVELMGGQINFVSRPQVGSTFTFTAVLQRCDRSAIGDSKPVMLHPLPSSFKGLSALLVDTRPVRATVTKYHLQRLGIACDVVATIDLALGVLSGRNGSSLTSTKQPCMLLIESDSWGFKIDVSLRSRLLEMKQDGHTNLLPKIILLAAAESSKLKAHYAVDSVITKPLKASALAACLFQTLGITQSSNERRDNSGSLHGLLLGKNILVVDDNKVNLRVAAGTLKKFGAKVECVESGKDALALLQVPYKFHLCLMDIQMPEMDGFEATQQIRTMEAKANEQAVACDDSETDGATRAAKWHLPVLAMTADVIQATHEECTKYGMDGYVTKPFEEKQLFQALQKFLDPGMSS

SEQ ID NO: 4011 - DNA, 1686 bp, Sorghum bicolor
  misc_feature: Ceres ANNOT ID no. 6034247
  misc_feature: Encodes the peptide sequence at SEQ ID NO 4012
atggctgccgacgccgccgccgcggcgatggccgcggcttccctctgcgacgaccttgagcccgccaccgcgcgcacccgcatccgtgatgtccttgccgcaggaaccgcgcgtgccggggaccgcgtcgtggtcggggggtgggtccggacgggccgggagcaggggaagggttccttcgccttcctggagctcagcgacggctcctgcgccgccacgcttcaggtcatcgtcgacgccgccgtgcacccgctcgcgcgcctcaccgccaccgggacctccgtgctcgtcgagggcgacatcaaggagccgcccgaggggaccaagcagaacgtcgagctcaaggtcagccgcgtgcttgaggtcggcgaggtcgatgccgccgtctacccgctgcccaagggcaaggtcaaactcacgctcgagaaactcagggacgtcgttcatctccgttcgcgcaccaacacgattggagcggttgctaggattaggcaccagttagcctatgcgtcacacactttcttcgatgagaatggatttctctatgtacatacaccaataataactacaagtgactgtgaaggtgctggtgagatgttccaagtgacaactctgtttagtcaggctgaaaaaactgagaaggaattgagagagaaccctgcaccatctgattctgaaattgaggcagctaaatttcttgtcaaggaaagaggtgatgcagtcgcacagcttaaagctgcaaaagccagcaaacaaaagatatcagctgctgttgatgagctaaatagggcaaaggaaattgtttcaaaactggaggagaggtccaagttaaagcctgggattccactcagggatgatggttcaatagcttttgaaaatgacttcttcaagcgtcaagcttttttgacagtatctggacagcttcaggtggagacatatgcatgtgctcttagtagcgtttatacctttggaccaacattccgggcagagaactcacatacatcacggcatttggcagagttttggatggttgaaccggaaatcgcattcgcaaacttgcaggatgacatgaactgtgcagaaaaatatgtacaatacctttgcaagtggctgcttgaccattgccgggaagatatggagtttatggtgaaaaattatgataagagtgcaattgaacgcctggagcttgtttcctcgactccttttgtgcggatttcgtatacaaaggctgtggagctcttgaaaaatgttacagacaagaagtttgataacaaagttgaatggggaattgatttagcctctgagcatgaaaggtatttaacagaggatatatttaagaagccagtgattgtctataactatccgaaaggaataaaggctttttatatgaggctcaatgatgatgacaagacggtggctgcaatggatgttcttgtgcctaaggtcggcgaattgattggtggaagccaaagggaggaacggttagatgttctgaaacagaggatacttgatgctggcttgcctttggaaccctatgaatggtacttggacctccgccgctttgggtctgtaaagcacagtggctttgggttgggttttgaaaggatgattctttttgcaaccggaatggagaacatcagagatgttatacccttcccaaggtacccagggagggctgatctgtga

SEQ ID NO: 4012 - protein, 561 aa, Sorghum bicolor
  misc_feature: Ceres ANNOT ID no. 6034247
  misc_feature (140)..(557): Pfam Id: tRNA-synt_2 Pfam Desc: tRNA synthetases class II (D, K and N)
  misc_feature (43)..(122): Pfam Id: tRNA_anti Pfam Desc: OB-fold nucleic acid binding domain
  misc_feature (35)..(561): NCBI GI: 92893958 NCBI Desc: aspartyl-trna synthetase, class iib; trna synthetase, class ii (d, k and n) [medicago truncatula]
  misc_feature (7)..(561): NCBI GI: 10176772 NCBI Desc: sync1 protein [arabidopsis thaliana]
  misc_feature (266)..(560): NCBI GI: 59798542 NCBI Desc: asparaginyl-trna synthetase (asparagine--trna ligase) (asnrs)
  misc_feature (281)..(560): NCBI GI: 126657196 NCBI Desc: asparaginyl-trna synthetase [cyanothece sp. ccy0110]
  misc_feature (281)..(560): NCBI GI: 19310458 NCBI Desc: at4g17300/dl4685w [arabidopsis thaliana]
  misc_feature (7)..(561): SWISSPROT Homolog: EC 6.1.1.22 Asparaginyl-tRNA synthetase, cytoplasmic 1
  misc_feature: Abnormal phyllotaxy, leaf number higher than wild-type
  misc_feature: Useful for making plants with modulated biomass
  misc_feature: GREAT-hit functional homolog of the protein sequence given in SEQ ID NO 13551
  misc_feature: Useful for making plants with modulated biomass
  misc_feature: Functional homolog of the protein sequence given in SEQ ID NO 13551
MAADAAAAAMAAASLCDDLEPATARTRIRDVLAAGTARAGDRVVVGGWVRTGREQGKGSFAFLELSDGSCAATLQVIVDAAVHPLARLTATGTSVLVEGDIKEPPEGTKQNVELKVSRVLEVGEVDAAVYPLPKGKVKLTLEKLRDVVHLRSRTNTIGAVARIRHQLAYASHTFFDENGFLYVHTPIITTSDCEGAGEMFQVTTLFSQAEKTEKELRENPAPSDSEIEAAKFLVKERGDAVAQLKAAKASKQKISAAVDELNRAKEIVSKLEERSKLKPGIPLRDDGSIAFENDFFKRQAFLTVSGQLQVETYACALSSVYTFGPTFRAENSHTSRHLAEFWMVEPEIAFANLQDDMNCAEKYVQYLCKWLLDHCREDMEFMVKNYDKSAIERLELVSSTPFVRISYTKAVELLKNVTDKKFDNKVEWGIDLASEHERYLTEDIFKKPVIVYNYPKGIKAFYMRLNDDDKTVAAMDVLVPKVGELIGGSQREERLDVLKQRILDAGLPLEPYEWYLDLRRFGSVKHSGFGLGFERMILFATGMENIRDVIPFPRYPGRADL

SEQ ID NO: 4013 - DNA, 819 bp, Sorghum bicolor; identical to SEQ ID NO: 15
  misc_feature: Ceres ANNOT ID no. 6034250
  misc_feature: Encodes the peptide sequence at SEQ ID NO 4014

SEQ ID NO: 4014 - protein, 272 aa, Sorghum bicolor; identical to SEQ ID NO: 16
  misc_feature: Ceres ANNOT ID no. 6034250
  misc_feature (78)..(268): Pfam Id: GATase Pfam Desc: Glutamine amidotransferase class-I
  misc_feature (97)..(251): Pfam Id: Peptidase_C26 Pfam Desc: Peptidase C26
  misc_feature (53)..(270): NCBI GI: 21594026 NCBI Desc: anthranilate synthase beta chain [arabidopsis thaliana]
  misc_feature (71)..(270): NCBI GI: 25403004 NCBI Desc: probable anthranilate synthase beta subunit [imported] - arabidopsis thaliana
  misc_feature (2)..(271): NCBI GI: 90265199 NCBI Desc: b0812a04.8 [oryza sativa (indica cultivar-group)]
  misc_feature (2)..(271): NCBI GI: 38567722 NCBI Desc: b1358b12.20 [oryza sativa (japonica cultivar-group)]
  misc_feature (2)..(271): NCBI GI: 115458822 NCBI Desc: os04g0463500 [oryza sativa (japonica cultivar-group)]
  misc_feature (77)..(269): SWISSPROT Homolog: EC 4.1.3.27 Anthranilate synthase component II
  misc_feature: Useful for making plants with altered carbon content
  misc_feature: GREAT-hit functional homolog of the protein sequence given in SEQ ID NO 13357
  misc_feature: Useful for making plants with altered carbon content
  misc_feature: Functional homolog of the protein sequence given in SEQ ID NO 13357
  misc_feature: The sequence is a functional homolog of SEQ ID NO. 469 in the 11/188,298 US application

SEQ ID NO: 4015 - DNA, 1113 bp, Sorghum bicolor
  misc_feature: Ceres ANNOT ID no. 6034251
  misc_feature: Encodes the peptide sequence at SEQ ID NO 4016
atggctgacgccgaggatatccagcccctcgtctgcgacaatggaaccggtatggtcaaggctgggttcgctggagatgacgccccgagggccgtcttccccagcatcgtggggcgcccgcgccacaccggtgtcatggtcgggatggggcagaaggacgcctacgtcggtgacgaggcgcagtccaagaggggtatcctgaccctcaagtaccccatcgagcacggaatcgtcagcaactgggacgatatggagaagatctggcatcacaccttctacaacgagctccgtgtggctcccgaggagcaccccgtcctcctcactgaggcgcccctgaaccccaaggctaaccgtgagaagatgacccagatcatgttcgagaccttcaacacccccgccatgtacgtcgccatccaggccgtcctctctctgtatgccagcggtcgtaccacagatggtgtcagccacactgtccccatctacgagggatacgccctcccccacgccatcctgcgtctcgacctggctggccgcgacctcaccgactacctcatgaagatcctgactgagcgcggctactccttcactaccactgctgagcgggaaattgtcagggacatgaaggagaagctcgcctacattgccctggactacgaccaggagatggagactgccaagaccagctcttccgtggagaagagctacgagcttcctgatggacaggtcatcaccattggcgctgagcgcttccgctgccctgaggtcctcttccagccatccttcattgggatggaagctgctggcattcacgagactacctacaactccatcatgaagtgcgacgtggatattaggaaggatctatatggcaacatcgtcctctctggtggtaccactatgttccctgggattgctgacaggatgagcaaggaaatcactgccttggctcctagcagcatgaagatcaaggtggttgctcctccagaaaggaagtacagtgtctggattggaggatccatcttggcatccctcagcaccttccagcagatgtggattgccaaggctgagtacgatgagtccggcccatccatcgtccacaggaaatgcttctaa

SEQ ID NO: 4016 - protein, 370 aa, Sorghum bicolor
  misc_feature: Ceres ANNOT ID no. 6034251
  misc_feature (4)..(370): Pfam Id: Actin Pfam Desc: Actin
  misc_feature (1)..(370): NCBI GI: 76800642 NCBI Desc: actin-1
  misc_feature (1)..(370): NCBI GI: 295885 NCBI Desc: actin [oryza sativa (indica cultivar-group)]
  misc_feature (1)..(370): NCBI GI: 1531672 NCBI Desc: actin [striga asiatica]
  misc_feature (1)..(370): NCBI GI: 7211789 NCBI Desc: actin 1 [avena nuda]
  misc_feature (1)..(370): NCBI GI: 1531674 NCBI Desc: actin [striga asiatica]
  misc_feature: The plant flowers significantly late compared to wild-type.
  misc_feature: The plant is abnormally small.
  misc_feature: Useful for making plants with modulated biomass
  misc_feature: Useful for making plants with modulated flowering time
  misc_feature: GREAT-hit functional homolog of the protein sequence given in SEQ ID NO 13060
  misc_feature: GREAT-hit functional homolog of the protein sequence given in SEQ ID NO 13142
  misc_feature: GREAT-hit functional homolog of the protein sequence given in SEQ ID NO 13143
  misc_feature: Useful for making plants with modulated biomass
  misc_feature: Useful for making plants with modulated flowering time
  misc_feature: Functional homolog of the protein sequence given in SEQ ID NO 13142
MADAEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNTPAMYVAIQAVLSLYASGRTTDGVSHTVPIYEGYALPHAILRLDLAGRDLTDYLMKILTERGYSFTTTAEREIVRDMKEKLAYIALDYDQEMETAKTSSSVEKSYELPDGQVITIGAERFRCPEVLFQPSFIGMEAAGIHETTYNSIMKCDVDIRKDLYGNIVLSGGTTMFPGIADRMSKEITALAPSSMKIKVVAPPERKYSVWIGGSILASLSTFQQMWIAKAEYDESGPSIVHRKCF

SEQ ID NO: 4017 - DNA, 705 bp, Sorghum bicolor; identical to SEQ ID NO: 17
  misc_feature: Ceres ANNOT ID no. 6034253
  misc_feature: Encodes the peptide sequence at SEQ ID NO 4018

SEQ ID NO: 4018 - protein, 234 aa, Sorghum bicolor; identical to SEQ ID NO: 18
  misc_feature: Ceres ANNOT ID no. 6034253
  misc_feature (9)..(66): Pfam Id: ZF-HD_dimer Pfam Desc: ZF-HD protein dimerisation region
  misc_feature (102)..(226): NCBI GI: 32480091 NCBI Desc: osjnbb0086g13.8 [oryza sativa (japonica cultivar-group)]
  misc_feature (102)..(226): NCBI GI: 116309869 NCBI Desc: h0823a09.8 [oryza sativa (indica cultivar-group)]
  misc_feature (102)..(187): NCBI GI: 5091602 NCBI Desc: 10a19i.6 [oryza sativa (japonica cultivar-group)]
  misc_feature (111)..(177): NCBI GI: 124359224 NCBI Desc: homeobox domain, zf-hd class; zf-hd homeobox protein cys/his-rich dimerisation region; homeodomain-like [medicago truncatula]
  misc_feature (103)..(204): NCBI GI: 13277220 NCBI Desc: zf-hd homeobox protein [flaveria bidentis]
  misc_feature: The sequence is a functional homolog of SEQ ID NO 102 in the 10/714,887US patent application
  misc_feature: The sequence is a functional homolog of SEQ ID NO 102 in the 11/435,388US patent application
  misc_feature: The sequence is a functional homolog of SEQ ID NO 106 in the 10/714,887US patent application
  misc_feature: The sequence is a functional homolog of SEQ ID NO 106 in the 11/435,388US patent application
  misc_feature: The sequence is a functional homolog of SEQ ID NO 112 in the 10/714,887US patent application
  misc_feature: The sequence is a functional homolog of SEQ ID NO 112 in the 11/435,388US patent application
  misc_feature: The sequence is a functional homolog of SEQ ID NO 124 in the 10/714,887US patent application
  misc_feature: The sequence is a functional homolog of SEQ ID NO 124 in the 11/435,388US patent application
  misc_feature: The sequence is a functional homolog of SEQ ID NO 60 in the 10/714,887US patent application
  misc_feature: The sequence is a functional homolog of SEQ ID NO 60 in the 11/435,388US patent application
  misc_feature: The sequence is a functional homolog of SEQ ID NO 66 in the 10/714,887US patent application
  misc_feature: The sequence is a functional homolog of SEQ ID NO 66 in the 11/435,388US patent application
  misc_feature: Useful for making plants with modulated growth and phenotype characteristics
  misc_feature: The sequence is a functional homolog of SEQ ID NO 102 in the 20060015972 US patent application
  misc_feature: The sequence is a functional homolog of SEQ ID NO 106 in the 20060015972 US patent application
  misc_feature: The sequence is a functional homolog of SEQ ID NO 112 in the 20060015972 US patent application
  misc_feature: The sequence is a functional homolog of SEQ ID NO 124 in the 20060015972 US patent application
  misc_feature: The sequence is a functional homolog of SEQ ID NO 60 in the 20060015972 US patent application
  misc_feature: The sequence is a functional homolog of SEQ ID NO 66 in the 20060015972 US patent application
  misc_feature: The sequence is a functional homolog of SEQ ID NO 124 in the 10/714,887 US patent application
  misc_feature: The sequence is a functional homolog of SEQ ID NO 124 in the 11/435,388 US patent application
  misc_feature: Useful for making plants with modulated low light sensitivity
  misc_feature: Functional homolog of the protein sequence given in SEQ ID NO 13756

SEQ ID NO: 4019 - DNA, 714 bp, Sorghum bicolor; identical to SEQ ID NO: 19
  misc_feature: Ceres ANNOT ID no. 6034254
  misc_feature: Encodes the peptide sequence at SEQ ID NO 4020

SEQ ID NO: 4020 - protein, 237 aa, Sorghum bicolor; identical to SEQ ID NO: 20
  misc_feature: Ceres ANNOT ID no. 6034254
  misc_feature (79)..(234): Pfam Id: CtaG_Cox11 Pfam Desc: Cytochrome c oxidase assembly protein CtaG / Cox11
  misc_feature (55)..(236): NCBI GI: 9857538 NCBI Desc: similar to cytochrome-c oxidase assembly protein [arabidopsis thaliana]
  misc_feature (30)..(236): NCBI GI: 145348616 NCBI Desc: cox 11/ctag family of cytochrome oxidase assembly protein-like protein [ostreococcus lucimarinus cce9901]
  misc_feature (57)..(236): NCBI GI: 11466506 NCBI Desc: component involved in haem biosynthesis [reclinomonas americana]
  misc_feature (3)..(236): NCBI GI: 24581944 NCBI Desc: cg31648-pa [drosophila melanogaster]
  misc_feature (42)..(236): NCBI GI: 60814946 NCBI Desc: cox11-like cytochrome c oxidase assembly protein [synthetic construct]

SEQ ID NO: 4021 - DNA, 720 bp, Sorghum bicolor
  misc_feature: Ceres ANNOT ID no. 6034276
  misc_feature: Encodes the peptide sequence at SEQ ID NO 4022
atgtgtacgaggggccactggagaccgtcagaggacgagaagctgaaagagctcgttgcgctgtacgggccgcacaactggaacgccatcgccgagaagcttcaagggagatcaggtaaaagctgcaggctgaggtggttcaatcagctggacccgaggatcaaccggagccccttctcggaggaagaggaggagctgctcctcgcctcccaccgcgtccacggcaaccggtgggccgtcatcgccaggctcttcccggggcgcaccgacaacgccgtcaagaaccactggcatgtgatcatggcgcggcggtgcagggagcggatgaggctctcaaacaggcgtggcggcggcgctgcaggtgcggctgtcgccggcgccggtgctgtggaagatgacaataaccctaggaacgccaagaagccgaggcctgatgcgagcagcatggcctccttgctagacaagtaccgaagagaattttccgtcgtcccgtttgccattaaccataatagcaaccagcaggactattgttcaactactaacgaagccgacacaaacaaatcagttgaattctatgattttctccaagtgaatgcgaactcgagcgacaccaagtgtggttcgagcattgaagagcaagaggagaaccgggatgatcaagctgaagggcaggtgcagttcatagatttcctggaggttggggcttctcatcgccagtga

SEQ ID NO: 4022 - protein, 239 aa, Sorghum bicolor
  misc_feature: Ceres ANNOT ID no. 6034276
  misc_feature (4)..(50): Pfam Id: Myb_DNA-binding Pfam Desc: Myb-like DNA-binding domain
  misc_feature (56)..(101): Pfam Id: Myb_DNA-binding Pfam Desc: Myb-like DNA-binding domain
  misc_feature (1)..(239): NCBI GI: 15220910 NCBI Desc: myb family transcription factor (myb52) [arabidopsis thaliana]
  misc_feature (1)..(239): NCBI GI: 9665072 NCBI Desc: contains similarity to myb homologue from arabidopsis thaliana gbd10936 and contains two myb-like dna-binding pf00249 domains
  misc_feature (1)..(170): NCBI GI: 31980093 NCBI Desc: myb transcription factor r2r3 type [populus tremula x populus tremuloides]
  misc_feature (1)..(115): NCBI GI: 140052980 NCBI Desc: homeodomain-related [medicago truncatula]
  misc_feature (1)..(115): NCBI GI: 145839475 NCBI Desc: r2r3-myb transcription factor myb3 [picea glauca]
  misc_feature: The sequence is a functional homolog of SEQ ID NO. 395 in the 11/188,298 US application
MCTRGHWRPSEDEKLKELVALYGPHNWNAIAEKLQGRSGKSCRLRWFNQLDPRINRSPFSEEEEELLLASHRVHGNRWAVIARLFPGRTDNAVKNHWHVIMARRCRERMRLSNRRGGGAAGAAVAGAGAVEDDNNPRNAKKPRPDASSMASLLDKYRREFSVVPFAINHNSNQQDYCSTTNEADTNKSVEFYDFLQVNANSSDTKCGSSIEEQEENRDDQAEGQVQFIDFLEVGASHRQ

SEQ ID NO: 4023 - DNA, 1407 bp, Sorghum bicolor
  misc_feature: Ceres ANNOT ID no. 6034294
  misc_feature: Encodes the peptide sequence at SEQ ID NO 4024
atggaggcggcgctagtggagcggctggaggcggcggtggcgcggctggaggccgccgtggcctccggcgcctcgatcgcgtcggcggcgccgcgcgacctcgacgctccggatgcccagtcggatccggccatcgtggcctacgacgagttcgtcgcggaggccgtcgggcggctcacggccgcggcggagaagatcggcgggaaggtgctggacgccaccaaggtgctcgccgaggcatttgccgtcgccaaggacctgctcgtacaggccaagcagctccagaaaccagcatcaatggctgatgcacagggcttcgttaagcccctcagtgatgttattgcaaaagcaactgcaatgaccgaaggaagtctcccagctttggcttgggtggcattcttaggaaaggactgtgcacatgtagaggaaagctggcagatggctgagttctacaataacaaggttcttgtggagtacagaaacaaagatcctgatcatgttgagtgggctaaagcattgaaggatctatacatgcccggtttgcgggattatgttaaaaagcattaccctcttggtcctgtctggggtcctgctggaggtgctgttgtttcccaaccaaaggctgctgctccaacacctaaagctccagcggttaaggctccccctccaccagctcctcctgccgcgcctctttttagcacagagaagtctccgaaatcttcaaagcctaaagaagggatgtctgctgtcttccaagagattagtacaaaacctgtgactgcagggttgcgaaaggttaccgatgatatgaagactaaaaaccgtgctgatagaagcggtgttgtcagcagtagtgttgctgctcctgctgcagctcctgaaaagacttctcgtgcggggtccttctctttcaaatctggaccccccaaactggaacttcagatgggacgcaaatgggtggttgagaatcaggttggcaagaagacccttgctattgatgattgtgattccagacaatctgtttatgtgtatggatgcaaggattctgtccttcaagtaaacggcaaggttaacaatatcactgttgacaaatgcactaaatttggaatcgttttcaaggatgttgtagcagcttttgaggttgtcaactgcaatggcgttgaggtccaatgtcagggtacggcaccgacaatatcaattgacaacacatctggatgtcaattatacttaagcaaagattcgttgggagcttcaattacttctgctaaatctagtgaaatcaatgtgatggttccaagtggtggcactgacggtgattgggtggagcatgcattgcctcagcagtacatccatagtttcaaggatgggcaattcaccacttcaccagtttcacactcgggagcgtaa

SEQ ID NO: 4024 - protein, 468 aa, Sorghum bicolor
  misc_feature: Ceres ANNOT ID no. 6034294
  misc_feature (306)..(466): Pfam Id: CAP_C Pfam Desc: DE Adenylate cyclase associated (CAP) C terminal
  misc_feature (1)..(293): Pfam Id: CAP_N Pfam Desc: Adenylate cyclase associated (CAP) N terminal
  misc_feature (1)..(468): NCBI GI: 62733576 NCBI Desc: cap protein [oryza sativa (japonica cultivar-group)]
  misc_feature (1)..(468): NCBI GI: 4126473 NCBI Desc: adenylyl cyclase associated protein [gossypium hirsutum]
  misc_feature (1)..(467): NCBI GI: 92885857 NCBI Desc: cap protein [medicago truncatula]
  misc_feature (3)..(467): NCBI GI: 37725381 NCBI Desc: cyclase-associated protein-1 [danio rerio]
  misc_feature (5)..(464): NCBI GI: 62896585 NCBI Desc: adenylyl cyclase-associated protein variant [homo sapiens]
MEAALVERLEAAVARLEAAVASGASIASAAPRDLDAPDAQSDPAIVAYDEFVAEAVGRLTAAAEKIGGKVLDATKVLAEAFAVAKDLLVQAKQLQKPASMADAQGFVKPLSDVIAKATAMTEGSLPALAWVAFLGKDCAHVEESWQMAEFYNNKVLVEYRNKDPDHVEWAKALKDLYMPGLRDYVKKHYPLGPVWGPAGGAVVSQPKAAAPTPKAPAVKAPPPPAPPAAPLFSTEKSPKSSKPKEGMSAVFQEISTKPVTAGLRKVTDDMKTKNRADRSGVVSSSVAAPAAAPEKTSRAGSFSFKSGPPKLELQMGRKWVVENQVGKKTLAIDDCDSRQSVYVYGCKDSVLQVNGKVNNITVDKCTKFGIVFKDVVAAFEVVNCNGVEVQCQGTAPTISIDNTSGCQLYLSKDSLGASITSAKSSEINVMVPSGGTDGDWVEHALPQQYIHSFKDGQFTTSPVSHSGA

SEQ ID NO: 4025 - DNA, 882 bp, Sorghum bicolor
  misc_feature: Ceres ANNOT ID no. 6034303
  misc_feature: Encodes the peptide sequence at SEQ ID NO 4026
atgtttaggagaaagcatgcctctcatttcgattccaacgatgctgatcagcgaaaagcaaagattgctgaactgaaatctgcacttgagcctttgtctgcccgtagtgagaagtactgcagcgaagcatgcttgacaagatatctagaagcccgtaactggaatgttgctaagtccagaaaaatgttggaagacagtctcaagtggagggcagcttacaggccagaagatatacgctggcctgaagtttctgttgaaggggaaacaggtaaaatgtacagggcaagttttcgagacagagaggggagaactattgtcgttatgagaccagcaaagcagaacacatcatcccatgaaggacagatacggttccttgcatactctttggagaatgcaatcctcagcctgcctgaaggccaagagaaaatggtctggctgatcgacttcacaggatggacaatggcaaatgctgtgcccataaagactgcccgagaaactgtaaacatcctgcagaatcattatcctgagaggctggccattgcatttctattcaatcccccaaaagtattcgaagcgttttggaaggttgtcaaatattttgttgacctgagaacgatcgagaaggtgaagtttgtttacccgaaggatgaagagagcatgaaggtcatccacaagttcattgacccggaagtccttcctattgagtttgggggcaagagcagtgtggtttacaaccatgaagagtactctgagttgatgaccaaagatgacactaaaatatccagcttttgggcaacagatgctcaaactgaccatgttaatcatgtcatcgatgggaccttggcccctgaggttacacctgttgtcaccgctaattgctga

SEQ ID NO: 4026 - protein, 293 aa, Sorghum bicolor
  misc_feature: Ceres ANNOT ID no. 6034303
  misc_feature (91)..(264): Pfam Id: CRAL_TRIO Pfam Desc: CRAL/TRIO domain
  misc_feature (8)..(78): Pfam Id: CRAL_TRIO_N Pfam Desc: CRAL/TRIO, N-terminus
  misc_feature (1)..(263): NCBI GI: 83283975 NCBI Desc: transporter-like protein [solanum tuberosum]
  misc_feature (4)..(287): NCBI GI: 92868927 NCBI Desc: cellular retinaldehyde-binding/triple function, n-terminal [medicago truncatula]
  misc_feature (21)..(275): NCBI GI: 30687745 NCBI Desc: sec14 cytosolic factor family protein / phosphoglyceride transfer family protein [arabidopsis thaliana]
  misc_feature (83)..(287): NCBI GI: 79321295 NCBI Desc: transporter [arabidopsis thaliana]
  misc_feature (62)..(269): NCBI GI: 145334241 NCBI Desc: sec14 cytosolic factor family protein / phosphoglyceride transfer family protein [arabidopsis thaliana]
MFRRKHASHFDSNDADQRKAKIAELKSALEPLSARSEKYCSEACLTRYLEARNWNVAKSRKMLEDSLKWRAAYRPEDIRWPEVSVEGETGKMYRASFRDREGRTIVVMRPAKQNTSSHEGQIRFLAYSLENAILSLPEGQEKMVWLIDFTGWTMANAVPIKTARETVNILQNHYPERLAIAFLFNPPKVFEAFWKVVKYFVDLRTIEKVKFVYPKDEESMKVIHKFIDPEVLPIEFGGKSSVVYNHEEYSELMTKDDTKISSFWATDAQTDHVNHVIDGTLAPEVTPVVTANC

SEQ ID NO: 4027 - DNA, 1254 bp, Sorghum bicolor
  misc_feature: Ceres ANNOT ID no. 6034322
  misc_feature: Encodes the peptide sequence at SEQ ID NO 4028
atgaagatcgcggtggaggggtgcatgcacggggagctggacatagtctacgacacgttgcgaaagctcgaggaggccgagggcgtcaagattgaccttcttctctgctgtggcgatttccaggctgttaggaatgagaacgatttacagtgtgttaacgtcccacaaaagtttcgtgccatgaactcattttggaagtactactcaggagaagcagttgctccgtacccaaccatctttatcggtggaaaccatgaagcatccaattatctgtgggaattgtactatggaggatgggcagcacctaacatatactttttggggtttgctggtgttgttaaatttggaaacatacgaattggtggactgtcaggaatatataacaaataccgttatcatttagggcactacgagaggcctccatacaatgaagatactatacggtctgtgtaccatgtaaggcattatgatgttctcaagctcatgcatttgaaggagccgctagatatattcttgtcacatgattggcctctgggcattactgagtatggaaactggcagaagctcattagtgtgaagaagcactttgaagaagaggttaacaacagaacactaggcagcaaacctgcagctgaattactgaacaaactaaaaccgccatactggttttcggggcaccttcactgtaagttccctgctatcatccagcatggaaagaatggacctacgacgaagtttcttgcacttgataagtgcattcctgggcgcaattttttgcaggttatagacattccatccaatccaggaccatatgaaatccagtatgatgaagaatggcttgcaataacacgaaagttcaacagtgttttccccttagcacggacacgatttactatgcgggatgaacagcttgacactcaagaagaccggcaatgggtcaggagcaagttgaatactagaggagctaagccttttgattttgtccagactgcaccatctttcaatccttccaatacaatatctaaacactccacaacagtttgctgcaggaacccacaaactgagtcttttcttcagcttctggaactcccatatctgctggactcatctaactctgagggtcattatctaaaaaaatctaactcggaggggtttggtagaaatgagtcaagctctcagcccggaaacacactagatgatgaagatatagagctaccagatgaagatgaagatgctttagaagatgatgaatga

SEQ ID NO: 4028 - protein, 417 aa, Sorghum bicolor
  misc_feature: Ceres ANNOT ID no. 6034322
  misc_feature (1)..(230): Pfam Id: Metallophos Pfam Desc: Calcineurin-like phosphoesterase
  misc_feature (236)..(367): Pfam Id: DBR1 Pfam Desc: Lariat debranching enzyme, C-terminal domain
  misc_feature (1)..(417): NCBI GI: 75254534 NCBI Desc: lariat debranching enzyme
  misc_feature (1)..(416): NCBI GI: 13877597 NCBI Desc: rna lariat debranching enzyme - like protein [arabidopsis thaliana]
  misc_feature (1)..(317): NCBI GI: 7270080 NCBI Desc: rna lariat debranching enzyme-like protein [arabidopsis thaliana]
  misc_feature (1)..(403): NCBI GI: 49118792 NCBI Desc: mgc80541 protein [xenopus laevis]
  misc_feature (1)..(408): NCBI GI: 41054477 NCBI Desc: debranching enzyme homolog 1 [danio rerio]
MKIAVEGCMHGELDIVYDTLRKLEEAEGVKIDLLLCCGDFQAVRNENDLQCVNVPQKFRAMNSFWKYYSGEAVAPYPTIFIGGNHEASNYLWELYYGGWAAPNIYFLGFAGVVKFGNIRIGGLSGIYNKYRYHLGHYERPPYNEDTIRSVYHVRHYDVLKLMHLKEPLDIFLSHDWPLGITEYGNWQKLISVKKHFEEEVNNRTLGSKPAAELLNKLKPPYWFSGHLHCKFPAIIQHGKNGPTTKFLALDKCIPGRNFLQVIDIPSNPGPYEIQYDEEWLAITRKFNSVFPLARTRFTMRDEQLDTQEDRQWVRSKLNTRGAKPFDFVQTAPSFNPSNTISKHSTTVCCRNPQTESFLQLLELPYLLDSSNSEGHYLKKSNSEGFGRNESSSQPGNTLDDEDIELPDEDEDALEDDE

SEQ ID NO: 4029 - DNA, 1083 bp, Sorghum bicolor
  misc_feature: Ceres ANNOT ID no. 6034341
  misc_feature: Encodes the peptide sequence at SEQ ID NO 4030
atggaggagatcacccaccactttggagttggcgcaagcagccacagccacggccacggccacggccagcaccaccatcaccaccacccatgggcatcctccctcagcgccgtcgttgcgccgccgccgcagcaaccgccgaccgcaggcctgccgctcaccctgaacacggtggcggccactgggaacagcggcgctagcggcaacccggtgctgcagcttgccaacggcggcagcctcctcgacgcgtgcgtcaacgtcaaggcgaagggcgagccctcgtcgtcgtctccctacgcaggcgacctcgaggccatcaaggccaagatcatctcgcacccacactactactcgctcctcgccgcctacctcgagtgcaagaaggtgggggcaccaccggatgtgtcggcgaggctgacggcgatggcgcaggagctggaggcgcggcagcgcacggcgctcagcggcctgggcgcagcgacggagccggagctggaccagttcatggaggcgtaccacgagatgctggtgaagttcaaggaggagctgacgaggccgctgcaggaggcgatggagttcatgcgaagggtggagtcgcagctcaactcgctttccatctctggaagatcgctgcgcaatatcctttcctctggctcttctgaggaggatcaagaaggtagcggaggagagacagagctccctgaagttgatgtccatggtgtagaccaagagctaaagcaccatctcctgaagaaatacagtggctatctaagctcgctcaagcaagaactgtcaaagaagaagaagaaagggaagctccctaaggaggctcgccagcagctccttagctggtgggatctgcactacaaatggccttacccctcagagactcagaaggtggcactggctgagtctaccgggcttgatctgaagcagatcaacaactggttcatcaaccagaggaagcggcactggaagccgtctgaggaaatgcaccacctgatgatggacgggtaccacaccaacactttcttcatggacggccatttcatcaacgatggcgggctctaccggcttggctag

SEQ ID NO: 4030 - protein, 360 aa, Sorghum bicolor
  misc_feature: Ceres ANNOT ID no. 6034341
  misc_feature (155)..(206): Pfam Id: KNOX2 Pfam Desc: KNOX2 domain
  misc_feature (104)..(148): Pfam Id: KNOX1 Pfam Desc: KNOX1 domain
  misc_feature (244)..(265): Pfam Id: ELK Pfam Desc: ELK domain
  misc_feature (8)..(355): NCBI GI: 85543290 NCBI Desc: knotted1 homeodomain protein [sorghum bicolor]
  misc_feature (1)..(360): NCBI GI: 32351475 NCBI Desc: homeobox transcription factor knotted1 [zea mays]
  misc_feature (8)..(355): NCBI GI: 85543296 NCBI Desc: knotted1 homeodomain protein [setaria italica]
  misc_feature (8)..(341): NCBI GI: 85543292 NCBI Desc: knotted1 homeodomain protein [panicum miliaceum]
  misc_feature (8)..(348): NCBI GI: 85543298 NCBI Desc: knotted1 homeodomain protein [chasmanthium latifolium]
  misc_feature: The plant is abnormally small.
  misc_feature: The plant produces a reduced number of seeds.
  misc_feature: There is no branching.
  misc_feature: Useful for biocontainment applications
  misc_feature: Useful for making plants with altered Lignin content
  misc_feature: Useful for making plants with modulated biomass
  misc_feature: GREAT-hit functional homolog of the protein sequence given in SEQ ID NO 12970
  misc_feature: Functional homolog of the protein sequence given in SEQ ID NO 13209
  misc_feature: Functional homolog of the protein sequence given in SEQ ID NO 13573
  misc_feature: Useful for biocontainment applications
  misc_feature: Useful for making plants with modulated biomass
  misc_feature: Functional homolog of the protein sequence given in SEQ ID NO 12970
  misc_feature: The sequence is a functional homolog of SEQ ID NO. 320 in the 11/188,298 US application
  misc_feature: The sequence is a functional homolog of SEQ ID NO. 499 in the 11/188,298 US application
MEEITHHFGVGASSHSHGHGHGQHHHHHHPWASSLSAVVAPPPQQPPTAGLPLTLNTVAATGNSGASGNPVLQLANGGSLLDACVNVKAKGEPSSSSPYAGDLEAIKAKIISHPHYYSLLAAYLECKKVGAPPDVSARLTAMAQELEARQRTALSGLGAATEPELDQFMEAYHEMLVKFKEELTRPLQEAMEFMRRVESQLNSLSISGRSLRNILSSGSSEEDQEGSGGETELPEVDVHGVDQELKHHLLKKYSGYLSSLKQELSKKKKKGKLPKEARQQLLSWWDLHYKWPYPSETQKVALAESTGLDLKQINNWFINQRKRHWKPSEEMHHLMMDGYHTNTFFMDGHFINDGGLYRLG

SEQ ID NO: 4031 - DNA, 1116 bp, Sorghum bicolor
  misc_feature: Ceres ANNOT ID no. 6034346
  misc_feature: Encodes the peptide sequence at SEQ ID NO 4032
atggaggatctctcggatcttggaggtcgcggccaccttggtgctgccaccagcaggcggcccgcgccgccatcattgccgtcgtcctcttcttctaaggtctcggtgcaagtctacaccgtcccaagcagctcagctgccggcggtggcggtgaagcagccgcccgagctcaaggcggtgttgcaccactgatccatgcgtcgtctagcgtcggtggccatggcggccgcgttgctgatcttctagatcccatcaaggccaagatcgtctcccaccctcgctaccaccgcctgctcgccgccttcttggactgccacaaggtcggctgcccgccggaagcggccgaggagatcgcggcggcggcgagggagcgcgaggcgtggcagcgcgcagccgtgggcgacgcgcacaatacaaggccggacccggagctcgaccagttcatggagtcctacagcgagctgctcgtggcgtggaaggaggagctgacccggccgctccgggaggccaaggagttcctgacgacggtggagttgcagcttaactccattaccaacaccgggccacccatgggagctctcatctcttcagctgcagaagataacactggactcgacatgtccgacgatgaccaagaagaaggcagcggcggcatggaggcagaagcagccctggggatcgacccttgctccgatgacaaggagctcaagaagcagctcctcaggaaatacagcgggtgtttgggcaacctgagaaaggagctgtgcaagaagaggaagaaaggcaagctccccaaggaggcccgtcagaagctgctcagctggtgggagctgcactatcgatggccctacccctcggagatggagaagatcgcactggcggagtcgacggggctggagcagaagcagatcaacaactggttcatcaaccagcggaagaggcactggaagccgtcggaggagatgcagttcgccgtcatggatgggttccacccaggggcgccgccgaacgccgccgcgttctacgtcgacgcacgcctcgtgggagcaacgccggcgatgttctatgcccggccggagcatggggctcatcatggcctctggcacaataattga

SEQ ID NO: 4032 - protein, 371 aa, Sorghum bicolor
  misc_feature: Ceres ANNOT ID no. 6034346
  misc_feature (83)..(127): Pfam Id: KNOX1 Pfam Desc: KNOX1 domain
  misc_feature (135)..(186): Pfam Id: KNOX2 Pfam Desc: KNOX2 domain
  misc_feature (235)..(256): Pfam Id: ELK Pfam Desc: ELK domain
  misc_feature (1)..(362): NCBI GI: 15667619 NCBI Desc: transcription factor osh3 [oryza sativa (indica cultivar-group)]
  misc_feature (1)..(362): NCBI GI: 115455081 NCBI Desc: os03g0727200 [oryza sativa (japonica cultivar-group)]
  misc_feature (1)..(362): NCBI GI: 5103723 NCBI Desc: knotted1-type homeobox protein osh3 [oryza sativa]
  misc_feature (82)..(349): NCBI GI: 1946218 NCBI Desc: kn1-like protein [malus x domestica]
  misc_feature (82)..(349): NCBI GI: 1946220 NCBI Desc: kn1-like protein [malus x domestica]
  misc_feature: The plant is abnormally small.
  misc_feature: The plant produces a reduced number of seeds.
  misc_feature: There is no branching.
  misc_feature: Useful for biocontainment applications
  misc_feature: Useful for making plants with altered Lignin content
  misc_feature: Useful for making plants with modulated biomass
  misc_feature: Functional homolog of the protein sequence given in SEQ ID NO 12970
  misc_feature: Functional homolog of the protein sequence given in SEQ ID NO 13209
  misc_feature: Functional homolog of the protein sequence given in SEQ ID NO 13573
  misc_feature: The sequence is a functional homolog of SEQ ID NO. 320 in the 11/188,298 US application
  misc_feature: The sequence is a functional homolog of SEQ ID NO. 499 in the 11/188,298 US application
MEDLSDLGGRGHLGAATSRRPAPPSLPSSSSSKVSVQVYTVPSSSAAGGGGEAAARAQGGVAPLIHASSSVGGHGGRVADLLDPIKAKIVSHPRYHRLLAAFLDCHKVGCPPEAAEEIAAAAREREAWQRAAVGDAHNTRPDPELDQFMESYSELLVAWKEELTRPLREAKEFLTTVELQLNSITNTGPPMGALISSAAEDNTGLDMSDDDQEEGSGGMEAEAALGIDPCSDDKELKKQLLRKYSGCLGNLRKELCKKRKKGKLPKEARQKLLSWWELHYRWPYPSEMEKIALAESTGLEQKQINNWFINQRKRHWKPSEEMQFAVMDGFHPGAPPNAAAFYVDARLVGATPAMFYARPEHGAHHGLWHNN

SEQ ID NO: 4033 - DNA, 735 bp, Sorghum bicolor
  misc_feature: Ceres ANNOT ID no. 6034357
  misc_feature: Encodes the peptide sequence at SEQ ID NO 4034
atggcctcgcatccgcacccgcaggaggataaatcagaccgccacagcgccggcgccggcgcgtcgagggagcaggagcggcggccgtccaaggcatggggaatcctcatcttcggcctcatcggcgtcaccaccgccagtttcgccattactcaagttcgcagaagcgtggactggttctacactcagttgaataaagtgcagacaacatcatcttggaggtatacaagtaatagctcaagtcgtggaagtttcagtgaggaaactaagaaaagatattatcagcgaatgcagcaggaatatgaagaggaacaagagagagttcaaagaataaggcatatgcaaagtgttttcaacagagagaggaataaatttagacgaggttatgaaagctggagggagaatggccctcctggtggctacaattacatccctcgggatgattggtattggcagactgatacttctcactcggaacataaaaatagacggacatacacaccggcgggacctagggtttatcctatgtcgcatcactatgcagttcttggtcttgacagatcacgtgcgacgccatatacagatgcagaagtgaagactgcttttagaacaaaagcgatggaagtccatcctgatcaaaatcaagatgatagagagggtgcagaagagaagttcaaggaggttgtcaagtcttacgaagcaattaaattggagagaaaaaatggtgtaagttga

SEQ ID NO: 4034 - protein, 244 aa, Sorghum bicolor
  misc_feature: Ceres ANNOT ID no. 6034357
  misc_feature (178)..(245): Pfam Id: DnaJ Pfam Desc: DnaJ domain
  misc_feature (25)..(240): NCBI GI: 18413065 NCBI Desc: dnaj heat shock n-terminal domain-containing protein [arabidopsis thaliana]
  misc_feature (9)..(242): NCBI GI: 34395286 NCBI Desc: dnaj protein family-like protein [oryza sativa (japonica cultivar-group)]
  misc_feature (176)..(235): NCBI GI: 54887416 NCBI Desc: dnajb10 protein [mus musculus]
  misc_feature (176)..(243): NCBI GI: 118137586 NCBI Desc: chain a, solution structure of the j domain of dnaj homolog subfamily b member 8
  misc_feature (179)..(243): NCBI GI: 1943502 NCBI Desc: human hsp40 (hdj-1), nmr
MASHPHPQEDKSDRHSAGAGASREQERRPSKAWGILIFGLIGVTTASFAITQVRRSVDWFYTQLNKVQTTSSWRYTSNSSSRGSFSEETKKRYYQRMQQEYEEEQERVQRIRHMQSVFNRERNKFRRGYESWRENGPPGGYNYIPRDDWYWQTDTSHSEHKNRRTYTPAGPRVYPMSHHYAVLGLDRSRATPYTDAEVKTAFRTKAMEVHPDQNQDDREGAEEKFKEVVKSYEAIKLERKNGVS

SEQ ID NO: 4035 - DNA, 651 bp, Sorghum bicolor
  misc_feature: Ceres ANNOT ID no. 6034359
  misc_feature: Encodes the peptide sequence at SEQ ID NO 4036
atggccgagacggtgggcttcgcgagcggcgacgcggcggcgtggcgcgcggcgctggccgcgtacgaccgccgtctcgcggccctggacaaacccgacctcgtggcagtggactccttctaccgccacgacctccccgccctcctgcgctgccgtgacccggaccccttcctcgccaagcccgagctggtgcgcctcctccagtggaagctctcacgcggcaagtggagaccgaggctgatggatttcgtcaagggcttggacgacgccgtggtggagacggcgtcgcgcaaggcgttcgcggctttgcccgacctcagaagggccatcaccgagctcaccttgctcaagggagtcggacctgccactgcgtccgccgtgctcgccgcgtatgcacctgatgtcgcaccgttcatgtctgacgaggcgatgctagcagccttgggcaatgcaaaggagtacactctgaagcagtacctttcatttgctgacaaattgcaagcaaaagcaaaggaactgagcataggagaagaaagtttcacaccctcggatgttgagagagcactgtggagctcagcaattgcatccaagtcaccagcaagcggcaacccaaagagtgaatcgaagatgcatggcaagaggaaaagatga

SEQ ID NO: 4036 - protein, 216 aa, Sorghum bicolor
  misc_feature: Ceres ANNOT ID no. 6034359
  misc_feature (31)..(199): NCBI GI: 54643651 NCBI Desc: ga15368-pa [drosophila pseudoobscura]
  misc_feature (31)..(199): NCBI GI: 24641377 NCBI Desc: cg2446-pe, isoform e [drosophila melanogaster]
  misc_feature (7)..(197): NCBI GI: 48098060 NCBI Desc: similar to cg2446-pc [apis mellifera]
  misc_feature (7)..(174): NCBI GI: 116116214 NCBI Desc: ensangp00000025699 [anopheles gambiae str. pest]
  misc_feature (31)..(196): NCBI GI: 116128388 NCBI Desc: ensangp00000014029 [anopheles gambiae str. pest]
MAETVGFASGDAAAWRAALAAYDRRLAALDKPDLVAVDSFYRHDLPALLRCRDPDPFLAKPELVRLLQWKLSRGKWRPRLMDFVKGLDDAVVETASRKAFAALPDLRRAITELTLLKGVGPATASAVLAAYAPDVAPFMSDEAMLAALGNAKEYTLKQYLSFADKLQAKAKELSIGEESFTPSDVERALWSSAIASKSPASGNPKSESKMHGKRKR

SEQ ID NO: 4037 - DNA, 957 bp, Sorghum bicolor
  misc_feature: Ceres ANNOT ID no. 6034362
  misc_feature: Encodes the peptide sequence at SEQ ID NO 4038
atgtactcaggccagcaatctgatcaaggtcctagtgcaaatagtggcagagaattccccaaggcaaattggaattctttcacaatgcatcaaaagatggcttatagtggacagtatgggtttggatcttacggcatcggcttagaagatagaccgggattgtatcaatcttcatctggtacattgagtcaggacatccaaatgagcgatgagcatagtggaggtgtgaagaagaggaaaggaatggaggaccgtgtcacattgttgcataatgcaggtgatcaacaaacagaaggttcatctcagccagaaaggaactcaatggaagaggggaacagaaagatttcgcccaaaatgcaaagcaaagaagattcttctgatggtgatggtactaaagaggactatgttcatgtccgggcaaagcgaggccaagccactaacagccacagccttgcagaaagactgaggagaaagaagataagtgagagaatgaagcttcttcaagatcttgttcctggatgcaataagatcactggcaaggcagtcatgctcgatgagattatcaactatgtgcagtcattgcaacgacaagtcgagttcttgtcaatgaaacttgcaactgttaaccccgagcttggctttgacattgagcagatcatatccaaacagatgatgctttcacaagacagacatcttgctttctatggagtcgatccaggatcaagcagcctcactgctccattcaaccaaggaatcatgcagccagaaatgatgtgcaacatttccaatcctgttgatgttttgcacggaactattcacgacttgtcaacaatgaaccagataccttctatgtgggaaggagttcagaatatgcctcagatgaacttcaaccctgtggcagctgatagcggcaccaacaactctggtatctatatgatcctctttattctcttctga

SEQ ID NO: 4038 - protein, 318 aa, Sorghum bicolor
  misc_feature: Ceres ANNOT ID no. 6034362
  misc_feature (145)..(195): Pfam Id: HLH Pfam Desc: Helix-loop-helix DNA-binding domain
  misc_feature (75)..(304): NCBI GI: 125664136 NCBI Desc: basic helix-loop-helix protein [sesamum indicum]
  misc_feature (37)..(239): NCBI GI: 79340401 NCBI Desc: dna binding / transcription factor [arabidopsis thaliana]
  misc_feature (37)..(239): NCBI GI: 110738493 NCBI Desc: bhlh transcription factor like protein [arabidopsis thaliana]
  misc_feature (37)..(239): NCBI GI: 110741191 NCBI Desc: bhlh transcription factor like protein [arabidopsis thaliana]
  misc_feature (69)..(270): NCBI GI: 50726625 NCBI Desc: ta1 protein-like [oryza sativa (japonica cultivar-group)]
  misc_feature: The sequence is a functional homolog of SEQ ID NO 1916 in the 11/479,226US patent application
  misc_feature: The sequence is a functional homolog of SEQ ID NO 1929 in the 10/374,780US patent application
  misc_feature: The sequence is a functional homolog of SEQ ID NO 1930 in the 10/374,780US patent application
  misc_feature: The sequence is a functional homolog of SEQ ID NO 198 in the 10/714,887US patent application
  misc_feature: The sequence is a functional homolog of SEQ ID NO 198 in the 11/435,388US patent application
  misc_feature: Useful for making plants with modulated growth and phenotype characteristics
  misc_feature: The sequence is a functional homolog of SEQ ID NO 198 in the 20060015972 US patent application
  misc_feature: The sequence is a functional homolog of SEQ ID NO 1929 in the 20060162006 US patent application
  misc_feature: The sequence is a functional homolog of SEQ ID NO 1930 in the 20060162006 US patent application
  misc_feature: The sequence is a functional homolog of SEQ ID NO 1916 in the 20070022495 US patent application
  misc_feature: The sequence is a functional homolog of SEQ ID NO 1930 in the 10/374,780 US patent application
  misc_feature: The sequence is a functional homolog of SEQ ID NO 186 in the 10/714,887 US patent application
  misc_feature: The sequence is a functional homolog of SEQ ID NO 186 in the 11/435,388 US patent application
  misc_feature: The sequence is a functional homolog of SEQ ID NO. 414 in the 11/188,298 US application
MYSGQQSDQGPSANSGREFPKANWNSFTMHQKMAYSGQYGFGSYGIGLEDRPGLYQSSSGTLSQDIQMSDEHSGGVKKRKGMEDRVTLLHNAGDQQTEGSSQPERNSMEEGNRKISPKMQSKEDSSDGDGTKEDYVHVRAKRGQATNSHSLAERLRRKKISERMKLLQDLVPGCNKITGKAVMLDEIINYVQSLQRQVEFLSMKLATVNPELGFDIEQIISKQMMLSQDRHLAFYGVDPGSSSLTAPFNQGIMQPEMMCNISNPVDVLHGTIHDLSTMNQIPSMWEGVQNMPQMNFNPVAADSGTNNSGIYMILFILF

SEQ ID NO: 4039 - DNA, 1806 bp, Sorghum bicolor
  misc_feature: Ceres ANNOT ID no. 6034366
  misc_feature: Encodes the peptide sequence at SEQ ID NO 4040
atggacctgatgggcggggtggtgatggacgcgggcggcggcggcgccgcggagctcggcctgctcggaggcggcggatctagcagcaggctgctcaagcacgggcggggcaatgcggcggcgggaggagaggaccacggctggggcggcggcgttggcggcggcagggccaagcaggccaggacggctacagcgtccgtcgtcgctggggacgtggtggaggcggccaaggcggcggcggcgccgttcctgctgggctcctgcagccccggccacggcggcgagcagatgctcagcttctcgtccgccaccgccgccgcgtcctcgtgcgcctccaccgccgcggttgcagcggctgtggcggctgatggtggggcgatgccgctgtactacggaaccccggcctcttgctcaggattgagctcggtgagcttgagcaccagcatgcagggggcaatggcccgggtgaggggtcccttcacgccgtcccagtggatcgagctggagcaccaggccctgatctacaagtacctggctgcgaacagccccatacctcacagcctcctcatccccatcaggaggagcctcgcatcgtctccctacccgccttcctacttcggcacgagcacattggggtggggctctttccagctgggctactccggcaatgcggatctggagcccgggcggtgccgccggacggacggcaagaaatggcggtgctccagggacgcggtcgccgaccagaagtactgcgagcgacacatgaaccggggacgccatcgttcaagaaagcatgtggaaggccagcctggccatgccgcgaaagccatgtccgcggtggtggcggctgctgctacccagcctgctgctctggccggcgccggagctactgctgctggcctcactgtcaatcagcaccagcagccggcgaagagctatgccacgggtgcggctgatccttgctctctgcaatataacagggaactggtgaacaaacagaatgagagtgaaaacatgcaggactctgacaatctctcgatgctgacttccatgactacaggaaacacaggcagcgtgtttccattctccaaacaaaataatccttttgaagtgaccagctcaaggccagagtttggccttgtttcatcagactcactgatgagctctccacatagttccttggagaatgtgaatctgctcagctcacagagtctgaatgaacaccagagttcagccaccctgcagcactttgtggactggcccaggacacctgcccagggaggtctttcatggcccgaggcagaagacatgcaagctcagagatcacagctctcaatatctgctccaatggcatcctctgagctatcatcggcctccacatctcccatccatgagaagctgatgctatcacctcttaagctgagccgcgagtatagtccaactggtctcagcattgcagcaaacagagatgaagttagccagttagaagcaacctgggcgacaatgttccgcgattcttcaatgggcggtccgttaggggaggttttgaacaagaacggcaatgtggaagcaaaaaactgcctgtcggcacctctgaaccttctaaccgactactgggattcaagccacgggatggagtcatcccctgtgggagttttgcagaagaccaccttcggatcagtctccagcagcactgggagcagccctaggattgagaaccacggcgcttacgatggtatcagcaacctgcgggatgatctcggctcaattgtagtaagccatccgagtatccgctttgtgtga

SEQ ID NO: 4040 - protein, 601 aa, Sorghum bicolor
  misc_feature: Ceres ANNOT ID no. 6034366
  misc_feature (225)..(270): Pfam Id: WRC Pfam Desc: WRC
  misc_feature (158)..(194): Pfam Id: QLQ Pfam Desc: QLQ
  misc_feature (341)..(550): NCBI GI: 46367694 NCBI Desc: ta3 protein [oryza sativa (japonica cultivar-group)]
  misc_feature (102)..(369): NCBI GI: 51039843 NCBI Desc: tpa: growth-regulating factor 7 [oryza sativa (japonica cultivar-group)]
  misc_feature (128)..(301): NCBI GI: 38345778 NCBI Desc: osjnba0083n12.16 [oryza sativa (japonica cultivar-group)]
  misc_feature (128)..(301): NCBI GI: 115460326 NCBI Desc: os04g0600900 [oryza sativa (japonica cultivar-group)]
  misc_feature (128)..(301): NCBI GI: 116310919 NCBI Desc: b0403h10-osigba0105a11.9 [oryza sativa (indica cultivar-group)]
  misc_feature: The sequence is a functional homolog of SEQ ID NO 1781 in the 10/374,780US patent application
  misc_feature: The sequence is a functional homolog of SEQ ID NO 1806 in the 11/479,226US patent application
  misc_feature: The sequence is a functional homolog of SEQ ID NO 2618 in the 10/374,780US patent application
  misc_feature: The sequence is a functional homolog of SEQ ID NO 302 in the 10/225,066US patent application
  misc_feature: The sequence is a functional homolog of SEQ ID NO 452 in the 11/435,388US patent application
  misc_feature: The sequence is a functional homolog of SEQ ID NO 660 in the 11/435,388US patent application
  misc_feature: Useful for making plants with modulated growth and phenotype characteristics
  misc_feature: The sequence is a functional homolog of SEQ ID NO 302 in the 20050160493 US patent application
  misc_feature: The sequence is a functional homolog of SEQ ID NO 1781 in the 20060162006 US patent application
  misc_feature: The sequence is a functional homolog of SEQ ID NO 452 in the 20060272060 US patent application
  misc_feature: The sequence is a functional homolog of SEQ ID NO 660 in the 20060272060 US patent application
MDLMGGVVMDAGGGGAAELGLLGGGGSSSRLLKHGRGNAAAGGEDHGWGGGVGGGRAKQARTATASVVAGDVVEAAKAAAAPFLLGSCSPGHGGEQMLSFSSATAAASSCASTAAVAAAVAADGGAMPLYYGTPASCSGLSSVSLSTSMQGAMARVRGPFTPSQWIELEHQALIYKYLAANSPIPHSLLIPIRRSLASSPYPPSYFGTSTLGWGSFQLGYSGNADLEPGRCRRTDGKKWRCSRDAVADQKYCERHMNRGRHRSRKHVEGQPGHAAKAMSAVVAAAATQPAALAGAGATAAGLTVNQHQQPAKSYATGAADPCSLQYNRELVNKQNESENMQDSDNLSMLTSMTTGNTGSVFPFSKQNNPFEVTSSRPEFGLVSSDSLMSSPHSSLENVNLLSSQSLNEHQSSATLQHFVDWPRTPAQGGLSWPEAEDMQAQRSQLSISAPMASSELSSASTSPIHEKLMLSPLKLSREYSPTGLSIAANRDEVSQLEATWATMFRDSSMGGPLGEVLNKNGNVEAKNCLSAPLNLLTDYWDSSHGMESSPVGVLQKTTFGSVSSSTGSSPRIENHGAYDGISNLRDDLGSIVVSHPSIRFV

SEQ ID NO: 4041 - DNA, 1503 bp, Sorghum bicolor
  misc_feature: Ceres ANNOT ID no. 6034371
  misc_feature: Encodes the peptide sequence at SEQ ID NO 4042
atgaagtacgtctccgggccgtacttcgagccggacttcgacccgctcctcgaccgcttcggcactcccggggtcgtcgtcgacaatgagacgcgtgaggattgcacgctcgtcaaggttgacagcgtgaaccgcgacggagtgctgcttgagatggtgcagctgctcaccgacctcgacctcgtcatctacaagtcgtacatctcctccgacggcggctggctcatggatgtgttccacgtgacggaccagatcgggcgcaagctgacggacccgtcgctcccggaggtcatccaacgcgcgctggtgccgttccaccggccgggcaacggcccgtcgccgccgaggttcaccacgtgcctgggcaacgtggtcgggccgggcgggcccgacgtgtcggactgcgcggcgctcgagttcacggtgcacgaccgcgcggggctcctgtcgtccatcacgtccgtgctggtggacaacgggtgccacgtcgcgtccgggcaggcgtggacgcacaacggccgcgcggcgggcgtgctgtacgtgacgacgacggcggcggccaccaccgcggacggcgccggcgcggcggcgctgctcccgagccggtgggcgcgcatcgagcggctggtgaacgccgtggtggacgcgcgcgagaacgtgaccggggagcgccactgggtgtgcgtgtcggagcccgtgcagggccgcgtccacacggagcgccgcctgcaccagctcatgcacgacgaccgggactacgagtccggcccggcgccgacccccgtcgacgaggagctcttcagcatgggcgaaaaggcggcgaccgcgcggacggcccgccgcggcgccgtgacgcgcgtgtccatcgacagctgggaggagcggggctacgccgtcgtcaagatgacgagcagggaccggcccaggctgctcttcgacacggtgtgcgcgctcaccgacatgcagtacgtcgtcttccacgctaccgtcggatcccagggggctcttgccatccaggaatactacatccggcacaaggacgggcgcacggtggacagcagcgccgagcggcagaaggtctcccggtgcctcgtggccgcggtggagaggagggccactcatggcgtgagggtggaggtgcgcgccgccgaccggtcggggttgctatcggatttcaccagggtgctgcgggagcacggcctgtcgctgctgagagttgagctcaagaggcacaaggacgacgcctttggcatattttacctcgtcacggacacgggcggcgaggtgcgcgccgaggcattgcgcgctgtgcaggcgagggtcgccgagatggacatctcgctcgacgttgtcaaggaggcccctgggtggccgccggtgaggaagaccagcgtgccagccccgcccgtcgccgggccggagaggcccagaccttccctggggagccttctatggtcacaccttgggaagctctcgaataacttcaactacatcaggtcttga

SEQ ID NO: 4042 - protein, 500 aa, Sorghum bicolor
  misc_feature: Ceres ANNOT ID no. 6034371
  misc_feature (376)..(442): Pfam Id: ACT Pfam Desc: ACT domain
  misc_feature (1)..(495): NCBI GI: 15239390 NCBI Desc: act domain-containing protein [arabidopsis thaliana]
  misc_feature (287)..(448): NCBI GI: 20466646 NCBI Desc: translation factor ef-1 alpha-like protein [arabidopsis thaliana]
  misc_feature (287)..(448): NCBI GI: 22138104 NCBI Desc: acr7 [arabidopsis thaliana]
  misc_feature (287)..(455): NCBI GI: 92892048 NCBI Desc: protein f5o11.14 [imported] - arabidopsis thaliana [medicago truncatula]
  misc_feature (235)..(500): NCBI GI: 22138098 NCBI Desc: acr4 [arabidopsis thaliana]
MKYVSGPYFEPDFDPLLDRFGTPGVVVDNETREDCTLVKVDSVNRDGVLLEMVQLLTDLDLVIYKSYISSDGGWLMDVFHVTDQIGRKLTDPSLPEVIQRALVPFHRPGNGPSPPRFTTCLGNVVGPGGPDVSDCAALEFTVHDRAGLLSSITSVLVDNGCHVASGQAWTHNGRAAGVLYVTTTAAATTADGAGAAALLPSRWARIERLVNAVVDARENVTGERHWVCVSEPVQGRVHTERRLHQLMHDDRDYESGPAPTPVDEELFSMGEKAATARTARRGAVTRVSIDSWEERGYAVVKMTSRDRPRLLFDTVCALTDMQYVVFHATVGSQGALAIQEYYIRHKDGRTVDSSAERQKVSRCLVAAVERRATHGVRVEVRAADRSGLLSDFTRVLREHGLSLLRVELKRHKDDAFGIFYLVTDTGGEVRAEALRAVQARVAEMDISLDVVKEAPGWPPVRKTSVPAPPVAGPERPRPSLGSLLWSHLGKLSNNFNYIRS

SEQ ID NO: 4043 - DNA, 1041 bp, Sorghum bicolor
  misc_feature: Ceres ANNOT ID no. 6034373
  misc_feature: Encodes the peptide sequence at SEQ ID NO 4044
atgaggacacatgaacgagctgccaatttggctcttgctggactgagcttggcgccacttgtggtcaacgtaaacccaaatgtgaatgtggtattgacagcatgccttactgtctatgtgggttgctaccgttctgtcaagccaactccaccctctgagaccatgtccaaggagcatgctatgcggttcccctttgttggaagtgctatgcttttatcactgttccttctattcaagtttctctcaaaagacttggtcaatgctgtgctcactgcctactttttcattctaggcattgttgctctctctgcaacactgcttccttctataaaacgttttcttccaaaagagtggaatgataatctcatcgtctggcaggctccacttatcccgctctcagtggagttcacaaagtcccagattgttgcttcaatacctggatttttcttttgcttgtggtatgcgtcaaagaagcattggcttgcaaacaatgttctgggattggctttctgtattcaggggattgagatgctgtcattgggatcatttaaaattggagccattctcttgggtggactttttgtgtatgacattttctgggtgttcttcactccagttatggttagtgtggctaaatcttttgatgctccgataaagcttctgtttccaactgcagacgctgcacgtccattctccatgcttggccttggtgacattgtaatacctggtatatttgttgcacttgccttgcgctttgatgtctcaagaggtatcaagaaccgttacttcaacggtgcatttttgggatacgctgtgggtatgacagtgaccatcattgtaatgaactggtttcaagctgcacagcctgctctactatacctcgttccttgtgtgattggtttcgttgctgttcccagtctgtggtatggagaagtgaaacagctgcttgagtttgatgagtcaaaagttgaggctgaggaaggtggtgtagaagaagagcaagatgataatagttccaaaggcaacaaaaaggtggactag

SEQ ID NO: 4044 - protein, 346 aa, Sorghum bicolor
  misc_feature: Ceres ANNOT ID no. 6034373
  misc_feature (47)..(320): Pfam Id: Peptidase_A22B Pfam Desc: Signal peptide peptidase
  misc_feature (40)..(335): NCBI GI: 47938038 NCBI Desc: hm13 protein [danio rerio]
  misc_feature (29)..(346): NCBI GI: 20452374 NCBI Desc: minor histocompatibility antigen h13 isoform 1 [mus musculus]
  misc_feature (29)..(344): NCBI GI: 17647929 NCBI Desc: cg11840-pa [drosophila melanogaster]
  misc_feature (29)..(344): NCBI GI: 14286280 NCBI Desc: minor histocompatibility antigen 13, isoform 1 [homo sapiens]
  misc_feature (40)..(321): NCBI GI: 33417096 NCBI Desc: h13-prov protein [xenopus laevis]
MRTHERAANLALAGLSLAPLVVNVNPNVNVVLTACLTVYVGCYRSVKPTPPSETMSKEHAMRFPFVGSAMLLSLFLLFKFLSKDLVNAVLTAYFFILGIVALSATLLPSIKRFLPKEWNDNLIVWQAPLIPLSVEFTKSQIVASIPGFFFCLWYASKKHWLANNVLGLAFCIQGIEMLSLGSFKIGAILLGGLFVYDIFWVFFTPVMVSVAKSFDAPIKLLFPTADAARPFSMLGLGDIVIPGIFVALALRFDVSRGIKNRYFNGAFLGYAVGMTVTIIVMNWFQAAQPALLYLVPCVIGFVAVPSLWYGEVKQLLEFDESKVEAEEGGVEEEQDDNSSKGNKKVD

SEQ ID NO: 4045 - DNA, 1746 bp, Sorghum bicolor
  misc_feature: Ceres ANNOT ID no. 6034382
  misc_feature: Encodes the peptide sequence at SEQ ID NO 4046
atggtggatccgccgtctgtgctcacgctcctggtgaagaagggaccctgcgaggggaagaccctgcagcgccgcgccggcgccgcggcgctccgtgtcggccgcgttgccaagggcaaccacctgcccgtgggcgacgcgggcgcgtcgcagaggcatttctccgtcgagttcctcccgccgcctgcggcccggtgggccgttaccgatctaggctcctctaatggcaccctcctcaacggtacgcctctcgtagccactatccccgctccgctctccgacggggacctcatcaagatcggggagaccaccgtgctcgccgtctccatatcgacagatgcgggcccgggaccgggaccgggccccgccgcgactaggcgttccgcgcgcaacgcatcggcggcggcggaggaacagggtcccgcggtttctcgcagggccggacggaggaaggccggtgtggcggaagcccccaaagctgtgaatgaagtggaggaggaagctgcactcccgactcgccgaggcgggcggaagaaggccggtgcggcggaagcccccgaagctgggcatgaagtggaggaggaagctgcactcccgactcgccgaggcgggcggaagaaggccggggcgatggaagcccccgaagctgggaataaagtggaggaggaagctgcactcccgtctcgccgaggcgggctaaagaaggccgttgagcccgctggagtggagacggaagcggaagatgaagagggggaagcggcaataccgagccgtgtcaggtcaaggaaggctgcagtgacgttcgtccttccgccacagccacaaaatacgaggtcagcgagagctgctgcaaggagaggtgaggtgttggggtgcgaaaacgatgaggaggaagtggtgaggaccggaagggggcgaggacgggttacaagggcaagtgctaggaatcgtacggatgttactcccgaggaggaggaagaggagggtgaggtggctgtgaccagagatcaggaagggacaactgccgagggcaagggtgagatggtgccagctgggagaggacgagcaaagaggggcagaggaggccgaggccgaggaagggctacgagggcaagaacaaagaaggctgaggatgcaattgttgagaacgatgaaaatgagcaagaagaaaaggatatggctgatggcagagaacgagtggggagtccattgagggtcttggctgtgaatgactgttctgaagaggataaggtggcagctgaggatgacaagttggatggaaactcaaaggcatccgtggaggataagatggtggatgtggaggaggaggcgacattgacagagagggcaatagaggggagggctcagcatgctcctgctgacaatggtggtgtggaagaagaggaggtgaagaatttgagcaagggaggggaaactgaattagatcaggaattgagggaaaaggtgtcaccagggtcaaagctggatggtgttggagaagtggaaaagaatgacaatagggaagctattggtgccagtggagagaaaggccatgagggggagcgcaaaggaagacgcagattggaggatatgacattgggggagtggtttgttcagatggagaaataccttctagcaaagaatgcagaggctgctgaaaaggctatagctgaagtgcaagagaaacatcggcggttttgtgaacatgttaaatcgctcaatctcaaaaagagtcctgctccttga

SEQ ID NO: 4046 - protein, 581 aa, Sorghum bicolor
  misc_feature: Ceres ANNOT ID no. 6034382
  misc_feature (31)..(101): Pfam Id: FHA Pfam Desc: FHA domain
  misc_feature (88)..(565): NCBI GI: 20452161 NCBI Desc: retinitis pigmentosa gtpase regulator [canis familiaris]
  misc_feature (92)..(530): NCBI GI: 9837379 NCBI Desc: retinitis pigmentosa gtpase regulator [homo sapiens]
  misc_feature (106)..(561): NCBI GI: 61658797 NCBI Desc: rpgr [callithrix jacchus]
  misc_feature (92)..(530): NCBI GI: 78190492 NCBI Desc: retinitis pigmentosa gtpase regulator isoform c [homo sapiens]
  misc_feature (92)..(530): NCBI GI: 77403863 NCBI Desc: tpa: rpgr orf15 isoform [homo sapiens]
MVDPPSVLTLLVKKGPCEGKTLQRRAGAAALRVGRVAKGNHLPVGDAGASQRHFSVEFLPPPAARWAVTDLGSSNGTLLNGTPLVATIPAPLSDGDLIKIGETTVLAVSISTDAGPGPGPGPAATRRSARNASAAAEEQGPAVSRRAGRRKAGVAEAPKAVNEVEEEAALPTRRGGRKKAGAAEAPEAGHEVEEEAALPTRRGGRKKAGAMEAPEAGNKVEEEAALPSRRGGLKKAVEPAGVETEAEDEEGEAAIPSRVRSRKAAVTFVLPPQPQNTRSARAAARRGEVLGCENDEEEVVRTGRGRGRVTRASARNRTDVTPEEEEEEGEVAVTRDQEGTTAEGKGEMVPAGRGRAKRGRGGRGRGRATRARTKKAEDAIVENDENEQEEKDMADGRERVGSPLRVLAVNDCSEEDKVAAEDDKLDGNSKASVEDKMVDVEEEATLTERAIEGRAQHAPADNGGVEEEEVKNLSKGGETELDQELREKVSPGSKLDGVGEVEKNDNREAIGASGEKGHEGERKGRRRLEDMTLGEWFVQMEKYLLAKNAEAAEKAIAEVQEKHRRFCEHVKSLNLKKSPAP

SEQ ID NO: 4047 - DNA, 1047 bp, Sorghum bicolor
  misc_feature: Ceres ANNOT ID no. 6034396
  misc_feature: Encodes the peptide sequence at SEQ ID NO 4048
atgggggtgctgataccagcccggccggagcaatgcacattgagccgtgtcgttgccctcaccaccgtctgcgtcgtcatcgtggtttgcacgtacgtcgtcgcgtcgtcttctccggccggaggcgacgccgggaacgaggagaggttctacaacatatggcgccgccgatcatcggattttgcccccgacgatctggaggtggcgctgcgcggtgcagcgtacgcaaacaagacgctgatcctgaccatgctgaacgaggcgtacgcggaggagggcggcctgctggacctcttcctcgagagcctgagggaaggggacggcaccgagcagctcatcgaccacgtcctcttcgtggccatggaccagcaggccttccgccggtgcaggagcctcggcggcggcgtcaagtgctacctgctccgggccgtggacagccagcagggcgacctctcgtcggagcagctctacatgtcggacggcttcatacgcatgatgtggcgccggatccggttccttggcgacgtcctcaagcacggctacagcttcattttcactgatatggacgtgatgtggctgaggaatccgttcccgaagctggaccgcggtgagggcgaggacttgctgatcagctccgacaagttcaacggcgtgccgcacgactacgccggcaacgagctgaacacgggcttcttcttcgtggactcgaacgaccggacggtggcgctgttcgacgagtggcacgcggcgcggcgggtctcggcggggatgaaggagcaggacgtgctgaaccggatgaagcggcgcggcgcgttccgccggctcggcctgcgcgtgcgcgtcctggacacggcgcgcttcagcgggttctgccaggacagccgggacgcggcgcaggtggccaccgtgcacgccaactgctgccgcaccaagcgggccaaggtcgctgacctcaaggccgtccttcgcgccgccaagcggctcaacaggacgacgacggagcttaggtggccagcgcatcgcgagtgcgtaaaatcgtggtcgtga

SEQ ID NO: 4048 - protein, 348 aa, Sorghum bicolor
  misc_feature: Ceres ANNOT ID no. 6034396
  misc_feature (57)..(343): NCBI GI: 6691205 NCBI Desc: f1k23.11 [arabidopsis thaliana]
  misc_feature (66)..(343): NCBI GI: 23306127 NCBI Desc: putataive insb from escherichia coli [oryza sativa (japonica cultivar-group)]
  misc_feature (76)..(343): NCBI GI: 6063544 NCBI Desc: similar to arabidopsis thaliana chromosome 2, bac clone f5o4. (ac005936) [oryza sativa (japonica cultivar-group)]
  misc_feature (70)..(345): NCBI GI: 21536907 NCBI Desc: regulatory protein [arabidopsis thaliana]
  misc_feature (62)..(345): NCBI GI: 42407980 NCBI Desc: regulatory protein-like [oryza sativa (japonica cultivar-group)]
MGVLIPARPEQCTLSRVVALTTVCVVIVVCTYVVASSSPAGGDAGNEERFYNIWRRRSSDFAPDDLEVALRGAAYANKTLILTMLNEAYAEEGGLLDLFLESLREGDGTEQLIDHVLFVAMDQQAFRRCRSLGGGVKCYLLRAVDSQQGDLSSEQLYMSDGFIRMMWRRIRFLGDVLKHGYSFIFTDMDVMWLRNPFPKLDRGEGEDLLISSDKFNGVPHDYAGNELNTGFFFVDSNDRTVALFDEWHAARRVSAGMKEQDVLNRMKRRGAFRRLGLRVRVLDTARFSGFCQDSRDAAQVATVHANCCRTKRAKVADLKAVLRAAKRLNRTTTELRWPAHRECVKSWS

SEQ ID NO: 4049 - DNA, 2313 bp, Sorghum bicolor
  misc_feature: Ceres ANNOT ID no. 6034399
  misc_feature: Encodes the peptide sequence at SEQ ID NO 4050
  misc_feature: Down-regulated in shoot tissues in response to methyl jasmonate treatment
  misc_feature: Down-regulated in root tissues in response to methyl jasmonate treatment
  misc_feature: Down-regulated in shoot tissues in response to salicylic acid treatment
atgggcatagcggcgccaccgtaccagcagaccatcaccacgtacgtgagccaacccaccaagagcagcgcagcgatctccgcctccgcccgggcggctaccgcgacgtctatgtcccactcccagggattccaccaccaggccagcagcggcgtctacggctactcctctgatggcttcgaccgcccggactccagccaccaccagcaggatcaccatcagcagcagcacgagcacgtggcgcagcagagccgccgcgacaagctgagggtgcaggccggcttcgacccggccgccgccgccgggcacggcctgctccctatcgacggcggcgacgaccatggcggccccgggtccatatacgagcaagcggcggcggccgccggggcctccaacatgctctccgagatgttcaacttccccgcgccgccttcgggtccctccgccaccgagctgctggccagccagatgagcgccaactaccgcttcgggctacggcaacagcagcaggccgggcccggaggggtggccggcttgtccggcggcgacggcggttggttcgggaccggcgcggcgggtcgtgctggcttggtcctcggtggggccagcatgggctcgttaggtgaaacgtcgtccccgaagcagcagcaagcaggcagcatggctggcctggccaccgacccggccgccgcgatgcagctcttcctcatgaacccacagcagcagcagcagcagtctagatcgtcgccgacgtcgccgccgccgtcggacgtgcagcaccacgaggcgttccaggcgttcggcgccgccgccggggccgcgttcggtggcgccgggaccggcgtcgtggaaggccagggtctgtccctctcgctgtcgccgtcgctacagcagctggagatggcgaagcaggccgaggagctgagggtccgggacggcgtgctctacttcaaccggcagcaacagcagcagggcccgacgtcggtgcagcagcagcagctgccgatggcattgcacggccaggtcggcgcgctggggcagcagctgcacgtcggatacggccccgcgggcgtcgcgggcgtgctgcgcaactccaagtacacccgcgcggcgcaggagctcctggaggagttctgcagcgtcgggcgcgggcagatcaagggcggcgcgcggggcgggcgtggggcctcggcgtccaaccctaacgccagcaataagcagggcggcgcctccagctccggcgccgcgcagtcgccgtcgtccgcgtccaaggagccccctcaactgtcccccgccgaccggttcgagcaccagcgcaagaaggccaagctcatctccatgctcgacgaggtggaccgtcggtacaaccactactgcgaccagatgcagatggtggtgaacttcttcgactcggtgatggggttcggcgcggcgacgccgtacacggcgctggcgcagaaggccatgtcgcggcacttccggtgcctcaaggacgccatcgcggcgcagctgcggaccacgtgcgagctgctcggggagaaggacgccggcaccagctccgggctcaccaagggcgagaccccgcggctgcgcgccatcgaccagagcctccggcagcagcgcgccttccaccacatgggaatgatggagcaggaggcctggaggccccagcgcggcctccccgaacgctccgtcaacatcctccgatcctggctcttcgagcacttcctgcacccgtacccgagcgacgccgataagcacctgttggcgaggcagaccgggctgtccaggaaccaggtctccaactggttcatcaacgcccgtgtccggctatggaagcccatgatcgaggagatgtatcagcaggagtgcagggagctcgagggttcctcggccggcggcgggggcggccccgagtccggcaacgacccctccggcgccgacgactcgcactctccgaccaccaccggcgcagcgcagctcccgcaacagcaacagcagcacggcacaatgcccggagtgatgatgccccacaagcccgacccgagcgccgcgggtccttcggctgcggacgcggcgttcgtcgggatcgacccggtggagctcctcggcggcgacgcgcacgtgggcggtggcgcggacgacctgtacgggcggttcgagcccggggtgagggtgcggtacgggcccgctgcggcaggcgcggccgccggcgacgtgtctctgacgctaggcctgcagcacgccggcgccggcaacgccgggcccgacagcaccgggcggttctccttgagagactacagcggttgttga

SEQ ID NO: 4050 - protein, 770 aa, Sorghum bicolor
  misc_feature: Ceres ANNOT ID no. 6034399
  misc_feature (360)..(502): Pfam Id: POX Pfam Desc: Associated with HOX
  misc_feature (35)..(770): NCBI GI: 13752407 NCBI Desc: homeodomain protein jubel1 [hordeum vulgare]
  misc_feature (259)..(656): NCBI GI: 7239157 NCBI Desc: homeodomain protein [malus x domestica]
  misc_feature (188)..(767): NCBI GI: 13877513 NCBI Desc: bel1-like homeobox 4 [arabidopsis thaliana]
  misc_feature (231)..(643): NCBI GI: 22652119 NCBI Desc: bel1-related homeotic protein 13 [solanum tuberosum]
  misc_feature (70)..(628): NCBI GI: 15215857 NCBI Desc: at4g36870/c7a10_490 [arabidopsis thaliana]
  misc_feature: The plant is abnormally small.
  misc_feature: The sequence is a functional homolog of SEQ ID NO 1372 in the 11/479,226US patent application
  misc_feature: The sequence is a functional homolog of SEQ ID NO 18 in the 10/286,264US patent application
  misc_feature: The sequence is a functional homolog of SEQ ID NO 2330 in the 10/374,780US patent application
  misc_feature: The sequence is a functional homolog of SEQ ID NO 236 in the 10/225,068US patent application
  misc_feature: The sequence is a functional homolog of SEQ ID NO 2482 in the 10/374,780US patent application
  misc_feature: The sequence is a functional homolog of SEQ ID NO 268 in the 10/412,699US patent application
  misc_feature: The sequence is a functional homolog of SEQ ID NO 588 in the 11/479,226US patent application
  misc_feature: The sequence is a functional homolog of SEQ ID NO 638 in the 10/412,699US patent application
  misc_feature: The sequence is a functional homolog of SEQ ID NO 820 in the 10/225,066US patent application
  misc_feature: Useful for making plants with modulated biomass
  misc_feature: Useful for making plants with modulated growth and phenotype characteristics
  misc_feature: The sequence is a functional homolog of SEQ ID NO 18 in the 20030093837 US patent application
  misc_feature: The sequence is a functional homolog of SEQ ID NO 268 in the 20040045049 US patent application
  misc_feature: GREAT-hit functional homolog of the protein sequence given in SEQ ID NO 13567
  misc_feature: Down-regulated in shoot tissues in response to methyl jasmonate treatment
  misc_feature: Down-regulated in root tissues in response to methyl jasmonate treatment
  misc_feature: Down-regulated in shoot tissues in response to salicylic acid treatment
  misc_feature: The sequence is a functional homolog of SEQ ID NO. 320 in the 11/188,298 US application
  misc_feature: The sequence is a functional homolog of SEQ ID NO. 499 in the 11/188,298 US application
MGIAAPPYQQTITTYVSQPTKSSAAISASARAATATSMSHSQGFHHQASSGVYGYSSDGFDRPDSSHHQQDHHQQQHEHVAQQSRRDKLRVQAGFDPAAAAGHGLLPIDGGDDHGGPGSIYEQAAAAAGASNMLSEMFNFPAPPSGPSATELLASQMSANYRFGLRQQQQAGPGGVAGLSGGDGGWFGTGAAGRAGLVLGGASMGSLGETSSPKQQQAGSMAGLATDPAAAMQLFLMNPQQQQQQSRSSPTSPPPSDVQHHEAFQAFGAAAGAAFGGAGTGVVEGQGLSLSLSPSLQQLEMAKQAEELRVRDGVLYFNRQQQQQGPTSVQQQQLPMALHGQVGALGQQLHVGYGPAGVAGVLRNSKYTRAAQELLEEFCSVGRGQIKGGARGGRGASASNPNASNKQGGASSSGAAQSPSSASKEPPQLSPADRFEHQRKKAKLISMLDEVDRRYNHYCDQMQMVVNFFDSVMGFGAATPYTALAQKAMSRHFRCLKDAIAAQLRTTCELLGEKDAGTSSGLTKGETPRLRAIDQSLRQQRAFHHMGMMEQEAWRPQRGLPERSVNILRSWLFEHFLHPYPSDADKHLLARQTGLSRNQVSNWFINARVRLWKPMIEEMYQQECRELEGSSAGGGGGPESGNDPSGADDSHSPTTTGAAQLPQQQQQHGTMPGVMMPHKPDPSAAGPSAADAAFVGIDPVELLGGDAHVGGGADDLYGRFEPGVRVRYGPAAAGAAAGDVSLTLGLQHAGAGNAGPDSTGRFSLRDYSGC

SEQ ID NO: 4051 - DNA, 600 bp, Sorghum bicolor
  misc_feature: Ceres ANNOT ID no. 6034403
  misc_feature: Encodes the peptide sequence at SEQ ID NO 4052
atggcgcactcgcgccgccaccaccttctcctccccacggccatggccacggcgtgcttcctcctcgcgctctgcgccgcgccggcgccggcccacggcgcgcgcgtcctgacgccgggcggcgctggcgcgggcgcggtcaccaaggcgcagcagcagcagggcggcaccagcaacgcgacggcggcgggcgagtacctggcgccgcacaaccaggcgcgcgcggcggtgggcgtggccccgctgcggtggagcgcggacctggcgtcggcggccgcgaagacggtggcgcagcagcagcggcagggcgggtgcgcgttcgcggacatgggggccagcccctacggcgccaaccaggggtgggcgagctaccgcgcgcgccccgccgaggtggtggcgctgtgggtggcggaggggcggtactacacccacgccaacaacacgtgcgcctcggggcggcagtgcggcacgtacacgcaggtggtgtggcgccgcaccaccgacgtcgggtgcgcgcaggcaagctgcgccacgggcgccacgctcacgctctgcctgtacaacccgcacggcaacgtgcagggccagagcccctactag

SEQ ID NO: 4052 - protein, 199 aa, Sorghum bicolor
  misc_feature: Ceres ANNOT ID no. 6034403
  misc_feature (67)..(187): Pfam Id: SCP Pfam Desc: SCP-like extracellular protein
  misc_feature (57)..(199): NCBI GI: 1236785 NCBI Desc: sts14 [solanum tuberosum]
  misc_feature (62)..(199): NCBI GI: 3986149 NCBI Desc: pr-1 like protein [camellia sinensis]
  misc_feature (60)..(199): NCBI GI: 21554246 NCBI Desc: sts14 [arabidopsis thaliana]
  misc_feature (65)..(199): NCBI GI: 228409 NCBI Desc: pathogenesis-related protein 1
  misc_feature (65)..(199): NCBI GI: 75994059 NCBI Desc: pathogenesis-related protein 1 [zea mays subsp. parviglumis]
MAHSRRHHLLLPTAMATACFLLALCAAPAPAHGARVLTPGGAGAGAVTKAQQQQGGTSNATAAGEYLAPHNQARAAVGVAPLRWSADLASAAAKTVAQQQRQGGCAFADMGASPYGANQGWASYRARPAEVVALWVAEGRYYTHANNTCASGRQCGTYTQVVWRRTTDVGCAQASCATGATLTLCLYNPHGNVQGQSPY

SEQ ID NO: 4053 - DNA, 1524 bp, Sorghum bicolor
  misc_feature: Ceres ANNOT ID no. 6034424
  misc_feature: Encodes the peptide sequence at SEQ ID NO 4054
  misc_feature: Down-regulated in shoot tissues in response to methyl jasmonate treatment
atgggcctgcgcgtggccgccaccgcgccagctgcggccggcgtgcgcgtgctcggtggcggcgccgcgagcgtgaagccgcgaccgtgggtggcgctcggaggcaggagacgcctctccgtgcggatgtccgtcgccactaccgagaccaccacctccgccgccgccgccgtgggcgcctcggaggaccaggcgctggaggctaggaactccaggacggtggtagcggtcatcctcggcggtggcgccgggaccaggctgttcccgctgaccaagcgcagggccaagcccgcggtgccaattggcggcgcgtacaggctgatcgacgtgccgatgagcaactgcataaacagtgggatcaacaaggtgtacatcctcacgcagttcaactcgcaatccctcaaccgccacctctccagggcctacgattgcaccaatggcgtggccttcggagacggattcgtcgaggttctagcagcaacccagaggcctggatcggagggaaagaggtggtttcagggtactgctgatgcagttcggcagttcgactggcttttcgatgatgcaaaatctaaagacattgatgatgtgttgattctttctggtgaccatctctaccgaatggactacatggactttgttcagagtcatcggcaaagaggtgcaggcatcagcatctgttgtttgccaattgatgacagccgggcatctgattttggcctaatgaagatagacgacactgcaagagttatttcattcagtgagaagccaaaaggagacgaattaaaggcaatgcaagttgacactacagtgctaggcttatcaaaggaggaagcagaaaagaaaccttacatagcttcaatgggggtctatatttttaagaaagacatacttctaaaccttttaagatggcgttttcccactgcaaatgattttggttctgaaataattcctgctgcagcaaaagaaatcaatgtaaaggcttatcttttcaatgattactgggaagatattggaactattaagtccttctttgaggcaaaccttgctcttgctgaacagcctccaaggttcagtttctatgacgctgacaaaccaatgtacacatcacggagaaacctaccaccatctatggtcaacaatagtaagatcactgattcaatcatttcccacggatgtttcttggataactgcaggatagaacatagtgttgttggagttcgttctcggataggctccaatgtgcacctcaaggatactgtaatgcttggcgctgattattatgaaactgacgcggaaagaagagaattgcttgcagaaggaaatgttcctattgggatcggagagaatacaacgattcaaaagtgtatcatagacaagaatgcgaggatagggaagaatgtgataatctccaattctgaaggtgtagtggaagctgatagaacctccgaaggcttctacatccgaaccggcgtcactgtcgtactgaagaactcgataattgctgatggattggtcatatga

SEQ ID NO: 4054 - protein, 507 aa, Sorghum bicolor
  misc_feature: Ceres ANNOT ID no. 6034424
  misc_feature (75)..(354): Pfam Id: NTP_transferase Pfam Desc: Nucleotidyl transferase
  misc_feature (1)..(507): NCBI GI: 89277024 NCBI Desc: plastid adp-glucose pyrophosphorylase large subunit [zea mays]
  misc_feature (1)..(507): NCBI GI: 2105137 NCBI Desc: adp-glucose pyrophosphorylase large subunit [hordeum vulgare]
  misc_feature (1)..(507): NCBI GI: 89277026 NCBI Desc: plastid adp-glucose pyrophosphorylase large subunit [triticum aestivum]
  misc_feature (53)..(507): NCBI GI: 4586350 NCBI Desc: glucose-1-phosphate adenylyltransferase [arabidopsis thaliana]
  misc_feature (38)..(507): NCBI GI: 1840116 NCBI Desc: adp-glucose pyrophosphorylase large subunit [lycopersicon esculentum]
  misc_feature (53)..(507): SWISSPROT Homolog: EC 2.7.7.27 Glucose-1-phosphate adenylyltransferase large subunit 1, chloroplastprecursor
  misc_feature: The sequence is a functional homolog of SEQ ID NO 39 in US patent 7312378
  misc_feature: The sequence is a functional homolog of SEQ ID NO 38 in US patent 7312378
  misc_feature: The sequence is a functional homolog of SEQ ID NO 37 in US patent 7312378
  misc_feature: Down-regulated in shoot tissues in response to methyl jasmonate treatment
  misc_feature: The sequence is a functional homolog of SEQ ID NO. 451 in the 11/188,298 US application
MGLRVAATAPAAAGVRVLGGGAASVKPRPWVALGGRRRLSVRMSVATTETTTSAAAAVGASEDQALEARNSRTVVAVILGGGAGTRLFPLTKRRAKPAVPIGGAYRLIDVPMSNCINSGINKVYILTQFNSQSLNRHLSRAYDCTNGVAFGDGFVEVLAATQRPGSEGKRWFQGTADAVRQFDWLFDDAKSKDIDDVLILSGDHLYRMDYMDFVQSHRQRGAGISICCLPIDDSRASDFGLMKIDDTARVISFSEKPKGDELKAMQVDTTVLGLSKEEAEKKPYIASMGVYIFKKDILLNLLRWRFPTANDFGSEIIPAAAKEINVKAYLFNDYWEDIGTIKSFFEANLALAEQPPRFSFYDADKPMYTSRRNLPPSMVNNSKITDSIISHGCFLDNCRIEHSVVGVRSRIGSNVHLKDTVMLGADYYETDAERRELLAEGNVPIGIGENTTIQKCIIDKNARIGKNVIISNSEGVVEADRTSEGFYIRTGVTVVLKNSIIADGLVI

SEQ ID NO: 4055 - DNA, 2451 bp, Sorghum bicolor
  misc_feature: Ceres ANNOT ID no. 6034425
  misc_feature: Encodes the peptide sequence at SEQ ID NO 4056
  misc_feature: Down-regulated in shoot tissues in response to salicylic acid treatment
atggacaagctccgcgtccaccgctgcactggcggcgcggtcgagtggtccccctcccccatcgtcgcgctcgtcgcctctccttgcgcctcccaggtcgccgccgcgcgtgaagacggctcactcgagctctggctcgtctccccgggctccgtcggatggcacaaccagctcactatacaggggaatgccgaatcgaggatcacatcactggtgtgggggcggagaggaggtgaagctaccggcaggctgctctcgtccagcgttgatgggtcggtgtccgaatgggatctcttccacctgcagcaaaagactgttctagatactgttggagttccaatctggcaaatggccatcgagccttcagatgatgctaaaagtactgaaaataattgctcagagtctggtgtcaatggccatccaaaccaaaatgactccagtgattctgacttaagtaacattgatgatggtgacaactctgaggatgaagatggttctaccaacacaagatcttcatatcatgtgaatgatttccagcgattggctcttgcgtgtgatgatggttctgtacgactgtaccacgtgcctgaatcaggtgcattgacttactataggtctcttccaagagtgagcgggcggactctgagcgtgacgtggagtagtaacgccaaatttgtattttctggcagcagtgatggtttaatcagatgctgggattcaacatctttccatgaaatgtatcgtattactgctggattgggaggggctggtagctcaccggaactctgcatctggacactattgtttctgaggtgtggaactattgttagtggagatagtaccgggagcgtacagttttgggatagccaccatggaacacttctgcaagcccactcttatcataaaggcgacgtgaatgcactaacaactgtgcccagtgagaacagggtattttctgcagggtctgatgggcaggtgattttgtacaaaatgtcaaaggatgaatttggtgctactaaaaatgtggtcaaagagcaagttcacaaatgggtctatgtgggatatgtgagagctcacactcatgatgtaagggcattgaccatggctgtacctatctgtagagaagatacattacccgaggaaaaggtggtgaagattcgccggcgtgaaaaacatgaattcagttaccacaaatgggctcatcttggtgttccgatgcttatatctggtggtgatgacaccaaattgtttgcatattcggcaagagagtttactcagtttgcacctcataatttctgccctgcacctcaacgccctttgataaagttggctaaggatagcacagtcaatggagattctgtaatgcttgtccagtctccaaactggttggatgttttacttgtgacagttcagaacaagttgatgactccaagtacatcatcatctccaggagatgctacagtccgacaacttgctcgtttgaaaagcaaggggtccagaaaaatcatttctagtgctgcctctgccaacggaacacttttggcctattcagatggtgtgagaccctgcctctttgcactagggcataagggtggaaagaagtatacccttgataaattagagctaccaaaaggattgccctgttcacagagcatgctgtttactgttgactcatccaatttgatacttgctgggcgtaatggaaaaatatacatcattgacattgcaacaagagaaatttcaaatatatttcaccctacaagaaaggcagatggagcaaaaatctcaagagaatcacctgtaacgaagatgttcctgagtgcagatgggcaatggctggctgcggttaactgctatggggatatttatgtattcaaccttgaggtgcaaaggcaacactggttcatatcccgaatgaacggtggttctgttacatctggtggtttttgccccaagaacaacacacttgttgtaactacatctaaaaacgaggtgtatgtatttgatgtggaagcaaaacaactaggtgaatggtccaagcgatatacgcatcagttgcccagaagtttccaggaatttcctggagaggtcattggcctatcatttcctccgcaaagctcatcatcagttgttgtatacagtaccagggctatgtgctacattgattttggattgccagtcgttgaggatgttgacttgccaaatcgatcagctggaccagtagagaagtcagatgccaaaaagacaacaaaatcaaggcagaagcgtaaggctcatgatgaagagtctaaacaagagaaaaggaataacttcaacttctttgcgttcaaagaaccggtgctctttgttgggcacctactggacagttcaattttaatagtagagaagcgatggatggatgttgttgaaggtttcagcgcaccggttcatagacacatatacggcacatga

SEQ ID NO: 4056 - protein, 816 aa, Sorghum bicolor
  misc_feature: Ceres ANNOT ID no. 6034425
  misc_feature (292)..(330): Pfam Id: WD40 Pfam Desc: WD domain, G-beta repeat
  misc_feature (59)..(816): NCBI GI: 115455169 NCBI Desc: os03g0735100 [oryza sativa (japonica cultivar-group)]
  misc_feature (7)..(446): NCBI GI: 7267337 NCBI Desc: at4g07410 [arabidopsis thaliana]
  misc_feature (138)..(816): NCBI GI: 145332979 NCBI Desc: transducin family protein / wd-40 repeat family protein [arabidopsis thaliana]
  misc_feature (479)..(757): NCBI GI: 9802540 NCBI Desc: f17l21.26 [arabidopsis thaliana]
  misc_feature (138)..(815): NCBI GI: 144923045 NCBI Desc: quinoprotein amine dehydrogenase, beta chain-like; wd40-like [medicago truncatula]
  misc_feature: Down-regulated in shoot tissues in response to salicylic acid treatment
MDKLRVHRCTGGAVEWSPSPIVALVASPCASQVAAAREDGSLELWLVSPGSVGWHNQLTIQGNAESRITSLVWGRRGGEATGRLLSSSVDGSVSEWDLFHLQQKTVLDTVGVPIWQMAIEPSDDAKSTENNCSESGVNGHPNQNDSSDSDLSNIDDGDNSEDEDGSTNTRSSYHVNDFQRLALACDDGSVRLYHVPESGALTYYRSLPRVSGRTLSVTWSSNAKFVFSGSSDGLIRCWDSTSFHEMYRITAGLGGAGSSPELCIWTLLFLRCGTIVSGDSTGSVQFWDSHHGTLLQAHSYHKGDVNALTTVPSENRVFSAGSDGQVILYKMSKDEFGATKNVVKEQVHKWVYVGYVRAHTHDVRALTMAVPICREDTLPEEKVVKIRRREKHEFSYHKWAHLGVPMLISGGDDTKLFAYSAREFTQFAPHNFCPAPQRPLIKLAKDSTVNGDSVMLVQSPNWLDVLLVTVQNKLMTPSTSSSPGDATVRQLARLKSKGSRKIISSAASANGTLLAYSDGVRPCLFALGHKGGKKYTLDKLELPKGLPCSQSMLFTVDSSNLILAGRNGKIYIIDIATREISNIFHPTRKADGAKISRESPVTKMFLSADGQWLAAVNCYGDIYVFNLEVQRQHWFISRMNGGSVTSGGFCPKNNTLVVTTSKNEVYVFDVEAKQLGEWSKRYTHQLPRSFQEFPGEVIGLSFPPQSSSSVVVYSTRAMCYIDFGLPVVEDVDLPNRSAGPVEKSDAKKTTKSRQKRKAHDEESKQEKRNNFNFFAFKEPVLFVGHLLDSSILIVEKRWMDVVEGFSAPVHRHIYGT

SEQ ID NO: 4057 - DNA, 978 bp, Sorghum bicolor
  misc_feature: Ceres ANNOT ID no. 6034450
  misc_feature: Encodes the peptide sequence at SEQ ID NO 4058
atggctgatttccggacctccacccaacgggagaggtggatcttccagccgcacgatctgatggagaggtgggcggcggcaaaccagcgggctgttcagacccttgcgcagtatgggacgacgcggcttagtgtggacctgcttgatggctcggtctcctacccagagcccgcaccggatcatgttgagggtagttcgggtataaaacctctgtcttacgaagaggagcaattgacacgggtattttacgagcagaaaattcaggaagtatgtgctgcattcaagttccctcacaaaatccaggctacagcaataatatatttcaagagattctatttacaatggtctgtaatggagcatcacccaaagttaacatgtgtatatgcttcttgcaaagtggaagaaaaccatgtttctgctgaggaacttggtaaaggaattcagcaggaccaccagatcattctaaataatgagatgattcttcttaaaactttagattttgacctcattgtttatgctccatatcgatcgattgaaggatttattgatgacctagaggatttttgcagggtaggtaatggtccattccagcgtttgaaggagttgcgccaagctgctgtatcccatgttgacaaaatgatgttgactgatgcacctcttctctatactcctgggcagttggcactggctgcccttcacaagtccaatgatcttctcagggtcgtcaattttgaaagatacttggaaactattttctcaaggcaacattctgattgtccagtcgaacagtttgttcagtcaatcaacacaatcaattacttggttgaccagcttaatatacctaccgttaaggacctgaggcacgttgaccgcaagctgaaacattgttgggatccaagctcacatgatgagcataagaagaaagaaaagaagtcaaagcacaaatcaaaaagaacatctactgatgcccaactgtaa

SEQ ID NO: 4058 - protein, 325 aa, Sorghum bicolor
  misc_feature: Ceres ANNOT ID no. 6034450
  misc_feature (67)..(170): Pfam Id: Cyclin_N Pfam Desc: Cyclin, N-terminal domain
  misc_feature (1)..(325): NCBI GI: 37999989 NCBI Desc: cyclin h-1 [oryza sativa (japonica cultivar-group)]
  misc_feature (1)..(325): NCBI GI: 9796396 NCBI Desc: cyclin h-1 [oryza sativa]
  misc_feature (1)..(325): NCBI GI: 29788869 NCBI Desc: cyclin h-1 [oryza sativa (japonica cultivar-group)]
  misc_feature (1)..(212): NCBI GI: 53771899 NCBI Desc: cyclin h-1 [zea mays]
  misc_feature (1)..(324): NCBI GI: 4106515 NCBI Desc: cak associated cyclinh homolog [populus tremula x populus tremuloides]
MADFRTSTQRERWIFQPHDLMERWAAANQRAVQTLAQYGTTRLSVDLLDGSVSYPEPAPDHVEGSSGIKPLSYEEEQLTRVFYEQKIQEVCAAFKFPHKIQATAIIYFKRFYLQWSVMEHHPKLTCVYASCKVEENHVSAEELGKGIQQDHQIILNNEMILLKTLDFDLIVYAPYRSIEGFIDDLEDFCRVGNGPFQRLKELRQAAVSHVDKMMLTDAPLLYTPGQLALAALHKSNDLLRVVNFERYLETIFSRQHSDCPVEQFVQSINTINYLVDQLNIPTVKDLRHVDRKLKHCWDPSSHDEHKKKEKKSKHKSKRTSTDAQL

SEQ ID NO: 4059 - DNA, 1140 bp, Sorghum bicolor
  misc_feature: Ceres ANNOT ID no. 6034451
  misc_feature: Encodes the peptide sequence at SEQ ID NO 4060
atgctgctcgcggcagagcccgacgacgctcatgaggaaggggagaatcagcagctgctaatcacgacgaagggagggcccgggcttgagggactggtggtggggagctactgccacgatgtgctgatccggggcgggcgcgtagtgggggagacgctcggcggggctgcggccttcgtgtccaacgtgctcgacgccgcctcgccccaggacgctgcgctcaacgggacagcccccttcgtcgtcgtggccaaggtgggccacgacttcgtctacgcctccgcgccggcgcccgcgcggcatccgcctctgctctgcgcgtcgccgaccacctccttccacgcccagttctcggagaccgccgcctcggcgcacgcccccgaccgggagctccggcgcgtgcgcgcctgcgacccgatctaccccgccgaccttcccgaccgccgcttcgcctacggcctcgccgtcggcgtcgccggggaggtgctaccggagacgctcgagcggatgatccggctctgccgcgcggtgctcgtggacgcgcaggcgctgatccgggcgttcgacggcgacggcgccgtcggccacgtggcgcttgacgatacgccgtacgcgcggcttctgccccgggtggcgttcgttaaggcgtcgtcggaggaggcgccatacgtcggggtggaaacgacgaggcagcggtgctgcgtgatcgtcacggaggggagggacgggtgccggctgtactgggacggtggggaggcgcgcgttgcgccgttccccgccgtccaggtggaccctactggcgccggagacagctttctcgcgggttttgcaaccggactgctgtgggggttgtcggcgaccgacgccgcgctgctggggaacttcttcggcgccgctgcggtatcgcaggtcggcgtgcccaccttccatcccaagatgttgcaggcagttaaagaaatacttgaagagaagacaacaaaacgatatagtccgtgtataaacggcactagttttaccttcgagaagtcaaatttgcacaatgagttacacgcagctctccaagaagcggcgatgctgatgtctgaacagcagcaggctgataaggccaacggcaatggtggtgatatttgctcgccatag

SEQ ID NO: 4060 - protein, 379 aa, Sorghum bicolor
  misc_feature: Ceres ANNOT ID no. 6034451
  misc_feature (29)..(313): Pfam Id: PfkB Pfam Desc: pfkB family carbohydrate kinase
  misc_feature (80)..(307): NCBI GI: 108757998 NCBI Desc: kinase, pfkb family [myxococcus xanthus dk 1622]
  misc_feature (94)..(305): NCBI GI: 86159407 NCBI Desc: carbohydrate kinase, pfkb [anaeromyxobacter dehalogenans 2cp-c]
  misc_feature (206)..(312): NCBI GI: 11498013 NCBI Desc: carbohydrate kinase, pfkb family [archaeoglobus fulgidus dsm 4304]
  misc_feature (211)..(305): NCBI GI: 104781099 NCBI Desc: ribokinase rbsk [pseudomonas entomophila l48]
  misc_feature (31)..(302): NCBI GI: 76258974 NCBI Desc: pfkb [chloroflexus aurantiacus j-10-fl]
  misc_feature: The sequence is a functional homolog of SEQ ID NO. 349 in the 11/188,298 US application
  misc_feature: The sequence is a functional homolog of SEQ ID NO. 302 in the 11/188,298 US application
MLLAAEPDDAHEEGENQQLLITTKGGPGLEGLVVGSYCHDVLIRGGRVVGETLGGAAAFVSNVLDAASPQDAALNGTAPFVVVAKVGHDFVYASAPAPARHPPLLCASPTTSFHAQFSETAASAHAPDRELRRVRACDPIYPADLPDRRFAYGLAVGVAGEVLPETLERMIRLCRAVLVDAQALIRAFDGDGAVGHVALDDTPYARLLPRVAFVKASSEEAPYVGVETTRQRCCVIVTEGRDGCRLYWDGGEARVAPFPAVQVDPTGAGDSFLAGFATGLLWGLSATDAALLGNFFGAAAVSQVGVPTFHPKMLQAVKEILEEKTTKRYSPCINGTSFTFEKSNLHNELHAALQEAAMLMSEQQQADKANGNGGDICSP

SEQ ID NO: 4061 - DNA, 1131 bp, Sorghum bicolor
  misc_feature: Ceres ANNOT ID no. 6034470
  misc_feature: Encodes the peptide sequence at SEQ ID NO 4062
atggccggcgcgggaggcagcgggggcggcggcgtggtccgcgacgtggaggcgctggacggcgtgcgctccatcgtgctaaagccttcggagtcgctcgacgagtcgcggttcaccaggatcgccggcgccgacttcaacgacccgggcctcggactcgaggggctgcttgcctcgcttgcgagcacggggttccaggcatccaacctcggcgacgccatcgacgtcgtcaaccagatgttagattggaggttatctcatgagaagcccagtgaggattgtgatgacgctgaacttgaccctaaatatagagaatctgtgaaatgcaagatatttctgggcttcacttcaaacctcgtgtcttctggcatccgggatataatccgttttctagctcagcatcacatggtggatgttattgttacaagtgctgggggtatagaggaggatctcattaaatgccttgcaccaacttatagaggtgatttttctttacctggagcactgctgcggtcaaaaggactgaaccggataggaaatctgttggtgcccaacgataactattgcaagtttgagaactggatcatgccactctttgaccagatgcttctggagcaatctactgagaatgtttggacaccgtcaaaggtgatagctcgtcttggcaaagaaataaatgatgaaagctcctatctttattgggcatacaagaataacattcctgtatactgcccagcgttgactgatggatcacttggagacatgctgttctgtcatgcagttcgtaatcctggccttattattgacattgtacaagatatacgactgatgaatggggaagccatccatgcaacaccaaggaagacagggattatagttcttggtggaggacttccaaagcatcatatatgcaatgccaatatgttccgcaatggtgcagattatgctgtctatattaacacggcccaagagtttgatggtagcgattccggagcacaccctgatgaagcagtctcatggggcaagatcaagggttcagcaaaacctgtaaaggtgcactgcgatgcaagcatcgctttcccgcttcttgttgctgcgacatttgcacgtaaggttcacagctccaaatga

SEQ ID NO: 4062 - protein, 376 aa, Sorghum bicolor
  misc_feature: Ceres ANNOT ID no. 6034470
  misc_feature (53)..(369): Pfam Id: DS Pfam Desc: Deoxyhypusine synthase
  misc_feature (5)..(371): NCBI GI: 12407779 NCBI Desc: deoxyhypusine synthase [musa acuminata]
  misc_feature (10)..(371): NCBI GI: 52222139 NCBI Desc: deoxyhypusine synthase [lactuca sativa]
  misc_feature (10)..(375): NCBI GI: 53850032 NCBI Desc: deoxyhypusine synthase [symphytum officinale]
  misc_feature (17)..(375): NCBI GI: 53850016 NCBI Desc: deoxyhypusine synthase [heliotropium indicum]
  misc_feature (10)..(375): NCBI GI: 53850006 NCBI Desc: deoxyhypusine synthase [cynoglossum officinale]
  misc_feature (5)..(371): SWISSPROT Homolog: EC 2.5.1.46 Deoxyhypusine synthase
  misc_feature (17)..(376): SWISSPROT Homolog: EC 2.5.1.45 Homospermidine synthase 1
  misc_feature: The sequence is a functional homolog of SEQ ID NO 2 in the 6,538,182 US patent
  misc_feature: The sequence is a functional homolog of SEQ ID NO 6 in US patent 7217866
MAGAGGSGGGGVVRDVEALDGVRSIVLKPSESLDESRFTRIAGADFNDPGLGLEGLLASLASTGFQASNLGDAIDVVNQMLDWRLSHEKPSEDCDDAELDPKYRESVKCKIFLGFTSNLVSSGIRDIIRFLAQHHMVDVIVTSAGGIEEDLIKCLAPTYRGDFSLPGALLRSKGLNRIGNLLVPNDNYCKFENWIMPLFDQMLLEQSTENVWTPSKVIARLGKEINDESSYLYWAYKNNIPVYCPALTDGSLGDMLFCHAVRNPGLIIDIVQDIRLMNGEAIHATPRKTGIIVLGGGLPKHHICNANMFRNGADYAVYINTAQEFDGSDSGAHPDEAVSWGKIKGSAKPVKVHCDASIAFPLLVAATFARKVHSSK

SEQ ID NO: 4063 - DNA, 330 bp, Sorghum bicolor
  misc_feature: Ceres ANNOT ID no. 6034471
  misc_feature: Encodes the peptide sequence at SEQ ID NO 4064
atggctgcaaagatacgcgtagtgatgaagtcttttatgagccaaagcaaccaggtctcagggcttctgccattcacaaagaagattggactacctgaatcacgagccttgtataccgtgttgcgatcacctcatattgataagaagtccagggaacaattctcaatgcatgtcaagaaacagtttgtggagcagacagccaaacctcacgaacttcacaaaaagttcttctggttaaaacgcctgcgtatacctggggctcagtttgaagtccaaatttctttcaagacacgtctggatatggcaagactaaggtcccaagctccttga

SEQ ID NO: 4064 - protein, 109 aa, Sorghum bicolor
  misc_feature: Ceres ANNOT ID no. 6034471
  misc_feature (1)..(109): NCBI GI: 11528351 NCBI Desc: ribosomal protein s10 [zea mays]
  misc_feature (1)..(109): NCBI GI: 11177526 NCBI Desc: ribosomal protein s10 [zea mays]
  misc_feature (1)..(100): NCBI GI: 115468400 NCBI Desc: os06g0538800 [oryza sativa (japonica cultivar-group)]
  misc_feature (1)..(105): NCBI GI: 1362069 NCBI Desc: ribosomal protein s10 - garden pea mitochondrion
  misc_feature (1)..(105): NCBI GI: 1710792 NCBI Desc: mitochondrial ribosomal protein s10
MAAKIRVVMKSFMSQSNQVSGLLPFTKKIGLPESRALYTVLRSPHIDKKSREQFSMHVKKQFVEQTAKPHELHKKFFWLKRLRIPGAQFEVQISFKTRLDMARLRSQAP

SEQ ID NO: 4065 - DNA, 219 bp, Sorghum bicolor
  misc_feature: Ceres ANNOT ID no. 6034481
  misc_feature: Encodes the peptide sequence at SEQ ID NO 4066
atggggaaggtgccggtgcggatgaaggcggtggtgtacgcgctgtcgccgttccagcagaaggtgatgccggggctgtggaaggacatcaccaccaagatccaccacaaggtcacggagaactggatctccgccacgctcctcgtcaccccagtcgtcggcacctaccaatacgccatgtggtacaaagagcaggagaagctgtcccacagatactaa

SEQ ID NO: 4066 - protein, 72 aa, Sorghum bicolor
  misc_feature: Ceres ANNOT ID no. 6034481
  misc_feature (1)..(72): NCBI GI: 633687 NCBI Desc: ubiquinol--cytochrome c reductase [solanum tuberosum]
  misc_feature (1)..(71): NCBI GI: 106879619 NCBI Desc: ubiquinol-cytochrome c reductase [plantago major]
  misc_feature (1)..(72): SWISSPROT Homolog: EC 1.10.2.2 Ubiquinol-cytochrome c reductase complex ubiquinone-binding proteinQP-C
  misc_feature: Useful for making plants with modulated nitrogen use efficiency
  misc_feature: GREAT-hit functional homolog of the protein sequence given in SEQ ID NO 12989
  misc_feature: Useful for making plants with modulated nitrogen use efficiency
  misc_feature: Functional homolog of the protein sequence given in SEQ ID NO 12989
MGKVPVRMKAVVYALSPFQQKVMPGLWKDITTKIHHKVTENWISATLLVTPVVGTYQYAMWYKEQEKLSHRY

SEQ ID NO: 4067 - DNA, 1134 bp, Sorghum bicolor
  misc_feature: Ceres ANNOT ID no. 6034492
  misc_feature: Encodes the peptide sequence at SEQ ID NO 4068
atggctgcggcgggggcgggcccgggccccgggggcggcgaggggaagaagcggggcgcgtcgcggagctggatcctgctcgacgcggccggggaggagcgggtgctggacgcagataagtacgccatcatgcaccgcgtcgacatcaacgcacgcgacctccgcatcctcgacccgctgctctcctacccctccaccatcctcggacgcgagcgtgccatcgtccttaatctcgaggttttgcttagggatccttctgatgagaatgtaatccctgtagtagaggagctccggaggcggttaactccatcaaatgccactcagcatgatggaaaagagaacttaaatggacagcatgatgtggaaggggcagaagaagatgaatccccttttgagttccgtgcattggaggttactctggaagcaatctgcagtttccttgatgcgcgcactactgagcttgagaccgatgcttacccagctctggatgagttgacatccaagatcagcagccgtaacttggatagggtacggaagttgaaaagcggcatgacaagattgactgctagggttcagaaggtgagagatgagcttgaacaattattggatgatgatgacgacatggctgatctttacttgtctagaaagttggctggggcatcttcccctgtcagtggttctggtggaccaaattggttccctgcatccccaactattggttcaaaaatatcaagagcaagcagagctagtgcagctactgtgcatggaaatgagaatgacgttgaagagctagagatgttgctagaggcatatttcatgcaaattgatggcacattaaacaaattgacaacgctgagagagtacatcgatgacacagaagattacattaatatccagcttgataaccaccgtaatcagttgattcagctagagttgttcttgagttctggtaccgtctgcctgtcgctgtactcattagttgctggagtctttggtatgaatattccgtatacctggaatgacggccatggatacatcttcaaatgggtggttattgtatcagggcttgtttgtgcctttatgtttatctccattgttgcgtatgcgagacacaagggtctcgtcggatcctga

SEQ ID NO: 4068 - protein, 377 aa, Sorghum bicolor
  misc_feature: Ceres ANNOT ID no. 6034492
  misc_feature (19)..(375): Pfam Id: CorA Pfam Desc: CorA-like Mg2+ transporter protein
  misc_feature (21)..(377): NCBI GI: 25360941 NCBI Desc: mrs2-7 [arabidopsis thaliana]
  misc_feature (21)..(377): NCBI GI: 30682808 NCBI Desc: magnesium transporter cora-like family protein (mrs2-7) [arabidopsis thaliana]
  misc_feature (21)..(377): NCBI GI: 42570515 NCBI Desc: magnesium transporter cora-like family protein (mrs2-7) [arabidopsis thaliana]
  misc_feature (129)..(377): NCBI GI: 115455255 NCBI Desc: os03g0742400 [oryza sativa (japonica cultivar-group)]
  misc_feature (21)..(377): NCBI GI: 90110819 NCBI Desc: truncated mg2+ transporter protein mgt7 [arabidopsis thaliana]
MAAAGAGPGPGGGEGKKRGASRSWILLDAAGEERVLDADKYAIMHRVDINARDLRILDPLLSYPSTILGRERAIVLNLEVLLRDPSDENVIPVVEELRRRLTPSNATQHDGKENLNGQHDVEGAEEDESPFEFRALEVTLEAICSFLDARTTELETDAYPALDELTSKISSRNLDRVRKLKSGMTRLTARVQKVRDELEQLLDDDDDMADLYLSRKLAGASSPVSGSGGPNWFPASPTIGSKISRASRASAATVHGNENDVEELEMLLEAYFMQIDGTLNKLTTLREYIDDTEDYINIQLDNHRNQLIQLELFLSSGTVCLSLYSLVAGVFGMNIPYTWNDGHGYIFKWVVIVSGLVCAFMFISIVAYARHKGLVGS

SEQ ID NO: 4069 - DNA, 10743 bp, Sorghum bicolor
  misc_feature: Ceres ANNOT ID no. 6034512
  misc_feature: Encodes the peptide sequence at SEQ ID NO 4070
atgaaatggtccacattgctcagtaaggtcgtcttcgccgccggccagcagcaggagcagcagccgccgccgcccccgccgccgccgccggggtcgccgttacaccgccagcaggcggtccaggacctcgccaccccgaggctcagctccgcctccaccggcggggacgagggcggcttcgacgcggcggccgggagctcgccctctgccgccgcgtcccctgccaggggcaaaaatgaattggagtcagactttaggagattatgggaagaatttcgctcttccagctctgaaaaggagaaagaaagggccttaaatttggctgtagatgtcttctgtaggctagtgaagcaatattctagtgtagctcaattagttacaaagttagtagaaggacatgttttttcttttgttattggaagagcttttgttactgatttggagaaactaagaatccatagcaaaggaagatcactgcgtgtggctgatgttattggcttcttttcagataccacagagcttggtatatgtccaggatcaaatttgttgtatgcagtcgaagttcttgtgacagagacaaatgataagcagcctctgttggactctggtattttgtgctgccttatatatatcctcaattctctattgagtcccaatgagaactccacaaataccttgcctgttcaccaagaaggatcgataattgagaaaaacaaaaatttggatcctatgcaatcacgacggcttgagattgagggaagcgtgatacatataatgaaagcattggcgagccatcaatctgctgcaccaagtttaattgaagatgatgccttgcaagttcttttccagatggttgcaaatggttcattatctgtgttttcacagttcagggatggtattgttccccttcacacaattcagctccatcgccatgcgatgcaggtccttggtcttcttcttgcaaatgacaatgggacttctgcaaagtacatcaggaagcaccagctgattaaggtacttcttatggctgtgaaagatttcaatcctcagagttgcgatgctgcttacaccatgggcattgtggatttattactggaatgtgttgagctgtcatacaggcctgagtctggatccataaggctgagggaagacatacataatgctcatggttaccagttccttgttcagtttgctctaacgctttgtagcttacacaaaaatcagactctccaatcctcatccaagttagcatccgaagaggatgcatcctttccttctgacagattagaacaagatgtattctcatgtgacctttcacctcagttgtctaggttgcttgatgttcttgtaaatttgtcacaaattggcccctcagaaaatggtggtggtaagagtttaaaatcttctcatgcgaaaggaacggggcacagcagaagccgaactccttctgctgacaagtttgatgacttgatggaagttagtagccccaaggtaaaagatcttgatgccattcagatgctacaagatatttttctgaaggcagacaacttggaagtgcaagctgaagttctcaatagaatgttcaagattttctcaagccatcttgaaaattacaagctatgccaacaactacgtactgttcctctttttatcctaaacatgggcagcttccctgcagcactacaagaggtcatcttaaaaatattggaatatgctgtcactgtagtaaactgcattccagagcaagagttgttgtcactttgttgcttattgcaacaaccaatttctaccagtcttaagcatacagtgctttcgttctttgtaaagctactttcctttgatcagcagtacaagaaagttcttagagaagttggtgtcctgggggtattgttagatgacttgaagcaaaacaagcttttctttggagatgagcagcaaaataaggcctttgactctacagagaggatgtctaatgcaactagatttcagaggacagtggacaacaaagatgcaattctttcgccaaagttaatggcttctagttctgcaaaatttcccatgtttgaagatgaagggacaattactgttgcttgggattgtcttttttatctgctgaaaagagctgagcctaaccagcaatcatttcgatcatccaatggtgtcaacatcattcttcctttcttggtatccgaaagccacagatctggtgtattgcgactattgtcatgcctaataattgaagattctcttcaggctcatccagaagaaatagggtcattgattgaaattttgaagagtgggatggtatcaacatcatctggttctcagtttaagcttgaaaatgatgcaaagtgtgatacatttggtgctttgtggcggattcttggggcaaacagctcagcacaaagaatatttggagaaaccactggattttccctgctgttgacgacactgcatactttccagaatgacagtgaaaatgaagagaccgaatcatctttgcatactcatatgaagatctttggttttctattgcgagcaatgacagctgcagtatgcaacaattctgtcaataggataaggctgcatacaatactgtcgtcgaacactttctatgatctcctctctgagtctgggctgctttgtgtggattgtgaaaaacaagttattttgcttttgcttgagcttgcacttgagattgttctcccgcccacgagtaacctgcaggtagagagcatttcttctgaaacctcagaggatgaattgagcttcttgtctgcaacatcgtttggactttcaaggcttgacaaggagcgtgtgtacaatgctagtgcaattgttgtgctgatccgttgtttgctggtatttacacctaaagttcaacttgagttgctgagattcattgagaagctagcaattgctggtcccttcaaccaggagaatttaacttctgttggatgtgttggccttctacttgagacaatcagcccatttttggagggttcctctcctattcttaatcatgccttgagaattgttgaactgctaggtgcttacaggttgtcttcgtctgagctaaggcttcttgtgagatatattcttcagctgaaagtgaagcgttcaggtcatctttttgttaatatgatggacaagttaattcaaatggaagatgtcagacaaggacatgtttctctagctcctttcattgaaatggacatgagcaaagccggtcatgcatctattcaggtttcattaggagaaagaacatggccacctgtttctgggtattcctttgtttgctggttccaatttcaggacttctttaaatgccaaccgaaggaagcagaaaaagcgtcaaaagggggatatagcaagaggagtgggcatgttttacgcatattttctgtgggtgcagtggacgatgctaacactctgtttgctgagctttatctccatgacaatggtgtttttactatatctacaggcagttcaagttcattgtcatttccaggcattgaaatggaagaaggaaaatggcatcatcttgctgtcgttcatagtaagccaaatgcactagctgggcttttccaagcaagtgtggctagcctgtatcttgatggaaagctgaggcacacaggcaagcttggatactcgccatccccatttggtaaatctttgcaagtaacacttggtacgcctactatacgtgggaaagtttctgacttttcatggcggctccggtgttgctatctttttgaggaggtcttgacaccagggagcatttgtttcatgtacattcttggacaagggtatcggggtttgttccaggacattgaccttctgagatttgtcccaaactgggcctgtggtggggaggtaatggcaattctggattcattagaagtggaagttcctgcaccttcaagcagccagcgtgttgacagttcaatgaaacaaggaagctctagacttgagagcagtggaattgtttgggacatggaacttttaagaaatctctccttacaattgtctgggaagaagcttatatttgcatttgatggaacttcatcagatgcttttcgagcatctggtactctttcgctgctgaaccttgtcgatccaacttctgctgctgcatcccctataggaggtataccaagatatgggcggctaagcggtgatgtttacatttgtaatcaatgcacaattggtgacactgttcaaacagttggtgggatgcctgtggtacttgcccttgttgaagctgctgaaagtagggatatgctgcatatggcgctggagctgcttgcactatctcttcagcagagtcatcaaaatgtaaaaaacatgcaggccttgaggggttatcatcttcttgcgctttttcttcataggagaatgtcactatttgatctgcaatctcttgatatcttctttcgtattgctgcttgtgaggcttcctttcctgagccacagaaatcaaagataaatcgaacagcaagctatgcgtctggaatgtccccagaggccagccttgatgatcttaccttacccaagtttggcgatgacatgtcttctggtggatcgcatggggatctagatgacttttcagctcaaaaggattcatttagccacttgtctgagctggagaatgctgacctagctggtgagacttctgaattcatagtcttgtcaaatgctgatatggttgaacacattcttttggactggacgatatgggttgctgctcctatatcagtgcagataactcttcttgggtttcttgagaggatggtgtccatgcattggttcagaaatcacaaccttacaatactgcgccgaattaatcttgttcaacatcttcttgttactttacaacgtggtgatgttgaaattcctgtgctggagaagctagttgtgcttctaggtgtcatcctggaggatggttttctagcttctgagctggagctcgtcgtaagattcataataatgacatttgatcctccagagcttacaccgaaccgccagattgtgcgggaggctatgggaaagcatgttattgtgaggaacatgttattggaaatgcttattgatctacaagttaccatagatgccgaagaattgctggagcaatggcataaagttgtttcatccagattggtcacatatttccttgacgaagcagtacatccaactagcatgagatggatcacgactcttttaggagtttgccttacgtcatcaactacatttgcattgaagttccgtacaagtggaggctttcaaggattgaatcatgtgcttccaagctttcacgattctccagaaatatactatatattgttctgtttggtgtttgggaagcctgtttatcctcgagtgccagaggtccgcatgcttgattttcatgctctcatgcctagcgatggaaactatggagaattgaagtttgtggatctattggacactataattgcaatggcaaaagctacatttgtttccttgattatgaaatctatgcttgcacatgagaataacaatctttcacatcttaatggcaccttggtcgcggatcttgttgaggcgacatcggacatgggaggtgatcttcaaggagaagctctgatgcataagacatatgcagcaaggttaatgggtggtgaagcagcagcacctgctgttgctacttcaatattgaggttcatggttgatctggcaaagatgtgcccaccattctctgctgtttgcaggcgacatgatttcctagagagctgtgttgatctctatttctcttgtgtgaggtctgattgtgccctgaggatggcaaaagatcttacaactgctgcaactgacgagaggaatgtacatgatgatgacaatggaagttcaaaggatgcattttcaagtttaccacatgatcaggagcaatcttccaaaacgttgagtgtcacaagttttcctcaggagcagaaaagttccagttcagaaagtactggcatgccaaactctttcgaagctgctgaagccaaagcagatgattcttcgaatcaggagctcagcactattattttaaacggagaagcaaaccaattgtttactaatgctcatgatcaagggcagaccacagcttccagtgcaaatggcattgctgaacaccaccatgtaactgattcacccaactcggttgctatgaataatgttggatctcctgttttatccgagaggtcaacccacagagcagcgagtacccctactgcatctccaatggccccattcacatcttggcctggcagtgcaggatcatatagtgatggtagacacctgacagcttctccatccatggcttcatctatgtctgggatagacctggactcgtcccctgatccgaggacaaatattcagggatcatctgccgttaatacctttttcccaatcaattcgaagcttttgcttgacatagatgatttaggttatgggggtggtccatgctctgcaggagctacagctgttctagattttgttgctcaaatccttgctgacactatctcagatcaacttaaagcagcactctttgttgagaacattttggagtctgtgcctttgtttgttgatgttgactctgctctggtttttcaaggcttgtgcctaagcagattgatgaacttccttgaaagaaagctcttgcttgatgacgaagaagatgggaagaaacttgacaagagccgctggtctgtcaatttggacccactttgctggatgattgttgatcgtgtgtacatgggctgctttccaaccccactcagggtactacaaacactagaattcttaatgtccatgttacagcttgctaataaagatggccgtgttgaagatgctgtgcctccaggtaaaggtattttgtccattgctcgaggaagcaagcaacttgatccttacatccacgcaatattgaagaacacaaaccggatgataatgtactgcttcctcccaacattcctcaaaagtatgggggaagatgatctacttgcaaatcttgcattcctgacagaaactgggaggagtttagcttctaaaccttaccaggaagatttttctattgatatttgtacagttcttcagctactaattgccaacaagagattggtgctctgcccaagcaatgttgatacagatctaatgtgttgtttctgcataaatttaatggcacttctccatgacaagagagtaactgctcaaaacttggcggttgatttacttaaatacttggtagtgcatcgtcgccaatctcttgaggacctgctagtttgcaagcctaaccaaggacaacaactggacatcctgcatggaggacttgataaattgctcactggaagcacgtcaatgttttttgaatggctccaaagttcccagcaaacaataagtaaagtgttggaccagtgcgctctaataatgtgggttcaatatattaccggctcagcaaagtttcctggcgtgagaataaaaggaatggaggtcaggcgcaagaaagagatgggacggaaatttcgcgaatctgcaaaactagatgccaggcactgggagcagataaatgagcggagatacaatcttgatttggttcgtgatgtgatgtctacagagctaagagcaattcgtcaagacaaatacggatggatattgcacggggaaagtgagtggcaaagccagctccaagaacttgttcatgagagaggtatttttcccatgcggcaatcatcaacagaacctgagtggcagctctgtgctgttgaaggaccatatagaatgaggaagaaacttgagcactccaaatttaagatagatactattcagaatgttctaaccagcaaccttggatcaaatggtgttaagatgatcaataaagaggatggagaattgttaacatctgggtcagatacaatgtcaggcttgaatcttttgacctacggcactgagccgaaggatcttgatgctgttgagttttcatcattcaaagatgacgatgacatattcaaaggaggaagcacaaaatcagctccaattggctggaccgatgataaaagcagcattaatgaacagagccttcattctgcgacggaatttggagcaaaatcaagttccctttcttttcacatgactgagagtcaccaggttaaatctgaacttagttcaccaaggagggcaccttcagtcaaaggtactgatgcaagaacctcagaggataaatcagaaaaggagttgcttgacaatggtgagtatcttatcaggccttatctggagccctatgagaaaataaggcataaatacaactgtgaacgggttgctggtcttgataagcacgatggaatatttctaattggagaactttgcttatacattatcgagaacttctacattgatgattccaattgcatttgtgaaaaggacagtgaagatgagctctctgtcatcgatcaagctttaggtgtgaacaaggatataatgggaagcagtgaatctcagttgaaatcaccttccacttggggtgggacagcaaaggtcttgcttggtggcagagcatgggcatataacggaggtgcttggggtaaagagaagctttgcagcagcagcaacctgcctcatccatggcatatgtggaagcttgatagtgttcatgagttgctgaaacgtgattaccagctccgccctgttgcaattgaaattttcagcatggatggttgcaatgaacttctagttttccacaaaaaggagagagaggaagttttcagaaatctgatcgccatgaatctcccgcggaatagcatgttggacacaaccatatcagcatcctctaaacaggagagtggtgaggggagccgtctttttaaaggcatggcaaaatcattttctaaaagatggcaaagtggagaaattacaaacttccaatatctcatgcatctaaatacacttgccggtcgagggtacagtgatctcacacagtacccagtatttccatgggttcttgcagattatgagagcgatgctttagatctgaggaatccacagacatttcgcaggcttgataaacccatgggatgccaaacggaggaaggagaagaggaattccgcaagagatatgatagttgggatgaccctgatgtaccaaagttccattatggctctcattattcaagtgctgggattgtccttttctatctcttaaggttgcctccttttagcacagaaaatcagaagctgcagggtggacaatttgaccatgcagatcgcttattcaacagtgtgagggatacatgggtcagcgctgcgggcaaaagtaacacatcagatgtgaaagaactaattcctgagttctattatttgcctgaatttttggagaacagttttaatctggacctgggcgagaaacaatcaggagagaaggttggtgatgttgttttgccaccttgggctaaaggcagtgctagagaattcattaggaagcatcgggaagcattggaatcagattacgtgtctgagaatctgcatcattggattgatcttatttttggatataagcagagaggaaaggcagctgaagatgctgtcaatgtcttctatcactacacatacgaaggcaatgttgacatagacgcagtatcagatcctaccatgaaggcttcaatactagcacaaatcaaccattttggtcagaccccaaaacagttattccagaaaccacatccacagaggcggactgacaggaaagtacctcctcatcctctacggtacagcgcctatctaacacagcaggagattcgcaagacagcatcttcggtgtcccaggttgtctcctacaatgataaaatcctaattgcttcagttaactgcttgctcaagccgctaacttataatgaatacatttcctggggattccctgaccgaagcttgagaatattaacatatgatcaggataggcttttgtctacacatgaaaaccttcatggtggtagtcaaattcagtgcactggagtgagccatgatggcaacattctcaccactggtggtgatgatggagttgttgcagtgtggagatttgtgaaggatggcatccgccgtctcctgagaatggagaaggctttgtgtgctcacacgggcaagataacttgtgtctctgtcagccaaccttactcattgattgtctcaggctctgatgactgttctgttatcttgtgggacctaacaagcctagtctttgtgaagcagctaccaaggttcccagcatcagtatccgcgctacatgtgaacaacctcactggtgagatcctgactggtgctggtgttctttttgctgtttggagcatcaatggggactgccttgctgtggtgaacacctcccagcttccttctgacctcatcttgtctgtgacaagcacgatacactcagattggcaggacacaaactggtacgtgacaggtcatcaaagtggtgcagttaaggtatggaagatggtgcactgctcgtctgatgaagcagtaaagagcaaatcgccttcggtatcttctggtgggcttacccttaacggccaaacaccagagtataggctacttttgcagaaggtgctcaagtcacataaacaccctgtcactgccctttgtataccaccggacttgaagcagcttctgagtggggatgccagcggccacttgctctcatggtcattgaaagacgacagtttcaagggttcatag

SEQ ID NO: 4070 - protein, 3580 aa, Sorghum bicolor
  misc_feature: Ceres ANNOT ID no. 6034512
  misc_feature (2968)..(3248): Pfam Id: Beach Pfam Desc: Beige/BEACH domain
  misc_feature (3372)..(3410): Pfam Id: WD40 Pfam Desc: WD domain, G-beta repeat
  misc_feature (1)..(3580): NCBI GI: 4587572 NCBI Desc: similar to gbu70015 lysosomal trafficking regulator from mus musculus and contains 2 pf00400 wd40, g-beta repeats. ests gbt43386 and gbaa395236 come from this gene. [arabidopsis
  misc_feature (1)..(3580): NCBI GI: 4587572 (continued) thaliana]
  misc_feature (1)..(3580): NCBI GI: 15218699 NCBI Desc: wd-40 repeat family protein / beige-related [arabidopsis thaliana]
  misc_feature (1288)..(3505): NCBI GI: 30679238 NCBI Desc: wd-40 repeat family protein / beige-related [arabidopsis thaliana]
  misc_feature (1769)..(3580): NCBI GI: 140070269 NCBI Desc: beige/beach; wd40-like [medicago truncatula]
  misc_feature (2970)..(3571): NCBI GI: 9313011 NCBI Desc: beige protein homolog [dictyostelium discoideum]
MKWSTLLSKVVFAAGQQQEQQPPPPPPPPPGSPLHRQQAVQDLATPRLSSASTGGDEGGFDAAAGSSPSAAASPARGKNELESDFRRLWEEFRSSSSEKEKERALNLAVDVFCRLVKQYSSVAQLVTKLVEGHVFSFVIGRAFVTDLEKLRIHSKGRSLRVADVIGFFSDTTELGICPGSNLLYAVEVLVTETNDKQPLLDSGILCCLIYILNSLLSPNENSTNTLPVHQEGSIIEKNKNLDPMQSRRLEIEGSVIHIMKALASHQSAAPSLIEDDALQVLFQMVANGSLSVFSQFRDGIVPLHTIQLHRHAMQVLGLLLANDNGTSAKYIRKHQLIKVLLMAVKDFNPQSCDAAYTMGIVDLLLECVELSYRPESGSIRLREDIHNAHGYQFLVQFALTLCSLHKNQTLQSSSKLASEEDASFPSDRLEQDVFSCDLSPQLSRLLDVLVNLSQIGPSENGGGKSLKSSHAKGTGHSRSRTPSADKFDDLMEVSSPKVKDLDAIQMLQDIFLKADNLEVQAEVLNRMFKIFSSHLENYKLCQQLRTVPLFILNMGSFPAALQEVILKILEYAVTVVNCIPEQELLSLCCLLQQPISTSLKHTVLSFFVKLLSFDQQYKKVLREVGVLGVLLDDLKQNKLFFGDEQQNKAFDSTERMSNATRFQRTVDNKDAILSPKLMASSSAKFPMFEDEGTITVAWDCLFYLLKRAEPNQQSFRSSNGVNIILPFLVSESHRSGVLRLLSCLIIEDSLQAHPEEIGSLIEILKSGMVSTSSGSQFKLENDAKCDTFGALWRILGANSSAQRIFGETTGFSLLLTTLHTFQNDSENEETESSLHTHMKIFGFLLRAMTAAVCNNSVNRIRLHTILSSNTFYDLLSESGLLCVDCEKQVILLLLELALEIVLPPTSNLQVESISSETSEDELSFLSATSFGLSRLDKERVYNASAIVVLIRCLLVFTPKVQLELLRFIEKLAIAGPFNQENLTSVGCVGLLLETISPFLEGSSPILNHALRIVELLGAYRLSSSELRLLVRYILQLKVKRSGHLFVNMMDKLIQMEDVRQGHVSLAPFIEMDMSKAGHASIQVSLGERTWPPVSGYSFVCWFQFQDFFKCQPKEAEKASKGGYSKRSGHVLRIFSVGAVDDANTLFAELYLHDNGVFTISTGSSSSLSFPGIEMEEGKWHHLAVVHSKPNALAGLFQASVASLYLDGKLRHTGKLGYSPSPFGKSLQVTLGTPTIRGKVSDFSWRLRCCYLFEEVLTPGSICFMYILGQGYRGLFQDIDLLRFVPNWACGGEVMAILDSLEVEVPAPSSSQRVDSSMKQGSSRLESSGIVWDMELLRNLSLQLSGKKLIFAFDGTSSDAFRASGTLSLLNLVDPTSAAASPIGGIPRYGRLSGDVYICNQCTIGDTVQTVGGMPVVLALVEAAESRDMLHMALELLALSLQQSHQNVKNMQALRGYHLLALFLHRRMSLFDLQSLDIFFRIAACEASFPEPQKSKINRTASYASGMSPEASLDDLTLPKFGDDMSSGGSHGDLDDFSAQKDSFSHLSELENADLAGETSEFIVLSNADMVEHILLDWTIWVAAPISVQITLLGFLERMVSMHWFRNHNLTILRRINLVQHLLVTLQRGDVEIPVLEKLVVLLGVILEDGFLASELELVVRFIIMTFDPPELTPNRQIVREAMGKHVIVRNMLLEMLIDLQVTIDAEELLEQWHKVVSSRLVTYFLDEAVHPTSMRWITTLLGVCLTSSTTFALKFRTSGGFQGLNHVLPSFHDSPEIYYILFCLVFGKPVYPRVPEVRMLDFHALMPSDGNYGELKFVDLLDTIIAMAKATFVSLIMKSMLAHENNNLSHLNGTLVADLVEATSDMGGDLQGEALMHKTYAARLMGGEAAAPAVATSILRFMVDLAKMCPPFSAVCRRHDFLESCVDLYFSCVRSDCALRMAKDLTTAATDERNVHDDDNGSSKDAFSSLPHDQEQSSKTLSVTSFPQEQKSSSSESTGMPNSFEAAEAKADDSSNQELSTIILNGEANQLFTNAHDQGQTTASSANGIAEHHHVTDSPNSVAMNNVGSPVLSERSTHRAASTPTASPMAPFTSWPGSAGSYSDGRHLTASPSMASSMSGIDLDSSPDPRTNIQGSSAVNTFFPINSKLLLDIDDLGYGGGPCSAGATAVLDFVAQILADTISDQLKAALFVENILESVPLFVDVDSALVFQGLCLSRLMNFLERKLLLDDEEDGKKLDKSRWSVNLDPLCWMIVDRVYMGCFPTPLRVLQTLEFLMSMLQLANKDGRVEDAVPPGKGILSIARGSKQLDPYIHAILKNTNRMIMYCFLPTFLKSMGEDDLLANLAFLTETGRSLASKPYQEDFSIDICTVLQLLIANKRLVLCPSNVDTDLMCCFCINLMALLHDKRVTAQNLAVDLLKYLVVHRRQSLEDLLVCKPNQGQQLDILHGGLDKLLTGSTSMFFEWLQSSQQTISKVLDQCALIMWVQYITGSAKFPGVRIKGMEVRRKKEMGRKFRESAKLDARHWEQINERRYNLDLVRDVMSTELRAIRQDKYGWILHGESEWQSQLQELVHERGIFPMRQSSTEPEWQLCAVEGPYRMRKKLEHSKFKIDTIQNVLTSNLGSNGVKMINKEDGELLTSGSDTMSGLNLLTYGTEPKDLDAVEFSSFKDDDDIFKGGSTKSAPIGWTDDKSSINEQSLHSATEFGAKSSSLSFHMTESHQVKSELSSPRRAPSVKGTDARTSEDKSEKELLDNGEYLIRPYLEPYEKIRHKYNCERVAGLDKHDGIFLIGELCLYIIENFYIDDSNCICEKDSEDELSVIDQALGVNKDIMGSSESQLKSPSTWGGTAKVLLGGRAWAYNGGAWGKEKLCSSSNLPHPWHMWKLDSVHELLKRDYQLRPVAIEIFSMDGCNELLVFHKKEREEVFRNLIAMNLPRNSMLDTTISASSKQESGEGSRLFKGMAKSFSKRWQSGEITNFQYLMHLNTLAGRGYSDLTQYPVFPWVLADYESDALDLRNPQTFRRLDKPMGCQTEEGEEEFRKRYDSWDDPDVPKFHYGSHYSSAGIVLFYLLRLPPFSTENQKLQGGQFDHADRLFNSVRDTWVSAAGKSNTSDVKELIPEFYYLPEFLENSFNLDLGEKQSGEKVGDVVLPPWAKGSAREFIRKHREALESDYVSENLHHWIDLIFGYKQRGKAAEDAVNVFYHYTYEGNVDIDAVSDPTMKASILAQINHFGQTPKQLFQKPHPQRRTDRKVPPHPLRYSAYLTQQEIRKTASSVSQVVSYNDKILIASVNCLLKPLTYNEYISWGFPDRSLRILTYDQDRLLSTHENLHGGSQIQCTGVSHDGNILTTGGDDGVVAVWRFVKDGIRRLLRMEKALCAHTGKITCVSVSQPYSLIVSGSDDCSVILWDLTSLVFVKQLPRFPASVSALHVNNLTGEILTGAGVLFAVWSINGDCLAVVNTSQLPSDLILSVTSTIHSDWQDTNWYVTGHQSGAVKVWKMVHCSSDEAVKSKSPSVSSGGLTLNGQTPEYRLLLQKVLKSHKHPVTALCIPPDLKQLLSGDASGHLLSWSLKDDSFKGS

SEQ ID NO: 4071 - DNA, 642 bp, Sorghum bicolor
  misc_feature: Ceres ANNOT ID no. 6034515
  misc_feature: Encodes the peptide sequence at SEQ ID NO 4072
atggcgaggtggcggccggcggtgctgctggtagtggctctggcggcggttttgtcggcggcgtggcgggcggatgcgctatcggtgacggtaaccgacaccgagtgcatccacgagttcgtgccctacgagggtgacacagtgtccgggaacttcgtcgtcgtcgaccacgacatcttctggagctccgaccacccaggcatcgacctcacggtaacgtcaccaggtggcaacactgtgcacacattgaagggaaaatctggtgacaaatttgagtttaaagctccgaggggtggcatgtacaagttctgcttccataacccatatggagcgcctgaaactgtttctttctacattcatgttgggcacatacccaatgagcacaatctggcgaaagatgagcacttggatcctatcaacgtcaaaatcgcggagctgaaggaagcattagaatctgtcaccgccgagcagaagtacctaaaagcacgcgaagctcgtcaccgacacactaatgagagtaccagaaagcgtgtcatgttctatacaatggcagagtacatagctttcatggcagctagcgcgttgcaagtcctctacatccgccgcttgttcagtaaaaatgtgggatacaacagagtgtag

SEQ ID NO: 4072 - protein, 213 aa, Sorghum bicolor
  misc_feature: Ceres ANNOT ID no. 6034515
  misc_feature (55)..(121): Pfam Id: EMP24_GP25L Pfam Desc: emp24/gp25L/p24 family/GOLD
  misc_feature (8)..(213): NCBI GI: 20147305 NCBI Desc: at3g22845/mwi23_22 [arabidopsis thaliana]
  misc_feature (4)..(213): NCBI GI: 82780758 NCBI Desc: coated vesicle membrane protein-like [triticum aestivum]
  misc_feature (8)..(204): NCBI GI: 40056982 NCBI Desc: emp24/gp25l/p24 family protein [dictyostelium discoideum]
  misc_feature (154)..(213): NCBI GI: 110295241 NCBI Desc: lrr resistance protein-like protein [gossypium arboreum]
  misc_feature (11)..(204): NCBI GI: 89273430 NCBI Desc: transmembrane emp24 domain trafficking protein 2 [xenopus tropicalis]
MARWRPAVLLVVALAAVLSAAWRADALSVTVTDTECIHEFVPYEGDTVSGNFVVVDHDIFWSSDHPGIDLTVTSPGGNTVHTLKGKSGDKFEFKAPRGGMYKFCFHNPYGAPETVSFYIHVGHIPNEHNLAKDEHLDPINVKIAELKEALESVTAEQKYLKAREARHRHTNESTRKRVMFYTMAEYIAFMAASALQVLYIRRLFSKNVGYNRV

SEQ ID NO: 4073 - DNA, 1518 bp, Sorghum bicolor
  misc_feature: Ceres ANNOT ID no. 6034527
  misc_feature: Encodes the peptide sequence at SEQ ID NO 4074
atggccgaggccgaggctggtagggcggcgatccggcgcgccctgcggtcgctgaaacggaggcacctcgccgaggaaggggcgcacagcccggccatcgaggcgctaacccgtcccttcgccgctcacgctttggagtggaaagagaaggctgagaagcatgaggtggagctgcagcactgctacaaggcacaatcccggctctctgagcagcttgtaaccgagatagaagaaggtaaagcatcaaaagcactgctcaaagagaaagaagcgatggttacaagtttgcaggctgaacttgagaagtcaagcgaagagaatgtacaactgaagcagtcacttgacgaaaaaacaaaagccttagatcttctcattcaagagcatcagacagtgaaagccgaacatgaacaagcattgacgaaactaaaagctgcagaggatgagaaccaaagtctgatcgatcgatggatgctagagaagatgaaggacgcagagaagctcaacgaggccaatgcaatgtatgaggagatggttctaaagctaaagacagctggagttggtggtatacaacttaacgcacagcaagaagctgatggcatcatacggcgttctgaagctggttacatggaaacatcaatcccatcaacatgcacagtaactattcgtgctcatgatggtgggtgtggatctttgatgtttgagcataactcagacaagctaattagtgggggccaggatcaaactcttaagatatggagtgcatctactggtgccttgacctccaccctacatggttgcttggggtctgttaatgatcttgccgtgaccaatgataacaagtttgtggtcgctgcctgtagctccaataagctgtttgtgtgggaagttaatgggggacgtcctcgtcacactctgactggtcacacaaaaaatgtttcatctgttgatgcaagctgggtgaagagctttgttgttgctagttcatccaatgatcgtactatcaagacttgggatctacagacaggtttctgcaaaagcaccataatgtctgcaagcaaccccaactcactagctttcattgatggtgacatcatttgttcgggccatagggatggaaatcttcggctatgggatgtccgtagtgggaaatgcactacacagatagctgctcatctagatgtcacctcggtctgcgtgtcacggagcaaaaattttattcttacaagtgggagagataatgtgcacaacctttttgatgttagaacattggagatttgtggaacattcagggccatgggtaacaaagtggtgggcagctggagcaaaccttgtattagccctgatgaaaattgcatcgctgctggttcttctgatggatctgtttacatatggtcgagactgaagaatggaacaccaaccatcctagagggtcattcttcacctgttctcgcaagtgcatggtgcggactaggacctcttgctacctcggacaggaatcatatttatctctggtcttga

SEQ ID NO: 4074 - protein, 505 aa, Sorghum bicolor
  misc_feature: Ceres ANNOT ID no. 6034527
  misc_feature (215)..(253): Pfam Id: WD40 Pfam Desc: WD domain, G-beta repeat
  misc_feature (299)..(338): Pfam Id: WD40 Pfam Desc: WD domain, G-beta repeat
  misc_feature (382)..(419): Pfam Id: WD40 Pfam Desc: WD domain, G-beta repeat
  misc_feature (12)..(169): Pfam Id: ATG16 Pfam Desc: Autophagy protein 16 (ATG16)
  misc_feature (1)..(505): NCBI GI: 79533267 NCBI Desc: nucleotide binding [arabidopsis thaliana]
  misc_feature (210)..(505): NCBI GI: 62510482 NCBI Desc: autophagy protein 16-like (apg16-like) (unq9393/pro34307)
  misc_feature (210)..(505): NCBI GI: 39843342 NCBI Desc: apg16l beta [homo sapiens]
  misc_feature (46)..(494): NCBI GI: 3122952 NCBI Desc: protein tipd
  misc_feature (206)..(487): NCBI GI: 125775554 NCBI Desc: ga15952-pa [drosophila pseudoobscura]
  misc_feature: The sequence is a functional homolog of SEQ ID NO. 502 in the 11/188,298 US application
  misc_feature: The sequence is a functional homolog of SEQ ID NO. 485 in the 11/188,298 US application
MAEAEAGRAAIRRALRSLKRRHLAEEGAHSPAIEALTRPFAAHALEWKEKAEKHEVELQHCYKAQSRLSEQLVTEIEEGKASKALLKEKEAMVTSLQAELEKSSEENVQLKQSLDEKTKALDLLIQEHQTVKAEHEQALTKLKAAEDENQSLIDRWMLEKMKDAEKLNEANAMYEEMVLKLKTAGVGGIQLNAQQEADGIIRRSEAGYMETSIPSTCTVTIRAHDGGCGSLMFEHNSDKLISGGQDQTLKIWSASTGALTSTLHGCLGSVNDLAVTNDNKFVVAACSSNKLFVWEVNGGRPRHTLTGHTKNVSSVDASWVKSFVVASSSNDRTIKTWDLQTGFCKSTIMSASNPNSLAFIDGDIICSGHRDGNLRLWDVRSGKCTTQIAAHLDVTSVCVSRSKNFILTSGRDNVHNLFDVRTLEICGTFRAMGNKVVGSWSKPCISPDENCIAAGSSDGSVYIWSRLKNGTPTILEGHSSPVLASAWCGLGPLATSDRNHIYLWS

SEQ ID NO: 4075 - DNA, 1305 bp, Sorghum bicolor
  misc_feature: Ceres ANNOT ID no. 6034528
  misc_feature: Encodes the peptide sequence at SEQ ID NO 4076
atggaggacacagcggtcgaagagcccgaggtgagcggcgccgcggagttcgcgccggcgctcgtcgctgcccacccacaaggcaactccgtcgccgtcgctattgggcccgagctccgcgcgttcgatctcagtgctggtctgccagtttcattgtcagatgattgtggtggccgttctcattcagatgctataagagctatttgcttcagtgtgagtggagctttgtttgcatctgctggtgacgacaaacttgtgaaggtttggaagactgattcatggcgttgcatccagactataacttcggagaagagggtcagtgcagttgctattagcaacgatgacctgtatgtaacttttgctgataaatttggtgttgtttggttagtcactttgcgggaagatagtgcagagcaggtttcagttgataacaaacctgtgtcaattcttggtcactattgcagtatcatcactagcatgaagttttcgccagatggacggttcattgctactgctgacagggacttcaaaatacgagtcacattattcccaaagaatcctctaaaaggggcccatgaaatacagagcttttgccttgggcatacagactttgtgtcatgcatcaccttcactagcatatctgaaacccagagctttcttgtatcaggaggaggtgattcaactgttcgcctgtgggactatgtaaatggatgtctccttgatacatttcaagtcagagataagatgggagaactcttaggaccaaatgaagcagatgatagcagtctagccattgcagatatatgtccgagtattgatggctcattggttgctgtagctattcaaagtttcagtggtgtaatgcttttagcatgtgatttagtaggaaagaagttatctttcctaaaggtgattacgatggaaaagagttatattcctactagcttagcatccagcctgtcctcagaactcctatggactgtcatgggcgcatcaaacatgcccaaccaggcttcctcccatttattaacccgtttaaggatcataccatgtttccaaaaggacagattatcttcttctgatgccggtcctgcgacccttgaagacggtgaggtaccacacggtgagaagctccttttggcactgcaaggaagcctcgacgtcacaaagcaagaggaggtgttagcttcagtgctggctgcgctgaaggtttcaatgcataagatgctggtgaagaagcactactcggaagagaggagggagcagaggaaaagaggtaggaacgacaagaagatcaagaactag

SEQ ID NO: 4076 - protein, 434 aa, Sorghum bicolor
  misc_feature: Ceres ANNOT ID no. 6034528
  misc_feature (52)..(90): Pfam Id: WD40 Pfam Desc: WD domain, G-beta repeat
  misc_feature (144)..(182): Pfam Id: WD40 Pfam Desc: WD domain, G-beta repeat
  misc_feature (192)..(233): Pfam Id: WD40 Pfam Desc: WD domain, G-beta repeat
  misc_feature (2)..(132): NCBI GI: 4587566 NCBI Desc: contains 2 pf00400 wd40, g-beta repeats. [arabidopsis thaliana]
  misc_feature (60)..(335): NCBI GI: 27696416 NCBI Desc: wdr4-prov protein [xenopus laevis]
  misc_feature (30)..(255): NCBI GI: 8249455 NCBI Desc: wd repeat domain 4 [homo sapiens]
  misc_feature (30)..(255): NCBI GI: 16445430 NCBI Desc: wd repeat domain 4 protein [homo sapiens]
  misc_feature (30)..(255): NCBI GI: 123989730 NCBI Desc: wd repeat domain 4 [synthetic construct]
  misc_feature: Useful for making plants with altered protein content
  misc_feature: Useful for making plants with modulated biomass
  misc_feature: Useful for making plants with modulated heat sensitivity
  misc_feature: GREAT-hit functional homolog of the protein sequence given in SEQ ID NO 13434
  misc_feature: GREAT-hit functional homolog of the protein sequence given in SEQ ID NO 13459
  misc_feature: Useful for making plants with altered protein content
  misc_feature: Functional homolog of the protein sequence given in SEQ ID NO 13459
MEDTAVEEPEVSGAAEFAPALVAAHPQGNSVAVAIGPELRAFDLSAGLPVSLSDDCGGRSHSDAIRAICFSVSGALFASAGDDKLVKVWKTDSWRCIQTITSEKRVSAVAISNDDLYVTFADKFGVVWLVTLREDSAEQVSVDNKPVSILGHYCSIITSMKFSPDGRFIATADRDFKIRVTLFPKNPLKGAHEIQSFCLGHTDFVSCITFTSISETQSFLVSGGGDSTVRLWDYVNGCLLDTFQVRDKMGELLGPNEADDSSLAIADICPSIDGSLVAVAIQSFSGVMLLACDLVGKKLSFLKVITMEKSYIPTSLASSLSSELLWTVMGASNMPNQASSHLLTRLRIIPCFQKDRLSSSDAGPATLEDGEVPHGEKLLLALQGSLDVTKQEEVLASVLAALKVSMHKMLVKKHYSEERREQRKRGRNDKKIKN

SEQ ID NO: 4077 - DNA, 261 bp, Sorghum bicolor
  misc_feature: Ceres ANNOT ID no. 6034530
  misc_feature: Encodes the peptide sequence at SEQ ID NO 4078
atggtacgcttcctgatcgtgctgcagaacgacatcgacctgctcaacccgccggcagagcttgagaagttaaagcacaagaaaaagcgcctcgtccagtctcccaactctttcttcatggatgtcaagtgccagggctgtttcagcatccactcccagactgtggttgtgtgccctggctgccaaactgttctctgccaacctactggtgggaaggctaggctcaccgagggttgctccttccgccgcaagggtgattag

SEQ ID NO: 4078 - protein, 86 aa, Sorghum bicolor
  misc_feature: Ceres ANNOT ID no. 6034530
  misc_feature (35)..(84): Pfam Id: Ribosomal_S27e Pfam Desc: Ribosomal protein S27
  misc_feature (6)..(86): NCBI GI: 55416173 NCBI Desc: s27 ribosomal protein [saccharum hybrid cultivar]
  misc_feature (6)..(86): NCBI GI: 4038471 NCBI Desc: 40s ribosomal protein s27 homolog [zea mays]
  misc_feature (6)..(86): NCBI GI: 45645202 NCBI Desc: 40s ribosomal protein s27 (manganese efficiency related protein 1)
  misc_feature (8)..(86): NCBI GI: 55416151 NCBI Desc: ribosomal protein s27 [saccharum hybrid cultivar]
  misc_feature (6)..(86): NCBI GI: 47848235 NCBI Desc: 40s ribosomal protein s27 [oryza sativa (japonica cultivar-group)]
MVRFLIVLQNDIDLLNPPAELEKLKHKKKRLVQSPNSFFMDVKCQGCFSIHSQTVVVCPGCQTVLCQPTGGKARLTEGCSFRRKGD

SEQ ID NO: 4079 - DNA, 759 bp, Sorghum bicolor
  misc_feature: Ceres ANNOT ID no. 6034546
  misc_feature: Encodes the peptide sequence at SEQ ID NO 4080
atggcgatcgctcggaccggcgtgtacgtcgacgactacctcgagtactcgagcaccctggctggcgacctgcagaggattctctccaccatgcgcgagctggatgacagggcacatggcattatgggtcagaccaaagaacagataaagtatattctgggagtatcatcccatgggtatgacaggtcaaacatggatgatgacgagtcggagaggatgaagaaggacattgaagctagccaggacaatgctctgaatctttgcaccgagaaagtcttactggcacgccaagcttatgacctgatagagagccatataaagcgccttgatgaagatttgggccagtttgcagaagatttaaagcatgaagggaagataccttcagatgaacctacagtccttcctctagttccggtggttagcagagatgagaaaaggaggtttggttttagtacgcctcaagcatcaaagaaatttagagagagggaatgggacagggaaaggggtatggactttgacttaatgccccctccaggtagcagcaagaaagcgggtacatctatggatgtggatcaaacaatcgatccaaatgaaccgacatactgtatatgccaccaggtttcatatggtgacatgattgcttgtgacaatgagaattgtgaaggaggcgaatggttccattacacgtgtgtgggtctgacaccagaaacgagattcaaggggaaatggttttgcccaacatgcaggacacttcagtaa

SEQ ID NO: 4080 - protein, 252 aa, Sorghum bicolor
  misc_feature: Ceres ANNOT ID no. 6034546
  misc_feature (201)..(251): Pfam Id: PHD Pfam Desc: PHD-finger
  misc_feature (1)..(251): NCBI GI: 42571873 NCBI Desc: phd finger protein-related [arabidopsis thaliana]
  misc_feature (1)..(251): NCBI GI: 124365573 NCBI Desc: zinc finger, fyve/phd-type [medicago truncatula]
  misc_feature (1)..(219): NCBI GI: 42571869 NCBI Desc: phd finger protein-related [arabidopsis thaliana]
  misc_feature (151)..(248): NCBI GI: 19921252 NCBI Desc: cg9293-pa, isoform a [drosophila melanogaster]
  misc_feature (190)..(248): NCBI GI: 24584112 NCBI Desc: cg9293-pb, isoform b [drosophila melanogaster]
  misc_feature: The plant is abnormally large.
  misc_feature: Useful for biocontainment applications
  misc_feature: Useful for making plants with modulated biomass
  misc_feature: GREAT-hit functional homolog of the protein sequence given in SEQ ID NO 12953
  misc_feature: Useful for biocontainment applications
  misc_feature: Useful for making plants with modulated biomass
  misc_feature: Functional homolog of the protein sequence given in SEQ ID NO 12953
MAIARTGVYVDDYLEYSSTLAGDLQRILSTMRELDDRAHGIMGQTKEQIKYILGVSSHGYDRSNMDDDESERMKKDIEASQDNALNLCTEKVLLARQAYDLIESHIKRLDEDLGQFAEDLKHEGKIPSDEPTVLPLVPVVSRDEKRRFGFSTPQASKKFREREWDRERGMDFDLMPPPGSSKKAGTSMDVDQTIDPNEPTYCICHQVSYGDMIACDNENCEGGEWFHYTCVGLTPETRFKGKWFCPTCRTLQ

SEQ ID NO: 4081 - DNA, 3372 bp, Sorghum bicolor
  misc_feature: Ceres ANNOT ID no. 6034555
  misc_feature: Encodes the peptide sequence at SEQ ID NO 4082
atgcgccgcggcctgcgtcgcgggttgggcatcctcctcgtcccgctcccgcacgtacccagccgcccgcaaccgacctctctcgcggctctccttctccttccccgccgcctcgatggcttctcccgccactccttctgcagcttccccggcggggggcgcgccgtcgagcagttctcagacgacgagtacgaccacgagtacgaggacctccggccgtcgtcatcggtggcgaacatcgacgagtggaggtggaagctgagcatgctccagcgcaacgcggaggagcaggagatcatctccagggaccggagggaccgccgggattatgaccaaatagccaacctcgccaagaggatgggactctacagtgagatgtacgggcgggtcgtggttgcgagcaaggtaccactgccgaactacaggcctgatctggatgacaagcggccacaaagagaggtggtgatcccgctgagcttgcagaggagagtagaaggacttgtgcaggagcatctagaccgtgcgctcttaccactggataaatgtggtggcaacacaaaaagtggctctgagatggctgagaatgcaaacctggatgagcagcatgattctctgcttgatcggtcagtcatggagaagatacttcagaggaagagcattcggatgcgaaattttcagagaagttggcaggaatcacctgaaggtgctaagatgctagagttccggagatcacttccagcatacaaagaaaaagaaaggcttctagcagccattgcacgcaatcaggttattgtaatttctggtgagacagggtgtggtaaaacaacacagctgcctcagtttgtattggaatcagagattgagtctggtcgaggggccttttgtaacataatttgtacacagccacgaagaatatctgcaatggcagttgcagaaagggtatccacagagagaggagaaaatcttggcgaatcggttggctataaagtccgtttggagggaattaagggaaaagatacacatttgcttttctgcaccagtggtatcttactaagacgattactgagtgaccgaaacttgaatggtgtgactcatgtatttgttgatgaaatacatgaaaggggcatgaatgaagatttcctattgattgtactgaaagagctgttatcacggcgccgtgatttgaggttgatattgatgagcgctactctaaatgcggaactcttctcaagttactttggaggagcgccaactatccatattcctggattcacacatccagtaagggcacattttttggaagacatattagagaggtcaggctacaagttgacctcaagcaatcaacttgatgattacgggcaagataaagtctggaaaactcagagacagctattgcctagaaaaaggaaaaatcaaattactacacttgttgaagaagcccttaaaaattcaagcttcgagacctatggttccaggacacgtgattctctagtgaattggaatcctgattgcatcggtttcaacctcattgaggctgttctgtgccacatatgtcgcaaagagcgaccgggtgctgttttagttttcatgactggatgggatgatattacttgcttgaaggatcaactgaaagcacatcctttgttaggtgatccgaatagggttttgctgcttgcatgccatggttctatggctacttctgagcagaggctaatttttgagaaaccacctcctaatgttcggaaggtagtccttgccacgaacatggcagaagcaagtattacaataaatgatatcgtttttgtcgttgattgtggtaaagcaaaggaaaccacatatgatgctctaaacaatactccctgcttactcccctcatggatttcaaaagcttctgcccgtcagaggaggggtagagctggccgtgtgcaacctggagaatgctatcatctgtatcctagatataaaaagtttgcaagtcggcagcattggggagttcctatcagctgctctacagcctccagaaccactagcttggaattcctgaagatgattggagcattagatggaaatgaaaaccttactgatcttggacggtacctttccatgcttccagttgatccaaaattgggaaagatgcttataatgggtgcagtttttcggtgcatagatcctatactcactgtagttgctggactgagtgttcgggatcctttcctgttgccacaggaaaagaaggatttggcaggaacagcaaaatctagattctcagcaaaggattatagtgatcatatggccctcgttcgggcttatgaaggatggaaggatgcagagagagaagggtctgcttatgaatactgctggagaaatttcctttcttctcaaacactacaagccattcactcacttcggaagcaattcagctatattttaaaggattccggtttgatagactctgatgggaatacaaataacagtttgagccataatcaatcattggtccgcggtattatatgttctgggctttttcctgggatagcatctgttgtgcatcgagaaaactcaatgtcctttaagaccatggatgacggccaagttcttctttatgttaattcagtgaatgcaaaatatcagactatcccatatccatggctggtctttggtgagaaggtgaaagtgaatgctgtcttcatccgtgattcaactggagtatcagactccatagtgattctgtttggtggtgctgtaacaaaaggaggcatggctgggcacttgaagatgcttgatggctacattgatttctttatggatccgagcctgtctgaatgctacctgcaactcaaagaagaacttgataaacttatacagaagaagcttgaagacccaaactttgacatccacaaggaaggcaagcacatcctattcgctgtacaagagcttgctgccggtgacctatgcgaaggaaggtttgtgtttggccgtgagacgagccgtgccaggctccggaatcctgaggacgacagcaagagcaacatcataaaggacgggatgaaccccaagagcctgctgcagacactgctgatgcgggccggccacaccccacccaagtacaagacgaagcacctcaagacgaacgagttcagggccatggtggagttcaagggcatgcagttcgtggggaagccgaagcggaacaagcagctcgcggagcgggacgccgccatcgaggcgctggggtggctgacgcagacgtccggcgtgaagccacaggacgagaacgacgatgactcgccgctggacctgactgatggcatgctgaagctgctcaccagaccgaggcggcactcgaagaataactctagaaaacgatga

SEQ ID NO: 4082 - protein, 1123 aa, Sorghum bicolor
  misc_feature: Ceres ANNOT ID no. 6034555
  misc_feature (677)..(768): Pfam Id: HA2 Pfam Desc: Helicase associated domain (HA2)
  misc_feature (550)..(644): Pfam Id: Helicase_C Pfam Desc: Helicase conserved C-terminal domain
  misc_feature (1019)..(1081): Pfam Id: dsrm Pfam Desc: Double-stranded RNA binding motif
  misc_feature (248)..(409): Pfam Id: DEAD Pfam Desc: DEAD/DEAH box helicase
  misc_feature (1)..(655): NCBI GI: 115455343 NCBI Desc: os03g0748800 [oryza sativa (japonica cultivar-group)]
  misc_feature (23)..(662): NCBI GI: 145361138 NCBI Desc: atp binding / helicase/ nucleic acid binding [arabidopsis thaliana]
  misc_feature (51)..(719): NCBI GI: 30694379 NCBI Desc: helicase domain-containing protein [arabidopsis thaliana]
  misc_feature (65)..(719): NCBI GI: 79548544 NCBI Desc: atp binding / atp-dependent helicase/ double-stranded rna binding / helicase/ nucleic acid binding [arabidopsis thaliana]
  misc_feature (262)..(742): NCBI GI: 115434200 NCBI Desc: os01g0118100 [oryza sativa (japonica cultivar-group)]
MRRGLRRGLGILLVPLPHVPSRPQPTSLAALLLLPRRLDGFSRHSFCSFPGGGRAVEQFSDDEYDHEYEDLRPSSSVANIDEWRWKLSMLQRNAEEQEIISRDRRDRRDYDQIANLAKRMGLYSEMYGRVVVASKVPLPNYRPDLDDKRPQREVVIPLSLQRRVEGLVQEHLDRALLPLDKCGGNTKSGSEMAENANLDEQHDSLLDRSVMEKILQRKSIRMRNFQRSWQESPEGAKMLEFRRSLPAYKEKERLLAAIARNQVIVISGETGCGKTTQLPQFVLESEIESGRGAFCNIICTQPRRISAMAVAERVSTERGENLGESVGYKVRLEGIKGKDTHLLFCTSGILLRRLLSDRNLNGVTHVFVDEIHERGMNEDFLLIVLKELLSRRRDLRLILMSATLNAELFSSYFGGAPTIHIPGFTHPVRAHFLEDILERSGYKLTSSNQLDDYGQDKVWKTQRQLLPRKRKNQITTLVEEALKNSSFETYGSRTRDSLVNWNPDCIGFNLIEAVLCHICRKERPGAVLVFMTGWDDITCLKDQLKAHPLLGDPNRVLLLACHGSMATSEQRLIFEKPPPNVRKVVLATNMAEASITINDIVFVVDCGKAKETTYDALNNTPCLLPSWISKASARQRRGRAGRVQPGECYHLYPRYKKFASRQHWGVPISCSTASRTTSLEFLKMIGALDGNENLTDLGRYLSMLPVDPKLGKMLIMGAVFRCIDPILTVVAGLSVRDPFLLPQEKKDLAGTAKSRFSAKDYSDHMALVRAYEGWKDAEREGSAYEYCWRNFLSSQTLQAIHSLRKQFSYILKDSGLIDSDGNTNNSLSHNQSLVRGIICSGLFPGIASVVHRENSMSFKTMDDGQVLLYVNSVNAKYQTIPYPWLVFGEKVKVNAVFIRDSTGVSDSIVILFGGAVTKGGMAGHLKMLDGYIDFFMDPSLSECYLQLKEELDKLIQKKLEDPNFDIHKEGKHILFAVQELAAGDLCEGRFVFGRETSRARLRNPEDDSKSNIIKDGMNPKSLLQTLLMRAGHTPPKYKTKHLKTNEFRAMVEFKGMQFVGKPKRNKQLAERDAAIEALGWLTQTSGVKPQDENDDDSPLDLTDGMLKLLTRPRRHSKNNSRKR

SEQ ID NO: 4083 - DNA, 1038 bp, Sorghum bicolor
  misc_feature: Ceres ANNOT ID no. 6034568
  misc_feature: Encodes the peptide sequence at SEQ ID NO 4084
atggcgctgctgatggaacccggcgctgagcccctgactgagagcgagcaggccgacctggccggcatcgccgccataaaggagtcggctgcgcgcgaattcaaggagcaggggaaccagttcgtccggatgggccggaagcactacgccgaggcggtctcctgctacacgaaggccatcgcccagatggagcccctctcctcgctcgacgcatctgccgccgccgacgcctccgttctcttcgccaaccgagcacacgtcaacctcctcctcggcaaccaccgacgggccctcgacgacgccgagcaggccatccgcctctccccctccagcgtcaaggcatactaccgggcagtgaaggcggcgcttgcgctcgacttgttgacggacgcggcgtccttctgccggaaggggctcgaacaggaccccgctaacgaggaattcaagaaactgttgtcggaagtggacgcaaaactgagagaacaagaccgtcagagagccaaggttgcacaagctatcaccaaagccaaggatcttgctgctgctatggaaaagagaggggtgaagcttgggaaggcagcctatcaagagctgactggggtaaagaagccaaagctggatgagcagggcgtgctccactggcctgttcttctgctatacccagaggtcatgtcgagtgacttcattgaggattttccagatacagatactttcttgccccaccttgatggtggttttggcaaacctttgtccaaaagtgaagtattaagatatcttctagaaggcactgtagatttgaaggcgcttccagatagcctgcttgatggggaagatgaagaacatgacagtagcaaatgtagcactgttacatcaactgatggctccagtaagtggatcaaagtaaaagaaggaaaaacacttcaagaggtgctgcaggataaaggctatatcgttcctgcaattcctgtgttctttgttgtttcaagaaagtccaccttctataaagatttcaaggctggaaattggtctttgccatga

SEQ ID NO: 4084 - protein, 345 aa, Sorghum bicolor
  misc_feature: Ceres ANNOT ID no. 6034568
  misc_feature (78)..(111): Pfam Id: TPR_1 Pfam Desc: Tetratricopeptide repeat
  misc_feature (1)..(334): NCBI GI: 115455361 NCBI Desc: os03g0750100 [oryza sativa (japonica cultivar-group)]
  misc_feature (1)..(248): NCBI GI: 18379248 NCBI Desc: tetratricopeptide repeat (tpr)-containing protein [arabidopsis thaliana]
  misc_feature (1)..(323): NCBI GI: 3142297 NCBI Desc: contains similarity to serine/threonine protein phosphatase gbx83099 from s. cerevisiae. [arabidopsis thaliana]
  misc_feature (105)..(248): NCBI GI: 17978865 NCBI Desc: at1g04130/f20d22_10 [arabidopsis thaliana]
  misc_feature (28)..(248): NCBI GI: 46229722 NCBI Desc: protein with 2 tpr domains; transcripts identified by est [cryptosporidium parvum]
MALLMEPGAEPLTESEQADLAGIAAIKESAAREFKEQGNQFVRMGRKHYAEAVSCYTKAIAQMEPLSSLDASAAADASVLFANRAHVNLLLGNHRRALDDAEQAIRLSPSSVKAYYRAVKAALALDLLTDAASFCRKGLEQDPANEEFKKLLSEVDAKLREQDRQRAKVAQAITKAKDLAAAMEKRGVKLGKAAYQELTGVKKPKLDEQGVLHWPVLLLYPEVMSSDFIEDFPDTDTFLPHLDGGFGKPLSKSEVLRYLLEGTVDLKALPDSLLDGEDEEHDSSKCSTVTSTDGSSKWIKVKEGKTLQEVLQDKGYIVPAIPVFFVVSRKSTFYKDFKAGNWSLP

SEQ ID NO: 4085 - DNA, 1677 bp, Sorghum bicolor
  misc_feature: Ceres ANNOT ID no. 6034571
  misc_feature: Encodes the peptide sequence at SEQ ID NO 4086
atggggcggtcgagaggggtgccgaattccggtgacgatgacaccggacacaggtcgaagcggaggagggtctcggggtcgggcggggacgcgacggactccatttcagccgccatcgggggagctggagagggagggggcaagaaggcgctctaccactgcaactactgcaacaaggacatctccgggaagatacggatcaaatgctccaagtgccctgacttcgacctctgcgtggagtgcttctctgttggcgctgaagttaccccacaccgcagcaaccatccatacagagtcatggacaacctgtctttcccacttatttgcccagactggaatgcagatgaagaaattctcctccttgagggaattgaaatgtatggtctgggaaactggcttgaagtggcagaacatgttggtaccaagtctaagttacagtgtattgatcattacacaacagcatacatgaactcaccttgttatcccctcccggatatgtctcatgttaatggcaagaacaggaaggagcttctagctatggctaaagtgcagggtgagagtaaaaaagggacttcactgttatctggagaactgactcctaaggctgaatctccattttctccctccagggtcaaggtggaagatgcacttggagaaggtccagcaggtcgatcaccttcacacatagctgttggtgcaaataaaaaggcttcaaatgtgggacagattaaagatggtgctaatgtgtcaaaaatcgaagatggtcatgtcgatagaagcgttggtgtgaagaagcccagatattctgcagatgaaggcccttcgttgactgaactgagtggatacaatgcaaagagacatgagtttgacccagagtatgataatgatgccgaacaagcgcttgctgagatggaatttaaagaaactgattcggaaaccgatcgtgaactgaaactccgtgttcttcgtatttatctgtccaggcttgaagaaagaaaaaggagaaaggagttcatattggaaagaaatttattgttccctaatcccttggagaaagatcttacaaatgaagacagggaagtttaccatcgctataaggtcttcatgcgttttctttccaaggaggaacatgaagccctcattaggagtgtcattgaggagcgaaaaattcggaggagaattcaagaactccaggaatgtcgctctgctgggtgccgcacactggctgaagcaaagatacacatagaacaaaagaggaaaaaagaatacgagctgaatgcccaaaaagctaaggagagcagccttattgcaaataataaatcggtacagaagatgaatcgatctatgaaaattgagtctgatgggaatttggatccaaagaaaggtggtgctggcttggattctcctaaaactacaggacttacaagtgttaagcagtgggatgactgggatatagttggtcttcctggggcagagctattaagtgctagcaacagattgctacctagtcattaccttagaatgcaggaggtgttgatgcaggagatattcaagggtagtgtcttaaagaaggaagatgcccatgtcttatttaaggttgatcctaccaaagtagatagtgtttatgatatggtaacgaaaaagctgggcaaccatgaggaggctccaactgtctag

SEQ ID NO: 4086 - protein, 558 aa, Sorghum bicolor
  misc_feature: Ceres ANNOT ID no. 6034571
  misc_feature (109)..(155): Pfam Id: Myb_DNA-binding Pfam Desc: Myb-like DNA-binding domain
  misc_feature (48)..(93): Pfam Id: ZZ Pfam Desc: Zinc finger, ZZ type
  misc_feature (1)..(558): NCBI GI: 18642468 NCBI Desc: transcriptional adaptor [zea mays]
  misc_feature (1)..(558): NCBI GI: 21898562 NCBI Desc: histone acetyltransferase complex component [zea mays]
  misc_feature (1)..(558): NCBI GI: 121957980 NCBI Desc: transcriptional adapter ada2
  misc_feature (180)..(558): NCBI GI: 18644088 NCBI Desc: pollen specific transcriptional adaptor [zea mays]
  misc_feature (1)..(245): NCBI GI: 42572927 NCBI Desc: transcriptional adaptor (ada2b) [arabidopsis thaliana]
  misc_feature: The sequence is a functional homolog of SEQ ID NO 106 in the 10/286,264US patent application
  misc_feature: The sequence is a functional homolog of SEQ ID NO 206 in the 10/412,699US patent application
  misc_feature: The sequence is a functional homolog of SEQ ID NO 425 in the 11/479,226US patent application
  misc_feature: Useful for making plants with modulated cold sensitivity
  misc_feature: Useful for making plants with modulated growth and phenotype characteristics
  misc_feature: GREAT-hit functional homolog of the protein sequence given in SEQ ID NO 13383
  misc_feature: The sequence is a functional homolog of SEQ ID NO 106 in the 20030093837 US patent application
  misc_feature: The sequence is a functional homolog of SEQ ID NO. 492 in the 11/188,298 US application
MGRSRGVPNSGDDDTGHRSKRRRVSGSGGDATDSISAAIGGAGEGGGKKALYHCNYCNKDISGKIRIKCSKCPDFDLCVECFSVGAEVTPHRSNHPYRVMDNLSFPLICPDWNADEEILLLEGIEMYGLGNWLEVAEHVGTKSKLQCIDHYTTAYMNSPCYPLPDMSHVNGKNRKELLAMAKVQGESKKGTSLLSGELTPKAESPFSPSRVKVEDALGEGPAGRSPSHIAVGANKKASNVGQIKDGANVSKIEDGHVDRSVGVKKPRYSADEGPSLTELSGYNAKRHEFDPEYDNDAEQALAEMEFKETDSETDRELKLRVLRIYLSRLEERKRRKEFILERNLLFPNPLEKDLTNEDREVYHRYKVFMRFLSKEEHEALIRSVIEERKIRRRIQELQECRSAGCRTLAEAKIHIEQKRKKEYELNAQKAKESSLIANNKSVQKMNRSMKIESDGNLDPKKGGAGLDSPKTTGLTSVKQWDDWDIVGLPGAELLSASNRLLPSHYLRMQEVLMQEIFKGSVLKKEDAHVLFKVDPTKVDSVYDMVTKKLGNHEEAPTV

SEQ ID NO: 4087 - DNA, 2244 bp, Sorghum bicolor
  misc_feature: Ceres ANNOT ID no. 6034575
  misc_feature: Encodes the peptide sequence at SEQ ID NO 4088
atggcgccgtcgcggaagtcgccggtggtggcggaggagcgggcggggatggaggaggggaagggggagcggtgcgcggtggaggaggtggcgctggtggtgccggagacggacgacccgtcgctgccggtgatgacattccgggcgtggacgctggggctcggctcctgcgtcgtcctcatcttcctcaacaccttcttcacgtaccgcacccagccgctcaccatctccgggatcctcgcacagatcctcgtgctccccgccggccgcttcatggccgccgtgctgcccaaccgcgaggtcaggctcctcggcggcaggctcggcagcttcaacctcaacccggggccattcaacgtcaaggagcacgtcatcatcaccatcttcgccaactgcggcgtctcctacggcggcggcgacgcctactccatcggcgccatcaccgtcatgaaggcctactacaagcagacgctcagcttcgcctgcgccctactcatcgtcctcacgacacagatactggggtacggctgggctgggatgctgaggaggtacctggtcgaccctgccgagatgtggtggccttctaatcttgcccaggtctcactcttcagggcgctgcacgagaaagaagaggagggcggcaagtcccgtggcccgtcgcggatgcgcttcttcctgatcgtcttcttcgcgagcttcgcgtactacgcgctgccgggctacctgctgccgatcctgaccttcttctcgtgggcgtgctgggtgtggccgcacagcatcacggcgcagcaggtcgggtccgggtaccacggcctcggcgtgggcgccttcacgctggactgggcgggcatctcggcgtaccacggcagcccgctggtggcgccgtgggcgtccatcgccaacacggccgtgggattcgtcatgttcatctacgtcatcgtgccgctctgctactggcagttcaacacgttcgacgcccgcaggttccccatcttctccaaccagctcttcacggcgtcggggcagaagtacgacaccaccaaggtgctcaccaaggacttcgacctcaacgtcgccgcctacgacagctacggcaagctctacctcagcccgctcttcgccatctccatcggctccgggttcctgcggttcacggccaccatcgtccacgtcctgctcttccatggcagcgacatgtggaagcagagcaagtcggccatgaacgccgtgaagatggacgtgcacgccaagctgatgcagaggtacaggcaggtgccacagtggtggttcctcatgctgctgctgggcagcgtggttgtgtcgctgctcatgtccttcgtctggaaggaggaggtgcagctgccgtggtgggggatgctcttcgccttcgcgctcgccttcgtcgtcacactccccatcggcgtcatccaggccaccaccaaccagcaaccggggtacgacatcatcgcgcagttcatgatcggctacgcgctgcccggcaagcccatcgccaacctgctcttcaagatttacggccggatcagcaccgtgcacgcgctgtcgttcctcgccgacctcaagctcggccactacatgaagatccccccacggtgcatgtacacggcccagctgatcgggacggtggtcgccggcgttgtgaacctggcggtggcgtggtggatgctggacaacatcgacaacatctgcgacgtggaggcgctgcacccggacagcccgtggacgtgccccaagtaccgcgtcacgttcgacgcgtcggtgatctggggcctgatcggccccgggcggctcttcggccggcacggtctctaccgcaacctggtgtggctgttcctggtcggcgcggtgctccccgtgccggtgtggctgctgagcagggcgttcccggagaagaagtggatcgcgctcatcaacgtgcccgtcatctcgtacggcttcgccgggatgccgccggccacgcccaccaacatcgccacatggctggtgacgggcaccatcttcaacttcttcgtcttcaggtaccgcaaggcgtggtggcagaagtacaactacgtgctctcggcggcgctcgacgccggcaccgccttcatgggggtgctcatcttcttcgcgctccagaacgcgcaccacgacctcaagtggtggggcacggaggtggatcactgcccgctcgcctcctgccccactgcgccgggcatcgccgtcaagggatgcccggtcttctga

SEQ ID NO: 4088 - protein, 747 aa, Sorghum bicolor
  misc_feature: Ceres ANNOT ID no. 6034575
  misc_feature (44)..(711): Pfam Id: OPT Pfam Desc: OPT oligopeptide transporter protein
  misc_feature (3)..(747): NCBI GI: 102140021 NCBI Desc: oligopeptide transporter opt family protein [musa acuminata]
  misc_feature (23)..(747): NCBI GI: 25083021 NCBI Desc: isp4 like protein [arabidopsis thaliana]
  misc_feature (23)..(747): NCBI GI: 67460720 NCBI Desc: probable oligopeptide transporter 3 (atopt3)
  misc_feature (82)..(747): NCBI GI: 30722286 NCBI Desc: glutathione transporter gt1 [brassica juncea]
  misc_feature (172)..(661): NCBI GI: 81051974 NCBI Desc: small oligopeptide transporter, opt family [allium cepa]
MAPSRKSPVVAEERAGMEEGKGERCAVEEVALVVPETDDPSLPVMTFRAWTLGLGSCVVLIFLNTFFTYRTQPLTISGILAQILVLPAGRFMAAVLPNREVRLLGGRLGSFNLNPGPFNVKEHVIITIFANCGVSYGGGDAYSIGAITVMKAYYKQTLSFACALLIVLTTQILGYGWAGMLRRYLVDPAEMWWPSNLAQVSLFRALHEKEEEGGKSRGPSRMRFFLIVFFASFAYYALPGYLLPILTFFSWACWVWPHSITAQQVGSGYHGLGVGAFTLDWAGISAYHGSPLVAPWASIANTAVGFVMFIYVIVPLCYWQFNTFDARRFPIFSNQLFTASGQKYDTTKVLTKDFDLNVAAYDSYGKLYLSPLFAISIGSGFLRFTATIVHVLLFHGSDMWKQSKSAMNAVKMDVHAKLMQRYRQVPQWWFLMLLLGSVVVSLLMSFVWKEEVQLPWWGMLFAFALAFVVTLPIGVIQATTNQQPGYDIIAQFMIGYALPGKPIANLLFKIYGRISTVHALSFLADLKLGHYMKIPPRCMYTAQLIGTVVAGVVNLAVAWWMLDNIDNICDVEALHPDSPWTCPKYRVTFDASVIWGLIGPGRLFGRHGLYRNLVWLFLVGAVLPVPVWLLSRAFPEKKWIALINVPVISYGFAGMPPATPTNIATWLVTGTIFNFFVFRYRKAWWQKYNYVLSAALDAGTAFMGVLIFFALQNAHHDLKWWGTEVDHCPLASCPTAPGIAVKGCPVF

SEQ ID NO: 4089 - DNA, 744 bp, Sorghum bicolor
  misc_feature: Ceres ANNOT ID no. 6034597
  misc_feature: Encodes the peptide sequence at SEQ ID NO 4090
atggggcgcgggaaggtgcagctgaagcggatcgagaacaagatcaaccgccaggtgaccttctccaagcgccgctcggggctgctcaagaaggcgcacgagatctccgtgctctgcgatgccgaggtcgcgcttatcatcttctccaccaagggcaagctctacgagtactccaccgattcatgtatggacaaaattcttgaacggtatgagcgttactcctatgcagaaaaggttctcatttcagcagaatctgaaactcagggcaactggtgccacgaatatagaaaactaaaggcgaaggtcgagacaatacagaaatgtcaaaagcacctcatgggagaggatcttgaaactttgaatctcaaagagcttcagcaactagagcagcagctggagagttcactgaaacatatcagaaccaggaagagccagcttatgctcgagtcaatttcagagctccaacggaaggagaagtctctacaggaggagaacaaggttctgcagaaggagaaagccttactcctgcctgcagctcgcggagaagcagaaagcccagcggcagcaagtgcagcgggaccaaactcaacagcagaccagttcgtcttcctcgtccttcatgataagggaagctgccccaacaacaaatatcagcatcttccctgtggcagcaggcgggagagtggtggaagctgcagcagcgccgccgcaggctcgcgttggactgccaccctggatgcttag

SEQ ID NO: 4090 - protein, 247 aa, Sorghum bicolor
  misc_feature: Ceres ANNOT ID no. 6034597
  misc_feature (75)..(174): Pfam Id: K-box Pfam Desc: K-box region
  misc_feature (9)..(59): Pfam Id: SRF-TF Pfam Desc: SRF-type transcription factor (DNA-binding and dimerisationdomain)
  misc_feature (1)..(198): NCBI GI: 29372764 NCBI Desc: m4 [zea mays]
  misc_feature (1)..(171): NCBI GI: 39843110 NCBI Desc: mads-box protein [dendrocalamus latiflorus]
  misc_feature (1)..(171): NCBI GI: 7592642 NCBI Desc: ap1-like mads box protein [oryza sativa]
  misc_feature (1)..(171): NCBI GI: 33242921 NCBI Desc: mads box protein [oryza sativa (japonica cultivar-group)]
  misc_feature (1)..(171): NCBI GI: 45385954 NCBI Desc: mads-box protein rmads211 [oryza sativa (japonica cultivar-group)]
  misc_feature: Abnormal phyllotaxy, leaf number higher than wild-type
  misc_feature: The plant flowers significantly earllier than wild-type.
  misc_feature: The plant flowers significantly late compared to wild-type.
  misc_feature: The plant is abnormally large.
  misc_feature: The plant is abnormally small.
  misc_feature: The plant produces a reduced number of seeds.
  misc_feature: The sequence is a functional homolog of SEQ ID NO 1360 in the 10/666,642US patent application
  misc_feature: The sequence is a functional homolog of SEQ ID NO 18 in the 10/412,699US patent application
  misc_feature: The sequence is a functional homolog of SEQ ID NO 188 in the 10/412,699US patent application
  misc_feature: The sequence is a functional homolog of SEQ ID NO 1884 in the 10/412,699US patent application
  misc_feature: The sequence is a functional homolog of SEQ ID NO 1886 in the 10/412,699US patent application
  misc_feature: The sequence is a functional homolog of SEQ ID NO 1971 in the 10/412,699US patent application
  misc_feature: The sequence is a functional homolog of SEQ ID NO 2146 in the 10/374,780US patent application
  misc_feature: The sequence is a functional homolog of SEQ ID NO 22 in the 10/666,642US patent application
  misc_feature: The sequence is a functional homolog of SEQ ID NO 2274 in the 10/374,780US patent application
  misc_feature: The sequence is a functional homolog of SEQ ID NO 352 in the 10/374,780US patent application
  misc_feature: The sequence is a functional homolog of SEQ ID NO 384 in the 10/225,066US patent application
  misc_feature: The sequence is a functional homolog of SEQ ID NO 704 in the 10/225,066US patent application
  misc_feature: The sequence is a functional homolog of SEQ ID NO 946 in the 10/412,699US patent application
  misc_feature: The sequence is a functional homolog of SEQ ID NO 948 in the 10/412,699US patent application
  misc_feature: There is no branching.
  misc_feature: Useful for biocontainment applications
  misc_feature: Useful for making plants with altered alkaloid content
  misc_feature: Useful for making plants with modulated biomass
  misc_feature: Useful for making plants with modulated flowering time
  misc_feature: Useful for making plants with modulated growth and phenotype characteristics
  misc_feature: Useful for making plants with modulated phosphate use efficiency
  misc_feature: GREAT-hit functional homolog of the protein sequence given in SEQ ID NO 12958
  misc_feature: Functional homolog of the protein sequence given in SEQ ID NO 13016
  misc_feature: Functional homolog of the protein sequence given in SEQ ID NO 13133
  misc_feature: Functional homolog of the protein sequence given in SEQ ID NO 13166
  misc_feature: Functional homolog of the protein sequence given in SEQ ID NO 13257
  misc_feature: Functional homolog of the protein sequence given in SEQ ID NO 13328
  misc_feature: The sequence is a functional homolog of SEQ ID NO 18 in the 20040045049 US patent application
  misc_feature: The sequence is a functional homolog of SEQ ID NO 188 in the 20040045049 US patent application
  misc_feature: The sequence is a functional homolog of SEQ ID NO 1884 in the 20040045049 US patent application
  misc_feature: The sequence is a functional homolog of SEQ ID NO 1886 in the 20040045049 US patent application
  misc_feature: The sequence is a functional homolog of SEQ ID NO 1971 in the 20040045049 US patent application
  misc_feature: The sequence is a functional homolog of SEQ ID NO 1360 in the 20070033671 US patent application
  misc_feature: The sequence is a functional homolog of SEQ ID NO 6 in US patent 7279615
  misc_feature: Useful for making plants with modulated biomass
  misc_feature: Useful for making plants with modulated flowering time
  misc_feature: Useful for making plants with modulated phosphate use efficiency
  misc_feature: Functional homolog of the protein sequence given in SEQ ID NO 13166
  misc_feature: The sequence is a functional homolog of SEQ ID NO 2 in US patent 7273968
  misc_feature: The sequence is a functional homolog of SEQ ID NO 1360 in the 10/666,642 US patent application
  misc_feature: The sequence is a functional homolog of SEQ ID NO 22 in the 10/666,642 US patent application
  misc_feature: Useful for making plants with altered alkaloid content
  misc_feature: Functional homolog of the protein sequence given in SEQ ID NO 13525
  misc_feature: The sequence is a functional homolog of SEQ ID NO 46 in the 10/666,642 US patent application
  misc_feature: The sequence is a functional homolog of SEQ ID NO 730 in the 10/666,642 US patent application
  misc_feature: The sequence is a functional homolog of SEQ ID NO 428 in the 10/666,642 US patent application
  misc_feature: The sequence is a functional homolog of SEQ ID NO 892 in the 11/435,388 US patent application
  misc_feature: The sequence is a functional homolog of SEQ ID NO 4 in US patent 7057087
  misc_feature: Useful for biocontainment applications
  misc_feature: Functional homolog of the protein sequence given in SEQ ID NO 13016
  misc_feature: Useful for making plants with altered terpenoid content
  misc_feature: Functional homolog of the protein sequence given in SEQ ID NO 13021
  misc_feature: Useful for making plants with altered lignin content
  misc_feature: Functional homolog of the protein sequence given in SEQ ID NO 12944
  misc_feature: The sequence is a functional homolog of SEQ ID NO 1955 in the 10/412,699 US patent application
  misc_feature: The sequence is a functional homolog of SEQ ID NO 1949 in the 10/412,699 US patent application
  misc_feature: Useful for making plants with modulated nitrogen use efficiency
  misc_feature: Functional homolog of the protein sequence given in SEQ ID NO 12982
  misc_feature: The sequence is a functional homolog of SEQ ID NO 1965 in the 10/412,699 US patent application
  misc_feature: The sequence is a functional homolog of SEQ ID NO 1967 in the 10/412,699 US patent application
  misc_feature: The sequence is a functional homolog of SEQ ID NO 1963 in the 10/412,699 US patent application
  misc_feature: The sequence is a functional homolog of SEQ ID NO 1957 in the 10/412,699 US patent application
  misc_feature: The sequence is a functional homolog of SEQ ID NO 1959 in the 10/412,699 US patent application
  misc_feature: The sequence is a functional homolog of SEQ ID NO. 361 in the 11/188,298 US application
  misc_feature: The sequence is a functional homolog of SEQ ID NO. 518 in the 11/188,298 US application
  misc_feature: The sequence is a functional homolog of SEQ ID NO. 273 in the 11/188,298 US application
  misc_feature: The sequence is a functional homolog of SEQ ID NO. 359 in the 11/188,298 US application
  misc_feature: The sequence is a functional homolog of SEQ ID NO. 420 in the 11/188,298 US application
  misc_feature: The sequence is a functional homolog of SEQ ID NO. 377 in the 11/188,298 US application
MGRGKVQLKRIENKINRQVTFSKRRSGLLKKAHEISVLCDAEVALIIFSTKGKLYEYSTDSCMDKILERYERYSYAEKVLISAESETQGNWCHEYRKLKAKVETIQKCQKHLMGEDLETLNLKELQQLEQQLESSLKHIRTRKSQLMLESISELQRKEKSLQEENKVLQKEKALLLPAARGEAESPAAASAAGPNSTADQFVFLVLHDKGSCPNNKYQHLPCGSRRESGGSCSSAAAGSRWTATLDA

SEQ ID NO: 4091 - DNA, 726 bp, Sorghum bicolor
  misc_feature: Ceres ANNOT ID no. 6034599
  misc_feature: Encodes the peptide sequence at SEQ ID NO 4092
atgggccgcgggaaggtggtgctgcagcggatcgagaacaagatcagccggcaggtgaccttcgccaagcgccggaacggcctgctcaagaaggcctacgagctctccatcctctgcgacgccgaggtcgcgctcgtcctcttctcccacgccggccgcctctaccagttctcatcctcctccaatctgcttaagactctagagcgataccagaggtacatctatgcttcagctgatgctgcagtgccatctagcgatgagatgcagaataactatcaagaatatgtgaacctgaaggcacgagttgaggttttacaacactcacaaaggaatcttcttggtgaagatctggctccacttagccctagtgaacttgaccagcttgagagtcaagtagacaagaccttgaagcaaataagatcaagaaagactcaagtgttacttgatgaactttgcgacttaaagagaaaggaacaaatgctgcaagatgcaaacagggttctgaaaaggaagctggacgagtttgaggcagaggctgcttctcccccgcagctagcgtggcaagacgggggcggcatgttgtcccatgaccctccacagccagaacatttcttccaggctctggagagcaacccatctctgcaacctacataccatacgatggacatgaaccagcagccagtgccatcgccgggcagctgctaccctcctgattggatggcttag

SEQ ID NO: 4092 - protein, 241 aa, Sorghum bicolor
  misc_feature: Ceres ANNOT ID no. 6034599
  misc_feature (75)..(174): Pfam Id: K-box Pfam Desc: K-box region
  misc_feature (9)..(59): Pfam Id: SRF-TF Pfam Desc: SRF-type transcription factor (DNA-binding and dimerisationdomain)
  misc_feature (1)..(241): NCBI GI: 29372762 NCBI Desc: m31 [zea mays]
  misc_feature (1)..(241): NCBI GI: 29372758 NCBI Desc: m24 [zea mays]
  misc_feature (1)..(241): NCBI GI: 45385956 NCBI Desc: mads-box protein rmads212 [oryza sativa (japonica cultivar-group)]
  misc_feature (1)..(241): NCBI GI: 45385966 NCBI Desc: mads-box protein rmads217 [oryza sativa (japonica cultivar-group)]
  misc_feature (1)..(241): NCBI GI: 45385974 NCBI Desc: mads-box protein rmads221 [oryza sativa (japonica cultivar-group)]
  misc_feature: Abnormal phyllotaxy, leaf number higher than wild-type
  misc_feature: The plant flowers significantly earllier than wild-type.
  misc_feature: The plant is abnormally small.
  misc_feature: The sequence is a functional homolog of SEQ ID NO 28 in the 10/666,642US patent application
  misc_feature: The sequence is a functional homolog of SEQ ID NO 30 in the 10/666,642US patent application
  misc_feature: Useful for making plants with modulated biomass
  misc_feature: Useful for making plants with modulated flowering time
  misc_feature: Useful for making plants with modulated growth and phenotype characteristics
  misc_feature: Functional homolog of the protein sequence given in SEQ ID NO 12958
  misc_feature: The sequence is a functional homolog of SEQ ID NO 28 in the 20070033671 US patent application
  misc_feature: The sequence is a functional homolog of SEQ ID NO 30 in the 20070033671 US patent application
  misc_feature: Functional homolog of the protein sequence given in SEQ ID NO 13569
  misc_feature: The sequence is a functional homolog of SEQ ID NO 4 in US patent 7057087
  misc_feature: Useful for making plants with modulated biomass
  misc_feature: Useful for making plants with modulated flowering time
  misc_feature: Functional homolog of the protein sequence given in SEQ ID NO 13569
  misc_feature: The sequence is a functional homolog of SEQ ID NO 30 in the 10/666,642 US patent application
  misc_feature: The sequence is a functional homolog of SEQ ID NO 28 in the 10/666,642 US patent application
  misc_feature: The sequence is a functional homolog of SEQ ID NO 36 in the 10/666,642 US patent application
  misc_feature: The sequence is a functional homolog of SEQ ID NO 60 in the 10/412,699 US patent application
  misc_feature: The sequence is a functional homolog of SEQ ID NO 6 in US patent 7279615
  misc_feature: The sequence is a functional homolog of SEQ ID NO 46 in the 10/666,642 US patent application
  misc_feature: The sequence is a functional homolog of SEQ ID NO 730 in the 10/666,642 US patent application
  misc_feature: Useful for making plants with altered alkaloid content
  misc_feature: Useful for making plants with altered terpenoid content
  misc_feature: Functional homolog of the protein sequence given in SEQ ID NO 13021
  misc_feature: The sequence is a functional homolog of SEQ ID NO 122 in the 10/666,642 US patent application
  misc_feature: The sequence is a functional homolog of SEQ ID NO 406 in the 10/412,699 US patent application
  misc_feature: The sequence is a functional homolog of SEQ ID NO 1701 in the 10/412,699 US patent application
  misc_feature: The sequence is a functional homolog of SEQ ID NO 1949 in the 10/412,699 US patent application
  misc_feature: The sequence is a functional homolog of SEQ ID NO 1965 in the 10/412,699 US patent application
  misc_feature: The sequence is a functional homolog of SEQ ID NO 1963 in the 10/412,699 US patent application
  misc_feature: The sequence is a functional homolog of SEQ ID NO 1967 in the 10/412,699 US patent application
  misc_feature: Useful for making plants with altered lignin content
  misc_feature: Functional homolog of the protein sequence given in SEQ ID NO 12944
  misc_feature: The sequence is a functional homolog of SEQ ID NO 1957 in the 10/412,699 US patent application
  misc_feature: The sequence is a functional homolog of SEQ ID NO 1959 in the 10/412,699 US patent application
  misc_feature: The sequence is a functional homolog of SEQ ID NO. 361 in the 11/188,298 US application
  misc_feature: The sequence is a functional homolog of SEQ ID NO. 273 in the 11/188,298 US application
  misc_feature: The sequence is a functional homolog of SEQ ID NO. 518 in the 11/188,298 US application
  misc_feature: The sequence is a functional homolog of SEQ ID NO. 359 in the 11/188,298 US application
  misc_feature: The sequence is a functional homolog of SEQ ID NO. 420 in the 11/188,298 US application
  misc_feature: The sequence is a functional homolog of SEQ ID NO. 377 in the 11/188,298 US application
MGRGKVVLQRIENKISRQVTFAKRRNGLLKKAYELSILCDAEVALVLFSHAGRLYQFSSSSNLLKTLERYQRYIYASADAAVPSSDEMQNNYQEYVNLKARVEVLQHSQRNLLGEDLAPLSPSELDQLESQVDKTLKQIRSRKTQVLLDELCDLKRKEQMLQDANRVLKRKLDEFEAEAASPPQLAWQDGGGMLSHDPPQPEHFFQALESNPSLQPTYHTMDMNQQPVPSPGSCYPPDWMA

SEQ ID NO: 4093 - DNA, 747 bp, Sorghum bicolor
  misc_feature: Ceres ANNOT ID no. 6034634
  misc_feature: Encodes the peptide sequence at SEQ ID NO 4094
atggccgcggcgatggacgtcgatagagccgggggcggggagaggcggccatcggagaaggagctcttccgtgccgcggaatccggcgacgccgccgccttcgcctccctcgcccccgcagacctctccctgcgcaacgaggatggccgctccctcctccacgtcgccgccgctgccggccatccccaggcacgcaaaggggtggtgctcgcgcttgcgcagtgcggtggtgacgccgcggcgaacgtgctgaacgcgaaggatgaagaggggtgggcgccgatccactctgcggcgagctctggcaactcccaaatcatcgacatcctgcttgagcgaggtgctgatgttaacctggtcactgatggtggccgaactgctcttcattatgctgcgagtaaagggaggcttaacatagctgaaaaattaatagccaatggtgctaatgtcaacaagaaagacaagtttggctgcacacctttgcatagagctgcaagcacaggaaatgcagagctgtgtgaattcctcatcgaggaaggcgcggaagttgatgctgttgacaagacaggacaaacacctcttatgcatgctgttatatgtgagaacaaaggggttgctcttctgctaattagacatggcgctgatgttgatgttgaggacaaggaaggctacactgtccttggccgagcatcgaacagcttcagacctgcactgatcgatgcagccaaagcaatgcttgaaggttga

SEQ ID NO: 4094 - protein, 248 aa, Sorghum bicolor
  misc_feature: Ceres ANNOT ID no. 6034634
  misc_feature (90)..(122): Pfam Id: Ank Pfam Desc: Ankyrin repeat
  misc_feature (123)..(155): Pfam Id: Ank Pfam Desc: Ankyrin repeat
  misc_feature (156)..(188): Pfam Id: Ank Pfam Desc: Ankyrin repeat
  misc_feature (189)..(221): Pfam Id: Ank Pfam Desc: Ankyrin repeat
  misc_feature (168)..(248): NCBI GI: 115455463 NCBI Desc: os03g0758400 [oryza sativa (japonica cultivar-group)]
  misc_feature (14)..(248): NCBI GI: 37681913 NCBI Desc: proteasome 26s subunit, non-atpase, 10 [danio rerio]
  misc_feature (37)..(248): NCBI GI: 119623102 NCBI Desc: proteasome (prosome, macropain) 26s subunit, non-atpase, 10, isoform cra_a [homo sapiens]
  misc_feature (37)..(248): NCBI GI: 62901912 NCBI Desc: proteasome 26s subunit non-atpase 10-like [synthetic construct]
  misc_feature (37)..(248): NCBI GI: 39654744 NCBI Desc: chain a, x-ray structure of human gankyrin
  misc_feature: The sequence is a functional homolog of SEQ ID NO 184 in the 10/225,068US patent application
  misc_feature: The sequence is a functional homolog of SEQ ID NO 1841 in the 10/374,780US patent application
  misc_feature: The sequence is a functional homolog of SEQ ID NO 382 in the 10/374,780US patent application
  misc_feature: The sequence is a functional homolog of SEQ ID NO 972 in the 10/225,066US patent application
  misc_feature: Useful for making plants with modulated growth and phenotype characteristics
  misc_feature: The sequence is a functional homolog of SEQ ID NO 184 in the 20050120408 US patent application
  misc_feature: The sequence is a functional homolog of SEQ ID NO 1841 in the 20060162006 US patent application
  misc_feature: The sequence is a functional homolog of SEQ ID NO 1841 in the 10/374,780 US patent application
  misc_feature: The sequence is a functional homolog of SEQ ID NO 184 in the 10/225,068 US patent application
  misc_feature: The sequence is a functional homolog of SEQ ID NO 382 in the 10/374,780 US patent application
  misc_feature: The sequence is a functional homolog of SEQ ID NO 972 in the 10/225,066 US patent application
MAAAMDVDRAGGGERRPSEKELFRAAESGDAAAFASLAPADLSLRNEDGRSLLHVAAAAGHPQARKGVVLALAQCGGDAAANVLNAKDEEGWAPIHSAASSGNSQIIDILLERGADVNLVTDGGRTALHYAASKGRLNIAEKLIANGANVNKKDKFGCTPLHRAASTGNAELCEFLIEEGAEVDAVDKTGQTPLMHAVICENKGVALLLIRHGADVDVEDKEGYTVLGRASNSFRPALIDAAKAMLEG

SEQ ID NO: 4095 - DNA, 873 bp, Sorghum bicolor
  misc_feature: Ceres ANNOT ID no. 6034659
  misc_feature: Encodes the peptide sequence at SEQ ID NO 4096
  misc_feature: Down-regulated in shoot tissues in response to salicylic acid treatment
atggcttcggcggcggcgtgggagggcccgacggccggggagctcatgtcagcgggggcggcggcgattcccggcggcgtgcgagtgaaggggtgggtcatccagtcccagaaaggctccatcctcaacgccgcctccctccaacgttttgaagatgaacttcaaacaacacatttacctgaaatggtttttggagagagtttcttgtcccttcaacatactcaaactggcatcaatttgcattttaatgcgcttgatgcactcaaggcatggaagaaagaggcactgccacctgttgaggttcctgctgcagcaaaatggaagttcagaagtaagccttctgaccaggttatacttgattacgactatacatttacaacaccatactgtgggagtgatgttgtgattgtgaactcaggcactacacaaacaagtttagatggatgtagcgctttgtgttgggaggatactaatgatcggattgacctagttgccctttcagctaaagagccaattcttttctacgacgaggttatcttgtatgaagatgagttggctgacaatggtatctcatttcttacagtgcgagtgagggtaatgccaaccggttggtttctgcttttgcgtttctggcttagagttgatggtgtactgatgagattgagagagactcgtttacattgttcatttggaaatggcgatggagccaaaccagtggtactccgtgaatgttgctggagggaagcaacatttgctagtttgtctgcgaaaggatatccttcagactctgcagcttacgcggacccaaatcgtattgccaataaacttcctattgtgacgcagaagacccagaagttgaaaatacctgactga

SEQ ID NO: 4096 - protein, 290 aa, Sorghum bicolor
  misc_feature: Ceres ANNOT ID no. 6034659
  misc_feature (62)..(256): Pfam Id: TIP41 Pfam Desc: TIP41-like family
  misc_feature (32)..(289): NCBI GI: 47507494 NCBI Desc: mgc79019 protein [xenopus laevis]
  misc_feature (10)..(286): NCBI GI: 47824822 NCBI Desc: tipa protein [emericella nidulans]
  misc_feature (24)..(286): NCBI GI: 37931677 NCBI Desc: jipa [emericella nidulans]
  misc_feature (32)..(256): NCBI GI: 119611226 NCBI Desc: tip41, tor signalling pathway regulator-like (s. cerevisiae), isoform cra_a [homo sapiens]
  misc_feature (54)..(288): NCBI GI: 116129571 NCBI Desc: ensangp00000028166 [anopheles gambiae str. pest]
  misc_feature: Down-regulated in shoot tissues in response to salicylic acid treatment
MASAAAWEGPTAGELMSAGAAAIPGGVRVKGWVIQSQKGSILNAASLQRFEDELQTTHLPEMVFGESFLSLQHTQTGINLHFNALDALKAWKKEALPPVEVPAAAKWKFRSKPSDQVILDYDYTFTTPYCGSDVVIVNSGTTQTSLDGCSALCWEDTNDRIDLVALSAKEPILFYDEVILYEDELADNGISFLTVRVRVMPTGWFLLLRFWLRVDGVLMRLRETRLHCSFGNGDGAKPVVLRECCWREATFASLSAKGYPSDSAAYADPNRIANKLPIVTQKTQKLKIPD

SEQ ID NO: 4097 - DNA, 1497 bp, Sorghum bicolor
  misc_feature: Ceres ANNOT ID no. 6034660
  misc_feature: Encodes the peptide sequence at SEQ ID NO 4098
atggcgagctccggcgatgaagggcgcgtggtggtggacctccgctccgcggcggagtcggcggctgccgacgaggaggcgcacgccacgcctctccacgagatcgagtccctatgcatgcgctgcggcgagaacggcatcacgaggcttctgctgacgctgatcccgcacttccgagaggtggttctgatggccttcgaatgcccacattgtggtgagaggaacaatgagattcagtttgctggacagctccaacctaagggatgttgctatagcttgaaggttccgttggggcagagtgacatactgaatcgtcaggttgtgaagtctgattcagcgactatcaagattccagagctggactttgagattcctcccgaagctcaacgtggaacactttctactgtggaagggattattatgcgggctgtggatgagctgcaggcacttcaagatgaacgaaagaaagtggatcctcagaaggctgaagctatcgatcaatttttactgaagttgagatctcttgggtcaggagaggctgcattcacctttattcttgatgaccctgcaggaaatagctttatcgagaacccgcatgctccatcatcagatcctttactatctgtgagattctacgaaaggactcgtgaacaacaagcagcacttggttttctggctgaaccaccaacagaacaacctggagaggctgttttgcctgcttcagctgtggaatccaattctgatgggttgcaaagcgtgccccatggctcagttggagctgttgcaggtcgtcgcgctatagctcagggaaaccctgacgaagttgctgcagcattgtgtagatactcagcaccagaagaggttgatactttaccatcaacatgtggggcctgtggaacagaatgtgtcacgcgattctttgctacaaaaatcccatatttccgggaggttattgttatggcaacaacatgtgacatgtgtggttatcgcaattcagagctgaagcctgggggtgaaattccagctaagggaaagaaaattacactgcgtgttcaaaacgcacgagaccttactcgcgatgtcataaagtcagattcagctagcgtgaaagtacctgaacttgagttggagctttcaagtggaacgttgggtggtatggtcacaactgttgaaggtttaattgtgaaaatatgtgaggctctggagagaatacatggattccaattgggcgatagcacactggaatggaaaaagaagaaatgggaggattttaaggagagattatccaagcttctgagtttacaagagccctggactctaataattgatgatggattggcggcttcgtttgtagccccggctactgattctttagaagatgacagccagctaaccatggaggagtatcagaggagttgggagcagaatgaggaacttggcctgaatgacatggatacgtcctctgcagacgcggcttacaacacgaccagcacatga

SEQ ID NO: 4098 - protein, 498 aa, Sorghum bicolor
  misc_feature: Ceres ANNOT ID no. 6034660
  misc_feature (36)..(197): Pfam Id: zf-ZPR1 Pfam Desc: ZPR1 zinc-finger domain
  misc_feature (292)..(453): Pfam Id: zf-ZPR1 Pfam Desc: ZPR1 zinc-finger domain
  misc_feature (6)..(496): NCBI GI: 102139844 NCBI Desc: zinc finger (zpr1 type) family protein [musa acuminata]
  misc_feature (12)..(498): NCBI GI: 15242258 NCBI Desc: zinc finger (zpr1-type) family protein [arabidopsis thaliana]
  misc_feature (12)..(498): NCBI GI: 28416551 NCBI Desc: at5g22480 [arabidopsis thaliana]
  misc_feature (12)..(498): NCBI GI: 21553756 NCBI Desc: zinc finger protein-like [arabidopsis thaliana]
  misc_feature (12)..(496): NCBI GI: 42568162 NCBI Desc: zinc finger (zpr1-type) family protein [arabidopsis thaliana]
  misc_feature: The sequence is a functional homolog of SEQ ID NO 139 in the 11/479,226US patent application
  misc_feature: The sequence is a functional homolog of SEQ ID NO 1781 in the 11/479,226US patent application
  misc_feature: The sequence is a functional homolog of SEQ ID NO 2210 in the 10/374,780US patent application
  misc_feature: The sequence is a functional homolog of SEQ ID NO 2316 in the 10/374,780US patent application
  misc_feature: The sequence is a functional homolog of SEQ ID NO 24 in the 10/412,699US patent application
  misc_feature: The sequence is a functional homolog of SEQ ID NO 240 in the 10/412,699US patent application
  misc_feature: The sequence is a functional homolog of SEQ ID NO 270 in the 10/374,780US patent application
  misc_feature: The sequence is a functional homolog of SEQ ID NO 4 in the 10/225,066US patent application
  misc_feature: The sequence is a functional homolog of SEQ ID NO 48 in the 10/225,066US patent application
  misc_feature: The sequence is a functional homolog of SEQ ID NO 50 in the 11/375,241US patent application
  misc_feature: The sequence is a functional homolog of SEQ ID NO 88 in the 10/666,642US patent application
  misc_feature: Useful for making plants with modulated growth and phenotype characteristics
  misc_feature: The sequence is a functional homolog of SEQ ID NO 24 in the 20040045049 US patent application
  misc_feature: The sequence is a functional homolog of SEQ ID NO 240 in the 20040045049 US patent application
  misc_feature: The sequence is a functional homolog of SEQ ID NO 4 in the 20050160493 US patent application
  misc_feature: The sequence is a functional homolog of SEQ ID NO 48 in the 20050160493 US patent application
  misc_feature: The sequence is a functional homolog of SEQ ID NO 2316 in the 10/374,780 US patent application
  misc_feature: The sequence is a functional homolog of SEQ ID NO 240 in the 10/412,699 US patent application
  misc_feature: The sequence is a functional homolog of SEQ ID NO 88 in the 10/666,642 US patent application
  misc_feature: The sequence is a functional homolog of SEQ ID NO 48 in the 10/225,066 US patent application
MASSGDEGRVVVDLRSAAESAAADEEAHATPLHEIESLCMRCGENGITRLLLTLIPHFREVVLMAFECPHCGERNNEIQFAGQLQPKGCCYSLKVPLGQSDILNRQVVKSDSATIKIPELDFEIPPEAQRGTLSTVEGIIMRAVDELQALQDERKKVDPQKAEAIDQFLLKLRSLGSGEAAFTFILDDPAGNSFIENPHAPSSDPLLSVRFYERTREQQAALGFLAEPPTEQPGEAVLPASAVESNSDGLQSVPHGSVGAVAGRRAIAQGNPDEVAAALCRYSAPEEVDTLPSTCGACGTECVTRFFATKIPYFREVIVMATTCDMCGYRNSELKPGGEIPAKGKKITLRVQNARDLTRDVIKSDSASVKVPELELELSSGTLGGMVTTVEGLIVKICEALERIHGFQLGDSTLEWKKKKWEDFKERLSKLLSLQEPWTLIIDDGLAASFVAPATDSLEDDSQLTMEEYQRSWEQNEELGLNDMDTSSADAAYNTTST

SEQ ID NO: 4099 - DNA, 1128 bp, Sorghum bicolor
  misc_feature: Ceres ANNOT ID no. 6034661
  misc_feature: Encodes the peptide sequence at SEQ ID NO 4100
atgcaggccgccgccgccgtccgccacccgcgcctattctcgccgtccccgggccgcgccgcgctgcaccggcgcgcacccagcaccgtgcgcatggcgctgcgcgaggacgggccctcggtggccatcgtgggcgccacgggcgcggtgggccaggagttcctccgcgtcatcacggaccgggacttcccctaccgcagcctccgcctcctcgccagcgagcggtccgcggggaagcgcctcgcctttgaggaccgcgagtacaccgtccaggacctcgcggccccgggggcgttcgacggcgtcgacatcgcgctgttcagcgccggcgggagcgtcagccggaagtacgggcccgcggcagtcgccagcggcgccgtcgtcgtcgacaacagctccgcgttccggatggatcccgaggtgccgctcgtcatccccgaggtcaaccctgaggccatggggaacgtccggctcgggcagggggcgattgtggcaaatccgaattgctcaaccatcatctgcctcatggctgccacgccgctccatcgccacgccaaggtggtaaggatggttgtcagcacataccaagcagcaagtggtgctggtgctgcggcaatggaagaactcaagctgcagactcaggaggtcttggaagggaaggcaccaacatgcaatattttcaaacagcagtatgcttttaatatattttcacacaatgcaccggttcttgagaatgggtataatgaggaagaaatgaaaatggtgaaggagacaagaaaaatttggaacgacaaggatgtgaaagtaactgcgacttgcatacgggttcctgtgatgcgtgcgcatgctgaaagtgtcaatctacagtttgaaaagccacttgatgaggatactgcaagagaaattttgaggggagctcctggtgttaccattattgatgaccgtgcttccaatcgcttccctacgcctctggaggtatcagataaagatgatgtagcagtgggtagaattcgtcaggacttgtccctggatgataaccgagggttggacatatttgtctgtggtgatcagatacgtaaaggtgccgcactcaatgctgttcagattgctgaaatgctcctgaagtga

SEQ ID NO: 4100 - protein, 375 aa, Sorghum bicolor
  misc_feature: Ceres ANNOT ID no. 6034661
  misc_feature (180)..(360): Pfam Id: Semialdhyde_dhC Pfam Desc: Semialdehyde dehydrogenase, dimerisation domain
  misc_feature (40)..(156): Pfam Id: Semialdhyde_dh Pfam Desc: Semialdehyde dehydrogenase, NAD binding domain
  misc_feature (36)..(374): NCBI GI: 11228579 NCBI Desc: aspartate-semialdehyde dehydrogenase precursor [arabidopsis thaliana]
  misc_feature (24)..(262): NCBI GI: 8778230 NCBI Desc: f10b6.22 [arabidopsis thaliana]
  misc_feature (40)..(374): NCBI GI: 87301615 NCBI Desc: aspartate-semialdehyde dehydrogenase [synechococcus sp. wh 5701]
  misc_feature (40)..(375): NCBI GI: 67923139 NCBI Desc: aspartate-semialdehyde dehydrogenase, usg-1 related [crocosphaera watsonii wh 8501]
  misc_feature (39)..(375): NCBI GI: 121523907 NCBI Desc: aspartate-semialdehyde dehydrogenase [parvibaculum lavamentivorans ds-1]
  misc_feature (37)..(374): SWISSPROT Homolog: EC 1.2.1.11 Aspartate-semialdehyde dehydrogenase
MQAAAAVRHPRLFSPSPGRAALHRRAPSTVRMALREDGPSVAIVGATGAVGQEFLRVITDRDFPYRSLRLLASERSAGKRLAFEDREYTVQDLAAPGAFDGVDIALFSAGGSVSRKYGPAAVASGAVVVDNSSAFRMDPEVPLVIPEVNPEAMGNVRLGQGAIVANPNCSTIICLMAATPLHRHAKVVRMVVSTYQAASGAGAAAMEELKLQTQEVLEGKAPTCNIFKQQYAFNIFSHNAPVLENGYNEEEMKMVKETRKIWNDKDVKVTATCIRVPVMRAHAESVNLQFEKPLDEDTAREILRGAPGVTIIDDRASNRFPTPLEVSDKDDVAVGRIRQDLSLDDNRGLDIFVCGDQIRKGAALNAVQIAEMLLK

SEQ ID NO: 4101 - DNA, 1134 bp, Sorghum bicolor
  misc_feature: Ceres ANNOT ID no. 6034664
  misc_feature: Encodes the peptide sequence at SEQ ID NO 4102
atgttgagggcggtggcgaggtgctgcggtcactggccgccgggcgccgcggcggcggacgggatgctgtggcagacggaactgcggccgcacgcggcgggggagttctcgatggccgcggcgcaggccaacgtgaccatggaggaccaggcgcaggtgctggcctccccggccgccaccctcgtcggcgtctacgacggacacggcggggcggacgcatcccggttcctccgatcccgactcttcccccatgtccaacgcttcgcgagggagcaagggggcatgagcgcggaggcgattcggagcgcgttcggcgcggccgaggaggagttccataagcaggtgaggcaggagtggacgaagcggccgcggctggctgctgtgggctcatgctgcctgctcggggccatctccggggacacgctgtacgtggccaacgccggggactcccgcgccgtgctcggccgtcgagtggtcggcggtggggtggccgtcgccgaacggctgtccaccgagcacaacgcggcgtccgaggaggtgcggcgggagctcaccgcgctcaaccccgacgacgcgcagatcgtggtgcacgccagaggggcgtggagggtgaaggggataattcaggtgtcaagatccattggcgatttttatctgaagaaaccagagtatagcttggaccccttgtttcggcaagttggcgcccctattccattgaagaggccagctcttagtgctgaaccatcagttcaagtacgcaagctgaaaccaaatgacctatttctgatatttgcttcggatggtctttgggagcacctcagcgacgatgatgcggtgcaaattgtcttcaagaatccaagaacagggatagccaacagattggtgaaggctgccttgaaggaagcaaccaggaagagagaggtcaggtaccgtgacctgaggacgatcgacaggggagtgaggcggcatttccacgatgacatcagcgtcgttgtggtctaccttgatagccaccgcgagcgccgccacaccagggtcatcgattcgagcagcaactgcaccagtgcgcccgtcgacatctactcctccaacacccaccagtcagcagagcccttgcacgcttataagtgctga

SEQ ID NO: 4102 - protein, 377 aa, Sorghum bicolor
  misc_feature: Ceres ANNOT ID no. 6034664
  misc_feature (33)..(307): Pfam Id: PP2C Pfam Desc: Protein phosphatase 2C
  misc_feature (1)..(376): NCBI GI: 56787112 NCBI Desc: bth-induced protein phosphatase 2c 2 k2 form [oryza sativa (indica cultivar-group)]
  misc_feature (5)..(362): NCBI GI: 33147010 NCBI Desc: protein phosphatase 2c-like [oryza sativa (japonica cultivar-group)]
  misc_feature (1)..(233): NCBI GI: 56787114 NCBI Desc: bth-induced protein phosphatase 2c 2 k3 form [oryza sativa (indica cultivar-group)]
  misc_feature (20)..(346): NCBI GI: 7768153 NCBI Desc: protein phosphatase 2c (pp2c) [fagus sylvatica]
  misc_feature (16)..(346): NCBI GI: 4206122 NCBI Desc: protein phosphatase 2c homolog [mesembryanthemum crystallinum]
  misc_feature: Useful for making plants with modulated biomass
  misc_feature: Useful for making plants with modulated low light sensitivity
  misc_feature: Functional homolog of the protein sequence given in SEQ ID NO 13347
  misc_feature: The sequence is a functional homolog of SEQ ID NO. 406 in the 11/188,298 US application
  misc_feature: The sequence is a functional homolog of SEQ ID NO. 386 in the 11/188,298 US application
  misc_feature: The sequence is a functional homolog of SEQ ID NO. 448 in the 11/188,298 US application
MLRAVARCCGHWPPGAAAADGMLWQTELRPHAAGEFSMAAAQANVTMEDQAQVLASPAATLVGVYDGHGGADASRFLRSRLFPHVQRFAREQGGMSAEAIRSAFGAAEEEFHKQVRQEWTKRPRLAAVGSCCLLGAISGDTLYVANAGDSRAVLGRRVVGGGVAVAERLSTEHNAASEEVRRELTALNPDDAQIVVHARGAWRVKGIIQVSRSIGDFYLKKPEYSLDPLFRQVGAPIPLKRPALSAEPSVQVRKLKPNDLFLIFASDGLWEHLSDDDAVQIVFKNPRTGIANRLVKAALKEATRKREVRYRDLRTIDRGVRRHFHDDISVVVVYLDSHRERRHTRVIDSSSNCTSAPVDIYSSNTHQSAEPLHAYKC

SEQ ID NO: 4103 - DNA, 1638 bp, Sorghum bicolor
  misc_feature: Ceres ANNOT ID no. 6034670
  misc_feature: Encodes the peptide sequence at SEQ ID NO 4104
atgagcattgtgcccaaggagacgattgaggtcatcgctcagagcgtcggcatccccagcctcggcgccgatgtcgccgtcgcgctcgcccctgacgtcgaataccgcctccgcgagatcatgcaggaatccattaaatgtatgcggcatgcaaagcggactgttctgacggcggatgatgttgacagtgccctgggcctcaggaatgttgagcctgtgtatggatttgcttctggtgatccattgcgttttaagagagctgttgggcataaggatctcttctatcttgatgatcgggaggtagacttcaaagagattattgaagctcctctgcctaaagcccccctggacacatcagttgtagcccattggctagcgattgagggggtacagcctgcaataccagagaatcctgctattgacgcaattgtaccatcaactgaaaataaaaggtctgagcatgggaaggatgatggacttacaattgatgtcaagcttcctgttaagcatgtattatctagagaattacagatgtactttgataaaatagctgagcttactatgagtagatctgatacgtccctttttaaagaagctttagtgagcctggcaaaagattctggtcttcatcctttggttccttatttttcctacttcattgtagatgaggttacccagagtttgggtgatcttcctgttttatttgctctaatgagagtagtccaaagtcttctccgtaatccacatattcatattgaaccttatttgcaccagctgatgccatcaatgatcacttgcattgttgcaaaaaggttagggcataggctctcagataaccactgggaacttagagacttctctgccaatttggttgcttccttatgtcggaggttttgtcatgtctatcacaaccttcagaatcggttaactaaaacattgatccatgcatttcttgatcctgccaaatcattgacacaacattatggtgctgttcaagggatatctgcattggggcccagcgcgattagacttcttcttttgcccaaccttgtgacatatatgcaacttctggagccggaactacaccttgaggagcagaaaaacgagatgaaaaggaaggaagcttggcgtgtttatggtgccttgctgtgtgctgcaggaaaatgcttgtatgatcggttgaaattatttcctggtttgctttctccatcgaagcggcctcttttacggagcaacaaaagggtcttaaccaacaacccaaataagcgaagatctagcacagatctctctgcaactcagccacctctgaagaagatggcaacagacgcaacagccaactccatggcctcagcttccatgggaggaaacatgcaaggtgccatggatggcttttccaaccagttagccaaccctggcatgatgcaggcctcgtcctctgggcagatggtggagagcatcccatcagctgcaatccggagagatcagggaagtgatctcgcacagagagtttctgcagtgcttaggcaagcttggaaggaggatcaggacactggtcatctcttggggtctctgtatgaggtcttcggtgaagccatcttctcctttgtccaaccaccagagatatccttgtttgtgtag

SEQ ID NO: 4104 - protein, 545 aa, Sorghum bicolor
  misc_feature: Ceres ANNOT ID no. 6034670
  misc_feature (2)..(68): Pfam Id: TAF Pfam Desc: TATA box binding protein associated factor (TAF)
  misc_feature (1)..(518): NCBI GI: 2196466 NCBI Desc: tata binding protein-associated factor [arabidopsis thaliana]
  misc_feature (3)..(459): NCBI GI: 42495554 NCBI Desc: tata binding protein associated factor 6b isoform 1 [arabidopsis thaliana]
  misc_feature (135)..(459): NCBI GI: 42495556 NCBI Desc: tata binding protein associated factor 6b isoform 2 [arabidopsis thaliana]
  misc_feature (122)..(459): NCBI GI: 4585980 NCBI Desc: very similar to tata binding protein-associated factor [arabidopsis thaliana]
  misc_feature (41)..(459): NCBI GI: 28059031 NCBI Desc: very similar to tata binding protein-associated factor [arabidopsis thaliana]
MSIVPKETIEVIAQSVGIPSLGADVAVALAPDVEYRLREIMQESIKCMRHAKRTVLTADDVDSALGLRNVEPVYGFASGDPLRFKRAVGHKDLFYLDDREVDFKEIIEAPLPKAPLDTSVVAHWLAIEGVQPAIPENPAIDAIVPSTENKRSEHGKDDGLTIDVKLPVKHVLSRELQMYFDKIAELTMSRSDTSLFKEALVSLAKDSGLHPLVPYFSYFIVDEVTQSLGDLPVLFALMRVVQSLLRNPHIHIEPYLHQLMPSMITCIVAKRLGHRLSDNHWELRDFSANLVASLCRRFCHVYHNLQNRLTKTLIHAFLDPAKSLTQHYGAVQGISALGPSAIRLLLLPNLVTYMQLLEPELHLEEQKNEMKRKEAWRVYGALLCAAGKCLYDRLKLFPGLLSPSKRPLLRSNKRVLTNNPNKRRSSTDLSATQPPLKKMATDATANSMASASMGGNMQGAMDGFSNQLANPGMMQASSSGQMVESIPSAAIRRDQGSDLAQRVSAVLRQAWKEDQDTGHLLGSLYEVFGEAIFSFVQPPEISLFV

SEQ ID NO: 4105 - DNA, 909 bp, Sorghum bicolor
  misc_feature: Ceres ANNOT ID no. 6034673
  misc_feature: Encodes the peptide sequence at SEQ ID NO 4106
  misc_feature: Up-regulated in shoot tissues in response to salicylic acid treatment
atggagcacattttcttttcgatgcaccggatagcctctcgctcggtgagacatcagggtttgcttggaaggggatggtacagctctgctgcgaaggggggcccttcgatcgccggtgtaagcgacatcattgctgtcgcatcagggaaaggcggcgtaggcaagtccaccactgcagttaacattgctgtagcacttgccaaagagtttaagcttcaggttggtttgctagatgccgacatctatggaccatccgttcccacaatgatgaatctccatgccaagcctgaagtaagtgaagatatgaagatgattccagttgagaaccatggtgtgcgatgcatgtccattggttttcttgtagacaaagatgcaccaattgtttggagaggtcctatggtaatgagtgctcttgagaagatgacaaggggagttgcttggggggaccttgatattcttgttgttgatatgcccccaggcactggtgatgctcaactatcgatgtcccaaaggcttcggttatctggtgctttaattgtttcaactcctcaagatattgctcttattgatgctagaagaggagccaacatgttccgcaaagttcaagttcctattctgggattggtagagaatatgagttgctttaagtgcccaaaatgtggtgagaaatcttacatcttcggggaaggtggagcacagagaactgcagaggaaatggacatgaaattacttggtgctgtacctcttgaaatcggcatcagaacaggttcagacgaaggccagcctatcgttgtatcatcaccgaactctgcatccgcgcaagcgtacgtaaatattgctgagaaggtgactcaaaggctcaatgagctagcagaggagcgacggatgggcccagaaatcttactttga

SEQ ID NO: 4106 - protein, 302 aa, Sorghum bicolor
  misc_feature: Ceres ANNOT ID no. 6034673
  misc_feature (44)..(255): Pfam Id: CbiA Pfam Desc: CobQ/CobB/MinD/ParA nucleotide binding domain
  misc_feature (42)..(298): Pfam Id: Fer4_NifH Pfam Desc: 4Fe-4S iron sulfur cluster binding proteins, NifH/frxC family
  misc_feature (27)..(292): NCBI GI: 21537349 NCBI Desc: atp binding protein-like [arabidopsis thaliana]
  misc_feature (16)..(289): NCBI GI: 89272112 NCBI Desc: novel protein similar to nucleotide binding protein 1 (mind homolog, e. coli) nubp1 [xenopus tropicalis]
  misc_feature (35)..(302): NCBI GI: 23015795 NCBI Desc: cog0489: atpases involved in chromosome partitioning [magnetospirillum magnetotacticum ms-1]
  misc_feature (35)..(302): NCBI GI: 82947427 NCBI Desc: atpase involved in chromosome partitioning [magnetospirillum magneticum amb-1]
  misc_feature (28)..(289): NCBI GI: 13474504 NCBI Desc: mrp protein(atp/gtp-binding protein) homolog [mesorhizobium loti maff303099]
  misc_feature: Up-regulated in shoot tissues in response to salicylic acid treatment
MEHIFFSMHRIASRSVRHQGLLGRGWYSSAAKGGPSIAGVSDIIAVASGKGGVGKSTTAVNIAVALAKEFKLQVGLLDADIYGPSVPTMMNLHAKPEVSEDMKMIPVENHGVRCMSIGFLVDKDAPIVWRGPMVMSALEKMTRGVAWGDLDILVVDMPPGTGDAQLSMSQRLRLSGALIVSTPQDIALIDARRGANMFRKVQVPILGLVENMSCFKCPKCGEKSYIFGEGGAQRTAEEMDMKLLGAVPLEIGIRTGSDEGQPIVVSSPNSASAQAYVNIAEKVTQRLNELAEERRMGPEILL

SEQ ID NO: 4107 - DNA, 1536 bp, Sorghum bicolor
  misc_feature: Ceres ANNOT ID no. 6034675
  misc_feature: Encodes the peptide sequence at SEQ ID NO 4108
atggcgcttcgcgccgtggagctccggcgattcctcctctcgcgcatcggcggcggcgaggcggcccttcctcctcttgcgtggcgcggccggccggtgagcacctccgccccggcggacgacgagctcgcggggaagagtgcctacgaggttctcggggttggggagtccagttccagcgccgagatcaaggcctccttccatcgcctagccaaagagacccacccagacgtcgccgcggctgctggttcccgacggttccttcagatcctcatcctatcagattcacagagaagagttcactatgatagctacctgcgatcacagaggcgagttgtgcagaaacatcccaggccatctcagttcgtgtacccaagtggttcaggctcaggcattgtggtacctcgagagagcaatgttgttgaatggctgaaatggtacaggcttaccattgatgacatagttaccaagaagagggttgccactggctctggttattttgataggctcgaaagtgaactgtacacagcaatccatgctgcatactatggccctgatgtcgactccatggatgtccttcctgattgctttgaagctgaggagaggtccgtgtatgaaacctctgagctattacaccttgtatcaggccgtgatctatttggtattgttagtgtagctgatagtgtcaaagagctgtcagatgtttgtcgtgaaaaactggcaccctctgggtttagatcttctgaatttactccaaaagtttcaagaaatgtgaataaggattcaatatctatgaattttatatctatgaattttgttgatatgaacaagcaagggatgcggcatgaaaattatattccttcatcagatgccttcaaggatatcgagttgcggatatttgggaaattagttgctactgcaactaggagccccaaatgcgattgcattgacaaatcggatgtggaagatcacattcatgtgtatcttgttccgaacgcagatctatctgatttaacgcaagggaatcttctcctgggcacaattactggattagccaccactggtgaggaaggatcttgctgtgtctatgatggtcacggaataaagacacatgtcattatgaagcaccggacgttgatggttaaacacatgcactggtatcaggttggagataaagtttcaccctgcgagtgtcgatgtagtagggctcgattgccacctagcaggtattggctttttgagcctcgttgttacatgcatgatactggtggatggtatatcgaaacatttgggagagacaagaaagggaggacaattccatctcaaagacagtgggatggtttcagtgaacattctgaaaagagattgcatccagcaatgtatcttgctgctctggcttacagatctttggatcttgaagatgctggaagaagacaatggaatgtgactagtttcctgcaattacccttatctcatatttgtcagctgttcaaaaaaattgttaatggggggaaggggattgacaggacacaatga

SEQ ID NO: 4108 - protein, 511 aa, Sorghum bicolor
  misc_feature: Ceres ANNOT ID no. 6034675
  misc_feature (47)..(103): Pfam Id: DnaJ Pfam Desc: DnaJ domain
  misc_feature (81)..(475): NCBI GI: 92880616 NCBI Desc: heat shock protein dnaj, n-terminal [medicago truncatula]
  misc_feature (44)..(103): NCBI GI: 115469980 NCBI Desc: os06g0716100 [oryza sativa (japonica cultivar-group)]
  misc_feature (24)..(103): NCBI GI: 42408733 NCBI Desc: dnaj protein homolog-like [oryza sativa (japonica cultivar-group)]
  misc_feature (47)..(110): NCBI GI: 1684851 NCBI Desc: dnaj-like protein [phaseolus vulgaris]
  misc_feature (43)..(105): NCBI GI: 47569309 NCBI Desc: dnaj protein [bacillus cereus g9241]
MALRAVELRRFLLSRIGGGEAALPPLAWRGRPVSTSAPADDELAGKSAYEVLGVGESSSSAEIKASFHRLAKETHPDVAAAAGSRRFLQILILSDSQRRVHYDSYLRSQRRVVQKHPRPSQFVYPSGSGSGIVVPRESNVVEWLKWYRLTIDDIVTKKRVATGSGYFDRLESELYTAIHAAYYGPDVDSMDVLPDCFEAEERSVYETSELLHLVSGRDLFGIVSVADSVKELSDVCREKLAPSGFRSSEFTPKVSRNVNKDSISMNFISMNFVDMNKQGMRHENYIPSSDAFKDIELRIFGKLVATATRSPKCDCIDKSDVEDHIHVYLVPNADLSDLTQGNLLLGTITGLATTGEEGSCCVYDGHGIKTHVIMKHRTLMVKHMHWYQVGDKVSPCECRCSRARLPPSRYWLFEPRCYMHDTGGWYIETFGRDKKGRTIPSQRQWDGFSEHSEKRLHPAMYLAALAYRSLDLEDAGRRQWNVTSFLQLPLSHICQLFKKIVNGGKGIDRTQ

SEQ ID NO: 4109 - DNA, 885 bp, Sorghum bicolor
  misc_feature: Ceres ANNOT ID no. 6034676
  misc_feature: Encodes the peptide sequence at SEQ ID NO 4110
atgaagggaggtggcgtcatccgggccgccggcggaggtgccggcggctcgggtctgatgcgaacgcgactgcggctccccgtggtgctcctctcctgctccctcttcttcctcgccggcttcttcggctcgctgctcttcacccaggatccggaggaggcggacatgccggtgccgagggagcggctgctggagacggcgtggcctgagatgccttacggcgagtccggcgaggctgcgccgtccttaatcccataccagattttgagctggcagcctcgtgctttgtactttcctcaatttgcaacatcagaacagtgtgaaaatatagtaaaaactgcaaaggagagacttaagccatcaacattagccctgaggaaaggtgaaaccgcggagagtacaaaaggaatcaggacaagttcgggaacattcctcagtgctaatgaagacccaactagaacccttgcagaaatcgagaagaagattgcaagagctaccatgatacccagaaatcatggggagccatttaatgtcctgcggtataatattggacaaaggtatgcttcacattatgacgcatttgacccagtccagtatggtccacaaaaaagtcaaagggtggcgtctttcttgctttatctcacgaatgtcgaagaagggggagaaactatgttcccatacgagaatggtgagaatatggatataggctatgactatgagaagtgcattggcctaaaggtaaagccaaggaagggtgatggactcttgttttactcccttatggtaaatggaaccattgaccggacttcacttcatggtagctgccccgtcatcaagggcgagaaatgggtcgccacaaaatggatcagagacaatatagtgtag

SEQ ID NO: 4110 - protein, 294 aa, Sorghum bicolor
  misc_feature: Ceres ANNOT ID no. 6034676
  misc_feature (172)..(291): Pfam Id: 2OG-FeII_Oxy Pfam Desc: 2OG-Fe(II) oxygenase superfamily
  misc_feature (20)..(291): NCBI GI: 140056346 NCBI Desc: 2og-fe(ii) oxygenase [medicago truncatula]
  misc_feature (24)..(291): NCBI GI: 40809925 NCBI Desc: prolyl 4-hydroxylase [nicotiana tabacum]
  misc_feature (23)..(291): NCBI GI: 30681957 NCBI Desc: oxidoreductase, 2og-fe(ii) oxygenase family protein [arabidopsis thaliana]
  misc_feature (87)..(289): NCBI GI: 18394842 NCBI Desc: oxidoreductase, 2og-fe(ii) oxygenase family protein [arabidopsis thaliana]
  misc_feature (28)..(288): NCBI GI: 42567428 NCBI Desc: oxidoreductase, 2og-fe(ii) oxygenase family protein [arabidopsis thaliana]
  misc_feature: The sequence is a functional homolog of SEQ ID NO. 333 in the 11/188,298 US application
MKGGGVIRAAGGGAGGSGLMRTRLRLPVVLLSCSLFFLAGFFGSLLFTQDPEEADMPVPRERLLETAWPEMPYGESGEAAPSLIPYQILSWQPRALYFPQFATSEQCENIVKTAKERLKPSTLALRKGETAESTKGIRTSSGTFLSANEDPTRTLAEIEKKIARATMIPRNHGEPFNVLRYNIGQRYASHYDAFDPVQYGPQKSQRVASFLLYLTNVEEGGETMFPYENGENMDIGYDYEKCIGLKVKPRKGDGLLFYSLMVNGTIDRTSLHGSCPVIKGEKWVATKWIRDNIV

SEQ ID NO: 4111 - DNA, 1005 bp, Sorghum bicolor
  misc_feature: Ceres ANNOT ID no. 6034684
  misc_feature: Encodes the peptide sequence at SEQ ID NO 4112
atggctaggccgtcggcaagcagcaaggcgtcgtcgtcgtcgctggtgatcctcgcgatcgtcgtcgccgccgcgtccctcgcgcagcccggcgcggccgacctgaagctgaactactacgcgagcacctgccccaacgtggagaccatcgtgcgcggcgcggtgcagcagagggtgcaggccaccatccgcaccgtcggctccaccgtccgcctcttcttccacgactgcttcgtcgagggctgcgacgcctcggtgctcatcgactccacgcccggcaaccaggccgagaaggacgcctccgacaacaagtccctcgcgcccgaaggcttcgacaccgtgcgcagcgccaaggccgccgtcgaggccgcctgccctggcacggtctcctgcgccgacgtgctcgccctcgccactcgggacgccatctccatgagtggcgggcctttcttccaagtggagctgggcaggctggacggcctgagctccagggccagcagcgtgccaggccagctgcccgagccgaaccagaccatggaccagctgctggcggtcttcaaggcacacgggctcgacatgtccgacctcgtcgcgctctcagcggcgcacagcgtgggtctggcgcactgcagcaagttcgcgaaccggctgtacagcttccagccggggcagccgacggacccgacgctgaaccccaagtacgcgcagttcctgcagagcaagtgccccaacggcggcgccgacaacctggtgctcatggaccaggcctcgccggcacagttcgacaaccagtactaccggaacctccaggacggcggcggcctgctgggctccgacgagctgctctacaccgacaaccgcacgcgccccatggtggactcgctggccaacagcaccgccgccttcaaccaggccttcgccgacgccatcgtcaggctcggccgcgtcggggtcaagtccggcaggcggggcaacatccgcaagcagtgccacgtcttcaactga

SEQ ID NO: 4112 - protein, 334 aa, Sorghum bicolor
  misc_feature: Ceres ANNOT ID no. 6034684
  misc_feature (51)..(298): Pfam Id: peroxidase Pfam Desc: Peroxidase
  misc_feature (15)..(334): NCBI GI: 28629828 NCBI Desc: peroxidase 1 [artemisia annua]
  misc_feature (32)..(334): NCBI GI: 1781336 NCBI Desc: peroxidase [spinacia oleracea]
  misc_feature (18)..(334): NCBI GI: 82698813 NCBI Desc: peroxidase [sesamum indicum]
  misc_feature (9)..(334): NCBI GI: 115477493 NCBI Desc: os08g0532700 [oryza sativa (japonica cultivar-group)]
  misc_feature (17)..(334): NCBI GI: 20148497 NCBI Desc: peroxidase, prxr2 [arabidopsis thaliana]
  misc_feature (17)..(334): SWISSPROT Homolog: EC 1.11.1.7 Peroxidase 50 precursor
  misc_feature: Useful for making plants with altered cell wall content and/or composition
  misc_feature: Functional homolog of the protein sequence encoded by LOCUS at4g31760
  misc_feature: Functional homolog of the protein sequence encoded by LOCUS at4g37520
  misc_feature: Functional homolog of the protein sequence encoded by LOCUS at4g37530
  misc_feature: Useful for making plants with altered cell wall content and/or composition
  misc_feature: Functional homolog of the protein sequence given in SEQ ID NO 13852
  misc_feature: Useful for making plants with altered carbohydrate content
  misc_feature: Functional homolog of the protein sequence given in SEQ ID NO 13853
MARPSASSKASSSSLVILAIVVAAASLAQPGAADLKLNYYASTCPNVETIVRGAVQQRVQATIRTVGSTVRLFFHDCFVEGCDASVLIDSTPGNQAEKDASDNKSLAPEGFDTVRSAKAAVEAACPGTVSCADVLALATRDAISMSGGPFFQVELGRLDGLSSRASSVPGQLPEPNQTMDQLLAVFKAHGLDMSDLVALSAAHSVGLAHCSKFANRLYSFQPGQPTDPTLNPKYAQFLQSKCPNGGADNLVLMDQASPAQFDNQYYRNLQDGGGLLGSDELLYTDNRTRPMVDSLANSTAAFNQAFADAIVRLGRVGVKSGRRGNIRKQCHVFN

SEQ ID NO: 4113 - DNA, 981 bp, Sorghum bicolor
  misc_feature: Ceres ANNOT ID no. 6034685
  misc_feature: Encodes the peptide sequence at SEQ ID NO 4114
atgggcgccgggatcaggatcctggcggcgttcttggcggtgctcgcggccgcggccgccggcggtgtgacggcgcagctgcggcaggactactacgcggcggtgtgcccggacctggagagcatcgtgcgcgacgcggtgtccaagaaggtgcaggcgcagcccgtcgccgtcggcgccaccatccgcctcttcttccacgattgcttcgtcgagggctgcgacgcgtctgtgatcctggtgtcgacggggaacaacacggcggagaaggaccacccgagcaacctctccctggccggcgacggcttcgacaccgtcatccaggccaaggcggccgtcgacgccgtgccggcgtgcaccaaccaggtgtcgtgcgccgacatcctggccctggccacccgggacgtcattgccctggctggcgggccgtcgtacgcggtggagctggggaggctggacgggctggtgtccatgtccaccaacgtcgacggcaagctgccgccgccgtcgttcaacctggaccagctgacgagcatgttcgccgtcaacaacctgtcgcaggccgacatgattgctctatccgcggcgcacacggtggggttcgggcactgcagcacgttcgcggaccggatccagccgcagaaggaggacccgacgatgaacgcgacgtacgcggtggacctgcaggcggcgtgcccgacgggtgtggaccccaacatcgcgctgcagctggaccccgtcacgccgcaggccttcgacaaccagtacttcgtcaacctggtgaacggccgcgggctcctcacctccgaccaggtgctctactccgacgcccggtcgcagcccaccgtggtggcgtgggcgcagaacgccaccgacttcgagctcgccttcgtcgacgccatcaccaggctcggccgcgtcggcgtcaagaccgacccgtcgcaggggaacatccgccgcgactgcgccttcctcaactga

SEQ ID NO: 4114 - protein, 326 aa, Sorghum bicolor
  misc_feature: Ceres ANNOT ID no. 6034685
  misc_feature (43)..(289): Pfam Id: peroxidase Pfam Desc: Peroxidase
  misc_feature (1)..(326): NCBI GI: 82698813 NCBI Desc: peroxidase [sesamum indicum]
  misc_feature (25)..(326): NCBI GI: 28629828 NCBI Desc: peroxidase 1 [artemisia annua]
  misc_feature (1)..(325): NCBI GI: 971564 NCBI Desc: peroxidase2 [medicago sativa]
  misc_feature (1)..(325): NCBI GI: 92883701 NCBI Desc: haem peroxidase, plant/fungal/bacterial [medicago truncatula]
  misc_feature (1)..(325): NCBI GI: 13992528 NCBI Desc: peroxidase2 [medicago sativa]
  misc_feature (7)..(326): SWISSPROT Homolog: EC 1.11.1.7 Peroxidase 35 precursor
  misc_feature: Useful for making plants with altered cell wall content and/or composition
  misc_feature: GREAT-hit functional homolog of the protein sequence encoded by LOCUS at3g49960
  misc_feature: Functional homolog of the protein sequence encoded by LOCUS at4g37520
  misc_feature: GREAT-hit functional homolog of the protein sequence encoded by LOCUS at5g67400
  misc_feature: Useful for making plants with altered carbohydrate content
  misc_feature: Functional homolog of the protein sequence given in SEQ ID NO 13853
  misc_feature: Useful for making plants with altered cell wall content and/or composition
  misc_feature: Functional homolog of the protein sequence given in SEQ ID NO 13854
MGAGIRILAAFLAVLAAAAAGGVTAQLRQDYYAAVCPDLESIVRDAVSKKVQAQPVAVGATIRLFFHDCFVEGCDASVILVSTGNNTAEKDHPSNLSLAGDGFDTVIQAKAAVDAVPACTNQVSCADILALATRDVIALAGGPSYAVELGRLDGLVSMSTNVDGKLPPPSFNLDQLTSMFAVNNLSQADMIALSAAHTVGFGHCSTFADRIQPQKEDPTMNATYAVDLQAACPTGVDPNIALQLDPVTPQAFDNQYFVNLVNGRGLLTSDQVLYSDARSQPTVVAWAQNATDFELAFVDAITRLGRVGVKTDPSQGNIRRDCAFLN

SEQ ID NO: 4115 - DNA, 981 bp, Sorghum bicolor
  misc_feature: Ceres ANNOT ID no. 6034706
  misc_feature: Encodes the peptide sequence at SEQ ID NO 4116
atggtgtcggactcggagctggtggagcggctgcaggaggtgctgcggtcgtcggacctcaacaccacgaccaccgctgccctgcgccgccgcctcgaggaggacttcggtgccgacctctcccacaagaaggccttcatccgggagcaggtcgacctcttcctcgccgaggtcgctgccaaggacgagccggaggagcccaaggaggaggagcccgaggaggcgccggtgcctaaggaggaggagggcgagggggtggaggaagagggcgagggcgagggggaagaggaggaagaggaggaggaggaggaggaagaggaggatggggatagcagcggcgcccggaagaagcagcggggtaatgatggcaagaaaaggggtggtggctttacaaaattatgcagtctttccccggcacttcaagagtttgtcggcgcctctgagttagccaggacagaggttgtcaagaagctttgggcatatattcgagaaaataatctgcaagaccaaaacaataggaggaagattttgcccgatgagagattgaggaagatcttcaatgtcaattcgattgatatgttccaaatgaataaagctttgaccaagcatatctggccattaaattctgagggtcctgtctctcctgacagatcaacacccaaagagaagccacaaaagagagacaggaatgaaggaaagaagcaaaagggtggctcttcaggagctggatctggtcttcttgtgccccttcaactttcggatgatttagtgaaatttatcggcactggtgagagcatgctatcacgatctgatgtcgtgaagaaaatgtgggactacataaaagagaacaacctgcaggatccttctgatcggaggaaaataatctgcgatgagaaactgaaggacctattaggagttgaaacgttcaccggctttactgtttcaaagctgcttgcccctcattttaccaaaacgaagtag

SEQ ID NO: 4116 - protein, 326 aa, Sorghum bicolor
  misc_feature: Ceres ANNOT ID no. 6034706
  misc_feature (130)..(205): Pfam Id: SWIB Pfam Desc: SWIB/MDM2 domain
  misc_feature (246)..(323): Pfam Id: SWIB Pfam Desc: SWIB/MDM2 domain
  misc_feature (3)..(56): Pfam Id: DEK_C Pfam Desc: DEK C terminal domain
  misc_feature (5)..(326): NCBI GI: 15230276 NCBI Desc: swib complex baf60b domain-containing protein [arabidopsis thaliana]
  misc_feature (5)..(240): NCBI GI: 42562626 NCBI Desc: swib complex baf60b domain-containing protein [arabidopsis thaliana]
  misc_feature (112)..(324): NCBI GI: 42408131 NCBI Desc: parathymosin-like [oryza sativa (japonica cultivar-group)]
  misc_feature (109)..(324): NCBI GI: 32488657 NCBI Desc: osjnba0087o24.7 [oryza sativa (japonica cultivar-group)]
  misc_feature (109)..(324): NCBI GI: 116308843 NCBI Desc: h1005f08.9 [oryza sativa (indica cultivar-group)]
MVSDSELVERLQEVLRSSDLNTTTTAALRRRLEEDFGADLSHKKAFIREQVDLFLAEVAAKDEPEEPKEEEPEEAPVPKEEEGEGVEEEGEGEGEEEEEEEEEEEEEDGDSSGARKKQRGNDGKKRGGGFTKLCSLSPALQEFVGASELARTEVVKKLWAYIRENNLQDQNNRRKILPDERLRKIFNVNSIDMFQMNKALTKHIWPLNSEGPVSPDRSTPKEKPQKRDRNEGKKQKGGSSGAGSGLLVPLQLSDDLVKFIGTGESMLSRSDVVKKMWDYIKENNLQDPSDRRKIICDEKLKDLLGVETFTGFTVSKLLAPHFTKTK

SEQ ID NO: 4117 - DNA, 1317 bp, Sorghum bicolor
  misc_feature: Ceres ANNOT ID no. 6034712
  misc_feature: Encodes the peptide sequence at SEQ ID NO 4118
atggcctcctcctcctcctcctcctcctcctcggccctccctctcttctcctccctcctcctcgcgctgctgctcctctccgccccctcgccgtccgcctccgccgagctctctttcctaaccgtttcctccaacggctccgcctccatctccgccgacccggagctggaggacgtggccccggagcccaccttcctggaggaggtcatcgacgccgtctcggagaagtacgactgggatccggacgccgaggtcagggtgtggccgctcgacgccgacgccgtccgcgtcggcgtcgtgcagcggtacgagttccgggcacgcgcgggcgggtcggcggctctggcgcggttctccgacgaggccgtgcagtggagacgcccctccgcgccggccctcgaggaggtggacgggccggacggcttcgacgtcgtccccgccgaaggcgcattcgggttcgacaccggcgtcagggacgtggagctggttgggccgctggagttgaagcttgctggcaacgaggacggtggcctcgtcgagctccagctaccgtcggggaatgccacatatacaaggcttaagaggatatttgttgcagatggcattgcattaaaggtcattggtgcacagaaagtttccgtaacccaccctcacagtataggtcttttatcaaatggaagtttgttgactagtaaccacgacctaagccaaatatggcctttgagctactcaacctgtgccccattacttcaagtgagcgttgtaggatcagtcataattgttgtgcatcaaacaagtgtatctgcaggccatgtgaaaactttcttaaggtcacataacactatagagttattgtcagacaagtgtaaagtcaacacagcaaatcggttgatctcagagtttttgttctcctcggttagcccaagactgataaagcttgagaagatcttgaagacttggtttagcaaaagaaaccaccataatagctcaatgcacttcattgaagctaaagtggcatcaataccgttggtgaaattccgtttggagtttgaaagggacgtcactgaagaggatcccatctgggatgatgttccagagtggaaaacgagacccatggtccggcgagtcccagttgacattatagccgaagtggaagatgacgataggttgaaggctatttcagtgaagaaggttagaaggcagtttccagtagtggacaccactacttggggcagcctggcttcaaatatttctttcacaaagtttctgtcattcattttgccaccagaaccgctgtcgctggatgtgaagtggtag

SEQ ID NO: 4118 - protein, 438 aa, Sorghum bicolor
  misc_feature: Ceres ANNOT ID no. 6034712
  misc_feature (215)..(438): NCBI GI: 115455547 NCBI Desc: os03g0765100 [oryza sativa (japonica cultivar-group)]
  misc_feature: Useful for making plants with modulated nitrogen use efficiency
  misc_feature: GREAT-hit functional homolog of the protein sequence given in SEQ ID NO 13246
  misc_feature: Useful for making plants with modulated nitrogen use efficiency
  misc_feature: Functional homolog of the protein sequence given in SEQ ID NO 13246
MASSSSSSSSSALPLFSSLLLALLLLSAPSPSASAELSFLTVSSNGSASISADPELEDVAPEPTFLEEVIDAVSEKYDWDPDAEVRVWPLDADAVRVGVVQRYEFRARAGGSAALARFSDEAVQWRRPSAPALEEVDGPDGFDVVPAEGAFGFDTGVRDVELVGPLELKLAGNEDGGLVELQLPSGNATYTRLKRIFVADGIALKVIGAQKVSVTHPHSIGLLSNGSLLTSNHDLSQIWPLSYSTCAPLLQVSVVGSVIIVVHQTSVSAGHVKTFLRSHNTIELLSDKCKVNTANRLISEFLFSSVSPRLIKLEKILKTWFSKRNHHNSSMHFIEAKVASIPLVKFRLEFERDVTEEDPIWDDVPEWKTRPMVRRVPVDIIAEVEDDDRLKAISVKKVRRQFPVVDTTTWGSLASNISFTKFLSFILPPEPLSLDVKW

SEQ ID NO: 4119 - DNA, 1119 bp, Sorghum bicolor
  misc_feature: Ceres ANNOT ID no. 6034724
  misc_feature: Encodes the peptide sequence at SEQ ID NO 4120
atgctgcaaaggaacctaccgaatctctgcctccagataagcccgccagcggcctcgtcggccgtcgttgcatccgacgcaccggtggcggcgtcggcgaagcctccgccgacacaaccaataagcacggcgacgtacgctgaaggaagcggcgaggtagggttctttgcaaaccctagccccggcgcggagcccccggggcttagccttgggctcgccacgccggcgcttggcgacaacgcggccggacggcgaggccaccacctccagccgcagggatgcgcgttcaagcgcgcggccgccagggcttccctgcctgccgccggatcgaagcgaagcgcccgggcgccgcggatgcgctggaccaccgcgctccacgcgcgcttcgtgcacgccgtcgagctcctcggcggacatgagagagcgacgccgaagtcggtgatggagctgatgaacgtcaaggatctaacgctcgcgcatgtcaagagccaccttcagatgtacaggacagtgaagagcacagacagatcgttgcacacagctacaggcgaggcgttgccgcttcagaggacggcggcgacagggatggaggcggcggcggccgcagcagcaggaggtggcggtggtggtgctggaggtggggtgataatggtaccagtgccagcagcatgtgacgacatggttgggatctgcagctctccttcggcgggctctgcgccgcctgctatggcgactacttccgctgctcacttcctctgtgcgccagcagcaacaactgctccactggcggcagcaccgtcacctcctccacccattcccccgaggagcaggactactgaccacgcagcagcagtgccggaaaaaggtgttgcaattgttgactcgttgcaccggccagtgcttgaagatactcatcagctgccaatgggactgcacgggtgtgttgacctgcttgaccccatggctacaaactgctcaagtccagcgagctcttctccatctctcgctagcctggagcagctgacggccgacatgtacgcgccgaacctggagatctccctggggaggcaggactggagcatggaccgtccggaaggactttgcctgaaatacctgtga

SEQ ID NO: 4120 - protein, 372 aa, Sorghum bicolor
  misc_feature: Ceres ANNOT ID no. 6034724
  misc_feature (118)..(169): Pfam Id: Myb_DNA-binding Pfam Desc: Myb-like DNA-binding domain
  misc_feature (77)..(208): NCBI GI: 84778270 NCBI Desc: kanadi-like transcription factor feathered [ipomoea nil]
  misc_feature (14)..(215): NCBI GI: 115479007 NCBI Desc: os09g0395300 [oryza sativa (japonica cultivar-group)]
  misc_feature (41)..(177): NCBI GI: 140069101 NCBI Desc: homeodomain-related [medicago truncatula]
  misc_feature (77)..(286): NCBI GI: 82754247 NCBI Desc: kanadi1-like protein [zea mays]
  misc_feature (8)..(214): NCBI GI: 29837235 NCBI Desc: myb family transcription factor-like [oryza sativa (japonica cultivar-group)]
  misc_feature: The sequence is a functional homolog of SEQ ID NO 1233 in the 10/666,642US patent application
  misc_feature: The sequence is a functional homolog of SEQ ID NO 1338 in the 10/374,780US patent application
  misc_feature: The sequence is a functional homolog of SEQ ID NO 1339 in the 10/374,780US patent application
  misc_feature: The sequence is a functional homolog of SEQ ID NO 1857 in the 10/374,780US patent application
  misc_feature: The sequence is a functional homolog of SEQ ID NO 935 in the 10/666,642US patent application
  misc_feature: Useful for making plants with modulated growth and phenotype characteristics
  misc_feature: The sequence is a functional homolog of SEQ ID NO 1338 in the 20060162006 US patent application
  misc_feature: The sequence is a functional homolog of SEQ ID NO 1339 in the 20060162006 US patent application
  misc_feature: The sequence is a functional homolog of SEQ ID NO 1857 in the 20060162006 US patent application
  misc_feature: The sequence is a functional homolog of SEQ ID NO 1233 in the 20070033671 US patent application
  misc_feature: The sequence is a functional homolog of SEQ ID NO 935 in the 20070033671 US patent application
  misc_feature: Useful for making plants with altered alkaloid content
  misc_feature: Useful for making plants with altered lignin content
  misc_feature: Functional homolog of the protein sequence given in SEQ ID NO 12899
  misc_feature: The sequence is a functional homolog of SEQ ID NO 2000 in the 11/479,226 US patent application
  misc_feature: The sequence is a functional homolog of SEQ ID NO 1995 in the 11/479,226 US patent application
  misc_feature: The sequence is a functional homolog of SEQ ID NO 1996 in the 11/479,226 US patent application
  misc_feature: The sequence is a functional homolog of SEQ ID NO 1997 in the 11/479,226 US patent application
  misc_feature: The sequence is a functional homolog of SEQ ID NO 1998 in the 11/479,226 US patent application
  misc_feature: The sequence is a functional homolog of SEQ ID NO 2001 in the 11/479,226 US patent application
  misc_feature: The sequence is a functional homolog of SEQ ID NO 1999 in the 11/479,226 US patent application
MLQRNLPNLCLQISPPAASSAVVASDAPVAASAKPPPTQPISTATYAEGSGEVGFFANPSPGAEPPGLSLGLATPALGDNAAGRRGHHLQPQGCAFKRAAARASLPAAGSKRSARAPRMRWTTALHARFVHAVELLGGHERATPKSVMELMNVKDLTLAHVKSHLQMYRTVKSTDRSLHTATGEALPLQRTAATGMEAAAAAAAGGGGGGAGGGVIMVPVPAACDDMVGICSSPSAGSAPPAMATTSAAHFLCAPAATTAPLAAAPSPPPPIPPRSRTTDHAAAVPEKGVAIVDSLHRPVLEDTHQLPMGLHGCVDLLDPMATNCSSPASSSPSLASLEQLTADMYAPNLEISLGRQDWSMDRPEGLCLKYL

SEQ ID NO: 4121 - DNA, 846 bp, Sorghum bicolor
  misc_feature: Ceres ANNOT ID no. 6034727
  misc_feature: Encodes the peptide sequence at SEQ ID NO 4122
atggagttcgccttggtcgagagtgaatcgttttcgccttcctgccccacgctcatcatgccagcgctgtcgattggcaacgtggggcagctcgccgtcgaccttctgatatcctcggcgagggcgaggcgggtggcctacctcgacgagccctccgtgctgccctgcgccggcaacgacgccttcggccctgacgccgtcggcgacctcgcactcgctcttgaagcttatgaatctacatctcataggctggctttcattcagcaaaggtctccagttattacagggatgatggtttcatttgcaaaaaatgttgctgatttcataagcagcattgggaagaaccatattgtcattatttcaagtttagattctggaaagaggagggtaattgatgcatccagtgacatgcaggtgtattacctttcaagttgcaatgaagatggttctgatccagaatatgagaaattggggtggaagaagcttgaggattacaatccatctcacaaacgttggagttatcttgctagcctagttgagggtggtgctctttcagaagatatggataatgatactgatgagatgacaataaatgattactatgtgagcctgccatttgcagcactcttctctgcctgcaaggctaaaggcttgaaagtttcctgtgtactgtgctactgctcagaaggcgacaacatgccagaatctttccagttagctgaggcaatatgtaaacttctaggtcatgaccttgagaaattccatggaaatgggccaaatgggtggatcgttcccttgtcatggaaatcagtttatggaccaccacctgatatgtccatcttttag

SEQ ID NO: 4122 - protein, 281 aa, Sorghum bicolor
  misc_feature: Ceres ANNOT ID no. 6034727
  misc_feature (137)..(258): NCBI GI: 102139860 NCBI Desc: cell cycle-regulated protein-related [musa acuminata]
  misc_feature (17)..(163): NCBI GI: 37589726 NCBI Desc: tumor necrosis factor superfamily, member 5-induced protein 1 [danio rerio]
  misc_feature (17)..(163): NCBI GI: 94732190 NCBI Desc: tumor necrosis factor superfamily, member 5-induced protein 1 [danio rerio]
  misc_feature (3)..(191): NCBI GI: 32484314 NCBI Desc: clast3-pending-prov protein [xenopus laevis]
  misc_feature (17)..(163): NCBI GI: 119621945 NCBI Desc: tumor necrosis factor superfamily, member 5-induced protein 1, isoform cra_a [homo sapiens]
  misc_feature: The plant produces a reduced number of seeds.
  misc_feature: Useful for biocontainment applications
  misc_feature: GREAT-hit functional homolog of the protein sequence given in SEQ ID NO 13244
  misc_feature: Useful for biocontainment applications
  misc_feature: Functional homolog of the protein sequence given in SEQ ID NO 13244
MEFALVESESFSPSCPTLIMPALSIGNVGQLAVDLLISSARARRVAYLDEPSVLPCAGNDAFGPDAVGDLALALEAYESTSHRLAFIQQRSPVITGMMVSFAKNVADFISSIGKNHIVIISSLDSGKRRVIDASSDMQVYYLSSCNEDGSDPEYEKLGWKKLEDYNPSHKRWSYLASLVEGGALSEDMDNDTDEMTINDYYVSLPFAALFSACKAKGLKVSCVLCYCSEGDNMPESFQLAEAICKLLGHDLEKFHGNGPNGWIVPLSWKSVYGPPPDMSIF

SEQ ID NO: 4123 - DNA, 777 bp, Sorghum bicolor
  misc_feature: Ceres ANNOT ID no. 6034729
  misc_feature: Encodes the peptide sequence at SEQ ID NO 4124
atggcgagcgtggcctcctcgagctgttccggctttctcctcccgccgagcttcgccagagtccgatgctcctcccgtccgtgctcttcgctccgcctgcggccgcggtggggcctgcgccggccgaggaccatcgcctgcgtcgcgccgccggactccgcggagccagagacggatgagcaggctgtggaagctgagtctgtcaaagaagaggctccgactagtacacccgaggatcctgggcttccagctctcccaaataaggatctcaacagaagggtagcactattgtcaactcttggggcagtggctctctttgcatcccagaggctcaatcttagcgaggcatctcttaaagatctcgctgccaatgccgtgccatatgaagaggctctttcaaatggcaagcccactgttgttgagttttatgcagactggtgcgaagtctgcagagagttagctccagatatctacaaagttgaacaacaatacaaggatcgtgtcaattttgtaatgctgaatgttgacaatacaaagtgggaacaagagcttgatgagtttggggtggaaggcattcctcactttgcctttctggataaggaaggaaatgaggaaggcaatgttgttgggagacttccaaaacagtattttcttgagaacgtggttgcacttgcttctggtgatcccaacatacctcatgcacgagtggttggtcagttctccagtgcggaatctaggaaagttcatcaagttcctgatcccagaagtcatggctag

SEQ ID NO: 4124 - protein, 258 aa, Sorghum bicolor
  misc_feature: Ceres ANNOT ID no. 6034729
  misc_feature (116)..(224): Pfam Id: Thioredoxin Pfam Desc: Thioredoxin
  misc_feature (38)..(258): NCBI GI: 20453407 NCBI Desc: at4g37200/c7a10_160 [arabidopsis thaliana]
  misc_feature (131)..(258): NCBI GI: 102139861 NCBI Desc: thioredoxin family protein [musa acuminata]
  misc_feature (74)..(258): NCBI GI: 75906563 NCBI Desc: thioredoxin-related [anabaena variabilis atcc 29413]
  misc_feature (74)..(258): NCBI GI: 17228066 NCBI Desc: thioredoxin-like protein [nostoc sp. pcc 7120]
  misc_feature (91)..(258): NCBI GI: 86605431 NCBI Desc: thioredoxin [cyanobacteria bacterium yellowstone a-prime]
MASVASSSCSGFLLPPSFARVRCSSRPCSSLRLRPRWGLRRPRTIACVAPPDSAEPETDEQAVEAESVKEEAPTSTPEDPGLPALPNKDLNRRVALLSTLGAVALFASQRLNLSEASLKDLAANAVPYEEALSNGKPTVVEFYADWCEVCRELAPDIYKVEQQYKDRVNFVMLNVDNTKWEQELDEFGVEGIPHFAFLDKEGNEEGNVVGRLPKQYFLENVVALASGDPNIPHARVVGQFSSAESRKVHQVPDPRSHG

SEQ ID NO: 4125 - DNA, 642 bp, Sorghum bicolor
  misc_feature: Ceres ANNOT ID no. 6034734
  misc_feature: Encodes the peptide sequence at SEQ ID NO 4126
atggggaaggggttcgcgtcgtacctggcgatgaagacggggccggagggcggcggcccggcggcggcggcgcagcaggcgctgatcgacgccgacctgcgggagctcggcgtcgccgcgcggaagctcgccaaccatgccttcgttctcggcggcggcctgggtttcggcacttccttcctcaagtggctggccttctttgcggcagtgtatctcttgatattggaccgcacaaattggaagaccaacatgctgacagctctcctggttccttacattttcttcactctgcctaatgtgctgttttctctgatcagaggagaggtggggaaatggattgcgattattgctgttattctgcgtctattctttccacgccacttcccagattggttagagcttcctggttccatcatcctgctcacagtggtcgcccccagcctgttcgcagacaccttaaggggtgacatcgttggtgtcttgatatgccttgcgattggatgctacctgctccacgagcacatcaatgcatcaggtggattcaggaacgccttcaggaagggcaatggtgtatcaaactccattggcatccttctactcttcatctaccctgtatgggcttttgtgctgcaagtcctgtag

SEQ ID NO: 4126 - protein, 213 aa, Sorghum bicolor
  misc_feature: Ceres ANNOT ID no. 6034734
  misc_feature (9)..(201): Pfam Id: WCOR413 Pfam Desc: Cold acclimation protein WCOR413
  misc_feature (1)..(213): NCBI GI: 27902673 NCBI Desc: cold acclimation protein cor413-pm1 [zea mays]
  misc_feature (7)..(213): NCBI GI: 16555360 NCBI Desc: cold acclimation protein wcor413-like protein beta form [triticum aestivum]
  misc_feature (7)..(213): NCBI GI: 1657855 NCBI Desc: cold acclimation protein wcor413 [triticum aestivum]
  misc_feature (28)..(213): NCBI GI: 21360378 NCBI Desc: stress-regulated protein sap1 [xerophyta viscosa]
  misc_feature (15)..(213): NCBI GI: 16356677 NCBI Desc: cold acclimation protein wcor413-like protein [physcomitrella patens]
MGKGFASYLAMKTGPEGGGPAAAAQQALIDADLRELGVAARKLANHAFVLGGGLGFGTSFLKWLAFFAAVYLLILDRTNWKTNMLTALLVPYIFFTLPNVLFSLIRGEVGKWIAIIAVILRLFFPRHFPDWLELPGSIILLTVVAPSLFADTLRGDIVGVLICLAIGCYLLHEHINASGGFRNAFRKGNGVSNSIGILLLFIYPVWAFVLQVL

SEQ ID NO: 4127 - DNA, 663 bp, Sorghum bicolor
  misc_feature: Ceres ANNOT ID no. 6034739
  misc_feature: Encodes the peptide sequence at SEQ ID NO 4128
atggcgctctccgtctcctccctcgccgccgccctctcccacctctctctcccatcgacttccacctccaagccccacccggccccgctcctgcgcctgcgctccacctcccgccgcgccgtcagcctcgcgctccgcgcctccgcggccgaggccgccgagccgtccgaggcggacctgcccgtggaggaggtggtggccgtcgaggaggaggcggaggaggatgcgctgtcgggaatcgcgctgcggaagtatgtgaagcagaggctgccgggtgggttcgcggcgcagcggatcaccgccacgggccgccgcaagacggccatcgcccgcgtcgtgctccaggagggaaccggcaaggtcttcatcaacttccgcgacgctaagggaaatccaatgtggatggagtactgcaaagtacccttgatgactctagggtttgagaacaactatgacgtctttgtcaaagtacatgggggtggtctctcaggccaggcccaggcaatttgccttggcgtagcccgtgcgttggtgaagatcagcaatgccaacagagttcctctgaagtcagaaggtttgctgacaagggacacccgtattgttgaaaggaagaaggctggtctcaagaaggcacgcaagcggccccagttctcaaagcgttga

SEQ ID NO: 4128 - protein, 220 aa, Sorghum bicolor
  misc_feature: Ceres ANNOT ID no. 6034739
  misc_feature (103)..(220): Pfam Id: Ribosomal_S9 Pfam Desc: Ribosomal protein S9/S16
  misc_feature (1)..(220): NCBI GI: 13242064 NCBI Desc: 9s ribosomal protein [zea mays]
  misc_feature (15)..(220): NCBI GI: 7578887 NCBI Desc: plastid ribosomal protein s9 precursor [spinacia oleracea]
  misc_feature (102)..(220): NCBI GI: 124112123 NCBI Desc: ribosomal protein s9 [chlorokybus atmophyticus]
  misc_feature (102)..(220): NCBI GI: 81301014 NCBI Desc: 30s ribosomal protein s9 [synechococcus elongatus pcc 7942]
  misc_feature (102)..(220): NCBI GI: 56751901 NCBI Desc: 30s ribosomal protein s9 [synechococcus elongatus pcc 6301]
MALSVSSLAAALSHLSLPSTSTSKPHPAPLLRLRSTSRRAVSLALRASAAEAAEPSEADLPVEEVVAVEEEAEEDALSGIALRKYVKQRLPGGFAAQRITATGRRKTAIARVVLQEGTGKVFINFRDAKGNPMWMEYCKVPLMTLGFENNYDVFVKVHGGGLSGQAQAICLGVARALVKISNANRVPLKSEGLLTRDTRIVERKKAGLKKARKRPQFSKR

SEQ ID NO: 4129 - DNA, 543 bp, Sorghum bicolor
  misc_feature: Ceres ANNOT ID no. 6034741
  misc_feature: Encodes the peptide sequence at SEQ ID NO 4130
atggcgaagcggccgtcgagcaagcggagcttcaggcttccgttcatgtgcgggcagtcggacgtggccagcgcggccgtcacgcgattgtcgtcgtcgtcgtcgtcattcggcagggggtccaggtccggctctagctccagctccagcagcaggcacggcgagctgcagtggatcttccagcacttcgaccgggacaatgacggcaagatctccggagccgagctgcgcgccttcttcgtgtccatgggcgacgacatgccgtcgtcgtacggcggcgacggtggctacatgctggacttcgccgacttcgtggcgctgatggagagggagggcggccaggaggaggacctgcggagggcgttcgaggtgttcaacgccgtggagtccgcgggcaggatcacggccaggggcctgcagagggtgctcgcccagctcggagacaagcgttccgtcgccgactgcgaggccatgatccgggcctacgacgtcgacggcgacggtggcctcgatttccacgagttccagaggatgatgagctaa

SEQ ID NO: 4130 - protein, 180 aa, Sorghum bicolor
  misc_feature: Ceres ANNOT ID no. 6034741
  misc_feature (55)..(83): Pfam Id: efhand Pfam Desc: EF hand
  misc_feature (154)..(181): Pfam Id: efhand Pfam Desc: EF hand
  misc_feature (1)..(180): NCBI GI: 15723363 NCBI Desc: calmodulin-like protein [musa acuminata]
  misc_feature (29)..(180): NCBI GI: 15289907 NCBI Desc: p0403c05.24 [oryza sativa (japonica cultivar-group)]
  misc_feature (28)..(180): NCBI GI: 140063818 NCBI Desc: calcium-binding ef-hand [medicago truncatula]
  misc_feature (31)..(180): NCBI GI: 22136314 NCBI Desc: calmodulin-like protein [arabidopsis thaliana]
  misc_feature (43)..(180): NCBI GI: 12963415 NCBI Desc: regulator of gene silencing [nicotiana tabacum]
MAKRPSSKRSFRLPFMCGQSDVASAAVTRLSSSSSSFGRGSRSGSSSSSSSRHGELQWIFQHFDRDNDGKISGAELRAFFVSMGDDMPSSYGGDGGYMLDFADFVALMEREGGQEEDLRRAFEVFNAVESAGRITARGLQRVLAQLGDKRSVADCEAMIRAYDVDGDGGLDFHEFQRMMS

SEQ ID NO: 4131 - DNA, 1686 bp, Sorghum bicolor
  misc_feature: Ceres ANNOT ID no. 6034742
  misc_feature: Encodes the peptide sequence at SEQ ID NO 4132
atgccgtccccgacgtcctacctcctcctgaacccctcaaaaccctcctccttccgctggctctcggccccggccccgcgcctccacgcccgccggttccatgtctcctgcgatgcgccgcggggtagcagtggcaggagtggcggcgggaggcgcgaggccatccccgccggcgccagcaaggccaagaagcagattgtcttcttcgacgccgcccctccggtgtcgcaggaaggcggggccgccgtggagaaggcggggggtgagaagccgacgaccaaggtgggcagcggcggcaacgcggcgctggcgttattgaggagggcgaccaagaggacgctcgcggtgctgtccaacctcccgctcgccatctccgagatgttcgccattgccgccctcatggctctagggacggtgattgaccagggagaggcgccgagctactacttcgagaagttccccgaggacaatccggtcttcggcttcatcacgtggaggtggatcctcacccccgggttcgaccacatgttctcctcgccggtcttcctcggcctcctcgcgctcctcgcgacgtccctcatggcctgcacctacacgacccagctccccatggtcaaggtcgcaagaagatggtcgttcacacattccggagaaagaatacggaagcaggagtttgcggactctcttccccgagcatccgttcaggatttgggagtcatcttgatgggtgctggatatgaggtattcaccaaggggccatctttgtatgctttcaaagggctggctggtcggtatgcgcctattggtgtgcacttggcaatgctcttcatcatggctggtgccacgctcagtgcgacaggaagctttaaaggctccgtggatgtgcctcaagggttgaactttgtcataggagatgtgatgaaacctagaggagtcctgtctgttgcgccagatgttttcaatactgaagtccatgtcaaccggttctacatggagtactatgatagtggagaggtctcacaattttacagtgatctctctctattcaaccttgatggtaaagaagtgatgagaaagactatcaaagtaaacgatcccctgagatacggagggatcaccatttaccagacagactggggattttcagcattgcaagtgaagaaaaatggtgagggccctttcaatttggcgatggcccccttgaaactgaatggggataagaagctctttggtacattcttgccacttgaagatgtggactcgtcgaatcctaatgtcaaaggaatatcaatgcttgctcgagatttgcagtctattgtgttgtatgatcaagagggtaagtttgtaggggtccgccggccaagctcgaaactgcctattgagatcaatggcaatgaaatactcattgaagatgctattggcagcactggactggatcttaagactgatccaggagttcctattgtttatgctggttttggtgcgcttatgttaacgacctgcattagctatctttcacactctcagatatgggcattgcaagatggaagtacagtagtcgttggagggaagacaaatcgagccaaacttgaattttctgaagagatgaaccggctacttgataaagtaccagagctgatcagtgccgatgagaatgtatttgataccaaatcgactgccacatga

SEQ ID NO: 4132 - protein, 561 aa, Sorghum bicolor
  misc_feature: Ceres ANNOT ID no. 6034742
  misc_feature (120)..(538): Pfam Id: ResB Pfam Desc: ResB-like family
  misc_feature (111)..(547): NCBI GI: 145354960 NCBI Desc: chloroplast cytochrome c biogenesis protein, ccs1-like protein [ostreococcus lucimarinus cce9901]
  misc_feature (13)..(391): NCBI GI: 25986609 NCBI Desc: c-type cytochrome synthesis 1 [chlamydomonas reinhardtii]
  misc_feature (13)..(391): NCBI GI: 25986617 NCBI Desc: c-type cytochrome synthesis 1 [chlamydomonas reinhardtii]
  misc_feature (103)..(543): NCBI GI: 67922271 NCBI Desc: resb-like [crocosphaera watsonii wh 8501]
  misc_feature (97)..(553): NCBI GI: 113474481 NCBI Desc: resb-like [trichodesmium erythraeum ims101]
MPSPTSYLLLNPSKPSSFRWLSAPAPRLHARRFHVSCDAPRGSSGRSGGGRREAIPAGASKAKKQIVFFDAAPPVSQEGGAAVEKAGGEKPTTKVGSGGNAALALLRRATKRTLAVLSNLPLAISEMFAIAALMALGTVIDQGEAPSYYFEKFPEDNPVFGFITWRWILTPGFDHMFSSPVFLGLLALLATSLMACTYTTQLPMVKVARRWSFTHSGERIRKQEFADSLPRASVQDLGVILMGAGYEVFTKGPSLYAFKGLAGRYAPIGVHLAMLFIMAGATLSATGSFKGSVDVPQGLNFVIGDVMKPRGVLSVAPDVFNTEVHVNRFYMEYYDSGEVSQFYSDLSLFNLDGKEVMRKTIKVNDPLRYGGITIYQTDWGFSALQVKKNGEGPFNLAMAPLKLNGDKKLFGTFLPLEDVDSSNPNVKGISMLARDLQSIVLYDQEGKFVGVRRPSSKLPIEINGNEILIEDAIGSTGLDLKTDPGVPIVYAGFGALMLTTCISYLSHSQIWALQDGSTVVVGGKTNRAKLEFSEEMNRLLDKVPELISADENVFDTKSTAT

SEQ ID NO: 4133 - DNA, 2079 bp, Sorghum bicolor
  misc_feature: Ceres ANNOT ID no. 6034755
  misc_feature: Encodes the peptide sequence at SEQ ID NO 4134
atggcgccgtggagcggcttgtggggcggcaaggccggcggcgacgcctaccggggcacgccggtggtggtcaagatggagaaccccaactggtccatctccgagatctcctcgccggaggacgacgacgaggacatcttggccgccggcggtcgccgcaaggggggccgctccaagaacgccaagcagatcaggtgggtgctgctcctcaaggcgcaccgcgccgccgggtgcctcgcctcgctggcctccaccgccgtcgcgctaggcggcgcggccaggcgcagggtggccgcggggaggaccgacgctgaggccggcgtggtggctgccaccggcgagagccccgtggtgcgctccaggttctacgccttcatcaaggccttcctcgtcgtctcgctgctcctcctagccgtcgaggtcgccgcttatttcagcggctgggacctcgccgcctccgcgctcgccatccccgtcatcggcctcgagtcgctgtacgcctcttggttgcgcttccgcgccacctacgttgcgccgggaatacagttcctcaccgacgcctgcgtcgtgctcttcctcatccagagcgccgaccgcctcatccagtgccttggctgcttctacatccacatcaagcgcatcaagcccaagcccaagtcgcttgcattgcctgatgcggaggacccggatgccgggtactaccccatggtacttgtccagataccaatgtgcaacgagaaggaggtgtatcaacaatcaattgcggccgtgtgcaaccttgactggccgaaatccaacttcttggttcaggtgttggatgactccgatgacccactgacacagactctgattagagaagaggtggccaaatggcaacagcaaggtgcccggattgtgtacaggcaccgtgtgttaagggatggttacaaggctggaaacctcaagtcagccatgagctgcagctatgtgaaggattacgaatttgttgccatctttgacgcagacttccaacctcatcctgactttctgaagcgcactgtgccacatttcaaggacaatgatgaacttgggctagtgcaagcaagatggtcctttgtgaataaggatgagaacctgctgactcggttgcagtatattaatctgtgcttccactttgaggtggaacagcaggtgaatggagtgttcttaaacttctttgggttcaatggcactgctggggtgtggaggatcaaggcattggaggactcaggtggatggatggaacggacaacagtggaggatatggacatcgctgttagggcacatctgcacggctggaagtttatattcctgaatgatgttgagtgccagtgcgaattgcccgagtcttatgaggcttacaggaagcagcagcatcggtggcattctggtccaatgcagctattcaggctttgtttaccagacatcatcaaatgcaagattgcgttttggaagaaagccaacttgattttccttttcttcctgcttcgaaagctcatattacctttctactccttcacgctcttctgcatcatcctcccgatgacgatgtttgtgcctgaagctgagcttcctgactgggtcgtgtgctacattccagccctcatgtccttgctcaacatcctaccttctccgaagtcattccctttcatcatcccatacctgctcttcgagaacaccatgtccgtgacaaagttcaatgccatgatctccggtctgttccagcttggaagcgcatacgagtgggtggtgaccaagaagtcaggccgctcatcagagggcgatctcatttccctggcccccaaggagctgaagcacctaaagacagggtctgcaccaaacctcgatgctgtcgcaaaggagcagctggcatcgaagaaggatgcgaaaaagaagcacaaccggatatacaagaaggagctcgcgctctcgatgttgctcctaaccgcggccgcccgaagcttgctctcgaagcagggtatacacttctacttcctcctgttccagggcatctccttcttgttagtaggccttgacctcataggcgagcaggtcgagtaa

SEQ ID NO: 4134 - protein, 692 aa, Sorghum bicolor
  misc_feature: Ceres ANNOT ID no. 6034755
  misc_feature (238)..(413): Pfam Id: Glycos_transf_2 Pfam Desc: Glycosyl transferase family 2
  misc_feature (111)..(692): NCBI GI: 16974749 NCBI Desc: cslc9 [oryza sativa]
  misc_feature (111)..(692): NCBI GI: 17385963 NCBI Desc: cslc9 [oryza sativa]
  misc_feature (7)..(692): NCBI GI: 34419218 NCBI Desc: tpa: cellulose synthase-like c2 [oryza sativa (indica cultivar-group)]
  misc_feature (8)..(691): NCBI GI: 114224789 NCBI Desc: cellulose synthase-like c3 [physcomitrella patens]
  misc_feature (8)..(691): NCBI GI: 114224787 NCBI Desc: cellulose synthase-like c2 [physcomitrella patens]
  misc_feature: Useful for making plants with altered cell wall content and/or composition
  misc_feature: GREAT-hit functional homolog of the protein sequence encoded by LOCUS at4g07960
  misc_feature: Useful for making plants with altered carbohydrate content
  misc_feature: Functional homolog of the protein sequence given in SEQ ID NO 13855
  misc_feature: Useful for making plants with altered cell wall content and/or composition
  misc_feature: Functional homolog of the protein sequence given in SEQ ID NO 13738
  misc_feature: The sequence is a functional homolog of SEQ ID NO. 403 in the 11/188,298 US application
MAPWSGLWGGKAGGDAYRGTPVVVKMENPNWSISEISSPEDDDEDILAAGGRRKGGRSKNAKQIRWVLLLKAHRAAGCLASLASTAVALGGAARRRVAAGRTDAEAGVVAATGESPVVRSRFYAFIKAFLVVSLLLLAVEVAAYFSGWDLAASALAIPVIGLESLYASWLRFRATYVAPGIQFLTDACVVLFLIQSADRLIQCLGCFYIHIKRIKPKPKSLALPDAEDPDAGYYPMVLVQIPMCNEKEVYQQSIAAVCNLDWPKSNFLVQVLDDSDDPLTQTLIREEVAKWQQQGARIVYRHRVLRDGYKAGNLKSAMSCSYVKDYEFVAIFDADFQPHPDFLKRTVPHFKDNDELGLVQARWSFVNKDENLLTRLQYINLCFHFEVEQQVNGVFLNFFGFNGTAGVWRIKALEDSGGWMERTTVEDMDIAVRAHLHGWKFIFLNDVECQCELPESYEAYRKQQHRWHSGPMQLFRLCLPDIIKCKIAFWKKANLIFLFFLLRKLILPFYSFTLFCIILPMTMFVPEAELPDWVVCYIPALMSLLNILPSPKSFPFIIPYLLFENTMSVTKFNAMISGLFQLGSAYEWVVTKKSGRSSEGDLISLAPKELKHLKTGSAPNLDAVAKEQLASKKDAKKKHNRIYKKELALSMLLLTAAARSLLSKQGIHFYFLLFQGISFLLVGLDLIGEQVE

SEQ ID NO: 4135 - DNA, 1074 bp, Sorghum bicolor
  misc_feature: Ceres ANNOT ID no. 6034777
  misc_feature: Encodes the peptide sequence at SEQ ID NO 4136
atgcagcccgacgccaacgccccctcccaccgcctcgcccgcgtcgccgcgcacctgcgcccgcagatggaggaaggcgcggtcgcgttcgcgctgaggcccgcggtgtgccgcgccaagggcggcgcgccggggttcaaggtcgcgatcctgggcgccgcgggcgggatcggacagccgctgtcgctgctcatgaagatgaaccctctcgtgtccgtgctccacctctacgatgtcgtcaacactcccggggtcaccgccgatatcagccacatggacaccagcgctgtggtccgtggcttccttggggcgcagcagcttgatgcagcacttacaggaatggaccttgtaatcatacccgctggtgtccctaggaaaccaggaatgacaagggatgatttattcaacataaatgctgggattgttcgtacactttgtgaaggcgtttcaagatgctgccctaatgcaattgtgaatttgatcagcaacccagtgaactcaactgtccccattgctgctgaggttttcaagaaagctggaacttatgatcctaagcgtcttcttggagtgacaacgctcgacgttgcgagggctaacacctttgtggccgaagtgcttggagttgatccaagagatgtcagtgttcctgttgttggtgggcatgctggggtaactatattgcccctcctctcccaggtcacacctccaagctcattcactcaggacgaaatcaaatatttgacagaccgcatacagaatggtggcacagaagttgtggaggcaaaggctggatcaggttctgcgactctgtcaatggcttttgctgctgcaaaatttggtgatgcatgcttgcgagctatgcggggcgatgctggcattgtggaatgctcatatgttgcatcagaggtgacagaactgccgttctttgcctcgaaagtgcggcttggccgtggtggagctgaggagatcctcccgcttggacctttgaatgattctgagagagctggtctggaagcggcaaagaaggaactgagcgagagcattcagaagggcatcgctttcgtgaacaagtga

SEQ ID NO: 4136 - protein, 357 aa, Sorghum bicolor
  misc_feature: Ceres ANNOT ID no. 6034777
  misc_feature (191)..(355): Pfam Id: Ldh_1_C Pfam Desc: lactate/malate dehydrogenase, alpha/beta C-terminal domain
  misc_feature (46)..(189): Pfam Id: Ldh_1_N Pfam Desc: lactate/malate dehydrogenase, NAD binding domain
  misc_feature (4)..(357): NCBI GI: 3183079 NCBI Desc: malate dehydrogenase, glyoxysomal precursor
  misc_feature (3)..(355): NCBI GI: 167284 NCBI Desc: glyoxysomal malate dehydrogenase precursor (ec 1.1.1.37)
  misc_feature (3)..(355): NCBI GI: 60593476 NCBI Desc: chain b, mature and translocatable forms of glyoxysomal malate dehydrogenase have different activities and stabilities but similar crystal structures
  misc_feature (3)..(355): NCBI GI: 126894 NCBI Desc: malate dehydrogenase, glyoxysomal precursor
  misc_feature (3)..(355): NCBI GI: 695311 NCBI Desc: glyoxysomal malate dehydrogenase
  misc_feature (4)..(357): SWISSPROT Homolog: EC 1.1.1.37 Malate dehydrogenase, glyoxysomal precursor
  misc_feature: The sequence is a functional homolog of SEQ ID NO. 341 in the 11/188,298 US application
MQPDANAPSHRLARVAAHLRPQMEEGAVAFALRPAVCRAKGGAPGFKVAILGAAGGIGQPLSLLMKMNPLVSVLHLYDVVNTPGVTADISHMDTSAVVRGFLGAQQLDAALTGMDLVIIPAGVPRKPGMTRDDLFNINAGIVRTLCEGVSRCCPNAIVNLISNPVNSTVPIAAEVFKKAGTYDPKRLLGVTTLDVARANTFVAEVLGVDPRDVSVPVVGGHAGVTILPLLSQVTPPSSFTQDEIKYLTDRIQNGGTEVVEAKAGSGSATLSMAFAAAKFGDACLRAMRGDAGIVECSYVASEVTELPFFASKVRLGRGGAEEILPLGPLNDSERAGLEAAKKELSESIQKGIAFVNK

SEQ ID NO: 4137 - DNA, 651 bp, Sorghum bicolor
  misc_feature: Ceres ANNOT ID no. 6034783
  misc_feature: Encodes the peptide sequence at SEQ ID NO 4138
atggcggcgctgctagcccggcaggcagcgcaggcgctccgcgcgaggcagacggcgcagctcttgccggccgcgtcggcgatgcaggggcacctccgcacctacatgaacgcggggattcccaagcggttcaaagaggatgaggagaaagaacagcttgcaaaagatgtcgcaaaagattggaatgctgtctttgaaaggagcatcaatacattgtttttgactgaaatggtccgtggcttgatgctaactctcaagtacttctttgacagaaatgttacaggtcctctgagtccccgcttccgtggtgagcatgctctcagacgttacgaatctggggaagagcgttgcattgcttgtaaactatgcgaagctatatgcccagcacaggcaattacaattgaggctgaagaacgtgaagacggcagtcgccgaaccacaagatatgatattgacatgaccaaatgcatttactgtgggttctgccaagaggcttgcccagtcgatgctattgttgaggggcctaactttgagtttgctactgagacacacgaggaactactgtatgacaaggagaaactgcttgagaatggtgatcgctgggagactgagattgctgagaacttgagatctgagagcctttatcgctga

SEQ ID NO: 4138 - protein, 216 aa, Sorghum bicolor
  misc_feature: Ceres ANNOT ID no. 6034783
  misc_feature (110)..(133): Pfam Id: Fer4 Pfam Desc: 4Fe-4S binding domain
  misc_feature (149)..(172): Pfam Id: Fer4 Pfam Desc: 4Fe-4S binding domain
  misc_feature (1)..(216): NCBI GI: 668985 NCBI Desc: nadh dehydrogenase; nadh:ubiquinone oxidoreductase (complex i) [solanum tuberosum]
  misc_feature (1)..(216): NCBI GI: 77416915 NCBI Desc: nadh:ubiquinone oxidoreductase-like [solanum tuberosum]
  misc_feature (1)..(216): NCBI GI: 89276311 NCBI Desc: mitochondrial nadh:ubiquinone oxidoreductase complex i [gymnadenia conopsea]
  misc_feature (1)..(216): NCBI GI: 668987 NCBI Desc: nadh dehydrogenase; nadh:ubiquinone oxidoreductase (complex i) [solanum tuberosum]
  misc_feature (1)..(216): NCBI GI: 1666177 NCBI Desc: nadh dehydrogenase; nadh:ubiquinone oxidoreductase (complex i) [nicotiana tabacum]
  misc_feature (64)..(216): SWISSPROT Homolog: EC 1.6.5.3 NADH-ubiquinone oxidoreductase subunit 8
  misc_feature (65)..(216): SWISSPROT Homolog: EC 1.6.99.5 NADH-quinone oxidoreductase subunit I
MAALLARQAAQALRARQTAQLLPAASAMQGHLRTYMNAGIPKRFKEDEEKEQLAKDVAKDWNAVFERSINTLFLTEMVRGLMLTLKYFFDRNVTGPLSPRFRGEHALRRYESGEERCIACKLCEAICPAQAITIEAEEREDGSRRTTRYDIDMTKCIYCGFCQEACPVDAIVEGPNFEFATETHEELLYDKEKLLENGDRWETEIAENLRSESLYR

SEQ ID NO: 4139 - DNA, 1704 bp, Sorghum bicolor
  misc_feature: Ceres ANNOT ID no. 6034785
  misc_feature: Encodes the peptide sequence at SEQ ID NO 4140
atgctcttctccaggaggcctctcgccgccgctctccacctcgcgcccctctcgcctccgctgctgctcctcttcgcgtccgcgtcctcctcctgctcgcccgccgccgccgcttcggcctccggctccagaggttgcactgctgtaaggatggacagtggcgcggtggagacagcgtccactggggcagtatggtcaacaccttcggcagaaccgagaagcatttctgtcgggaaggaggtattctgcaataggtcactcaacatgaggaacattacagcagtgggatttgatatggactacactctggcacagtacaagcctgagaccttcgaggcccttgcttactatggtacaatagagaagcttgtgaaggatctgcgctaccctgaagagttgctgacttgggagtttgattggaaatatatggtcagaggactagttcttgataagaagagaggaaatatcttgaagatggatcgacacaagtatgtaaaagttgcataccatggttttaaggaactgtcgaaagaagaaaaagttgctgcttatgggagtacattgataagagattcatttgatgaacctgattatgcccttatagatacgcttttctcactgggtgaagcttatctatttgctcagcttgttgatttcatggacaagaatcctggaaaagtacctgcaggcacagactatccacttatgtacagagatgtgaggtctgcggttgatttgtgtcatcgtgatggaactttaaagcgcatggtggcgaaggatcctgccaggtacatcaatgaggacttggcaattgtaccaatgcttgaaatgatcaggaaatctggacgctcaacattcttagtgacgaatagtttgtgggactacactgatgttgtcatgaactacctttgtgggccatacacttcggatgtaggctctggtctcaaccacaaatggcttcaatattttgatattgtaataacaggcagttcgaagccaagtttcttccatgatgataaccgtgcaggcctctttgaagttgagcctgattctggaaagcttctgaatgctgatattcagattggaagcccaagatcaagtcatcaacactcaacaccagttcagaaagtttaccagggaggcaatgttggtcatctccacagattactttctgttgcttctagttcacagattctctatgttggtgatcacatatatggagatattctgcggagcaagaaagttctgggttggcggactatgctagtaattccagaactagaacaagaggtgaagcttctctcagaatcaaagtctacaaggaaggagcttagacatcttagaatgaagcgtgattcaattgaagacagaatccatcatcttgaatggtctcttaaacttgatgatgtcacagaaaatcagaaggagaagttgttctctgaacatgacaatctgctgaaacagagagagcatgttcgccgccttcatcaagaggctcagaggcaacatcatcagaagtttcataaggtgtggggacagctcatgaagactgggtaccaaaattccagatttgctcatcaggttgagagatttgcatgcttgtacagcagccaggttacaaacttcggtttgtattcccccaacaagtactatcgtccgagcgaagattacatgccccatgagtttgatgtgcttgggctgtag

SEQ ID NO: 4140 - protein, 567 aa, Sorghum bicolor
  misc_feature: Ceres ANNOT ID no. 6034785
  misc_feature (157)..(567): Pfam Id: 5_nucleotid Pfam Desc: 5' nucleotidase family
  misc_feature (55)..(561): NCBI GI: 86158294 NCBI Desc: had superfamily (subfamily ig) hydrolase, 5'-nucleotidase [anaeromyxobacter dehalogenans 2cp-c]
  misc_feature (48)..(561): NCBI GI: 115379310 NCBI Desc: cytosolic imp-gmp specific 5'-nucleotidase [stigmatella aurantiaca dw4/3-1]
  misc_feature (80)..(356): NCBI GI: 83754365 NCBI Desc: chain a, crystal structure of the cytosolic imp-gmp specific 5'- nucleotidase (lpg0095) from legionella pneumophila, northeast structural genomics target lgr1
  misc_feature (67)..(561): NCBI GI: 121539758 NCBI Desc: had superfamily (subfamily ig) hydrolase, 5'-nucleotidase [anaeromyxobacter sp. fw109-5]
  misc_feature (81)..(483): NCBI GI: 40555840 NCBI Desc: 5'-nucleotidase, cytosolic ii [mus musculus]
MLFSRRPLAAALHLAPLSPPLLLLFASASSSCSPAAAASASGSRGCTAVRMDSGAVETASTGAVWSTPSAEPRSISVGKEVFCNRSLNMRNITAVGFDMDYTLAQYKPETFEALAYYGTIEKLVKDLRYPEELLTWEFDWKYMVRGLVLDKKRGNILKMDRHKYVKVAYHGFKELSKEEKVAAYGSTLIRDSFDEPDYALIDTLFSLGEAYLFAQLVDFMDKNPGKVPAGTDYPLMYRDVRSAVDLCHRDGTLKRMVAKDPARYINEDLAIVPMLEMIRKSGRSTFLVTNSLWDYTDVVMNYLCGPYTSDVGSGLNHKWLQYFDIVITGSSKPSFFHDDNRAGLFEVEPDSGKLLNADIQIGSPRSSHQHSTPVQKVYQGGNVGHLHRLLSVASSSQILYVGDHIYGDILRSKKVLGWRTMLVIPELEQEVKLLSESKSTRKELRHLRMKRDSIEDRIHHLEWSLKLDDVTENQKEKLFSEHDNLLKQREHVRRLHQEAQRQHHQKFHKVWGQLMKTGYQNSRFAHQVERFACLYSSQVTNFGLYSPNKYYRPSEDYMPHEFDVLGL

SEQ ID NO: 4141 - DNA, 2205 bp, Sorghum bicolor
  misc_feature: Ceres ANNOT ID no. 6034788
  misc_feature: Encodes the peptide sequence at SEQ ID NO 4142
atgacggtggcccgcggtccgcccggccgcccctcttccgggcttctgggctgctggcgccgccgcccggcgctgggcttcggcgccaaggtcggcatcgccatcgcgcttggcctctccttcgccatcatctggacctcactctccccgacttcctcctcccagcagatctctaccgagcgatcctccttcgcagccgaagttgccgcaccgccaactgccttccacaatcgcaccgccggcggcggcggcgggcacgctcaccggaagccccgccccgtcccgcacagccacaagaagcgccaccctgctccgtctggatcccattcccatccccaccgctccaatgccaccgcctcgctggatgccgccgctgtgaaggccgatcactccgagccggctccggtaaccgacccggggccgaaggagaaggaaccggagcaggagcaggagcaggaacaggagccagacatggagatggagccggaacaggaagcggagctgcccatgcccgagcagggcggggacaattcggggaaggcccctgcagaggaggatgaggagaaaccgccgcagctggaattggaagacgagcctagtgaggatgacggcgaggaggatgatcccgaggcggcaaagaggaaggctccaagtaagaagaggaagctcccgcctttgttcagcccgggtgcgcattaccactggaagctttgtggcgccaagagcagctaccactatattccttgtgtggatttcgatggggatgggagccagaggcaccatgagcgcagctgcccaaggtctcctgttacgtgtttggtgtcactgcccaaggagtataaacagcctgctgcatggcccgagaggaaggacaaggtttggtatgggaatgttgggcatcctaggttgtcaaattatgttaagggacacaactggctgaaccacagcggcgagtacttgatgttcccgccagacgaatgggagttcaaaggtagcgcaagacattatgttgaatcaattgatgagatggctcctgacattgactggggtaaaaatatacgcataatattggatgtcggatgcaaaagcgctggctttggtatcgctctactcaagaaagatgtgataacgctatctttaggccttatgaatgaccaaacagaccttgcgcaagttgcccttgaacgtggtatccctgcaacagttggcagtctgggatcgcgaagattacccttccctagtggtgcatttgatgctattcactgtggtgattgcaatataccatggcattctaatggtggaaaacttctcctagagataaatagaattcttcgtccaggaggatacttcatcatatcaagcaaaagtgctgacctggagagtgaagaaggaatatcagcttcaatgactgcgctttgttggaatgcaatagcttacaatagtgatgatgtcagtgaggctggagtgaagatatttcagcgaccagcctcaaacgaggtatatgatctgagagcaaaaaaagatcctccattttgcaaggaagagcagaacaaagctagtgcatggtatacccatatcaaacattgcctgcacaaagcacctgttggtatcgaagaaagaggcagtgactggcccgaggagtggcccaagaggctcgagagtttccctgagtggctcggggatacacaaacaagggtggcttctgatcataaccattggaaggctgttgttgagaaatcttatctggatggattgggcattgactggtcaaatatccgtaacgtaatggatatgagggctgtatttggaggatttgcagctgcactggcatctaaaaaggtttgggtcatgaatgttgttcctgtgcatgctgcagacaccctacccataatctatgaacgtggcctgatcggtgtgtatcatgattggtgtgaaccatttagtacatatccaaggtcctatgatcttttacatgctgaccatttattctcacgcctgaagatcagatgtaagcaacctgtctcaattgttgttgagatggaccggattttgaggcctggaggttgggctatcatccgtgataaactcgggatccttgacccattggagacaatcttgaaatcactgcattgggaaattgtcatgaccttcagaaaggacaaggaaggtatcatgtctgtaaagaaaacaacatggcgtccataa

SEQ ID NO: 4142 - protein, 734 aa, Sorghum bicolor
  misc_feature: Ceres ANNOT ID no. 6034788
  misc_feature (357)..(452): Pfam Id: Methyltransf_11 Pfam Desc: Methyltransferase domain
  misc_feature (77)..(734): NCBI GI: 21928175 NCBI Desc: at5g64030/mbm17_13 [arabidopsis thaliana]
  misc_feature (122)..(734): NCBI GI: 115441471 NCBI Desc: os01g0883900 [oryza sativa (japonica cultivar-group)]
  misc_feature (126)..(734): NCBI GI: 10176951 NCBI Desc: ankyrin-like protein [arabidopsis thaliana]
  misc_feature (199)..(678): NCBI GI: 38567836 NCBI Desc: osjnbb0020j19.14 [oryza sativa (japonica cultivar-group)]
  misc_feature (199)..(734): NCBI GI: 115461536 NCBI Desc: os04g0692400 [oryza sativa (japonica cultivar-group)]
MTVARGPPGRPSSGLLGCWRRRPALGFGAKVGIAIALGLSFAIIWTSLSPTSSSQQISTERSSFAAEVAAPPTAFHNRTAGGGGGHAHRKPRPVPHSHKKRHPAPSGSHSHPHRSNATASLDAAAVKADHSEPAPVTDPGPKEKEPEQEQEQEQEPDMEMEPEQEAELPMPEQGGDNSGKAPAEEDEEKPPQLELEDEPSEDDGEEDDPEAAKRKAPSKKRKLPPLFSPGAHYHWKLCGAKSSYHYIPCVDFDGDGSQRHHERSCPRSPVTCLVSLPKEYKQPAAWPERKDKVWYGNVGHPRLSNYVKGHNWLNHSGEYLMFPPDEWEFKGSARHYVESIDEMAPDIDWGKNIRIILDVGCKSAGFGIALLKKDVITLSLGLMNDQTDLAQVALERGIPATVGSLGSRRLPFPSGAFDAIHCGDCNIPWHSNGGKLLLEINRILRPGGYFIISSKSADLESEEGISASMTALCWNAIAYNSDDVSEAGVKIFQRPASNEVYDLRAKKDPPFCKEEQNKASAWYTHIKHCLHKAPVGIEERGSDWPEEWPKRLESFPEWLGDTQTRVASDHNHWKAVVEKSYLDGLGIDWSNIRNVMDMRAVFGGFAAALASKKVWVMNVVPVHAADTLPIIYERGLIGVYHDWCEPFSTYPRSYDLLHADHLFSRLKIRCKQPVSIVVEMDRILRPGGWAIIRDKLGILDPLETILKSLHWEIVMTFRKDKEGIMSVKKTTWRP

SEQ ID NO: 4143 - DNA, 1845 bp, Sorghum bicolor
  misc_feature: Ceres ANNOT ID no. 6034807
  misc_feature: Encodes the peptide sequence at SEQ ID NO 4144
atgtggcgcggctgcgtgtcgcggggcctccggaaggtcaaggccgccgcctcggcctccaggctcttctctacgagctcgtcctacacggtggtggatcacacctatgatgctgttgtcgtgggagccggaggtgcggggctcagggcagcgattggcctctcggagcatgggttcaacactgcctgcatcaccaagctcttccccacacgatcacatacagtggctgctcagggaggcataaatgctgctcttggcaacatgagtgaagatgactggagatggcatatgtatgatacagtcaaaggaagtgactggttgggcgaccaagattctattcagtatatgtgcagagaggcaccaaaagctgttatagaacttgagaactatggcttaccattttccagaaccgaagatggaaaaatttatcaacgcgcctttggtggacaaagcttagattttggaaaaggtgggcaagcctatcggtgtgcatgtgcagccgatagaacagggcatgctatgctacacacactatatggtcaagcaatgaagcataatactcagttttttgttgaatattttgcactggaccttctcatggacaatgaaggcatctgccaaggtgtaattgcgctaaacatggaggatggtacccttcatcgttttcgtgctgcaaatacaattctagccactggaggttatggtagagcctacttttcagcaacttcagctcacacatgtactggtgatggcaacgctatggttgcacgtgccggattaccccttcagttccatcctacaggcatttatggtgctggatgcctgataacagaaggttcccgaggtgaaggtggtattcttcggaacagtgaaggtgagagatttatggaacgatatgctccaactgctaaagatcttgcatctcgtgatgttgtttcgagatcgatgacaatggaaattagggagggccgtggtgtaggaccactgaaggaccatatctatctgcacctcaaccatcttcctccagaagttctcaaggaaaggcttcctggtatatctgaaactgctgcgatttttgctggtgttgatgtcaccaaagagccgattcctgttttgcctactgtgcactataacatgggtggtatcccaacaaactatcatggggaggtgctgcatatcaagggtgatgatccagatgcagttgttcctggtctgatggctgctggggaagctgcttgtgcatctgttcacggcgctaacaggcttggtgcaaattcacttcttgatatagttgtatttggcagggcttgtgcaaacagggttgctgagatatccaaaccaggagagaagcagaagcctcttggaaaaggtgttggagaaaatactattgcttggttggataagttgaggaatgcaaatggatctttacctacttcaaagattcgtctcaacatgcaacgggttatgcaaaacaatgctgcagttttccgcacacaagaaactcttgaggaaggctgtgaactgattagcaaagcatgggagagtttccatgatgtcaagatcagtgacagaagtctcatatggaattcagacttgattgagaccatagaattggaaaacctgctaataaatgcatgcataaccatgtattcagcagaggctcgcaaagagagcagaggagctcatgcccgtgaagatttttcgacaagagatgatgagagctggatgaagcacaccctagggtattgggagaacgagaaggttagactagcctacaggccagttcacatgaataccttggacgatgaagttcaatctttcccaccgaaagcacgtgtttactaa

SEQ ID NO: 4144 - protein, 614 aa, Sorghum bicolor
  misc_feature: Ceres ANNOT ID no. 6034807
  misc_feature (37)..(427): Pfam Id: FAD_binding_2 Pfam Desc: FAD binding domain
  misc_feature (482)..(614): Pfam Id: Succ_DH_flav_C Pfam Desc: Fumarate reductase/succinate dehydrogenase flavoproteinC-terminal domain
  misc_feature (37)..(367): Pfam Id: DAO Pfam Desc: FAD dependent oxidoreductase
  misc_feature (1)..(614): NCBI GI: 75135397 NCBI Desc: succinate dehydrogenase [ubiquinone] flavoprotein subunit, mitochondrial precursor (fp) (flavoprotein subunit of complex ii)
  misc_feature (20)..(614): NCBI GI: 21700795 NCBI Desc: at5g66760/msn2_16 [arabidopsis thaliana]
  misc_feature (26)..(573): NCBI GI: 94733755 NCBI Desc: succinate dehydrogenase complex, subunit a, flavoprotein (fp) [danio rerio]
  misc_feature (26)..(573): NCBI GI: 41053873 NCBI Desc: succinate dehydrogenase complex, subunit a, flavoprotein (fp) [danio rerio]
  misc_feature (26)..(573): NCBI GI: 116129991 NCBI Desc: ensangp00000010243 [anopheles gambiae str. pest]
  misc_feature (1)..(614): SWISSPROT Homolog: EC 1.3.5.1 Succinate dehydrogenase [ubiquinone] flavoprotein subunit, mitochondrialprecursor
  misc_feature (26)..(614): SWISSPROT Homolog: EC 1.3.99.1 Succinate dehydrogenase flavoprotein subunit
MWRGCVSRGLRKVKAAASASRLFSTSSSYTVVDHTYDAVVVGAGGAGLRAAIGLSEHGFNTACITKLFPTRSHTVAAQGGINAALGNMSEDDWRWHMYDTVKGSDWLGDQDSIQYMCREAPKAVIELENYGLPFSRTEDGKIYQRAFGGQSLDFGKGGQAYRCACAADRTGHAMLHTLYGQAMKHNTQFFVEYFALDLLMDNEGICQGVIALNMEDGTLHRFRAANTILATGGYGRAYFSATSAHTCTGDGNAMVARAGLPLQFHPTGIYGAGCLITEGSRGEGGILRNSEGERFMERYAPTAKDLASRDVVSRSMTMEIREGRGVGPLKDHIYLHLNHLPPEVLKERLPGISETAAIFAGVDVTKEPIPVLPTVHYNMGGIPTNYHGEVLHIKGDDPDAVVPGLMAAGEAACASVHGANRLGANSLLDIVVFGRACANRVAEISKPGEKQKPLGKGVGENTIAWLDKLRNANGSLPTSKIRLNMQRVMQNNAAVFRTQETLEEGCELISKAWESFHDVKISDRSLIWNSDLIETIELENLLINACITMYSAEARKESRGAHAREDFSTRDDESWMKHTLGYWENEKVRLAYRPVHMNTLDDEVQSFPPKARVY

SEQ ID NO: 4145 - DNA, 1704 bp, Sorghum bicolor
  misc_feature: Ceres ANNOT ID no. 6034811
  misc_feature: Encodes the peptide sequence at SEQ ID NO 4146
atggcgtcgccggcgctaatctccgacacggagcagtggaaggccctccaggcgcatgtcggcgcgattcagaagacgcacctgcgggacctgatggccgacgccgatcgatgcaaggcaatgacggctgagtatgaagggatctttctggattactcgaggcagcaggcgactggtgaaaccatcgagaagctgcttaaattggctgaggttgccaagctcaaggagaagattgagaagatgtttaaaggtgaaaagataaatagcacggagaacaggtcagtgcttcatgtagctctgagggctccaagagatgcagttataaacagtgatggggtgaatgtggtccctgaggtttggtctgttaaagataaaatcaaggagttttcggacactttcagaagtggatcatgggttggagcaactggaaaaccattgaccaatgttgtgtcagttggaataggtggtagctttcttggccctctatttgtgcatactgcgctccagactgatccagaagcagcagaatgtgcgaaaggccgacaactgagattccttgcaaatgttgatccagttgatgttgcacgaagcattaaagatttagatccagaaaccactctggtggtggttgtatcaaagacattcacaacagctgaaacaatgttaaatgctcgaactcttaaggagtggatcgtttcttctcttgggccacaggctgttgcaaaacatatgattgctgtcagtactaatcttaagcttgtgaaggagtttggaattgacccaaacaatgcttttgccttttgggactgggttggtggccgttatagtgtttgcagtgctgttggtgttctgccattatctcttcagtatggttttccaattgtccagaaatttttggagggagcttccagcattgacaaccacttcaactcatcttcatttgagaaaaatatacctgtactccttggtttgttgagtgtgtggaatgtttcatttcttggttatccagctagagcaatattgccatattcccaggcacttgagaaattggcaccacatatacaacagcttagcatggagagcaacgggaagggtgtttccattgatggcattccactccccttcgagacgggtgaaattgattttggtgaacctggaactaatggccagcacagcttctatcaattaatccatcagggaagggtcatcccttgcgattttattggtgttgttaaaagtcagcagcctgtttacttgaaaggggaaactgtgagtaatcatgatgagcttatgtccaatttctttgcccagcctgatgcacttgcttatggaaagactcctgaacaattgcacagtgagaaagttccggaaaatcttatccctcataagacttttaagggcaaccggccatcactaagtttgcttttgcctacactatccgcatatgaggttggacagcttttatccatctatgagcaccgggttgcagttcagggcttcatatggggaattaactcgtttgatcagtggggagtggagctagggaagtcgcttgcttcccaagtgaggaaacagctgcatgaatcccgaatggaaggaaagcctgttgatggctttaaccacagtacttcaagtttgcttgcacgatatcttgctgtcaagccacccactccatatgacactaccgtgctaccgaaggtgtaa

SEQ ID NO: 4146 - protein, 567 aa, Sorghum bicolor
  misc_feature: Ceres ANNOT ID no. 6034811
  misc_feature (51)..(547): Pfam Id: PGI Pfam Desc: Phosphoglucose isomerase
  misc_feature (1)..(567): NCBI GI: 596023 NCBI Desc: glucose-6 phosphate isomerase
  misc_feature (1)..(567): NCBI GI: 91694275 NCBI Desc: glucose-6-phosphate isomerase [hordeum vulgare]
  misc_feature (1)..(567): NCBI GI: 91694277 NCBI Desc: glucose-6-phosphate isomerase [triticum aestivum]
  misc_feature (1)..(567): NCBI GI: 90179750 NCBI Desc: glucose-6-phosphate isomerase, cytosolic b (gpi-b) (phosphoglucose isomerase b) (pgi-b) (phosphohexose isomerase b) (phi-b)
  misc_feature (1)..(567): NCBI GI: 52077263 NCBI Desc: glucose-6-phosphate isomerase b [oryza sativa (japonica cultivar-group)]
  misc_feature (1)..(567): SWISSPROT Homolog: EC 5.3.1.9 Glucose-6-phosphate isomerase, cytosolic
  misc_feature: Useful for making plants with altered cell wall content and/or composition
  misc_feature: GREAT-hit functional homolog of the protein sequence encoded by LOCUS at5g42740
  misc_feature: Useful for making plants with altered cell wall content and/or composition
  misc_feature: Functional homolog of the protein sequence given in SEQ ID NO 13856
  misc_feature: Useful for making plants with altered carbohydrate content
  misc_feature: Functional homolog of the protein sequence given in SEQ ID NO 13857
MASPALISDTEQWKALQAHVGAIQKTHLRDLMADADRCKAMTAEYEGIFLDYSRQQATGETIEKLLKLAEVAKLKEKIEKMFKGEKINSTENRSVLHVALRAPRDAVINSDGVNVVPEVWSVKDKIKEFSDTFRSGSWVGATGKPLTNVVSVGIGGSFLGPLFVHTALQTDPEAAECAKGRQLRFLANVDPVDVARSIKDLDPETTLVVVVSKTFTTAETMLNARTLKEWIVSSLGPQAVAKHMIAVSTNLKLVKEFGIDPNNAFAFWDWVGGRYSVCSAVGVLPLSLQYGFPIVQKFLEGASSIDNHFNSSSFEKNIPVLLGLLSVWNVSFLGYPARAILPYSQALEKLAPHIQQLSMESNGKGVSIDGIPLPFETGEIDFGEPGTNGQHSFYQLIHQGRVIPCDFIGVVKSQQPVYLKGETVSNHDELMSNFFAQPDALAYGKTPEQLHSEKVPENLIPHKTFKGNRPSLSLLLPTLSAYEVGQLLSIYEHRVAVQGFIWGINSFDQWGVELGKSLASQVRKQLHESRMEGKPVDGFNHSTSSLLARYLAVKPPTPYDTTVLPKV

SEQ ID NO: 4147 - DNA, 1506 bp, Sorghum bicolor
  misc_feature: Ceres ANNOT ID no. 6034832
  misc_feature: Encodes the peptide sequence at SEQ ID NO 4148
atggcggcgagccgggccgacctcgccgacgacggcttcgcggcgccgcggctcttctcgcagggcgtctcctacacctacgacgacgtcatcttcctgccggggtacatcggcttccccgccgacgccgtcgacctctccacgcgcctctcccgccgcgtgccgctctccatcccctgcgtcgcgtccccgatggacaccgtctccgaggccaccatggccgcggccatggcctccctcggcgccgccgccgtcgtgcactgcaacaccgaaccccacgcccaggccgccatcgtccgcgccgccaagtcacgccgcctccccttcgtctcctccgtgcccttcttctccccgtcctccgccccgacgctcaacgacttcgctggcaacgagtacgccctcgttactcagcacggagattcgctctccacgctcgtcggcgtcgctgtcgcagccgatgctgcctcccgcgaggtccctgtctctgtctatgagtacatgagaccggcaccgcgcttagcctccgcctccttcgacttcgagaaagcggccgccttccttgccgatgagggtctggattacgcccctcttgtatccgacgacggtgaggttgtcgatctcatcaccgccaaggatgtggagcgcatccggagctatccgaagctaggcaagccgtctcttggagcagacgggaagtttgtagttgcggcctccattgggacccgtgaggatgacaagggaaggctggagcagctagttaaggcgggggcaaatgctatcgtgattgatagttcacaggggaactccatttaccagcttgatatgataaagtttgccaagaagatgtacccggaggtggatttgattgggggtaatgtggtgacaattgcacaggcccagaatttgattcaagctggtgcagatggtttgcgtgttggaatgggttctggctcaatttgtaccactcaggaggtttgtgctgttggaagaggacaggcaacagcggtgtataaggtttcatcttatgccaaggatcacaatgtaccagttattgctgatggtggaatttcaaactctggacatatcgtgaaagctctgtcactgggggcatccactgttatgatgggcagctttttagccggcagtcacgaagctcctggtacttatgagtacaaggacgggcgtcgagtcaaaaaatacagaggcatgggctctcttgaagccatgacaaaagggagtgatgcaaggtaccttggtgatactctcaagctcaaagtcgcccaaggcgttgttggagcagtagctgacaaaggttctgtactgaggttcattccttacacaatgcaagcagttaagcaaggattccaagatcttggtgcagattctctccagtcagctcatgatcttttgcgatcagagactctcagattagaggtgagaaccggcgctgcccaggttgaaggtggaatccatgggctggtttcatacgagaagaaggcattctag

SEQ ID NO: 4148 - protein, 501 aa, Sorghum bicolor
  misc_feature: Ceres ANNOT ID no. 6034832
  misc_feature (23)..(491): Pfam Id: IMPDH Pfam Desc: IMP dehydrogenase / GMP reductase domain
  misc_feature (10)..(501): NCBI GI: 28413147 NCBI Desc: inosine monophosphate dehydrogenase [vigna unguiculata]
  misc_feature (10)..(501): NCBI GI: 4468193 NCBI Desc: inosine monophosphate dehydrogenase [glycine max]
  misc_feature (10)..(501): NCBI GI: 23463051 NCBI Desc: at1g79470/t8k14_11 [arabidopsis thaliana]
  misc_feature (31)..(501): NCBI GI: 38096048 NCBI Desc: inosine-5'-phosphate dehydrogenase [nicotiana tabacum]
  misc_feature (117)..(501): NCBI GI: 16417597 NCBI Desc: inosine-5'-monophosphate dehydrogenase-like protein [glycine max]
  misc_feature (10)..(501): SWISSPROT Homolog: EC 1.1.1.205 Inosine-5'-monophosphate dehydrogenase
MAASRADLADDGFAAPRLFSQGVSYTYDDVIFLPGYIGFPADAVDLSTRLSRRVPLSIPCVASPMDTVSEATMAAAMASLGAAAVVHCNTEPHAQAAIVRAAKSRRLPFVSSVPFFSPSSAPTLNDFAGNEYALVTQHGDSLSTLVGVAVAADAASREVPVSVYEYMRPAPRLASASFDFEKAAAFLADEGLDYAPLVSDDGEVVDLITAKDVERIRSYPKLGKPSLGADGKFVVAASIGTREDDKGRLEQLVKAGANAIVIDSSQGNSIYQLDMIKFAKKMYPEVDLIGGNVVTIAQAQNLIQAGADGLRVGMGSGSICTTQEVCAVGRGQATAVYKVSSYAKDHNVPVIADGGISNSGHIVKALSLGASTVMMGSFLAGSHEAPGTYEYKDGRRVKKYRGMGSLEAMTKGSDARYLGDTLKLKVAQGVVGAVADKGSVLRFIPYTMQAVKQGFQDLGADSLQSAHDLLRSETLRLEVRTGAAQVEGGIHGLVSYEKKAF

SEQ ID NO: 4149 - DNA, 714 bp, Sorghum bicolor
  misc_feature: Ceres ANNOT ID no. 6034835
  misc_feature: Encodes the peptide sequence at SEQ ID NO 4150
atggttgtccaggagttcacagttgatctcaacaagccccttgttttccaggttggccatcttgaggagcgttaccaagaatgggttcaccaacctattgtcagcaaggagggtccacgctttttcggaaatgatgtcttggagttcttgacttgcacaaagtggtgggctgtgccaactatatggctccctgttgtttgcttcatgttcgtgaaatcaattttgatgggtaataccattcaggacgtagttctgatggctctatttggaatatttatttggacgctgattgaatatactttgcaccgcttcctattccacattgagaccaaaacctactggtggaacaccgcacattaccttcttcatggatgccaccataagcaccctatggactcactcaggcttgtttttcctcctactgcaacagcaattttgtgtttcccgttctggaacctggtcgcattcttcgcaactccatctaccacacctgcattatttggaggtggtctgttgggatatgtgatgtatgattgcactcactactacctgcaccatggacaaccatccacagacccagcaaaacatctcaagaggtatcacctcagccatcacttcagaatccaagacatgggctttggcattacctcatcgctttgggacgctgtctttgggacattgcctccatccatgacacctgggaagaagaactga

SEQ ID NO: 4150 - protein, 237 aa, Sorghum bicolor
  misc_feature: Ceres ANNOT ID no. 6034835
  misc_feature (87)..(206): Pfam Id: FA_hydroxylase Pfam Desc: Fatty acid hydroxylase
  misc_feature (1)..(237): NCBI GI: 115489684 NCBI Desc: os12g0628400 [oryza sativa (japonica cultivar-group)]
  misc_feature (1)..(236): NCBI GI: 23308163 NCBI Desc: at2g34770/t29f13.2 [arabidopsis thaliana]
  misc_feature (88)..(229): NCBI GI: 54038699 NCBI Desc: loc398669 protein [xenopus laevis]
  misc_feature (88)..(229): NCBI GI: 32766618 NCBI Desc: loc398669 protein [xenopus laevis]
  misc_feature (88)..(229): NCBI GI: 12053843 NCBI Desc: fatty acid hydroxylase [homo sapiens]
MVVQEFTVDLNKPLVFQVGHLEERYQEWVHQPIVSKEGPRFFGNDVLEFLTCTKWWAVPTIWLPVVCFMFVKSILMGNTIQDVVLMALFGIFIWTLIEYTLHRFLFHIETKTYWWNTAHYLLHGCHHKHPMDSLRLVFPPTATAILCFPFWNLVAFFATPSTTPALFGGGLLGYVMYDCTHYYLHHGQPSTDPAKHLKRYHLSHHFRIQDMGFGITSSLWDAVFGTLPPSMTPGKKN

SEQ ID NO: 4151 - DNA, 1296 bp, Sorghum bicolor
  misc_feature: Ceres ANNOT ID no. 6034837
  misc_feature: Encodes the peptide sequence at SEQ ID NO 4152
atgacgacagtgtcgcgcgcgctcggctcagcgttcgcgggcttcacgcgggcacccgcggcggcgcagactgcgacgaccctgccctccccgtgcggctcgtcggcgctactccagcactggcgctggagccgggctagccgcgcccggcggttctcgtccggccgctcggcacggataagcatgagcctccgcgccggcatcgtcgggcttcccaacgtcggcaagtccactctcttcaacgccattgttgaaaacggaaaggcacaagctgcaaactttcccttttgcaccatcaacccaaatgttggtgtggtggctatccctgatcctcgtttgcaggtgctctcaaaattaagcaagtcacagcagacggtcccaacatccattgagcttgtggacattgcaggtctcgtcaaaggagcaagcaaaggagagggactaggaaatcaattcctttcaaacatccgtgaagtggattccatacttcaggttgtgcgatgctttgaggatgacgatatagttcatgtcaatggcaaggtcgatcccagatcagacatcgatgtcattaacctagagctgatattttcggatcttgaacagatagagaagaggctagataagcttaacaagagcaaaactaaagatgcgcaagtaaaagcgaaggaacaagcagagaaatcaggattggaaaaaattcagcaggcacttatggaaggaaaacctgcaagatcggttgatttagctgagcatgagaaggaagctatacaacatctttgtctgctaaccatgaaacctgtcatttatgttgctaatgtaacagaatctgatcttgctgaacctgatagcaatcctcatgtcaaagaggtggctaaagcagcatcagacttgcagtctggtatggttacaatatcagctcaggttgaagctgaactcgctgagctacctttggaagagagagtagaatatttaaaatctcttggtgttgctgaaagtggactaggaaatttagtaaaagcaacatataatctattgggattaagaacttatttcacaaccggagagaaggaaacaaaagcatggactattctttcaggcatgactgcaccacaggcagctggagttattcatagtgactttcagaaaggattcatcagagctgaaactgtatcctatgatgattttgttgcagctggttctcttggagtagcaagggagaaagggctgttgaggttggaagggaaggattatgttgtgcaggaaggagatgtcatgcttttcagattcaatgtgtga

SEQ ID NO: 4152 - protein, 431 aa, Sorghum bicolor
  misc_feature: Ceres ANNOT ID no. 6034837
  misc_feature (64)..(207): Pfam Id: MMR_HSR1 Pfam Desc: GTPase of unknown function
  misc_feature (57)..(431): NCBI GI: 42562778 NCBI Desc: gtp-binding protein-related [arabidopsis thaliana]
  misc_feature (57)..(431): NCBI GI: 6056379 NCBI Desc: similar to gtp-binding protein [arabidopsis thaliana]
  misc_feature (150)..(431): NCBI GI: 115455709 NCBI Desc: os03g0781000 [oryza sativa (japonica cultivar-group)]
  misc_feature (64)..(431): NCBI GI: 56750976 NCBI Desc: probable gtp binding protein [synechococcus elongatus pcc 6301]
  misc_feature (64)..(431): NCBI GI: 86610344 NCBI Desc: gtp-binding protein ychf [cyanobacteria bacterium yellowstone b-prime]
MTTVSRALGSAFAGFTRAPAAAQTATTLPSPCGSSALLQHWRWSRASRARRFSSGRSARISMSLRAGIVGLPNVGKSTLFNAIVENGKAQAANFPFCTINPNVGVVAIPDPRLQVLSKLSKSQQTVPTSIELVDIAGLVKGASKGEGLGNQFLSNIREVDSILQVVRCFEDDDIVHVNGKVDPRSDIDVINLELIFSDLEQIEKRLDKLNKSKTKDAQVKAKEQAEKSGLEKIQQALMEGKPARSVDLAEHEKEAIQHLCLLTMKPVIYVANVTESDLAEPDSNPHVKEVAKAASDLQSGMVTISAQVEAELAELPLEERVEYLKSLGVAESGLGNLVKATYNLLGLRTYFTTGEKETKAWTILSGMTAPQAAGVIHSDFQKGFIRAETVSYDDFVAAGSLGVAREKGLLRLEGKDYVVQEGDVMLFRFNV

SEQ ID NO: 4153 - DNA, 834 bp, Sorghum bicolor
  misc_feature: Ceres ANNOT ID no. 6034844
  misc_feature: Encodes the peptide sequence at SEQ ID NO 4154
atggaggccatggccaggccaagtgtagctccgtcgttgcagccccgcccgtgcccgaggccgcaccggaacagctgcccaccttcctccatgcgacggagagttgcttgctcggcctcggcggccgacgccgacgtggtcgacctcttcgacgccgctaagctcactgtggacaagttcgtgagcagcggcatggtggtggggcttggctccggcccggcgtccgccctggcgatccagtaccttggcacgcgcctccgccggggatctctcaccggcatcaccgcagtgacctctgcgaacgaggcagacatggcagggatacgggctagcagctatcaggaagtgatcgaagagggcaccctggctgctgtcatcgggcggcgaaagacggagagcggagagccctctttcatggtggagaaggcaatggctaagtcagctgacaagcttgccttcatcactgggcacgacaagtacgtgacgggcatcgagggttctatcccggtcctggttaaaagtggaaactggatagacaccgccgaagagattgatgatttgtttctaggagatgcagaggtttggaggaggccatcgtttggaactgccgggccactggggggtgaccacccattggttaccaaggagggccatcacgtactcgatgttatcttcacaactccaatctcagatcttggtcaggtagcagagaagttggacaaaattgatggcgttgtggatcatgggatcatttgcggcaaccaatcatatgctgtcattgcatccaaaggggaagttcaggtcctggacgagaaatcttcagtgatacagtag

SEQ ID NO: 4154 - protein, 277 aa, Sorghum bicolor
  misc_feature: Ceres ANNOT ID no. 6034844
  misc_feature (94)..(266): Pfam Id: Rib_5-P_isom_A Pfam Desc: Ribose 5-phosphate isomerase A (phosphoriboisomerase A)
  misc_feature (65)..(270): NCBI GI: 84874518 NCBI Desc: ribose 5-phosphate isomerase-like [saussurea involucrata]
  misc_feature (57)..(268): NCBI GI: 77024233 NCBI Desc: chloroplast ribulose phosphate isomerase [pavlova lutheri]
  misc_feature (43)..(269): NCBI GI: 41017643 NCBI Desc: ribose-5-phosphate isomerase a (phosphoriboisomerase a) (pri)
  misc_feature (43)..(269): NCBI GI: 37519599 NCBI Desc: ribose 5-phosphate isomerase [gloeobacter violaceus pcc 7421]
  misc_feature (50)..(270): NCBI GI: 84688016 NCBI Desc: ribose 5-phosphate isomerase [rhodobacterales bacterium htcc2654]
MEAMARPSVAPSLQPRPCPRPHRNSCPPSSMRRRVACSASAADADVVDLFDAAKLTVDKFVSSGMVVGLGSGPASALAIQYLGTRLRRGSLTGITAVTSANEADMAGIRASSYQEVIEEGTLAAVIGRRKTESGEPSFMVEKAMAKSADKLAFITGHDKYVTGIEGSIPVLVKSGNWIDTAEEIDDLFLGDAEVWRRPSFGTAGPLGGDHPLVTKEGHHVLDVIFTTPISDLGQVAEKLDKIDGVVDHGIICGNQSYAVIASKGEVQVLDEKSSVIQ

SEQ ID NO: 4155 - DNA, 1275 bp, Sorghum bicolor
  misc_feature: Ceres ANNOT ID no. 6034851
  misc_feature: Encodes the peptide sequence at SEQ ID NO 4156
atggacggcaatgcgaggtcgtcggcggcgaatcagaagaagcccatcgtcgcggacgacgacctcatcgagctgctgtggcacaacgggagcgtcgtcgcgcagccccaggcgcaccacaggccggcgccggcgccggcgccgccgccctccgaccgcgaccgcccggctggcgccagcggcctcaccggcgaggagaccgccgcgtggttcccggacaccctcgacgacgccctcgagaaggacctgtacacgcatctctggtacagcaccatcgccgacgccgccccgcaacacgagggcacgctcctggctaccccgcagccgtcgccgccgccgccgctgccggttgggagcagcggcgtcgagtcgagctgggccggcgacatctgctccaccttctgcggcagcaaccaggtgcccaggacgccggcagggaccagcaggaaggacgctgcattgcagtcggcagggaccagcggtgccggcgggcacgacggcacatcgtcgtccggtgggtctggaagcaactatgggggatccgggctgccaagtgacagcgtccatgtccacaagaggaaggggaggtgtagagacgactcagatagtccgagtgaggatgccgagtgtgaggaggcaactgaggagaccaaaccgtcgcggcgacatgggccgaaacgccggactcgtgcagctgaagttcataatctctcagagaggagaagaagggacaggatcaatgaaaagatgcgcgcgttgcaagagctgatcccgcactgcaacaagactgacaaagcgtcgatattagatgagacgattgagtatctcaagtccctccaaatgcaagttcagatcatgtggatgacttctgggatggcaccaatgatgtttcctggtgctcaccaattcatgccaccaatggctctaggcatgaattcaggttgcatccctgcagcgcaaggcctaagtcagatgccaagattaccatacatgaaccaccccctgccaaatcatatccctctgaactcatctccagctatgaatccactgaatgctgcgaaccagatgatgcaaaacggtcacctcagggaggcaagtaatcacttccttcacctagatgggcgaacagcggtggtacctcaggtaccaggaccccatgtttatggacatcaaatagcacaagccgaagaacccaatagtatactggaagtggctgctagtactgttgtgccaacttctagggcagggcaaccacctagttttgatggagtttag

SEQ ID NO: 4156 - protein, 424 aa, Sorghum bicolor
  misc_feature: Ceres ANNOT ID no. 6034851
  misc_feature (231)..(280): Pfam Id: HLH Pfam Desc: Helix-loop-helix DNA-binding domain
  misc_feature (5)..(416): NCBI GI: 24059945 NCBI Desc: transcription factor bhlh9-like protein [oryza sativa (japonica cultivar-group)]
  misc_feature (18)..(383): NCBI GI: 115470555 NCBI Desc: os07g0143200 [oryza sativa (japonica cultivar-group)]
  misc_feature (60)..(424): NCBI GI: 28372349 NCBI Desc: pif3 like basic helix loop helix protein [arabidopsis thaliana]
  misc_feature (136)..(358): NCBI GI: 115454269 NCBI Desc: os03g0639300 [oryza sativa (japonica cultivar-group)]
  misc_feature (107)..(401): NCBI GI: 30689224 NCBI Desc: phytochrome-interacting factor 4 (pif4) / basic helix-loop-helix protein 9 (bhlh9) / short under red-light 2 (srl2) [arabidopsis thaliana]
  misc_feature: The sequence is a functional homolog of SEQ ID NO 10 in the 10/666,642US patent application
  misc_feature: The sequence is a functional homolog of SEQ ID NO 1139 in the 10/374,780US patent application
  misc_feature: The sequence is a functional homolog of SEQ ID NO 1140 in the 10/374,780US patent application
  misc_feature: The sequence is a functional homolog of SEQ ID NO 1141 in the 10/374,780US patent application
  misc_feature: The sequence is a functional homolog of SEQ ID NO 1188 in the 11/479,226US patent application
  misc_feature: The sequence is a functional homolog of SEQ ID NO 120 in the 10/225,068US patent application
  misc_feature: The sequence is a functional homolog of SEQ ID NO 1337 in the 10/412,699US patent application
  misc_feature: The sequence is a functional homolog of SEQ ID NO 1338 in the 10/412,699US patent application
  misc_feature: The sequence is a functional homolog of SEQ ID NO 1339 in the 10/412,699US patent application
  misc_feature: The sequence is a functional homolog of SEQ ID NO 160 in the 10/374,780US patent application
  misc_feature: The sequence is a functional homolog of SEQ ID NO 42 in the 11/375,241US patent application
  misc_feature: The sequence is a functional homolog of SEQ ID NO 534 in the 10/412,699US patent application
  misc_feature: The sequence is a functional homolog of SEQ ID NO 54 in the 10/412,699US patent application
  misc_feature: The sequence is a functional homolog of SEQ ID NO 540 in the 10/412,699US patent application
  misc_feature: The sequence is a functional homolog of SEQ ID NO 624 in the 11/435,388US patent application
  misc_feature: The sequence is a functional homolog of SEQ ID NO 944 in the 10/225,066US patent application
  misc_feature: The sequence is a functional homolog of SEQ ID NO 96 in the 10/374,780US patent application
  misc_feature: The sequence is a functional homolog of SEQ ID NO 960 in the 10/374,780US patent application
  misc_feature: Useful for making plants with modulated growth and phenotype characteristics
  misc_feature: The sequence is a functional homolog of SEQ ID NO 1337 in the 20040045049 US patent application
  misc_feature: The sequence is a functional homolog of SEQ ID NO 1338 in the 20040045049 US patent application
  misc_feature: The sequence is a functional homolog of SEQ ID NO 1339 in the 20040045049 US patent application
  misc_feature: The sequence is a functional homolog of SEQ ID NO 534 in the 20040045049 US patent application
  misc_feature: The sequence is a functional homolog of SEQ ID NO 54 in the 20040045049 US patent application
  misc_feature: The sequence is a functional homolog of SEQ ID NO 540 in the 20040045049 US patent application
  misc_feature: The sequence is a functional homolog of SEQ ID NO 96 in the 20060162006 US patent application
  misc_feature: The sequence is a functional homolog of SEQ ID NO 960 in the 20060162006 US patent application
  misc_feature: The sequence is a functional homolog of SEQ ID NO 1139 in the 10/374,780 US patent application
  misc_feature: The sequence is a functional homolog of SEQ ID NO 1337 in the 10/412,699 US patent application
  misc_feature: The sequence is a functional homolog of SEQ ID NO. 414 in the 11/188,298 US application
  misc_feature: The sequence is a functional homolog of SEQ ID NO. 483 in the 11/188,298 US application
MDGNARSSAANQKKPIVADDDLIELLWHNGSVVAQPQAHHRPAPAPAPPPSDRDRPAGASGLTGEETAAWFPDTLDDALEKDLYTHLWYSTIADAAPQHEGTLLATPQPSPPPPLPVGSSGVESSWAGDICSTFCGSNQVPRTPAGTSRKDAALQSAGTSGAGGHDGTSSSGGSGSNYGGSGLPSDSVHVHKRKGRCRDDSDSPSEDAECEEATEETKPSRRHGPKRRTRAAEVHNLSERRRRDRINEKMRALQELIPHCNKTDKASILDETIEYLKSLQMQVQIMWMTSGMAPMMFPGAHQFMPPMALGMNSGCIPAAQGLSQMPRLPYMNHPLPNHIPLNSSPAMNPLNAANQMMQNGHLREASNHFLHLDGRTAVVPQVPGPHVYGHQIAQAEEPNSILEVAASTVVPTSRAGQPPSFDGV

SEQ ID NO: 4157 - DNA, 1137 bp, Sorghum bicolor
  misc_feature: Ceres ANNOT ID no. 6034863
  misc_feature: Encodes the peptide sequence at SEQ ID NO 4158
atgagctccgctgcggtggccgccgccaatgtcgccgtcatcggagccggaatatccggctccgtgtgcgcgtcgctgctagccgcgcggggcgtggccgtgacgctcttcgactcgggccgcggcgccggcggccgcatggcgcagcggagggaggtgatcgaggatggcacggagctgcggttcgaccatggtgcgccatacttcaccgtcaccaacaacgaggttgcccgggtcgttagtgggtgggaggcgcgggggatcgtcgccgagtggaaggccacgttcgcatgcttcgatctggcaaccggcaaattcacagactttgagaaggagggaacagctaaaaagtatgtgggagtgccagccatgaactcaatatgcaaatcactctgtctagaggatggtgtggtggccaaatttggtgtcactgtgggcaagatggattggcttcaagataggagttcatggtcactagctagcttggatgggaaagaccttggcaattttgattacgtcgtagcaacagataagaatgtagcgtcaacaagtttttctgggttgactggaagaccgccacctcttgatttgtcgtcatttccacgcctgcctacaatacttcaagatatcccagttcgtccgtgttttgctcttatggtagcattttcagagccattggctatggtacctgttcatggtttctctttcaacaattccaattctctgagttgggccttttgtaatagtagtaagccagggcgtgcttgtgtacctcctaacagacaatcttgggtattgcattcgacaactgagtatgcttccaaggtagtaaagaatattggtccacggaaaccttcagcggaggcacttgctaaggtggcagatgaattgttcagtgaattccaggcgactggattaagcattccacaaccaatttttatgagagctcacagatggggtgctgctttcccagctattgcaattagtggagatgataagtgtgtttgggacaagagcacgaaattggcaatttgtggagatttctgtacaaacccaagtgtcgaaggagcaatccttagtgccacaagaggtgcttccaaaatccttgaatgtttaagcctcccgtcagggttgtga

SEQ ID NO: 4158 - protein, 378 aa, Sorghum bicolor
  misc_feature: Ceres ANNOT ID no. 6034863
  misc_feature (1)..(373): NCBI GI: 22655396 NCBI Desc: at1g55980/t6h22.19 [arabidopsis thaliana]
  misc_feature (1)..(195): NCBI GI: 8778316 NCBI Desc: f14j16.31 [arabidopsis thaliana]
  misc_feature (1)..(195): NCBI GI: 8778321 NCBI Desc: f14j16.28 [arabidopsis thaliana]
  misc_feature (11)..(176): NCBI GI: 87306827 NCBI Desc: amine oxidase, flavin-containing [blastopirellula marina dsm 3645]
  misc_feature (204)..(372): NCBI GI: 83746114 NCBI Desc: nadph-dependent glutamate synthase beta chain and related oxidoreductases [ralstonia solanacearum uw551]
MSSAAVAAANVAVIGAGISGSVCASLLAARGVAVTLFDSGRGAGGRMAQRREVIEDGTELRFDHGAPYFTVTNNEVARVVSGWEARGIVAEWKATFACFDLATGKFTDFEKEGTAKKYVGVPAMNSICKSLCLEDGVVAKFGVTVGKMDWLQDRSSWSLASLDGKDLGNFDYVVATDKNVASTSFSGLTGRPPPLDLSSFPRLPTILQDIPVRPCFALMVAFSEPLAMVPVHGFSFNNSNSLSWAFCNSSKPGRACVPPNRQSWVLHSTTEYASKVVKNIGPRKPSAEALAKVADELFSEFQATGLSIPQPIFMRAHRWGAAFPAIAISGDDKCVWDKSTKLAICGDFCTNPSVEGAILSATRGASKILECLSLPSGL

SEQ ID NO: 4159 - DNA, 474 bp, Sorghum bicolor
  misc_feature: Ceres ANNOT ID no. 6034864
  misc_feature: Encodes the peptide sequence at SEQ ID NO 4160
atggcaacgcgtgcgcagccgcagtcttcttcgaccggatccgtgacggtgacgatcgatgcgtcgtcctccacctcagccccgcccccggcggccgcgtcggcgccggcgccggcccccgaggcggtggtgctgcgcctgaagcggcgggccaagaagaaggtgtcgtggaaggaggggacggtggacaacgagggcctgggccgcaagagctcgaagaagtgctgcatattccacaaggaggtccccttcgacgaggactgcagcgacgacgaggcccccggcggcggccaccggtgccctcgccctcacggtgacgccggcgaggggaccagcggcggcggcgggtgctcgtcctcttcccacgaccatggccatggccatgaggaatgtttgcacaaatcatgcaaagtggagggcaatcttgtttatccacggccaactacttctcacagttacaagtgtgagaagtag

SEQ ID NO: 4160 - protein, 157 aa, Sorghum bicolor
  misc_feature: Ceres ANNOT ID no. 6034864
  misc_feature (44)..(92): Pfam Id: PPI_Ypi1 Pfam Desc: Protein phosphatase inhibitor
  misc_feature (1)..(128): NCBI GI: 115457594 NCBI Desc: os04g0295000 [oryza sativa (japonica cultivar-group)]
  misc_feature (10)..(108): NCBI GI: 124365574 NCBI Desc: protein phosphatase inhibitor [medicago truncatula]
  misc_feature (21)..(123): NCBI GI: 50415603 NCBI Desc: ppp1r11-prov protein [xenopus laevis]
  misc_feature (10)..(114): NCBI GI: 46237689 NCBI Desc: protein phosphatase 1, regulatory (inhibitor) subunit 11 [rattus norvegicus]
  misc_feature (21)..(123): NCBI GI: 49250355 NCBI Desc: mgc69244 protein [xenopus tropicalis]
MATRAQPQSSSTGSVTVTIDASSSTSAPPPAAASAPAPAPEAVVLRLKRRAKKKVSWKEGTVDNEGLGRKSSKKCCIFHKEVPFDEDCSDDEAPGGGHRCPRPHGDAGEGTSGGGGCSSSSHDHGHGHEECLHKSCKVEGNLVYPRPTTSHSYKCEK

SEQ ID NO: 4161 - DNA, 1143 bp, Sorghum bicolor
  misc_feature: Ceres ANNOT ID no. 6034870
  misc_feature: Encodes the peptide sequence at SEQ ID NO 4162
atggcgcccgctgctgctgcgtcccgggtggctgtctcgtcgccggtcttcggctccgatggcggcgccaggagctccgggatcaagggtaacaacaatgttagcttcggcaacaaatcctgggtcggcggcacattggcctgggagagcagctcggtgcggcccaggcacgtgaacaaggtgctctgcatgtcggtccagcaggcgagcaagagtaaagtctctgttgcgccactcgatcttgagagcgccaaggagccacctctcaacacatacaagcccaaggagcccttcacggccaccattgtctcggtggagaggctagtcggccccaaagctccaggggagacttgccacatcgtcattgaccatggtggcaatgtgccgtactgggagggccagagttatggtgtcattcctcctggagaaaaccccaaaaagcctggagccccacaaaatgtcaggctttattcaattgcatcaactaggtatggagattactttgatggaagaaccggaagcttgtgtgtccgccgtgcagtttattatgatcctgaaactggcaaggaggagccctcaaagaatggtgtctgcagtaatttcctgtgcaactcaaaacctggggacaagattcaattaacaggtccctctggcaaaataatgcttctaccggaggaggatccaaacgcaacccatatcatgattgctactggcaccggtgttgcccccttccgtgggtacctgcgtcgcatgttcatggaagatgttccaaactacagatttggtggcttggcctggctcttccttggtgttgccaattcagacagccttctgtatgacgaagaattcaccagctatcttaagcagtatccagacaatttcaggtacgacaaagccctcagtagggagcagaagaacaggagtggtggcaaaatgtacgtccaggacaagatcgaggagtacagcgatgagattttcaagcttctggatggcggagcgcacatctacttctgcggtttgaagggaatgatgcctggaattcaggacacccttaagaaggtggcagagcagagaggcgagagctgggaccagaagctctcccagctcaagaagaacaagcaatggcacgttgaggtctactag

SEQ ID NO: 4162 - protein, 380 aa, Sorghum bicolor
  misc_feature: Ceres ANNOT ID no. 6034870
  misc_feature (233)..(349): Pfam Id: NAD_binding_1 Pfam Desc: Oxidoreductase NAD-binding domain
  misc_feature (5)..(380): NCBI GI: 729480 NCBI Desc: ferredoxin--nadp reductase, root isozyme, chloroplast precursor (fnr)
  misc_feature (5)..(380): NCBI GI: 113549947 NCBI Desc: os03g0784700 [oryza sativa (japonica cultivar-group)]
  misc_feature (5)..(380): NCBI GI: 115455751 NCBI Desc: os03g0784700 [oryza sativa (japonica cultivar-group)]
  misc_feature (1)..(380): NCBI GI: 3913653 NCBI Desc: ferredoxin--nadp reductase, embryo isozyme, chloroplast precursor (fnr)
  misc_feature (59)..(380): NCBI GI: 500751 NCBI Desc: ferredoxin-nadp reductase precursor
  misc_feature (5)..(380): SWISSPROT Homolog: EC 1.18.1.2 Ferredoxin--NADP reductase, root isozyme, chloroplast precursor
MAPAAAASRVAVSSPVFGSDGGARSSGIKGNNNVSFGNKSWVGGTLAWESSSVRPRHVNKVLCMSVQQASKSKVSVAPLDLESAKEPPLNTYKPKEPFTATIVSVERLVGPKAPGETCHIVIDHGGNVPYWEGQSYGVIPPGENPKKPGAPQNVRLYSIASTRYGDYFDGRTGSLCVRRAVYYDPETGKEEPSKNGVCSNFLCNSKPGDKIQLTGPSGKIMLLPEEDPNATHIMIATGTGVAPFRGYLRRMFMEDVPNYRFGGLAWLFLGVANSDSLLYDEEFTSYLKQYPDNFRYDKALSREQKNRSGGKMYVQDKIEEYSDEIFKLLDGGAHIYFCGLKGMMPGIQDTLKKVAEQRGESWDQKLSQLKKNKQWHVEVY

SEQ ID NO: 4163 - DNA, 942 bp, Sorghum bicolor
  misc_feature: Ceres ANNOT ID no. 6034871
  misc_feature: Encodes the peptide sequence at SEQ ID NO 4164
atggcgaacccgtcgccgtacttctccgccggtccgtactcggggcccgcgccggcggcgaaggatcaggacgcggcgaaggaggatcaggacgtggcgcagctcgtgctcgacctctgcgtcccggagctccgcgagaaggctctcttcttcctctccaagaaacgagaaaaatgtgaagatcttgctctactactatggcactcttatggcacaatggctgcactactccaggaaattgtgtcaacatatcgatcactttcacccccaaaattgtcatctgaccaatcaactcgagtctgcaatgcgcttgcactccttcagtgtgtcgcatcgcaccctgatactaggatcccattcgtaaatgcactggttccactgtacctctaccctttcttgaacactacctacaaaacaagagaatatgagttcttgaggcttaccagcctgggtgtgattggtgctcttgtgaagtttgatgatcgtgaagtcgttgcgtttctgctgacatctgaaataattcctttgtgtctgcgtgctattgatatgggcagtgaactttcaaaaacggtggccacttttattattcaaaagattatgcttgatgacgcagggctagtgtatgtatgtgcttctttggaacgtttctgtgctgtagccagtgtgctaggtcagatggttgaagaactagttgaacagccttccccaaggttgctgaagcacataatccgctgctacctcaggctgacagatgaccgaagggcttgcaatgcgctacgcagtagcctgcccaccgcgttgagagatgggacattcaacgacttaatcgaggtcgatctcacggcaaggctatggcttcatcagctgctgcataacatcatgatgatgtcaaacggtgggggcggccctcaccctgtcctgggtcgtgccatggggatgtga

SEQ ID NO: 4164 - protein, 313 aa, Sorghum bicolor
  misc_feature: Ceres ANNOT ID no. 6034871
  misc_feature (34)..(296): Pfam Id: Rcd1 Pfam Desc: Cell differentiation family, Rcd1-like
  misc_feature (12)..(304): NCBI GI: 9294407 NCBI Desc: rcd1 [arabidopsis thaliana]
  misc_feature (14)..(305): NCBI GI: 47938747 NCBI Desc: mgc78923 protein [xenopus laevis]
  misc_feature (26)..(305): NCBI GI: 119591031 NCBI Desc: rcd1 required for cell differentiation1 homolog (s. pombe), isoform cra_b [homo sapiens]
  misc_feature (30)..(293): NCBI GI: 126030479 NCBI Desc: chain a, crystal structure analysis of human rcd-1 conserved region
  misc_feature (16)..(293): NCBI GI: 54643814 NCBI Desc: ga12828-pa [drosophila pseudoobscura]
MANPSPYFSAGPYSGPAPAAKDQDAAKEDQDVAQLVLDLCVPELREKALFFLSKKREKCEDLALLLWHSYGTMAALLQEIVSTYRSLSPPKLSSDQSTRVCNALALLQCVASHPDTRIPFVNALVPLYLYPFLNTTYKTREYEFLRLTSLGVIGALVKFDDREVVAFLLTSEIIPLCLRAIDMGSELSKTVATFIIQKIMLDDAGLVYVCASLERFCAVASVLGQMVEELVEQPSPRLLKHIIRCYLRLTDDRRACNALRSSLPTALRDGTFNDLIEVDLTARLWLHQLLHNIMMMSNGGGGPHPVLGRAMGM

SEQ ID NO: 4165 - DNA, 621 bp, Sorghum bicolor
  misc_feature: Ceres ANNOT ID no. 6034874
  misc_feature: Encodes the peptide sequence at SEQ ID NO 4166
atgggatcgagcgaggcggagaagccgctgcgtcggatcgcggcgtcgttcgaggagctcgccgccgtcgccaagcagcagcccccggcgtccatggacgcgggggccttttcgcgcgcctgctccaacgtctccgtcctcttcggctgcctcggcatcgccttcaagttcgcggagatggactacgtcgccaaggttgatgatttggtggaggcgtccaagtcaattttgacattgccttctatggttgagctagacattcagactgacactgtcaggaaaccagggagccatacaaggaatctgcttagagtaaagcgtgggattgatatggttaaagtcctctttgagcaaattcttgtcacagagggcaactccttaagggatgcggcatcagtagcttatgctcaggtttttgctcctcaccatggatgggcaataaggaaagcagttgctgctggaatgtacgcccttccctcaaagtcccagctgttgaagaaattgaatgaagatgaggaatcagcgaaggttcaaatgcagaactttgtcaggtcatcagctccagtaatctgctatgttgatgaccttttcacctcaaggaatttgggcatagattggtga

SEQ ID NO: 4166 - protein, 206 aa, Sorghum bicolor
  misc_feature: Ceres ANNOT ID no. 6034874
  misc_feature (25)..(204): Pfam Id: GLTP Pfam Desc: Glycolipid transfer protein (GLTP)
  misc_feature (8)..(206): NCBI GI: 116309275 NCBI Desc: osigba0130k07.2 [oryza sativa (indica cultivar-group)]
  misc_feature (36)..(202): NCBI GI: 24656881 NCBI Desc: cg30392-pa [drosophila melanogaster]
  misc_feature (36)..(202): NCBI GI: 17861418 NCBI Desc: gh03649p [drosophila melanogaster]
  misc_feature (51)..(202): NCBI GI: 51011077 NCBI Desc: zgc:92000 [danio rerio]
  misc_feature (32)..(168): NCBI GI: 48098213 NCBI Desc: similar to ensangp00000010834 [apis mellifera]
MGSSEAEKPLRRIAASFEELAAVAKQQPPASMDAGAFSRACSNVSVLFGCLGIAFKFAEMDYVAKVDDLVEASKSILTLPSMVELDIQTDTVRKPGSHTRNLLRVKRGIDMVKVLFEQILVTEGNSLRDAASVAYAQVFAPHHGWAIRKAVAAGMYALPSKSQLLKKLNEDEESAKVQMQNFVRSSAPVICYVDDLFTSRNLGIDW

SEQ ID NO: 4167 - DNA, 1038 bp, Sorghum bicolor
  misc_feature: Ceres ANNOT ID no. 6034881
  misc_feature: Encodes the peptide sequence at SEQ ID NO 4168
atggacgaagccagcacctccgcgtccggcgccgcgacgaggcgcgccttcccgccggcaagatcgggagttttctataggttcacccagcagaatctcccagcttggaagccagcaatgacacctggatgtttaatagccatgttcttgattattggaatcattttcgtaccttttgggcttctttgtctccaaagttcaaatcatgttgcagaaatcattcaccgctatgatgttgactgtgtacctaatgcttacagaggaaataggcaagcttatattaaggacagctcgattttaaagaactgtactctgcaagcgaaggttctggaacacatgagagcaccaatttatgtttattatgaactcgagaatttctatcagaatcatcgcaggtatatcaaaagtagaagtgataaacagctgcggtttggggcgaaatacacggctgagtcgtgcagtcctgttcagtgggataataatggttccccaattgtcccctgcggcttgattgcctggagcttattcaatgatacctatgattttactcgtgggtccaaggaaataaaggtcaacagaaaaaacatttcatggaagagtgatcgggagcataagtttggcagagatgtgtttccttccaactttcagaatggaaccttgattggagggggaaaactcgaccctactgtcccactgagtgagcaggaagatcttattgtgtggatgcggacttctgctcttcccaagtttcgaaagctgtatggtgtaattgaagacgatctacatgccgatgagaccataaccattctcataggaaataattacaacacctacacttttggtggaaagaaaagcatagttctttcgactgcatcctggctaggtggcaagaataacttccttggacatgcttatattgtcactggttcattgagcatcttcatatcaatcctctttgctctgattcatgtgaagtacccaaggccccaaggtgaccctaattgcctatcctggaacaggaaaaacagcaatagctaa

SEQ ID NO: 4168 - protein, 345 aa, Sorghum bicolor
  misc_feature: Ceres ANNOT ID no. 6034881
  misc_feature (63)..(334): Pfam Id: CDC50 Pfam Desc: LEM3 (ligand-effect modulator 3) family / CDC50 family
  misc_feature (1)..(340): NCBI GI: 52076505 NCBI Desc: lem3-like [oryza sativa (japonica cultivar-group)]
  misc_feature (3)..(340): NCBI GI: 49388971 NCBI Desc: lem3 (ligand-effect modulator 3)-like [oryza sativa (japonica cultivar-group)]
  misc_feature (27)..(340): NCBI GI: 42562089 NCBI Desc: lem3 (ligand-effect modulator 3) family protein / cdc50 family protein [arabidopsis thaliana]
  misc_feature (28)..(340): NCBI GI: 4835763 NCBI Desc: t8k14.13 [arabidopsis thaliana]
  misc_feature (27)..(340): NCBI GI: 4966357 NCBI Desc: >f3o9.16 [arabidopsis thaliana]
  misc_feature: Useful for making plants with modulated nitrogen use efficiency
  misc_feature: Functional homolog of the protein sequence given in SEQ ID NO 13263
MDEASTSASGAATRRAFPPARSGVFYRFTQQNLPAWKPAMTPGCLIAMFLIIGIIFVPFGLLCLQSSNHVAEIIHRYDVDCVPNAYRGNRQAYIKDSSILKNCTLQAKVLEHMRAPIYVYYELENFYQNHRRYIKSRSDKQLRFGAKYTAESCSPVQWDNNGSPIVPCGLIAWSLFNDTYDFTRGSKEIKVNRKNISWKSDREHKFGRDVFPSNFQNGTLIGGGKLDPTVPLSEQEDLIVWMRTSALPKFRKLYGVIEDDLHADETITILIGNNYNTYTFGGKKSIVLSTASWLGGKNNFLGHAYIVTGSLSIFISILFALIHVKYPRPQGDPNCLSWNRKNSNS

SEQ ID NO: 4169 - DNA, 645 bp, Sorghum bicolor
  misc_feature: Ceres ANNOT ID no. 6034884
  misc_feature: Encodes the peptide sequence at SEQ ID NO 4170
atggccggggagaagaagcagggcctgcagctgctggacttctgggtgagcccgttcgggcagcgctgccgcatcgcgctggacgagaagggcctgccctacgagtacctggagcaggacgacctgctggggaacaagagcgagctcctgctccacgccaacccggtccacaagaagatccccgtgctcctccacgacggccgccccatctgcgagtccctcctcatcgtgcagtacctcgacgaggcgttcccggcgacgccgccggcccggttctgggcggactacgtggacaagaagctctacgactgcggcacccggctgtggaagctcaatggggacggccacgcgcaggcgcggacggagatggtcgagatcctccgcacgctggagggcgcgctcggcgacggcgagttcttcggcggcgaggcgttcgggttcgtcgacgtcgcgctcgtgccgttcacgtcgcggttcctcgcctacgagcggttcggggagctcagcgtcgagaaggagtgccccaggctcgccgcgtgggccaagcgctgcgcggaacggcccagcgtcgccaagaacttgtacccggcggagaaggtgtacgagttcatctgcgggatgaagaagaggctcggcatcgagtag

SEQ ID NO: 4170 - protein, 214 aa, Sorghum bicolor
  misc_feature: Ceres ANNOT ID no. 6034884
  misc_feature (7)..(82): Pfam Id: GST_N Pfam Desc: Glutathione S-transferase, N-terminal domain
  misc_feature (92)..(188): Pfam Id: GST_C Pfam Desc: Glutathione S-transferase, C-terminal domain
  misc_feature (1)..(214): NCBI GI: 2288969 NCBI Desc: glutathione transferase [zea mays]
  misc_feature (1)..(214): NCBI GI: 6683765 NCBI Desc: glutathione-s-transferase [hordeum vulgare]
  misc_feature (1)..(214): NCBI GI: 75674128 NCBI Desc: glutathione-s-transferase [hordeum vulgare]
  misc_feature (1)..(214): NCBI GI: 20067419 NCBI Desc: glutathione transferase [triticum aestivum]
  misc_feature (1)..(214): NCBI GI: 20067417 NCBI Desc: glutathione transferase [triticum aestivum]
  misc_feature: Useful for making plants with modulated drought sensitivity
  misc_feature: Functional homolog of the protein sequence given in SEQ ID NO 13370
MAGEKKQGLQLLDFWVSPFGQRCRIALDEKGLPYEYLEQDDLLGNKSELLLHANPVHKKIPVLLHDGRPICESLLIVQYLDEAFPATPPARFWADYVDKKLYDCGTRLWKLNGDGHAQARTEMVEILRTLEGALGDGEFFGGEAFGFVDVALVPFTSRFLAYERFGELSVEKECPRLAAWAKRCAERPSVAKNLYPAEKVYEFICGMKKRLGIE

SEQ ID NO: 4171 - DNA, 807 bp, Sorghum bicolor
  misc_feature: Ceres ANNOT ID no. 6034888
  misc_feature: Encodes the peptide sequence at SEQ ID NO 4172
atggataccacttcacctggtaatccacctccaaaaccgtgggaacgtgcaggagcttcatctggctcagtgccttttaagccgccctctggtggtagcaccagtgatgttgttgaagcttctgggacagcaaaacatggagaggttgtttctgctgctgggaacaatgttgcctcaaatgtaaacagcaacatttcaacgcctgtgcccccaaggccttggcagcagcaaggctatggaaactcttatgggggttatggctctagtatgtatagctcttacggcggatatagtggaccctatggaaataacatgtattcaggttatggaggaggttatggcagcagtatgtatggtggttctggaatgtatggtggatcaatgtataacagtggaatgggaggaccctatggtggttatggtatgggcatgagtccttataatcagggagcaaattcatttgggccgcctgcaccaccccctggtttctggatgtccttcctacgagtgatgcatggtgttgtaaatttctgtgggagggttagcttccttattagccagaacactcaggcatttcacatgttcattactgcatttttgcagttatgtgatcgggctggaatgctttatggcgagcttgcaagatttgttctacgtttgctggggatcaaaacaaaaccgaagaagggtggtgttaagggcgcaggagctccatcatcagaaggacgaggccagcagtttgttgaggcaccgaaagctaactcctcatgggacagcgtctggactgaggatggcaaggggaagtaa

SEQ ID NO: 4172 - protein, 268 aa, Sorghum bicolor
  misc_feature: Ceres ANNOT ID no. 6034888
  misc_feature (10)..(213): NCBI GI: 111609730 NCBI Desc: peroxin 13 [penicillium chrysogenum]
  misc_feature (5)..(259): NCBI GI: 44981706 NCBI Desc: acr230cp [eremothecium gossypii]
  misc_feature (5)..(259): NCBI GI: 45185916 NCBI Desc: acr230cp [eremothecium gossypii]
  misc_feature (78)..(160): NCBI GI: 19386747 NCBI Desc: p0413c03.3 [oryza sativa (japonica cultivar-group)]
  misc_feature (78)..(225): NCBI GI: 2498763 NCBI Desc: peroxisomal membrane protein pex13 (peroxin-13)
MDTTSPGNPPPKPWERAGASSGSVPFKPPSGGSTSDVVEASGTAKHGEVVSAAGNNVASNVNSNISTPVPPRPWQQQGYGNSYGGYGSSMYSSYGGYSGPYGNNMYSGYGGGYGSSMYGGSGMYGGSMYNSGMGGPYGGYGMGMSPYNQGANSFGPPAPPPGFWMSFLRVMHGVVNFCGRVSFLISQNTQAFHMFITAFLQLCDRAGMLYGELARFVLRLLGIKTKPKKGGVKGAGAPSSEGRGQQFVEAPKANSSWDSVWTEDGKGK

SEQ ID NO: 4173 - DNA, 2505 bp, Sorghum bicolor
  misc_feature: Ceres ANNOT ID no. 6034899
  misc_feature: Encodes the peptide sequence at SEQ ID NO 4174
atgtctcagccccacgccgccgctgccgcctcgaagcgccccttctcgtccaccaccacatccccgtccccgacctcctcccctgcgacgccgcttatgaagaaggccaagcaccccgccgcctcctcctcctccgcggggaccgtcgagaagaacggcatccaacttgataccgccgtcgccgccgccgccgccacgggcgggggccgaacgaacggcgaggaggatgcggagatggtgctcgcggaccaggacgagctccccgcgcccagcgcgccggcctccgcgggcgttgccgccaacctcttccgtaagaaggccacgctcccgcagccgtcgacctccgcccgcaagcccctccgcatcaaaataggtcaaccaaaactgccaaaaaacttcgaagaggatacatgggcaattttgaaggatgctatcacagctatttttctcaagcagaaactttcttgtgatgttgagaaactctatcaggctgctggtgatctttgtctacacaagctaggggcaaacctatacgaacgaatcaagaaagaatgtgaaatacacatagctgaaaaaatatcagcattagtgggtcaaagcccagatttggttgtatttttgtctctggtccaaagaacatggcaagatttttgtgatcagatgttgattattcgtggtattgctttacttcttgatgtaaaatatgtcaagaatgtggcaaatatttgttcagtgtgggatatggggctgcaactgttccgcaagcatctatcactatccccggagattgaacacaaaactgtaactggccttctcagattgattgagagtgagaggcttggtgaagcaatagataggacattacttagtcatcttctgaagatgctcactgctcttggaatgtattcagagagttttgaaaagccctttcttgaatgcacttctgaattttatgctacggaaggtgttaaatatatgcaacaatctgatattccagactacctgaagcatgtggagtcgaggttgcaagaagaacatgaaaggtgtattctatatttggaagctaacacaaggaagccactaatcgcaactactgaaaagcaattgctagaacgtcatacatctgcaattattgagaaggggttctctatgctcatggatgcaaatcgtataaatgacctctcgaggatgtacgaccttttccagagggttaacgctgttgagttgctaaaactagcgcttagttcatatatccgggctacaggccagggcattattatggatgaagaaaaggacagagaattagttccatttcttcttgattttaaggcatcccttgacaaaatattggaagaaagttttgccaagaatgaggctttctcgaataccataaaagattcatttgagcaccttatcaatctaagacagaaccgacctgcggaattgattgcaaagtttcttgatgagaaacttcgagctggcaataaagggacatcagaagaagagctggagggtatacttgatagagttttggtcctgtttcggtttatacaaggtaaagatgtatttgaggcattctacaagaaggatctagctaagaggttgctgcttgggaagagcgcatcaatagatgctgaaaaatcgatgatcacaaaactcaaaactgagtgtggaagtcagtttaccaacaagctggagggaatgttcaaggacattgaattatccaaagaaataaatgattcattcaggcaatcatctcaagctaggacaaagcttccctctggcattgaaatgagtgttcatgtgcttacaacaggctattggcctacatatccaccaatggacgtgaaactcccacacgaactgaatgtgtaccaggatatatttaaagagttctatttgagcaagtacagtggaaggcgtttaatgtggcagaattctttgggacattgtgtcttgaaagcggactttcccaaaggcaaaaaggaacttgcagtgtcattgtttcagagtgtggttttgatgttgttcaatgatgcacaaaagttaagtttccttgacatcaaagattccactggtatcgaggataaagaattgagacggacactgcaatcacttgcatgtggtaaagttcgggttctccaaaagataccaaaagggagagatgtagaagataaggatgaatttgtattcaatgaagattttagtgctcccctctatcgcataaaggtaaatgcaattcaaatgaaggagacggtagaagaaaacacgagcaccactgagagagtgttccaggatcggcagtatcaggttgatgcagccatagttcgaataatgaagacgcggaaggtcctcagccacacccttctaataacggagctttaccagcagctcaagttccctgttaagccagctgatatcaagaaaagaatagagagcttgatcgaccgggagtacctggaacgggacaggagtaacccccagatctacaactatctggcttga

SEQ ID NO: 4174 - protein, 834 aa, Sorghum bicolor
  misc_feature: Ceres ANNOT ID no. 6034899
  misc_feature (138)..(736): Pfam Id: Cullin Pfam Desc: Cullin family
  misc_feature (99)..(834): NCBI GI: 30524962 NCBI Desc: cullin 4 [arabidopsis thaliana]
  misc_feature (221)..(834): NCBI GI: 9757989 NCBI Desc: cullin [arabidopsis thaliana]
  misc_feature (3)..(834): NCBI GI: 57209316 NCBI Desc: cullin 4b [homo sapiens]
  misc_feature (3)..(834): NCBI GI: 55977850 NCBI Desc: cullin homolog 4b (cul-4b)
  misc_feature (3)..(834): NCBI GI: 119632285 NCBI Desc: cullin 4b, isoform cra_e [homo sapiens]
MSQPHAAAAASKRPFSSTTTSPSPTSSPATPLMKKAKHPAASSSSAGTVEKNGIQLDTAVAAAAATGGGRTNGEEDAEMVLADQDELPAPSAPASAGVAANLFRKKATLPQPSTSARKPLRIKIGQPKLPKNFEEDTWAILKDAITAIFLKQKLSCDVEKLYQAAGDLCLHKLGANLYERIKKECEIHIAEKISALVGQSPDLVVFLSLVQRTWQDFCDQMLIIRGIALLLDVKYVKNVANICSVWDMGLQLFRKHLSLSPEIEHKTVTGLLRLIESERLGEAIDRTLLSHLLKMLTALGMYSESFEKPFLECTSEFYATEGVKYMQQSDIPDYLKHVESRLQEEHERCILYLEANTRKPLIATTEKQLLERHTSAIIEKGFSMLMDANRINDLSRMYDLFQRVNAVELLKLALSSYIRATGQGIIMDEEKDRELVPFLLDFKASLDKILEESFAKNEAFSNTIKDSFEHLINLRQNRPAELIAKFLDEKLRAGNKGTSEEELEGILDRVLVLFRFIQGKDVFEAFYKKDLAKRLLLGKSASIDAEKSMITKLKTECGSQFTNKLEGMFKDIELSKEINDSFRQSSQARTKLPSGIEMSVHVLTTGYWPTYPPMDVKLPHELNVYQDIFKEFYLSKYSGRRLMWQNSLGHCVLKADFPKGKKELAVSLFQSVVLMLFNDAQKLSFLDIKDSTGIEDKELRRTLQSLACGKVRVLQKIPKGRDVEDKDEFVFNEDFSAPLYRIKVNAIQMKETVEENTSTTERVFQDRQYQVDAAIVRIMKTRKVLSHTLLITELYQQLKFPVKPADIKKRIESLIDREYLERDRSNPQIYNYLA

SEQ ID NO: 4175 - DNA, 924 bp, Sorghum bicolor
  misc_feature: Ceres ANNOT ID no. 6034902
  misc_feature: Encodes the peptide sequence at SEQ ID NO 4176
atgaacagcttgttctcgagctcatggaagcgcggcgggggagacgacggggacatcgagtccggcagcgtggagatgtctgcgccgccgggtgccgcggcgggtgcgagcctggaccggttcttcgaggacgtggagtcgatcaaggacgagctccgtgacctggagcggatccagcgctcgctccacgacggcaacgaggcgggcaagtctctccacgacgcgtccgcggtgcgcgacctccgcgcgcggatggacgcggacgtctccgcggcgatcaagaaggcgaaagtggtgaagctccgtctcgagtcgctggaccgcgccaacgccgccaaccgctcggtgcccgggtgcgggcccggttcctccaccgaccgcacccggacctccgtcgtggccgggctgcgcaagaagctccgcgactcgatggagtccttctcgtcgctgcggtcccgcgtggcgtccgagtacagggacacggtggcgcggcggtacttcacggtgacggggacgcagcccgacgaggcgacgctggacgcgctggcggagtccggggaaggggagcggttcctgcagcgcgccatcgcggagcaagggagagggcaggtgctgggcgtggtggcggagatccaggagcggcacggcgccgtggcggagctggagcggtccctgcttgagctgcagcaggtgttcaacgacatggccgtgctcgtggccgcgcagggggagcagctggacgacatcgaggggaacgtggggcgggcaaggtcgttcgtcgatcgcgggcgcgagcagctgcaggtggcgaggaagcaccagaagagcacgcgcaagtggacctgcatcgccatcctcatcctcctcgtcatcatcctcgtcatcgtcctccccatcgtgctccaaaacaccaagaagaactag

SEQ ID NO: 4176 - protein, 307 aa, Sorghum bicolor
  misc_feature: Ceres ANNOT ID no. 6034902
  misc_feature (37)..(144): Pfam Id: Syntaxin Pfam Desc: Syntaxin
  misc_feature (213)..(275): Pfam Id: SNARE Pfam Desc: SNARE domain
  misc_feature (1)..(307): NCBI GI: 78146241 NCBI Desc: snare protein [oryza sativa (japonica cultivar-group)]
  misc_feature (1)..(307): NCBI GI: 33465459 NCBI Desc: syntaxin [hordeum vulgare subsp. vulgare]
  misc_feature (1)..(299): NCBI GI: 4206787 NCBI Desc: syntaxin-related protein nt-syr1 [nicotiana tabacum]
  misc_feature (26)..(300): NCBI GI: 42572385 NCBI Desc: syntaxin 121 (syp121) / syntaxin-related protein (syr1) [arabidopsis thaliana]
  misc_feature (4)..(305): NCBI GI: 32308092 NCBI Desc: syntaxin-like protein 4 [hordeum vulgare subsp. vulgare]
MNSLFSSSWKRGGGDDGDIESGSVEMSAPPGAAAGASLDRFFEDVESIKDELRDLERIQRSLHDGNEAGKSLHDASAVRDLRARMDADVSAAIKKAKVVKLRLESLDRANAANRSVPGCGPGSSTDRTRTSVVAGLRKKLRDSMESFSSLRSRVASEYRDTVARRYFTVTGTQPDEATLDALAESGEGERFLQRAIAEQGRGQVLGVVAEIQERHGAVAELERSLLELQQVFNDMAVLVAAQGEQLDDIEGNVGRARSFVDRGREQLQVARKHQKSTRKWTCIAILILLVIILVIVLPIVLQNTKKN

SEQ ID NO: 4177 - DNA, 1323 bp, Sorghum bicolor
  misc_feature: Ceres ANNOT ID no. 6034905
  misc_feature: Encodes the peptide sequence at SEQ ID NO 4178
atgggcatctcggcgaggtggctcaagtcgttagttgggttgaggaaggtggagcggcagcagcagcatcgtaaggaggatgcagatgttggacgaatgaaaggcgatgttgccgatcagtttcattttcagaatcagcgctctcaagaagacagcagcattgctgcacaagaagaaattccagaggttccttatggaaatgatccacctgaagttgattctaatgcaccttcatgcttggaacccacttgtgattcagctcatgtgccactgtctcaaaccgaagaggaactggaagagatctgggctgctacgattattcagacagcatttagagcattcctggctaggagagcccgtcgagctttaaaagggctggttaggcttcaagcccttgtaaggggtcatatagtaagaaagcaagctgccacgacactccgctgtatgcaagctttggtcagagttcaggcccgtgttagagcaaggcgagttcgcatggctttggaaaaccagactgaccagcaaaatacttcaccagagcacacgattgaggcacgtgttagagaaattgaggatggctggtgtgatagtatcggttctgtggaagatatccaagcaaaacttctaaagaggcaggaagcagcagctaaacgggagcgagccatggcctatgctctagctcatcagtggcaagcaagttcaagacaagctgcatcatttgaacctgacaagaacagctggggctggaattggctagagagatggatggctgttcggccttgggagagtcggttccttggcacttacgctgcagatgggatttttgtagttaatgaaaccaggcaacctgacataagtgcaacgaagaccccatgcagaaaacctgttaaaaagcatgattcaacccttcaatcaaacacattgaaccagaaggtcttcccatcaaactcagagggtggtggctcctcgacaaaccgatccagtggttcggcatcagctaaatctagactgaaggttttacccagagaaggcgctgaggaagcttcatctcgtccttctgtacttgttgtgcggtccactagtaacccaagggagaggacttccaatattaattcaaaagagaggactggggacttggattgtcaagttcataaaagattctccttgcctggcattggttcagaagctggcaaacacctgacaaagaaaggcacggttaaccgatccctgaaggccacaaaagattcccaaatactggggtcaaggcaccatcttgccagttccattgatccagttcccactagagttgagctagagacttga

SEQ ID NO: 4178 - protein, 440 aa, Sorghum bicolor
  misc_feature: Ceres ANNOT ID no. 6034905
  misc_feature (1)..(431): NCBI GI: 140062699 NCBI Desc: iq calmodulin-binding region [medicago truncatula]
  misc_feature (1)..(431): NCBI GI: 92876066 NCBI Desc: iq calmodulin-binding region [medicago truncatula]
  misc_feature (1)..(375): NCBI GI: 15233296 NCBI Desc: calmodulin-binding family protein [arabidopsis thaliana]
  misc_feature (98)..(416): NCBI GI: 115465173 NCBI Desc: os05g0541100 [oryza sativa (japonica cultivar-group)]
  misc_feature (59)..(268): NCBI GI: 115461823 NCBI Desc: os05g0123200 [oryza sativa (japonica cultivar-group)]
MGISARWLKSLVGLRKVERQQQHRKEDADVGRMKGDVADQFHFQNQRSQEDSSIAAQEEIPEVPYGNDPPEVDSNAPSCLEPTCDSAHVPLSQTEEELEEIWAATIIQTAFRAFLARRARRALKGLVRLQALVRGHIVRKQAATTLRCMQALVRVQARVRARRVRMALENQTDQQNTSPEHTIEARVREIEDGWCDSIGSVEDIQAKLLKRQEAAAKRERAMAYALAHQWQASSRQAASFEPDKNSWGWNWLERWMAVRPWESRFLGTYAADGIFVVNETRQPDISATKTPCRKPVKKHDSTLQSNTLNQKVFPSNSEGGGSSTNRSSGSASAKSRLKVLPREGAEEASSRPSVLVVRSTSNPRERTSNINSKERTGDLDCQVHKRFSLPGIGSEAGKHLTKKGTVNRSLKATKDSQILGSRHHLASSIDPVPTRVELET

SEQ ID NO: 4179 - DNA, 516 bp, Sorghum bicolor
  misc_feature: Ceres ANNOT ID no. 6034935
  misc_feature: Encodes the peptide sequence at SEQ ID NO 4180
atgaccatgaccgcggtcgccatgccttcctccgaggcggcgtcgtccccttccaagcgagccgctggcggcctccgagggccgcggccgctgccgctgaaggtgtcgtcgtcgtcccggggctcgtctccgccgaccacgacgtccaacaaggcgccgccgtccaccaccaccaagaagcacccggtgatcgtgtacgagcacacgcccaaggtcatccacgccaggccgcaggagttcatgaccgtcgtgcagcggctcaccggcaagccccccgtcgcgcccgccacgtcgtcgtcgtcgtcgtacatgccgatctcgcccgcgctggccgaggagggcggcggcggcgaccctctcctgctcacgctcggccagcgccaggccgcgccgccggcgacagcaacgacgacgatgatgccgtccccaatggccgccgggatgctgatgtccccgggcttcatcttctcccctaacaccatgcaggccatccaggagctcagccccttgttctaa

SEQ ID NO: 4180 - protein, 171 aa, Sorghum bicolor
  misc_feature: Ceres ANNOT ID no. 6034935
  misc_feature (66)..(96): Pfam Id: VQ Pfam Desc: VQ motif
  misc_feature (10)..(117): NCBI GI: 115470691 NCBI Desc: os07g0161900 [oryza sativa (japonica cultivar-group)]
  misc_feature (16)..(102): NCBI GI: 22329705 NCBI Desc: vq motif-containing protein [arabidopsis thaliana]
  misc_feature (18)..(102): NCBI GI: 42562220 NCBI Desc: vq motif-containing protein [arabidopsis thaliana]
  misc_feature (18)..(102): NCBI GI: 8920632 NCBI Desc: contains weak similarity to bab503 major core protein from simian t-cell lymphotrophic virus type 1 gbaf230486. [arabidopsis thaliana]
  misc_feature (11)..(146): NCBI GI: 39545720 NCBI Desc: osjnba0033g16.10 [oryza sativa (japonica cultivar-group)]
MTMTAVAMPSSEAASSPSKRAAGGLRGPRPLPLKVSSSSRGSSPPTTTSNKAPPSTTTKKHPVIVYEHTPKVIHARPQEFMTVVQRLTGKPPVAPATSSSSSYMPISPALAEEGGGGDPLLLTLGQRQAAPPATATTTMMPSPMAAGMLMSPGFIFSPNTMQAIQELSPLF

SEQ ID NO: 4181 - DNA, 999 bp, Sorghum bicolor
  misc_feature: Ceres ANNOT ID no. 6034937
  misc_feature: Encodes the peptide sequence at SEQ ID NO 4182
atgtcatcctcctcgccgccacacgtcgtcgaggacatgccccatgtcctccagcttctcagcgatggcacggtggtccggttcgccgactacgacacgctccctcctccgtccgtgcctcccgcgctgcccgtccagtggaaggacgtcgtgtacgacgccacccacgacctcaagctccgcgtgtacagaccgccgccggactcctgcggtaataacaagctgcccgtgctcgtctacttccacggcggcggctacgtcctcggcaccttcgcgctgcccaatttccacgcctgctgcctccgccttgccgccgagctcccggccgtcgtcctctccgccgactaccgcctcgcaccggagcaccgcctccccgcggccctcgacgacgcggcgtccgtcatggactgggtgcgcgctcaggccgtcgacgcggcgggaggggacccctggctcgccgagtcggctgacctccgccgggtgttcgtcaccggtgactcggcgggcgggaacatcgtccaccacgtcgccgtccgcctcgcctcggcatcgggcgagctctcccccgggctcgacccggtgcgcgtcgccgggcacgtcatgctctgcccgttcttcggcggggcggagaggacggcgtccgaggcggagttcccgcccggcccgttcctgacgctgccgtggtacgaccaagcatggcggctggcgctgcccccgggcgccacgagggaccatccgttcgcgaacccgttcggtccggagagccccgcgctgggcggcgtcgcgctcccgcccacgctcgtcgtggccgcggagcgggacctgctgcgcgaccgccaggcggactacgtcgcgcggctcaaggcgacggaacagcccgtggagcacgtcgagttcgaggggcagcaccacgggttcttcgccgtggagcccgccggcgacgccggcagcgaggtggtccggctcgtcaggcggtttgtgtatggcaactcctactga

SEQ ID NO: 4182 - protein, 332 aa, Sorghum bicolor
  misc_feature: Ceres ANNOT ID no. 6034937
  misc_feature (78)..(308): Pfam Id: Abhydrolase_3 Pfam Desc: alpha/beta hydrolase fold
  misc_feature (8)..(327): NCBI GI: 115470703 NCBI Desc: os07g0162700 [oryza sativa (japonica cultivar-group)]
  misc_feature (2)..(330): NCBI GI: 82697963 NCBI Desc: cxe carboxylesterase [actinidia deliciosa]
  misc_feature (5)..(331): NCBI GI: 82697949 NCBI Desc: cxe carboxylesterase [malus pumila]
  misc_feature (9)..(328): NCBI GI: 5487873 NCBI Desc: prmc3 [pinus radiata]
  misc_feature (9)..(306): NCBI GI: 82697961 NCBI Desc: cxe carboxylesterase [actinidia deliciosa]
MSSSSPPHVVEDMPHVLQLLSDGTVVRFADYDTLPPPSVPPALPVQWKDVVYDATHDLKLRVYRPPPDSCGNNKLPVLVYFHGGGYVLGTFALPNFHACCLRLAAELPAVVLSADYRLAPEHRLPAALDDAASVMDWVRAQAVDAAGGDPWLAESADLRRVFVTGDSAGGNIVHHVAVRLASASGELSPGLDPVRVAGHVMLCPFFGGAERTASEAEFPPGPFLTLPWYDQAWRLALPPGATRDHPFANPFGPESPALGGVALPPTLVVAAERDLLRDRQADYVARLKATEQPVEHVEFEGQHHGFFAVEPAGDAGSEVVRLVRRFVYGNSY

SEQ ID NO: 4183 - DNA, 543 bp, Sorghum bicolor
  misc_feature: Ceres ANNOT ID no. 6034940
  misc_feature: Encodes the peptide sequence at SEQ ID NO 4184
atgtcgacgagcgcaacaaacacggaagccgccgccgccagcagcagcccgggcaagcggtgcgcggcgtgcaagaaccagcgcaggaagtgcggccacgactgcgtcctcgcaccctacttcccggcatcggatccccagagatacgcatgcgtgcagagggtcttcggcgccagcaatgtcgcaagaatgctccagaatctccctgtccacgaacgagccagagcagcggacacgatggcgatggaggcgcgccggcgggtgcaggacccggtgtacggatgcgccgggatcgtgggccgcctccagggagagatcagagcggcgcagtgcgagctggccaggacgcaggcccagatcgccgtgcacgccgcggcagccgcagttcgcgcgcgcccggcgccggcggtggacgcgctggcggcgggacagcacgcgccggcagcccctctgcagcagcaagacgatgacgctgcattccaaggattggacgccctgctcatcgatgactgtcgctgggacggtttagctcgtttgctttga

SEQ ID NO: 4184 - protein, 180 aa, Sorghum bicolor
  misc_feature: Ceres ANNOT ID no. 6034940
  misc_feature (21)..(170): NCBI GI: 51972120 NCBI Desc: at1g31320 [arabidopsis thaliana]
  misc_feature (4)..(135): NCBI GI: 62997483 NCBI Desc: asymmetric leaves2 [zea mays]
  misc_feature (4)..(135): NCBI GI: 120431393 NCBI Desc: ial1 [zea mays]
  misc_feature (2)..(148): NCBI GI: 20804970 NCBI Desc: b1099d03.24 [oryza sativa (japonica cultivar-group)]
  misc_feature (2)..(151): NCBI GI: 84104903 NCBI Desc: ramosa 2 [zea mays]
  misc_feature: Useful for making plants with modulated biomass
  misc_feature: Functional homolog of the protein sequence given in SEQ ID NO 13858
MSTSATNTEAAAASSSPGKRCAACKNQRRKCGHDCVLAPYFPASDPQRYACVQRVFGASNVARMLQNLPVHERARAADTMAMEARRRVQDPVYGCAGIVGRLQGEIRAAQCELARTQAQIAVHAAAAAVRARPAPAVDALAAGQHAPAAPLQQQDDDAAFQGLDALLIDDCRWDGLARLL

SEQ ID NO: 4185 - DNA, 4083 bp, Sorghum bicolor
  misc_feature: Ceres ANNOT ID no. 6034951
  misc_feature: Encodes the peptide sequence at SEQ ID NO 4186
atggggaaggcggcggcggcggtggtgctggccgtgaacggcaagcggtacgaggccgccggcgcggacccgtcgacgacgctgctggagttcctgcgcacacagacgcccgtcaggggccccaagctcggctgcggcgaaggtggctgtggtgcatgtgttgtcctcgtctccaagtacgacccgttcaccgacgaggtgaccgagttctcagcgagctcctgcctgacgctgctccatagcgtggaccgctgctcggtgaccaccagtgagggcattggcaacaccaaggatggttaccaccctgtgcagcagcgcctctccggcttccatgcctcccagtgcggcttctgcacgcctggcatgtgcatgtccatcttctctgcgcttgtcaaagccgataaggcagctgatcgaccagccccgcctgacggcttctccaagctcacttcctcggaggcggagaaggctgtctccggcaacctgtgccggtgcactgggtacaggcccatcgtcgacgcttgcaagagcttcgcagccgatgttgatcttgaggacctgggcctcaactgcttctggaagaagggtgatgagcctgcagatgtcagcaaactgccaggttacaacagtggtgccgtctgcactttccctgagtttctcaaatctgagataaagtcctcgattgagcaggttaacagtgctgcagttcctgtttctgacgatggctggtaccgtcctaagagcattgacgagcttcacagactgtttcaatctgactcattcgatgaaaattctgtgaagatagtagcttcaaacactgggtctggggtgtataaggatcaagacctttatgacaagtacattgacatcaaagagatcccagagctttcagtcatcaacagaagcagcaagggggttgagcttggatcagttgtctccatctctaaagcaattgaggtgctatcagatggaaatgtggttttcaaaaagattgcagatcacctgaccaaagtggcctctccatttgttcggaacacagcaaccataggtggaaacatcattatggcgcaacgattgcaatttccatccgacattgtgactgtactactagctgcaagtacaacagtcactatccaggtggcttccaaaacgcattgcctcgccttggaggaattcttgcagcagcctccatgtgattctaggaccctgctgctgagcatatttatccccgattggagttcagatggcatcacctttgagaccttccgagcagcacctcgtccacttggcaatgctgtctcatatgtcaattcagctttcttggcaaggacttcagtggatgcaggatcaagggaccatctcattgaggatatatgtctggcgttcggtgcgtatggagctgatcatgctattagagctaggaaggttgaggattacctgaagggcaaaacagtgagctcgtctgttatacttgaagctgttcggttgcttaaagggactgttaaaccatcagaaggaacaacacatcctgagtatagaatcagcttggctgtcagtttcttgtttaccttcctatcttcccttggcaacagcttgaatgaatcagaaaaggttaatggtcccaatgggttatatagtaatggagccacaaatggtgccatccagcactcattggagaagcatcttaagtttgacagcaatgatttgccaatacgatcgagacaagaaatgtttttgactgatgagtacaagccagttggcaagccaattaagaaagcaggggcagagatccaagcttcaggggaagctgtgtacgttgatgatatccctgctcccaaagattgcctctatggagcatttatctatagcacccaccctcatgcccatgtaaaggctatcaactttaaatcatctttggcttcacagaaggtcattaccgttatcaccgcaaaggatattccaagcggtggacaaaatattggttcaagcttcccagggatgggagaagaagcactttttgcagatccagttgctgaatttgctggtcaaaatattggtgtcgtgattgctgaaacacagaagtatgcctacatggcagcaaagcaagccgttattgagtatagcacagaaaatctgcagccaccaattctgacaatagaagatgcaatccaacgaaacagctacttccaaacccccccatttttagctcctacgccagttggtgattacaaccaagggatgtctgaagctgatcacaagattctatcagcggaggtaaaactggaatcccaatattatttctacatggagacacaagtggcgctagctattcctgatgaagataactgcataaccatctattgttcaacacaaattcctgaggtcacgcaaaatgtggttgcaaagtgccttggcattccatttcacaatgtccgcctcatcaccagaagagttggaggaggctttggtggaaaggcaatgaaagcaatacatgttgcatgtgcatgtgcggttgccgcattcaagctacagcgtccagttcggatgtaccttgatcgcaagacagacatgataatggcaggcggtcgacatcctatgaaggtgaagtactctgttgggttcaagtcagatggcaagatcacagccttgcacattgatcttgggatcaatgctggaatatcgcctgatgtgagcccaatgatgccacttgctatcataggttctctcaaaaagtacaactggggcaatcttgcatttgacaccaaggtctgcaaaacaaatgtctcatcaaaatcagcaatgagggggcctggagatgtgcagggctctttcatcgctgaagccatcattgagcatgttgcctcggcactttcagttgacactaacaccataaggaggaagaaccttcatgacttcgagagccttgtggtgttctacggagataccgcaggtgaagcttctacctacagcctagttaccatgtttgataagctggcctcctctccagaataccagcgccgagctgaaatggtggagcacttcaatagaagcaacaagtggaagaagcgtggcatttcttgtgtgccaattacatatgaggttaggcttcggccaactccaggcaaggtgtctatcatgaatgatggttccattgctgttgaggtcggaggggttgagataggccaagggttgtggacaaaagtgcagcagatgacagcatttggattgggagagctgtgtcctgacggtggtgaaagcctactagacaaggttcgcgtcattcaggccgatacattgagcatgatccagggagggttcaccggtgggagcaccacttctgaaactagctgtgaagcggttcgacagtcatgtgttgcactagtcgagagactaaagccaatcaaggagaatctggaggctaaggctggcacagtggaatggagtgccttgattgctcaggcaagtatggcgagtgtgaacttatcagcacatgcatactggacccctgatccaactttcacaagctatttgaactacggagctggcattagtgaggtggaaattgatgtcctgacaggagccacaacaattctaaggagtgaccttgtctacgattgcgggcaaagcttgaaccctgctgtcgatttgggccaggtggaaggtgcattcatccaaggagtaggcttcttcacaaacgaggactacgcaaccaactctgacgggttggttatccacgatggtacatggacatacaagatccccacggtcgacaccatcccaaagcagttcaatgttgagctgatcaacagcgcccatgaccagaagcgtgtcctctcttccaaagcatcgggcgagcctccgcttcttctagcttcctcagttcactgtgcaatgagggaggccatcagggccgccaggaaggaattctcggtttgcactggtccagcaaactccaccatcacgttccagatggacgtgccggcgacgatgcctatcatcaaggagctctgcggcctggatgtcgtcgagaggtacctggagagcatgtccgctgccagcccaacagccactgctcaagcatag

SEQ ID NO: 4186 - protein, 1360 aa, Sorghum bicolor
  misc_feature: Ceres ANNOT ID no. 6034951
  misc_feature (722)..(1260): Pfam Id: Ald_Xan_dh_C2 Pfam Desc: Aldehyde oxidase and xanthine dehydrogenase, molybdopterinbinding domain
  misc_feature (239)..(412): Pfam Id: FAD_binding_5 Pfam Desc: FAD binding domain in molybdopterin dehydrogenase
  misc_feature (600)..(711): Pfam Id: Ald_Xan_dh_C Pfam Desc: Aldehyde oxidase and xanthine dehydrogenase, a/b hammerheaddomain
  misc_feature (89)..(177): Pfam Id: Fer2_2 Pfam Desc: [2Fe-2S] binding domain
  misc_feature (420)..(533): Pfam Id: CO_deh_flav_C Pfam Desc: CO dehydrogenase flavoprotein C-terminal domain
  misc_feature (10)..(81): Pfam Id: Fer2 Pfam Desc: 2Fe-2S iron-sulfur cluster binding domain
  misc_feature (1)..(1360): NCBI GI: 2589164 NCBI Desc: aldehyde oxidase-2 [zea mays]
  misc_feature (1)..(1360): NCBI GI: 2589162 NCBI Desc: aldehyde oxidase [zea mays]
  misc_feature (1)..(1351): NCBI GI: 75298566 NCBI Desc: probable aldehyde oxidase 2 (ao-2)
  misc_feature (1)..(1351): NCBI GI: 115455835 NCBI Desc: os03g0790900 [oryza sativa (japonica cultivar-group)]
  misc_feature (4)..(1351): NCBI GI: 75298567 NCBI Desc: probable aldehyde oxidase 3 (ao-3)
  misc_feature (1)..(1347): SWISSPROT Homolog: EC 1.2.3.1 Aldehyde oxidase 1
  misc_feature (49)..(1347): SWISSPROT Homolog: EC 1.2.3.14 Abscisic-aldehyde oxidase
MGKAAAAVVLAVNGKRYEAAGADPSTTLLEFLRTQTPVRGPKLGCGEGGCGACVVLVSKYDPFTDEVTEFSASSCLTLLHSVDRCSVTTSEGIGNTKDGYHPVQQRLSGFHASQCGFCTPGMCMSIFSALVKADKAADRPAPPDGFSKLTSSEAEKAVSGNLCRCTGYRPIVDACKSFAADVDLEDLGLNCFWKKGDEPADVSKLPGYNSGAVCTFPEFLKSEIKSSIEQVNSAAVPVSDDGWYRPKSIDELHRLFQSDSFDENSVKIVASNTGSGVYKDQDLYDKYIDIKEIPELSVINRSSKGVELGSVVSISKAIEVLSDGNVVFKKIADHLTKVASPFVRNTATIGGNIIMAQRLQFPSDIVTVLLAASTTVTIQVASKTHCLALEEFLQQPPCDSRTLLLSIFIPDWSSDGITFETFRAAPRPLGNAVSYVNSAFLARTSVDAGSRDHLIEDICLAFGAYGADHAIRARKVEDYLKGKTVSSSVILEAVRLLKGTVKPSEGTTHPEYRISLAVSFLFTFLSSLGNSLNESEKVNGPNGLYSNGATNGAIQHSLEKHLKFDSNDLPIRSRQEMFLTDEYKPVGKPIKKAGAEIQASGEAVYVDDIPAPKDCLYGAFIYSTHPHAHVKAINFKSSLASQKVITVITAKDIPSGGQNIGSSFPGMGEEALFADPVAEFAGQNIGVVIAETQKYAYMAAKQAVIEYSTENLQPPILTIEDAIQRNSYFQTPPFLAPTPVGDYNQGMSEADHKILSAEVKLESQYYFYMETQVALAIPDEDNCITIYCSTQIPEVTQNVVAKCLGIPFHNVRLITRRVGGGFGGKAMKAIHVACACAVAAFKLQRPVRMYLDRKTDMIMAGGRHPMKVKYSVGFKSDGKITALHIDLGINAGISPDVSPMMPLAIIGSLKKYNWGNLAFDTKVCKTNVSSKSAMRGPGDVQGSFIAEAIIEHVASALSVDTNTIRRKNLHDFESLVVFYGDTAGEASTYSLVTMFDKLASSPEYQRRAEMVEHFNRSNKWKKRGISCVPITYEVRLRPTPGKVSIMNDGSIAVEVGGVEIGQGLWTKVQQMTAFGLGELCPDGGESLLDKVRVIQADTLSMIQGGFTGGSTTSETSCEAVRQSCVALVERLKPIKENLEAKAGTVEWSALIAQASMASVNLSAHAYWTPDPTFTSYLNYGAGISEVEIDVLTGATTILRSDLVYDCGQSLNPAVDLGQVEGAFIQGVGFFTNEDYATNSDGLVIHDGTWTYKIPTVDTIPKQFNVELINSAHDQKRVLSSKASGEPPLLLASSVHCAMREAIRAARKEFSVCTGPANSTITFQMDVPATMPIIKELCGLDVVERYLESMSAASPTATAQA

SEQ ID NO: 4187 - DNA, 678 bp, Sorghum bicolor
  misc_feature: Ceres ANNOT ID no. 6034957
  misc_feature: Encodes the peptide sequence at SEQ ID NO 4188
atggcttcgcgtaaggtgctgctcatcaccgccgccatggccgccgtcgtcgtgggcgccctgctcccggcgacctcttcggcggcgaactacatggtcggggacgactccggctgggacctcgacgtggactacgacgcctgggccagcggcaagcacttcaaggtcggcgacacgctcggccacccacaacgtggtgtggtggacgcgcagaactacaaggcgtgcaccgtgccgagcaacgcgccgacgctgacctccggggacgaccgcgtggcgctggaccaggccgggcggtggctcttcatctgcggcgtcgaagaccactgccagtccggcatgaagctcgccgtcgacgccgctcgggagctgccgccgccctcgacgtccgcggatgcgccaccgccgccgctgggcgcatcctccgccggcgggccgccaccgccaccgctcgtggagctgggatctgacgccccatggtcgccggcccctccttgcgttgttggagcgcccctctcgccgggtccggccgcgcccgccgtggcgcccccgtcacccccgccgccgtcggccgccgaccacctcccatctccctctggcgcggtgcgctcgccgggtgtcgtcaccgaccatggcaggccccctacgtccgcgcagctgccacagcaatttgtatag

SEQ ID NO: 4188 - protein, 225 aa, Sorghum bicolor
  misc_feature: Ceres ANNOT ID no. 6034957
  misc_feature (39)..(114): Pfam Id: Cu_bind_like Pfam Desc: Plastocyanin-like domain
  misc_feature (17)..(218): NCBI GI: 92876856 NCBI Desc: blue (type 1) copper domain [medicago truncatula]
  misc_feature (10)..(209): NCBI GI: 7576204 NCBI Desc: uclacyanin 3 [arabidopsis thaliana]
  misc_feature (1)..(218): NCBI GI: 87162639 NCBI Desc: blue (type 1) copper domain [medicago truncatula]
  misc_feature (67)..(221): NCBI GI: 56202119 NCBI Desc: phytocyanin protein -like [oryza sativa (japonica cultivar-group)]
  misc_feature (13)..(221): NCBI GI: 62861393 NCBI Desc: early salt stress and cold acclimation-induced protein 2-1 [lophopyrum elongatum]
MASRKVLLITAAMAAVVVGALLPATSSAANYMVGDDSGWDLDVDYDAWASGKHFKVGDTLGHPQRGVVDAQNYKACTVPSNAPTLTSGDDRVALDQAGRWLFICGVEDHCQSGMKLAVDAARELPPPSTSADAPPPPLGASSAGGPPPPPLVELGSDAPWSPAPPCVVGAPLSPGPAAPAVAPPSPPPPSAADHLPSPSGAVRSPGVVTDHGRPPTSAQLPQQFV

SEQ ID NO: 4189 - DNA, 2124 bp, Sorghum bicolor
  misc_feature: Ceres ANNOT ID no. 6034975
  misc_feature: Encodes the peptide sequence at SEQ ID NO 4190
atgccacagttgcggagtggtgctcggagagcttgtctgaggtctaagaaggtcgacaaggctgcagacccagttgggagccctgcagtgctgcctcctcagggcagggctagaaggcgtggaggtgttgtgcctggtagtggtagaggtaacaaggcagctgctaagggtagagggaggtcagcttcgaaacacagaggaaaggggctcgaggctattgatttgcagattcatctgccttacaacaacctccctgaacctgttgttgccggcgaggcagttatttgcacagcccacaaggacctttgtttgggcaaggcagctgaccgtgctgccatcttaagaatggtgggtgatatggataaatttgcagtggcagaggatgatgccacaacctccccagtgcctgagagggttcaagtaggtaattccccagaatatttaactggtaaaaagttaggcaaaggtggctttggccaggtttatgttggaagaagagtatctggtggatcttctcgtatgggtcctgatgcatatgaggttgcactaaaatttgagcaccgaagcagtaagggatgcaactatgcccccccatgcgagtggcatgtttatcacactctcaatggttgttatggcattccatcagtccactacaagggtcgccagggagactactacattcttgtaatggatatgcttggttccagcctctgggatgtttggaattctgtaggacaggcgatggctcctcatatggctgcttgcattgctgttgaagccatatcaattcttgagaaacttcactcaaaaggctttgtacatggtgatgtgaaaccagagaaccttttgcttggtcagcctggttcacttgatgagaagaagcttttcctgattgatcttggtttagcatccaggtggaaagaagcaatatctgataagcatgttgaatacgatcagagaccagatatctttaggggaacaattagatatgctagtgtccatgctcatttaggtcgtactggtagtaggagggatgatctggagtcactagcatacacccttatttttttaataagaggaagattgccttggcaaggctatcagggagataacaagagttttcttgtttgtaagaagaaaatgaccacttctccagagatgctttgttcctcctgtccagctccattcaaatattttcttgagatggtcaccaatatgaaatttgatgaagagccaaattactctaaacttatttctctttttgatggtttgattgaagagcctgcttcaagacccatcagaattgatggagctctaaaggttggacagaaacgtggaagagcacatgtaaaccttgaggtcagtgaacaaccgaagaagaaagttagattggggagcccagtaactcaatggatttcagtgtataatgctaggtggcccatgaagcagagatatcattataatgtagctgattcaaggctgcaccagcatatagaaaaaggtaatcaagatggtttgtatataagttgtgtggcttcttcagcaaacttttgggctgtcatcatggatgctgggactggattttgttctcaagtttatgacctctcacaagtgtttctgcacaaggagtggattacagagcagtgggagaagaattattacataacagcaattgctggtgcaaccaatggaagttccttgattgtaatgtctaaaggaactccttacacacagcagtcatacaaagtcagtgaatcatttccttataaatggattaataaaaaatggaaagaaggttttcatgtgacatctatggctacagcagggaatcgttggggagtgatcgtgtcaaggaatgcaggctattctactcaggtggtggagctggacttcctgtatcctagtgaaggtatccatcggcgatgggagactggttacaggataacttcgattgcagcaacacctgaccaagctgcttttatcttgagcatcccaaagaggaagcccatggacgagacgcaagaaattctccgtacttccgccttccccagcagccatgtaaaggaaaaatgggtgaagaacctgtatatttcctcggtctgctacgggcgaactgtgtgctga

SEQ ID NO: 4190 - protein, 707 aa, Sorghum bicolor
  misc_feature: Ceres ANNOT ID no. 6034975
  misc_feature (147)..(421): Pfam Id: Pkinase Pfam Desc: Protein kinase domain
  misc_feature (31)..(707): NCBI GI: 9758901 NCBI Desc: casein kinase-like protein [arabidopsis thaliana]
  misc_feature (121)..(707): NCBI GI: 92896769 NCBI Desc: protein kinase-like [medicago truncatula]
  misc_feature (116)..(706): NCBI GI: 115462563 NCBI Desc: os05g0200500 [oryza sativa (japonica cultivar-group)]
  misc_feature (80)..(706): NCBI GI: 30682888 NCBI Desc: protein kinase family protein [arabidopsis thaliana]
  misc_feature (121)..(706): NCBI GI: 115439889 NCBI Desc: os01g0744300 [oryza sativa (japonica cultivar-group)]
  misc_feature: The sequence is a functional homolog of SEQ ID NO. 399 in the 11/188,298 US application
  misc_feature: The sequence is a functional homolog of SEQ ID NO. 340 in the 11/188,298 US application
MPQLRSGARRACLRSKKVDKAADPVGSPAVLPPQGRARRRGGVVPGSGRGNKAAAKGRGRSASKHRGKGLEAIDLQIHLPYNNLPEPVVAGEAVICTAHKDLCLGKAADRAAILRMVGDMDKFAVAEDDATTSPVPERVQVGNSPEYLTGKKLGKGGFGQVYVGRRVSGGSSRMGPDAYEVALKFEHRSSKGCNYAPPCEWHVYHTLNGCYGIPSVHYKGRQGDYYILVMDMLGSSLWDVWNSVGQAMAPHMAACIAVEAISILEKLHSKGFVHGDVKPENLLLGQPGSLDEKKLFLIDLGLASRWKEAISDKHVEYDQRPDIFRGTIRYASVHAHLGRTGSRRDDLESLAYTLIFLIRGRLPWQGYQGDNKSFLVCKKKMTTSPEMLCSSCPAPFKYFLEMVTNMKFDEEPNYSKLISLFDGLIEEPASRPIRIDGALKVGQKRGRAHVNLEVSEQPKKKVRLGSPVTQWISVYNARWPMKQRYHYNVADSRLHQHIEKGNQDGLYISCVASSANFWAVIMDAGTGFCSQVYDLSQVFLHKEWITEQWEKNYYITAIAGATNGSSLIVMSKGTPYTQQSYKVSESFPYKWINKKWKEGFHVTSMATAGNRWGVIVSRNAGYSTQVVELDFLYPSEGIHRRWETGYRITSIAATPDQAAFILSIPKRKPMDETQEILRTSAFPSSHVKEKWVKNLYISSVCYGRTVC

SEQ ID NO: 4191 - DNA, 1695 bp, Sorghum bicolor
  misc_feature: Ceres ANNOT ID no. 6034978
  misc_feature: Encodes the peptide sequence at SEQ ID NO 4192
atgagagaagagagcaacaagaagagcaagctctcctggtcgaaatccctcgtgaggaagtggttcaacatcaagagtaaggcgcaggaattccatgcggattgcgacgccgcccaagggagggacgggcatggcactgaatggaggaccagctgctcagagagggaggcaggcgcggccaagaaaagcagaactgaccggtcgtcgaagcggagtagtatggaccgaacccgaggaggaaaaaacgacgttgtcgatgtggcatgcctcacagaagttcagaattacagaatctttgcctccacatggaatgtcggcggtaaatccccaccaaggggattgaatcttgacgactggctccattcttcacctccagctgatatctatgtgttaggatttcaagaaattgttcctttgaatgctggaaatgttcttggcactgaagataatctcccagcgaaaaaatgggtatcgcttgtcaggaggacactgaacaagaatcctggctcatgctgttatggtggctaccgcacaccatctcctgtccctgatccagttgtagaacaagatgctgattttgagggatcatcgagaaggcaggacagtttatcctatttgcatcgtcggtcattcaaccttagccggagtttaagagttgaaaggaaccatatgctgtcacatccaaggttggatcgtaggttcagtgtctgtgacccagttagcttgggagggaggccaagtgattttgatgggaacttcccattcatggggtcaccagatgatcattgtatcgaggaggatacaagcaatggagcatatttttcacccttcccatatggctatggtgcctgcgcacctatggaagaaaatgattatcagacaaatacatctaggtactgtttggttgccagcaagcagatggttggtatatttctcaccatttgggtacgcagcgaaataagaaatgatgtgagaaacctgaaagtttcttgtgtgggtaggggactaatgggttatcttggaaataaggggtctatatccataagcatgtctttgcaccacacaaccttttgttttgtctgttgtcatttgacctccggtgaaaaggagggagatgaacttcggaggaattctgatgttatggaaattctaaggaagactagatttccacaggtccgtggtgctgctgatgtcaagtcaccagaaacaattcttgagcatgatcgtatcatttggcttggggatttgaattatcggattgctctttcgtactgctcagctaaagctcttgttgaaatgcatagttggaaacaactattggagaaagatcagctacggatagaacgaagatgtgggcgtgttttccagggatggaaagaaggcaggatttattttcctccaacatataaatactcattcaactcagatcgttattctggtgtgcgtcccaaagaaaagcggagaacacctgcttggtgtgatcgcattttgtggtatggtaatggcctcatgcaattgtcctatgttcgcggagagtctcgcttctctgaccacaggccagtgtacagtattttcatggctgaggttgaaagtatccgccacagaagaagaaacgtgggctatttcagctctagaattgaggtggaagagcttttgccatatccgtacagctctggagaaatgaagttctactaa

SEQ ID NO: 4192 - protein, 564 aa, Sorghum bicolor
  misc_feature: Ceres ANNOT ID no. 6034978
  misc_feature (98)..(525): Pfam Id: Exo_endo_phos Pfam Desc: Endonuclease/Exonuclease/phosphatase family
  misc_feature (1)..(564): NCBI GI: 92883941 NCBI Desc: inositol polyphosphate related phosphatase [medicago truncatula]
  misc_feature (239)..(554): NCBI GI: 47155293 NCBI Desc: inositol 1,4,5-trisphosphate 5-phosphatase [arabidopsis thaliana]
  misc_feature (64)..(561): NCBI GI: 7523406 NCBI Desc: inositol-1, 4, 5-trisphosphate 5-phosphatase-like protein [arabidopsis thaliana]
  misc_feature (338)..(528): NCBI GI: 115450875 NCBI Desc: os03g0160600 [oryza sativa (japonica cultivar-group)]
  misc_feature (190)..(564): NCBI GI: 15220522 NCBI Desc: endonuclease/exonuclease/phosphatase family protein [arabidopsis thaliana]
  misc_feature (190)..(564): SWISSPROT Homolog: EC 3.1.3.56 Type I inositol-1,4,5-trisphosphate 5-phosphatase CVP2
MREESNKKSKLSWSKSLVRKWFNIKSKAQEFHADCDAAQGRDGHGTEWRTSCSEREAGAAKKSRTDRSSKRSSMDRTRGGKNDVVDVACLTEVQNYRIFASTWNVGGKSPPRGLNLDDWLHSSPPADIYVLGFQEIVPLNAGNVLGTEDNLPAKKWVSLVRRTLNKNPGSCCYGGYRTPSPVPDPVVEQDADFEGSSRRQDSLSYLHRRSFNLSRSLRVERNHMLSHPRLDRRFSVCDPVSLGGRPSDFDGNFPFMGSPDDHCIEEDTSNGAYFSPFPYGYGACAPMEENDYQTNTSRYCLVASKQMVGIFLTIWVRSEIRNDVRNLKVSCVGRGLMGYLGNKGSISISMSLHHTTFCFVCCHLTSGEKEGDELRRNSDVMEILRKTRFPQVRGAADVKSPETILEHDRIIWLGDLNYRIALSYCSAKALVEMHSWKQLLEKDQLRIERRCGRVFQGWKEGRIYFPPTYKYSFNSDRYSGVRPKEKRRTPAWCDRILWYGNGLMQLSYVRGESRFSDHRPVYSIFMAEVESIRHRRRNVGYFSSRIEVEELLPYPYSSGEMKFY

SEQ ID NO: 4193 - DNA, 513 bp, Sorghum bicolor
  misc_feature: Ceres ANNOT ID no. 6034983
  misc_feature: Encodes the peptide sequence at SEQ ID NO 4194
atgcagccgccgccggcggtgaccgcggtgctgctgctgcttctgcttctggccgccgcgccggcgacggggcagattgcgacgtcgtgcacggcgtcgctgataacgacgttcacgccgtgcctcaacttcgtgacggggagcaccaacggcggcggctcgccgacgcagcagtgctgcggctcgctggctgagatggtgcgcacgggcgccgactgcgcctgcctcatcctcaccggcaacgtgcccttcagcctccccatcaaccgcacgctcgccatctccctccccaagctctgcagctccacctccgtcccgctccagtgccgagcaccgattccaccggaatcgtcagactctccggtggatcctacggcgacgtctccggcggtggactcgccgcccttctcccagaggccagtggtgctgcccagctcgtcagttaggagttctcacgcgtccgtggcggctgtcaccattgtactgtcgatagtggcgaccattttcgtctga

SEQ ID NO: 4194 - protein, 170 aa, Sorghum bicolor
  misc_feature: Ceres ANNOT ID no. 6034983
  misc_feature (30)..(109): Pfam Id: Tryp_alpha_amyl Pfam Desc: Protease inhibitor/seed storage/LTP family
  misc_feature (6)..(168): NCBI GI: 115455869 NCBI Desc: os03g0793900 [oryza sativa (japonica cultivar-group)]
  misc_feature (9)..(147): NCBI GI: 115470831 NCBI Desc: os07g0175500 [oryza sativa (japonica cultivar-group)]
  misc_feature (7)..(147): NCBI GI: 42571345 NCBI Desc: protease inhibitor/seed storage/lipid transfer protein (ltp)-related [arabidopsis thaliana]
  misc_feature (7)..(129): NCBI GI: 8778716 NCBI Desc: t25n20.10 [arabidopsis thaliana]
  misc_feature (14)..(141): NCBI GI: 92883938 NCBI Desc: plant lipid transfer/seed storage/trypsin-alpha amylase inhibitor [medicago truncatula]
MQPPPAVTAVLLLLLLLAAAPATGQIATSCTASLITTFTPCLNFVTGSTNGGGSPTQQCCGSLAEMVRTGADCACLILTGNVPFSLPINRTLAISLPKLCSSTSVPLQCRAPIPPESSDSPVDPTATSPAVDSPPFSQRPVVLPSSSVRSSHASVAAVTIVLSIVATIFV

SEQ ID NO: 4195 - DNA, 561 bp, Sorghum bicolor
  misc_feature: Ceres ANNOT ID no. 6034984
  misc_feature: Encodes the peptide sequence at SEQ ID NO 4196
atggtggcagcttatcatcacgtggccacgcgctgccttgccctgcccctggccttcatggcggccggggtcctggcgtggcagtgcgcggcgcagtccggcccgggctgcatgccggagctcgtcagcctgaacccgtgcatggactacatgtccggcaacgagacagcgccagacgggccgtgctgctcggccgtgtcgggcatgctgcgctccagcccgggctgcctctgcatggtggtcggcggcacggccgcgtcgctcggcgtcgccgtcgacgccgaccgcgcgctccggctgcccgcggcgtgcaaggtccaggccccgcctgccagccagtgcaacgccgtgggagttccagtgccgtctccggcggcggggacggcgtcgcccggggatccggcggcggcgacgccgtcggacgccaacgtcacgcctgcagggtctggatcgaaggctacaccggcgtccacccttccatactctgacggaaacgatagcaaaccaggaacgttcttcgtcttcgccgtcgttgcactggcgctgctccatcgtttctaa

SEQ ID NO: 4196 - protein, 186 aa, Sorghum bicolor
  misc_feature: Ceres ANNOT ID no. 6034984
  misc_feature (37)..(114): Pfam Id: Tryp_alpha_amyl Pfam Desc: Protease inhibitor/seed storage/LTP family
  misc_feature (13)..(184): NCBI GI: 50509338 NCBI Desc: protease inhibitor-like protein [oryza sativa (japonica cultivar-group)]
  misc_feature (1)..(157): NCBI GI: 25553602 NCBI Desc: protease inhibitor-like protein [oryza sativa (japonica cultivar-group)]
  misc_feature (17)..(183): NCBI GI: 92883937 NCBI Desc: plant lipid transfer protein/par allergen [medicago truncatula]
  misc_feature (8)..(181): NCBI GI: 56549227 NCBI Desc: lipid transfer protein [capsicum annuum]
  misc_feature (8)..(181): NCBI GI: 56549235 NCBI Desc: lipid transfer protein [capsicum annuum]
MVAAYHHVATRCLALPLAFMAAGVLAWQCAAQSGPGCMPELVSLNPCMDYMSGNETAPDGPCCSAVSGMLRSSPGCLCMVVGGTAASLGVAVDADRALRLPAACKVQAPPASQCNAVGVPVPSPAAGTASPGDPAAATPSDANVTPAGSGSKATPASTLPYSDGNDSKPGTFFVFAVVALALLHRF

SEQ ID NO: 4197 - DNA, 1224 bp, Sorghum bicolor
  misc_feature: Ceres ANNOT ID no. 6034986
  misc_feature: Encodes the peptide sequence at SEQ ID NO 4198
atgaatgcattggcagcaaccagcaggaacttcaagcaggcagctaagctgctgggcctcgactccaagctggagaagagcttgctcattccattcagggagatcaaggttgaatgcacaatcccaaaagatgatgggactttggcatcctatgttggatttagggttcaacatgacaacgctaggggacctatgaagggtggaatcagataccaccatgaggttgaccctgatgaagtcaatgccttggcacaactgatgacatggaaaacagcagtggctaacataccatatggaggagctaaaggtggaataggatgtagccctggagacctgagcatctccgagcttgagaggcttacccgagtttttactcagaaaatccatgacttaattggcatccataccgacgttccagctccagatatgggcaccaactcacagacaatggcatggatacttgatgaatactcaaagttccatggttactcacctgctgttgtgacaggaaagcctgttgaccttggaggatcattgggaagagatgcagctactggaaggggggttctgtttgctactgaagctttgcttgcagagcatggcaaaggcatttcaggccagcgtttcgtcatacagggattcggtaacgttggttcctgggcagctcagctgatcaatgaagccggtggcaaggtgattgctatcagtgatgtcacaggcgctgtcaaaaacgtcaatggccttgacattgcccagctagtgaagcactcggcggagaacagagggatcaagggcttcaacgggggagatgccatcgatccaaactcattgctcactgaagagtgcgacgtcctcatcccagcagcgcttgggggagtcataaataaggataatgctaacgacataaaagcaaagtacatcatcgaggctgccaatcacccctcagacccagaggcagacgaggcaagcgtcatcatcctccccgacatcctcgccaactctggcggtgtcacagtgagctacttcgagtgggttcagaacatccaggggttcatgtgggacgaggagaaggtgaacgcggagctccggacgtacatgacgcgcgccttcggggacgtgaaggagatgtgccggagccacaactgcgacctccgcatgggcgccttcacgctgggcgtcaaccgcgtcgcgcgcgccaccgtcctcaggggatgggaagcctga

SEQ ID NO: 4198 - protein, 407 aa, Sorghum bicolor
  misc_feature: Ceres ANNOT ID no. 6034986
  misc_feature (176)..(404): Pfam Id: ELFV_dehydrog Pfam Desc: Glutamate/Leucine/Phenylalanine/Valine dehydrogenase
  misc_feature (31)..(161): Pfam Id: ELFV_dehydrog_N Pfam Desc: Glu/Leu/Phe/Val dehydrogenase, dimerisation domain
  misc_feature (1)..(407): NCBI GI: 1931631 NCBI Desc: glutamate dehydrogenase [zea mays]
  misc_feature (1)..(407): NCBI GI: 12643763 NCBI Desc: glutamate dehydrogenase (gdh)
  misc_feature (1)..(407): NCBI GI: 1931629 NCBI Desc: glutamate dehydrogenase mutant [zea mays]
  misc_feature (1)..(407): NCBI GI: 33242905 NCBI Desc: glutamate dehydrogenase [oryza sativa (japonica cultivar-group)]
  misc_feature (1)..(407): NCBI GI: 4150965 NCBI Desc: glutamate dehydrogenase [asparagus officinalis]
  misc_feature (1)..(407): SWISSPROT Homolog: EC 1.4.1.3 Glutamate dehydrogenase
MNALAATSRNFKQAAKLLGLDSKLEKSLLIPFREIKVECTIPKDDGTLASYVGFRVQHDNARGPMKGGIRYHHEVDPDEVNALAQLMTWKTAVANIPYGGAKGGIGCSPGDLSISELERLTRVFTQKIHDLIGIHTDVPAPDMGTNSQTMAWILDEYSKFHGYSPAVVTGKPVDLGGSLGRDAATGRGVLFATEALLAEHGKGISGQRFVIQGFGNVGSWAAQLINEAGGKVIAISDVTGAVKNVNGLDIAQLVKHSAENRGIKGFNGGDAIDPNSLLTEECDVLIPAALGGVINKDNANDIKAKYIIEAANHPSDPEADEASVIILPDILANSGGVTVSYFEWVQNIQGFMWDEEKVNAELRTYMTRAFGDVKEMCRSHNCDLRMGAFTLGVNRVARATVLRGWEA

SEQ ID NO: 4199 - DNA, 1845 bp, Sorghum bicolor
  misc_feature: Ceres ANNOT ID no. 6035014
  misc_feature: Encodes the peptide sequence at SEQ ID NO 4200
atggggcgggggcgggggcggtgggccccggggatccgcgcggcggcgctgatcctgctcgcggtcgcggctgctgccggagccgccgcgggggatcccgatccggacgagctcgagcgcgcgtttccaatagtggagccagatcacggacacactaaacttcgtctctcagaacaaggtctggaagcaattcgaaggatcgaaactcctattgctgttgttggtgtcattggtccctatcgatctggaaaatcttttctcctcaaccagcttctctccttatcttgtgataaaggttttggagttggtcatatgcgagatactaaaactaaaggtatttggatttggggtactcctgttgagatggatgttgatggttccaaagtttctgtcctttatctagacactgaagggtttgaaagtgttgggaaatcaaatgtatatgatgataggatatttgctttggcgactgtcttaagttcagtccttatctacaaccttcctgagacggtacgtgaagctgatatatctaggctttcatttgccgttgaaattgctgaagaattctatggaagagtcaaggggcaagatgttgcttttgagccagcaaagcttctctggcttatccagagggatttcctgcaaggaaaatctgttcaacaaatggtcaatgaagccctccaacgggtgcctaatgataatggtgataaatatattgatgaggtcaatcaaatacgagattctttggcagttatgggcaacaacagtactgcttttagcttgccccagccacatcttcaaagaacaaaattatgtgatatggaggacaaagagcttgaacccttatatgtaaaacggcgggagcaattaaagcagcttgtttcgtccattgtaaaaccaaaaattgtgcagggtagaactctaaatgggaaggactttgcttctttcttgcagcagattcttgaggctttgaataaaggcgaaattccatcaactggatctttggttgaaatttttaataaagccattcttgatcgctgtctgaaggtttacagggagaaaatggatggcttaggcctaccagtaccggtagacgaactgcagaaacttcatgagatggcaaatggtgaagctagaattctctttgataagcagcactttggtaaacatcatgctgctcagtcggccctcaagcttgaagatgagattaaaaaggtgtacagaaacgtccttctagctaatgaatatcaatcgtcaaagctgtgtgaagctcgcttttctgagtgtgaggataagatggatcaccttcaagtcttgaaacttccttccatggcaaaattcaatgcaggatttactcactgcaatcaaagttttgtaaaggattgcgtgggacctgcaaaagaaagctatgaacgtagaatgtcaaagatgcttgccaagtctcgtgctctttttatcaaggagtacaataacaagcttttcaattggttggtgaccttctctttggtcatggtggtcattggccgctttgtcatcaagttcttcttacttgaaattgtcgcctgggtgatgttcatcttcctagagacgtacacgagaatgttctggtcagcggaatcactttactataatccagcttggcacatcattgtttcttcctgggaaatcattgtgtacagccctattcttgatctggacagatgggctatcccaattgtcataatgctgtcatttggggttttttactggagatgcttcggtggaagaaggaagcggggaaggggttcgctcctcccattgtacaagaattcttacaagaactcgagtcgctcgagatcagactag

SEQ ID NO: 4200 - protein, 614 aa, Sorghum bicolor
  misc_feature: Ceres ANNOT ID no. 6035014
  misc_feature (51)..(306): Pfam Id: GBP Pfam Desc: Guanylate-binding protein, N-terminal domain
  misc_feature (13)..(614): NCBI GI: 115470895 NCBI Desc: os07g0181700 [oryza sativa (japonica cultivar-group)]
  misc_feature (213)..(614): NCBI GI: 42569749 NCBI Desc: guanylate-binding family protein [arabidopsis thaliana]
  misc_feature (433)..(614): NCBI GI: 46402432 NCBI Desc: at2g38850 [arabidopsis thaliana]
  misc_feature (39)..(197): NCBI GI: 89300763 NCBI Desc: guanylate-binding protein, n-terminal domain containing protein [tetrahymena thermophila sb210]
  misc_feature (36)..(476): NCBI GI: 89291280 NCBI Desc: guanylate-binding protein, n-terminal domain containing protein [tetrahymena thermophila sb210]
MGRGRGRWAPGIRAAALILLAVAAAAGAAAGDPDPDELERAFPIVEPDHGHTKLRLSEQGLEAIRRIETPIAVVGVIGPYRSGKSFLLNQLLSLSCDKGFGVGHMRDTKTKGIWIWGTPVEMDVDGSKVSVLYLDTEGFESVGKSNVYDDRIFALATVLSSVLIYNLPETVREADISRLSFAVEIAEEFYGRVKGQDVAFEPAKLLWLIQRDFLQGKSVQQMVNEALQRVPNDNGDKYIDEVNQIRDSLAVMGNNSTAFSLPQPHLQRTKLCDMEDKELEPLYVKRREQLKQLVSSIVKPKIVQGRTLNGKDFASFLQQILEALNKGEIPSTGSLVEIFNKAILDRCLKVYREKMDGLGLPVPVDELQKLHEMANGEARILFDKQHFGKHHAAQSALKLEDEIKKVYRNVLLANEYQSSKLCEARFSECEDKMDHLQVLKLPSMAKFNAGFTHCNQSFVKDCVGPAKESYERRMSKMLAKSRALFIKEYNNKLFNWLVTFSLVMVVIGRFVIKFFLLEIVAWVMFIFLETYTRMFWSAESLYYNPAWHIIVSSWEIIVYSPILDLDRWAIPIVIMLSFGVFYWRCFGGRRKRGRGSLLPLYKNSYKNSSRSRSD

SEQ ID NO: 4201 - DNA, 1218 bp, Sorghum bicolor
  misc_feature: Ceres ANNOT ID no. 6035015
  misc_feature: Encodes the peptide sequence at SEQ ID NO 4202
  misc_feature: Up-regulated in shoot tissues in response to salicylic acid treatment
atggagcgcgtcttctccgtggaggagatccccaacccctactgggccccgccgcaccctcaatcagctgccgccggcgctgttgctgcaccaggtggaggaggaggagctgtggacgcggcgggcgcgatgaaccggtgcccgtcggagtggtatttccagaagttcctggaggaggccgtgctcgacagcccggggcccgtccctggcgtcggtaggggcagcgttgtagctggagctgaggcgccggagagcaagccgctggggcccgcggctgcctcgagttcggttgttgaccctgtggagtacaacgcgatgctcaagcagaagctggagaaggacctcgctgctgtcgccatgtggagggcttctggtgcagcacctccagatcgttctgcagttgcttcttccttgccaagtgttgatgttccgcatgcagctcctcttaaacccatcggaggtactgaaagtctagttcaaaacaagctagctggtgctccaggtgtgggatcaggtccacatgtagtacaaactgccgatatccctattaagcaaaccactagctcttcctcacgagagcagtcagatgatgatgacatggaaggagatgctgagactactggaaatgcaaaccctgttcaacaaagactacagagaaggaagcaatccaaccgagaatcagccaggcgttcgagaagcagaaaggcagctcacttgaatgaactggaggcacaggtagcacagttaagagttgaaaactcttcgctgttaaggcgacttgctgatgttaatcagaagttcaatgaggctgctgttgacaatagggtgctaaaggcagatgttgaaaccttgagagcaaaggtgaagatggcagaggactcagtgaagcgggtaacaggcatgaacgcgttgttccctgccgtgtctgatatgtcgtccctcagcatgccattcaatggctccccaactgactccacctctgatgccgctgtccccatccaagatgacccaaacagttacttcgcaaatccaagtgaaatcggaggcaacaatggttacatgccagatatagcttcctcggttcaagaggacgacaattttgtcaatggggctgctggcaagatgggcagaacagcctcgctgcagcgggtggcaagcctggagcacctccagaagaggatgtgtggagggccggcttcatccgggtcgacctcctag

SEQ ID NO: 4202 - protein, 405 aa, Sorghum bicolor
  misc_feature: Ceres ANNOT ID no. 6035015
  misc_feature (212)..(275): Pfam Id: bZIP_1 Pfam Desc: bZIP transcription factor
  misc_feature (212)..(266): Pfam Id: bZIP_2 Pfam Desc: Basic region leucine zipper
  misc_feature (1)..(405): NCBI GI: 168428 NCBI Desc: opaque2 heterodimerizing protein 2 [zea mays]
  misc_feature (1)..(405): NCBI GI: 168530 NCBI Desc: opaque2 heterodimerizing protein 1
  misc_feature (1)..(405): NCBI GI: 1144536 NCBI Desc: opaque-2 heterodimerizing protein 1b
  misc_feature (1)..(405): NCBI GI: 1783305 NCBI Desc: bzip protein [oryza sativa (japonica cultivar-group)]
  misc_feature (1)..(405): NCBI GI: 4115746 NCBI Desc: bzip protein [oryza sativa (indica cultivar-group)]
  misc_feature: The sequence is a functional homolog of SEQ ID NO 1108 in the 10/225,066US patent application
  misc_feature: The sequence is a functional homolog of SEQ ID NO 1120 in the 11/479,226US patent application
  misc_feature: The sequence is a functional homolog of SEQ ID NO 12 in the 10/412,699US patent application
  misc_feature: The sequence is a functional homolog of SEQ ID NO 1232 in the 10/412,699US patent application
  misc_feature: The sequence is a functional homolog of SEQ ID NO 1762 in the 10/374,780US patent application
  misc_feature: The sequence is a functional homolog of SEQ ID NO 2 in the 10/374,780US patent application
  misc_feature: The sequence is a functional homolog of SEQ ID NO 464 in the 11/435,388US patent application
  misc_feature: The sequence is a functional homolog of SEQ ID NO 486 in the 10/412,699US patent application
  misc_feature: The sequence is a functional homolog of SEQ ID NO 812 in the 10/412,699US patent application
  misc_feature: The sequence is a functional homolog of SEQ ID NO 910 in the 10/374,780US patent application
  misc_feature: The sequence is a functional homolog of SEQ ID NO 926 in the 10/374,780US patent application
  misc_feature: Useful for making plants with altered alkaloid content
  misc_feature: Useful for making plants with altered terpenoid content
  misc_feature: Useful for making plants with modulated endosperm cell number
  misc_feature: Useful for making plants with modulated endosperm size
  misc_feature: Useful for making plants with modulated growth and phenotype characteristics
  misc_feature: Functional homolog of the protein sequence given in SEQ ID NO 13237
  misc_feature: GREAT-hit functional homolog of the protein sequence given in SEQ ID NO 13412
  misc_feature: The sequence is a functional homolog of SEQ ID NO 12 in the 20040045049 US patent application
  misc_feature: The sequence is a functional homolog of SEQ ID NO 1232 in the 20040045049 US patent application
  misc_feature: The sequence is a functional homolog of SEQ ID NO 486 in the 20040045049 US patent application
  misc_feature: The sequence is a functional homolog of SEQ ID NO 812 in the 20040045049 US patent application
  misc_feature: The sequence is a functional homolog of SEQ ID NO 1762 in the 20060162006 US patent application
  misc_feature: The sequence is a functional homolog of SEQ ID NO 910 in the 20060162006 US patent application
  misc_feature: Useful for making plants with modulated endosperm cell number
  misc_feature: Useful for making plants with modulated endosperm size
  misc_feature: Functional homolog of the protein sequence given in SEQ ID NO 13412
  misc_feature: The sequence is a functional homolog of SEQ ID NO 1232 in the 10/412,699 US patent application
  misc_feature: The sequence is a functional homolog of SEQ ID NO 926 in the 10/374,780 US patent application
  misc_feature: Up-regulated in shoot tissues in response to salicylic acid treatment
  misc_feature: The sequence is a functional homolog of SEQ ID NO. 337 in the 11/188,298 US application
MERVFSVEEIPNPYWAPPHPQSAAAGAVAAPGGGGGAVDAAGAMNRCPSEWYFQKFLEEAVLDSPGPVPGVGRGSVVAGAEAPESKPLGPAAASSSVVDPVEYNAMLKQKLEKDLAAVAMWRASGAAPPDRSAVASSLPSVDVPHAAPLKPIGGTESLVQNKLAGAPGVGSGPHVVQTADIPIKQTTSSSSREQSDDDDMEGDAETTGNANPVQQRLQRRKQSNRESARRSRSRKAAHLNELEAQVAQLRVENSSLLRRLADVNQKFNEAAVDNRVLKADVETLRAKVKMAEDSVKRVTGMNALFPAVSDMSSLSMPFNGSPTDSTSDAAVPIQDDPNSYFANPSEIGGNNGYMPDIASSVQEDDNFVNGAAGKMGRTASLQRVASLEHLQKRMCGGPASSGSTS

SEQ ID NO: 4203 - DNA, 456 bp, Sorghum bicolor
  misc_feature: Ceres ANNOT ID no. 6035036
  misc_feature: Encodes the peptide sequence at SEQ ID NO 4204
atggagctgctcaaggagctggtccccggctgcagtaaggtatcaggaacagcactggtgctagatgagatcatcaatcatgttcagtctctccaaaggcaagttgagtatttgtcaatgaggctcgcagctgtaaacccaagggtcgattttggtgggctagacagctttctgaccacggagtgtggaaggatagcaggcttcaactgcaagaacggaatcgacttggagcaggtaacctggccagaaatgggtgttcatggaacaaggcagctgatgcaacttcaacagcacttctggcatggtgatttagcacatccacaccaagtggcttcacagtgggaaaagcggggggatggccatcctcccgtctttggcaaccccagtccctctctcttcggctatgatctaacaagctctggtaaacttgcacgcattcctatattgccttcctga

SEQ ID NO: 4204 - protein, 151 aa, Sorghum bicolor
  misc_feature: Ceres ANNOT ID no. 6035036
  misc_feature (1)..(145): NCBI GI: 51090957 NCBI Desc: basic helix-loop-helix protein-like [oryza sativa (japonica cultivar-group)]
  misc_feature (1)..(140): NCBI GI: 92899328 NCBI Desc: helix-loop-helix dna-binding [medicago truncatula]
  misc_feature (13)..(136): NCBI GI: 30695832 NCBI Desc: basic helix-loop-helix (bhlh) family protein [arabidopsis thaliana]
  misc_feature (1)..(61): NCBI GI: 119655907 NCBI Desc: bhlhogu [brassica rapa subsp. chinensis]
  misc_feature (1)..(77): NCBI GI: 29647487 NCBI Desc: bhlh transcription factor(gbof-1)-like [oryza sativa (japonica cultivar-group)]
  misc_feature: The sequence is a functional homolog of SEQ ID NO 18 in the 10/225,066US patent application
  misc_feature: The sequence is a functional homolog of SEQ ID NO 1929 in the 10/374,780US patent application
  misc_feature: The sequence is a functional homolog of SEQ ID NO 1930 in the 10/374,780US patent application
  misc_feature: The sequence is a functional homolog of SEQ ID NO 2808 in the 10/374,780US patent application
  misc_feature: Useful for making plants with modulated growth and phenotype characteristics
  misc_feature: The sequence is a functional homolog of SEQ ID NO 18 in the 20050160493 US patent application
  misc_feature: The sequence is a functional homolog of SEQ ID NO 1929 in the 20060162006 US patent application
  misc_feature: The sequence is a functional homolog of SEQ ID NO 1930 in the 20060162006 US patent application
  misc_feature: The sequence is a functional homolog of SEQ ID NO 672 in the 11/435,388 US patent application
  misc_feature: Useful for making plants with altered lignin content
  misc_feature: Functional homolog of the protein sequence given in SEQ ID NO 13755
MELLKELVPGCSKVSGTALVLDEIINHVQSLQRQVEYLSMRLAAVNPRVDFGGLDSFLTTECGRIAGFNCKNGIDLEQVTWPEMGVHGTRQLMQLQQHFWHGDLAHPHQVASQWEKRGDGHPPVFGNPSPSLFGYDLTSSGKLARIPILPS

SEQ ID NO: 4205 - DNA, 1725 bp, Sorghum bicolor
  misc_feature: Ceres ANNOT ID no. 6035072
  misc_feature: Encodes the peptide sequence at SEQ ID NO 4206
atggccgacgatcccctggactcgtccccgtcggcgtccgccgccgccgctgctgccggcggagtctgctccgcccccgccccagcgctccggccgcggcgggagccatttgagtacgggctcctgccgatccccaagctggtcttcccggagggcacgctgacgcaaaccctatcccagctgaaggagaggctcgcgccggggggaccgcgggtgggcgccgcagcgctcgctgatgcgctgcagatccctgccgagcaggcggccctggcgctcgggacgctcgctgcggtgctgcccgcggaggatccggagctcggcgaggatggcgcggggaatgccgacctccgcgacctgcttcttttcatctacatccagtcctacaagcgcctcgtgccgcgcgcgcacaaggactcgcccgccgtcgcggatgtttggccgtccacctccgccttcgatggatacctctccgcgctatcgccgatccagtttgtacgcagcaatagtcgccgttttatgccttcacaagcagatgaagaatctcatcaactgtcatatttacaaaagcatatggccaacattctaacacttttagcagattctgttgatggagagggagatgactctatggtattgacaatggagacttttgagcaccttggatttttgttgcatctctctgaaggaactcctttaagccaagcagctacattttttgcaaattcggatccagacatgcccgctgctcctgtacctgctgctctggtacatgattggatcttgcagcatatagcttcagcattagattttatggcagagaagtctgcggcaaaagaaaacagcaataatgcatttgatcctgatgtcacaatgtctgatgctgtcacgaatacaagaattcatagcagctcaccaactggcacttctgcaccaaactatcctggatactaccgaaatgcatcatttgtggagggttgctctaaaacttcagttgtcaaacaagcatcggatctgaaagggcattcaataaaggttttgaactgccatgattctgtcatttacattttagccccacttaagtatgcaaccgtctacggatgttctgacactaccattattcttggtgctattggtaaggttgttaaagtggagcattgtgaacgtgtacaaattattgcagcttcaaaacgaatctgtattgccaattgtcgtgaatgtatcttctacttgggagtaaatcaccaaccacttattgtgggggacaaccataaattacaagttgccccattcaatacttattatccactacttggggagcatttggcacaagttggtgtggatcctaatgtcaacaagtgggaccaaccttttgtgttgggagttgttgatccgcatgattctttatctcatcctgctggggtttctgacgtccaggccgagtccgccacttgtctagatcctgatctatttactaactttttgattcctagttggtttgaagtagaaggacctaccaaatacaatccgtttaccttacctgaagtttactgggcatcccaaaggaaaaagcatgcttctctggacgatattcaaaagaatatccgggaactggagatcgatgataaccggaagaaagaattagcatgtgcccttcatgctcaattcaaagattggttatatgcttcagggaatatccgccagctatactgtttgcaaggtgaataa

SEQ ID NO: 4206 - protein, 574 aa, Sorghum bicolor
  misc_feature: Ceres ANNOT ID no. 6035072
  misc_feature (340)..(457): Pfam Id: TBCC Pfam Desc: Tubulin binding cofactor C
  misc_feature (1)..(574): NCBI GI: 51091222 NCBI Desc: tubulin-specific chaperone c-like [oryza sativa (japonica cultivar-group)]
  misc_feature (1)..(574): NCBI GI: 49388111 NCBI Desc: tubulin-specific chaperone c-like protein [oryza sativa (japonica cultivar-group)]
  misc_feature (30)..(574): NCBI GI: 124360656 NCBI Desc: tubulin binding cofactor c [medicago truncatula]
  misc_feature (4)..(574): NCBI GI: 17380620 NCBI Desc: at3g57890/t10k17_100 [arabidopsis thaliana]
  misc_feature (30)..(562): NCBI GI: 42569861 NCBI Desc: tubulin-specific chaperone c-related [arabidopsis thaliana]
MADDPLDSSPSASAAAAAAGGVCSAPAPALRPRREPFEYGLLPIPKLVFPEGTLTQTLSQLKERLAPGGPRVGAAALADALQIPAEQAALALGTLAAVLPAEDPELGEDGAGNADLRDLLLFIYIQSYKRLVPRAHKDSPAVADVWPSTSAFDGYLSALSPIQFVRSNSRRFMPSQADEESHQLSYLQKHMANILTLLADSVDGEGDDSMVLTMETFEHLGFLLHLSEGTPLSQAATFFANSDPDMPAAPVPAALVHDWILQHIASALDFMAEKSAAKENSNNAFDPDVTMSDAVTNTRIHSSSPTGTSAPNYPGYYRNASFVEGCSKTSVVKQASDLKGHSIKVLNCHDSVIYILAPLKYATVYGCSDTTIILGAIGKVVKVEHCERVQIIAASKRICIANCRECIFYLGVNHQPLIVGDNHKLQVAPFNTYYPLLGEHLAQVGVDPNVNKWDQPFVLGVVDPHDSLSHPAGVSDVQAESATCLDPDLFTNFLIPSWFEVEGPTKYNPFTLPEVYWASQRKKHASLDDIQKNIRELEIDDNRKKELACALHAQFKDWLYASGNIRQLYCLQGE

SEQ ID NO: 4207 - DNA, 1737 bp, Sorghum bicolor
  misc_feature: Ceres ANNOT ID no. 6035073
  misc_feature: Encodes the peptide sequence at SEQ ID NO 4208
atggcaggaagcaacggcactctgctgatcgcattccgcatcgtcctcttctgcgccctcgcctccgcggccaccaccttgctgctccctctcatcacaaggccatgcgcctcctccctgtcaagaaccatcctcgccgccaccgccctcgaccctcacctcatctcctgcgccgacgacggctccaagtccaatgccgagctgtctgaaggcgacggaggcaacaagccggccggtagcggcggcaggcccatagtcacggacctgctgtcgtgcggcgagcccgacctcccatcccacgcgctcccgccgttccgctgctgcccgccgacaccgccgtccggcactcctatcgccaacttcacgttccccgacccaggcgagccgctccggacgcggcggccggcgcacgagtccggctccggcagcggcacggacaacagcgtcgtcgccaggtacgcgcgcgcggtggcgctgatgaaggcgctgccggagtcggacccgcgcagcttctaccagcaggccaacgtccactgcgcctactgcgccgccgcgtaccggcaggcggggcgaccggagctgcccctgcagatccactactcgtggctcttcttcccgttccaccgcgcctacctctacttcttcgagcgcgtcgcggcgaggctcctgggcgaccccggcttcgccgtgccgttctggagctgggacgtgccggaggggatgcgggtgccgccggagttcgccgacgccgcgtccccgctgtacgaccccatgaggaacccggaccacgcgccgccgagactcgtcgacctcgacttctcgtacgtggacaggaattgcaccgacgagcagcaaatccagctcaacctccgcatcatgtataaacagatggtcaccaacgcgccgctgccgtcgctcttccacgggcagccgtaccgcgccggcgaccgggcgatgcccggagcagggacggtggagctgagcccgcacaacgtaatccaccgatggtccggcgacctctcgcgggccaaccacgagaacatgggcgcctactactccgccgcccgcgaccccatcttctacccgcaccacgccaactccgaccgcctctgggaggtctggcgcggcgtcggcggcggccacgcggacttcacggaccccgactggctcgactcgtcgttcctgttctacgacgaggacgcccggctcgtgcgagtcaccgtccgcgacatgctcgacgtcgggaggctccggtacgcgtacgccgaggtcggcctgccgtggctcagcgcgcggccgcccgtcgtcgccgacgtgaaccgcggaagaggcggcccgacgcacctgaagtccgtccgcttcccggtgtcgctcgatgctgcggtgaccgcggcggtgagccggcggcggcagggaaagccacgagggcagcgggaggaggaggtgctggtggtcgacggcatcgaagccgacggcgcggacttcgtcaagttcgacgtgtacgtgaacgcggtggatcacgagaaggtcggccccggcggacgggaaatggctggaagctttgtgtccctgaagcaccccggcgaggtggtggtgcagaccagcatgagggtggcgctgaaggagatcctggaggacctgggcgccgagggagacgacagcgtcacggtgacgttggtgcccgtggaggggagggtcaggatcggaggcctcagaatagtgtacatgacggagtga

SEQ ID NO: 4208 - protein, 578 aa, Sorghum bicolor
  misc_feature: Ceres ANNOT ID no. 6035073
  misc_feature (100)..(428): Pfam Id: Tyrosinase Pfam Desc: Common central domain of tyrosinase
  misc_feature (54)..(573): NCBI GI: 37359228 NCBI Desc: polyphenol oxidase [ananas comosus]
  misc_feature (83)..(502): NCBI GI: 1172584 NCBI Desc: polyphenol oxidase, chloroplast precursor (ppo) (catechol oxidase)
  misc_feature (83)..(502): NCBI GI: 15487290 NCBI Desc: polyphenol oxidase [pyrus pyrifolia]
  misc_feature (77)..(502): NCBI GI: 2293358 NCBI Desc: polyphenol oxidase [malus x domestica]
  misc_feature (71)..(502): NCBI GI: 2293360 NCBI Desc: polyphenol oxidase [malus x domestica]
  misc_feature (88)..(433): SWISSPROT Homolog: EC 1.10.3.1 Polyphenol oxidase A1, chloroplast precursor
MAGSNGTLLIAFRIVLFCALASAATTLLLPLITRPCASSLSRTILAATALDPHLISCADDGSKSNAELSEGDGGNKPAGSGGRPIVTDLLSCGEPDLPSHALPPFRCCPPTPPSGTPIANFTFPDPGEPLRTRRPAHESGSGSGTDNSVVARYARAVALMKALPESDPRSFYQQANVHCAYCAAAYRQAGRPELPLQIHYSWLFFPFHRAYLYFFERVAARLLGDPGFAVPFWSWDVPEGMRVPPEFADAASPLYDPMRNPDHAPPRLVDLDFSYVDRNCTDEQQIQLNLRIMYKQMVTNAPLPSLFHGQPYRAGDRAMPGAGTVELSPHNVIHRWSGDLSRANHENMGAYYSAARDPIFYPHHANSDRLWEVWRGVGGGHADFTDPDWLDSSFLFYDEDARLVRVTVRDMLDVGRLRYAYAEVGLPWLSARPPVVADVNRGRGGPTHLKSVRFPVSLDAAVTAAVSRRRQGKPRGQREEEVLVVDGIEADGADFVKFDVYVNAVDHEKVGPGGREMAGSFVSLKHPGEVVVQTSMRVALKEILEDLGAEGDDSVTVTLVPVEGRVRIGGLRIVYMTE

SEQ ID NO: 4209 - DNA, 924 bp, Sorghum bicolor
  misc_feature: Ceres ANNOT ID no. 6035100
  misc_feature: Encodes the peptide sequence at SEQ ID NO 4210
atggacgccgggcgcaagcggaccgcgccggaggcgggcgccaacggcgcgggcggcccgaagcgcgcgagagaatcggagacaactcaaatgggtgtaggaagcaaatccaagccgtgcaccaaatttttcagcacggctggttgtccctttggtgcaagttgccattttctccataacttcccgggtggctaccaggcggtttcaaagatgaccaacttaggtggaccgcctgttccggctccaccaggaagaatgcctatgggacctggtggccctgatgggccaccttcacctgctgtgaagactcgcatgtgtaacaagtacaacactgcagaaggatgtaaatgggggagcaagtgccacttcgctcatggagaaagggagcttggaaagcccctgcagatggacaactcaatgggagctcctcctccaatggggccagggcccaacggtcacttcatgccaccaccaatgcctcacctagacatggttcctccttccaccttcggtgcttcagccacagccaagatcagtgtcgatgcatcccttgctggcgccatcatcgggaagggtggtgccaacacaaagcatatatcccgagtgactggggccaagttagccatccgggacaatgaggctgatcccaaccataaaaacattgagcttgagggaacatttgaccagatcaagcacgctagcgcaatggtcacagagttgattgtccgcatcagtggtaaggcgcctggcccacaagccaagaataacccaggaggcagggggcctggttctcatgctgggggtcctggaagcaacttcaagaccaagttgtgtgagaacttcaacaaaggctcctgcacctttggggacaggtgccactttgcccatggcgaaagtgagctgcgcaaacctgctgctgcttga

SEQ ID NO: 4210 - protein, 307 aa, Sorghum bicolor
  misc_feature: Ceres ANNOT ID no. 6035100
  misc_feature (35)..(61): Pfam Id: zf-CCCH Pfam Desc: Zinc finger C-x8-C-x5-C-x3-H type (and similar)
  misc_feature (101)..(127): Pfam Id: zf-CCCH Pfam Desc: Zinc finger C-x8-C-x5-C-x3-H type (and similar)
  misc_feature (273)..(298): Pfam Id: zf-CCCH Pfam Desc: Zinc finger C-x8-C-x5-C-x3-H type (and similar)
  misc_feature (175)..(237): Pfam Id: KH_1 Pfam Desc: KH domain
  misc_feature (1)..(307): NCBI GI: 51090454 NCBI Desc: kh domain-containing protein / zinc finger protein-like [oryza sativa (japonica cultivar-group)]
  misc_feature (45)..(307): NCBI GI: 115468968 NCBI Desc: os06g0618100 [oryza sativa (japonica cultivar-group)]
  misc_feature (3)..(306): NCBI GI: 32488659 NCBI Desc: osjnba0087o24.9 [oryza sativa (japonica cultivar-group)]
  misc_feature (3)..(306): NCBI GI: 116308845 NCBI Desc: h1005f08.11 [oryza sativa (indica cultivar-group)]
  misc_feature (36)..(134): NCBI GI: 92081526 NCBI Desc: zinc finger protein [ciona intestinalis]
  misc_feature: The sequence is a functional homolog of SEQ ID NO 60 in the 10/666,642US patent application
  misc_feature: The sequence is a functional homolog of SEQ ID NO 600 in the 10/666,642US patent application
  misc_feature: Useful for making plants with altered alkaloid content
  misc_feature: Useful for making plants with altered terpenoid content
  misc_feature: Useful for making plants with modulated growth and phenotype characteristics
  misc_feature: GREAT-hit functional homolog of the protein sequence given in SEQ ID NO 12965
  misc_feature: GREAT-hit functional homolog of the protein sequence given in SEQ ID NO 13274
  misc_feature: The sequence is a functional homolog of SEQ ID NO 60 in the 20070033671 US patent application
  misc_feature: The sequence is a functional homolog of SEQ ID NO 600 in the 20070033671 US patent application
  misc_feature: The sequence is a functional homolog of SEQ ID NO 600 in the 10/666,642 US patent application
  misc_feature: Useful for making plants with altered alkaloid content
  misc_feature: Functional homolog of the protein sequence given in SEQ ID NO 13274
  misc_feature: The sequence is a functional homolog of SEQ ID NO. 291 in the 11/188,298 US application
MDAGRKRTAPEAGANGAGGPKRARESETTQMGVGSKSKPCTKFFSTAGCPFGASCHFLHNFPGGYQAVSKMTNLGGPPVPAPPGRMPMGPGGPDGPPSPAVKTRMCNKYNTAEGCKWGSKCHFAHGERELGKPLQMDNSMGAPPPMGPGPNGHFMPPPMPHLDMVPPSTFGASATAKISVDASLAGAIIGKGGANTKHISRVTGAKLAIRDNEADPNHKNIELEGTFDQIKHASAMVTELIVRISGKAPGPQAKNNPGGRGPGSHAGGPGSNFKTKLCENFNKGSCTFGDRCHFAHGESELRKPAAA

SEQ ID NO: 4211 - DNA, 1440 bp, Sorghum bicolor
  misc_feature: Ceres ANNOT ID no. 6035136
  misc_feature: Encodes the peptide sequence at SEQ ID NO 4212
atgtccgacgaggtgtacgacgctgacggcgacatcagccgctacctgcagaccccgtcgctggagcctcttgtgctcgcagtgcctgacgacggtgagaccgcggcaacgcacgtcgtcgaggcgccgcagcatgtgccgccgcccgttcatgggggcgtggccttaccaacggcaccgacgacgccggtgaacctgtctatggagttcggcaacgacgatgtccagaacaatcatgcgatgacgatggacgtgcagccgctgcagggtcaaggtcagtacggtttccctgcagaacaatcatgcgttcttccggaactactaggagccttgtcactgtacgaccattattccatggatgacggggacgacgacactactgttgacgctctcttcaagagcgccgaggacgccggcaacaatcacagcagcgccgtggcggtagagcactccgtgctccctgttgaggaagacctaataaccttcgtgccgttcgttctcggccaactggattgctccaagtgccgatcagtcagggaggtgctccatgaaagcgcaaatcacaagctctattttgttgtgcacgtcggggaccctgctggaacattccaacacgcgatcattgatcgcgcgtatatcgatgccagtggccaaaccatactgaacgagctcatgtatgctgatctccgcaagcgcacacatgggcgtgtgcagaacttcatcgcaaacagtgtggaaatgctcaagaacgacaccagtgggaagctgacggactcttgttctacattccaggcaaacaacagcatgcacatagagctagagacgaatatgctgaaggagatactttccgcgccttcttctaatactgaagcagtaggcgtccctcagtcaggtcctcaagctcctcatcaaacagtcacgcgggcagaagtaaacaccaatgttgatgacactgtgcttaataacgctgctaattggcctgtgttttctcctcctgctgcaatacttgaatcttcacaagttagtgttcaacgtggaatgccatcgtccagtgatgccagtgcaacaggcaacgaaagtctgcttgcaaagcaacgccgaagaatctcccagttgaccatgaaagatatagccaacttaatgcacatgagcaagaaagatgccgccaagaaactgaatatttcagtcacatctctcaagcggctctgccggaagaacaacactgaccgctggcctgctcgcaagatcaattcactcgacagtcagattaagaagctcgaggaagctgcactgagaaatgttgggacgacaggcctgctggcgattaaggaaaagatggaaaagctgaattatgagaaggcaatggtttatgcctccgtctggaaggttatccaggagaaccagaagcataacgatggtgctggtggcagcagtggttga

SEQ ID NO: 4212 - protein, 479 aa, Sorghum bicolor
  misc_feature: Ceres ANNOT ID no. 6035136
  misc_feature (368)..(419): Pfam Id: RWP-RK Pfam Desc: RWP-RK domain
  misc_feature (337)..(427): NCBI GI: 38345397 NCBI Desc: osjnba0017b10.3 [oryza sativa (japonica cultivar-group)]
  misc_feature (368)..(422): NCBI GI: 119672855 NCBI Desc: minus dominant protein [pleodorina starrii]
  misc_feature (364)..(427): NCBI GI: 115459932 NCBI Desc: os04g0564000 [oryza sativa (japonica cultivar-group)]
  misc_feature (372)..(465): NCBI GI: 119358851 NCBI Desc: rwp1 rwp-rk domain-containing protein (ic) [ostreococcus tauri]
  misc_feature (299)..(419): NCBI GI: 86200409 NCBI Desc: mid [chlamydomonas reinhardtii]
  misc_feature: The sequence is a functional homolog of SEQ ID NO 1911 in the 10/374,780US patent application
  misc_feature: Useful for making plants with modulated growth and phenotype characteristics
  misc_feature: The sequence is a functional homolog of SEQ ID NO 1911 in the 20060162006 US patent application
MSDEVYDADGDISRYLQTPSLEPLVLAVPDDGETAATHVVEAPQHVPPPVHGGVALPTAPTTPVNLSMEFGNDDVQNNHAMTMDVQPLQGQGQYGFPAEQSCVLPELLGALSLYDHYSMDDGDDDTTVDALFKSAEDAGNNHSSAVAVEHSVLPVEEDLITFVPFVLGQLDCSKCRSVREVLHESANHKLYFVVHVGDPAGTFQHAIIDRAYIDASGQTILNELMYADLRKRTHGRVQNFIANSVEMLKNDTSGKLTDSCSTFQANNSMHIELETNMLKEILSAPSSNTEAVGVPQSGPQAPHQTVTRAEVNTNVDDTVLNNAANWPVFSPPAAILESSQVSVQRGMPSSSDASATGNESLLAKQRRRISQLTMKDIANLMHMSKKDAAKKLNISVTSLKRLCRKNNTDRWPARKINSLDSQIKKLEEAALRNVGTTGLLAIKEKMEKLNYEKAMVYASVWKVIQENQKHNDGAGGSSG

SEQ ID NO: 4213 - DNA, 1602 bp, Sorghum bicolor
  misc_feature: Ceres ANNOT ID no. 6035175
  misc_feature: Encodes the peptide sequence at SEQ ID NO 4214
atggcgggaggaggggcggcgccgccgcccaagcaggaggagctgcagccgcacccggtgaaggaccagctgcccagcgtgtcctactgcatcacaagtccaccgccctggcctgaggccgtcatccttggattccagcactacattgtgatgctgggcacctctgtcatcataccaagcgctcttgttccccagatgggaggaggaaacgaggagaaggctcgggtgattcagacgctgctgttcgttgccggcatcaacaccctgtgccagtcattctttgggactcgtctccctgcagtgatgggtggatcctacaccatcgtcgcacccaccatctccatcatcatggctggtcgttacagcaatgaagcagaccctcatgagaaattcttgcggaccatgcgaggaacacaaggcgctctcatcatcgcatcgacaattcagatcatacttggttttagtggcctttggcgtaatgtcgttaaatttctaagcccattgtctgctgtacctctggtctcgctagctggatttgggctatatgagcttggttttccaggggttgctaagtgtgtagaaattgggcttccagaaatcattctaatgctcatattttcccagtatttacctcatgctgtcaatgcggcaaagcctgtgttcgaccggttttctgtgattttcacaattgcaattgtatggctgtatgcatacattctcacagttagcggtgcatacaagaatgcccgaacaaagacgcaagtccattgccgtgttgaccgctctggacttattagtggagctccttggattagtgtcccataccctttccaatggggggccccaacatttgatgctggtgaatcatttgcaatgatggtggccgcatttgttgctcttgtcgagtcaagtgggaccttcattgctgtgtcaagatatgcaagtgcgactatcatacctccttcaattcttggtcgtggcattggttggcagggcattggtactttactgggtgcattttttgggacagctaacgggactgcagtgtcagttgaaaatgctggtttgcttgctttgacacatgttggtagccgaagagtagtccagatatctgcaggcttcatgattttcttctctatccttgggaaattcggggctatctttgcttcaatcccactgccgatattcgctgccctgtactgcattttctttgcatacattggtgcttgtggcctgagcttccttcagttctgcaacctgaacagcttcaggaccaagttcatcatggggttctccttgttcatgggcctgtcagtcccccaatacttcaacgagtacacgtccgtggctggctacggcccggtgcacaccggcgcccgatggttcaacgacatgatcaacgtgcccttctcgtcgaagccgttcgtggcggtgctggtggccttcttgctggacaacacgatccaggtgcgggacagcggcgtgaggagggacaggggctaccactggtgggacaagttccggagcttcaagacggacagccgcagcgaggagttctactcgctgcccttcaacctcaacaagttcttcccttccgtctga

SEQ ID NO: 4214 - protein, 533 aa, Sorghum bicolor
  misc_feature: Ceres ANNOT ID no. 6035175
  misc_feature (38)..(445): Pfam Id: Xan_ur_permease Pfam Desc: Permease family
  misc_feature (3)..(533): NCBI GI: 89330191 NCBI Desc: leaf permease 1 [oryza sativa (japonica cultivar-group)]
  misc_feature (3)..(533): NCBI GI: 30696385 NCBI Desc: xanthine/uracil permease family protein [arabidopsis thaliana]
  misc_feature (3)..(533): NCBI GI: 144923095 NCBI Desc: xanthine/uracil/vitamin c permease [medicago truncatula]
  misc_feature (6)..(533): NCBI GI: 31711940 NCBI Desc: at5g49990 [arabidopsis thaliana]
  misc_feature (1)..(331): NCBI GI: 5091547 NCBI Desc: t10o24.16 [arabidopsis thaliana]
MAGGGAAPPPKQEELQPHPVKDQLPSVSYCITSPPPWPEAVILGFQHYIVMLGTSVIIPSALVPQMGGGNEEKARVIQTLLFVAGINTLCQSFFGTRLPAVMGGSYTIVAPTISIIMAGRYSNEADPHEKFLRTMRGTQGALIIASTIQIILGFSGLWRNVVKFLSPLSAVPLVSLAGFGLYELGFPGVAKCVEIGLPEIILMLIFSQYLPHAVNAAKPVFDRFSVIFTIAIVWLYAYILTVSGAYKNARTKTQVHCRVDRSGLISGAPWISVPYPFQWGAPTFDAGESFAMMVAAFVALVESSGTFIAVSRYASATIIPPSILGRGIGWQGIGTLLGAFFGTANGTAVSVENAGLLALTHVGSRRVVQISAGFMIFFSILGKFGAIFASIPLPIFAALYCIFFAYIGACGLSFLQFCNLNSFRTKFIMGFSLFMGLSVPQYFNEYTSVAGYGPVHTGARWFNDMINVPFSSKPFVAVLVAFLLDNTIQVRDSGVRRDRGYHWWDKFRSFKTDSRSEEFYSLPFNLNKFFPSV

SEQ ID NO: 4215 - DNA, 936 bp, Sorghum bicolor
  misc_feature: Ceres ANNOT ID no. 6035225
  misc_feature: Encodes the peptide sequence at SEQ ID NO 4216
atggcccaggctccggcgcgcgccgcctccgccgtgcggctcttcgacgcgcactgccacctgcaagatccccgcgtcgcggccgtcgcccccgccctcatacgcgccgccgccgcatccggcgtcgcacgcttcgcggtcaacggcacctccgagaaggactggcacctggtgcagcagatggccgaggatcacccagccgtcgtcccctgcttcggcctgcacccatggtgggtacccgagaggtcgccggattggatgaattccttgcggcggttcttcgccgaaaccccggaggcggctgttggggagattggtctggacaaaggttcacatggaaaaaccatcgacttcggagaacaggtcgaagtgttccaacgacaacttgaacttgctaaggaattggagagacctgtttctgttcattgtgtgcgggcatttggtgatcttctggaagtactgaagcaaactggacctttcccagcaggcgtgttgttacattcttatatgggatcttcagaaatggtgtctggcctttcaaatttaggctgttacttttcactatctggcttcttgataggcatgaaatccactaaagctaagaaaatgctgaagtcaatacccttggatagaattcttttagagacagacgcacctgatgcattaccaagattggacaatgttgctgtatcaccagtccctgttcacagttcagatgcagatactgaaaagcgtcacatagattcagagtcacaggctgctaatgcatcaaatgagtccctgaaccatccagaaaatatccatatcgttttgaattatgtcgcatcactccttgaaatgccagagtcagaattggcggagctgagttacaagaatgcaaccaaactgttttcttatcctggctccaaagttcagcctgaagctgaaggcatttaa

SEQ ID NO: 4216 - protein, 311 aa, Sorghum bicolor
  misc_feature: Ceres ANNOT ID no. 6035225
  misc_feature (15)..(298): Pfam Id: TatD_DNase Pfam Desc: TatD related DNase
  misc_feature (1)..(311): NCBI GI: 38345538 NCBI Desc: osjnba0020j04.13 [oryza sativa (japonica cultivar-group)]
  misc_feature (1)..(311): NCBI GI: 116309681 NCBI Desc: h0404f02.5 [oryza sativa (indica cultivar-group)]
  misc_feature (12)..(304): NCBI GI: 18418353 NCBI Desc: tatd-related deoxyribonuclease family protein [arabidopsis thaliana]
  misc_feature (14)..(223): NCBI GI: 145621118 NCBI Desc: hydrolase, tatd family [geobacter bemidjiensis bem]
  misc_feature (14)..(297): NCBI GI: 89305291 NCBI Desc: hydrolase, tatd family protein [tetrahymena thermophila sb210]
  misc_feature: The plant is abnormally small.
  misc_feature: Useful for making plants with modulated biomass
  misc_feature: GREAT-hit functional homolog of the protein sequence given in SEQ ID NO 13236
  misc_feature: Useful for making plants with modulated biomass
  misc_feature: Functional homolog of the protein sequence given in SEQ ID NO 13236
MAQAPARAASAVRLFDAHCHLQDPRVAAVAPALIRAAAASGVARFAVNGTSEKDWHLVQQMAEDHPAVVPCFGLHPWWVPERSPDWMNSLRRFFAETPEAAVGEIGLDKGSHGKTIDFGEQVEVFQRQLELAKELERPVSVHCVRAFGDLLEVLKQTGPFPAGVLLHSYMGSSEMVSGLSNLGCYFSLSGFLIGMKSTKAKKMLKSIPLDRILLETDAPDALPRLDNVAVSPVPVHSSDADTEKRHIDSESQAANASNESLNHPENIHIVLNYVASLLEMPESELAELSYKNATKLFSYPGSKVQPEAEGI

SEQ ID NO: 4217 - DNA, 1131 bp, Sorghum bicolor
  misc_feature: Ceres ANNOT ID no. 6035227
  misc_feature: Encodes the peptide sequence at SEQ ID NO 4218
atgactctgtcccgtgcactccactgctcatctctcctcgttacggcgctgctgttcattttcccttcatctgcagcagtgccgcctgctctcttcatctttggagactcccttgttgatgcaggcaacaatgactacctcgtgaccctttccaaggccaatgcaccaccatacggcgtcgattttgagttctccggtggcaagccaaccgggaggttcacaaatgggatgaccattgcagatatcatgggtaatgccaagtgtgaatccctggggcagaaatctcttgctccacccttcttggccccaaattcaagtgctgcaatgaccaacagcggaatcaactatggctccggttcttctggcatatttgatgatactggctctatttatattggaagaattccgctaggaatgcaaatcagctacttcgaaaagaccagatcacagatactagagaccatggacaaggaagctgcaactgatttcttcaagaaggcgctctttattatagcagcaggatccaatgatatcttggagtatgtttcaccatcagtaccattctttggacgagagaagcctgatccatcacatttccaggatgcattggtttccaacctgacattttatctgaagaggctaaatgaactgggggctaggaagtttgttgtgtccgatgttgggcctctcggttgtataccgtacgttcgtgctctggagttcatgcctgcaggggagtgctcggcatcagcgaatcgagtcactgaaggttacaacaagaaactgaagaggatggtcgagaagatgaaccaggagatgggtccggagagtaaatttgtgtacacagacacgtacaagatcgttatggagatcattcagaactaccgccaatacggtttcgatgatgcgctggacccgtgctgtggcggcagcttccctccgtttctctgtattggcgtcaccaactccagctcctcgatgtgcagtgaccgctccaagtacgtgttctgggatgcgttccacccgactgaaaccgccaacctcatcgtcgccggtaaacttctcgacggcgacgcgactgcggcctggcctatcaatgtccgcgagctgtcccagtacgagcacaaatga

SEQ ID NO: 4218 - protein, 376 aa, Sorghum bicolor
  misc_feature: Ceres ANNOT ID no. 6035227
  misc_feature (31)..(354): Pfam Id: Lipase_GDSL Pfam Desc: GDSL-like Lipase/Acylhydrolase
  misc_feature (9)..(376): NCBI GI: 116309680 NCBI Desc: h0404f02.4 [oryza sativa (indica cultivar-group)]
  misc_feature (36)..(376): NCBI GI: 115460062 NCBI Desc: os04g0577300 [oryza sativa (japonica cultivar-group)]
  misc_feature (23)..(371): NCBI GI: 10177373 NCBI Desc: gdsl-motif lipase/hydrolase-like protein [arabidopsis thaliana]
  misc_feature (17)..(372): NCBI GI: 144924855 NCBI Desc: lipolytic enzyme, g-d-s-l [medicago truncatula]
  misc_feature (186)..(371): NCBI GI: 7268372 NCBI Desc: proline-rich, apg like protein [arabidopsis thaliana]
MTLSRALHCSSLLVTALLFIFPSSAAVPPALFIFGDSLVDAGNNDYLVTLSKANAPPYGVDFEFSGGKPTGRFTNGMTIADIMGNAKCESLGQKSLAPPFLAPNSSAAMTNSGINYGSGSSGIFDDTGSIYIGRIPLGMQISYFEKTRSQILETMDKEAATDFFKKALFIIAAGSNDILEYVSPSVPFFGREKPDPSHFQDALVSNLTFYLKRLNELGARKFVVSDVGPLGCIPYVRALEFMPAGECSASANRVTEGYNKKLKRMVEKMNQEMGPESKFVYTDTYKIVMEIIQNYRQYGFDDALDPCCGGSFPPFLCIGVTNSSSSMCSDRSKYVFWDAFHPTETANLIVAGKLLDGDATAAWPINVRELSQYEHK

SEQ ID NO: 4219 - DNA, 1488 bp, Sorghum bicolor
  misc_feature: Ceres ANNOT ID no. 6035228
  misc_feature: Encodes the peptide sequence at SEQ ID NO 4220
atggcgccgttccagatgcggttcgggctacagatctctcccgcgcgctccgacgaggaggaggaagaggacgaggaagaggaggacgaagagctcgaggaggaggaggagtatgacgagatggagagcgaggggacggcctcgccgccgatgatgctccgggcagggaggggaggaggaggaggaggaggaggagggggcgggggagggctggtgggcgccgtcgtgggggcgctgcggaggtcgctggtgatgtgcagcgccggcgccgtgggtgtcgacgacgacgacgacgacgacgacgaggacagcgagggcgaggggatcgagattgggcggcccacggacgtgcggcacgtctcgcacgtcaccttcgaccgtttcggcggcttcctcggcctccccgctgacctcgagccagacgtgccccggcgcacgcccagtgccagtgtaagtgtatttggcgtttcacccacctctctgcaatgttcatatgatcaaagaggaaacagtgtgcccacaatattgctaatgatgcagaggaagttatatgcgcatgaaggacttaagattgaagggatatttaggattaatgcagaaaatagccaggaagtctatgtcagggaccaattaaacagtggaatggtaccagatgaagttgacttgcactgccttgctgggttgataaaggcatggtttcgggagcttccttcaggtgtattggatgcactaacaccagaacaagtaatgcactgcaacacggaagaggagtgcgctctccttgcttctatgctaccaccagttgaagcaacactacttgattgggccattaatctgatggctgatgttgtagagcaagaaaactacaacaagatgaatgcccggaacatcgcgatggtttttgctcccaatatgactcagatggccgatccattaactgccctgatacatgcagttcaggtgatgaatttcctcaagactttaatcatgaagactttaaaggaacgaaaggagaaaaatggagcactccaagcatcacaatcatgctctggttctccaaatgaccaagatgaacatcagatgccagagcatttggagaaacctttagttctgtcaagtcaaaaagactttgattttcccatgattgatagggacactcctgttcaagtccttggagctgagaaagctctccatcatgactcacaaatccattctgatgagacaaaaaagtttggaattggtatggaccacaagaaaagccagagtgacgtttcttctcttggcagtgattcgaacaatcgattcaacagttcaggaagagaatttggtagcagaaatggcgaaggcttgtttgacagatttagttttaggaaaggggttgagaggctttgcaggcatcccgtgtttcagttgagtaggtccatgaagaagtctgcagatgtcgtggtcttcgatgcccccagagaagcaagacaagcttgggtatga

SEQ ID NO: 4220 - protein, 495 aa, Sorghum bicolor
  misc_feature: Ceres ANNOT ID no. 6035228
  misc_feature (173)..(310): Pfam Id: RhoGAP Pfam Desc: RhoGAP domain
  misc_feature (110)..(156): Pfam Id: PBD Pfam Desc: P21-Rho-binding domain
  misc_feature (1)..(494): NCBI GI: 116309679 NCBI Desc: h0404f02.3 [oryza sativa (indica cultivar-group)]
  misc_feature (41)..(480): NCBI GI: 34451568 NCBI Desc: rho gtpase activating protein 2 [oryza sativa (japonica cultivar-group)]
  misc_feature (49)..(480): NCBI GI: 115447915 NCBI Desc: os02g0679500 [oryza sativa (japonica cultivar-group)]
  misc_feature (16)..(356): NCBI GI: 140055673 NCBI Desc: rhogap; wiscott-aldrich syndrome, c-terminal [medicago truncatula]
  misc_feature (71)..(494): NCBI GI: 3695061 NCBI Desc: rac gtpase activating protein 2 [lotus japonicus]
MAPFQMRFGLQISPARSDEEEEEDEEEEDEELEEEEEYDEMESEGTASPPMMLRAGRGGGGGGGGGGGGGLVGAVVGALRRSLVMCSAGAVGVDDDDDDDDEDSEGEGIEIGRPTDVRHVSHVTFDRFGGFLGLPADLEPDVPRRTPSASVSVFGVSPTSLQCSYDQRGNSVPTILLMMQRKLYAHEGLKIEGIFRINAENSQEVYVRDQLNSGMVPDEVDLHCLAGLIKAWFRELPSGVLDALTPEQVMHCNTEEECALLASMLPPVEATLLDWAINLMADVVEQENYNKMNARNIAMVFAPNMTQMADPLTALIHAVQVMNFLKTLIMKTLKERKEKNGALQASQSCSGSPNDQDEHQMPEHLEKPLVLSSQKDFDFPMIDRDTPVQVLGAEKALHHDSQIHSDETKKFGIGMDHKKSQSDVSSLGSDSNNRFNSSGREFGSRNGEGLFDRFSFRKGVERLCRHPVFQLSRSMKKSADVVVFDAPREARQAWV

SEQ ID NO: 4221 - DNA, 1056 bp, Sorghum bicolor
  misc_feature: Ceres ANNOT ID no. 6035234
  misc_feature: Encodes the peptide sequence at SEQ ID NO 4222
atggatatgggaagcgggcccgcgctccagtacctcctgtgcctcgcctgggtcgcggccaccctccctatcgccgccgccgcgctgccgatccccacggccgccggcggccgtttcatccacggcctgctctgcgccttctcgtcccgcgggaagacagtcaggccctcggtctcgtcctcgtccaagacgagattcaccgttccacaaaaattcttcttgcatttttacgtggtgggtgcggttgtgacgactagcttgctacttgcaatatggttctatgcatacatgaaaatgacacctttgatgccggaaccatcgagttactccacaattgctagccatcttgttggcggttcaaattcattctctttggcaaatttctggtcgtcacgccccatggaacacaagcatcgtgtctggcgtactgtatttgtactgatattgatggaaattcaggtcctgagacgcctatatgagactgaacatgtcttccactacagcccttcagctcgaatgcacatcataggatatctaacgggtattttctactatgtggctgcacctttatcacttgctagttcttgtcttcctgaagcaatacagtatcttcaatatcaaatagctgagttcatagtcaagggtcgagcaagaatgccagatctagcaattgacccatcacatctcttgaagcctcttctaaagttggggtggtgccagtggattggtgctgttattttcatctggggctcactccatcagatccgctgccatgcaattcttggatcattgcgtgaacacaaagattctgatgaatatgtaattccatgtggtgactggtttggtcgtgtgtcttgccctcattaccttgctgaactagtactatattttggcatgttgatagctagtggtggatcagacatttcggtgtggttcctgtacctttttgtgataacaaacttatcctttgcagcggtacaaacacataaatggtatcttcagaaatttgaagattaccctcgttctcgctatgcaattattccatttgtatgctag

SEQ ID NO: 4222 - protein, 351 aa, Sorghum bicolor
  misc_feature: Ceres ANNOT ID no. 6035234
  misc_feature (217)..(351): Pfam Id: Steroid_dh Pfam Desc: 3-oxo-5-alpha-steroid 4-dehydrogenase
  misc_feature (1)..(349): NCBI GI: 115472177 NCBI Desc: os07g0493400 [oryza sativa (japonica cultivar-group)]
  misc_feature (12)..(350): NCBI GI: 92870670 NCBI Desc: 3-oxo-5-alpha-steroid 4-dehydrogenase, c-terminal [medicago truncatula]
  misc_feature (17)..(350): NCBI GI: 42570801 NCBI Desc: 3-oxo-5-alpha-steroid 4-dehydrogenase family protein / steroid 5-alpha-reductase family protein [arabidopsis thaliana]
  misc_feature (17)..(350): NCBI GI: 27363426 NCBI Desc: at2g16530/f1p15.9 [arabidopsis thaliana]
  misc_feature (190)..(350): NCBI GI: 27503918 NCBI Desc: mgc53983 protein [xenopus laevis]
MDMGSGPALQYLLCLAWVAATLPIAAAALPIPTAAGGRFIHGLLCAFSSRGKTVRPSVSSSSKTRFTVPQKFFLHFYVVGAVVTTSLLLAIWFYAYMKMTPLMPEPSSYSTIASHLVGGSNSFSLANFWSSRPMEHKHRVWRTVFVLILMEIQVLRRLYETEHVFHYSPSARMHIIGYLTGIFYYVAAPLSLASSCLPEAIQYLQYQIAEFIVKGRARMPDLAIDPSHLLKPLLKLGWCQWIGAVIFIWGSLHQIRCHAILGSLREHKDSDEYVIPCGDWFGRVSCPHYLAELVLYFGMLIASGGSDISVWFLYLFVITNLSFAAVQTHKWYLQKFEDYPRSRYAIIPFVC

SEQ ID NO: 4223 - DNA, 1131 bp, Sorghum bicolor
  misc_feature: Ceres ANNOT ID no. 6035236
  misc_feature: Encodes the peptide sequence at SEQ ID NO 4224
atggcactgccggcggctaacccgggcgtccgtctcggctgccaggaggctccggcgatgggcttggggttggcgccgcggctagcactgcgtcgtcccgccgcggtctcccggcataggagcactggcagagggaagtttccagtggcagccaccagtctagatgactatcttccaatgcgaagcactgaagtgaaaaatcggacatcaaccggtgatatcgcaagtctcagattaatcactgcagtgaaaaccccttatttgccagatggaaggttcgatcttgaatcatatgattctttgataaacatgcagatagagggtggttctgaaggtgtaatagttggtggaacaacaggagagggtcacctaatgagctgggatgaacacattatgcttattgggcatactgttaactgctttggcactagaattaaagtgataggcaacacagggagtaattctaccagagaggctgttcacgcaacagagcaggggtttgctgttggcatgcatgcagctctccacatcaacccttactatgggaagacctcaactgaaggattgatctctcattttgaggctgttctgccgatgggtccaaccatcatttacaatgtgccatccaggagtggccaggatattcctcctcaagttattgaggcactttcaggttattcaagcctggcaggagtaaaagaatgtgtcggacatgagagagtcaagtgctacactgacaaaggtataacaatatggagtggtaatgatgatgaatgccatgattctaggtggaaatatggtgccactggagttatttctgtagcaagcaaccttgttcctggtctcatgcgtaatctcatgtatgaaggggagaatgcattgctaaatgagaagctgttgcctctgatgaaatggttattctgccagccgaatcccatcgcactcaacactgctctggctcagcttggggtggcaaggcctgttttcagattgccgtatgttcctcttcttcttgagaagcggattgagtttgtccggattgttgaagctattggacggggaaactttgtgggacagaaagaagcacgtgttctcaacgatgatgattttgttttgatcagtaggtattag

SEQ ID NO: 4224 - protein, 376 aa, Sorghum bicolor
  misc_feature: Ceres ANNOT ID no. 6035236
  misc_feature (75)..(352): Pfam Id: DHDPS Pfam Desc: Dihydrodipicolinate synthetase family
  misc_feature (2)..(376): NCBI GI: 118237 NCBI Desc: dihydrodipicolinate synthase 2, chloroplast precursor (dhdps 2)
  misc_feature (3)..(376): NCBI GI: 115457444 NCBI Desc: os04g0254000 [oryza sativa (japonica cultivar-group)]
  misc_feature (3)..(376): NCBI GI: 116311089 NCBI Desc: h0807c06-h0308c08.5 [oryza sativa (indica cultivar-group)]
  misc_feature (44)..(376): NCBI GI: 7272361 NCBI Desc: dihydrodipicolinate synthase [oryza sativa]
  misc_feature (4)..(376): NCBI GI: 118241 NCBI Desc: dihydrodipicolinate synthase, chloroplast precursor (dhdps)
  misc_feature (2)..(376): SWISSPROT Homolog: EC 4.2.1.52 Dihydrodipicolinate synthase 2, chloroplast precursor
MALPAANPGVRLGCQEAPAMGLGLAPRLALRRPAAVSRHRSTGRGKFPVAATSLDDYLPMRSTEVKNRTSTGDIASLRLITAVKTPYLPDGRFDLESYDSLINMQIEGGSEGVIVGGTTGEGHLMSWDEHIMLIGHTVNCFGTRIKVIGNTGSNSTREAVHATEQGFAVGMHAALHINPYYGKTSTEGLISHFEAVLPMGPTIIYNVPSRSGQDIPPQVIEALSGYSSLAGVKECVGHERVKCYTDKGITIWSGNDDECHDSRWKYGATGVISVASNLVPGLMRNLMYEGENALLNEKLLPLMKWLFCQPNPIALNTALAQLGVARPVFRLPYVPLLLEKRIEFVRIVEAIGRGNFVGQKEARVLNDDDFVLISRY

SEQ ID NO: 4225 - DNA, 2007 bp, Sorghum bicolor
  misc_feature: Ceres ANNOT ID no. 6035238
  misc_feature: Encodes the peptide sequence at SEQ ID NO 4226
atggcggcggcagcgccagagaagaggccccctcgctcgctctttgaactcgcctctgacttctttgattcatccgtcctccttcgggctcacccatccacggccccctctgcggtggaaccatccgaaccctcccggtcaccgccgccgccgacgactcagcagcagcagcagcagctttcagaggcttcgggatccaggtggacgtgcaacacctgtgccgccgagttcgagtcgctacaggagcagcgcgagcacttcaagtccgacctacaccgcctcaacgttaagttgagcattgctggtaaaactattataaaggaagaggacctagacaaagcagattctgattctctgtttgatgatttggagatatctagtgtctctggttcagaggacgaacaagaaaatggacctgcatcagaacgtttgctctcagttaaaggcaaggaagaattcaggaagaaactttactttcgtcgtgcatcgggtgacacaatttctatctatagatgcatgctcttgaaagaacatgaagaaccattaattgattgtaagtctggtcagatggaaaatgcatcttgtgtaccggaggaggagatgataaatagggtgaagcatttgacttgtgaacctcgtgatgcgtcacatttgagaattgttatactaacaagcggtggacattttgctggatgcgtttttgatggaaattccattgtagcacataaaacatttcataggtatgttgtaagagcaaaggctgggaagaggcaatctggaaaagatgctactggaaaagttgcacactcagcaggctcttctctacggcgctataacgaagcagcactgaaaaaggaagttcaagaattaattgtttcatggaagtcatactttgagacatgtgtttgtgccttcatttatgctccatctaagaaccgacagatgctcttcgatggggagaagactcagtcagtaattcagtcatgtgatattcgtccagttccattgactgtccatcgtcccactttgaaggaagctaagcgggtatattgtaacctaacacaactctactatgagatggaatgttcaaccacagatgaaaccttacctgatgctggaagtgtgaaaaatgttgaacaaagtcaaggaaaaaagaaggaagtggacgcagaccctgaggaatctatttctgacttgtctgccaggttggaattgttgaataagaatgaatcagcaacaataccatcatctaagaacgaaacaacacctcttcatgaggcagcaaagtgtggcaatgctcagctgaccctggagttactcgagcagggtttggatccttgcataaaagatgcaagaggaaagacaccttattcgctggcttcagataaggaagttagaaatacattcagaagatttatggcactcaaccttgacaaatgggattggcatgccgcagatgtgcctagtgcactaacaaaagaaatggaagaatcacaagctgcaaaacaagcagacaaggatgccaaaaggaaagcacgtgcaaaggagttgaagaaattaaaaaaagcaagagaaaaggaagagaaggaaaaggagaaggctaaggctcaagcatcgcagtcacaaactgatgttaaaggcacttcaagtggccaaatggctaacagaactgcatcagtgccaggccttaaaccaaagcatcagacgccacagcaaatacttatagcaaaggaggaggaacgacagcgaaaacaagctgaagaaagagagaagagagcagctgcagcagagagaagacttgcagctcttgctgcccaatctgctggagccggcgcgtcaggtgcagcagcaacaaactgctcagcacagagggcagtaccagatgacaattcgtgttcatgctgttttgcttccttggctggcaaggtgccattccaccgatacaactacaaatactgcagcacgacatgtatgcatcttcattcagaaatgctgcaagatgattaa

SEQ ID NO: 4226 - protein, 668 aa, Sorghum bicolor
  misc_feature: Ceres ANNOT ID no. 6035238
  misc_feature (419)..(451): Pfam Id: Ank Pfam Desc: Ankyrin repeat
  misc_feature (1)..(668): NCBI GI: 115460038 NCBI Desc: os04g0574600 [oryza sativa (japonica cultivar-group)]
  misc_feature (2)..(420): NCBI GI: 110832744 NCBI Desc: ankyrin repeat and zinc finger domain-containing protein 1
  misc_feature (5)..(420): NCBI GI: 119591114 NCBI Desc: ankyrin repeat and zinc finger domain containing 1, isoform cra_a [homo sapiens]
  misc_feature (33)..(359): NCBI GI: 110556649 NCBI Desc: ankyrin repeat and zinc finger domain containing protein [mus musculus]
  misc_feature (33)..(359): NCBI GI: 110832745 NCBI Desc: ankyrin repeat and zinc finger domain-containing protein 1
MAAAAPEKRPPRSLFELASDFFDSSVLLRAHPSTAPSAVEPSEPSRSPPPPTTQQQQQQLSEASGSRWTCNTCAAEFESLQEQREHFKSDLHRLNVKLSIAGKTIIKEEDLDKADSDSLFDDLEISSVSGSEDEQENGPASERLLSVKGKEEFRKKLYFRRASGDTISIYRCMLLKEHEEPLIDCKSGQMENASCVPEEEMINRVKHLTCEPRDASHLRIVILTSGGHFAGCVFDGNSIVAHKTFHRYVVRAKAGKRQSGKDATGKVAHSAGSSLRRYNEAALKKEVQELIVSWKSYFETCVCAFIYAPSKNRQMLFDGEKTQSVIQSCDIRPVPLTVHRPTLKEAKRVYCNLTQLYYEMECSTTDETLPDAGSVKNVEQSQGKKKEVDADPEESISDLSARLELLNKNESATIPSSKNETTPLHEAAKCGNAQLTLELLEQGLDPCIKDARGKTPYSLASDKEVRNTFRRFMALNLDKWDWHAADVPSALTKEMEESQAAKQADKDAKRKARAKELKKLKKAREKEEKEKEKAKAQASQSQTDVKGTSSGQMANRTASVPGLKPKHQTPQQILIAKEEERQRKQAEEREKRAAAAERRLAALAAQSAGAGASGAAATNCSAQRAVPDDNSCSCCFASLAGKVPFHRYNYKYCSTTCMHLHSEMLQDD

SEQ ID NO: 4227 - DNA, 939 bp, Sorghum bicolor
  misc_feature: Ceres ANNOT ID no. 6035253
  misc_feature: Encodes the peptide sequence at SEQ ID NO 4228
atggtgggcggcttcctccgggccttcgccgccgcttccgctgtgcccgcagcagctgccgcagcctacgccctctcttcctcctccgccccctgctccccgaagctccgcttccctctgcctgcctccttgctctccgccgccgccgcctcctcctcctcgacctccgggcgcgctcccagcgccgtgcccccgatggccaccgccgccgcggccgcggccgatctctcggcgcccgataagcagcaggactcggcgcttccggagctcacgacggaattcatggtggacatgaaatgtgagggatgcgtaacagctgtgaaaaacaagctgcaaactcttgaaggaataaaaaacattgaggtggacttgtctaaccaagttgttagggttctgggatctcttccagtgaagacaatgctagacgcccttcatcaaacaggtcgagatgcacgactgattggccaagggaacccaaatgatttcttagtttccgctgctgtagctgagtttaaagggccagttatatttggtgttgttcgtttggcccaagtaaacatggagttggctagagttgaagccacgtttagtggtctatcacctggtaaacatggatggtcaataaatcagtttggagatttgacaagaggtgcagaaagcactggcaatgtatataatccgccagatcatttatccaataagccgcttggtgacctgggaacactagaagctggagagaatggggaagcccatttctcaggaccgaaggagaaactgagagtcgttgacttgattggccgctctattgctctgtatgcaaccgaggacagatcagaccccggcattgctgcagccgtgattgcaagaagcgccggcgtaggagagaactacaagaagctctgcacttgtgatggtgtcaccatttgggaatcaagctaa

SEQ ID NO: 4228 - protein, 312 aa, Sorghum bicolor
  misc_feature: Ceres ANNOT ID no. 6035253
  misc_feature (93)..(153): Pfam Id: HMA Pfam Desc: Heavy-metal-associated domain
  misc_feature (164)..(291): Pfam Id: Sod_Cu Pfam Desc: Copper/zinc superoxide dismutase (SODC)
  misc_feature (40)..(312): NCBI GI: 12711645 NCBI Desc: cu/zn-superoxide dismutase copper chaperone precursor [glycine max]
  misc_feature (10)..(312): NCBI GI: 37654464 NCBI Desc: copper chaperone precursor [solanum tuberosum]
  misc_feature (8)..(312): NCBI GI: 92872960 NCBI Desc: superoxide dismutase, copper/zinc binding; heavy metal transport/detoxification protein [medicago truncatula]
  misc_feature (2)..(312): NCBI GI: 8778642 NCBI Desc: f5o11.26 [arabidopsis thaliana]
  misc_feature (10)..(312): NCBI GI: 5815465 NCBI Desc: cu/zn-superoxide dismutase copper chaperone precursor [arabidopsis thaliana]
MVGGFLRAFAAASAVPAAAAAAYALSSSSAPCSPKLRFPLPASLLSAAAASSSSTSGRAPSAVPPMATAAAAAADLSAPDKQQDSALPELTTEFMVDMKCEGCVTAVKNKLQTLEGIKNIEVDLSNQVVRVLGSLPVKTMLDALHQTGRDARLIGQGNPNDFLVSAAVAEFKGPVIFGVVRLAQVNMELARVEATFSGLSPGKHGWSINQFGDLTRGAESTGNVYNPPDHLSNKPLGDLGTLEAGENGEAHFSGPKEKLRVVDLIGRSIALYATEDRSDPGIAAAVIARSAGVGENYKKLCTCDGVTIWESS

SEQ ID NO: 4229 - DNA, 1413 bp, Sorghum bicolor
  misc_feature: Ceres ANNOT ID no. 6035260
  misc_feature: Encodes the peptide sequence at SEQ ID NO 4230
atgacgacgcggggagccaagcgcgccgcgacctccgaccccgccgcacccgatttaccaagtaagagagtaatggacggaccctcttttgatgttcacagggcggagtcttcccatcagcatgtgatggcaggacccgctaccttagatcctcgacgggctgaggctgccagtaaacatgtgagggcactcaatacccagtttgcgagctgggttcaattgcagctgcaaaatcatcctgatgaactttgggaggatggccttaaggattacatatcacatgcatctgaaatcatggaaaaattcaaggatgttgtcaactggcttaggcaaaatcaagcaggttcaacagttgtttcatccccaagctcactcaaggatgagaagtctaatctaccagcagcagacgatagcaagctcttggtacaagcaagttcagataacaaacagaaggctccaattgtagcttctagttctccatcttttcagaactcaagcttaccaaaccttttttcatcgccttctcagccaaaaacaccggatttcagtggtatgtttgctaacaagaagaacacatctggtgatagcagtaaaccacctttccaatttggtggaaataatgtcatatttggtgataagaaggatacagctgttgacagcagtaaatctttccagtttgttgcaaataatggcatgtttggtgacaagaaggatacgcctagtaacagcaaacccttccagtttggtgcaaacaatggcatatttggtcttggtgacaagaagactacaaccagtgacaacagtaaccctttccagtttggtgcaaataatggttttccaacatccaatgcaccatctattttttcttcagttcctcaaagttttagcccacagagtccacctctgttttcaatgaatcaacaatcagtcctctcaggaaaccaaaatactgctgaagcttcagctgacgcagatgaagatgctgaacctgagaagccaagcagcccttctgtaaagaaggcagaagagaaaggggtagttgttgttcatgaaaccaaatgcaaggtgtatgtgaagcatgatgatgccactaagggttggaaagacattggtgttggtcagctctctatcagaagtaaagaaggcgcagagaaagcttccaaagaatctgctcctaccattgttataagaaatgatgttggtaaaatcctactgaatgctctgatctacaaggggataaaaatgaatcttcagaagaatacggttgcttcgatatttcatacttcagattcgcagtcaagtgaatcagatggtggcacagtcgtagctcgaacatacctgttccggttgaaaaatgaggaggaggctacaaaattatcgacagcaatcaaggagaatgcacctacagactga

SEQ ID NO: 4230 - protein, 470 aa, Sorghum bicolor
  misc_feature: Ceres ANNOT ID no. 6035260
  misc_feature (337)..(469): Pfam Id: Ran_BP1 Pfam Desc: RanBP1 domain
  misc_feature (227)..(470): NCBI GI: 53370648 NCBI Desc: ranbp1 domain containing protein [oryza sativa (japonica cultivar-group)]
  misc_feature (146)..(469): NCBI GI: 20334758 NCBI Desc: at4g11790/t5c23_220 [arabidopsis thaliana]
  misc_feature (242)..(468): NCBI GI: 92890882 NCBI Desc: ranbp1; evh1 [medicago truncatula]
  misc_feature (125)..(466): NCBI GI: 19921802 NCBI Desc: cg2158-pa [drosophila melanogaster]
  misc_feature (122)..(465): NCBI GI: 6323367 NCBI Desc: nup2p [saccharomyces cerevisiae]
MTTRGAKRAATSDPAAPDLPSKRVMDGPSFDVHRAESSHQHVMAGPATLDPRRAEAASKHVRALNTQFASWVQLQLQNHPDELWEDGLKDYISHASEIMEKFKDVVNWLRQNQAGSTVVSSPSSLKDEKSNLPAADDSKLLVQASSDNKQKAPIVASSSPSFQNSSLPNLFSSPSQPKTPDFSGMFANKKNTSGDSSKPPFQFGGNNVIFGDKKDTAVDSSKSFQFVANNGMFGDKKDTPSNSKPFQFGANNGIFGLGDKKTTTSDNSNPFQFGANNGFPTSNAPSIFSSVPQSFSPQSPPLFSMNQQSVLSGNQNTAEASADADEDAEPEKPSSPSVKKAEEKGVVVVHETKCKVYVKHDDATKGWKDIGVGQLSIRSKEGAEKASKESAPTIVIRNDVGKILLNALIYKGIKMNLQKNTVASIFHTSDSQSSESDGGTVVARTYLFRLKNEEEATKLSTAIKENAPTD

SEQ ID NO: 4231 - DNA, 684 bp, Sorghum bicolor
  misc_feature: Ceres ANNOT ID no. 6035263
  misc_feature: Encodes the peptide sequence at SEQ ID NO 4232
atggactgggcgtactacggcatcagcggctactcgacgacgccgtctcctcctccggtgggcgttggcggcggcgttggggacgaggacgaggcgtacatgacggtgtcgtcggcgccgccgaagcggcgcgcggggcggaccaagttcaaggagacgaggcacccggtgtacaagggcgtgcgcagcaggaaccccgggcggtgggtgtgcgaggtgcgggagccgcacggcaggcagcggatctggctgggaaccttcgagaccgccgagatggcggcgcgcgcgcacgacgtcgccgcgctggcgctgcgcggccgcgccgcgtgcctcaacttcgcggactcgccgcgcaggctccgcgtgcccgcgcagggcgcagggcacgacgagatacgccgcgccgcggtggaggccgccgagctgttccgccctccgcagcagcagcagcacaatgtgggtggttccgaggcggcggcggcggcggtcgctgcgccctgcgcacaggggagcggcggcggcggcatcggtggcgacttcgcttactacccgatggacgacgggctggagttcgaaatgcatgggtatcttgacatggcgcaggggatgctcgtcgacccgccgcaggcgaccgcgtggatcgaggacgagtacgaatgcgaggtcagtctttggagctactga

SEQ ID NO: 4232 - protein, 227 aa, Sorghum bicolor
  misc_feature: Ceres ANNOT ID no. 6035263
  misc_feature (56)..(107): Pfam Id: AP2 Pfam Desc: AP2 domain
  misc_feature (1)..(227): NCBI GI: 38605941 NCBI Desc: osjnba0019k04.2 [oryza sativa (japonica cultivar-group)]
  misc_feature (1)..(227): NCBI GI: 32455222 NCBI Desc: transcription factor [oryza sativa (japonica cultivar-group)]
  misc_feature (1)..(227): NCBI GI: 60547489 NCBI Desc: hvcbf11 [hordeum vulgare subsp. vulgare]
  misc_feature (1)..(227): NCBI GI: 60593403 NCBI Desc: tacbf11 [triticum aestivum]
  misc_feature (9)..(227): NCBI GI: 19071243 NCBI Desc: crt/dre binding factor 1 [hordeum vulgare subsp. vulgare]
  misc_feature: The plant flowers significantly late compared to wild-type.
  misc_feature: The plant is abnormally small.
  misc_feature: The sequence is a functional homolog of SEQ ID NO 102 in the 10/675,852US patent application
  misc_feature: The sequence is a functional homolog of SEQ ID NO 1223 in the 10/374,780US patent application
  misc_feature: The sequence is a functional homolog of SEQ ID NO 1225 in the 10/374,780US patent application
  misc_feature: The sequence is a functional homolog of SEQ ID NO 1226 in the 10/374,780US patent application
  misc_feature: The sequence is a functional homolog of SEQ ID NO 1227 in the 10/374,780US patent application
  misc_feature: The sequence is a functional homolog of SEQ ID NO 1232 in the 10/374,780US patent application
  misc_feature: The sequence is a functional homolog of SEQ ID NO 1239 in the 10/374,780US patent application
  misc_feature: The sequence is a functional homolog of SEQ ID NO 1245 in the 10/374,780US patent application
  misc_feature: The sequence is a functional homolog of SEQ ID NO 1314 in the 11/479,226US patent application
  misc_feature: The sequence is a functional homolog of SEQ ID NO 1412 in the 10/412,699US patent application
  misc_feature: The sequence is a functional homolog of SEQ ID NO 16 in the 10/225,068US patent application
  misc_feature: The sequence is a functional homolog of SEQ ID NO 186 in the 10/374,780US patent application
  misc_feature: The sequence is a functional homolog of SEQ ID NO 190 in the 11/375,241US patent application
  misc_feature: The sequence is a functional homolog of SEQ ID NO 194 in the 10/412,699US patent application
  misc_feature: The sequence is a functional homolog of SEQ ID NO 1940 in the 10/412,699US patent application
  misc_feature: The sequence is a functional homolog of SEQ ID NO 2204 in the 10/374,780US patent application
  misc_feature: The sequence is a functional homolog of SEQ ID NO 2245 in the 10/666,642US patent application
  misc_feature: The sequence is a functional homolog of SEQ ID NO 2278 in the 10/374,780US patent application
  misc_feature: The sequence is a functional homolog of SEQ ID NO 409 in the 11/479,226US patent application
  misc_feature: The sequence is a functional homolog of SEQ ID NO 428 in the 10/714,887US patent application
  misc_feature: The sequence is a functional homolog of SEQ ID NO 516 in the 11/435,388US patent application
  misc_feature: The sequence is a functional homolog of SEQ ID NO 566 in the 10/225,066US patent application
  misc_feature: The sequence is a functional homolog of SEQ ID NO 61 in the 10/838,616US patent application
  misc_feature: The sequence is a functional homolog of SEQ ID NO 616 in the 10/412,699US patent application
  misc_feature: The sequence is a functional homolog of SEQ ID NO 694 in the 11/435,388US patent application
  misc_feature: The sequence is a functional homolog of SEQ ID NO 696 in the 11/435,388US patent application
  misc_feature: The sequence is a functional homolog of SEQ ID NO 698 in the 11/435,388US patent application
  misc_feature: The sequence is a functional homolog of SEQ ID NO 700 in the 11/435,388US patent application
  misc_feature: The sequence is a functional homolog of SEQ ID NO 704 in the 11/435,388US patent application
  misc_feature: The sequence is a functional homolog of SEQ ID NO 706 in the 11/435,388US patent application
  misc_feature: The sequence is a functional homolog of SEQ ID NO 716 in the 11/435,388US patent application
  misc_feature: The sequence is a functional homolog of SEQ ID NO 718 in the 11/435,388US patent application
  misc_feature: The sequence is a functional homolog of SEQ ID NO 750 in the 11/435,388US patent application
  misc_feature: The sequence is a functional homolog of SEQ ID NO 76 in the 10/669,824US patent application
  misc_feature: The sequence is a functional homolog of SEQ ID NO 76 in the 10/870,198US patent application
  misc_feature: The sequence is a functional homolog of SEQ ID NO 764 in the 11/435,388US patent application
  misc_feature: The sequence is a functional homolog of SEQ ID NO 776 in the 11/435,388US patent application
  misc_feature: The sequence is a functional homolog of SEQ ID NO 778 in the 11/435,388US patent application
  misc_feature: The sequence is a functional homolog of SEQ ID NO 780 in the 11/435,388US patent application
  misc_feature: The sequence is a functional homolog of SEQ ID NO 782 in the 10/225,066US patent application
  misc_feature: Useful for making plants with altered terpenoid content
  misc_feature: Useful for making plants with modulated biomass
  misc_feature: Useful for making plants with modulated flowering time
  misc_feature: Useful for making plants with modulated growth and phenotype characteristics
  misc_feature: Functional homolog of the protein sequence given in SEQ ID NO 13195
  misc_feature: Functional homolog of the protein sequence given in SEQ ID NO 13196
  misc_feature: The sequence is a functional homolog of SEQ ID NO 1412 in the 20040045049 US patent application
  misc_feature: The sequence is a functional homolog of SEQ ID NO 194 in the 20040045049 US patent application
  misc_feature: The sequence is a functional homolog of SEQ ID NO 1940 in the 20040045049 US patent application
  misc_feature: The sequence is a functional homolog of SEQ ID NO 616 in the 20040045049 US patent application
  misc_feature: The sequence is a functional homolog of SEQ ID NO 1225 in the 20060162006 US patent application
  misc_feature: The sequence is a functional homolog of SEQ ID NO 1226 in the 20060162006 US patent application
  misc_feature: The sequence is a functional homolog of SEQ ID NO 1227 in the 20060162006 US patent application
  misc_feature: The sequence is a functional homolog of SEQ ID NO 1232 in the 20060162006 US patent application
  misc_feature: The sequence is a functional homolog of SEQ ID NO 1239 in the 20060162006 US patent application
  misc_feature: The sequence is a functional homolog of SEQ ID NO 1245 in the 20060162006 US patent application
  misc_feature: The sequence is a functional homolog of SEQ ID NO 694 in the 20060272060 US patent application
  misc_feature: The sequence is a functional homolog of SEQ ID NO 696 in the 20060272060 US patent application
  misc_feature: The sequence is a functional homolog of SEQ ID NO 698 in the 20060272060 US patent application
  misc_feature: The sequence is a functional homolog of SEQ ID NO 700 in the 20060272060 US patent application
  misc_feature: The sequence is a functional homolog of SEQ ID NO 704 in the 20060272060 US patent application
  misc_feature: The sequence is a functional homolog of SEQ ID NO 750 in the 20060272060 US patent application
  misc_feature: The sequence is a functional homolog of SEQ ID NO 776 in the 20060272060 US patent application
  misc_feature: The sequence is a functional homolog of SEQ ID NO 778 in the 20060272060 US patent application
  misc_feature: The sequence is a functional homolog of SEQ ID NO 780 in the 20060272060 US patent application
  misc_feature: Functional homolog of the protein sequence given in SEQ ID NO 13570
  misc_feature: Functional homolog of the protein sequence given in SEQ ID NO 13574
  misc_feature: The sequence is a functional homolog of SEQ ID NO 1223 in the 10/374,780 US patent application
  misc_feature: The sequence is a functional homolog of SEQ ID NO 1412 in the 10/412,699 US patent application
  misc_feature: The sequence is a functional homolog of SEQ ID NO 716 in the 11/435,388 US patent application
  misc_feature: The sequence is a functional homolog of SEQ ID NO 1232 in the 10/374,780 US patent application
  misc_feature: The sequence is a functional homolog of SEQ ID NO 718 in the 11/435,388 US patent application
  misc_feature: Useful for making plants with modulated water use efficiency
  misc_feature: Functional homolog of the protein sequence given in SEQ ID NO 13860
  misc_feature: The sequence is a functional homolog of SEQ ID NO 1239 in the 10/374,780 US patent application
  misc_feature: The sequence is a functional homolog of SEQ ID NO 764 in the 11/435,388 US patent application
  misc_feature: The sequence is a functional homolog of SEQ ID NO 1224 in the 10/374,780 US patent application
  misc_feature: The sequence is a functional homolog of SEQ ID NO 1413 in the 10/412,699 US patent application
  misc_feature: The sequence is a functional homolog of SEQ ID NO 710 in the 11/435,388 US patent application
  misc_feature: The sequence is a functional homolog of SEQ ID NO 1229 in the 10/374,780 US patent application
  misc_feature: Useful for making plants with modulated biomass
  misc_feature: Useful for making plants with modulated flowering time
  misc_feature: Functional homolog of the protein sequence given in SEQ ID NO 13574
  misc_feature: The sequence is a functional homolog of SEQ ID NO 692 in the 11/435,388 US patent application
  misc_feature: The sequence is a functional homolog of SEQ ID NO 4 in US patent 7317141
  misc_feature: The sequence is a functional homolog of SEQ ID NO 750 in the 11/435,388 US patent application
  misc_feature: The sequence is a functional homolog of SEQ ID NO 1245 in the 10/374,780 US patent application
  misc_feature: The sequence is a functional homolog of SEQ ID NO 776 in the 11/435,388 US patent application
  misc_feature: The sequence is a functional homolog of SEQ ID NO 1248 in the 10/374,780 US patent application
MDWAYYGISGYSTTPSPPPVGVGGGVGDEDEAYMTVSSAPPKRRAGRTKFKETRHPVYKGVRSRNPGRWVCEVREPHGRQRIWLGTFETAEMAARAHDVAALALRGRAACLNFADSPRRLRVPAQGAGHDEIRRAAVEAAELFRPPQQQQHNVGGSEAAAAAVAAPCAQGSGGGGIGGDFAYYPMDDGLEFEMHGYLDMAQGMLVDPPQATAWIEDEYECEVSLWSY

SEQ ID NO: 4233 - DNA, 942 bp, Sorghum bicolor
  misc_feature: Ceres ANNOT ID no. 6035269
  misc_feature: Encodes the peptide sequence at SEQ ID NO 4234
atgggggtgggggcgtcgacgagcgtggtggcgccggaggggtacggccgcggccgggggtgggggcagacgtcgctgggcgacatgcccgagagctgcgtcgcggcggtgctgctctacctcgacccggctgagatctgccaggtggcctgcctcaaccgggcgttccggggcgcggcctctgccgactgcatctgggccgccaagttgcccgccaactacaggtacctcgccgcactcgcggccgcggccgacgacgacgacgactgcggttgcggtggcgcggccgaaggcgatgatggcaggtgctgctcctccgcggcgatcaagaaggagatatacgcgcgcctctgccggcctactccgttcgacggtggcaccaaggaattttggatcgagaagaacaagggaggtttctgcatgtccatttcctcaaaggctatgtcaatcacagggcgagacgataggaggtattggagccacctatccacagaggaatcaagatttcacagcgttgcctatctccagcagatttggtggcttgaggtaggtggggagattgatttctgctttcctgctggttcatacagcctattcttccggctccatttgggcagaccgcacaagcggatgggccgccgaggccatggatctgagaatatccacggttgggacatcagaccgacacggttccagctctcaacttcagatgatcagcacactgtatctgagtcttatctaattaaccctggaagatggatcctttaccacgtcggtgatttcgtcatatcgagttctgacgaggtgacagaactcaagttctctatgatgcagattgattgtacgcatacaaaaggcggcctgtgtgttgattcagtctatatataccccaaagatcttgaatttgaggaggactgcgtattctgccagcaaattttgtag

SEQ ID NO: 4234 - protein, 313 aa, Sorghum bicolor
  misc_feature: Ceres ANNOT ID no. 6035269
  misc_feature (24)..(71): Pfam Id: F-box Pfam Desc: F-box domain
  misc_feature (1)..(310): NCBI GI: 116310025 NCBI Desc: osigba0127a14.1 [oryza sativa (indica cultivar-group)]
  misc_feature (29)..(310): NCBI GI: 38567911 NCBI Desc: osjnba0088i22.7 [oryza sativa (japonica cultivar-group)]
  misc_feature (3)..(304): NCBI GI: 50253258 NCBI Desc: f-box protein-like [oryza sativa (japonica cultivar-group)]
  misc_feature (65)..(300): NCBI GI: 115480249 NCBI Desc: os09g0525300 [oryza sativa (japonica cultivar-group)]
  misc_feature (109)..(299): NCBI GI: 42572749 NCBI Desc: f-box family protein / lectin-related [arabidopsis thaliana]
MGVGASTSVVAPEGYGRGRGWGQTSLGDMPESCVAAVLLYLDPAEICQVACLNRAFRGAASADCIWAAKLPANYRYLAALAAAADDDDDCGCGGAAEGDDGRCCSSAAIKKEIYARLCRPTPFDGGTKEFWIEKNKGGFCMSISSKAMSITGRDDRRYWSHLSTEESRFHSVAYLQQIWWLEVGGEIDFCFPAGSYSLFFRLHLGRPHKRMGRRGHGSENIHGWDIRPTRFQLSTSDDQHTVSESYLINPGRWILYHVGDFVISSSDEVTELKFSMMQIDCTHTKGGLCVDSVYIYPKDLEFEEDCVFCQQIL

SEQ ID NO: 4235 - DNA, 1764 bp, Sorghum bicolor
  misc_feature: Ceres ANNOT ID no. 6035282
  misc_feature: Encodes the peptide sequence at SEQ ID NO 4236
atggggctcctcagctccctgccgccccaccgccggggcgccttatcgggcggcgggtggcagtggtccttcctcgacgtcgtctggggggtcttcctcatcgccgtggtcgtcttcctcgcgctcgtcttcacgccgcgccgcggggaccccgtcctaaccgccgcctccgtcgcccgcgccggcggtagcggcggcgcggtgccgccgtgcgccgcctcggaggtggacctcctcccctgcgaggacccgcgccgcagctcccgcctcagccgcgagatgaactactaccgcgagcgccactgcccggctcgtggcgaggcgctcgcgtgccttgtgccgccgccccgtggctaccgcgttcccgtaccctggcccgagagcctccacaagatctggcatgacaacatgccttatggtaagattgctgaaagaaaaggtcatcaagggtggatgaagcatgaaggttcgtacttcatttttcctggtggtgggactatgttccctgacggagctgaacaatatattgaaaagcttagccagtatgttccactgaaaactggtgtcgtcaggacaggtcttgatatgggatgcggggttgctagcttcggtggatttttgcttaaagagaatatcatgacactttcatttgcaccaagagattcgcataagtctcaaatacaatttgccttggagagaggaattccagcatttcttttgatgttgggcacacgccgtcttccttttccagcacagtcctttgattttgtccattgttcccggtgtttgataccttttactacactggcagatggatcttacttgattgaagctgaccgtctacttaggcctgggggctatctaatcatatcgggcccccctgtgagatggaagaatcaggagaaggaatgggatgaacttcaagcaatggcaggagctttgtgttacaaattgatcactgtagatggtaatactgccatttggaagaaacctgctgaagcttcatgtcttcctaaccaaaatggatttggccttgatctgtgtagcaccaatgacgatccagatgaagcatggtacttcaagttgaataaatgtgtcggtaaagtttccatgtcggaagagatagctataggttctgttcccaggtggccagataggctgtctaaaccttctgctagggcatcagttatcaacaatggagcaagcttgtttgaagtagatagtcagaagtgggttaggagagtggcatattataaaaaatcacttggcgtgaagcttgggagcacacacatacgcaatgtcatggacatgaatgcattctttggaggattcgcagccgctatagtgtctgatcctgtatgggttatgaatgttgttcctgctcagaagccattgacacttggagttatttatgataggggccttattggggtttatcatgactggtgtgaaccattctcaacatatcctcgtacttacgatctcattcatgctgatgcaattgactccttgataagtgacccgatttcaggcactagcagatgtgacctgtttgatgtcatgttggagatggaccgcatactgcgcccagaaggaactgccgtaatacgggcctccccagatgtggtagacaaggcagcacagattgctcggtcgattcggtggaaggcccaggtgcatgacagtgaaccagaatcaggtagtaccgagaaaatacttgtggctacgaaaacattttggaagctaccactaacatcacaatag

SEQ ID NO: 4236 - protein, 587 aa, Sorghum bicolor
  misc_feature: Ceres ANNOT ID no. 6035282
  misc_feature (194)..(290): Pfam Id: Methyltransf_11 Pfam Desc: Methyltransferase domain
  misc_feature (1)..(585): NCBI GI: 116310010 NCBI Desc: osigba0139p06.9 [oryza sativa (indica cultivar-group)]
  misc_feature (1)..(585): NCBI GI: 38344378 NCBI Desc: osjnbb0032e06.12 [oryza sativa (japonica cultivar-group)]
  misc_feature (131)..(563): NCBI GI: 115459994 NCBI Desc: os04g0569400 [oryza sativa (japonica cultivar-group)]
  misc_feature (71)..(580): NCBI GI: 50253255 NCBI Desc: dehydration-responsive family protein-like [oryza sativa (japonica cultivar-group)]
  misc_feature (69)..(587): NCBI GI: 92886308 NCBI Desc: generic methyltransferase [medicago truncatula]
  misc_feature: The sequence is a functional homolog of SEQ ID NO 354 in the 10/374,780US patent application
  misc_feature: The sequence is a functional homolog of SEQ ID NO 72 in the 10/225,068US patent application
  misc_feature: The sequence is a functional homolog of SEQ ID NO 910 in the 10/225,066US patent application
  misc_feature: Useful for making plants with modulated growth and phenotype characteristics
  misc_feature: The sequence is a functional homolog of SEQ ID NO 72 in the 20050120408 US patent application
  misc_feature: The sequence is a functional homolog of SEQ ID NO 354 in the 10/374,780 US patent application
  misc_feature: The sequence is a functional homolog of SEQ ID NO 72 in the 10/225,068 US patent application
  misc_feature: The sequence is a functional homolog of SEQ ID NO 910 in the 10/225,066 US patent application
MGLLSSLPPHRRGALSGGGWQWSFLDVVWGVFLIAVVVFLALVFTPRRGDPVLTAASVARAGGSGGAVPPCAASEVDLLPCEDPRRSSRLSREMNYYRERHCPARGEALACLVPPPRGYRVPVPWPESLHKIWHDNMPYGKIAERKGHQGWMKHEGSYFIFPGGGTMFPDGAEQYIEKLSQYVPLKTGVVRTGLDMGCGVASFGGFLLKENIMTLSFAPRDSHKSQIQFALERGIPAFLLMLGTRRLPFPAQSFDFVHCSRCLIPFTTLADGSYLIEADRLLRPGGYLIISGPPVRWKNQEKEWDELQAMAGALCYKLITVDGNTAIWKKPAEASCLPNQNGFGLDLCSTNDDPDEAWYFKLNKCVGKVSMSEEIAIGSVPRWPDRLSKPSARASVINNGASLFEVDSQKWVRRVAYYKKSLGVKLGSTHIRNVMDMNAFFGGFAAAIVSDPVWVMNVVPAQKPLTLGVIYDRGLIGVYHDWCEPFSTYPRTYDLIHADAIDSLISDPISGTSRCDLFDVMLEMDRILRPEGTAVIRASPDVVDKAAQIARSIRWKAQVHDSEPESGSTEKILVATKTFWKLPLTSQ

SEQ ID NO: 4237 - DNA, 1023 bp, Sorghum bicolor
  misc_feature: Ceres ANNOT ID no. 6035283
  misc_feature: Encodes the peptide sequence at SEQ ID NO 4238
atgtcgcacgccgacgtggaggcgggcgccccggcagcgagggcggcgccaccggcgacgacggggatcaagccgccgccggggcggtacaacacgaccagcaacgcgccgtacgtgcagccgtcgccgttctactacgaccacgcggcggcgcacgagcggcaccactggtcgtggctggtgccgctggtggtgatcgccaacgtcgccatgttcgtggtggtcatgttctacaacaactgcccgcgcggcggcggcgactgcgtcggccgcggcttcctccgccgcttctccttccagccgctcaaggagaacccgctcctcggcccgacggccgccacgctgcagaagtacggagccctcgactggtacaaggtggtgcacgggaaccaggcgtggcggctggagtcctgcacctggctgcacgccggcctcatccacctgctcgccaacatgatcagcctcatcttcatcggcgtccgcctggagcagcagtttggattctggagggtggggctggtgtacctcgtctccggcttcggcgggagcgtgctctccgtcctcttcatcaggaagggcgtctccgtgggagcctccggcgcgctcttcggcctcctgggagcgatgctgtcggagctcatcaccaactggtccatctacaccaacagatttgcagccatgttgaacctgatcatcatcgccgccatcaacctggcgctcgggatactcccgcacgtcgacaacttcgcgcacatcggcgggttcgcgacgggcttcctgctcggcttcgtgctgctgatccagccccagttcgggtggcttgagcagccctatggatccaagaccaagtccaagtacaaggcatatcagatcattctcctgattgctgccctggtcttgctggctgcagggcttgctgttggattggtcatggtgtttagaggagagaacggcaacgatcactgcggctggtgccactacctcacctgtgtgccgacgtcaagctggaagtgtgacaattga

SEQ ID NO: 4238 - protein, 340 aa, Sorghum bicolor
  misc_feature: Ceres ANNOT ID no. 6035283
  misc_feature (126)..(270): Pfam Id: Rhomboid Pfam Desc: Rhomboid family
  misc_feature (1)..(339): NCBI GI: 116310009 NCBI Desc: osigba0139p06.8 [oryza sativa (indica cultivar-group)]
  misc_feature (1)..(339): NCBI GI: 38344377 NCBI Desc: osjnbb0032e06.11 [oryza sativa (japonica cultivar-group)]
  misc_feature (45)..(339): NCBI GI: 294845 NCBI Desc: membrane protein [saccharum hybrid cultivar h65-7052]
  misc_feature (57)..(340): NCBI GI: 20466143 NCBI Desc: at5g07250/t28j14_190 [arabidopsis thaliana]
  misc_feature (57)..(338): NCBI GI: 9502383 NCBI Desc: t12c24.28 [arabidopsis thaliana]
  misc_feature: Useful for making plants with altered cell wall content and/or composition
  misc_feature: Functional homolog of the protein sequence encoded by LOCUS at1g12750
MSHADVEAGAPAARAAPPATTGIKPPPGRYNTTSNAPYVQPSPFYYDHAAAHERHHWSWLVPLVVIANVAMFVVVMFYNNCPRGGGDCVGRGFLRRFSFQPLKENPLLGPTAATLQKYGALDWYKVVHGNQAWRLESCTWLHAGLIHLLANMISLIFIGVRLEQQFGFWRVGLVYLVSGFGGSVLSVLFIRKGVSVGASGALFGLLGAMLSELITNWSIYTNRFAAMLNLIIIAAINLALGILPHVDNFAHIGGFATGFLLGFVLLIQPQFGWLEQPYGSKTKSKYKAYQIILLIAALVLLAAGLAVGLVMVFRGENGNDHCGWCHYLTCVPTSSWKCDN

SEQ ID NO: 4239 - DNA, 1143 bp, Sorghum bicolor
  misc_feature: Ceres ANNOT ID no. 6035289
  misc_feature: Encodes the peptide sequence at SEQ ID NO 4240
atggcgacgccccgctctccgagcccccgtgccgacgcgcccctcgattccgcgccgctgctgggcggtgcctccggcggcgggagccgtcgccgaggcggagcgctccgccggccctccctccgcggcgcggcgcggctgctgcgccgcggcgggcggcgggccatgcgggaaccctcggtgctggtgcgggaggcagccgcagagcacctcgaggagcggcaggctgactgggcctactcccgccccgtcgtggcgctcgacctgctctggaacctcgccttcatcacggtcgccgcggtcgtgctcgtgctcagccgcgacgaggactcgcccatgccgctccggacctgggtcgccggctacgccctgcagtgcgtcgtacacatggtctgcgtcgcaatcgagtaccggatgcgccacggccagggcggcggcgccggcgccgcgcccactgacgaggaaaggggcagcgacggatcgtcctcgtccagcgacgacgatgacagggagttcgatcgccatggtcgccgcaccgattacgccagtattgcaaagcacttggagtctgctaatacaatgttctccttcatatggtggataattggattttattggatatctgctgggggtgaagaggttatccgggatgcacctcaactttactggctttgcatagtctttctggcatttgatgtgttttttgttgtattctgcgttgctctggcttgtatcattggtattgctgtctgttgttgccttccttgtatcatagcaattctctatgcagtatctgaccaggaaggagcatctgaagatgacattcgtcaaatcccaagatacaaatttcggcggaccgacgagcctgaaaagcaagatgttgaccccatgggtccttttggtggaataatgacagagtgcggcaccaatcaacctattgagaaagtgcttgcagctgaggatgcagagtgttgtatttgcctatcggcttatgatgatggtgcagagttgcgcgaactcccctgtgggcaccatttccactgcacctgcatcgacaagtggcttcacatcaatgcaacatgccccctgtgcaagtacaacattcggaaaagcagcagtagcagtggaagtgaagaagtttga

SEQ ID NO: 4240 - protein, 380 aa, Sorghum bicolor
  misc_feature: Ceres ANNOT ID no. 6035289
  misc_feature (324)..(364): Pfam Id: zf-C3HC4 Pfam Desc: Zinc finger, C3HC4 type (RING finger)
  misc_feature (56)..(380): NCBI GI: 38344371 NCBI Desc: osjnbb0032e06.5 [oryza sativa (japonica cultivar-group)]
  misc_feature (56)..(380): NCBI GI: 116310006 NCBI Desc: osigba0139p06.5 [oryza sativa (indica cultivar-group)]
  misc_feature (73)..(380): NCBI GI: 115459986 NCBI Desc: os04g0568900 [oryza sativa (japonica cultivar-group)]
  misc_feature (1)..(338): NCBI GI: 115447875 NCBI Desc: os02g0674700 [oryza sativa (japonica cultivar-group)]
  misc_feature (16)..(380): NCBI GI: 16604388 NCBI Desc: at1g63170/f16m19_7 [arabidopsis thaliana]
  misc_feature: The sequence is a functional homolog of SEQ ID NO. 329 in the 11/188,298 US application
  misc_feature: The sequence is a functional homolog of SEQ ID NO. 271 in the 11/188,298 US application
  misc_feature: The sequence is a functional homolog of SEQ ID NO. 350 in the 11/188,298 US application
MATPRSPSPRADAPLDSAPLLGGASGGGSRRRGGALRRPSLRGAARLLRRGGRRAMREPSVLVREAAAEHLEERQADWAYSRPVVALDLLWNLAFITVAAVVLVLSRDEDSPMPLRTWVAGYALQCVVHMVCVAIEYRMRHGQGGGAGAAPTDEERGSDGSSSSSDDDDREFDRHGRRTDYASIAKHLESANTMFSFIWWIIGFYWISAGGEEVIRDAPQLYWLCIVFLAFDVFFVVFCVALACIIGIAVCCCLPCIIAILYAVSDQEGASEDDIRQIPRYKFRRTDEPEKQDVDPMGPFGGIMTECGTNQPIEKVLAAEDAECCICLSAYDDGAELRELPCGHHFHCTCIDKWLHINATCPLCKYNIRKSSSSSGSEEV

SEQ ID NO: 4241 - DNA, 2088 bp, Sorghum bicolor
  misc_feature: Ceres ANNOT ID no. 6035294
  misc_feature: Encodes the peptide sequence at SEQ ID NO 4242
  misc_feature: Down-regulated in shoot tissues in response to salicylic acid treatment
atggaggggtgccaactgctagtaggctgtaggattgagatggaggaggaagcgttctttgactcgcgagaggagctcacggcgtcgccggcgcccagcccgggccctgcattgccgtggtcgggaagcctcgacagtgtgtgccagaggagggagcggttcatgagaagcatgggcctagagtgctgcccggctcccccgcaggccgatgccgtggccaccgtgggcgatgtcgagaaggaggaggttgtgccggaatttgggaggttgtggtcgcagtcggatgagaatgactgctccatgtcgagttggtccacggaggagacggggagctccgtggatggtgtctcggatgacaattctgtcagtggatccagccgggatgatgctagcagcaaggtgagcaggagtttcagttcgttgtccttcatccagaggctcatgagccgcagtggtaagctctctggtgtgcccaaggcgattgagaggagaagaaacggatggcttcggaggctgggcttgagggctggtatcctcgatcatggagctgatgaagctagcaccagctcctcagagagtgagcaaaacaggggtggaaggtacgaaagggtcaaggtccgctgctacaggaagtggtcgaaagaattgtcagcagtttatcaaggccaagtgatcaagggccatgatggggccatcctgactatgaagtttagtccggatgggcagtttcttgcaagtggaggcgaagatggagttgttagggtctgggctgtcacacagtctgaggactgcaaaattcccgtggatgatccttcttgtgtttacctcaaagctcatcgccagagtggcttggctcctgttgttgctgacaatgagaagaaatgcaaagtcaagggcgtgaagcaatctgcagattctgcttgtgttgtgattccaacaatggtgttccagatctcagaggaaccattgcatgagttctgtggccactctggtgatgtactgtgtctgtcgtggtctgacaacaagcatctactgtcagcatcaacagacaaaactgttcgcttgtgggaaataggatctgcaaactgcatcactgtttttccacacagcaactttgtgacttgtgtccagttcaatccaaccaatgagaatcgattcatcagtggatcaatagatggcaaaatccgtgtatgggatattcccagatgtagtgtcattgattgggtggatattagagacataataacagcggtttgctatcgacctgatggaaagggagcagtggttggaaccattactggaaattgtcggttttatgatgcatcagataatctgctgaggcttgagacacaaattgcactcagtggcaagaagaagtcttctcttaaaagaatcactgcttttgagttctccccaagcaacccaagtaaattaatggttacctctgctgactcgaagatcaaaattcttgatggaaccgttgtgactcagaattatagtggactccgaactggctcttgccagtcattggcaacattcactcctgatgggcagcatatagtttctgctagcgaagactccaatatttatgtatggaaccatgaaaaccaagatgagccttcactgaaacatgcaaaaaccatatggtcctcagagcgcttccactccaacaatgcagccatcgcaataccatggaatggccaaaaacccagaaaccctgtctctttggcctctcaaattttgtcaccgcaaggagataacttctggtgcatgagtaaggctgtgaagtgcagttcaagtcgcagtgaagattctgctattaatagttttgtgtcaagatttgctcctggtattttcaatttgaatcaggagttctcctctgagtccacttgcagaagttcagcaacctggccagaggaaattctgccttctcgttcaattcgtgcaattttggatgagtcacagtacaagttcctaaggaactgtttccagaccacaccaaactcctggggtcaagtgatagttactgcaggatgggacggcaagattaggtcgttccagaattatggcttaccagcgcatcagtga

SEQ ID NO: 4242 - protein, 695 aa, Sorghum bicolor
  misc_feature: Ceres ANNOT ID no. 6035294
  misc_feature (219)..(257): Pfam Id: WD40 Pfam Desc: WD domain, G-beta repeat
  misc_feature (320)..(357): Pfam Id: WD40 Pfam Desc: WD domain, G-beta repeat
  misc_feature (361)..(399): Pfam Id: WD40 Pfam Desc: WD domain, G-beta repeat
  misc_feature (1)..(695): NCBI GI: 115459978 NCBI Desc: os04g0568400 [oryza sativa (japonica cultivar-group)]
  misc_feature (12)..(695): NCBI GI: 116309815 NCBI Desc: osigba0103m18.5 [oryza sativa (indica cultivar-group)]
  misc_feature (12)..(695): NCBI GI: 38344367 NCBI Desc: osjnbb0032e06.1 [oryza sativa (japonica cultivar-group)]
  misc_feature (101)..(609): NCBI GI: 92898868 NCBI Desc: wd-40 repeat [medicago truncatula]
  misc_feature (115)..(570): NCBI GI: 30689405 NCBI Desc: wd-40 repeat family protein [arabidopsis thaliana]
  misc_feature: Useful for making plants with altered cell wall content and/or composition
  misc_feature: GREAT-hit functional homolog of the protein sequence encoded by LOCUS at5g53500
  misc_feature: Useful for making plants with altered cell wall content and/or composition
  misc_feature: Functional homolog of the protein sequence given in SEQ ID NO 13859
  misc_feature: Down-regulated in shoot tissues in response to salicylic acid treatment
  misc_feature: The sequence is a functional homolog of SEQ ID NO. 502 in the 11/188,298 US application
  misc_feature: The sequence is a functional homolog of SEQ ID NO. 485 in the 11/188,298 US application
MEGCQLLVGCRIEMEEEAFFDSREELTASPAPSPGPALPWSGSLDSVCQRRERFMRSMGLECCPAPPQADAVATVGDVEKEEVVPEFGRLWSQSDENDCSMSSWSTEETGSSVDGVSDDNSVSGSSRDDASSKVSRSFSSLSFIQRLMSRSGKLSGVPKAIERRRNGWLRRLGLRAGILDHGADEASTSSSESEQNRGGRYERVKVRCYRKWSKELSAVYQGQVIKGHDGAILTMKFSPDGQFLASGGEDGVVRVWAVTQSEDCKIPVDDPSCVYLKAHRQSGLAPVVADNEKKCKVKGVKQSADSACVVIPTMVFQISEEPLHEFCGHSGDVLCLSWSDNKHLLSASTDKTVRLWEIGSANCITVFPHSNFVTCVQFNPTNENRFISGSIDGKIRVWDIPRCSVIDWVDIRDIITAVCYRPDGKGAVVGTITGNCRFYDASDNLLRLETQIALSGKKKSSLKRITAFEFSPSNPSKLMVTSADSKIKILDGTVVTQNYSGLRTGSCQSLATFTPDGQHIVSASEDSNIYVWNHENQDEPSLKHAKTIWSSERFHSNNAAIAIPWNGQKPRNPVSLASQILSPQGDNFWCMSKAVKCSSSRSEDSAINSFVSRFAPGIFNLNQEFSSESTCRSSATWPEEILPSRSIRAILDESQYKFLRNCFQTTPNSWGQVIVTAGWDGKIRSFQNYGLPAHQ

SEQ ID NO: 4243 - DNA, 2043 bp, Sorghum bicolor
  misc_feature: Ceres ANNOT ID no. 6035319
  misc_feature: Encodes the peptide sequence at SEQ ID NO 4244
  misc_feature: Up-regulated in shoot tissues in response to methyl jasmonate treatment
  misc_feature: Up-regulated in shoot tissues in response to salicylic acid treatment
atgggcgaccttgctgatctcgggggtgctggcgagtcggcgcgttcgcatgtcgccgccgccggcggcggcggccagcgggacaggctggcggcgctgctggagctcgcggcggccgacgacgccgtggggttccgcgaggctctcgcggtgggaggcgcccagggcaacttagcggagctggcggacggagtggggctgtggtatggccggagcaaggcgtacgagccgcgcacgccgctgatggtcgcggcgacttacggcagcgtggaggtggtgtcgctgctgctcggcctcggatgtgtcgacgtcaaccggcgccctggcgtcgacggcgccaccccgctgcactgcgccgcctccggcggctcgcggaacgccgtggccgtcgtcaagctactcctggctgctggcgccgacccggtaacccccgactccgccggtcgcttgcctgcagacgtcatcttgtctccccctgcttcgcccgacgccttgggcgatctggagatgctccttggccgccgccgagggctcgctgtggcgacctcggtaccatcgcgctcgtcgtccccgccgctctcgtcctcgccggatgagggcaacaggtcgccatcctcgcggtcgtcttcgctgtccccgattaccgtggaccgtgccaagaaggagtacccggtggatccgacgctgcccgacatcaagagcagcgtgtatgcgtccgacgagttccgcatgttcgcgttcaaggtgcgcccatgctccagggcctactcgcatgactggacagagtgtccattcgtgcaccctggcgagaacgcccgtcgccgggaccctcgcaagcacccatacacggccgtgccctgccccaacttccgccgccctggtggctgccccagcggtgatagctgcgagttctcccatggtgtcttcgagagctggctccacccgtcgcagtaccgcacaaggctctgcaaggagggcgcagcttgtgcccgccgcatctgcttcttcgcccatgatgaagatgagctccgccatgtgcctcacaataatggtgcaggtctgctgtctccccgtgcctcttcatccattgacatgactgctgctgctgctcttgggcttctacctggatctcctactaggcactttgtgccaccaccgctgtcaccatctgccgccaacaatggtggaggtgctgctgctgctcattggctccaaggcagcaggctacgatcttctttcaatgcaagggatgcacaggttgatgaccttggcgcgctcctggaatgggaatcacaataccttggagcgctcagcctcccacaaagcagccgatcccagccccgtctttctactggtctgagtattcgtccaacaggaattgctccatccaaccttgaagagatgtatgcttcagacatggctatgtcgccaaggttcaccaatgaccaaggtcactcagtctactcaccagcacacaaatcagcccttctaaacaagtttcatcatcagcaaaagggccttttgtcgcctgtcaataccaacaggatgtactcacctaggggtcttgatccatcaattctccattatccatatggtggcatgtctcctcggtcccctcggactatggagccaacatctcccctaagtgtctgtgttggagcaactgttacacagcgtgatatgttggatcagttctcttcactgaataagcatcaagtgccatctgtgggatcgccacggaaccttaatgcctcatggggcaacattggtaccccaaagagtaaggtcgactggggtgttgacgacgacgaactagtccgtttgaggcaccctgtgcaacctggaaatacagcagaggagccagatgtgtcttgggtgcagtcactggtgaaccatgctgagctgaatggcaagaggggtgaaatggcaggtatggcttctcgatcgattaacaggcctgacctgagcagtcagggtgactcactggatcagagtgttattgcttcttggcttgagcagcagatgcacttggagccgaagtaa

SEQ ID NO: 4244 - protein, 680 aa, Sorghum bicolor
  misc_feature: Ceres ANNOT ID no. 6035319
  misc_feature (111)..(146): Pfam Id: Ank Pfam Desc: Ankyrin repeat
  misc_feature (282)..(308): Pfam Id: zf-CCCH Pfam Desc: Zinc finger C-x8-C-x5-C-x3-H type (and similar)
  misc_feature (31)..(678): NCBI GI: 7630041 NCBI Desc: zinc finger transcription factor-like protein [arabidopsis thaliana]
  misc_feature (31)..(678): NCBI GI: 22136426 NCBI Desc: zinc finger transcription factor-like protein [arabidopsis thaliana]
  misc_feature (377)..(657): NCBI GI: 46367690 NCBI Desc: zf protein [oryza sativa (japonica cultivar-group)]
  misc_feature (28)..(405): NCBI GI: 124360202 NCBI Desc: zinc finger, ccch-type [medicago truncatula]
  misc_feature (28)..(599): NCBI GI: 140039408 NCBI Desc: zinc finger, ccch-type [medicago truncatula]
  misc_feature: Up-regulated in shoot tissues in response to methyl jasmonate treatment
  misc_feature: Up-regulated in shoot tissues in response to salicylic acid treatment
MGDLADLGGAGESARSHVAAAGGGGQRDRLAALLELAAADDAVGFREALAVGGAQGNLAELADGVGLWYGRSKAYEPRTPLMVAATYGSVEVVSLLLGLGCVDVNRRPGVDGATPLHCAASGGSRNAVAVVKLLLAAGADPVTPDSAGRLPADVILSPPASPDALGDLEMLLGRRRGLAVATSVPSRSSSPPLSSSPDEGNRSPSSRSSSLSPITVDRAKKEYPVDPTLPDIKSSVYASDEFRMFAFKVRPCSRAYSHDWTECPFVHPGENARRRDPRKHPYTAVPCPNFRRPGGCPSGDSCEFSHGVFESWLHPSQYRTRLCKEGAACARRICFFAHDEDELRHVPHNNGAGLLSPRASSSIDMTAAAALGLLPGSPTRHFVPPPLSPSAANNGGGAAAAHWLQGSRLRSSFNARDAQVDDLGALLEWESQYLGALSLPQSSRSQPRLSTGLSIRPTGIAPSNLEEMYASDMAMSPRFTNDQGHSVYSPAHKSALLNKFHHQQKGLLSPVNTNRMYSPRGLDPSILHYPYGGMSPRSPRTMEPTSPLSVCVGATVTQRDMLDQFSSLNKHQVPSVGSPRNLNASWGNIGTPKSKVDWGVDDDELVRLRHPVQPGNTAEEPDVSWVQSLVNHAELNGKRGEMAGMASRSINRPDLSSQGDSLDQSVIASWLEQQMHLEPK

SEQ ID NO: 4245 - DNA, 1857 bp, Sorghum bicolor
  misc_feature: Ceres ANNOT ID no. 6035331
  misc_feature: Encodes the peptide sequence at SEQ ID NO 4246
atgttgccgcgcacgcactcccaccaggcgcggcggcgctccggcctgggcccgcagctctgcgccgctgcggccgcgctcctgctgctcctctccctcgccgtcctccactcgcgcctctcctcctcgtcctcctcccgcttccccacatccgcctcccgctcccgctcctccacgcccgccgccgactccaacaactcctccgctctcctcgccgacgaggaggacgaggacgtggccgccgcgctcgacccgctgctcaccgtcgccaccaccactgccgccgccaccgagggcgattctctcgccaacgccgacgacgatcgcatcgatgagctcgacgtgttggacgaggacgccgtgggcgccgacgcggccgactccgcctccgcctctacggcgggagccgccacacccctcgtctgggaccacgtcgccggcgccgctcgcctgccgttccgcctccccgcctccggccaatccctgcccgcggggctgccgcgcctcgactccccgcgtcggatagccgccgcggccttcggatcggacgacgagctggtggatctggaactgcgggtcgagatctcgtccatcgccggtatcgaggacgcgctgctcctgaagcccgcctctggtaaggccgccgagacgcggctccgcgtcgggtgggcgcgctggcttgaggggaaggccgactacctacggcgcgatcggatgctccgctccaacctggagtccctcaatccgcgcaaccacccgctgctccaggatccggacagccccggcctcacctctctcaccaaaggcgaccgcatggtgcagcgaatgctactggccgagctcgacaagcccgcgtccaagagctttgagcggcgtaggcttctatcttccgagaacaagcagagcatgggaacaactatgaaggagaagccgcagaagggaaggaggtggggatatttcccgggggttgatccacatttgggattctcagagttcatggagaggttcttcgagcatgggaagtgctccatgagggtgttcatggtgtggaacagcccacagtgggcctatggcatcaggcaccagaggggattggagagtctactcaagcagcacccagatgcctgtgtagtcatgctatcggagacactggagctagaatccttcgagcaattcgtcaaggaaggatataaagttgctgttgcgttgccaaatcttgatgaacttttggaaagcagtccagctcatgtatttgcatcagtgtggtatgaatggcggcagacaaaatattaccatttgcactacagtgagctagtacgccttgctgctctttacagatatggtggaatataccttgactctgatgttattgtacttaaacctttaacatcgctccggaattctattggtgctacaaatcatgtctctggaaattccagttttggtgctgctgtgttagcatttgaaaaacagagccctttattggaggagtgccttaaggaattttattcgacatatgatgataccctcatgcagtggaatggggctgaacttatgacaagagtgataagcaatctttctagcaaagcagatgaaaatagggggtatcttgacattaagttggagccctctgtgaaattttaccctataagctctactgacattatacgatatttctcagagccagataatatggtcgaaaaaacacatcatgatgcaatcttttctaggatcgtgaatgactctatcactttccatttttggaatggcatcacgtctgcactggtgcctgaacccagcagtgttgtttcgaaaatccttaaccgttactgcatccgttgccttgatgttttatag

SEQ ID NO: 4246 - protein, 618 aa, Sorghum bicolor
  misc_feature: Ceres ANNOT ID no. 6035331
  misc_feature (486)..(619): Pfam Id: Gb3_synth Pfam Desc: Alpha 1,4-glycosyltransferase conserved region
  misc_feature (397)..(486): Pfam Id: Gly_transf_sug Pfam Desc: Glycosyltransferase sugar-binding region containing DXDmotif
  misc_feature (1)..(559): NCBI GI: 115472843 NCBI Desc: os07g0567300 [oryza sativa (japonica cultivar-group)]
  misc_feature (100)..(618): NCBI GI: 85719350 NCBI Desc: glycosyltransferase sugar-binding region containing dxd motif; alpha 1,4-glycosyltransferase conserved region [medicago truncatula]
  misc_feature (284)..(614): NCBI GI: 115459564 NCBI Desc: os04g0529700 [oryza sativa (japonica cultivar-group)]
  misc_feature (342)..(614): NCBI GI: 140042948 NCBI Desc: glycosyltransferase sugar-binding region containing dxd motif; alpha 1,4-glycosyltransferase conserved region [medicago truncatula]
  misc_feature (342)..(614): NCBI GI: 145360743 NCBI Desc: transferase/ transferase, transferring glycosyl groups [arabidopsis thaliana]
MLPRTHSHQARRRSGLGPQLCAAAAALLLLLSLAVLHSRLSSSSSSRFPTSASRSRSSTPAADSNNSSALLADEEDEDVAAALDPLLTVATTTAAATEGDSLANADDDRIDELDVLDEDAVGADAADSASASTAGAATPLVWDHVAGAARLPFRLPASGQSLPAGLPRLDSPRRIAAAAFGSDDELVDLELRVEISSIAGIEDALLLKPASGKAAETRLRVGWARWLEGKADYLRRDRMLRSNLESLNPRNHPLLQDPDSPGLTSLTKGDRMVQRMLLAELDKPASKSFERRRLLSSENKQSMGTTMKEKPQKGRRWGYFPGVDPHLGFSEFMERFFEHGKCSMRVFMVWNSPQWAYGIRHQRGLESLLKQHPDACVVMLSETLELESFEQFVKEGYKVAVALPNLDELLESSPAHVFASVWYEWRQTKYYHLHYSELVRLAALYRYGGIYLDSDVIVLKPLTSLRNSIGATNHVSGNSSFGAAVLAFEKQSPLLEECLKEFYSTYDDTLMQWNGAELMTRVISNLSSKADENRGYLDIKLEPSVKFYPISSTDIIRYFSEPDNMVEKTHHDAIFSRIVNDSITFHFWNGITSALVPEPSSVVSKILNRYCIRCLDVL

SEQ ID NO: 4247 - DNA, 1314 bp, Sorghum bicolor
  misc_feature: Ceres ANNOT ID no. 6035345
  misc_feature: Encodes the peptide sequence at SEQ ID NO 4248
atggcgtcgtgcgtagccgctatgacgctcgccggcgcccgacctgcgtctcacgcccctggctccgcggcggccaccaacagtggccgcgcgcagcttagcttccatcgccgcggcgttcgcgctcgagtcatccgcgcctcccaccgccgcccacaccatccctctttttcgcttgaggatgagggggttctggagtggctgaggggcgcggccgcggcgctcgccatcgtagcccagatttccgtgtcgctgccggcgaacgcggttctttactcgcctgacacgaaggtgccgaggactggggagctggccctgaggagggcgatccccgctaacccgaacatgaaggctatacaggaatcgctggaggatatttcctacttgttgaggataccacagaggaagccatacggttccatggagagcgatgtgaagaagtccatgaaaatagcaatggacaacaaggaggcgatccttggaagcattcctgcagagcataaagaagagggtgccaagctatatacttcactactcgaagagaagggtggtttccagactctcttgaaatatatcaaggagaatgatcctgacaaactttctatagcacttgcttcgtcacttgatattgttgctgaattggagctgttacaggcccctggtctgtccttcctcctgccccagcagtacttagaatatccaaggctaacaggaagaggagttgttgaattcacagttgaaaaaggtgacggttcaacattctttccaactggtggcggtgaaccgaaaagtgttgctacgattcaggtcattattgatgggtactctgccccactgactgctggaaactttgcaaaaatggtcttggatggggcatatgacggggtaacacttaaatgtgcaagccaggcaattattgccgataatgagactggaaaaaatgggtatactgttccattagaggtcaagccagcaggacaattcgaaccattgtacagaactccgctaagcattcaggatggagaattgccagtcctgccgatgtcggtgtatggtgctgttgccatggcacatagtgtggattcagatgaatactcctcaccaacacagttctttttctatctttatgacaagagaaactctggcttaggaggaatatcgtttgatgagggacagttttcagttttcgggtataccacggatggaagagatgttctatcgcagattaagaccggggataaaattcgttctgccaagcttgtacaaggcagggaacgccttgtgctgccatcaatagcccccgaagagagctga

SEQ ID NO: 4248 - protein, 437 aa, Sorghum bicolor
  misc_feature: Ceres ANNOT ID no. 6035345
  misc_feature (86)..(430): NCBI GI: 42564190 NCBI Desc: peptidyl-prolyl cis-trans isomerase tlp38, chloroplast / thylakoid lumen ppiase of 38 kda / cyclophilin / rotamase [arabidopsis thaliana]
  misc_feature (86)..(430): NCBI GI: 18202432 NCBI Desc: peptidyl-prolyl cis-trans isomerase tlp38, chloroplast precursor (ppiase) (rotamase) (thylakoid lumen ppiase of 38 kda) (p38)
  misc_feature (56)..(433): NCBI GI: 119511601 NCBI Desc: peptidyl-prolyl cis-trans isomerase, cyclophilin type [nodularia spumigena ccy9414]
  misc_feature (77)..(431): NCBI GI: 22298363 NCBI Desc: peptidyl-prolyl cis-trans isomerase [thermosynechococcus elongatus bp-1]
  misc_feature (102)..(433): NCBI GI: 53687303 NCBI Desc: cog0652: peptidyl-prolyl cis-trans isomerase (rotamase) - cyclophilin family [nostoc punctiforme pcc 73102]
  misc_feature (86)..(430): SWISSPROT Homolog: EC 5.2.1.8 Peptidyl-prolyl cis-trans isomerase CYP37, chloroplast precursor
MASCVAAMTLAGARPASHAPGSAAATNSGRAQLSFHRRGVRARVIRASHRRPHHPSFSLEDEGVLEWLRGAAAALAIVAQISVSLPANAVLYSPDTKVPRTGELALRRAIPANPNMKAIQESLEDISYLLRIPQRKPYGSMESDVKKSMKIAMDNKEAILGSIPAEHKEEGAKLYTSLLEEKGGFQTLLKYIKENDPDKLSIALASSLDIVAELELLQAPGLSFLLPQQYLEYPRLTGRGVVEFTVEKGDGSTFFPTGGGEPKSVATIQVIIDGYSAPLTAGNFAKMVLDGAYDGVTLKCASQAIIADNETGKNGYTVPLEVKPAGQFEPLYRTPLSIQDGELPVLPMSVYGAVAMAHSVDSDEYSSPTQFFFYLYDKRNSGLGGISFDEGQFSVFGYTTDGRDVLSQIKTGDKIRSAKLVQGRERLVLPSIAPEES

SEQ ID NO: 4249 - DNA, 1701 bp, Sorghum bicolor
  misc_feature: Ceres ANNOT ID no. 6035354
  misc_feature: Encodes the peptide sequence at SEQ ID NO 4250
atggcggcggcgtggtctaggatcgggaggggagcgcagctgtcgctgtcgcagtccctgtcgaggaccctctacgagggcggcgtcggcggcgcgacaccggcggaggcggcttccgcgctgcgcagtgccgccgcgctgtcccgtgcccggggccagcacgtgtcgtcgctccacagcctcgtgggaaggtccgccggcggcggccacctcctccagccgccgagcaggggcatcgtcaccacgcccgcgaggctgcaccccgcgtcgtccgcggcggtggcggcggagctctcggacgcggagacgagggagcacgatcctgtgacggcgccgcctcgccagacgccgggcctcggcccgacgcggcccggggagaagccgcgcgtcgtggtgctgggcaccgggtgggcggcgtgccggctgctcaaggacgtggacacgagcgcctacgacgtcgtgtgcgtgtcgccccggaaccacatggtgttcacgccgctgctggcgtccacgtgcgtcggcacgctcgagttccgctccgtcgtcgagcccgtcagccgcatccagtcggcgctcgccacccgccccggctcctacttcttcctcgcctcctgcaccggcgtcgacaccaaggcgcacgaggtgtactgcacggccgcgtccgttgacgctcagctgcccagcgacccgtaccagttcaagatcgcctacgacaagctggtgatcgcgagcggcgccgagccgctcactttcaacatcaagggcgtccaggagaacgccatcttcctccgcgaggtgagccacgcgcaggagatccgcaggaagctgctcaccaacctcatgctcgccgagaatccaggcttgtctgacgaagagaagaagcggctcctgcattgcgtggtcgtcggcggaggccccaccggcgtcgagttcagcggtgagctcagtgacttcatcacgcgcgacgtgcgccagaggtacgcgcacgtcaaggactacgtcaaggtcaccctcatcgaggcaaacgaaatcttgtcatctttcgatatcgggctgcggcagtacgcgacgaatcacctgtcaaagtatggagttaatctggtgcgaggcattgtgaaggaggtgaagcccacggagatcactctgagcgacggcacccgcgtgccctacggcctgctggtctggtccacgggcgtcggcccgtcggagttcgtcaagtccctggacctgcccaagtcccctggcgggaggatcggcgtggacgagtggctccgcgtgcccacggccccggacgtgttcgcgctgggcgactgcgcggggttcctggaagggaccggcaagccggtgctcccggcgttggctcaggtcgcggagcgggagggccggtacctggcgcggctgctcgggaaggtcgcggcgcagaacggcggcaaggcgcactgcgccggcaaggccgacctcggggagccgttcgtgtacaagcacatcggcagcatggcgtccgtcggccggtacaaggcgctcgtcgacctcagggagaacaaggatgccaagggggtgtcgatggctggcttcctcagctggctgatgtggcggtcagcgtacctgacgcgggtggtgagctggaggaacaggttctacgtggcggtgaactggggaacgacgcttgtgtttggcagggacaacaccaggattggctga

SEQ ID NO: 4250 - protein, 566 aa, Sorghum bicolor
  misc_feature: Ceres ANNOT ID no. 6035354
  misc_feature (129)..(442): Pfam Id: Pyr_redox_2 Pfam Desc: Pyridine nucleotide-disulphide oxidoreductase
  misc_feature (298)..(398): Pfam Id: Pyr_redox Pfam Desc: Pyridine nucleotide-disulphide oxidoreductase
  misc_feature (127)..(565): NCBI GI: 71748224 NCBI Desc: nadh dehydrogenase [trypanosoma brucei]
  misc_feature (127)..(565): NCBI GI: 70832835 NCBI Desc: nadh dehydrogenase [trypanosoma brucei]
  misc_feature (126)..(439): NCBI GI: 87240748 NCBI Desc: fad-dependent pyridine nucleotide-disulphide oxidoreductase; calcium-binding ef-hand [medicago truncatula]
  misc_feature (126)..(439): NCBI GI: 5734587 NCBI Desc: external rotenone-insensitive nadph dehydrogenase [solanum tuberosum]
  misc_feature (127)..(460): NCBI GI: 42567013 NCBI Desc: pyridine nucleotide-disulphide oxidoreductase family protein [arabidopsis thaliana]
MAAAWSRIGRGAQLSLSQSLSRTLYEGGVGGATPAEAASALRSAAALSRARGQHVSSLHSLVGRSAGGGHLLQPPSRGIVTTPARLHPASSAAVAAELSDAETREHDPVTAPPRQTPGLGPTRPGEKPRVVVLGTGWAACRLLKDVDTSAYDVVCVSPRNHMVFTPLLASTCVGTLEFRSVVEPVSRIQSALATRPGSYFFLASCTGVDTKAHEVYCTAASVDAQLPSDPYQFKIAYDKLVIASGAEPLTFNIKGVQENAIFLREVSHAQEIRRKLLTNLMLAENPGLSDEEKKRLLHCVVVGGGPTGVEFSGELSDFITRDVRQRYAHVKDYVKVTLIEANEILSSFDIGLRQYATNHLSKYGVNLVRGIVKEVKPTEITLSDGTRVPYGLLVWSTGVGPSEFVKSLDLPKSPGGRIGVDEWLRVPTAPDVFALGDCAGFLEGTGKPVLPALAQVAEREGRYLARLLGKVAAQNGGKAHCAGKADLGEPFVYKHIGSMASVGRYKALVDLRENKDAKGVSMAGFLSWLMWRSAYLTRVVSWRNRFYVAVNWGTTLVFGRDNTRIG

SEQ ID NO: 4251 - DNA, 1422 bp, Sorghum bicolor
  misc_feature: Ceres ANNOT ID no. 6035360
  misc_feature: Encodes the peptide sequence at SEQ ID NO 4252
atgaacgagaaggcgtccgtttccaaggagctcaacgccaagcacaagaagatattggaaagtcttcttcggcttcctgagaatagagaatgtgcggactgcaagtcgaagggtcctcgatgggcaagtgtaaatctagggatctttatatgtatgacatgttctggaattcatagaagcctgggggtgcacatatctaaggtaagatctgcaaccctggatacatggctgccagagcaagttgcatttattcaatcaatgggaaacgaaaaagcaaatagctattgggaagcagagctgcctcctaactatgatagggttgggatagagaatttcatccgtgcaaaatatgaggacaagagatgggtaccgaggaatggaacatcacgacctacctccggtgttcgagatgagaagagccaagagtctctggctagtgctaataggagtggacatggtcatagatcttcatttgagcaaaaccgtgttacagctcttccgagcaaagttgcacctgtagcttcaaggataccctctcaggcatcacctcagcccccaaaggtagaaccaccagttcctaaggtggtttcacctcctcagccacagaaatctcctgccaaagttgaggcaacaccccctaaagttgagaagccatcagttgcgccgcctcctaaagtcgattatgctaccgatctctttaacatgttatcaatggatggaacaacagagaaagagtcagagtcatcttcaaatgatgataatgcctgggatggattccagtctgcacaaccagtacctagctcagagaaaaaagattctgccaaaccggcagaaagcaagacccagtcaacatccggaatagaagacctatttaaagactcaccagctctgtcaatatcctcagctccagctgtttcccaagtaaatgcgaagaatgatatcatgagtttgtttgagaagtccaatatggtatcgcctttcgctgcccatcaacagcagctggcgtttatgtctcagcagcaagctcttctaatggctgctcttaaagctggaaatgcaccacaaatgattccagggaatgccaatcagctaaatgctaatggttctaatccccctcttggaaccttgcctttccaaaactggacaaatcttggttatcaaaatcctgggttgactccagcagcagcacagaatggtgccaccaaggttgcgaacaacaatcaggacttttcttctggtacctttggttttggcacacctggggtgtacaacactagttcagctgtcccagcaaatggggccacggcagcaggtgctagcaacaacggcactgcatcaactgcatcttctaatctcccctcacaatctggcaaagattacgatttttcctcgttaactcaaggatttttcaccaaacgatga

SEQ ID NO: 4252 - protein, 473 aa, Sorghum bicolor
  misc_feature: Ceres ANNOT ID no. 6035360
  misc_feature (16)..(130): Pfam Id: ArfGap Pfam Desc: Putative GTPase activating protein for Arf
  misc_feature (1)..(473): NCBI GI: 92876968 NCBI Desc: arf gtpase activating protein [medicago truncatula]
  misc_feature (1)..(472): NCBI GI: 21618169 NCBI Desc: arf gap-like zinc finger-containing protein ziga3 [arabidopsis thaliana]
  misc_feature (7)..(472): NCBI GI: 10441352 NCBI Desc: arf gap-like zinc finger-containing protein ziga3 [arabidopsis thaliana]
  misc_feature (8)..(142): NCBI GI: 50417734 NCBI Desc: mgc80897 protein [xenopus laevis]
  misc_feature (8)..(142): NCBI GI: 62896981 NCBI Desc: stromal membrane-associated protein variant [homo sapiens]
  misc_feature: Useful for making plants with altered terpenoid content
  misc_feature: Useful for making plants with modulated nitrogen use efficiency
  misc_feature: GREAT-hit functional homolog of the protein sequence given in SEQ ID NO 13285
  misc_feature: The sequence is a functional homolog of SEQ ID NO. 425 in the 11/188,298 US application
MNEKASVSKELNAKHKKILESLLRLPENRECADCKSKGPRWASVNLGIFICMTCSGIHRSLGVHISKVRSATLDTWLPEQVAFIQSMGNEKANSYWEAELPPNYDRVGIENFIRAKYEDKRWVPRNGTSRPTSGVRDEKSQESLASANRSGHGHRSSFEQNRVTALPSKVAPVASRIPSQASPQPPKVEPPVPKVVSPPQPQKSPAKVEATPPKVEKPSVAPPPKVDYATDLFNMLSMDGTTEKESESSSNDDNAWDGFQSAQPVPSSEKKDSAKPAESKTQSTSGIEDLFKDSPALSISSAPAVSQVNAKNDIMSLFEKSNMVSPFAAHQQQLAFMSQQQALLMAALKAGNAPQMIPGNANQLNANGSNPPLGTLPFQNWTNLGYQNPGLTPAAAQNGATKVANNNQDFSSGTFGFGTPGVYNTSSAVPANGATAAGASNNGTASTASSNLPSQSGKDYDFSSLTQGFFTKR

SEQ ID NO: 4253 - DNA, 1515 bp, Sorghum bicolor
  misc_feature: Ceres ANNOT ID no. 6035367
  misc_feature: Encodes the peptide sequence at SEQ ID NO 4254
atggccgatccccagaagccccaggccgaggtcctgaccgagtcagtgcgggtcaacagcatcgaggcggaggccacgctcaggggcggcgagctggcgtggcgccccgccgccgccggcgacggagaggggcaggagcggcggctggagctggagtcggaggtgctcgggtgccgggtggacgggaggaagctcaaattcgcgacctttgccgagaccggcggcggtaaaggaaaagggggaggaggggatgggaatcggaggagaggggaggtcgtggtggagatggagaacgatgatgccgcgttgcggtgggcggacgccatcagggatcgtttcgcctcgctcggccggccaaacaaattgttcattatagtgaacccttatggtggaaagagaagcggacggagtattttccagaatgaagtcctccccctcattgaagcttctggcgtgctttatacgatgcaagaaaccaagcatcgccttcatgctcaagagattgcacattcacttgatcttaggaagtatgatggcatcatttgtgttagtggagatggtgtgatggtagaggttgtcaatggtctcctgcaaagggaagactgggaaacagcaataaaagtgccccttgggatcattccagcaggtactggaaatggaatggcacggtctctactgcatgctgctggtgaaccattctctatatctaatgctgtgtttgcaatcatcagaggtcataaacgtgcacttgatgttacttctgttgtgcaaggaaagacaaggttctttagtgtcttaatgcttacatggggtctggtggctgatgttgatattgaatcagagaagtataggtggatgggaagtgctcgccttgacttttatctactactccgcgtgctgaacctgcgacggtacaatgggcgcatcctttttgttccagcaccaggatatgaagaagttggtgatcctgtggatcaaactaccggttccgaaacaaacgggtttagcacgggcattcaagaagacgtagcaactgacagtaatggtgaaacgcgtggctatgttggcccgtcggtcaaagaatccgatcttagatggagatcgctgaacggtccgttcgtttcagtctggctcggcaatgttcctttcgccagtgaagatgccatggcagcaccaaaagcagagtttgcggatggctacttggatgctgccataatcaaggattgcccacggcgggatgttgtcggccttttgttccagatgaaggacggcgcctacgtgaactcgccatgcgtggagtacttcaaggtgaaggcgatccggatcgagccgggcctgcgcgtgggcagcagcaccaagggtggtatcatcgactcggacggggaggtgcttgcgaggggcgatgatgggtcccactcccgcgccggcgacgagccggggcacctgatggcgtacggcccgcccatccagctgacggtggaccaggggctggccaccatcttctccccgagatga

SEQ ID NO: 4254 - protein, 504 aa, Sorghum bicolor
  misc_feature: Ceres ANNOT ID no. 6035367
  misc_feature (121)..(259): Pfam Id: DAGK_cat Pfam Desc: Diacylglycerol kinase catalytic domain
  misc_feature (245)..(504): NCBI GI: 115472791 NCBI Desc: os07g0563000 [oryza sativa (japonica cultivar-group)]
  misc_feature (29)..(504): NCBI GI: 115440333 NCBI Desc: os01g0782200 [oryza sativa (japonica cultivar-group)]
  misc_feature (7)..(467): NCBI GI: 79481008 NCBI Desc: d-erythro-sphingosine kinase/ diacylglycerol kinase [arabidopsis thaliana]
  misc_feature (7)..(289): NCBI GI: 79325207 NCBI Desc: diacylglycerol kinase [arabidopsis thaliana]
  misc_feature (212)..(467): NCBI GI: 79325211 NCBI Desc: diacylglycerol kinase [arabidopsis thaliana]
MADPQKPQAEVLTESVRVNSIEAEATLRGGELAWRPAAAGDGEGQERRLELESEVLGCRVDGRKLKFATFAETGGGKGKGGGGDGNRRRGEVVVEMENDDAALRWADAIRDRFASLGRPNKLFIIVNPYGGKRSGRSIFQNEVLPLIEASGVLYTMQETKHRLHAQEIAHSLDLRKYDGIICVSGDGVMVEVVNGLLQREDWETAIKVPLGIIPAGTGNGMARSLLHAAGEPFSISNAVFAIIRGHKRALDVTSVVQGKTRFFSVLMLTWGLVADVDIESEKYRWMGSARLDFYLLLRVLNLRRYNGRILFVPAPGYEEVGDPVDQTTGSETNGFSTGIQEDVATDSNGETRGYVGPSVKESDLRWRSLNGPFVSVWLGNVPFASEDAMAAPKAEFADGYLDAAIIKDCPRRDVVGLLFQMKDGAYVNSPCVEYFKVKAIRIEPGLRVGSSTKGGIIDSDGEVLARGDDGSHSRAGDEPGHLMAYGPPIQLTVDQGLATIFSPR

SEQ ID NO: 4255 - DNA, 867 bp, Sorghum bicolor
  misc_feature: Ceres ANNOT ID no. 6035387
  misc_feature: Encodes the peptide sequence at SEQ ID NO 4256
atggcttcgtcagtggccgccgcggcgagcacattcctgggcacccgcctgtcggacccggcgccgcagaacgggcgcatcgtggcccggttcggcttcggaaagccgaaaaaggctgctgcccccaagaaggtgtccaagatctcctctgaccggccgctgtggttccccggcgccgtggcgcccgactacctcgacggcacgctggtcggcgactacggcttcgaccccttcgggctcgggaagcccgtggagtacctgcagttcgatttggactcgctggaccagaacctggccaagaatgagcccggcgtcgtcatcggcacccgcttcgagtcctccgacgtcaaatccaccccgttgcagccctacagcgaggtgttcggcctccagcggttccgcgagtgcgagctcatccacggccgctgggccatgctcgccaccctcggcgccctctccgtcgagtggctcaccggcgtcacctggcaggacgccggcgaggtggagctggtggacgggtcctcgtacctgggccagccgctgccgttctccatctcgacgctcatctggatcgaggtgctggtgatcggctacatcgagttccagcgcaacgccgagctcgacccggagaagaggctgtaccccggcggctcctacttcgacccgctcggcctggcggccgacccggagaagaaggagcggctgcagctggcggagatcaagcacgcgcgcctcgccatggtcgccttcctcggattcgccgtgcaggccgccgccaccggcaaggggccgctcaacaactgggccacccacctgagcgacccgctccacaccaccatcttcgacacgttcggagcatcctcttaa

SEQ ID NO: 4256 - protein, 288 aa, Sorghum bicolor
  misc_feature: Ceres ANNOT ID no. 6035387
  misc_feature (60)..(258): Pfam Id: Chloroa_b-bind Pfam Desc: Chlorophyll A-B binding protein
  misc_feature (1)..(288): NCBI GI: 2326947 NCBI Desc: chlorophyll a/b-binding protein cp29 precursor [zea mays]
  misc_feature (1)..(288): NCBI GI: 34394009 NCBI Desc: chlorophyll a/b-binding protein [oryza sativa (japonica cultivar-group)]
  misc_feature (1)..(287): NCBI GI: 445116 NCBI Desc: light-harvesting complex iia protein;
  misc_feature (2)..(288): NCBI GI: 4689382 NCBI Desc: chlorophyll a/b binding protein cp29 [vigna radiata]
  misc_feature (2)..(287): NCBI GI: 140051171 NCBI Desc: chlorophyll a-b binding protein [medicago truncatula]
  misc_feature: Useful for making plants with modulated biomass
  misc_feature: Useful for making plants with modulated drought sensitivity
  misc_feature: Useful for making plants with modulated phosphate use efficiency
  misc_feature: Functional homolog of the protein sequence given in SEQ ID NO 13527
  misc_feature: Useful for making plants with modulated water use efficiency
  misc_feature: Functional homolog of the protein sequence given in SEQ ID NO 13861
  misc_feature: Useful for making plants with modulated biomass
  misc_feature: Useful for making plants with modulated drought sensitivity
  misc_feature: Useful for making plants with modulated phosphate use efficiency
  misc_feature: Functional homolog of the protein sequence given in SEQ ID NO 13527
MASSVAAAASTFLGTRLSDPAPQNGRIVARFGFGKPKKAAAPKKVSKISSDRPLWFPGAVAPDYLDGTLVGDYGFDPFGLGKPVEYLQFDLDSLDQNLAKNEPGVVIGTRFESSDVKSTPLQPYSEVFGLQRFRECELIHGRWAMLATLGALSVEWLTGVTWQDAGEVELVDGSSYLGQPLPFSISTLIWIEVLVIGYIEFQRNAELDPEKRLYPGGSYFDPLGLAADPEKKERLQLAEIKHARLAMVAFLGFAVQAAATGKGPLNNWATHLSDPLHTTIFDTFGASS

SEQ ID NO: 4257 - DNA, 1710 bp, Sorghum bicolor
  misc_feature: Ceres ANNOT ID no. 6035396
  misc_feature: Encodes the peptide sequence at SEQ ID NO 4258
atggccgacggcgatccggcgccggcgctggcactggccaacgagaagctccctgccccggcggcggctgacgtggatgagacgcgcccggcgccaccgctggagccctcccggggtccggacgaggagaagcgcccgctcgaagaggaagaggcggaggtggaggcgcacccgccgcgggaaccaaccggggcgccgccagtagatcgcttggggatggaggtggtggcggcggcagaagcggacatgaaggcgaacgaagtggagaaggagaggggggatcgggcgaaggagaagcgggagaaggataaggggaaggggaaggaggggaaggagaaggagaaggtggaggaagaggcgaagctgaaagtgactgcggtggtgaaggtggaggggacggagaaggaggtcaaggtgacccggccgccagctggggccagtgcggagacgcccatcctagcggtgccggtggtggccgtgccttgcttcattgcgcctccagggtttgcgggccagtttgcaatgactcatcaagcagctttggcgagtgttacagcacaggcacaaatgcacttgcagtcaccaacttcatctgcatgttcagaagtgccatcaagtccattttatatgacaccaagatctctagtgccacttcagcaatcaccatcagtaactgaaggaaatatttgtaaaccaattgctgacaagtcattttcatctgattcaaaatcacaccatgttgttgtaaatatggtagctgatggcttcaactggaggaaatatggtcagaagcaggtgaaaagtagtgataattccaggagctactatagatgcacaaactcaggttgtctggctaaaaagaaggttgagcatttccctgatggccgtgttgtggaaatcatttatagaggagctcacaatcatgaaccaccacaaaagaccagatttgcaaaagaaagagtgactccaattggtgttccctctggaggcgaaaccttgagacttgtgaacacagaaattgtagaatccagtacccctacatgtaaattggaacagagtgccatctcagaaacttctgagcagcatctcttttgctcaagtgactgtgaaggggatgctggtaacaaatctgaaaatgaacatcctagtgcagaacccctgccaaagcgaaggacacttgagaccacagcgcctaacttaacgccagttctcagaacagttagagagcaaaagattattgtgcaggctgggaagatgagtgatggatacagatggcgcaagtatgggcagaaaatcgtgaagggaaatccaaaccccaggagttattaccgctgcacgcatggtggatgccctgtccgtaagcatgtggaaaaggcaccagatgatgttaacaatattgttgtaacttatgaaggtaaacacaatcacgatgaaccattcagaagcagcagcataccagtttctgcaatcagtccgtcagcaacaaccactgagcaacccaacacatcaactacatcagatgagaaacctccaaccattactcagaaggatgccaacagtgagtctgataaggagacaactttggaatttggaggtgagaaggcacttgaatctgcacaaacactgctcagcatcaaaactaactccgatgacatgaagaactctgtcctgaaagaaacttctgctgcagtacaagtccaaaacagttga

SEQ ID NO: 4258 - protein, 569 aa, Sorghum bicolor
  misc_feature: Ceres ANNOT ID no. 6035396
  misc_feature (252)..(310): Pfam Id: WRKY Pfam Desc: WRKY DNA -binding domain
  misc_feature (419)..(478): Pfam Id: WRKY Pfam Desc: WRKY DNA -binding domain
  misc_feature (18)..(569): NCBI GI: 83320257 NCBI Desc: wrky transcription factor 82 [oryza sativa (japonica cultivar-group)]
  misc_feature (36)..(390): NCBI GI: 115475674 NCBI Desc: os08g0276200 [oryza sativa (japonica cultivar-group)]
  misc_feature (137)..(484): NCBI GI: 927025 NCBI Desc: spf1-like dna-binding protein [cucumis sativus]
  misc_feature (128)..(489): NCBI GI: 8778394 NCBI Desc: f16a14.18 [arabidopsis thaliana]
  misc_feature (171)..(489): NCBI GI: 5080772 NCBI Desc: similar to dna-binding proteins [arabidopsis thaliana]
  misc_feature: The sequence is a functional homolog of SEQ ID NO 140 in the 10/225,068US patent application
  misc_feature: The sequence is a functional homolog of SEQ ID NO 227 in the 11/479,226US patent application
  misc_feature: The sequence is a functional homolog of SEQ ID NO 2444 in the 10/374,780US patent application
  misc_feature: The sequence is a functional homolog of SEQ ID NO 592 in the 10/412,699US patent application
  misc_feature: The sequence is a functional homolog of SEQ ID NO 734 in the 10/225,066US patent application
  misc_feature: Useful for making plants with modulated growth and phenotype characteristics
  misc_feature: The sequence is a functional homolog of SEQ ID NO 592 in the 20040045049 US patent application
  misc_feature: The sequence is a functional homolog of SEQ ID NO 227 in the 20070022495 US patent application
  misc_feature: The sequence is a functional homolog of SEQ ID NO 114 in the 11/375,241 US patent application
  misc_feature: The sequence is a functional homolog of SEQ ID NO 146 in the 10/286,264 US patent application
  misc_feature: The sequence is a functional homolog of SEQ ID NO 2500 in the 10/374,780 US patent application
  misc_feature: The sequence is a functional homolog of SEQ ID NO 672 in the 10/412,699 US patent application
MADGDPAPALALANEKLPAPAAADVDETRPAPPLEPSRGPDEEKRPLEEEEAEVEAHPPREPTGAPPVDRLGMEVVAAAEADMKANEVEKERGDRAKEKREKDKGKGKEGKEKEKVEEEAKLKVTAVVKVEGTEKEVKVTRPPAGASAETPILAVPVVAVPCFIAPPGFAGQFAMTHQAALASVTAQAQMHLQSPTSSACSEVPSSPFYMTPRSLVPLQQSPSVTEGNICKPIADKSFSSDSKSHHVVVNMVADGFNWRKYGQKQVKSSDNSRSYYRCTNSGCLAKKKVEHFPDGRVVEIIYRGAHNHEPPQKTRFAKERVTPIGVPSGGETLRLVNTEIVESSTPTCKLEQSAISETSEQHLFCSSDCEGDAGNKSENEHPSAEPLPKRRTLETTAPNLTPVLRTVREQKIIVQAGKMSDGYRWRKYGQKIVKGNPNPRSYYRCTHGGCPVRKHVEKAPDDVNNIVVTYEGKHNHDEPFRSSSIPVSAISPSATTTEQPNTSTTSDEKPPTITQKDANSESDKETTLEFGGEKALESAQTLLSIKTNSDDMKNSVLKETSAAVQVQNS

SEQ ID NO: 4259 - DNA, 1920 bp, Sorghum bicolor
  misc_feature: Ceres ANNOT ID no. 6035470
  misc_feature: Encodes the peptide sequence at SEQ ID NO 4260
atggcgccgtcggcgtgggccgtagccctcgccgcactctgcatcgtcgcgctcgcgccaccggcagcagggttctacctacccggcgtcgcgcccaatgacttcgagaagaaagatccacttcctgtgaaagtcaacaagctgacctcaatcaagacacaacttccatactcttactattctctcccattctgcaagccggataccatagttgacagtgcggaaaatctcggtgaagttcttcgtggagatcgcattgaaaactctccctatacgtttgaaatgagggagcctcagatgtgtcaaatagtctgcaagatatctgttggggagaaagaagcaaagcttctcaaggagaagattgaagatgagtaccgtgttaacatgattcttgacaacctacctttagttgttcctattcaaagagtggatcaagaaggtgcttatttctatcaacatggattccatgttggggccaaaggaaaatattcagggagcaaggatgaaaaatacttcatccacaaccatctatcttttacggtgaaatatcacagggatgagcaaagagatatttccaggattgtggcctttgaagtgaaaccatacagcgttaagcatgaatatgaagggcaatggaatgataagaagacccgcctgacaacgtgtgatcctcatgctcaacgtattattacctcatctgagtctcctcaggaggttgaagttggcaaggatatcatatttacttatgatgtggatttcaaggagagtgacatcaagtgggcatctcggtgggacagctatctattgatgacagatgatcagatccactggttctcaattgtgaattctctcatgattgtcctcttcctttctggaatggttgcgatgatcatgctccgtaccctttaccgggatatctccaagtataaccaacttgagactcaggaagaggcccaggaggagacaggatggaagcttgttcacggtgatgttttcaggcctccatcaaactcagactggctctgtgtttatgtcggcaccggtgtccaattctttggcatgctgcttgtcactatggtatttgcggttcttggcttcctttctccatcgaacaggggtggactgatgacagccatgctcctgctctgggtgttcatggggttgcttgctggctactcttcttcacgtctttacaagttgttcaagggctcagaatggaagaacattgccttgaggacagccttcactttccctggcagtgtgtttgctattttcttcttcttgaatgctcttatctgggggcaaaagtcttcaggtgctgttccattcaccacaatgtttgcccttgtcctcctttggttcggtatctcagtacctttggtttttgttggaagcttccttggcttcaagaaacctaccattgaagatccagtgaagacaaacaagataccaaggcagatccctgagcaggcctggtacatgaacccaatcttctcgattctaattggagggatccttccatttggtgctgtgttcatcgaactcttctttatccttacctccatctggctgcaccagttctactacatctttgggttcctcttccttgtgttcctgattctcatcgtgacatgtgctgagatctcgattgtgctatgttacttccagctctgcagcgaggattacctgtggtggtggaggtcatacctgacatctggttcctctgcactctacctcttcttgtatgcaaccttctatttcttcacaaagcttgagatcaccaagtttgtctcagcagttctgtactttggttacatgctcattgcctcatatgccttctttgccttgaccggcacaatcggattctatgcgtgcttcctgttcacaaggctgatttactcatcggtcaagatcgagtaa

SEQ ID NO: 4260 - protein, 639 aa, Sorghum bicolor
  misc_feature: Ceres ANNOT ID no. 6035470
  misc_feature (55)..(597): Pfam Id: EMP70 Pfam Desc: Endomembrane protein 70
  misc_feature (6)..(639): NCBI GI: 115480625 NCBI Desc: os09g0557800 [oryza sativa (japonica cultivar-group)]
  misc_feature (4)..(639): NCBI GI: 115477743 NCBI Desc: os08g0554900 [oryza sativa (japonica cultivar-group)]
  misc_feature (7)..(639): NCBI GI: 92897792 NCBI Desc: nonaspanin (tm9sf) [medicago truncatula]
  misc_feature (10)..(639): NCBI GI: 51534986 NCBI Desc: endomembrane protein 70-like [oryza sativa (japonica cultivar-group)]
  misc_feature (251)..(639): NCBI GI: 115477747 NCBI Desc: os08g0555200 [oryza sativa (japonica cultivar-group)]
MAPSAWAVALAALCIVALAPPAAGFYLPGVAPNDFEKKDPLPVKVNKLTSIKTQLPYSYYSLPFCKPDTIVDSAENLGEVLRGDRIENSPYTFEMREPQMCQIVCKISVGEKEAKLLKEKIEDEYRVNMILDNLPLVVPIQRVDQEGAYFYQHGFHVGAKGKYSGSKDEKYFIHNHLSFTVKYHRDEQRDISRIVAFEVKPYSVKHEYEGQWNDKKTRLTTCDPHAQRIITSSESPQEVEVGKDIIFTYDVDFKESDIKWASRWDSYLLMTDDQIHWFSIVNSLMIVLFLSGMVAMIMLRTLYRDISKYNQLETQEEAQEETGWKLVHGDVFRPPSNSDWLCVYVGTGVQFFGMLLVTMVFAVLGFLSPSNRGGLMTAMLLLWVFMGLLAGYSSSRLYKLFKGSEWKNIALRTAFTFPGSVFAIFFFLNALIWGQKSSGAVPFTTMFALVLLWFGISVPLVFVGSFLGFKKPTIEDPVKTNKIPRQIPEQAWYMNPIFSILIGGILPFGAVFIELFFILTSIWLHQFYYIFGFLFLVFLILIVTCAEISIVLCYFQLCSEDYLWWWRSYLTSGSSALYLFLYATFYFFTKLEITKFVSAVLYFGYMLIASYAFFALTGTIGFYACFLFTRLIYSSVKIE

SEQ ID NO: 4261 - DNA, 615 bp, Sorghum bicolor
  misc_feature: Ceres ANNOT ID no. 6035476
  misc_feature: Encodes the peptide sequence at SEQ ID NO 4262
atggaactgccaactcgccgtgctggtcggagtgctccggatcgaggctttgctgctgcgccccgtgttgggaggggagctgccgtttcctgctgctgggagaagccagggaccctctgcttgctgagggcaaaatctccttccttgcccagacactcgaggaaggtggaatgggccatcagaactatgtcagacgacagtggtgaccagtcaagcaacagcactcgccttttcagtgcaattcgatcattttggaacaaattgtctgccaagctgaagaaagcaaggaaagggttacccgtgaagatcctattctttctgattggattctattgcgctactgcgttcgctaccgtcattgggcaaacgggtgactgggacatactgtcagccggacttgctgttgccgttgtggaggttattggtgcgctgatgtacagggcttcctttgcgttacttggtaggatcaggaacatgattaccatatttaattactggaaagctgggcttacacttgggctgttcttggattcattcaaatatgaagtggatgagtttctcgaatcatgtaacccattcaactttcagattaatatattcactgggctttggtaa

SEQ ID NO: 4262 - protein, 204 aa, Sorghum bicolor
  misc_feature: Ceres ANNOT ID no. 6035476
  misc_feature (18)..(204): NCBI GI: 115456649 NCBI Desc: os03g0852600 [oryza sativa (japonica cultivar-group)]
  misc_feature (3)..(180): NCBI GI: 50252920 NCBI Desc: antigen receptor-like protein [oryza sativa (japonica cultivar-group)]
  misc_feature (67)..(180): NCBI GI: 3335348 NCBI Desc: t8f5.20 [arabidopsis thaliana]
  misc_feature (65)..(180): NCBI GI: 50251788 NCBI Desc: antigen receptor-like [oryza sativa (japonica cultivar-group)]
  misc_feature: Useful for making plants with modulated nitrogen use efficiency
  misc_feature: GREAT-hit functional homolog of the protein sequence given in SEQ ID NO 13259
  misc_feature: Useful for making plants with modulated nitrogen use efficiency
  misc_feature: Functional homolog of the protein sequence given in SEQ ID NO 13259
MELPTRRAGRSAPDRGFAAAPRVGRGAAVSCCWEKPGTLCLLRAKSPSLPRHSRKVEWAIRTMSDDSGDQSSNSTRLFSAIRSFWNKLSAKLKKARKGLPVKILFFLIGFYCATAFATVIGQTGDWDILSAGLAVAVVEVIGALMYRASFALLGRIRNMITIFNYWKAGLTLGLFLDSFKYEVDEFLESCNPFNFQINIFTGLW

SEQ ID NO: 4263 - DNA, 2088 bp, Sorghum bicolor
  misc_feature: Ceres ANNOT ID no. 6035478
  misc_feature: Encodes the peptide sequence at SEQ ID NO 4264
atggcgtcctccgccgcggctccgagcggcgcgccaccggctgggaagcgcccggcctccagcggacgggagggagatcagatggtcatcacgccgctgggcgccggcagcgaggtcggccgctcctgcgtccacatgaccttcaagggccgcaccgtcctcttcgactgcggcatccacccggcgtactctggcatggcggcgctgccatacttcgacgagatcgatccgtccaccatagacgtgctcctcatcacccactttcacttggaccatgctgcctcgctgccgtacttcctggagaagactacattcaagggcagggtgtttatgacccacgccacaaaggctatttacaggctgctgctctcagattatgtcaaggtcagcaaagtgtccgtggaagatatgttgtatgatgagaatgacattgctcgctccatggaaaaaatcgaggttatagatttccaccagacattggaagttaatgggatacgcttctggtgctacactgctggacatgtacttggtgccgccatgttcatggtggatattgctggcgtgcgcattctttacaccggtgactactcccgtgaagaagaccgccacctacgagctgctgagctcccacagttctccccagatatttgcattattgagtcaacctatggtgtacagcaacatcaaccccggattgttcgtgagaagcgctttactgaggtcattcacaataccgtttcacaggggggtcgtgttcttatcccggcatttgcacttggcagagcacaagaactgttacttatccttgatgagtattggtccaaacacccagagctccataagattcctatctattacgcttcccctcttgccaagaggtgcatggctgtctaccagacatacataaactccatgaatgaaaggatacggaaccagtttgcacaatccaatcccttccatttcaagcatatcgagtccttgaatagcattgataactttcatgatgtgggtccttcagtggtgatggctagtccaggtggtcttcagagtggtctctctaggcagcttttcgataagtggtgcacagataagaagaatgcttgtgttattccaggttatgttgtggaggggacccttgcgaagaccattatcaacgagcctagagaagtgacgctagctaatgggctcactgctcctcttcatatgtcagtccactatatctctttttcagctcatgccgatttccctcagacaagcaactttttggatgaacttcggccaccaaatattattcttgtacatggtgaagcaaacgaaatgtcaaggcttaaacagaaacttaaaactcagtttgatggtacaaatattgtatctcccaagaattgccaatcagtagagatgtatttcacttgtgagaaaatggccaagactattggcaggctggcagaaaaagtaccagaaggtggagagtcttccggtggcttacttgtcaagaagggattcacgtatcagattatggctcctgaagatctccgtgtctttacacagttatcaacagctaacatcactcagcgcattgcagtcccttattctggttcttttgaagtcataaagtacagactgaagcaaatatatgagagcgtggagtcagcaacagaagaatctgatgttccagcattgattgtgcatgaaagagtgacagttcgcctagattcagaaagttatgttacgctgcagtggtcatctgatcccatcagtgacatggtgtctgattctgtggtggctatgatcttgaacattggtcgtgaaggtccaaaagttgttccggttgaagaagcagttaagaccaaagaagagacggagaaggttgctcaaaaggtggtatatgctcttatgacatcacttttcggtgatgttaaagttacagcggaagggaaatttgtcatatctgtagatggaaatgtggcacacttggatgggatgagtggcgatgttaaatgtgaaaatgctacactgaaggaacggatcaagactgcattccgtcgcatacagagcgccgtgagaccaatcccactttcagcctcttga

SEQ ID NO: 4264 - protein, 695 aa, Sorghum bicolor
  misc_feature: Ceres ANNOT ID no. 6035478
  misc_feature (40)..(228): Pfam Id: Lactamase_B Pfam Desc: Metallo-beta-lactamase superfamily
  misc_feature (396)..(438): Pfam Id: RMMBL Pfam Desc: RNA-metabolising metallo-beta-lactamase
  misc_feature (16)..(694): NCBI GI: 92885254 NCBI Desc: beta-lactamase-like; rna-metabolising metallo-beta-lactamase [medicago truncatula]
  misc_feature (16)..(692): NCBI GI: 89267474 NCBI Desc: cleavage and polyadenylation specific factor 3 [xenopus tropicalis]
  misc_feature (16)..(692): NCBI GI: 49522504 NCBI Desc: cleavage and polyadenylation specific factor 3, 73kda [xenopus tropicalis]
  misc_feature (19)..(690): NCBI GI: 75773721 NCBI Desc: cleavage and polyadenylation specific factor 3, 73kda [bos taurus]
  misc_feature (19)..(690): NCBI GI: 15079675 NCBI Desc: cleavage and polyadenylation specific factor 3, 73kda [homo sapiens]
MASSAAAPSGAPPAGKRPASSGREGDQMVITPLGAGSEVGRSCVHMTFKGRTVLFDCGIHPAYSGMAALPYFDEIDPSTIDVLLITHFHLDHAASLPYFLEKTTFKGRVFMTHATKAIYRLLLSDYVKVSKVSVEDMLYDENDIARSMEKIEVIDFHQTLEVNGIRFWCYTAGHVLGAAMFMVDIAGVRILYTGDYSREEDRHLRAAELPQFSPDICIIESTYGVQQHQPRIVREKRFTEVIHNTVSQGGRVLIPAFALGRAQELLLILDEYWSKHPELHKIPIYYASPLAKRCMAVYQTYINSMNERIRNQFAQSNPFHFKHIESLNSIDNFHDVGPSVVMASPGGLQSGLSRQLFDKWCTDKKNACVIPGYVVEGTLAKTIINEPREVTLANGLTAPLHMSVHYISFSAHADFPQTSNFLDELRPPNIILVHGEANEMSRLKQKLKTQFDGTNIVSPKNCQSVEMYFTCEKMAKTIGRLAEKVPEGGESSGGLLVKKGFTYQIMAPEDLRVFTQLSTANITQRIAVPYSGSFEVIKYRLKQIYESVESATEESDVPALIVHERVTVRLDSESYVTLQWSSDPISDMVSDSVVAMILNIGREGPKVVPVEEAVKTKEETEKVAQKVVYALMTSLFGDVKVTAEGKFVISVDGNVAHLDGMSGDVKCENATLKERIKTAFRRIQSAVRPIPLSAS

SEQ ID NO: 4265 - DNA, 1023 bp, Sorghum bicolor
  misc_feature: Ceres ANNOT ID no. 6035484
  misc_feature: Encodes the peptide sequence at SEQ ID NO 4266
atggtgctgaagctgtccggcacgcaccggcagcacggcgcgcagcacaggcgcggcggttcgccaccacctcggggccgtgccacctccctgtaccgcagcggctactaccgccccggcgtggtgcaggacgacatggctgtgcccccggccacgtacctgggcggcggcgccggcgtcaccggcgcgtcgagcgcgagctccaccccggcgtgggacctgcccgtccgcgcggacggcgaggccagggagtgggtggcgcaggtggagcccggcgtgcagatcaccttcgtgtccctccccggcggcgccggcaacgacctcaagcgcatccggttcagccgcgagatgtacgacaagtggcaggcgcagaagtggtggggcgataacaacgagcgcatcatggagctctacaacgtccgccgcttcagccgacaggtgctccccacgccgccacgctccgacgacggcgagagggagtcgttctactcgcagtcgcaggcggggtcgatgatcgggagccccgcggccaccccgtcgccggcgccactcacgccggagaggatcagctggggcgcgttcgcgcggcaggtggcgccgccgccagcaggcgcagcgggcggcgccgcgcggcagcacagcttccggcccatgtcgccgccgccgccgtcctcgtccaacccttcggagcgggcctggcagcagcagcaccagcagcagcgacaggacggtagtggagcggccggcaagagccccgccgcctccgaggcagccaccgccacggaagccgcgaggacgaccacgtcgtccagggacgacgtgtccgtcagcaacgccagcgagctggaggtgacggagtggatcatccaggaccagcccggcgtgtacatcaccgtcagggagctcgcagacgggagccgggagctgcgccgcgtcaggttcagccgcgagaggtttgctgagctgaatgccaagctgtggtgggaggagaacaaggagaggatacaggctcagtacctttga

SEQ ID NO: 4266 - protein, 340 aa, Sorghum bicolor
  misc_feature: Ceres ANNOT ID no. 6035484
  misc_feature (103)..(138): Pfam Id: DZC Pfam Desc: Disease resistance/zinc finger/chromosome condensation-likeregion
  misc_feature (304)..(339): Pfam Id: DZC Pfam Desc: Disease resistance/zinc finger/chromosome condensation-likeregion
  misc_feature (194)..(340): NCBI GI: 57222218 NCBI Desc: at1g54180 [arabidopsis thaliana]
  misc_feature (68)..(238): NCBI GI: 109020194 NCBI Desc: brevis radix [arabidopsis thaliana]
  misc_feature (54)..(238): NCBI GI: 56461772 NCBI Desc: at1g54180 [arabidopsis thaliana]
  misc_feature (117)..(314): NCBI GI: 51536140 NCBI Desc: major intrinsic protein-like [oryza sativa (japonica cultivar-group)]
  misc_feature (207)..(340): NCBI GI: 38345776 NCBI Desc: osjnba0083n12.14 [oryza sativa (japonica cultivar-group)]
MVLKLSGTHRQHGAQHRRGGSPPPRGRATSLYRSGYYRPGVVQDDMAVPPATYLGGGAGVTGASSASSTPAWDLPVRADGEAREWVAQVEPGVQITFVSLPGGAGNDLKRIRFSREMYDKWQAQKWWGDNNERIMELYNVRRFSRQVLPTPPRSDDGERESFYSQSQAGSMIGSPAATPSPAPLTPERISWGAFARQVAPPPAGAAGGAARQHSFRPMSPPPPSSSNPSERAWQQQHQQQRQDGSGAAGKSPAASEAATATEAARTTTSSRDDVSVSNASELEVTEWIIQDQPGVYITVRELADGSRELRRVRFSRERFAELNAKLWWEENKERIQAQYL

SEQ ID NO: 4267 - DNA, 2877 bp, Sorghum bicolor
  misc_feature: Ceres ANNOT ID no. 6035487
  misc_feature: Encodes the peptide sequence at SEQ ID NO 4268
  misc_feature: Down-regulated in shoot tissues in response to salicylic acid treatment
atgagtagcagccgcaaaaactttcgccgccgcgcggatgacgacgaggacgccaacggcgacggcggcagccacaccaagccctccaccgccacctccacgaagacgaaaaccctaacggtgcccaagcccaagtcgccgccgagacgtcagggggcgagccgcctcagcttcgcggacgacgaggacgaggacgacgccgaggagggccccttcgcgcagcgccgccgccccccgacggcctcggtgcgcccggcgcgcacggcgtccccggccgccggagcgctccaccgcctcacgcccgccagggaccggatcaggagctcgccggcgcctgccgtcgctgctgcgtcagcgcctaagccgtccaacttccagtcccatgctggggagtacacaccagagcgcctccgggagctccagaagaatgcgcgcccgctccctgggagcctcttgcgttcccaaccacagactccggcgactgagccccggtcacaaaagttgcctggtatccctgcaagttccactccagctaccaccaccgcagctgcagcagaaactgtggttattcttaaaggtttggtgaaacctatgtctgaggccagcattgggccaaggataccgaagcatgacaaggaggaagataaatctgaggaagaggaggaaggagatgaagaggatgaagggccagtgatacctgaccgtgcaaccatcgatgccatcagggcaaagcgacagcagcggcagcagccaaggcatgcggcgccagattatatctctcttgatggtggtggtgtgctgagcagccggggtggtggtgatgagtcaagtgatgaggatgacaatgagacaagggatcggattgcaatgtacactgacaagccaagtgatggcctgaggagcacaaaaagtgtattcggcgggatcagtaacaggggtcctgccacaagtttggggactctcagtgatggcaacaggatggttgaggatgatagagacgatgacgatgatgaagaagagaggaggtgggaggaagagcagttcagaaaggggcttggtaggaggatggacgacgcttctactcagagatcagcaaatggcgtaccagctgctatgcatgttcagccacagccatttggatacccagtgggttcccattaccagccctcccttagcagtgttgtgcctgcagcatcagtttttgcatctggaactgcagagttcttgtccatcgctcagcaagcagatgttgcaaataaagccctgcaagacaacatccgaaagcttagggagactcacaagacaacagtcagtgctttagttaagaccgacacacatcttaacgaagctctttcagagatatcaagcctagagagtggtttgcaggatgccgaaaagaggtttgtctatatgcaggagctccgggattatgtttctgtcatgtgtgattttttgaatgacaaggcgtttttaatagaggagttggaggaaaacatacagaaattgcatgaaaatcgagctttggctatttctgagaggcgtgcagctgacctagctgatgaatcaggtgtgattgaagctgctgtaaatgctgcagtatctattcttagcaaaggatcaagctcagcttacctgtctgctgcatcaaatgctgcccaagcagcagcagctgctgctagggaaagttccaacctcccacctgagttggatgagtttggtagagatatcaacatgcagaagcgtatggatcttaagcgcagggaagagaacaggagacgaaggaaaacccagtcagagaccaagagattggcatctgcagtgaaaaataagggcattgagaagattgaaggagagctaagcactgatgaaagtgacagtgagagcactgcttatgtttccagccgggatgagtttcttaaggctgctgaccatgtgttcaatgatgctaaagaggaatactcgagccttagaactgtcaaggacaagtttgaaggctggaaaactcaatacccctctgcataccgagatgctcatgtagccctgagtgcaccgtctgtgttcaccccttttgtgagactggagctcctgaaatgggatcccctccatgaaacaaccgatttcttcgacatggattggcataaggttctttttgactacggtatgcaagctaatgagagtccctcaggttcgaatgattctgatgtggttccagtcttagtagaaaaggtggctctccctattctgcaccaccgtattaagcactgctgggatgtattgagtacccaaaggactagaaacgctgtggatgctagtaggatggtgatcggttatttaccaacctcaagcaaggatttgcatcaattactggcttctgtgagaagccgtctaactgaggccattgctgatctttcagtaccagcctggggatcaatggtgacgaggactgttccaggtgcctctcagtatgctgcgtatagatttggtgttgctatacgtcttcttaagaacgtttgtctgtggaaagacatccttgcagagcatgttgttgagaagcttgctttagacgaattactgagagggaagattcttcctcatatgaagagtatcatcctggatgttcacgatgcaatcactagggctgagcgaatagctgcctcactttcagaagtttggcctaaacaaagtcaaaagctgcagccttttgtagatctagtggttgagttgggaaacaagctggagaggagacacacgtcaggcattagcgaggaagagacacgtggtctagctcgtcgattgaaaaacgtattggtcagccttaatgagtacgataaagctagagctattttgaagacgtttcagctcagagaagccctttag

SEQ ID NO: 4268 - protein, 958 aa, Sorghum bicolor
  misc_feature: Ceres ANNOT ID no. 6035487
  misc_feature (416)..(939): Pfam Id: GCFC Pfam Desc: GC-rich sequence DNA-binding factor-like protein
  misc_feature (565)..(956): NCBI GI: 17061786 NCBI Desc: c21orf66 isoform a [mus musculus]
  misc_feature (565)..(956): NCBI GI: 119370499 NCBI Desc: gc-rich sequence dna-binding factor homolog
  misc_feature (600)..(914): NCBI GI: 6063510 NCBI Desc: gcf2 fusion protein [homo sapiens]
  misc_feature (600)..(914): NCBI GI: 40555892 NCBI Desc: chromosome 2 open reading frame 3 [homo sapiens]
  misc_feature (600)..(914): NCBI GI: 119619994 NCBI Desc: chromosome 2 open reading frame 3, isoform cra_c [homo sapiens]
  misc_feature: Down-regulated in shoot tissues in response to salicylic acid treatment
MSSSRKNFRRRADDDEDANGDGGSHTKPSTATSTKTKTLTVPKPKSPPRRQGASRLSFADDEDEDDAEEGPFAQRRRPPTASVRPARTASPAAGALHRLTPARDRIRSSPAPAVAAASAPKPSNFQSHAGEYTPERLRELQKNARPLPGSLLRSQPQTPATEPRSQKLPGIPASSTPATTTAAAAETVVILKGLVKPMSEASIGPRIPKHDKEEDKSEEEEEGDEEDEGPVIPDRATIDAIRAKRQQRQQPRHAAPDYISLDGGGVLSSRGGGDESSDEDDNETRDRIAMYTDKPSDGLRSTKSVFGGISNRGPATSLGTLSDGNRMVEDDRDDDDDEEERRWEEEQFRKGLGRRMDDASTQRSANGVPAAMHVQPQPFGYPVGSHYQPSLSSVVPAASVFASGTAEFLSIAQQADVANKALQDNIRKLRETHKTTVSALVKTDTHLNEALSEISSLESGLQDAEKRFVYMQELRDYVSVMCDFLNDKAFLIEELEENIQKLHENRALAISERRAADLADESGVIEAAVNAAVSILSKGSSSAYLSAASNAAQAAAAAARESSNLPPELDEFGRDINMQKRMDLKRREENRRRRKTQSETKRLASAVKNKGIEKIEGELSTDESDSESTAYVSSRDEFLKAADHVFNDAKEEYSSLRTVKDKFEGWKTQYPSAYRDAHVALSAPSVFTPFVRLELLKWDPLHETTDFFDMDWHKVLFDYGMQANESPSGSNDSDVVPVLVEKVALPILHHRIKHCWDVLSTQRTRNAVDASRMVIGYLPTSSKDLHQLLASVRSRLTEAIADLSVPAWGSMVTRTVPGASQYAAYRFGVAIRLLKNVCLWKDILAEHVVEKLALDELLRGKILPHMKSIILDVHDAITRAERIAASLSEVWPKQSQKLQPFVDLVVELGNKLERRHTSGISEEETRGLARRLKNVLVSLNEYDKARAILKTFQLREAL

SEQ ID NO: 4269 - DNA, 1359 bp, Sorghum bicolor
  misc_feature: Ceres ANNOT ID no. 6035492
  misc_feature: Encodes the peptide sequence at SEQ ID NO 4270
atgagggtgaaggtgatttcgcgctccaccgacgactacacgcgcgagcgcagccaggacctgcagaaagtgttccgcaactatgatccagcgctccgtagtcaagagaaagctgttgagtatactcgagcactcaatgctgccaagttagagaagatatttgctaagccatttatcggagctatggatgggcatattgatgcggtatcatgcatggcgaaaaaccccaatcatttaaaagcaatattttctggttcaatggatggagatgttcgcctttgggacattgctgcgaggaaaacagtttgtcagttccccggacaccagggtgctgtaagaggtttaacaacatccacggatggtgattttcttgtatcatgtggcgttgactgcactgttcggctctggaaagatccgatgcttaaaatggtggacaatagcgaccgtgccggagataattcccagccatcagcagtctacacctggaagcatgcattctggggtgctgaccaccagtgggacggtaatctttttgcaactgttggtgctcaagttgatatatgggatcctgacaggtcagagccaataaatagcttcgaatggggtaaagatacgattctttctgtgcgatttgatcctggagactgtaatattttgattacatccggcagtgatcggagtctaacactctatgacctgcgcatgtcatctccagctagaaagctaataatgaagacaaggtgcaattcagtatgctggaaccccagagagcccatgaacttcactgctgcaaatgaagacacaaactgttactcctttgatgctagaaagctagatgaagcgaaaattgttcacaaaggccatgtttcagcagtgatggatattgactactcaccaacagggcgtgaatttgtcactggttcatatgatagaacagtaaggatctttaattatcttggagaccacagcagagagatttatcacaccaagaggatgcaaagggtgttttgtgtgaaatacacctatgatgggacctatctagtctctggcagtgatgatacaaatcttcgtctgtggaagtccaaagcttcagaacaacttggagttcttcttccacgggagcgcaaaaagctagagtaccaggatgctttgaaggagcggtacaagcatctcccagaagtgaagcggattgtaaggcatagacacctgccgaagccaatctacaaggcagccaacctacggcgtacgatgatggaagctgaaaaccggaaagaggaaagaaggcgaaagcacagcgctccggggagcatgcctgtgcagccgttcaggaagcggagaatcatcaaagaagttgagtaa

SEQ ID NO: 4270 - protein, 452 aa, Sorghum bicolor
  misc_feature: Ceres ANNOT ID no. 6035492
  misc_feature (361)..(448): Pfam Id: Sof1 Pfam Desc: Sof1-like domain
  misc_feature (56)..(95): Pfam Id: WD40 Pfam Desc: WD domain, G-beta repeat
  misc_feature (99)..(137): Pfam Id: WD40 Pfam Desc: WD domain, G-beta repeat
  misc_feature (193)..(232): Pfam Id: WD40 Pfam Desc: WD domain, G-beta repeat
  misc_feature (279)..(317): Pfam Id: WD40 Pfam Desc: WD domain, G-beta repeat
  misc_feature (1)..(452): NCBI GI: 115435566 NCBI Desc: os01g0238900 [oryza sativa (japonica cultivar-group)]
  misc_feature (1)..(452): NCBI GI: 23505961 NCBI Desc: at4g28450/f20o9_130 [arabidopsis thaliana]
  misc_feature (1)..(452): NCBI GI: 17065094 NCBI Desc: sof1 protein-like protein [arabidopsis thaliana]
  misc_feature (24)..(452): NCBI GI: 30687972 NCBI Desc: transducin family protein / wd-40 repeat family protein [arabidopsis thaliana]
  misc_feature (1)..(452): NCBI GI: 38348458 NCBI Desc: gene model 83 [mus musculus]
  misc_feature: The sequence is a functional homolog of SEQ ID NO. 485 in the 11/188,298 US application
  misc_feature: The sequence is a functional homolog of SEQ ID NO. 502 in the 11/188,298 US application
MRVKVISRSTDDYTRERSQDLQKVFRNYDPALRSQEKAVEYTRALNAAKLEKIFAKPFIGAMDGHIDAVSCMAKNPNHLKAIFSGSMDGDVRLWDIAARKTVCQFPGHQGAVRGLTTSTDGDFLVSCGVDCTVRLWKDPMLKMVDNSDRAGDNSQPSAVYTWKHAFWGADHQWDGNLFATVGAQVDIWDPDRSEPINSFEWGKDTILSVRFDPGDCNILITSGSDRSLTLYDLRMSSPARKLIMKTRCNSVCWNPREPMNFTAANEDTNCYSFDARKLDEAKIVHKGHVSAVMDIDYSPTGREFVTGSYDRTVRIFNYLGDHSREIYHTKRMQRVFCVKYTYDGTYLVSGSDDTNLRLWKSKASEQLGVLLPRERKKLEYQDALKERYKHLPEVKRIVRHRHLPKPIYKAANLRRTMMEAENRKEERRRKHSAPGSMPVQPFRKRRIIKEVE

SEQ ID NO: 4271 - DNA, 1722 bp, Sorghum bicolor
  misc_feature: Ceres ANNOT ID no. 6035504
  misc_feature: Encodes the peptide sequence at SEQ ID NO 4272
atggagcagaggaacgttctggcattgggtgaacatgttctgaaagctactattcgcaagcgaaagcatgagactgctatggagcaccctgaaggcaatgatgtgatggtgttctctcagcatgatccaagaaaacaccctgcaacatttgatgacagagctaactgtaagaagtctaaattaatttcctgtgggagtggatctatattggagtcatatcggaactttaagacaagtgggctgcctgtgcgtgtgcttttctaccaacatggtgactggagtgattttccagaggatgttgtcaatctagcacaacaggacttccagttgaagaggccaattactactgctgtgttccagaacaagcacatcatgttggacttcgttcacatgatttgcatagattatgagatgaccatagacaaaccactagcatgggttgatgatcatggcaaacacttctttccagatttatctgctggactgtacacatctaaaccatctcagcatgagaaaggtgaagctgatgagtgtgatggagtgtcaagtgtagctgaaagctcaagttcggtatctgttggtgaagtagtttctcatagcaagaggatcagtaatattgcagaggacaacctgaaagcacataacaggctgtatgaagctgttggtgaaaataattcaggtccttcatttcatttgaatgaatattttagtggaaccatacaagctactggcaagccaaacaatggtccacgtgttgattcagctgtgcagaatttgttgctcaaaggattaggtcagccttttagcgagaaagatattattgctatctatagaacaccactgctagatcagcaatggcaagttcgttgtggtctcttccaaaaggaggttgaagagaccaggagtcgtcgggggaatgcaaatgtgcgttatgcttggcttccttgctcaagatataccatggagcagatgacgacgcgaggtgctctggaaactgcaaagcctaagaaggggtccatgtttggtgttgggacttgtcttgctcctgcaaactgttcaaattcatgtgccagatattctgagtttcaagaagatggcatcatcagaatgatgctgtgccgtgtaataatgggtaatgttgaggttgttttgcctggatcaaagcaattccagccatccaatgaaagttttgataatggcgtggatgatcttcaaaatccacagaattacatcatatgggattctaatgtgcataaacacatatttgctgaatatgctgttattgtcaaagtacctccagtgaccaatggatgtttggtcttgaaggatagtgtgcccaacatatctgagatcataagtactggttctccagacaatctaaccaaggaagataggttccaaaccttggcaccgtccggtgttgaacaagaagcacctaagctggggcatgctccaagggcgccctcctcaccatggatgcccttttcaatgctttttgctgccatttccacaaaagtgcctcgttcagacatggatttggtcatcagatactatgaagaatttaagaggaaagggataagcaggagcgacttggtgatacggataaggcaaatagtcggagataagatattggtttctacaataatgaggcttcaccagaagtccccacaggtggcagcagctgggctaccaagagcactcgcaagggggaagagggagtag

SEQ ID NO: 4272 - protein, 573 aa, Sorghum bicolor
  misc_feature: Ceres ANNOT ID no. 6035504
  misc_feature (215)..(570): NCBI GI: 115456679 NCBI Desc: os03g0854800 [oryza sativa (japonica cultivar-group)]
  misc_feature (56)..(432): NCBI GI: 124360253 NCBI Desc: poly(adp-ribose) polymerase, catalytic region [medicago truncatula]
  misc_feature (66)..(557): NCBI GI: 11044957 NCBI Desc: ceo protein [arabidopsis thaliana]
  misc_feature (66)..(557): NCBI GI: 14150488 NCBI Desc: atp8 [arabidopsis thaliana]
  misc_feature (257)..(552): NCBI GI: 115461248 NCBI Desc: os04g0672200 [oryza sativa (japonica cultivar-group)]
MEQRNVLALGEHVLKATIRKRKHETAMEHPEGNDVMVFSQHDPRKHPATFDDRANCKKSKLISCGSGSILESYRNFKTSGLPVRVLFYQHGDWSDFPEDVVNLAQQDFQLKRPITTAVFQNKHIMLDFVHMICIDYEMTIDKPLAWVDDHGKHFFPDLSAGLYTSKPSQHEKGEADECDGVSSVAESSSSVSVGEVVSHSKRISNIAEDNLKAHNRLYEAVGENNSGPSFHLNEYFSGTIQATGKPNNGPRVDSAVQNLLLKGLGQPFSEKDIIAIYRTPLLDQQWQVRCGLFQKEVEETRSRRGNANVRYAWLPCSRYTMEQMTTRGALETAKPKKGSMFGVGTCLAPANCSNSCARYSEFQEDGIIRMMLCRVIMGNVEVVLPGSKQFQPSNESFDNGVDDLQNPQNYIIWDSNVHKHIFAEYAVIVKVPPVTNGCLVLKDSVPNISEIISTGSPDNLTKEDRFQTLAPSGVEQEAPKLGHAPRAPSSPWMPFSMLFAAISTKVPRSDMDLVIRYYEEFKRKGISRSDLVIRIRQIVGDKILVSTIMRLHQKSPQVAAAGLPRALARGKRE

SEQ ID NO: 4273 - DNA, 1179 bp, Sorghum bicolor
  misc_feature: Ceres ANNOT ID no. 6035509
  misc_feature: Encodes the peptide sequence at SEQ ID NO 4274
atggacatagcggaggaggccgtcgccggcaccgcagctcagggcgacctcgccgaggttgtggcccgtgcaggtgcaatggccatggccgccgcgccgagtcaccaccggcggccaccctctccctctcctgcagcagcagatcacagtcacgtcatgtcgagggctgccggccagatcatggccatccctcctgcttgttacgacgaggagcaggagctacggcctgctgctgcttgcggtgacgcggtgatgttcgacgtgccgtcgtctatggtcgtcgatccataccatcagctgtcttcgtcggcggccacggcgccgccgcacgggcacggcgggtactggctgccgccacaacagatctcccagcaggcctgctatggcctcgacgtggccatgggaggcgctgccgccgccgatgccgacggcgacgagcccatgatgatgaggatctctccagtcactccgccgccgccttctcatcatcaaatcatgaagagcagaaaaaatgaggtgaagaaggtggtgtgtatcccggcgctacctccggcgagcagccggccaggaggaggagaggtgattccctctgatctttgggcgtggaggaaatacggccagaagcccatcaagggctcgccttacccaagaggttactacagatgcagcagctcaaagggatgtatggcgaggaagcaagtagagcgcagccgcagtgacccgaatatgctagtgattacctacacggcagaacacaaccacccttggccaatgcaacgaaatgtacttgctgggtactcccggcctcacactcacatgtccaactgcaagaagaagaacagctgcagggttgaaccgacgagttcatggccaacatcatcatcgtcgtcatcatcatcaaagaatgccaactacttcgagcataatgtagttcccagtagcaacatcgagtgtcaacaaatgacaaacatgatggaagataatgcagctgggtatgttgcctatgccatcgatactcttgatgaggagggtgttgcgatgcatcagccgatcaatcgcaatagcatccaaccttcagatgaagttttcgcagagttggaggaattggagcctagtaataatcctgtgaatgcaaacatctactctaggggggtaagttatgagtggcaaaagttctaa

SEQ ID NO: 4274 - protein, 392 aa, Sorghum bicolor
  misc_feature: Ceres ANNOT ID no. 6035509
  misc_feature (196)..(256): Pfam Id: WRKY Pfam Desc: WRKY DNA -binding domain
  misc_feature (166)..(275): NCBI GI: 39545857 NCBI Desc: osjnba0093f12.9 [oryza sativa (japonica cultivar-group)]
  misc_feature (166)..(275): NCBI GI: 115460270 NCBI Desc: os04g0597300 [oryza sativa (japonica cultivar-group)]
  misc_feature (166)..(275): NCBI GI: 46394328 NCBI Desc: tpa: wrky transcription factor 37 [oryza sativa (japonica cultivar-group)]
  misc_feature (166)..(370): NCBI GI: 15990586 NCBI Desc: wrky transcription factor 14 [arabidopsis thaliana]
  misc_feature (166)..(309): NCBI GI: 46394386 NCBI Desc: tpa: wrky transcription factor 66 [oryza sativa (indica cultivar-group)]
  misc_feature: The plants are small.
  misc_feature: The sequence is a functional homolog of SEQ ID NO 10 in the 10/412,699US patent application
  misc_feature: The sequence is a functional homolog of SEQ ID NO 1020 in the 10/412,699US patent application
  misc_feature: The sequence is a functional homolog of SEQ ID NO 1021 in the 10/412,699US patent application
  misc_feature: The sequence is a functional homolog of SEQ ID NO 1024 in the 10/412,699US patent application
  misc_feature: The sequence is a functional homolog of SEQ ID NO 1026 in the 10/412,699US patent application
  misc_feature: The sequence is a functional homolog of SEQ ID NO 124 in the 11/479,226US patent application
  misc_feature: The sequence is a functional homolog of SEQ ID NO 1738 in the 10/412,699US patent application
  misc_feature: The sequence is a functional homolog of SEQ ID NO 1962 in the 10/374,780US patent application
  misc_feature: The sequence is a functional homolog of SEQ ID NO 376 in the 10/225,066US patent application
  misc_feature: The sequence is a functional homolog of SEQ ID NO 525 in the 10/374,780US patent application
  misc_feature: The sequence is a functional homolog of SEQ ID NO 526 in the 10/374,780US patent application
  misc_feature: The sequence is a functional homolog of SEQ ID NO 530 in the 10/374,780US patent application
  misc_feature: The sequence is a functional homolog of SEQ ID NO 534 in the 10/374,780US patent application
  misc_feature: Useful for making plants with modulated biomass
  misc_feature: Useful for making plants with modulated growth and phenotype characteristics
  misc_feature: The sequence is a functional homolog of SEQ ID NO 10 in the 20040045049 US patent application
  misc_feature: The sequence is a functional homolog of SEQ ID NO 1020 in the 20040045049 US patent application
  misc_feature: The sequence is a functional homolog of SEQ ID NO 1021 in the 20040045049 US patent application
  misc_feature: The sequence is a functional homolog of SEQ ID NO 1024 in the 20040045049 US patent application
  misc_feature: The sequence is a functional homolog of SEQ ID NO 1026 in the 20040045049 US patent application
  misc_feature: The sequence is a functional homolog of SEQ ID NO 1738 in the 20040045049 US patent application
  misc_feature: Functional homolog of the protein sequence given in SEQ ID NO 13583
  misc_feature: The sequence is a functional homolog of SEQ ID NO 106 in the 10/412,699 US patent application
  misc_feature: The sequence is a functional homolog of SEQ ID NO 124 in the 10/225,068 US patent application
  misc_feature: The sequence is a functional homolog of SEQ ID NO 32 in the 10/374,780 US patent application
  misc_feature: The sequence is a functional homolog of SEQ ID NO 428 in the 10/225,066 US patent application
MDIAEEAVAGTAAQGDLAEVVARAGAMAMAAAPSHHRRPPSPSPAAADHSHVMSRAAGQIMAIPPACYDEEQELRPAAACGDAVMFDVPSSMVVDPYHQLSSSAATAPPHGHGGYWLPPQQISQQACYGLDVAMGGAAAADADGDEPMMMRISPVTPPPPSHHQIMKSRKNEVKKVVCIPALPPASSRPGGGEVIPSDLWAWRKYGQKPIKGSPYPRGYYRCSSSKGCMARKQVERSRSDPNMLVITYTAEHNHPWPMQRNVLAGYSRPHTHMSNCKKKNSCRVEPTSSWPTSSSSSSSSKNANYFEHNVVPSSNIECQQMTNMMEDNAAGYVAYAIDTLDEEGVAMHQPINRNSIQPSDEVFAELEELEPSNNPVNANIYSRGVSYEWQKF

SEQ ID NO: 4275 - DNA, 2025 bp, Sorghum bicolor
  misc_feature: Ceres ANNOT ID no. 6035530
  misc_feature: Encodes the peptide sequence at SEQ ID NO 4276
atggctcgcaacagggaagtagtgattttgctgttggatgttgggccttcgatgcatggggtgctgcaagaggtcaagaacatatgctcgactcttgtgcataagaagctagtttataacaggagcgatgaagtcggtattgtcctctttggaactaaaggaacatgcaatgagcttgcaaaggagcttgggggctataagcatgtgacagtcacacgtgatattaaagttgtagatgaaggggcggcacaggctctgcaaaaccttccattaggatctgcccctggtgattgtatccatgaaatagcagtagggaagcggaggctctgtttaatcaccagtgcacaggatttattaagagatccgcccgaggggactaaagaagaacaggtggacaccattgcagacatgttgaaaaaacacagtatcaagttggagtgcattatctttagagaaccgggagtgctccgtaatgctgtaatggaagaaaacgaccgattattgtatcagttcagaaatagatcagttgcaaaggtagttcaggttgacagcccaacatcactgttgggtgctctcaagacaagaaatgtgcttccagttaccgtcttcaggggagacctggaagtgaactccaattttaaaattaaggtgtgggtctataagaaaacagctgaggagaaattccccactttgaagaagtattcggacaaggctcctccaagtgataaacttgcctctcatgaagtcaaagttgattatgagtacaagagcgttgtcgaaccagacaaaattgttccaccagaccagaggattaaggggtatctttatggtcctcaagttattcctgtatcaaatgctgaatgggaggcagtcaagttcaagccagagaaaggtgtgaagcttctaggatttacagatagatccaacgtaccacggcaccattttatgaaagacgtatgcttgtttatacctgaaccaggcaacattaaagcaactcttgcagtttctgccatagcaagagcaatgcatcaaatgaacaaggctgctattgtgcgatgtgtgtggagacaaggtcaagggaatgttgctcttggtgtattgacaccgaatatttcagcagtggacaatgtccaagattccttttacttcaatgtactcccatttgctgaggacatcagagagtttcagtttcgatcctttagcagcctgccatcatcatctcagcccactgaagaacaacaagaagctgcagataacctagtgaagatgttagacctagcaccacctggaagagaggtcctcaagcctgagtttacaccaaaccccatgttggagagattttacagttaccttgatctcaagtcaaagcagccagatgcaaatgtaccaccacttgatagatctctaaggaggataactgaacctgatcctaatgtggttggccaacaaacacaattaatacagaatttaggcaaagcttttgagctgaaggagaaccccaagaaaaagaaagcacgaggacaggacatattggcatataccggtgcaggtgatcaagctaaatctgtagaagagccttctgtagagaaggacagagttctggaaaatacacatccacctacagagaatgttggggcgatcagagattcgaatccagttcacgattttgaggccatgctggctaatagatctagctcaacttgggttcagaaggctattgaagatatgcagaattacacagcagctttgttacaaaagtctcatgatgggagtaactaccaaaaggcacttgaatgttttgctgctctgcggaaggcctgcattattgaacaggaaccacaggaattcaacgaattcctaacaaagatttacgagagattgaaggagggtgatgctgccaagttctttcaacttctctcctcaaaaaatatttcacttatcagcaaagaggaagcgcctgacagcgacgtgactgaggagatggcaaaaagtttctacctgaaacgagaaaaggcgtctcagtag

SEQ ID NO: 4276 - protein, 674 aa, Sorghum bicolor
  misc_feature: Ceres ANNOT ID no. 6035530
  misc_feature (549)..(670): Pfam Id: Ku_PK_bind Pfam Desc: Ku C terminal domain like
  misc_feature (207)..(417): Pfam Id: Ku Pfam Desc: Ku70/Ku80 beta-barrel domain
  misc_feature (7)..(199): Pfam Id: Ku_N Pfam Desc: Ku70/Ku80 N-terminal alpha/beta domain
  misc_feature (1)..(670): NCBI GI: 19401142 NCBI Desc: kap-2 [medicago truncatula]
  misc_feature (1)..(670): NCBI GI: 92894774 NCBI Desc: ku70/ku80, n-terminal alpha/beta; ku80 antigen [medicago truncatula]
  misc_feature (1)..(670): NCBI GI: 12006422 NCBI Desc: ku80-like protein [arabidopsis thaliana]
  misc_feature (105)..(670): NCBI GI: 8778524 NCBI Desc: f21d18.26 [arabidopsis thaliana]
  misc_feature (105)..(673): NCBI GI: 19401144 NCBI Desc: kap-2 [phaseolus vulgaris]
MARNREVVILLLDVGPSMHGVLQEVKNICSTLVHKKLVYNRSDEVGIVLFGTKGTCNELAKELGGYKHVTVTRDIKVVDEGAAQALQNLPLGSAPGDCIHEIAVGKRRLCLITSAQDLLRDPPEGTKEEQVDTIADMLKKHSIKLECIIFREPGVLRNAVMEENDRLLYQFRNRSVAKVVQVDSPTSLLGALKTRNVLPVTVFRGDLEVNSNFKIKVWVYKKTAEEKFPTLKKYSDKAPPSDKLASHEVKVDYEYKSVVEPDKIVPPDQRIKGYLYGPQVIPVSNAEWEAVKFKPEKGVKLLGFTDRSNVPRHHFMKDVCLFIPEPGNIKATLAVSAIARAMHQMNKAAIVRCVWRQGQGNVALGVLTPNISAVDNVQDSFYFNVLPFAEDIREFQFRSFSSLPSSSQPTEEQQEAADNLVKMLDLAPPGREVLKPEFTPNPMLERFYSYLDLKSKQPDANVPPLDRSLRRITEPDPNVVGQQTQLIQNLGKAFELKENPKKKKARGQDILAYTGAGDQAKSVEEPSVEKDRVLENTHPPTENVGAIRDSNPVHDFEAMLANRSSSTWVQKAIEDMQNYTAALLQKSHDGSNYQKALECFAALRKACIIEQEPQEFNEFLTKIYERLKEGDAAKFFQLLSSKNISLISKEEAPDSDVTEEMAKSFYLKREKASQ

SEQ ID NO: 4277 - DNA, 1491 bp, Sorghum bicolor
  misc_feature: Ceres ANNOT ID no. 6035533
  misc_feature: Encodes the peptide sequence at SEQ ID NO 4278
atgttctcgcacggcgctgattccgcccacgacgccggggccgtcggcgtcagcaccggcggggccaccgtccccacccgcttcgtttggccctacggtgggaagagggtcttcgtctcaggctcctttaccaggtggtcggaacatttgccgatgtctcctgtcgaaggctgccccactgtatttcaggctatttgcagcctgtctccagggattcacgagtacaagttctttgtggatggggagtggcggcatgatgagcgccaacctactatatctggggagtttggaatagttaacacattatacttgacaagggaatttaaccaactaaacgccttattaagtccaagcacacctggaagcaggatgaacatggatgtggataatgaaaattttcaacgtacggttacgttgtcggatggtaccgttccggaaggtactccgagagtttcagaggctgcaatacaaatctctaggtgccgcgtttctgaatatctgaatttgcatacatgctatgatttactcccggattcgggcaaggttattgctctggacattaatttacctgtgaagcaatcttttcatattctgcatgaacaggggattcctgtagctcctctctgggactcatttagaggtcaatttgttggtcttctgagcccattggatttcatacttatattgcgggagctagaaactcatggctcgaacttgacagaagagcagcttgaaacacatacgatatctgcatggaaagaggctaagcggcaaacttatggaagaaatgatggtcaatggcgaccacatcagcatctagtgcatgctaccccttatgagtctttgagggacattgcagtaaaacttttgcaaaatggcatttctacagtgccagttatttattcatcatcatcggatggatcattcccgcagttgttgcatcttgcatccctctctggaattttgaaatgtatttgtagatatttcaaaaactcgacttgtaatttgcctattctgaaccaaccagtgtgctccattccactgggttcctgggttccgaaaattggtgatcctaacagtcgtccattggctatgttgcgacctaatgcatcacttagctctgcccttaacatgttggttcaagctggagtgagctcagtaccaattgtagatgaaaatgacgccctgcttgacacttattctagaagtgacatcacagccctagcaaaagacaaggtctacacacatgttcggctggatgagatgaccattcatcaggctttgcagcttggacaagatgccaatacaccttttggattttttaacggtcagagatgccagatgtgcctccgatctgatcctttgctaaaggtgatggagcgactggctaatcctggggtgaggcgggtgttcattgtggaagctgggagcaaacgagtggagggcattatatcactgagtgatattttcaagttcttgctgagcttgtga

SEQ ID NO: 4278 - protein, 496 aa, Sorghum bicolor
  misc_feature: Ceres ANNOT ID no. 6035533
  misc_feature (176)..(317): Pfam Id: CBS Pfam Desc: CBS domain pair
  misc_feature (357)..(494): Pfam Id: CBS Pfam Desc: CBS domain pair
  misc_feature (1)..(496): NCBI GI: 11139548 NCBI Desc: protein kinase akinbetagamma-2 [zea mays]
  misc_feature (1)..(496): NCBI GI: 11139546 NCBI Desc: protein kinase akinbetagamma-1 [zea mays]
  misc_feature (1)..(494): NCBI GI: 92877083 NCBI Desc: cbs [medicago truncatula]
  misc_feature (1)..(494): NCBI GI: 29887975 NCBI Desc: akin betagamma [medicago truncatula]
  misc_feature (1)..(494): NCBI GI: 140058269 NCBI Desc: cbs [medicago truncatula]
  misc_feature: The sequence is a functional homolog of SEQ ID NO. 473 in the 11/188,298 US application
MFSHGADSAHDAGAVGVSTGGATVPTRFVWPYGGKRVFVSGSFTRWSEHLPMSPVEGCPTVFQAICSLSPGIHEYKFFVDGEWRHDERQPTISGEFGIVNTLYLTREFNQLNALLSPSTPGSRMNMDVDNENFQRTVTLSDGTVPEGTPRVSEAAIQISRCRVSEYLNLHTCYDLLPDSGKVIALDINLPVKQSFHILHEQGIPVAPLWDSFRGQFVGLLSPLDFILILRELETHGSNLTEEQLETHTISAWKEAKRQTYGRNDGQWRPHQHLVHATPYESLRDIAVKLLQNGISTVPVIYSSSSDGSFPQLLHLASLSGILKCICRYFKNSTCNLPILNQPVCSIPLGSWVPKIGDPNSRPLAMLRPNASLSSALNMLVQAGVSSVPIVDENDALLDTYSRSDITALAKDKVYTHVRLDEMTIHQALQLGQDANTPFGFFNGQRCQMCLRSDPLLKVMERLANPGVRRVFIVEAGSKRVEGIISLSDIFKFLLSL

SEQ ID NO: 4279 - DNA, 933 bp, Sorghum bicolor
  misc_feature: Ceres ANNOT ID no. 6035534
  misc_feature: Encodes the peptide sequence at SEQ ID NO 4280
atggcaaccgcaatgtccccctccccctcggccgcaatcgctcgccccagccatcctcgctcctgtgctgctgcttcggtggccctccgctcgggcttcctgggccgcgggctggccgcggtggtgccggtggccgtggacgaccccagatgccgtctccgccgccgcgtctccttctccgtgcgcatggcctgggacgggcccctctcgtcggtgcgcctcatcatgcagggcaggaacgtgaagctgagcgacaagctcaaggagcacatcgaggacaaggtgggccgggcggtgtccaagcactgccacctggtccgggaggtggacgtgcgcctctccgcgcgcggcggcgagctcggccgcggacccaagacgtcgcgctgcgagatcacgctcttcagcaagcgccacggcgtcctgcgcgccgaggaggacgccgagtccacctacgccagcatcgacctcgccgccgccatcatcaagcgcaagctccgcaagatcaaggagaaggagacggaggtgcggcgcgacggcgacggtggtgcgggaggcgcctgggaagaggagctcccgctgctcgacgacgacctggtggaggccgacgaattggctgcggccgtgggcgcggaggacgagcagactgttgtcgccaaggtggtgcgcaccaaggtgttcgagatgccgccgctgacggtggaggaggcgctggagcagctggacaacgtgggccacaacttctactgcttcagggacgaggcaacgggccaggtcaacatcctctaccgcaggaaggaaggcggctacggcctcatcatccccaaggaggacggcaacttcgacaacaaggacaccgtcggcgttgcgcaaccaccaccacccgccgctccggagccgtccttggccgtgcacaccgccgccgacaacaactga

SEQ ID NO: 4280 - protein, 310 aa, Sorghum bicolor
  misc_feature: Ceres ANNOT ID no. 6035534
  misc_feature (73)..(175): Pfam Id: Ribosomal_S30AE Pfam Desc: Sigma 54 modulation protein / S30EA ribosomal protein
  misc_feature (2)..(298): NCBI GI: 170131 NCBI Desc: ribosomal protein 30s subunit
  misc_feature (2)..(298): NCBI GI: 18031 NCBI Desc: spinach s22 r-protein [spinacia oleracea]
  misc_feature (17)..(298): NCBI GI: 51457950 NCBI Desc: chloroplast-specific ribosomal protein [lycopersicon esculentum]
  misc_feature (2)..(181): NCBI GI: 227070 NCBI Desc: ribosomal protein cs-s5
  misc_feature (72)..(282): NCBI GI: 75910086 NCBI Desc: sigma 54 modulation protein/ribosomal protein s30ea [anabaena variabilis atcc 29413]
MATAMSPSPSAAIARPSHPRSCAAASVALRSGFLGRGLAAVVPVAVDDPRCRLRRRVSFSVRMAWDGPLSSVRLIMQGRNVKLSDKLKEHIEDKVGRAVSKHCHLVREVDVRLSARGGELGRGPKTSRCEITLFSKRHGVLRAEEDAESTYASIDLAAAIIKRKLRKIKEKETEVRRDGDGGAGGAWEEELPLLDDDLVEADELAAAVGAEDEQTVVAKVVRTKVFEMPPLTVEEALEQLDNVGHNFYCFRDEATGQVNILYRRKEGGYGLIIPKEDGNFDNKDTVGVAQPPPPAAPEPSLAVHTAADNN

SEQ ID NO: 4281 - DNA, 972 bp, Sorghum bicolor
  misc_feature: Ceres ANNOT ID no. 6035556
  misc_feature: Encodes the peptide sequence at SEQ ID NO 4282
atggcgtccgaggtgtggctatcgccggcgtctcgcctcccatctctctccaccaacgcaccacctcgcttccgctccaacccacctgccaccacaaccgcctctttcttctctccccgcccccgccctgctcgcggcgccctgcctctgctgcgcgtccgccgccgtcttcgcgccaccgaccagcaaggccaggttcaggaacaagacgacgaggtggtggacagcaacatcctcccctactgcaacatcgacaggaagcagaagaagacgctcggagagatggagcaggagttcctgcaagcctgtcaggccttttactttgaccagaaggccatcatgtccagcgaggagtttgacaacctcaaggaggagctcatgtgggaggggagcagcgtcgtcatgctaagcgaagatgagcaaaagcttctggaagcttccatggcctatgccgctggcagccccatcatgtctgatgctgaattcgaccaactcaaactcaaattaaagacagacggcagtgtcattgtgatggagggtcccaggtgcagtctaaggagtcataaggtgtacagcgacttgaatgttgactacctaaagatgttcctgctaaatgttccagccaccactgtagctctgggactgttctttttcattgatgaattgactggttttgagatcaatgtgttccagctgccagagcctttcggattcattttcacatggtttgctgctttgcccctaatattgttcctagcacagttattgactaaggctatagtccaggactttataatcctcaaggggccatgtccaaattgtggtactgagaacctttctttctttgggactatactgtcagtctctagtggcggtacaacaaacaaagtgaaatgtgcaaattgcagtactgagctggaatatgactcaaagtctcgggtgatcacacttccagaagcatcaagtgcataa

SEQ ID NO: 4282 - protein, 323 aa, Sorghum bicolor
  misc_feature: Ceres ANNOT ID no. 6035556
  misc_feature: Useful for making plants with modulated nitrogen use efficiency
  misc_feature: Functional homolog of the protein sequence given in SEQ ID NO 12993
  misc_feature: Useful for making plants with modulated nitrogen use efficiency
  misc_feature: Functional homolog of the protein sequence given in SEQ ID NO 12993
MASEVWLSPASRLPSLSTNAPPRFRSNPPATTTASFFSPRPRPARGALPLLRVRRRLRATDQQGQVQEQDDEVVDSNILPYCNIDRKQKKTLGEMEQEFLQACQAFYFDQKAIMSSEEFDNLKEELMWEGSSVVMLSEDEQKLLEASMAYAAGSPIMSDAEFDQLKLKLKTDGSVIVMEGPRCSLRSHKVYSDLNVDYLKMFLLNVPATTVALGLFFFIDELTGFEINVFQLPEPFGFIFTWFAALPLILFLAQLLTKAIVQDFIILKGPCPNCGTENLSFFGTILSVSSGGTTNKVKCANCSTELEYDSKSRVITLPEASSA

SEQ ID NO: 4283 - DNA, 1515 bp, Sorghum bicolor
  misc_feature: Ceres ANNOT ID no. 6035557
  misc_feature: Encodes the peptide sequence at SEQ ID NO 4284
atggggctcgtctccgggatggtggcggggctgcttctgggcgtggcgctcatggccgcctggagcaggatgatgcgccgccgcaccgccaagcgcgtcgccaaggcagctgacatcaacatccttggctcactctcaagagacgatctaaaaaaactatgtggtgacaattttcctgaatgggtgtcgtttcaacagtttgagcaggtaaagtggctgaacaaacacctaagcaaactctggccttttatagcacaggctgcaacgttggttgtcaaggaatctgttgaaccactactcgatgattaccgccctccaggaataaaatcgctgaagtttagcagatttttccttggaaatgtgccaccaaagatagaaggtattcgtatccaaaacctccagccaggccagatcatcatggacattgattttcggtggggtggagatccaagcataatcctagctgttgattccatttttgcttcattgcccattcagctcaaggatctccaggtattcacggtcgtacgtactatatttcagctttctgaagaggtcccctgcatctccaccgttgtggtggctctccttgcagagccaaagccgaagatacagtacaccctcaaggctgtgggaggaagccttactgctattccagggctttctgatatgattgatgatactgtgaattcaattgttactgacatgcttcagtggccacataggatcgtggttccacttggagtcaatgttgatacaagtgagatggagctgaaacctcagggcagacttgcagtgacagtagtgaaagcaacttgtttggttaatatggagatgattggaaaatcagatccttacgtggtattgtacatccgtcccatgctgaaggtgaaaacgaaggtcgtcgatcataaccttaatcctgaatggaacgagacatttcatctgattgtggaagacaaggaaacacaggaagttatatttgagatttacgatgaggacactcttcagcaagacaagaagatgggtgtggctaaactggcagtgaacagccttgaacctgctgagagcccaacggacatcaccctgaatgtgctgcagtcactagattcactgaaagtgaaggacaacaagggtagagggacactgcacctcaaggtcctgtaccacccattgacgagggaggagcaaatggaggccatggagctggagaagaaagccatggaggagaagaagcggctcaaggaggccgggctaatcggcagcaccatggacgcgctgggcggcgccgcctcgctggtgggctccggcgtcgttggcggcgtcggcctcgtcggctccggaatcggcgccggagtgggcctggtgggctccggaatcggcgccgtgggaagtgggcttggcaaagcgggacacttcatgggccgaaccgtcactggcagtttcagcatgccacggaagcgcgaccgcttgcagcaggtcacgtcacgctcacattcacagataataacctga

SEQ ID NO: 4284 - protein, 504 aa, Sorghum bicolor
  misc_feature: Ceres ANNOT ID no. 6035557
  misc_feature (264)..(346): Pfam Id: C2 Pfam Desc: C2 domain
  misc_feature (1)..(481): NCBI GI: 2789434 NCBI Desc: clb1 [lycopersicon esculentum]
  misc_feature (18)..(483): NCBI GI: 1769895 NCBI Desc: calb protein [arabidopsis thaliana]
  misc_feature (1)..(397): NCBI GI: 38344897 NCBI Desc: osjnba0033g05.21 [oryza sativa (japonica cultivar-group)]
  misc_feature (1)..(395): NCBI GI: 92881657 NCBI Desc: c2 [medicago truncatula]
  misc_feature (1)..(395): NCBI GI: 117557355 NCBI Desc: ntermtm-c2type2.2 protein [arabidopsis thaliana]
MGLVSGMVAGLLLGVALMAAWSRMMRRRTAKRVAKAADINILGSLSRDDLKKLCGDNFPEWVSFQQFEQVKWLNKHLSKLWPFIAQAATLVVKESVEPLLDDYRPPGIKSLKFSRFFLGNVPPKIEGIRIQNLQPGQIIMDIDFRWGGDPSIILAVDSIFASLPIQLKDLQVFTVVRTIFQLSEEVPCISTVVVALLAEPKPKIQYTLKAVGGSLTAIPGLSDMIDDTVNSIVTDMLQWPHRIVVPLGVNVDTSEMELKPQGRLAVTVVKATCLVNMEMIGKSDPYVVLYIRPMLKVKTKVVDHNLNPEWNETFHLIVEDKETQEVIFEIYDEDTLQQDKKMGVAKLAVNSLEPAESPTDITLNVLQSLDSLKVKDNKGRGTLHLKVLYHPLTREEQMEAMELEKKAMEEKKRLKEAGLIGSTMDALGGAASLVGSGVVGGVGLVGSGIGAGVGLVGSGIGAVGSGLGKAGHFMGRTVTGSFSMPRKRDRLQQVTSRSHSQIIT

SEQ ID NO: 4285 - DNA, 810 bp, Sorghum bicolor
  misc_feature: Ceres ANNOT ID no. 6035558
  misc_feature: Encodes the peptide sequence at SEQ ID NO 4286
atggtgctcctcctcctcctgctcctcgtcgccgtcgcctcctcctccctatcccatgatggcgtcgtcgtcgccgacgtgccgccgtccaacaagctgatcttcatcctggcggggcaatccaacatggccggccgcggcggggtggtggcgaaccgctgggacggcgtggtgccgggcgactgcgcgccgtcccccgcggtgctccgcctctcgcccgacctgcgctgggaggaggcgcgggagccgctgcacgcgggaatcgacgccgaccaccacgccgtcggggtcgggcccgggatggcgttcgccaacgcgctgctgcggtcgggccacgcggggagccccgtggtggggctcgtcccctgcgccgtcgggggcacgcggatggcccagtggggcaagggcaccgacctctacgccgagatgctgcgccgcgccagggtcgccgtcgagaccgggggacgcatcggggcgctgctgtggtaccaaggggagagcgacaccgtcaggtggtctgacgccaccgagtacggccgacggatggccatgctcgtccgcgatctccgcgctgatctcggcatcccgcacctcctcgtcatccaggtagggttagcatcaggcctaggacagtatactcaagtcgtaagggatgctcagaaagggatcaaacttcgcaacgtcagattcgttgatgcaatgggattgccattgcaagacggccatctgcatctaagcacccaagctcaagtccagcttggacatatgctggctcagtcctatttgaattatggtacatcccagctctag

SEQ ID NO: 4286 - protein, 269 aa, Sorghum bicolor
  misc_feature: Ceres ANNOT ID no. 6035558
  misc_feature (7)..(269): NCBI GI: 115456711 NCBI Desc: os03g0857500 [oryza sativa (japonica cultivar-group)]
  misc_feature (23)..(263): NCBI GI: 75766303 NCBI Desc: chain d, x-ray structure of protein from arabidopsis thaliana at4g34215 at 1.6 angstrom resolution
  misc_feature (34)..(263): NCBI GI: 58532036 NCBI Desc: osjnba0009k15.9 [oryza sativa (japonica cultivar-group)]
  misc_feature (23)..(206): NCBI GI: 7270372 NCBI Desc: receptor protein kinase-like protein [arabidopsis thaliana]
  misc_feature (10)..(261): NCBI GI: 32473459 NCBI Desc: probable acetyl xylan esterase axea [rhodopirellula baltica sh 1]
  misc_feature: Useful for making plants with altered cell wall content and/or composition
  misc_feature: GREAT-hit functional homolog of the protein sequence encoded by LOCUS at4g34215
  misc_feature: Useful for making plants with altered cell wall content and/or composition
  misc_feature: Functional homolog of the protein sequence given in SEQ ID NO 13862
MVLLLLLLLVAVASSSLSHDGVVVADVPPSNKLIFILAGQSNMAGRGGVVANRWDGVVPGDCAPSPAVLRLSPDLRWEEAREPLHAGIDADHHAVGVGPGMAFANALLRSGHAGSPVVGLVPCAVGGTRMAQWGKGTDLYAEMLRRARVAVETGGRIGALLWYQGESDTVRWSDATEYGRRMAMLVRDLRADLGIPHLLVIQVGLASGLGQYTQVVRDAQKGIKLRNVRFVDAMGLPLQDGHLHLSTQAQVQLGHMLAQSYLNYGTSQL

SEQ ID NO: 4287 - DNA, 837 bp, Sorghum bicolor
  misc_feature: Ceres ANNOT ID no. 6035560
  misc_feature: Encodes the peptide sequence at SEQ ID NO 4288
atggcgcaactggtgcctgaattcatctccctcttcctcctcatcctcctggcctccgcaccagccgccacggcctccagcagccccacgctggtgttcctcctggcggggcagtccaacatgggcggccgcggcggcgccaccaacggcacctgggacggcgtcgtgccgcccgactgcgccccgtccccgcgcatcctccgcctctccccgtctctgcgctgggaggaggcccgggagccgctgcacgccggcatcgacctgcacaacgtcctcggggtcggacccgggatgcccttcgcgcacgcgctcctgcgccgccacggccgcgtcccgccgcacgccgtcgtggggctcgtcccctgcgcgcagggcgccacgcccatcgccagctggtcccgcggcacgccgctgtacgaccgcatgctcaagcgcgcaagggccgccctcgccaacaacaacaacaacaacaacaacaacaacaacaatgctggatcttccaggctcgccgcgcttctgtggtaccagggcgaggccgacaccatcaggcgccaggacgccgacgtctacacgtcccgcatggaggccttcgtccgcgacgtccgccgggacctcggcatgcccgacctgctcgtcatccaggtcggcctcgccacgggccagggcaagttcgtcgacatcgtcagggaagcgcagaggagggtcagcctccacaacgtcaaatacgtggacgccaagggcctgcccgtcgccagcgactacacgcaccttaccacgccggcacaggtgcagctcggcaagatgctcgccgcctcctacctggcacccacgctctga

SEQ ID NO: 4288 - protein, 278 aa, Sorghum bicolor
  misc_feature: Ceres ANNOT ID no. 6035560
  misc_feature (32)..(275): NCBI GI: 58532036 NCBI Desc: osjnba0009k15.9 [oryza sativa (japonica cultivar-group)]
  misc_feature (21)..(275): NCBI GI: 75766303 NCBI Desc: chain d, x-ray structure of protein from arabidopsis thaliana at4g34215 at 1.6 angstrom resolution
  misc_feature (21)..(218): NCBI GI: 7270372 NCBI Desc: receptor protein kinase-like protein [arabidopsis thaliana]
  misc_feature (13)..(150): NCBI GI: 115456711 NCBI Desc: os03g0857500 [oryza sativa (japonica cultivar-group)]
  misc_feature (32)..(274): NCBI GI: 87309203 NCBI Desc: probable acetyl xylan esterase axea [blastopirellula marina dsm 3645]
  misc_feature: Useful for making plants with altered cell wall content and/or composition
  misc_feature: GREAT-hit functional homolog of the protein sequence encoded by LOCUS at3g53010
  misc_feature: Useful for making plants with altered cell wall content and/or composition
  misc_feature: Functional homolog of the protein sequence given in SEQ ID NO 13865
MAQLVPEFISLFLLILLASAPAATASSSPTLVFLLAGQSNMGGRGGATNGTWDGVVPPDCAPSPRILRLSPSLRWEEAREPLHAGIDLHNVLGVGPGMPFAHALLRRHGRVPPHAVVGLVPCAQGATPIASWSRGTPLYDRMLKRARAALANNNNNNNNNNNNAGSSRLAALLWYQGEADTIRRQDADVYTSRMEAFVRDVRRDLGMPDLLVIQVGLATGQGKFVDIVREAQRRVSLHNVKYVDAKGLPVASDYTHLTTPAQVQLGKMLAASYLAPTL

SEQ ID NO: 4289 - DNA, 1338 bp, Sorghum bicolor
  misc_feature: Ceres ANNOT ID no. 6035570
  misc_feature: Encodes the peptide sequence at SEQ ID NO 4290
  misc_feature: Up-regulated in root tissues in response to methyl jasmonate treatment
  misc_feature: Up-regulated in shoot tissues in response to methyl jasmonate treatment
atggcggcctcactcgtgtcctcgctcactgtgcccctcgtctccgccgtcctcggtgccgccatcgccctcgtcttcctcgccggctacctcagccgcaagcgcgccgccatcgctcacatccctcccacggcgaccgccgccgccccggaccagcctaagcatgtccgcccctccaaccaggcccagaacaagaagggccacctccgcgcgcatcaccacgcggccgacaaggacgcggccaagaagcaccaccatctcgatgtcaacaccttgagggggcatactgactccgtcactgcacttgccttctccaatgacgctggcaacctagcaacagtatgcgccgatggagccatcagggtattcaggatcgatgatacctctagcaagagctttaaaattctgaggataaacttgcctgctggagcacaccctaccgctgttgctttctcagaggggtcatcatctgttgttgtggcagcacaggcgcttctggggtcatctctctatatgtatgcagatgttagcgctcctccaaccgcggaaaacaaacagcagggaaagctttctccacctgagatcaagtggagtcaccccaagatccatggcaaggagtctgtgctcaatgttgcagcagcccgtgcaactcatgggtccggtgatgggagcactataattatctcatgctcagaagcaactgatatcaaagtttggcacgggaagagtggaaaggagttgggtacagttgacaccaatcaattaaaaaataatatggctgacatatccccaaatggtcgcttcatagctgctgccgcttttactgccgatgtcaaggtgtgggagatagtttactcgaaggatggttcagcgaaggaggttaataaagttatgcaactcaagggtcataagagtgctgttacttgcttgtgcttcgctccaaattctgaggaagtgattactgcatccaaagatggttccattcgagtatggaacattaatgtaaggtaccacctcgatgaggacccaaagaccttgagagttatgccaattccacttcatgactcaaaaggttctgtttgccaatatgaccatatgaacgtctctcctgatggtaaaattctggctgtaacaagtggatcaacgttgcaatggttatgtgtggaaactggtacagttttggatacagctgagaaagcacatgaaggtgatataactggcattgcttgggctccacgaaaaattcccaatggtggcgtgcctgtgtttattttggggactgctggtgtggacaaaaaggtgaaactttggtcagcgccagaggttggttcaacatga

SEQ ID NO: 4290 - protein, 445 aa, Sorghum bicolor
  misc_feature: Ceres ANNOT ID no. 6035570
  misc_feature (86)..(124): Pfam Id: WD40 Pfam Desc: WD domain, G-beta repeat
  misc_feature (294)..(332): Pfam Id: WD40 Pfam Desc: WD domain, G-beta repeat
  misc_feature (391)..(438): Pfam Id: WD40 Pfam Desc: WD domain, G-beta repeat
  misc_feature (7)..(441): NCBI GI: 23506101 NCBI Desc: at4g00090/f6n15_8 [arabidopsis thaliana]
  misc_feature (268)..(442): NCBI GI: 14091657 NCBI Desc: f6n15.8-like protein [mangifera indica]
  misc_feature (219)..(408): NCBI GI: 47086511 NCBI Desc: transducin (beta)-like 2 [danio rerio]
  misc_feature (219)..(405): NCBI GI: 51703864 NCBI Desc: tbl2-prov protein [xenopus tropicalis]
  misc_feature (200)..(410): NCBI GI: 119590078 NCBI Desc: hcg18987, isoform cra_c [homo sapiens]
  misc_feature: Up-regulated in root tissues in response to methyl jasmonate treatment
  misc_feature: Up-regulated in shoot tissues in response to methyl jasmonate treatment
  misc_feature: The sequence is a functional homolog of SEQ ID NO. 502 in the 11/188,298 US application
MAASLVSSLTVPLVSAVLGAAIALVFLAGYLSRKRAAIAHIPPTATAAAPDQPKHVRPSNQAQNKKGHLRAHHHAADKDAAKKHHHLDVNTLRGHTDSVTALAFSNDAGNLATVCADGAIRVFRIDDTSSKSFKILRINLPAGAHPTAVAFSEGSSSVVVAAQALLGSSLYMYADVSAPPTAENKQQGKLSPPEIKWSHPKIHGKESVLNVAAARATHGSGDGSTIIISCSEATDIKVWHGKSGKELGTVDTNQLKNNMADISPNGRFIAAAAFTADVKVWEIVYSKDGSAKEVNKVMQLKGHKSAVTCLCFAPNSEEVITASKDGSIRVWNINVRYHLDEDPKTLRVMPIPLHDSKGSVCQYDHMNVSPDGKILAVTSGSTLQWLCVETGTVLDTAEKAHEGDITGIAWAPRKIPNGGVPVFILGTAGVDKKVKLWSAPEVGST

SEQ ID NO: 4291 - DNA, 1455 bp, Sorghum bicolor
  misc_feature: Ceres ANNOT ID no. 6035574
  misc_feature: Encodes the peptide sequence at SEQ ID NO 4292
atgacgacaccaccgccacccaagcatgagccgcatggcctcgccgctgttgcggccgaggtgcgcgcgcagcgcggcatcgcgctcccgctcatcggcatgaacctcacctggttcgccaagcaggccgtcaccaccgccttcctgggccgcctcggcgacctccagctggccgccggcacgctcggctacagcttcgccaacgtcaccggcttcgccgtcctcaccggcctctgcggcgccatggagcccatctgcggccaggcgcacggcgcggggaacgtcgccctcctgcgcgggacgctgctcagggccacgctcatgctcctcgccgcctccgtccccatcgcgctcctctggacgcgcgtcgacgccgtcctgctgcgcttcggccagcagcccgacatcgccgacacggccaggacctacgtgctctgcctcctcccggacctcgccgtcacctccgtgctcaacccgctcaaggcctacctcagcgcgcaggaggtgacgctgcccacgctgttcgccgccgcgctggcgctggcgctccacatcccgctcaccgtctcgctctccgccaggatgggcgtcaggggagtggccgcggcagtctggctcagcgacctcgccctcgcgctcatgctcgccgcctacgtgctcgcccacgagctccggcgggggacgacgaccaagccaccaacaccaacaccaacacctgcctccccgacgtcgtcgctcctccgtctcgccgtcccctgctgcctcaacacctgcctcgagtggtggtcctacgagatcctggtgctcctcacgggccgcctccccgacgcccgccgcatggtggccgtcgtcgccgtcaccctcaacttcgactacctgctgttcgccgccatgctgtcgctgtccgtcagcgcgtcggtgcgcgtctccaacgagctgggcgccggggacgccgccctggcgcgccgcgccgcaagggtgtccgtcgcgggcggcttggcggcgggcctcgccggcggcctgctcatgctggcggcgcgccggccgtggccccgcatatacacccgcagcccggaggtgcgggacggcgtgggccgggccatgaaggtcatggccatgctggaggtggtcaacttcccgctcaacgtctgcggcggcatcgtgcggggcacggcgcgcccgctgctgggcatgtacgccgtcgtcggtggcttctacgtggtggcgctgccggtcggcgtcgcgctcgggttcaaggcccgcctcggactcgagggactgctggccggcttcctgctgggcgccgccgtcagcctggcggtgctcgtcacggtcatcgtgtgcatggactgggcggcagaggcagacaaggcgcggaccagggcaggggatgccggtgccggtcgtgtcgagccgtcggcgaccaaggcgccggtggaatcggaggcttgctag

SEQ ID NO: 4292 - protein, 484 aa, Sorghum bicolor
  misc_feature: Ceres ANNOT ID no. 6035574
  misc_feature (30)..(190): Pfam Id: MatE Pfam Desc: MatE
  misc_feature (252)..(415): Pfam Id: MatE Pfam Desc: MatE
  misc_feature (2)..(467): NCBI GI: 52076031 NCBI Desc: ethionine resistance protein -like [oryza sativa (japonica cultivar-group)]
  misc_feature (2)..(467): NCBI GI: 115480241 NCBI Desc: os09g0524300 [oryza sativa (japonica cultivar-group)]
  misc_feature (20)..(458): NCBI GI: 6520161 NCBI Desc: zf14 [arabidopsis thaliana]
  misc_feature (20)..(484): NCBI GI: 92890896 NCBI Desc: multi antimicrobial extrusion protein mate [medicago truncatula]
  misc_feature (14)..(459): NCBI GI: 92867203 NCBI Desc: multi antimicrobial extrusion protein mate [medicago truncatula]
MTTPPPPKHEPHGLAAVAAEVRAQRGIALPLIGMNLTWFAKQAVTTAFLGRLGDLQLAAGTLGYSFANVTGFAVLTGLCGAMEPICGQAHGAGNVALLRGTLLRATLMLLAASVPIALLWTRVDAVLLRFGQQPDIADTARTYVLCLLPDLAVTSVLNPLKAYLSAQEVTLPTLFAAALALALHIPLTVSLSARMGVRGVAAAVWLSDLALALMLAAYVLAHELRRGTTTKPPTPTPTPASPTSSLLRLAVPCCLNTCLEWWSYEILVLLTGRLPDARRMVAVVAVTLNFDYLLFAAMLSLSVSASVRVSNELGAGDAALARRAARVSVAGGLAAGLAGGLLMLAARRPWPRIYTRSPEVRDGVGRAMKVMAMLEVVNFPLNVCGGIVRGTARPLLGMYAVVGGFYVVALPVGVALGFKARLGLEGLLAGFLLGAAVSLAVLVTVIVCMDWAAEADKARTRAGDAGAGRVEPSATKAPVESEAC

SEQ ID NO: 4293 - DNA, 342 bp, Sorghum bicolor
  misc_feature: Ceres ANNOT ID no. 6035755
  misc_feature: Encodes the peptide sequence at SEQ ID NO 4294
atggccgctgagactgttgtcctcaaggttgctatgtcatgcgagggttgcgccggggcggtcagaagagtgctctccaagatggaaggaattgagaccttcgacatagacctcaaggagcagaaggtgacagtcaaaggcaatgtcaagcctgaggacgtcttccagacggtttccaagtcggggaagaagacctcctactgggagggcgaagccgtagccccggacgcttcggctccagcagcagcagaagcagctcccaccaccgcggcagaagcgcctgcggatgctgctgctgctgctgctgtgccagagataaccccagccaaagctgacgcttga

SEQ ID NO: 4294 - protein, 113 aa, Sorghum bicolor
  misc_feature: Ceres ANNOT ID no. 6035755
  misc_feature (6)..(67): Pfam Id: HMA Pfam Desc: Heavy-metal-associated domain
  misc_feature (1)..(113): NCBI GI: 37651975 NCBI Desc: chopper chaperone [hordeum vulgare subsp. vulgare]
  misc_feature (1)..(111): NCBI GI: 6525009 NCBI Desc: copper chaperone homolog cch [oryza sativa]
  misc_feature (3)..(113): NCBI GI: 21553785 NCBI Desc: copper homeostasis factor [arabidopsis thaliana]
  misc_feature (1)..(111): NCBI GI: 6525011 NCBI Desc: copper chaperone homolog cch [glycine max]
  misc_feature (3)..(86): NCBI GI: 47176684 NCBI Desc: copper chaperone [populus alba x populus tremula var. glandulosa]
MAAETVVLKVAMSCEGCAGAVRRVLSKMEGIETFDIDLKEQKVTVKGNVKPEDVFQTVSKSGKKTSYWEGEAVAPDASAPAAAEAAPTTAAEAPADAAAAAAVPEITPAKADA

SEQ ID NO: 4295 - DNA, 2397 bp, Sorghum bicolor
  misc_feature: Ceres ANNOT ID no. 6035756
  misc_feature: Encodes the peptide sequence at SEQ ID NO 4296
atggcgcctcctcctcctcctcctcctcacttgctgccgcgctcttccagcttcacgagcagcgtcatcacccccgcgtccccacacaggggcagccacagacccaatacgtccgtcccaaacgcctccaccactaccgccaccgcggcgcagctctcgctgctccgcgcccacgtccgcgccggccggatgcggcccgcgcgggaggtgttcgacgcaatgccggatcgagggaggtccctcgtcgcatggaccacgctcatgtccgggtacgccacccacggtccagcctccgaggcgctcgagctgctcctctgcatgctcggtcttctcgtcagacccgacgccttcgtcttctctgtcgcgctgcgagcctgcgccgccgtcgggagccttggactcggcaggcagctccacggcgccgtcgccaagctcgggtacgtgggcgccgacctctttgtggccaacggcctcgtcaccatgtactcgagctgccagtcactccgttgcgctgagaaggtcttcggcagtatcacctctccggacctggtttcctggacatctatgctcagtgcatacaccgagaacggatgtgacgccgaagcgctgatgctgttcatggaaatggcccgtgatggcatcgcgtgcgatgcttttacactgtcggtggcactcagggcagcttcgagtttgggccatgtgggattgggccatcagctacactgctgcatgatcaagatggggttggtcggcaaggagttcctggataattgtctgatcggattctatggacggtccggtgaactgcagctgatgcgaaacgtgttcgatgagatgaatggcaaagatttggtttcttggaacaccataatccagtgttatgctgaaaacttgtgccacgaagaagcctcagctcattttcgtgctatgatgtttgaatttgcagaatgcgacgagtttaccctgggcagcattcttcatgttgttaccgcaactggtgcttttggtcatggtatggaaatacatggctacctcatcagagccggtttggactctgacaagcacgttatgagtgctctcatcgatatgtatgtcaattgggctactcttcataagaggtaccgtgtgtttcctttgagaatgttaaaatattatctgacagtccagggcaagctggatcaattcatcgtggcaagcagtctgaagtcatgtgcttctggtctagatctggtagcagggaggatgttgcacgcttgcattttaaagtctaatatgaatccagattcttttgttactagttcgttggtcgacatgtatgctaaatgcggtgctctggaggaatcaaatatgctgttttcaagaaccaagaatccaggtacagctgtgtggtctgctgctatctcaggaaactgtctgaatggccagtacggaagagcagtgcacttgtttaggaggatgcagtcagagcatgtgcaacctaacgaattcacctacaccgctatacttacggcatgtatggctcttggagatactgatagtggtatggagatccacagcaactcgattcgaagtgggtatggaaccaacacctctgtcctgaaaagtttgattaccttttacctaagacaaggtaggtaccaccaggctctgaaactgtgcttagcactctcaaaccatgatatttcttgggacacattggttgaatcattttctcaggttgaccatcatgttggaatagttaatctctttcatgttatccaacgttgcggtgcgaaccttgactaccatactgcacgtctcatcttgagttcgtgtgggaagctgggacttcttgaggaagggttgcaagcacatgcctacatgaccaagcgtggccttgcttccacagcctgtaccaacagctatctcatcgacatgtactcaagttgtggtagccttagacatgcgttcgatgccttcaactatatgcctgacaaggatgcatcttcctggacctcaatagtggcagcaaacgtcgagaatggctgcccagagactgccattcgcctgttttcacagatgcagaaggagaagtgccgtccgacaccagaggcatttttatctgtgctgaaggcctgtgcgagaactggcctagtaaatgaagcattcaggttttttgcgtccatgacggaggtttacaagatacagccctcggaggagcattattcccacatgattgaagtcttgagtcgtgcggggatgttcaaggaggcagagcatttcatcgacagtgttgttccttctgaatctggcgcgtcggcctggagtttgctttgtgctgctgcgaaacagaacggaaatgataagacggtaaagcttgcaggagacagactagcaaggcttcctggtggatgctga

SEQ ID NO: 4296 - protein, 798 aa, Sorghum bicolor
  misc_feature: Ceres ANNOT ID no. 6035756
  misc_feature (82)..(116): Pfam Id: PPR Pfam Desc: PPR repeat
  misc_feature (184)..(218): Pfam Id: PPR Pfam Desc: PPR repeat
  misc_feature (461)..(495): Pfam Id: PPR Pfam Desc: PPR repeat
  misc_feature (662)..(696): Pfam Id: PPR Pfam Desc: PPR repeat
  misc_feature (393)..(794): NCBI GI: 30694644 NCBI Desc: pentatricopeptide (ppr) repeat-containing protein [arabidopsis thaliana]
  misc_feature (393)..(780): NCBI GI: 10177099 NCBI Desc: selenium-binding protein-like [arabidopsis thaliana]
  misc_feature (156)..(791): NCBI GI: 115436472 NCBI Desc: os01g0355100 [oryza sativa (japonica cultivar-group)]
  misc_feature (393)..(794): NCBI GI: 140070126 NCBI Desc: tetratricopeptide-like helical [medicago truncatula]
  misc_feature (377)..(794): NCBI GI: 140044375 NCBI Desc: asp/glu racemase; tetratricopeptide-like helical [medicago truncatula]
MAPPPPPPPHLLPRSSSFTSSVITPASPHRGSHRPNTSVPNASTTTATAAQLSLLRAHVRAGRMRPAREVFDAMPDRGRSLVAWTTLMSGYATHGPASEALELLLCMLGLLVRPDAFVFSVALRACAAVGSLGLGRQLHGAVAKLGYVGADLFVANGLVTMYSSCQSLRCAEKVFGSITSPDLVSWTSMLSAYTENGCDAEALMLFMEMARDGIACDAFTLSVALRAASSLGHVGLGHQLHCCMIKMGLVGKEFLDNCLIGFYGRSGELQLMRNVFDEMNGKDLVSWNTIIQCYAENLCHEEASAHFRAMMFEFAECDEFTLGSILHVVTATGAFGHGMEIHGYLIRAGLDSDKHVMSALIDMYVNWATLHKRYRVFPLRMLKYYLTVQGKLDQFIVASSLKSCASGLDLVAGRMLHACILKSNMNPDSFVTSSLVDMYAKCGALEESNMLFSRTKNPGTAVWSAAISGNCLNGQYGRAVHLFRRMQSEHVQPNEFTYTAILTACMALGDTDSGMEIHSNSIRSGYGTNTSVLKSLITFYLRQGRYHQALKLCLALSNHDISWDTLVESFSQVDHHVGIVNLFHVIQRCGANLDYHTARLILSSCGKLGLLEEGLQAHAYMTKRGLASTACTNSYLIDMYSSCGSLRHAFDAFNYMPDKDASSWTSIVAANVENGCPETAIRLFSQMQKEKCRPTPEAFLSVLKACARTGLVNEAFRFFASMTEVYKIQPSEEHYSHMIEVLSRAGMFKEAEHFIDSVVPSESGASAWSLLCAAAKQNGNDKTVKLAGDRLARLPGGC

SEQ ID NO: 4297 - DNA, 1812 bp, Sorghum bicolor
  misc_feature: Ceres ANNOT ID no. 6035762
  misc_feature: Encodes the peptide sequence at SEQ ID NO 4298
atggggatcgcggaggtggctctccacaccatgccgggggcattcaccacccactccccggcatccattctgtccctcagggcagtcgctaggaggaggaacaagaacactgattcggtgcccaacaccagggcactgcaaggcctcctaaggattccgaggctgaggtccgtcaggcggctgtgccagcggatagacgacattgcgagggtcacagaggggaatgggacttgggtcaaggaagccatgaataacgccggccaggttcttggcgacatcagcgtgcctggtcaggctgtaggtggcaatggtagcctaaatgggagtgttgccaagcctccacctcagaggcggaagtcctcatcggttgaggatgaggcctgggaacttctgcaggagtcaatggtttactattgtggtagtcctgttgggacaattgctgccaacgatccaaatgacagtgatccggtgaactatgatcaggtgtttattcgggacttcataccatctggcattgcttttctactgaagggggaatatgaaattgtgcgtaatttcattctacacacccttcagcttcagagctgggagaagacaatggactgccatagtccaggtcaaggtttaatgcccgccagcttcaaagtgcggacaattccgcttgatggtgatgaggatgcaactgaggaggtcttggatcctgattttggggaggccgcaataggccgtgtggcacctgttgattcaggtctatggtggatcatattgcttagggcatatggaaagtgttcaggggatctgtcagtacaggagagaattgatgtccagactggaatgaaaatgattctgaagctttgtttagctgatggtttcgacatgttccctacattactcgtaactgatggttcatgcatgattgatcgtcgaatgggaatccatgggcatccacttgaaattcaggcactcttctattcagccctcttgtgtgcgcgtgagatgttggctcaagaagacggatcagctgacttaatccgcgccctgaacaatagacttattgcactgtcctttcatatcagggagtactactggcttgacatgcaaaagttgaatgagatatatcgatataaaacagaagaatattcttatgatgctgtcaacaaattcaacatataccccgatcagatatctccatggcttgttgagtggatacctcctaaggggggttactttattggaaacctccagccagctcatatggacttccgattcttttcattgggaaatttatggtcaatagtaagcagcttggcaacaactcatcagtcgcatgccattttagaccttatcgagtctaaatggtctgatttagtggcagagatgccactaaagatatgctatcctgctcttgagaaccaggaatggaaaatcatcactgggagtgatcctaaaaacacgccttggtcgtaccacaatggaggatcctggccaacattactgtggcagctcacagtggcatgcatcaagatgaacagaccagagcttgcagccaaagctatagaggtagctgagaggcgtattgctacagacaaatggcctgaatactacgacaccaagagagcacgcttcattgggaaacaggcacggctgtaccaaacgtggtcaattgctgggttcctagtagccaagctactgatagaaaaaccagatgctgctaggattctgtggaacgatgaggatgcagaaatccttaatgctttgagcacaaacagaaaacggggcaagaaagtgttgaagaaaacatacattgtgtga

SEQ ID NO: 4298 - protein, 603 aa, Sorghum bicolor
  misc_feature: Ceres ANNOT ID no. 6035762
  misc_feature (115)..(587): Pfam Id: Invertase_neut Pfam Desc: Plant neutral invertase
  misc_feature (1)..(603): NCBI GI: 124270304 NCBI Desc: neutral/alkaline invertase [lolium perenne]
  misc_feature (33)..(603): NCBI GI: 2832717 NCBI Desc: alkaline/neutral invertase [lolium temulentum]
  misc_feature (87)..(603): NCBI GI: 32490319 NCBI Desc: osjnba0042i15.24 [oryza sativa (japonica cultivar-group)]
  misc_feature (87)..(603): NCBI GI: 116309429 NCBI Desc: h0321h01.13 [oryza sativa (indica cultivar-group)]
  misc_feature (62)..(603): NCBI GI: 92899277 NCBI Desc: plant neutral invertase; glycoside transferase, six-hairpin [medicago truncatula]
  misc_feature: Useful for making plants with altered carbohydrate content
  misc_feature: Functional homolog of the protein sequence given in SEQ ID NO 13652
  misc_feature: Useful for making plants with modulated oxidative stress sensitivity
  misc_feature: Functional homolog of the protein sequence given in SEQ ID NO 13231
MGIAEVALHTMPGAFTTHSPASILSLRAVARRRNKNTDSVPNTRALQGLLRIPRLRSVRRLCQRIDDIARVTEGNGTWVKEAMNNAGQVLGDISVPGQAVGGNGSLNGSVAKPPPQRRKSSSVEDEAWELLQESMVYYCGSPVGTIAANDPNDSDPVNYDQVFIRDFIPSGIAFLLKGEYEIVRNFILHTLQLQSWEKTMDCHSPGQGLMPASFKVRTIPLDGDEDATEEVLDPDFGEAAIGRVAPVDSGLWWIILLRAYGKCSGDLSVQERIDVQTGMKMILKLCLADGFDMFPTLLVTDGSCMIDRRMGIHGHPLEIQALFYSALLCAREMLAQEDGSADLIRALNNRLIALSFHIREYYWLDMQKLNEIYRYKTEEYSYDAVNKFNIYPDQISPWLVEWIPPKGGYFIGNLQPAHMDFRFFSLGNLWSIVSSLATTHQSHAILDLIESKWSDLVAEMPLKICYPALENQEWKIITGSDPKNTPWSYHNGGSWPTLLWQLTVACIKMNRPELAAKAIEVAERRIATDKWPEYYDTKRARFIGKQARLYQTWSIAGFLVAKLLIEKPDAARILWNDEDAEILNALSTNRKRGKKVLKKTYIV

SEQ ID NO: 4299 - DNA, 759 bp, Sorghum bicolor
  misc_feature: Ceres ANNOT ID no. 6035769
  misc_feature: Encodes the peptide sequence at SEQ ID NO 4300
atgggagattcaaagggcggcgccggcggcatgggcatgaacatggtgaccacggtgatggccttctcggtcagcgccttcttcgtgctcttcgtcttcaccaggctgctctgcgcgcgtctccacctgtccagggcggccgccgaccgcgccgctgccggcgacgccttcgccgtcaacgtggagcgcggcatccacggcctggagccgtccgtggtgacgaccttccccaccgtcaagctcggcgacggcgacggcgacggtggccagcaaacgccgccggtgcaggaggagtgcacggtgtgtctggaggagtacgaggccaaggacgtggtgcgcgtgctccccgcctgcggccacgccttccacgcggcctgcatcgacgcctggctgaggcaacaccccacctgccccgtctgccgcgcctccctgcgcgccaagaacggcacccgcgccgcgccgctcgactacagcctcctcgtcgccggcgccgcagcgaggggctccgcggccgccgcccagcaggtcgtccccgcgtcctcctcgtcctacctcggcgcgtcaccgccggcagccggacaccagcaccagacggacgacatgggtgccgatggcctgctggagatcatctccgaagagcccgcctcgtcgggaggcccgagccctgctgctgctgctggcggtggtggtggccattctcgctgcgcggacgcggcgaggcagagcgaaggcagcgccggctcgtccgaacattgctag

SEQ ID NO: 4300 - protein, 252 aa, Sorghum bicolor
  misc_feature: Ceres ANNOT ID no. 6035769
  misc_feature (99)..(140): Pfam Id: zf-C3HC4 Pfam Desc: Zinc finger, C3HC4 type (RING finger)
  misc_feature (10)..(159): NCBI GI: 124360239 NCBI Desc: zinc finger, ring-type [medicago truncatula]
  misc_feature (2)..(195): NCBI GI: 20160754 NCBI Desc: p0503c12.20 [oryza sativa (japonica cultivar-group)]
  misc_feature (16)..(245): NCBI GI: 49389042 NCBI Desc: ring finger 1 [oryza sativa (japonica cultivar-group)]
  misc_feature (16)..(243): NCBI GI: 38569180 NCBI Desc: osjnba0086b14.4 [oryza sativa (japonica cultivar-group)]
  misc_feature (16)..(243): NCBI GI: 116310080 NCBI Desc: h0818e04.18 [oryza sativa (indica cultivar-group)]
  misc_feature: The sequence is a functional homolog of SEQ ID NO 1131 in the 10/666,642US patent application
  misc_feature: The sequence is a functional homolog of SEQ ID NO 1132 in the 10/666,642US patent application
  misc_feature: The sequence is a functional homolog of SEQ ID NO 1133 in the 10/666,642US patent application
  misc_feature: The sequence is a functional homolog of SEQ ID NO 1134 in the 10/666,642US patent application
  misc_feature: Useful for making plants with modulated growth and phenotype characteristics
  misc_feature: The sequence is a functional homolog of SEQ ID NO 1131 in the 20070033671 US patent application
  misc_feature: The sequence is a functional homolog of SEQ ID NO 1132 in the 20070033671 US patent application
  misc_feature: The sequence is a functional homolog of SEQ ID NO 1133 in the 20070033671 US patent application
  misc_feature: The sequence is a functional homolog of SEQ ID NO 1134 in the 20070033671 US patent application
  misc_feature: The sequence is a functional homolog of SEQ ID NO. 329 in the 11/188,298 US application
  misc_feature: The sequence is a functional homolog of SEQ ID NO. 271 in the 11/188,298 US application
  misc_feature: The sequence is a functional homolog of SEQ ID NO. 350 in the 11/188,298 US application
  misc_feature: The sequence is a functional homolog of SEQ ID NO. 424 in the 11/188,298 US application
MGDSKGGAGGMGMNMVTTVMAFSVSAFFVLFVFTRLLCARLHLSRAAADRAAAGDAFAVNVERGIHGLEPSVVTTFPTVKLGDGDGDGGQQTPPVQEECTVCLEEYEAKDVVRVLPACGHAFHAACIDAWLRQHPTCPVCRASLRAKNGTRAAPLDYSLLVAGAAARGSAAAAQQVVPASSSSYLGASPPAAGHQHQTDDMGADGLLEIISEEPASSGGPSPAAAAGGGGGHSRCADAARQSEGSAGSSEHC

SEQ ID NO: 4301 - DNA, 2124 bp, Sorghum bicolor
  misc_feature: Ceres ANNOT ID no. 6035799
  misc_feature: Encodes the peptide sequence at SEQ ID NO 4302
atgggcacggccaacggccagcagccggcggcggagggcgcttcctctgacaagctccgccacgtcgagtccatgtcggagctgccctccggcgccggcaagatctccgggatcaacgccgtcgtgctcggggagtcgctcgccgccgaggagaacgacctcatcttccccagctccgacttctctgccaacgctctcgtctcctctccgaaacagtatcgggagatgtatgagaggtccatcaagaacccggctgggttctggtcggagattgccgagacattttactggaaggagaagtggaaccctgccgaagtctgctcggagaacctcgatgtcaccaagggacccgtccagatcaactggttcaagggagggaaaactaacatatgttacaacgctgttgaccgcaacatcgagtctggcaatggggacaagattgcaatgtactgggagggtaatgagcccagtcaggatgggaagctcacctattccgagctcctggagaaggtttgccagcttgcaaattacttgaagagccttggtgtcggcaagggtgatgctgttattatctacttaccaatgctactggagcttcccattgccatgcttgcctgtgcccgcattggtgctgtccactcggttgtgtttgctggcttctcagcagattctctagcccaaaggattgttgattgcaagccgaagcttgtcatcacgtgcaatgctgtgaagcggggagtcaagcccatctttctcaaagatatagtggatgtggctttggtcgaaagtgagaagaatggagtctctgtaggtctctgcttgacgtatgaaaatcagtcagccatgaagagggaagacacaaaatggcaaccagaaagggatgtttggtggcaggatgtcgtgaccaaatttccaaccaaatgtgatgtggaatgggtggatgccgaggatccattgttccttttgtacacaagtggcagcacagggaagccaaagggtgtgttgcatacttctgggggctacatggtgtatactgcaacaacctttaagtacgcatttgactacaagccaactgacatatactggtgcactgcagactgtggctggattactggacatagttatgtaacatatggtcctctcctgaatggtgctacggttctcgtttttgaagggactccgaactaccctgattcaggccgatgctgggacattgtcgacaagtacaatgtgacaatattttatactgccccaactcttgttcgttcactcatgcgtgatggcactgagtatgtcacacgttactctcgaaagtctctacgagtcctgggaagtgttggtgagccaatcaatcctagtgcatggagatggttctacaatattgttggggattcccggtgccccatatcagacacctggtggcaaactgaaactggcggtttcatgatcacccctttgcctggcgcctggcctcagaaaccgggttctgcaacctttcctttctttggtgttcagccagtcattgttgatgagaaagggcaagagattgaaggggaatgcagtggatatctttgcataaagaaatcatggcctggggctttccggactctgtatggagatcatgagagatatgagaccacatacttcaaaccatttgctgggtactatttcactggtgatggttgcagcagagacaaagatggttatcactggctgactggaagagtagatgatgtcatcaatgtcagtggacaccgaatcggcactgccgaggttgagtcagctttggtgtcacatccacagtgtgcagaggctgctgttgttggtgttgagcatgaggtcaaaggtcaaggaatttatgcttttgtaactttggtggatggtgttccgtatagtgaggaactacgaaaaagccttataatgacagtgcgcaaccagattggggcatttgcagctcctgacaagatccactgggcaccaggacttcctaaaacccggagtggcaagatcatgcgaaggattttgcgtaaaattgctgcacggcaactggatgaacttggggacataagcacccttgctgaacctgctgtagttgaccagcttattgcgctcagcgattgctag

SEQ ID NO: 4302 - protein, 707 aa, Sorghum bicolor
  misc_feature: Ceres ANNOT ID no. 6035799
  misc_feature (163)..(607): Pfam Id: AMP-binding Pfam Desc: AMP-binding enzyme
  misc_feature (32)..(706): NCBI GI: 116309453 NCBI Desc: h0502b11.5 [oryza sativa (indica cultivar-group)]
  misc_feature (15)..(706): NCBI GI: 145323645 NCBI Desc: amp binding / acetate-coa ligase/ catalytic [arabidopsis thaliana]
  misc_feature (15)..(706): NCBI GI: 2708624 NCBI Desc: acetyl-coa synthetase [arabidopsis thaliana]
  misc_feature (76)..(706): NCBI GI: 38346152 NCBI Desc: osjnbb0118p14.12 [oryza sativa (japonica cultivar-group)]
  misc_feature (15)..(706): NCBI GI: 140047441 NCBI Desc: amp-dependent synthetase and ligase [medicago truncatula]
  misc_feature (289)..(703): SWISSPROT Homolog: EC 6.2.1.1 Acetyl-coenzyme A synthetase, cytoplasmic
MGTANGQQPAAEGASSDKLRHVESMSELPSGAGKISGINAVVLGESLAAEENDLIFPSSDFSANALVSSPKQYREMYERSIKNPAGFWSEIAETFYWKEKWNPAEVCSENLDVTKGPVQINWFKGGKTNICYNAVDRNIESGNGDKIAMYWEGNEPSQDGKLTYSELLEKVCQLANYLKSLGVGKGDAVIIYLPMLLELPIAMLACARIGAVHSVVFAGFSADSLAQRIVDCKPKLVITCNAVKRGVKPIFLKDIVDVALVESEKNGVSVGLCLTYENQSAMKREDTKWQPERDVWWQDVVTKFPTKCDVEWVDAEDPLFLLYTSGSTGKPKGVLHTSGGYMVYTATTFKYAFDYKPTDIYWCTADCGWITGHSYVTYGPLLNGATVLVFEGTPNYPDSGRCWDIVDKYNVTIFYTAPTLVRSLMRDGTEYVTRYSRKSLRVLGSVGEPINPSAWRWFYNIVGDSRCPISDTWWQTETGGFMITPLPGAWPQKPGSATFPFFGVQPVIVDEKGQEIEGECSGYLCIKKSWPGAFRTLYGDHERYETTYFKPFAGYYFTGDGCSRDKDGYHWLTGRVDDVINVSGHRIGTAEVESALVSHPQCAEAAVVGVEHEVKGQGIYAFVTLVDGVPYSEELRKSLIMTVRNQIGAFAAPDKIHWAPGLPKTRSGKIMRRILRKIAARQLDELGDISTLAEPAVVDQLIALSDC

SEQ ID NO: 4303 - DNA, 861 bp, Sorghum bicolor
  misc_feature: Ceres ANNOT ID no. 6035839
  misc_feature: Encodes the peptide sequence at SEQ ID NO 4304
atgtccgacctccgcccgccggagcaccaagtcgccggccaccgcgcctccgccaacaagctgggtccgctcgtcgacggctccggcctcttctacaagccgctccaggccggggaccgcggggagcaagagctcgccttctacgaggcgttctccgcgcacgccgccgtcccggcccgcatccgggacaccttcttcccgcggttccacggcacgcggctcctccccaccgaggcgcggcccggggagccgcatccgcacctcgtcctcgacgacctcctcgcggggctcgaggcgccctgcgtcgccgacatcaagatcggcgccgtcacgtggccgccgagctcgccggagccctacgtcgccaagtgcctcgccaaggaccgcgggaccacgagcgttctgctcggattccgcgtctccggcgtccgggtcgtcggccccgggggcgccgtgtggcgcacggagcgcccggaggtgaaggccctggacaccgccggcgtccgccgcgtgctccggcgctacgtgtcatccgaggggatggactgcgcgctcgccgcggcggtgtacggcggcaaagggggagtcttgtcacagctgcgcgagctcaaggcgtggttcgaggagcagactctgttccacttctactcggcgtcgattcttctgggctatgatgctagtgcagctgcagcaaccggaggtgagggtggggtgagggtgaagctggtggactttgcccatgtggccgagggtgatggggtgattgaccacaacttcctcggcgggctctgctcgctgatcaagttcatatctgacattgttccagagacccctcagacgctgcctttgggtccttcttaa

SEQ ID NO: 4304 - protein, 286 aa, Sorghum bicolor
  misc_feature: Ceres ANNOT ID no. 6035839
  misc_feature (18)..(271): Pfam Id: IPK Pfam Desc: Inositol polyphosphate kinase
  misc_feature (4)..(274): NCBI GI: 134307091 NCBI Desc: inositol polyphosphate multikinase [solanum tuberosum]
  misc_feature (1)..(274): NCBI GI: 92876040 NCBI Desc: inositol polyphosphate kinase [medicago truncatula]
  misc_feature (1)..(225): NCBI GI: 140067935 NCBI Desc: inositol polyphosphate kinase [medicago truncatula]
  misc_feature (10)..(274): NCBI GI: 21430778 NCBI Desc: sd14726p [drosophila melanogaster]
  misc_feature (10)..(274): NCBI GI: 24580674 NCBI Desc: cg13688-pa [drosophila melanogaster]
  misc_feature: The sequence is a functional homolog of SEQ ID NO 8 in US patent 7067720
MSDLRPPEHQVAGHRASANKLGPLVDGSGLFYKPLQAGDRGEQELAFYEAFSAHAAVPARIRDTFFPRFHGTRLLPTEARPGEPHPHLVLDDLLAGLEAPCVADIKIGAVTWPPSSPEPYVAKCLAKDRGTTSVLLGFRVSGVRVVGPGGAVWRTERPEVKALDTAGVRRVLRRYVSSEGMDCALAAAVYGGKGGVLSQLRELKAWFEEQTLFHFYSASILLGYDASAAAATGGEGGVRVKLVDFAHVAEGDGVIDHNFLGGLCSLIKFISDIVPETPQTLPLGPS

SEQ ID NO: 4305 - DNA, 2961 bp, Sorghum bicolor
  misc_feature: Ceres ANNOT ID no. 6035848
  misc_feature: Encodes the peptide sequence at SEQ ID NO 4306
atggcgtccaacacaggagcgtcaggatggttcaggggtaaggtgaaggctgtgacatctggggattgtctactaatcatggggagctcaaaggctgagatcccacctgagaagtccatcaccctgtcctaccttatggccccaaggctggctcgccgaggtggagttgatgagccttttgcatgggaaagcaaagagtttctgaggaagctttgtatagggaaggaggtcacgttcagagtggattatacagctcctaatattggacgagaatttggaactgtttatctaggcgacaagaatgttgcatactcagtagtttctgctggatgggcaagggtaaaggagcaaggccccaaggggggcgaacaaaacccttaccttgctgagctgttgaggttggaggaagtcgccaagcaacagggtgttggtcgttggagcaaggaacctggtgctgctgaagagtcaataagagatcttccaccatctgcaattggtgaagcaagtggttttgatgcaaagggttttgcggttgcaaataaaggcaagagtctggaggcaatagttgaacaagtccgcgatggcagtactgttcgtgtgtatttactccctagtttccagtttgtgcagatatatgttgctggagtacaggctccatcaatggggagacgcccatcggtacctactgtaattgctgaaactgatgatactgctaatggcgtgaacggtgaagattctgagggaacacctgcgcaactgactacagcacaaagacttgttgcttctgcagcttctgctgaagttccaccagataggtatggaagagaagccaagcacttcacagagactagagtcctcaacagagatgtgcgtattgtggtggaaggcacagatagctttagtaatataattggttctgtgtattaccctgatggagagactgcaaaagacttggcccttgagcttgttgaaaatgggcttgcaaagtatgttgagtggagtgctaatatgcttgatgttgaagtaaaaataaagctgaagaacgcagaacttcaggctaaaaaggatcaattgagaatctggacagggtttaagccaccggtgacaaactcgaagcccattcatgaccagaaatttactggaaaagtggtagaggttgtaagtggggattgtattattgtggctgatgatgctgctccatatggcagtccttcagctgaacgtcgggttaatctgtcaagcattagggctcctaagttgggcaatgctcgtacagatgtgaagcctgaaccttttggtcgtgaatctaaggaattcttgcgcacgaggttgattggcaagcaagtggctgttgaaatggaatactctcgaaggatcagcactgtggatggacagagtgctgctccaacagcaaacatggctgatacgagagttctagattatggttcagtatttctgggttcaccatcacagactgatggagatgacatatcttctgctccgagctctgccagccagcctggagttaatgttgctgagcttttgctctcacgaggctttgctaaaacatctaaacacagggattatgaggaaagatcacactattatgatgctttattagcagctgaatcacgggctgagaaagcaaagaaaggagtccattctctaaaagaatctcctgtgatgcatataacagatttgacaactgtatctgcaaagaaggccaaagatttccttcccttcttgcagcggaacagaaggcattcggccatcgtcgaatatgtttttagtggccatcggttcaaactaacaattcctaaggagacttgcagtattgccttctcattatctggtgttcggtgtcctggtaaaggcgaaccatactcagatgaagctattgctttgatgaggagaaggatactgcaacgtgatgtggagatagaggttgaagcagttgacaggacaggaacattcataggttctttgtgggagtccaagaccaacatgggctctgtacttctggaagctgggctcgccaaactgagttcatttggcttggataggatctcagatgcttatgtcctacaaagagctgaacagtctgcaaagcaacaaaagattaagatatgggagaactatgtcgagggtgaaaatgcttccaacggatccacacctgaatctaaacaaaaggaaattctcaaggttgtcgtcacggaagttcttggtggtgggaagttttatgttcagacagtgggtgaccagagggtggcttcaattcaacagcagcttgcatctttgaaacttaaagatgcgccagtaattggtgcttttaatcctgtgaagggagagatagtcctcgcacaatttagccttgacaactcctggaacagagctatgattgttaatgaacctcgttctgtagaatctccgaacgacaagtttgaagtattctatattgactatggcaaccaagaggtggttacctacagtcgtctacgacctgtggacccatctgtttcctcgtctcctgctcttgctcagctatgcagccttgctttcataaaagtgcccagtcttgaggatgacttcggtcaggaagcagcagagtatctaagcgaatgtttgctcagtagctcaaaacaataccgggcaatgatcgaagaacgtgatgcttctgggggaaaatcaaaaggacaaggaaccggaaatgttctcattgttactcttgttgatgcggagacagaaagtagcataaatgctaccatgcttgaggaagggcttgcccggcttgaaagaagcaagagatgggacactagggagaggaagacagctctccagaacctggaacagttccaggagaaggcaaagaaggaaaggctgcggatctggcagtacggagatgttgaatcggacgaggaggagcaggccccagctgcaaggaagcctggaggtcgtcggtag

SEQ ID NO: 4306 - protein, 986 aa, Sorghum bicolor
  misc_feature: Ceres ANNOT ID no. 6035848
  misc_feature (9)..(148): Pfam Id: SNase Pfam Desc: Staphylococcal nuclease homologue
  misc_feature (183)..(363): Pfam Id: SNase Pfam Desc: Staphylococcal nuclease homologue
  misc_feature (377)..(556): Pfam Id: SNase Pfam Desc: Staphylococcal nuclease homologue
  misc_feature (586)..(712): Pfam Id: SNase Pfam Desc: Staphylococcal nuclease homologue
  misc_feature (727)..(853): Pfam Id: TUDOR Pfam Desc: Tudor domain
  misc_feature (1)..(986): NCBI GI: 49388930 NCBI Desc: rna binding protein rp120 [oryza sativa (japonica cultivar-group)]
  misc_feature (1)..(986): NCBI GI: 32966012 NCBI Desc: rna binding protein rp120 [oryza sativa (japonica cultivar-group)]
  misc_feature (1)..(986): NCBI GI: 114144940 NCBI Desc: tudor protein with multiple snc domains [picea abies]
  misc_feature (2)..(986): NCBI GI: 92871102 NCBI Desc: tudor; staphylococcus nuclease subtype [medicago truncatula]
  misc_feature (1)..(986): NCBI GI: 21929220 NCBI Desc: 110 kda 4snc-tudor domain protein [pisum sativum]
MASNTGASGWFRGKVKAVTSGDCLLIMGSSKAEIPPEKSITLSYLMAPRLARRGGVDEPFAWESKEFLRKLCIGKEVTFRVDYTAPNIGREFGTVYLGDKNVAYSVVSAGWARVKEQGPKGGEQNPYLAELLRLEEVAKQQGVGRWSKEPGAAEESIRDLPPSAIGEASGFDAKGFAVANKGKSLEAIVEQVRDGSTVRVYLLPSFQFVQIYVAGVQAPSMGRRPSVPTVIAETDDTANGVNGEDSEGTPAQLTTAQRLVASAASAEVPPDRYGREAKHFTETRVLNRDVRIVVEGTDSFSNIIGSVYYPDGETAKDLALELVENGLAKYVEWSANMLDVEVKIKLKNAELQAKKDQLRIWTGFKPPVTNSKPIHDQKFTGKVVEVVSGDCIIVADDAAPYGSPSAERRVNLSSIRAPKLGNARTDVKPEPFGRESKEFLRTRLIGKQVAVEMEYSRRISTVDGQSAAPTANMADTRVLDYGSVFLGSPSQTDGDDISSAPSSASQPGVNVAELLLSRGFAKTSKHRDYEERSHYYDALLAAESRAEKAKKGVHSLKESPVMHITDLTTVSAKKAKDFLPFLQRNRRHSAIVEYVFSGHRFKLTIPKETCSIAFSLSGVRCPGKGEPYSDEAIALMRRRILQRDVEIEVEAVDRTGTFIGSLWESKTNMGSVLLEAGLAKLSSFGLDRISDAYVLQRAEQSAKQQKIKIWENYVEGENASNGSTPESKQKEILKVVVTEVLGGGKFYVQTVGDQRVASIQQQLASLKLKDAPVIGAFNPVKGEIVLAQFSLDNSWNRAMIVNEPRSVESPNDKFEVFYIDYGNQEVVTYSRLRPVDPSVSSSPALAQLCSLAFIKVPSLEDDFGQEAAEYLSECLLSSSKQYRAMIEERDASGGKSKGQGTGNVLIVTLVDAETESSINATMLEEGLARLERSKRWDTRERKTALQNLEQFQEKAKKERLRIWQYGDVESDEEEQAPAARKPGGRR

SEQ ID NO: 4307 - DNA, 2208 bp, Sorghum bicolor
  misc_feature: Ceres ANNOT ID no. 6035868
  misc_feature: Encodes the peptide sequence at SEQ ID NO 4308
atgtcgtcgtcagccgaagccgagagcgcggcggcggcggcgaccgagaggttccagcgccatgactccctgtacggcgacgccgagaaggtcaccaacggcaagcaccacggctccggggacagctgggcgcggacgctgatgctggcgttccagagcatcggcgtggtgtacggcgacatcgggacgtcgccgctgtacgtgtactcgagcacgttcccggacggcatccggcaccccgacgacctcctcggcgtcctctcgctcatcctctacactctcatcctcatccctatgctcaagtacgtcttcgtcgtcctccacgccaacgacaatggcgatggtggaacgttcgcgctctactcgctgatctcgcggtacgccaagatcaggatgatcccagaccagcagagcgaggacgcaacggtatccaactacagggtggaggcggccagctcacggctgcggagggcgcagtggctcaaggagaagctcgagtccagcaatgccgccaagatcgggctcttcaccatcaccatcctcggcacctccatggtcatgggcgatggaaccttgacgccagcaatctctgtgctctcggcagtgagtgggatcagggagaaagcgcccaacttgagccaattggaggtggtgtggatctcggtggccatactgttccttctcttctcggtgcagcgcttcggcaccgacaaggtgggctactccttcgcgcccatcatatccgtgtggttcgtcctcatcgccggcactgggatgtacaacctcgccgcgcacgatgccaccgtcctccgcgccttcaaccccatgtacattgtcgactacttccgcaggaacggcaaggaggcatgggtctcgctaggtggtgccgtcctctgcatcaccggcacggaggccatgtttgccgatctcggccattttaacatcagggccattcagatcagcttcacatgcatcctcttcccctctgtggcgctgtgctacatgggtcaggcggcctacctgcgcaaattccctgaaaacgttgtcgacaccttctacaaatccatcccagtggccatgttctggccggcgttcctggtggcgatcctggcggcgatcatcgcgagccaggccatgctgtcgggcgcgttcgccatcctgtccaaggcgctgtccctggggtgcttcccccgggtggaggtggtgcacacctccagcaagtacgcggggcaggtgtacctcccggaggtgaacttgctgatcggcgtcgccagcgtcgccgtcacgctggggttccagaccacggccaacatcggcaacgcgtacgggatctgcgtggtgaccgtcttctccatcaccacgcacctgctggcggtggtgatgctgctggtgtggcgcgcgcagccggcgctgtccgccgccttctacgccgtcttcggcctcgtcgagttcctctacctctcctccatcctctccaagttcgccgagggcgggtacctgcccttctgcttctcgctggtgctcatggcgctcatggccgcgtggcactacgtccacgtcctgcgctactggtacgagctggaccacgccgtgccggcggccgagctggccgccgtgctggcgcgccgcgacgtgcgccgggtgcccggcgtcggcctcctctactcggagctggtccaggggatcccgcccgtgttcccgcgcctggtcgacaagatcccctccgtgcacgccgtcttcgtcttcgtgtccatcaagcacctcccgatcccacgcgtagcggcgccggagcgcttcatcttccggcgcgtcggccccgtcgaccaccgcgtgttccgctgcgtggcgaggtacggctacacggacccgatggaagggcaccgggagttcgccgccttcctcctggaccgcctcaagacgttcgtccaggaggaggccgccttcgcctccaccaccagcggttcatcggcggcggtggcggtggcggaggaggagcagcggctcatcgacgcggaggcggagcgcggggtggtgtacctgatgggggaggccacggtgacggcggcggcggggtcgtcgctgctgaaacgggtggtggtgaacaacgtgtacggcttcctacggaagaacctccggggggagagccacaaggcgctgtccatccccaaagaccagctgctcagggtcggcatcacctacgagatctga

SEQ ID NO: 4308 - protein, 735 aa, Sorghum bicolor
  misc_feature: Ceres ANNOT ID no. 6035868
  misc_feature (48)..(735): Pfam Id: K_trans Pfam Desc: K+ potassium transporter
  misc_feature (2)..(698): NCBI GI: 115458178 NCBI Desc: os04g0401700 [oryza sativa (japonica cultivar-group)]
  misc_feature (4)..(667): NCBI GI: 12862380 NCBI Desc: high-affinity potassium transporter [phragmites australis]
  misc_feature (4)..(667): NCBI GI: 12862382 NCBI Desc: high-affinity potassium transporter [phragmites australis]
  misc_feature (2)..(698): NCBI GI: 62900231 NCBI Desc: potassium transporter 1 (oshak1)
  misc_feature (4)..(667): NCBI GI: 12862378 NCBI Desc: high-affinity potassium transporter [phragmites australis]
  misc_feature: The sequence is a functional homolog of SEQ ID NO. 279 in the 11/188,298 US application
MSSSAEAESAAAAATERFQRHDSLYGDAEKVTNGKHHGSGDSWARTLMLAFQSIGVVYGDIGTSPLYVYSSTFPDGIRHPDDLLGVLSLILYTLILIPMLKYVFVVLHANDNGDGGTFALYSLISRYAKIRMIPDQQSEDATVSNYRVEAASSRLRRAQWLKEKLESSNAAKIGLFTITILGTSMVMGDGTLTPAISVLSAVSGIREKAPNLSQLEVVWISVAILFLLFSVQRFGTDKVGYSFAPIISVWFVLIAGTGMYNLAAHDATVLRAFNPMYIVDYFRRNGKEAWVSLGGAVLCITGTEAMFADLGHFNIRAIQISFTCILFPSVALCYMGQAAYLRKFPENVVDTFYKSIPVAMFWPAFLVAILAAIIASQAMLSGAFAILSKALSLGCFPRVEVVHTSSKYAGQVYLPEVNLLIGVASVAVTLGFQTTANIGNAYGICVVTVFSITTHLLAVVMLLVWRAQPALSAAFYAVFGLVEFLYLSSILSKFAEGGYLPFCFSLVLMALMAAWHYVHVLRYWYELDHAVPAAELAAVLARRDVRRVPGVGLLYSELVQGIPPVFPRLVDKIPSVHAVFVFVSIKHLPIPRVAAPERFIFRRVGPVDHRVFRCVARYGYTDPMEGHREFAAFLLDRLKTFVQEEAAFASTTSGSSAAVAVAEEEQRLIDAEAERGVVYLMGEATVTAAAGSSLLKRVVVNNVYGFLRKNLRGESHKALSIPKDQLLRVGITYEI

SEQ ID NO: 4309 - DNA, 831 bp, Sorghum bicolor
  misc_feature: Ceres ANNOT ID no. 6035880
  misc_feature: Encodes the peptide sequence at SEQ ID NO 4310
atggacttctcctacttcttctcgtcgtcgtcttcgtcggagaagaagtcctcgacgaagcgccggcagcagcagcagcagcatcaacaggacaacaatggcaacgagacaagatacctcggggtgaggcggcggccatggggccggtacgccgcagagatccgggacccggccaccaaggagcggcactggctcggcacgttcgacaccgcggaggaggccgccatcgcctacgaccgcgccgcccgcaacatccgcggcgccaacgcccgcaccaacttcgcctaccccgacctgccgccgggctcctccgtcaccccgtacctctccccggacctctccgccgaccagctccagcactactattacgccgccgccgaccccgtagcacccgccgccgctcatcagctggcaacaacaccggactgcgatcatcatcagtccgcacatggcggcggcgccggcggcaacgatccggtctatcatcagtaccaccacgtgccggtggagacgacgatgccgtcctacggcggcgctgctgacgcgtcgttcatggcctacggcgggaacgctgagatgggcatgtactgcttcgaaggcgccaacaacggcgccgctggcggcggtgacgacagggcgtggtgcgacgcgtcggagctgcagttcggtggtcacaacgacgacacggcggcggcggcggcggccaacgcgtcgcacggaatgtacttcgaggaagggtacttgcacagcccaatgttttcgccgatgccggccgccgacgaggtcgtcgacgggttccagctcggcgggtcgtcttcgtattactactga

SEQ ID NO: 4310 - protein, 276 aa, Sorghum bicolor
  misc_feature: Ceres ANNOT ID no. 6035880
  misc_feature (37)..(88): Pfam Id: AP2 Pfam Desc: AP2 domain
  misc_feature (1)..(276): NCBI GI: 38605805 NCBI Desc: osjnbb0014d23.10 [oryza sativa (japonica cultivar-group)]
  misc_feature (1)..(276): NCBI GI: 116309386 NCBI Desc: osigba0113l04.1 [oryza sativa (indica cultivar-group)]
  misc_feature (1)..(194): NCBI GI: 49387780 NCBI Desc: branched silkless 1-like [oryza sativa (japonica cultivar-group)]
  misc_feature (9)..(205): NCBI GI: 62466419 NCBI Desc: frizzy panicle [oryza glumipatula]
  misc_feature (9)..(205): NCBI GI: 62466455 NCBI Desc: frizzy panicle [oryza rufipogon]
  misc_feature: The plant flowers significantly late compared to wild-type.
  misc_feature: The sequence is a functional homolog of SEQ ID NO 1195 in the 10/666,642US patent application
  misc_feature: The sequence is a functional homolog of SEQ ID NO 1291 in the 10/374,780US patent application
  misc_feature: Useful for making plants with modulated biomass
  misc_feature: Useful for making plants with modulated flowering time
  misc_feature: Useful for making plants with modulated growth and phenotype characteristics
  misc_feature: Functional homolog of the protein sequence given in SEQ ID NO 12895
  misc_feature: The sequence is a functional homolog of SEQ ID NO 1291 in the 20060162006 US patent application
  misc_feature: The sequence is a functional homolog of SEQ ID NO 1195 in the 20070033671 US patent application
  misc_feature: Useful for making plants with modulated biomass
  misc_feature: Useful for making plants with modulated flowering time
  misc_feature: Functional homolog of the protein sequence given in SEQ ID NO 13801
MDFSYFFSSSSSSEKKSSTKRRQQQQQHQQDNNGNETRYLGVRRRPWGRYAAEIRDPATKERHWLGTFDTAEEAAIAYDRAARNIRGANARTNFAYPDLPPGSSVTPYLSPDLSADQLQHYYYAAADPVAPAAAHQLATTPDCDHHQSAHGGGAGGNDPVYHQYHHVPVETTMPSYGGAADASFMAYGGNAEMGMYCFEGANNGAAGGGDDRAWCDASELQFGGHNDDTAAAAAANASHGMYFEEGYLHSPMFSPMPAADEVVDGFQLGGSSSYYY

SEQ ID NO: 4311 - DNA, 654 bp, Sorghum bicolor
  misc_feature: Ceres ANNOT ID no. 6035881
  misc_feature: Encodes the peptide sequence at SEQ ID NO 4312
atgtcgtccgacgcggtggccgccaggaagggccggttgaagcagcgctacgacaacgagttccgcctcgtcgcagggtgcgtgccgtaccgggcgaacaagaaggacgacgagctaggcaacccgtgcagcagcctcggcgtcggcgacgaccacacggcggaggtggaggtgctcatgatctccacgcctaaccggaccgacatggtcttccccaagggtgggtgggaggacgacgaggacgtgtaccaggcggcatcccgcgaggccatggaggaggccggcgtcaagggcatcatcaacagagctgccttggggcactgggtgttcaagagcaagagcagccagaacagcaccagccttagtggagcctgcaagggctacatcttcgccatggaggtcaccgaggagctggagacgtggccggagcaggacacgcacaaccgccgatgggtctctcccgccgaagcctaccagctctgccggtacgaatggatgcgggaggcgctcaccgcgctgctggagaggctgtcggtgctcgagccggtggccgcggcgacggcggcagccacaccgccggagctgaccgaccaacaagctggcatgtacatgatgctgcaggcgtcctcggacggcgcggtggcgctgtgctag

SEQ ID NO: 4312 - protein, 217 aa, Sorghum bicolor
  misc_feature: Ceres ANNOT ID no. 6035881
  misc_feature (21)..(176): Pfam Id: NUDIX Pfam Desc: NUDIX domain
  misc_feature (6)..(217): NCBI GI: 115458156 NCBI Desc: os04g0399300 [oryza sativa (japonica cultivar-group)]
  misc_feature (6)..(217): NCBI GI: 116309470 NCBI Desc: h0209h04.8 [oryza sativa (indica cultivar-group)]
  misc_feature (6)..(174): NCBI GI: 15231598 NCBI Desc: mutt/nudix family protein [arabidopsis thaliana]
  misc_feature (6)..(174): NCBI GI: 8698735 NCBI Desc: contains similarity to ap2/erebp-like transcription factor from arabidopsis thaliana gbaf216581 and contains bacterial mutt protein pf00293 and ap2 pf00847 domains
  misc_feature (3)..(170): NCBI GI: 92884561 NCBI Desc: nudix hydrolase [medicago truncatula]
MSSDAVAARKGRLKQRYDNEFRLVAGCVPYRANKKDDELGNPCSSLGVGDDHTAEVEVLMISTPNRTDMVFPKGGWEDDEDVYQAASREAMEEAGVKGIINRAALGHWVFKSKSSQNSTSLSGACKGYIFAMEVTEELETWPEQDTHNRRWVSPAEAYQLCRYEWMREALTALLERLSVLEPVAAATAAATPPELTDQQAGMYMMLQASSDGAVALC

SEQ ID NO: 4313 - DNA, 1299 bp, Sorghum bicolor
  misc_feature: Ceres ANNOT ID no. 6035887
  misc_feature: Encodes the peptide sequence at SEQ ID NO 4314
atgacgcgggcgagggcggtgtggcgccccgctgcggtcgtcctcctcgcggtcgcttccctctcctgcgtcctcacgccgccgctggtctccgcagccgcgggagcagaggtggccggcggggtggctcgtcggaataccgagcgcatcgcaggaagtgctggtgatgtgctagaggacaatcctattggaaggttgaaggttttcatctatgacttgccaagcaagtacaacaagaggattgtcaccaaggatccacgatgcctccatcacatgtttgctgccgagatattcatgcaccggttcttgctctctagtgcggtgcgaacactcaacccagaagaagctgattggttctacacgccggtttacactacatgtgatcttactcctgctggacttccacttccattcaagtccccaaggatgatgagaagtgcaatcaaatttatttcaaacaagtggcctttctggaacagaactgatggagctgatcacttctttgttgttccacatgattttggtgcatgctttcactatcaggaagaaaaagctaccgaacgtggaattctcccaatgctccgccgtgctacattggtccaaacatttgggcagaagaaccatgtctgcctgaaagagggttctatcattataccgccatatgcacctccacagaaaatgcaggctcacttggttccccctgacactccccgttcaatctttgtttacttcaggggactgttttatgacaatggtaatgaccctgagggtgggtattatgcgagaggtgcccgagcatcactgtgggagaacttcaagaacaatcctctctttgatatctccacagatcaccctgtcacttactatgaagatatgcagcgcgcagtcttctgcttgtgcccactgggatgggcaccatggagcccgaggctggtggaggccgtggttttcggctgcattccagtcatcatagctgatgacattgtcctaccatttgctgatgctatcccatgggaggacattggagtttttgttgacgaagaggatgttccaaagctagattcaatcctcacttccattccaatcgaaaatattctacggaagcaaagattgctggccaatccatctatgaagaaggccatgttgttcccacagccagcccaacctagggatgcattccatcagatcctaaatggccttgctcgcaagttgccacacatgcagagtgtatacttgcaaccaggagagaagcacctcaactggactgctggacctgctggagatctgaagccttggtag

SEQ ID NO: 4314 - protein, 432 aa, Sorghum bicolor
  misc_feature: Ceres ANNOT ID no. 6035887
  misc_feature (68)..(372): Pfam Id: Exostosin Pfam Desc: Exostosin family
  misc_feature (22)..(432): NCBI GI: 17978869 NCBI Desc: at5g61840/mac9_140 [arabidopsis thaliana]
  misc_feature (43)..(432): NCBI GI: 15223522 NCBI Desc: exostosin family protein [arabidopsis thaliana]
  misc_feature (42)..(432): NCBI GI: 60657598 NCBI Desc: secondary cell wall-related glycosyltransferase family 47 [populus tremula x populus tremuloides]
  misc_feature (92)..(432): NCBI GI: 23821292 NCBI Desc: pectin-glucuronyltransferase [nicotiana plumbaginifolia]
  misc_feature (92)..(406): NCBI GI: 39725600 NCBI Desc: npgut1 homolog [nicotiana tabacum]
  misc_feature: Useful for making plants with altered cell wall content and/or composition
  misc_feature: GREAT-hit functional homolog of the protein sequence encoded by LOCUS at1g27440
  misc_feature: GREAT-hit functional homolog of the protein sequence encoded by LOCUS at5g61840
  misc_feature: Useful for making plants with altered carbohydrate content
  misc_feature: Functional homolog of the protein sequence given in SEQ ID NO 13639
  misc_feature: Useful for making plants with altered cell wall content and/or composition
  misc_feature: Functional homolog of the protein sequence given in SEQ ID NO 13864
MTRARAVWRPAAVVLLAVASLSCVLTPPLVSAAAGAEVAGGVARRNTERIAGSAGDVLEDNPIGRLKVFIYDLPSKYNKRIVTKDPRCLHHMFAAEIFMHRFLLSSAVRTLNPEEADWFYTPVYTTCDLTPAGLPLPFKSPRMMRSAIKFISNKWPFWNRTDGADHFFVVPHDFGACFHYQEEKATERGILPMLRRATLVQTFGQKNHVCLKEGSIIIPPYAPPQKMQAHLVPPDTPRSIFVYFRGLFYDNGNDPEGGYYARGARASLWENFKNNPLFDISTDHPVTYYEDMQRAVFCLCPLGWAPWSPRLVEAVVFGCIPVIIADDIVLPFADAIPWEDIGVFVDEEDVPKLDSILTSIPIENILRKQRLLANPSMKKAMLFPQPAQPRDAFHQILNGLARKLPHMQSVYLQPGEKHLNWTAGPAGDLKPW

SEQ ID NO: 4315 - DNA, 2229 bp, Sorghum bicolor
  misc_feature: Ceres ANNOT ID no. 6035912
  misc_feature: Encodes the peptide sequence at SEQ ID NO 4316
atgtccatctccccacgcgaacgcaccggaggacactattacccgcgcccgcacaaccctagccctagtacccaacatggcagcgacagacgccgccacggccgccgctcccctccggcatccgtctcgccacctggcgccgctgcggcggccggcgacggtggggtcggctcgagctcccacccagtggttccagctattagagaatctattaatgctcccgaaaaggtagttggatttataatatctggggaagagacaattactcaagaggttggcagtattgaagaatgccactcttcagaacaggggaatttgggtttccctgtagataattttggttcagttgggccatatcctgagagacctaaaatggcgggatcccttgaggctgaccatttggcttcaggttctactggacatcagggtaatgggactcagatagctgccaggaagaatcagtccgtgaatgccaatcacctcctgaatttccagtatgatcctatttctcggccacagcccagaggccctagaacatatcctcccagaagacaaaggaagatcaaaccttacaacaaggatctgttcctccaagcaaactataagtttgttgtgttggatactgggaattaccagattgaatcaatggatcctgataagatgcttcagtgggaagatattatctgtgtaaggtactatagcccttctgaggtacaatgccctatttgtttggaaagcccattgtgcccacagatcacatcatgtggacacatatattgctttccatgcattttgcattatctaacgatgggcaaagaggattatagaggtgaatgctggaagaagtgtcctctgtgtttcatgatggtatcaacaaaggatttgtatacaatacaaattactcaagtccagaatttctgtgctggtgacgttgccacatttacacttctgagtcgttcaagaaattcactcactccttccattaaaatctcctccagtgaaagttctacagcagatgaagatccatataatgttttctcaaagtttattgtgacatctgacgtggagttgtctgttcgagaggcaaaattggatcttagtaattggttgcatatggcagacttaggccttgttgatgacttggagaaacttccatatgtttctgctgctttggagcaactggaagaaaggatgaaacattggattgagtacagaaactatggtggtagccctccatcaaaagatagcttctctcctggatctagtttcaagtctaggaattcttttgatgtgaatacttctcaccagatcagcggccgcaagatctctgtttcagatagagatatggtcagtggtatttcagaactctccatgtctcctgagttgagcacaaactctggtaaaggaacaatgtctaaagtaaatgagaaatgtaccaccaccattgattcaaatgaacatgatccatacatattttaccaggtgtcagatggccaacacctaattcttcatccactaaacatgagatgtcttctaaaccattttggaggttctgatatgcttccacctaggataactgcaaaaatattggagctggaaactgtaacacagtctgaggctataaggaagcgctatcggtttttgagtcatttctcattaacaactacattccagttctgtgaaattgacctgagtgatatagtatctcctagctcattggctccattcttggatgaaatcaagaagcgtgagaaacaaagaagacgaaccgccaagaaggaagaaagtgagagagcaaaggcagaagttgctgctgctgtgcaggcatcagctatgcggtttgagtatgcaaattcctctcaaagtcacaacgatgtcatgttctctctggatgacttcgaagctctgggaaacaatgctgggccatccaccagtccacgagtcagtgaaaggaagcttttctctgacgtaacacgcctgggttttgcatctgctcaagactcacctcccctaagactcggaactggggatgccaatggccaaagtgaaaactcgagagaccaagggccgttagcgacacctgcattatcatttgccagcatcatatcttccagtagagccgtggctgcagctgacaactcggagatgcagaaagcaaatggcactgggaagaagggcaagaaagcaactagagtgctcttgtcgactggtggcgcccgtcgatactga

SEQ ID NO: 4316 - protein, 742 aa, Sorghum bicolor
  misc_feature: Ceres ANNOT ID no. 6035912
  misc_feature (240)..(286): Pfam Id: zf-C3HC4 Pfam Desc: Zinc finger, C3HC4 type (RING finger)
  misc_feature (154)..(397): NCBI GI: 21619487 NCBI Desc: ring finger protein 10 [homo sapiens]
  misc_feature (154)..(397): NCBI GI: 9367867 NCBI Desc: rnf10, ring finger 10; kiaa0262; rie2; alternatively spliced product [homo sapiens]
  misc_feature (154)..(397): NCBI GI: 119618608 NCBI Desc: ring finger protein 10, isoform cra_c [homo sapiens]
  misc_feature (154)..(397): NCBI GI: 119618607 NCBI Desc: ring finger protein 10, isoform cra_b [homo sapiens]
  misc_feature (154)..(397): NCBI GI: 60654675 NCBI Desc: ring finger protein 10 [synthetic construct]
  misc_feature: The sequence is a functional homolog of SEQ ID NO 74 in the 10/666,642US patent application
  misc_feature: Useful for making plants with modulated growth and phenotype characteristics
  misc_feature: The sequence is a functional homolog of SEQ ID NO 74 in the 20070033671 US patent application
MSISPRERTGGHYYPRPHNPSPSTQHGSDRRRHGRRSPPASVSPPGAAAAAGDGGVGSSSHPVVPAIRESINAPEKVVGFIISGEETITQEVGSIEECHSSEQGNLGFPVDNFGSVGPYPERPKMAGSLEADHLASGSTGHQGNGTQIAARKNQSVNANHLLNFQYDPISRPQPRGPRTYPPRRQRKIKPYNKDLFLQANYKFVVLDTGNYQIESMDPDKMLQWEDIICVRYYSPSEVQCPICLESPLCPQITSCGHIYCFPCILHYLTMGKEDYRGECWKKCPLCFMMVSTKDLYTIQITQVQNFCAGDVATFTLLSRSRNSLTPSIKISSSESSTADEDPYNVFSKFIVTSDVELSVREAKLDLSNWLHMADLGLVDDLEKLPYVSAALEQLEERMKHWIEYRNYGGSPPSKDSFSPGSSFKSRNSFDVNTSHQISGRKISVSDRDMVSGISELSMSPELSTNSGKGTMSKVNEKCTTTIDSNEHDPYIFYQVSDGQHLILHPLNMRCLLNHFGGSDMLPPRITAKILELETVTQSEAIRKRYRFLSHFSLTTTFQFCEIDLSDIVSPSSLAPFLDEIKKREKQRRRTAKKEESERAKAEVAAAVQASAMRFEYANSSQSHNDVMFSLDDFEALGNNAGPSTSPRVSERKLFSDVTRLGFASAQDSPPLRLGTGDANGQSENSRDQGPLATPALSFASIISSSRAVAAADNSEMQKANGTGKKGKKATRVLLSTGGARRY

SEQ ID NO: 4317 - DNA, 2181 bp, Sorghum bicolor
  misc_feature: Ceres ANNOT ID no. 6036084
  misc_feature: Encodes the peptide sequence at SEQ ID NO 4318
atgggtgcagacccaagtacccaggatgcgatggtggaggcagccctaaaagcaaagcatgcagcagagcgcaagttccatgcatgtaacatcaagggtgcccggaggtcagcgatcaaggctcataacttgtgcccatcacttgagggcatatctcagatgatctccacacttgatgttcacgttgcatctgagtcgaagattgatggggagagtgactggtacaggatactgtctctagatgccacggctgatgaagaggaggtgaagaaacagtacagaaagctagctctccagttgcacccagacaagaacaagtcggttggtgcagaggttgccttcagacttatatcggaggcatggagtgtattgtctgacaagagcaggaagatgctttatgatcagaagaggagagaccacagtgcggccaatgtgtccaatggtttgtatgcttctgatataaaagtcagtaagcgagcacgaaaaaatgccgctgccgctgcctctgcctcagcagctgtcgaggctactactcgtcctgcaggggctaatacattctggacatcatgcaaccgctgcaggatgcagtatgagtacttgagaatttatctgaaccacaacctactgtgcccaaactgtcaccatgcattcatggctgtagaaactggatttccctgcaatggaaccagtaattcattcacctggacaaccaagccacagcagcaggagaaccacaatactgtcgttgaccattcataccaatcagcaagcagaacatcaagcattccaggcactggacatggagcataccagcaagagaacacttatgagttgtacaataaccaaagtttccagttcactcagtaccccaagacaacaggcgctgctgctacaaatggatacagtacacagtccttagagaaatcaaagagaaaacatgaagagaactacatatacaattatttttcaagtggcaatgacaatgggtatgcatcagggcgtgggcggcattcaaaaaggaggcggaatttcaataatggctatgcatctgtggactgtaacggggaaactctggctgcaactgccggtatgactgtgattgccgaaggaggaagagttaatggtacatcaggggaaaagtttagatctgcagtaagtgcaagaaaagctaatgtcttgagggagatcttccaacttgacacccgtggtcttcttcttgagaaagccaaagcagaagttcgtgaaaaattacaaggctggaatatttcgacatctagccagcttgccaagaaagggaaatcagaaagaagagagaagcaagtcgaaaacaatataaaggttaatggcatcctctctgacaatccaatcaatagatgcaagaaatacagttcaaaagatgcagatgtcgagatccctgtgactgatgtagtgaatccagaacagatgcgtgtacccatgtccattgatgtccctgacccagatttccatgactttgataaagatcgaacagaaagagcctttggcaatgatcagatctgggctacatatgatagtgaagatggcatgcctcgcctatatgcaatggtacagaaagttatttccatgaaacctttcaggatacggatgagcttcctcaattctaagtccaacaatgaactggcaccaataaactggatcgcctcaggttttacgaagacatgtggtgattttaggattggaagataccagattactgaaacagtcaacatcttttctcacagagtttgctggagtaaaggtcctcggggaattatcaggattattccccaaaaaggtgatacatgggctgtgtaccggaactggtctcctgattggaatgaacttacaccagatgatgtgatatataagtatgagatagtagaagtgactgatgacttcacagaagagcaaggtgtgggtgttgtcccattgctgaaggtagctgggttcaaagcagttttccacaggctcacgggccccgatgtggtcagaagaataccgaaggaagagcttttccgcttctctcatcgggttccttctcgcctgctcactggtgaagaaagaaataatgctccaaaaggttgccatgagttggatcctgctgcaactccagttgacctgcttaagattattacagatgtcaaggaagataccacacagtga

SEQ ID NO: 4318 - protein, 726 aa, Sorghum bicolor
  misc_feature: Ceres ANNOT ID no. 6036084
  misc_feature (73)..(134): Pfam Id: DnaJ Pfam Desc: DnaJ domain
  misc_feature (12)..(726): NCBI GI: 38344577 NCBI Desc: osjnba0053b21.9 [oryza sativa (japonica cultivar-group)]
  misc_feature (12)..(726): NCBI GI: 116309347 NCBI Desc: osigba0096p03.4 [oryza sativa (indica cultivar-group)]
  misc_feature (144)..(726): NCBI GI: 115458066 NCBI Desc: os04g0388800 [oryza sativa (japonica cultivar-group)]
  misc_feature (393)..(710): NCBI GI: 9757996 NCBI Desc: dnaj protein-like [arabidopsis thaliana]
  misc_feature (224)..(710): NCBI GI: 79536755 NCBI Desc: heat shock protein binding / unfolded protein binding [arabidopsis thaliana]
MGADPSTQDAMVEAALKAKHAAERKFHACNIKGARRSAIKAHNLCPSLEGISQMISTLDVHVASESKIDGESDWYRILSLDATADEEEVKKQYRKLALQLHPDKNKSVGAEVAFRLISEAWSVLSDKSRKMLYDQKRRDHSAANVSNGLYASDIKVSKRARKNAAAAASASAAVEATTRPAGANTFWTSCNRCRMQYEYLRIYLNHNLLCPNCHHAFMAVETGFPCNGTSNSFTWTTKPQQQENHNTVVDHSYQSASRTSSIPGTGHGAYQQENTYELYNNQSFQFTQYPKTTGAAATNGYSTQSLEKSKRKHEENYIYNYFSSGNDNGYASGRGRHSKRRRNFNNGYASVDCNGETLAATAGMTVIAEGGRVNGTSGEKFRSAVSARKANVLREIFQLDTRGLLLEKAKAEVREKLQGWNISTSSQLAKKGKSERREKQVENNIKVNGILSDNPINRCKKYSSKDADVEIPVTDVVNPEQMRVPMSIDVPDPDFHDFDKDRTERAFGNDQIWATYDSEDGMPRLYAMVQKVISMKPFRIRMSFLNSKSNNELAPINWIASGFTKTCGDFRIGRYQITETVNIFSHRVCWSKGPRGIIRIIPQKGDTWAVYRNWSPDWNELTPDDVIYKYEIVEVTDDFTEEQGVGVVPLLKVAGFKAVFHRLTGPDVVRRIPKEELFRFSHRVPSRLLTGEERNNAPKGCHELDPAATPVDLLKIITDVKEDTTQ

SEQ ID NO: 4319 - DNA, 210 bp, Sorghum bicolor
  misc_feature: Ceres ANNOT ID no. 6036104
  misc_feature: Encodes the peptide sequence at SEQ ID NO 4320
atggcggactggggccccgtggtggtgggcgtggtgctcttcgtgctgctgtcgcctggcctgctctgcgagctcccgggcacgcaccgccacgtcgacttcggcggcttccacaccaacggcaaggccatcttcgtgcacaccctcatcttcttcgccgccttcaccatcctcacgctcgcgctccacgtccacatctacaccggctag

SEQ ID NO: 4320 - protein, 69 aa, Sorghum bicolor
  misc_feature: Ceres ANNOT ID no. 6036104
  misc_feature (1)..(69): NCBI GI: 115485585 NCBI Desc: os11g0496500 [oryza sativa (japonica cultivar-group)]
  misc_feature (3)..(67): NCBI GI: 1532167 NCBI Desc: localized according to blastn similarity to est sequences; therefore, the coding span corresponds only to an area of similarity since the initation codon and stop codon could not
  misc_feature (3)..(67): NCBI GI: 1532167 (continued) be precisely determined [arabidopsis thaliana]
  misc_feature (2)..(67): NCBI GI: 1532168 NCBI Desc: localized according to blastn similarity to est sequences; therefore, the coding span corresponds only to an area of similarity since the initation codon and stop codon could not
  misc_feature (2)..(67): NCBI GI: 1532168 (continued) be precisely determined [arabidopsis thaliana]
  misc_feature (1)..(64): NCBI GI: 10178281 NCBI Desc: katanin p80 subunit-like protein [arabidopsis thaliana]
  misc_feature: Useful for making plants with altered cell wall content and/or composition
  misc_feature: Functional homolog of the protein sequence given in SEQ ID NO 13863
MADWGPVVVGVVLFVLLSPGLLCELPGTHRHVDFGGFHTNGKAIFVHTLIFFAAFTILTLALHVHIYTG

SEQ ID NO: 4321 - DNA, 510 bp, Sorghum bicolor
  misc_feature: Ceres ANNOT ID no. 6036111
  misc_feature: Encodes the peptide sequence at SEQ ID NO 4322
atggcgtgctgccgggccctctctctccagctccttcccgcctccgctcactcccgcccccggattaacttccatcgtcgcatccgatgctgcgccgccgcgggcgaccaggtggaggcgccgcaggacgccgtgctcaaggccatttctcaagtagcaagttctaaaggaaggattgcacaaacaacaaatgttatcatgggtggtactgtgacagatgacacaacagatgaatgggttgttcttgataaaaaggtaaatacttatcctacagttagagggtttacagcaattggtacaggaggtgatgattttgtccagtcaatggttgttgctgttgaatcagtcattggagaacatgttcccgagggtcaaatatcccagaaagtgtctgcaaaggggaaatatgtgtctgtcaaaattggacctatccgtgtggtttccaaggagcaggtccaagcggtgtacaatgccatgaggaaagatgagcgaatgaaattctttttgtga

SEQ ID NO: 4322 - protein, 169 aa, Sorghum bicolor
  misc_feature: Ceres ANNOT ID no. 6036111
  misc_feature (1)..(126): NCBI GI: 38347226 NCBI Desc: osjnba0044m19.8 [oryza sativa (japonica cultivar-group)]
  misc_feature (11)..(134): NCBI GI: 115458042 NCBI Desc: os04g0386500 [oryza sativa (japonica cultivar-group)]
  misc_feature: The plant produces a reduced number of seeds.
  misc_feature: Useful for biocontainment applications
  misc_feature: Functional homolog of the protein sequence given in SEQ ID NO 13158
  misc_feature: Useful for biocontainment applications
  misc_feature: Functional homolog of the protein sequence given in SEQ ID NO 13158
MACCRALSLQLLPASAHSRPRINFHRRIRCCAAAGDQVEAPQDAVLKAISQVASSKGRIAQTTNVIMGGTVTDDTTDEWVVLDKKVNTYPTVRGFTAIGTGGDDFVQSMVVAVESVIGEHVPEGQISQKVSAKGKYVSVKIGPIRVVSKEQVQAVYNAMRKDERMKFFL

SEQ ID NO: 4323 - DNA, 1275 bp, Sorghum bicolor
  misc_feature: Ceres ANNOT ID no. 6036160
  misc_feature: Encodes the peptide sequence at SEQ ID NO 4324
atggacaaggagcagctcggcacgctgctccgcgacctcgacgcgctccagcagcgtcccgacgacctcgcctccaccatccatcggatgcgggagcggttactggcgatgatgaatccggccgccggcgccgcttctcgatccaagatcaaggacatgagcgcagaagtggtggacaacaacccctacagcagacttatggcgttgcaacggatgggcgtggtggagaattatgagcgcatcagggactactctgtcgccatcgttggcataggtggtgttggtagtgttgctgctgagatgctcactagatgtggaatcggacgcctgttgctgtatgactatgacacagtcgagttggccaacatgaataggttgttctttcgtccagaacaggttggaatgaccaaaacagatgctgctgtacagacactttctggaataaatcctgatgttgtgttggagagctactcattgaatattactacagtcaaaggtttcgatacatttttagcaagtttaaaagcacagagctctcatgggcgtagcactggagttgatcttgtcttgagttgtgtcgataactatgaagctcgtatggttgtaaaccaggcatgcaatgagcttggtcagacgtggatggagtctggtgtctcagaagatgctgtttctggtcatatacaactgctggttcctggtgaaactgcatgttttgcatgtgctcctccattggttgtagcatctggagtggatgagcgtacacttaagagagaaggtgtttgtgctgcctctttgccaactacaatgggtgttgttgctggtctcctggtccagaatgctctgaaatatttgttgaactttggacaagtttccccttacttgggatataactcacttaaggattatttccctgcaatggaaatgaggccaaatccacaatgctcgaatccagcatgtgttacgagacagaaagaatatatggaatccaaacctgctagagatgcagcagcaaaggctaagatggaagctgaagcatctgcagcaaatgaatgtcctgtccatgtagacaatgagtggaatattagtgttgttgatgatgaagaaacggggacatcgaacattcgaaacactccagatatcctaccagaaggtcttgtccgtgagcttccagatgctgattcatatgcagaaccagctgcagcaggtagttccagtgctattgatgatgatctcgaggagctccagcgccaacttgatgccctaaacgcatcttag

SEQ ID NO: 4324 - protein, 424 aa, Sorghum bicolor
  misc_feature: Ceres ANNOT ID no. 6036160
  misc_feature (82)..(227): Pfam Id: ThiF Pfam Desc: ThiF family
  misc_feature (13)..(409): NCBI GI: 18043599 NCBI Desc: ube1dc1 protein [mus musculus]
  misc_feature (21)..(421): NCBI GI: 24641311 NCBI Desc: cg1749-pa [drosophila melanogaster]
  misc_feature (46)..(421): NCBI GI: 54642933 NCBI Desc: ga14526-pa [drosophila pseudoobscura]
  misc_feature (21)..(421): NCBI GI: 108880359 NCBI Desc: ubiquitin-activating enzyme e1 [aedes aegypti]
  misc_feature (43)..(415): NCBI GI: 119599596 NCBI Desc: ubiquitin-activating enzyme e1-domain containing 1, isoform cra_b [homo sapiens]
  misc_feature: Useful for making plants with modulated oxidative stress sensitivity
  misc_feature: GREAT-hit functional homolog of the protein sequence given in SEQ ID NO 13005
  misc_feature: Useful for making plants with modulated oxidative stress sensitivity
  misc_feature: Functional homolog of the protein sequence given in SEQ ID NO 13005
MDKEQLGTLLRDLDALQQRPDDLASTIHRMRERLLAMMNPAAGAASRSKIKDMSAEVVDNNPYSRLMALQRMGVVENYERIRDYSVAIVGIGGVGSVAAEMLTRCGIGRLLLYDYDTVELANMNRLFFRPEQVGMTKTDAAVQTLSGINPDVVLESYSLNITTVKGFDTFLASLKAQSSHGRSTGVDLVLSCVDNYEARMVVNQACNELGQTWMESGVSEDAVSGHIQLLVPGETACFACAPPLVVASGVDERTLKREGVCAASLPTTMGVVAGLLVQNALKYLLNFGQVSPYLGYNSLKDYFPAMEMRPNPQCSNPACVTRQKEYMESKPARDAAAKAKMEAEASAANECPVHVDNEWNISVVDDEETGTSNIRNTPDILPEGLVRELPDADSYAEPAAAGSSSAIDDDLEELQRQLDALNAS

SEQ ID NO: 4325 - DNA, 1152 bp, Sorghum bicolor
  misc_feature: Ceres ANNOT ID no. 6036220
  misc_feature: Encodes the peptide sequence at SEQ ID NO 4326
atgcttgctgtgtcacaagaacatcttgctcattcacagacgtgcttccgagcaaggatgcaactcaagcctcctacaagacccaaactctattcagggctcatgccccaggaggaattcgattcatactgtgatctaataccaggcttgcctgaagacttggcaaagatatgtcttgcccttgttcctcgtactcattttcctgtcatgggtgcagtttccaagaggtggatgtcatttcttgagagcaaggaactcatagctgtgaggaaggaggttgggaaacttgaggagtgggtgtatgtcttgactccagatgctggcgcaaaggggtcgcactgggagatcctagagtgttcagggcaaaagcagagccctcttccgcgtatgcctggactaaccaaagctgggttcggtgtggttgttattggtgggaagctctttattattgctggctattccgctgaccatgggaaagattgtgtttcagatgaggtttatcaatatgattcttgccttaacaggtggactgttcttgctaagatgaatgtagctcggtgtgactttgcctgtgcagaggtcaatggggtgatatatgttgctggcggatttggtccaaatggcgagagtttatctagcgtcgaagtttatgatctagaacagaataaatggacactgattgagggcctacggagaccacggtggggctgcttcgggtgcagctttgaagggaagctctatgtcatgggtggccgttcaagcttcacaattggcaactcccgttttgttgacgtgtacaatcctaataaccatgcctgggaccaggtcaagaacggctgtgtgatggtcacggctcatgcagtcctcggcgagaagctcttctgcatcgagtggaagaaccagaggtctctagcaatcttcaacccggctgacaactcctggcagaaggtccccgtgccgcttactggtagctcaagcactcgtttttcctttggggtacatgaggacaagctgctgctcttccctctggaggaagagcctgggtatcagacgctgatgtatgatcctgcagctccgatggggtctgagtggtgcacatcgaagctgaagccatcaggttcttgcctgtgcagcgtgaccatcaaagcctga

SEQ ID NO: 4326 - protein, 383 aa, Sorghum bicolor
  misc_feature: Ceres ANNOT ID no. 6036220
  misc_feature (134)..(183): Pfam Id: Kelch_1 Pfam Desc: Kelch motif
  misc_feature (185)..(231): Pfam Id: Kelch_1 Pfam Desc: Kelch motif
  misc_feature (233)..(280): Pfam Id: Kelch_1 Pfam Desc: Kelch motif
  misc_feature (185)..(231): Pfam Id: Kelch_2 Pfam Desc: Kelch motif
  misc_feature (2)..(383): NCBI GI: 48716191 NCBI Desc: kelch repeat-containing f-box protein-like [oryza sativa (japonica cultivar-group)]
  misc_feature (46)..(383): NCBI GI: 3176664 NCBI Desc: contains similarity to beta scruin gbz47541 from limulus polyphemus. ests gbt04493 and gbaa585955 come from this gene. [arabidopsis thaliana]
  misc_feature (46)..(381): NCBI GI: 15223520 NCBI Desc: kelch repeat-containing f-box family protein [arabidopsis thaliana]
  misc_feature (2)..(316): NCBI GI: 92881986 NCBI Desc: cyclin-like f-box [medicago truncatula]
  misc_feature (44)..(314): NCBI GI: 115444911 NCBI Desc: os02g0202900 [oryza sativa (japonica cultivar-group)]
  misc_feature: The sequence is a functional homolog of SEQ ID NO. 315 in the 11/188,298 US application
  misc_feature: The sequence is a functional homolog of SEQ ID NO. 440 in the 11/188,298 US application
MLAVSQEHLAHSQTCFRARMQLKPPTRPKLYSGLMPQEEFDSYCDLIPGLPEDLAKICLALVPRTHFPVMGAVSKRWMSFLESKELIAVRKEVGKLEEWVYVLTPDAGAKGSHWEILECSGQKQSPLPRMPGLTKAGFGVVVIGGKLFIIAGYSADHGKDCVSDEVYQYDSCLNRWTVLAKMNVARCDFACAEVNGVIYVAGGFGPNGESLSSVEVYDLEQNKWTLIEGLRRPRWGCFGCSFEGKLYVMGGRSSFTIGNSRFVDVYNPNNHAWDQVKNGCVMVTAHAVLGEKLFCIEWKNQRSLAIFNPADNSWQKVPVPLTGSSSTRFSFGVHEDKLLLFPLEEEPGYQTLMYDPAAPMGSEWCTSKLKPSGSCLCSVTIKA

SEQ ID NO: 4327 - DNA, 1266 bp, Sorghum bicolor
  misc_feature: Ceres ANNOT ID no. 6036222
  misc_feature: Encodes the peptide sequence at SEQ ID NO 4328
atggcggggctgtcgctgcggtgcggcgactgcggcgcgcagctgcggagtgtggaggaggcgcaggcgcacgccgaggccaccaaccacgccaacttcgtcgagtccaccgaggccgtcctcaaccttgtctgctccgactgcggcaagccgtgccgctcccagaccgaggtggacctgcataccaagcgcacgggccatacggagttcgcggacaagaccgcggaggcggccaaacccatcgatctcgaggcgccgcttaagccggcctccgaggatgccatggacgtcgacgcctcggcctcggcgagcgcggagccacaagagatggttgtcccggaggtgaacaaggagatgctcacggaccttgagggcatgggtttctcaacagcccgcgccactagggcgcttcacttctctggtaatagcaccattgaaggtgctattaactggctttctgagcaccaggaggacgcagatattgatgagatgcctctggtaccggctaattcaaaaacagaggctaacaaacctagcctgactcctgaggaaatgaagattaaagcacaggagctaagggagcgtgcacgtaagaagaaagaggaagaagaaagaagaatggaaagagaaagggagaagatgtcaaataaatcagaaagaatacgaatcggaaaagaacttcttgaagccaaaagaattgaggaacaaaatgaaaggaaacgcatgatagaactgcgaagacttgagaaagaggaggagaaaagagctagagaaaaaatccgccagaaattagaagaagataaggctgaaaggagaaggaaactaggattgccaccagaagacccagcagctgccaaaccaagtgcaccacctcctgttgaagagaagaagagtgcattacctgtcaggccagccacaaaggcagagaggatgagggattgcctaagaaatcttaagcaacagaacaaggatgatgatgctaaagtgaagagggcgtttcaaacactccttacttacattggaaacgttgctaaaaatcctgatgaggagaaatttagaaagatcaggttgacgaatgcaacatttcaggagagggttggaaatctgcatgggggcatagagttcctggagctctgcggatttgagaaactcgaaggcaacgagtttttgtttttggcaagggaaaaagtcgacaaggcgatcctgaacacagctggagccgagctgaattctgccatcaccaatcctttcttcggagtcctttga

SEQ ID NO: 4328 - protein, 421 aa, Sorghum bicolor
  misc_feature: Ceres ANNOT ID no. 6036222
  misc_feature (115)..(152): Pfam Id: UBA Pfam Desc: UBA/TS-N domain
  misc_feature (1)..(421): NCBI GI: 92893003 NCBI Desc: pug; zinc finger, c2h2-type; uba-like [medicago truncatula]
  misc_feature (194)..(421): NCBI GI: 115477409 NCBI Desc: os08g0526700 [oryza sativa (japonica cultivar-group)]
  misc_feature (120)..(309): NCBI GI: 49250567 NCBI Desc: mgc89251 protein [xenopus tropicalis]
  misc_feature (120)..(309): NCBI GI: 49256281 NCBI Desc: mgc84184 protein [xenopus laevis]
  misc_feature (170)..(313): NCBI GI: 55236063 NCBI Desc: ensangp00000015697 [anopheles gambiae str. pest]
MAGLSLRCGDCGAQLRSVEEAQAHAEATNHANFVESTEAVLNLVCSDCGKPCRSQTEVDLHTKRTGHTEFADKTAEAAKPIDLEAPLKPASEDAMDVDASASASAEPQEMVVPEVNKEMLTDLEGMGFSTARATRALHFSGNSTIEGAINWLSEHQEDADIDEMPLVPANSKTEANKPSLTPEEMKIKAQELRERARKKKEEEERRMEREREKMSNKSERIRIGKELLEAKRIEEQNERKRMIELRRLEKEEEKRAREKIRQKLEEDKAERRRKLGLPPEDPAAAKPSAPPPVEEKKSALPVRPATKAERMRDCLRNLKQQNKDDDAKVKRAFQTLLTYIGNVAKNPDEEKFRKIRLTNATFQERVGNLHGGIEFLELCGFEKLEGNEFLFLAREKVDKAILNTAGAELNSAITNPFFGVL

SEQ ID NO: 4329 - DNA, 951 bp, Sorghum bicolor
  misc_feature: Ceres ANNOT ID no. 6036233
  misc_feature: Encodes the peptide sequence at SEQ ID NO 4330
atggccgctgccactgccactgccaccgccgccgccgtcgcgctcgcctccccggcggccatccgcgcatcgccggtgcgccgcggcctcgtcagcttcgcccctgcgctccgctccggccccgaccgcatctcccgcgccgtcgccctccctggtgtaagaactcatgttacggctgttgatcaagttattgtacaaggggagacaaagttggaaggtcctgtggttgttgttactggtgcttccagggggattggaaaagccactgcattggctcttggaaaagcaggctgcaaggtcttggtgaattatgcccgatcttcaaaggaggccgaagaagtctcaaaggagattgaagcatccggaggccaggccattacctttggaggagatgtttccaaagaggctgatgttgaatctatgataaaaatggctgttgatacatggggaaccattgatgtgctagtaaacaacgcaggaatcacacgggacacattgttgatgagaatgaagaaatcgcaatggcaagatgtgattgatttgaatcttacaggcgttttcctttgcacgcaggctgcaacaaaagtaatgatgaagaagaaaaagggaagaattatcaacatagcatcggttgttggtttaaccggcaatgctggacaggctaattacgctgctgccaaggctggggttattgggttcacgaaaacagttgctagggagtatgccagcagaaatattaatgcaaacgttatcgctcctggctttattgcatcagatatgactgctgaacttggagaagagctagagaagaaaattctgtcagctattcccttagggcgatatggtcggccagaggatgtagcaggtctggtggaattcttagccctcagcccagctgcaagctacatcactggacaggtcctcaccatcgatggagggatggtaatgtaa

SEQ ID NO: 4330 - protein, 316 aa, Sorghum bicolor
  misc_feature: Ceres ANNOT ID no. 6036233
  misc_feature (74)..(242): Pfam Id: adh_short Pfam Desc: short chain dehydrogenase
  misc_feature (74)..(259): Pfam Id: KR Pfam Desc: KR domain
  misc_feature (3)..(316): NCBI GI: 38346116 NCBI Desc: osjnbb0006n15.11 [oryza sativa (japonica cultivar-group)]
  misc_feature (1)..(316): NCBI GI: 18046 NCBI Desc: 3-oxoacyl-[acyl-carrier protein] reductase; beta-ketoacyl-acp reductase [cuphea lanceolata]
  misc_feature (9)..(316): NCBI GI: 14422251 NCBI Desc: 3-oxyacyl-[acyl carrier protein] reductase [brassica napus]
  misc_feature (3)..(316): NCBI GI: 14422263 NCBI Desc: beta-oxyacyl-[acyl-carrier protein] reductase [brassica napus]
  misc_feature (24)..(316): NCBI GI: 14422249 NCBI Desc: 3-oxyacyl-[acyl carrier protein] reductase [brassica napus]
  misc_feature (1)..(316): SWISSPROT Homolog: EC 1.1.1.100 3-oxoacyl-[acyl-carrier-protein] reductase, chloroplast precursor
  misc_feature: The sequence is a functional homolog of SEQ ID NO. 389 in the 11/188,298 US application
MAAATATATAAAVALASPAAIRASPVRRGLVSFAPALRSGPDRISRAVALPGVRTHVTAVDQVIVQGETKLEGPVVVVTGASRGIGKATALALGKAGCKVLVNYARSSKEAEEVSKEIEASGGQAITFGGDVSKEADVESMIKMAVDTWGTIDVLVNNAGITRDTLLMRMKKSQWQDVIDLNLTGVFLCTQAATKVMMKKKKGRIINIASVVGLTGNAGQANYAAAKAGVIGFTKTVAREYASRNINANVIAPGFIASDMTAELGEELEKKILSAIPLGRYGRPEDVAGLVEFLALSPAASYITGQVLTIDGGMVM

SEQ ID NO: 4331 - DNA, 579 bp, Sorghum bicolor
  misc_feature: Ceres ANNOT ID no. 6036273
  misc_feature: Encodes the peptide sequence at SEQ ID NO 4332
atgcggcggcgcgggcggcgcctccccgcggcgctgtggctcgacgctgccgtgacgttggcggcgctggtcgtgctcgtgctccttgtggcgcggccggcgggcgcggcgtggtgcatcgcgcggagcggggcgtcggacaaggcgctgcagtcggcgctggactacgcgtgcggccccgcggggggtgcggactgcgcgcccatccagtccaccggcctctgctacctgcccaacaccctcgccgcgcacgcctcctacgccttcaactccatcttccagcgctcccgcgccgcgccgggtgcatgcgacttcgccggcaccgccaccgtcacgctcaccgaccccagttatggatcatgcacctacccttcatctccaagcactgccgggcaaacaggatcacctggttcaatatccatgccagggactcccacaccaaaaggaactgggagcactggaggattgagcccacctgatgtcgattcgaccgactccaatgctgaacctctggcgaccacatccctgccatctcttgctctctcctgtttcatgtatatgttcttgcagttgtggtga

SEQ ID NO: 4332 - protein, 192 aa, Sorghum bicolor
  misc_feature: Ceres ANNOT ID no. 6036273
  misc_feature (37)..(123): Pfam Id: X8 Pfam Desc: X8 domain
  misc_feature (17)..(192): NCBI GI: 22328593 NCBI Desc: glycosyl hydrolase family protein 17 [arabidopsis thaliana]
  misc_feature (17)..(171): NCBI GI: 57899559 NCBI Desc: glycosyl hydrolase family protein 17-like [oryza sativa (japonica cultivar-group)]
  misc_feature (17)..(179): NCBI GI: 115473199 NCBI Desc: os07g0600700 [oryza sativa (japonica cultivar-group)]
  misc_feature (35)..(135): NCBI GI: 53793113 NCBI Desc: elicitor inducible beta-1,3-glucanase-like [oryza sativa (japonica cultivar-group)]
  misc_feature (17)..(171): NCBI GI: 23495810 NCBI Desc: glycosyl hydrolase family 17-like protein [oryza sativa (japonica cultivar-group)]
MRRRGRRLPAALWLDAAVTLAALVVLVLLVARPAGAAWCIARSGASDKALQSALDYACGPAGGADCAPIQSTGLCYLPNTLAAHASYAFNSIFQRSRAAPGACDFAGTATVTLTDPSYGSCTYPSSPSTAGQTGSPGSISMPGTPTPKGTGSTGGLSPPDVDSTDSNAEPLATTSLPSLALSCFMYMFLQLW

SEQ ID NO: 4333 - DNA, 1272 bp, Sorghum bicolor
  misc_feature: Ceres ANNOT ID no. 6036286
  misc_feature: Encodes the peptide sequence at SEQ ID NO 4334
atggataagctcagtggttctgcacgtcttatgattgtttcagatcttgaccatacaatggttgatcatcatgacgaggagaacttgtccttgcttaggtttggtgccctgtgggaatctgtttactgccaggattctctacttgtcttctcgactggaagatcaccaactctttacaaggaattgaggaaagagaagcctatgctgacgccagacatcactatcatgtctgttggcaccgagataacatatggggaggcaatggttcctgatgatggctgggaagaatatctgaacaataagtgggacagaaatattgtcgtagaagaaactgtgggcttttctgagctgaagcttcagccagagacagaacagcgcccgcacaaggtcagctttttggttgataagaagagtgcccaggaagtgataaaatctgttgccgagaggttggagaaacgtgggctagatgccaaaataatatatagtggtggccaggaccttgatatattacctcaaggagctggaaagggccaagcacttgcatatttgcttaaaaagctaagctcatgtggaaaaccgcccaacaatactcttgtttgtggtgactctggtaatgatgcagaattattcagcatccctggtgtacatggtgtcatggttagcaatgcccaagaggaactacttcagtggtacacagaaaatgcgaaggataacccgaagataattcatgcaaatgagagatgcgcagctggtattatacaagctattggacacttcaagctaggacctaacatttctcctagagacatggagttcccttatgcaaaggaagcctctttcaaacctacagatgctgtagtaaagttctacgttctctatgagaagtggcgcagggctgaggttccaaagtctgattcagttataaaatacttcaaagacatcactcatgcaaatggagttatcatccatcctgctgggcttgaactctcactccatgcatccattgatgcattgggatcatgttatggtgacaaacaagggaaaaagtaccgagcatgggtggacagactttttatcacacagactggttcagatagttgggtggtgagatttgacttgtgggaatcagaaggtgatgtccgtgtgtgctctctgtcaagtcttgctttggttctaaaggctgaatcccccgagggctttgtgctaacccacatccaaaagacatggctgaatggatactcttcaggggttgagcaggcgtctaagctgtag

SEQ ID NO: 4334 - protein, 423 aa, Sorghum bicolor
  misc_feature: Ceres ANNOT ID no. 6036286
  misc_feature (8)..(261): Pfam Id: S6PP Pfam Desc: Sucrose-6F-phosphate phosphohydrolase
  misc_feature (262)..(393): Pfam Id: S6PP_C Pfam Desc: Sucrose-6-phosphate phosphohydrolase C-terminal
  misc_feature (12)..(242): Pfam Id: Hydrolase_3 Pfam Desc: haloacid dehalogenase-like hydrolase
  misc_feature (1)..(423): NCBI GI: 11127755 NCBI Desc: sucrose-phosphatase [zea mays]
  misc_feature (1)..(423): NCBI GI: 69205229 NCBI Desc: sucrose phosphate phosphatase [saccharum officinarum]
  misc_feature (1)..(423): NCBI GI: 14587240 NCBI Desc: sucrose-phosphatase-like protein [oryza sativa (japonica cultivar-group)]
  misc_feature (1)..(423): NCBI GI: 115436646 NCBI Desc: os01g0376700 [oryza sativa (japonica cultivar-group)]
  misc_feature (1)..(423): NCBI GI: 28190685 NCBI Desc: sucrose-phosphatase [hordeum vulgare subsp. vulgare]
MDKLSGSARLMIVSDLDHTMVDHHDEENLSLLRFGALWESVYCQDSLLVFSTGRSPTLYKELRKEKPMLTPDITIMSVGTEITYGEAMVPDDGWEEYLNNKWDRNIVVEETVGFSELKLQPETEQRPHKVSFLVDKKSAQEVIKSVAERLEKRGLDAKIIYSGGQDLDILPQGAGKGQALAYLLKKLSSCGKPPNNTLVCGDSGNDAELFSIPGVHGVMVSNAQEELLQWYTENAKDNPKIIHANERCAAGIIQAIGHFKLGPNISPRDMEFPYAKEASFKPTDAVVKFYVLYEKWRRAEVPKSDSVIKYFKDITHANGVIIHPAGLELSLHASIDALGSCYGDKQGKKYRAWVDRLFITQTGSDSWVVRFDLWESEGDVRVCSLSSLALVLKAESPEGFVLTHIQKTWLNGYSSGVEQASKL

SEQ ID NO: 4335 - DNA, 1254 bp, Sorghum bicolor
  misc_feature: Ceres ANNOT ID no. 6036287
  misc_feature: Encodes the peptide sequence at SEQ ID NO 4336
atgatatacacggcgatcgacacgttctacctgacggacgagcagctgcgcgactcgccgtcgcggaaggatgggatcgacgaggccaccgagaccgcgctccgcgtctacggctgcgacctcatccaggagagcggcatcctcctcaaaccacaagcggtgatggccacggcacaagtactgttccatcgcttttactgcaagaaatcatttgttcgattcagtgcaaagagagttgctgctagctgtgtttggctggcagggaagttggaggagagtcccaggagatcaaagcatattatatttgtcttccacagaatggaatgtaggagagaaaacttgcctatcgaattcttagatgttttttcaaagaaatattcagaactgaggcatgacctgatacggacagaacgacatctgttgaaggagatggggtttatttgccatgtcgagcacccccataagttcatatcaaactaccttgcaacacttgaagcccctcctgagcttactcaagaggcatggaaccttgccaatgatagcttaaggacaactctgtgtgtgcgatttaagagtgaagtagtagcatgtggagttgtgtatgctgcagctaggagacaccgtgtaccccttcctgaagatcctccgtggtggactgtctttgatgctgatgaagcaggaattcaggaagtttgcaaggttcttgctcacctctacagcctgcccaaggctcaatacattccagtgtataaagacaatgattcctttactgttaggagaatctctgatccacaggcttcaaaggaaagtccagcaagtgctgttgctagcgataagggtacccccataccctcaagttctagccaggagaaggattcagtgactaagactatactaaacaaggtgaaggaaaaaagtgatgacgaaggtaaaccattacccgctgaacttgatggaaaagaaaacttggtggtgaactcgaaaaatgagaagtctgattctggtgttgaccggagtcgggaaagagaaagagagagatcaagagggcgggaacgtgatgccaggggtagggattcggatcgtgatagcaggggtcgtgactctgatcgcgagagggaccggagacgtcgctctagggaaagaagttcaggacactcagacaaggagaaatcaaggcgacattcatcacgagaccgggttgactactacagttcgcattcatctcgtgaaaaagatcggcacaggcaccattga

SEQ ID NO: 4336 - protein, 417 aa, Sorghum bicolor
  misc_feature: Ceres ANNOT ID no. 6036287
  misc_feature (5)..(148): Pfam Id: Cyclin_N Pfam Desc: Cyclin, N-terminal domain
  misc_feature (1)..(417): NCBI GI: 13924511 NCBI Desc: ania-6a type cyclin [arabidopsis thaliana]
  misc_feature (55)..(417): NCBI GI: 145329953 NCBI Desc: rcy1 (arginine-rich cyclin 1) [arabidopsis thaliana]
  misc_feature (2)..(416): NCBI GI: 49116980 NCBI Desc: loc443688 protein [xenopus laevis]
  misc_feature (2)..(416): NCBI GI: 81170400 NCBI Desc: cyclin-l1
  misc_feature (2)..(415): NCBI GI: 81170402 NCBI Desc: cyclin-l2
MIYTAIDTFYLTDEQLRDSPSRKDGIDEATETALRVYGCDLIQESGILLKPQAVMATAQVLFHRFYCKKSFVRFSAKRVAASCVWLAGKLEESPRRSKHIIFVFHRMECRRENLPIEFLDVFSKKYSELRHDLIRTERHLLKEMGFICHVEHPHKFISNYLATLEAPPELTQEAWNLANDSLRTTLCVRFKSEVVACGVVYAAARRHRVPLPEDPPWWTVFDADEAGIQEVCKVLAHLYSLPKAQYIPVYKDNDSFTVRRISDPQASKESPASAVASDKGTPIPSSSSQEKDSVTKTILNKVKEKSDDEGKPLPAELDGKENLVVNSKNEKSDSGVDRSRERERERSRGRERDARGRDSDRDSRGRDSDRERDRRRRSRERSSGHSDKEKSRRHSSRDRVDYYSSHSSREKDRHRHH

SEQ ID NO: 4337 - DNA, 891 bp, Sorghum bicolor
  misc_feature: Ceres ANNOT ID no. 6036288
  misc_feature: Encodes the peptide sequence at SEQ ID NO 4338
atggccgccgcggccgccgtctccgcggtcccgatgccttcccgactcaccctccgtgcccacccctgctcctccgccgctccgctccctatgcgcgcgctccccttcctccgcagccgcctccgctccttgaccacggcctacgctgtcaagcaggacgcggccctctggacccctgcgcccgtctccgccgtcagcgccgccaccgccgacggctccatctcctacgtcgtcgtcgacctctccgacgccgctgacctcgtggactcgtacacgaccccggggcagtacctcaagatccgcgtaccctctgccggggacgagctcaagccggcgttcatggccatcgcatcgccgcccggcgcggggccccggttcgagttcgtcgtcaaaaccgtgccggggaccaccgccgagaagctctgcaccctccgagacggggatgttgtggagctcggcgccgtcacgggggacggcttcgccctcgacaagataaatccgcccgacgtcgcgcaggccgtgctcatgttcgccacggggacggggatcagtacgattcgttcacttatcgagtttggttttgctgccaatgaaagagctgatgtgaggctttattatggtgctagaaatctgcaatcgatggcataccaggagagattcaagaactgggagtcaactggagttaaaataataccagtcttatcacgaccagatgacagttggaatggtgaacgagggcacgttcaggatgctttcttcaaaaacaagaacatagtaaatccatcttctacgggagccgtactttgtggacagaatgaaatgcaggaggaaatcacctcagcccttgtagcagatggtgtctcacgagacaaaatcttaacgaactactga

SEQ ID NO: 4338 - protein, 296 aa, Sorghum bicolor
  misc_feature: Ceres ANNOT ID no. 6036288
  misc_feature (175)..(280): Pfam Id: NAD_binding_1 Pfam Desc: Oxidoreductase NAD-binding domain
  misc_feature (18)..(296): NCBI GI: 92894452 NCBI Desc: phenol hydroxylase reductase [medicago truncatula]
  misc_feature (13)..(293): NCBI GI: 1170601 NCBI Desc: fruit protein pkiwi502
  misc_feature (7)..(249): NCBI GI: 42571485 NCBI Desc: oxidoreductase nad-binding domain-containing protein [arabidopsis thaliana]
  misc_feature (84)..(296): NCBI GI: 115434222 NCBI Desc: os01g0120600 [oryza sativa (japonica cultivar-group)]
  misc_feature (87)..(296): NCBI GI: 108763602 NCBI Desc: oxidoreductase, nad-binding [myxococcus xanthus dk 1622]
MAAAAAVSAVPMPSRLTLRAHPCSSAAPLPMRALPFLRSRLRSLTTAYAVKQDAALWTPAPVSAVSAATADGSISYVVVDLSDAADLVDSYTTPGQYLKIRVPSAGDELKPAFMAIASPPGAGPRFEFVVKTVPGTTAEKLCTLRDGDVVELGAVTGDGFALDKINPPDVAQAVLMFATGTGISTIRSLIEFGFAANERADVRLYYGARNLQSMAYQERFKNWESTGVKIIPVLSRPDDSWNGERGHVQDAFFKNKNIVNPSSTGAVLCGQNEMQEEITSALVADGVSRDKILTNY

SEQ ID NO: 4339 - DNA, 669 bp, Sorghum bicolor
  misc_feature: Ceres ANNOT ID no. 6036295
  misc_feature: Encodes the peptide sequence at SEQ ID NO 4340
atggttagcttgaggcgacgtcgactattgggtctttgttctgggaaagactcattgccagttgatcttcctaagcccattgaaaatgaaaaaactgtggaagttgtgcactccaatgtgaagccattcagtgtgcatcctctgcccttggcaaagacttctgatgtgctcacaaaatcctcaaatggttctgatgattcaaaggaagagaaaacccagtactatccaggcaaggaaatcaagcgcagaaaacgacatagaagaaagcagtacgtggatcaagagccctgcattatgaggggggtttatttcaaaaatatgaaatggcaggctgccataaaagttgacaagaaacagattcacttgggtactgttgggacacaggacgaagcagcccggctttatgatagggctgcttttatgtgtggaagggagccaaactttgagctttctgaggaagagaagcaggaactacggaagtacacctgggagggcttcttagcagtgactcgcaacacgataaccagcaaaaaacaaaggaaagttgggttgccaaggcgtagcaaggcagacctgttcatgggacagagtgatggcgatactgagatggccaatggaggcggttcatcgaattctgataatggagacgcagagacgtcggcatcttag

SEQ ID NO: 4340 - protein, 222 aa, Sorghum bicolor
  misc_feature: Ceres ANNOT ID no. 6036295
  misc_feature (97)..(145): Pfam Id: AP2 Pfam Desc: AP2 domain
  misc_feature (1)..(222): NCBI GI: 115446241 NCBI Desc: os02g0499000 [oryza sativa (japonica cultivar-group)]
  misc_feature (81)..(180): NCBI GI: 42566740 NCBI Desc: ap2 domain-containing transcription factor family protein [arabidopsis thaliana]
  misc_feature (81)..(180): NCBI GI: 145333031 NCBI Desc: ap2 domain-containing transcription factor family protein [arabidopsis thaliana]
  misc_feature (76)..(196): NCBI GI: 53830021 NCBI Desc: floral homeotic protein [triticum aestivum subsp. spelta]
  misc_feature (76)..(196): NCBI GI: 53830033 NCBI Desc: floral homeotic protein [triticum urartu]
  misc_feature: Useful for making plants with altered alkaloid content
  misc_feature: GREAT-hit functional homolog of the protein sequence given in SEQ ID NO 13121
  misc_feature: Useful for making plants with altered alkaloid content
  misc_feature: Functional homolog of the protein sequence given in SEQ ID NO 13121
MVSLRRRRLLGLCSGKDSLPVDLPKPIENEKTVEVVHSNVKPFSVHPLPLAKTSDVLTKSSNGSDDSKEEKTQYYPGKEIKRRKRHRRKQYVDQEPCIMRGVYFKNMKWQAAIKVDKKQIHLGTVGTQDEAARLYDRAAFMCGREPNFELSEEEKQELRKYTWEGFLAVTRNTITSKKQRKVGLPRRSKADLFMGQSDGDTEMANGGGSSNSDNGDAETSAS

SEQ ID NO: 4341 - DNA, 1446 bp, Sorghum bicolor
  misc_feature: Ceres ANNOT ID no. 6036303
  misc_feature: Encodes the peptide sequence at SEQ ID NO 4342
atggccgcgccgcagcctgccgcccccgcccccgaggcgccgccgtctgcgcaagtggtgggcaacgcgttcgtgcagcagtactacctcgtgctgcaccagtcgccggatctggtgtaccgcttctaccaggacgccagccgcctcgcccgccccgcatccgccgccggagccgccggcatggactccgtcaccaccatggaggcgatcagcgagaagataatggagatggacgtgtcgaaagcggagatcaggacggtggactcgcaggagtcgctaggcggcggcgtcactgtgctcgtcactggccacctcaccggtcgtgatggagtgcgccgcgagttctcgcagtccttcttcctcgcgccgcaggagaagggctacttcgtgctcaacgacatcttccgcttcgtcggggacatccctgcccctaccgccgttgaggcgcagccggaggcggatgctgtagtcccgcctgtggctgctccacttgccaacggcacagctactcctgctgtggagcctgccattcctgatgatcatgatgctgtgccacagcaggaaaatcatgttgtggaccgatcaccgcctcaacctgaggaggaggatgaggctgaggtttacaatccgccaccagaggaagtagtggatgaggaacaacctgttcctgaagtgataaatgaagttccaaacaatgtggcacctgtggcggctactacagttgccccagttttgcaggaggaggcaccaaagaagtcatatgcctcaattgtcaaagtcatgaaagaagttccattgcctgctcctgcacctcctactaggcctgcaccgcccaaaccagagaagcagtctccacctgctcctactcctgtcacagatgtaccgcctttcagttctaaccctgacaacagcaatatccaagagcctgaagttgatgctcatgcaatatatgtgaggaatttacctttaaatgccactgaaactcaactggaggatgagttcaagaagtttggtaccattaagcaaaatggcattcaagtcagaagcaacaagattcaaggcttctgttacggattcgttgagtttgaggattctacttctgtccagagtgctatagaggcttcccctgtaacaattggcggtcgtcaatgttatgttgaggaaaagaggacaccaggttcacggggctccagcagaggtggcaggtttgcaccaggcaggggcaacaacttcagaagtgaaggtaccagaggccgtggtaactacggtggaggaaggggctacgggaggggtgagttcagttacaggtcggattatggtggcagaagtggtggcagaggtggcccagcacgtggagctgatgtcggctaccagagggttgaccatgctggatatgctggtggtcgtggtggccgcacagcagctgctggtgcccctgcaaaatga

SEQ ID NO: 4342 - protein, 481 aa, Sorghum bicolor
  misc_feature: Ceres ANNOT ID no. 6036303
  misc_feature (20)..(137): Pfam Id: NTF2 Pfam Desc: Nuclear transport factor 2 (NTF2) domain
  misc_feature (316)..(386): Pfam Id: RRM_1 Pfam Desc: RNA recognition motif. (a.k.a. RRM, RBD, or RNP domain)
  misc_feature (4)..(480): NCBI GI: 116309580 NCBI Desc: osigba0140a01.7 [oryza sativa (indica cultivar-group)]
  misc_feature (7)..(477): NCBI GI: 21360395 NCBI Desc: at3g25150/mjl12_9 [arabidopsis thaliana]
  misc_feature (12)..(472): NCBI GI: 30697452 NCBI Desc: nuclear transport factor 2 (ntf2) family protein / rna recognition motif (rrm)-containing protein [arabidopsis thaliana]
  misc_feature (12)..(472): NCBI GI: 21553535 NCBI Desc: ras-gtpase-activating protein sh3-domain binding protein-like [arabidopsis thaliana]
  misc_feature (20)..(477): NCBI GI: 9294171 NCBI Desc: rna-binding protein-like [arabidopsis thaliana]
  misc_feature: Useful for making plants with modulated nitrogen use efficiency
  misc_feature: Functional homolog of the protein sequence given in SEQ ID NO 13162
  misc_feature: The sequence is a functional homolog of SEQ ID NO. 458 in the 11/188,298 US application
MAAPQPAAPAPEAPPSAQVVGNAFVQQYYLVLHQSPDLVYRFYQDASRLARPASAAGAAGMDSVTTMEAISEKIMEMDVSKAEIRTVDSQESLGGGVTVLVTGHLTGRDGVRREFSQSFFLAPQEKGYFVLNDIFRFVGDIPAPTAVEAQPEADAVVPPVAAPLANGTATPAVEPAIPDDHDAVPQQENHVVDRSPPQPEEEDEAEVYNPPPEEVVDEEQPVPEVINEVPNNVAPVAATTVAPVLQEEAPKKSYASIVKVMKEVPLPAPAPPTRPAPPKPEKQSPPAPTPVTDVPPFSSNPDNSNIQEPEVDAHAIYVRNLPLNATETQLEDEFKKFGTIKQNGIQVRSNKIQGFCYGFVEFEDSTSVQSAIEASPVTIGGRQCYVEEKRTPGSRGSSRGGRFAPGRGNNFRSEGTRGRGNYGGGRGYGRGEFSYRSDYGGRSGGRGGPARGADVGYQRVDHAGYAGGRGGRTAAAGAPAK

SEQ ID NO: 4343 - DNA, 2397 bp, Sorghum bicolor
  misc_feature: Ceres ANNOT ID no. 6036479
  misc_feature: Encodes the peptide sequence at SEQ ID NO 4344
atgggggatgcatgtttctcgacacagctgattgacggtgatggggtcttcaatgtttccggattggatcatttcatgaaggaagttaaattgggtgaatgcgggctttcatatgctgttgtatcgataatgggcccacaaagtagtgggaagagtacactattgaatcatctttttggcacgaattttagggagatggatgctttcaaaggaaggtcacaaactaccaaaggtatatggttagcgaaggcccaaaacattgaaccttgcacccttgtaatggatttggaaggaactgatggaagagagaggggagaggatgacacagcctttgagaagcaaagtgcgttgtttgctttggctgtttcggacattgtgcttatcaatatgtggtgtcatgacattggcagagaacaggctgcaaacaaacctcttttgaagaccgttttccaggtcatgatgaggttgttcagtccacgtaaaacaacattattatttgtaattcgtgacaaatcaaagacacctcttgaaaatcttgaacctattctaagggaagacattcataagatatgggatactgttcctaaaccccatgcccataaagaaactccactcagtgaatttttcaatgtagaagttgtggctttatccagttatgaggaaaaagaagagttattcaaggagcaggtttccaatttaagagatagatttcagcattccattgctcctggtggacttgctggagatcgccgcggtgttgtcccagcttcaggtttttcttttagttcacagcagttttggaaggtcattaaggagaacaaagaccttgatctacccgctcataaagttatggtggctactgtacgttgtgaggaaattggtaatgagaaacttgccagttttacagctgatgaggaatggcaacaagttgaagaggctgttcaacatggctatgtacctgggtttgggaataaactcagcagccttcttgacagatgtttatctgagtatgacatggaggctatatattttgatgatggtgtcagaacctcaaaaagacaacaacttgagtctaaactcttgcagcttgtcaatcctgcataccaatcgcttctgggtcatttacggactagaattgtggaagaatttaaggagtcctttgacaaggccctcacaaaggagggatttgctgttgcagctcgtgattgtactcatactttcatagaaaagttcgataaaggatctgaagatgctgctattcaacaagtgaaatgggacccctcaaaagttaaggataagcttaagtgtgacattgaagcacatgtggcttcagttcgtgcagcaaagttatctgaactttgtgccaaatatgaggcacaacttacgaaagctctggcagaacctgttgaagccctgctagattcagcctgtgaagatacctggccagccattagaaagctgctccaacgtgagacaaaagctgctatttcaggtcttgaatctgctctttcagcttttgaactcgatgaagcaactgagaaggaattgcttgtgaaactggaaaaccacggaaggagtgttgtggaatcaaaagcaaaagaagaggctggaagggtcttgattcgtatgaaggacaggttctcaactctattcagtcgtgatgctgactcaatgccaagggtgtggacaggaaaggaggacataaaagcaattactaaaactgcacgttcagcttccatgaaattgcttgctacactggctgcaattcggttggatgaggatggtgacgacatagaaaacactctcaaccttgctcttgttgatacttcaagacctggaactactgatagaagtattcaatcatttgatccacttgcctccagttcgtgggaaaaggttcctgaggagaaaactttaattagccctgtccagtgcaaatctttgtggaggcaatttaaagctgaaacagaatatacagtcactcaggccatagctgctcaggaagcaaataagaggaacaacaactggctaccacctccctgggcccttgccgcaatggctatcctcggattcaacgaatttatgacattgctgaggaatcccctgtacctggctgttatatttgtcatcttccttgttgggaaggccatttgggtacagttagacattgccagtgaattccaaaatggctttctcccagccattctttcgctgtccacaaagtttgttcccactataatgaacattttgaagagattagcagacgaggggcaaagacctgcagcctcagacaggcaacgagagatggagctccaaccaacgaatcgttcatcgtacagcagtgtgacatctgcagggtcgtccagcataactgccacagagaatggatccgaatag

SEQ ID NO: 4344 - protein, 798 aa, Sorghum bicolor
  misc_feature: Ceres ANNOT ID no. 6036479
  misc_feature (44)..(785): Pfam Id: RHD3 Pfam Desc: Root hair defective 3 GTP-binding protein (RHD3)
  misc_feature (3)..(798): NCBI GI: 115437816 NCBI Desc: os01g0575000 [oryza sativa (japonica cultivar-group)]
  misc_feature (3)..(798): NCBI GI: 47934042 NCBI Desc: root hair defective 3 gtp-binding protein [triticum aestivum]
  misc_feature (44)..(777): NCBI GI: 15219333 NCBI Desc: root hair defective 3 gtp-binding (rhd3) family protein [arabidopsis thaliana]
  misc_feature (70)..(797): NCBI GI: 42572425 NCBI Desc: root hair defective 3 (rhd3) [arabidopsis thaliana]
  misc_feature (3)..(798): NCBI GI: 9759601 NCBI Desc: gtp-binding protein-like; root hair defective 3 protein-like [arabidopsis thaliana]
MGDACFSTQLIDGDGVFNVSGLDHFMKEVKLGECGLSYAVVSIMGPQSSGKSTLLNHLFGTNFREMDAFKGRSQTTKGIWLAKAQNIEPCTLVMDLEGTDGRERGEDDTAFEKQSALFALAVSDIVLINMWCHDIGREQAANKPLLKTVFQVMMRLFSPRKTTLLFVIRDKSKTPLENLEPILREDIHKIWDTVPKPHAHKETPLSEFFNVEVVALSSYEEKEELFKEQVSNLRDRFQHSIAPGGLAGDRRGVVPASGFSFSSQQFWKVIKENKDLDLPAHKVMVATVRCEEIGNEKLASFTADEEWQQVEEAVQHGYVPGFGNKLSSLLDRCLSEYDMEAIYFDDGVRTSKRQQLESKLLQLVNPAYQSLLGHLRTRIVEEFKESFDKALTKEGFAVAARDCTHTFIEKFDKGSEDAAIQQVKWDPSKVKDKLKCDIEAHVASVRAAKLSELCAKYEAQLTKALAEPVEALLDSACEDTWPAIRKLLQRETKAAISGLESALSAFELDEATEKELLVKLENHGRSVVESKAKEEAGRVLIRMKDRFSTLFSRDADSMPRVWTGKEDIKAITKTARSASMKLLATLAAIRLDEDGDDIENTLNLALVDTSRPGTTDRSIQSFDPLASSSWEKVPEEKTLISPVQCKSLWRQFKAETEYTVTQAIAAQEANKRNNNWLPPPWALAAMAILGFNEFMTLLRNPLYLAVIFVIFLVGKAIWVQLDIASEFQNGFLPAILSLSTKFVPTIMNILKRLADEGQRPAASDRQREMELQPTNRSSYSSVTSAGSSSITATENGSE

SEQ ID NO: 4345 - DNA, 2397 bp, Sorghum bicolor; identical to SEQ ID NO: 4343
  misc_feature: Ceres ANNOT ID no. 6036482
  misc_feature: Encodes the peptide sequence at SEQ ID NO 4346

SEQ ID NO: 4346 - protein, 798 aa, Sorghum bicolor; identical to SEQ ID NO: 4344
  misc_feature: Ceres ANNOT ID no. 6036482
  misc_feature (44)..(785): Pfam Id: RHD3 Pfam Desc: Root hair defective 3 GTP-binding protein (RHD3)
  misc_feature (3)..(798): NCBI GI: 115437816 NCBI Desc: os01g0575000 [oryza sativa (japonica cultivar-group)]
  misc_feature (3)..(798): NCBI GI: 47934042 NCBI Desc: root hair defective 3 gtp-binding protein [triticum aestivum]
  misc_feature (44)..(777): NCBI GI: 15219333 NCBI Desc: root hair defective 3 gtp-binding (rhd3) family protein [arabidopsis thaliana]
  misc_feature (70)..(797): NCBI GI: 42572425 NCBI Desc: root hair defective 3 (rhd3) [arabidopsis thaliana]
  misc_feature (3)..(798): NCBI GI: 9759601 NCBI Desc: gtp-binding protein-like; root hair defective 3 protein-like [arabidopsis thaliana]

SEQ ID NO: 4347 - DNA, 507 bp, Sorghum bicolor
  misc_feature: Ceres ANNOT ID no. 6036615
  misc_feature: Encodes the peptide sequence at SEQ ID NO 4348
atggcttgctccaagctctccctagtagtgctgctcgcattgctcgtggtcctcgccgccggcccagcggcggtgcgacgggccgaagcggcggcatcggcgcatctgcacttttacatgcacgacgtgacgggcgggccatcggcgacggcggtgcgagtggttaatggtccacggggcaacttcggcaacaccatggtgatcgacgacaagctaaccgaggggacgtcggcgtcgtcgacgacggtgggacgcgcgcagggctactacatggtggcgtcggtggcgaacctcgagttcctcgtcaacatgaatgtcgtgcttacttctggcccatatgccggaagctcgctcacggtggttggccgtgacgacgtcagcgtcccggtgagggagctctcggtggtcggcggcacggggcagttcaggatggcgcgcggctatgtgctgtggaagaccgtcacccccgagattctcgacctggagatcttcgtcaacccttcttga

SEQ ID NO: 4348 - protein, 168 aa, Sorghum bicolor
  misc_feature: Ceres ANNOT ID no. 6036615
  misc_feature (6)..(165): Pfam Id: Dirigent Pfam Desc: Dirigent-like protein
  misc_feature (4)..(167): NCBI GI: 77552297 NCBI Desc: dirigent-like protein [oryza sativa (japonica cultivar-group)]
  misc_feature (15)..(158): NCBI GI: 115486441 NCBI Desc: os11g0644700 [oryza sativa (japonica cultivar-group)]
  misc_feature (8)..(163): NCBI GI: 34394264 NCBI Desc: disease resistance response protein-like protein [oryza sativa (japonica cultivar-group)]
  misc_feature (11)..(164): NCBI GI: 28812108 NCBI Desc: disease resistance response protein-like protein [oryza sativa (japonica cultivar-group)]
  misc_feature (2)..(168): NCBI GI: 40253353 NCBI Desc: disease resistance response protein-like [oryza sativa (japonica cultivar-group)]
MACSKLSLVVLLALLVVLAAGPAAVRRAEAAASAHLHFYMHDVTGGPSATAVRVVNGPRGNFGNTMVIDDKLTEGTSASSTTVGRAQGYYMVASVANLEFLVNMNVVLTSGPYAGSSLTVVGRDDVSVPVRELSVVGGTGQFRMARGYVLWKTVTPEILDLEIFVNPS

SEQ ID NO: 4349 - DNA, 1395 bp, Sorghum bicolor
  misc_feature: Ceres ANNOT ID no. 6036725
  misc_feature: Encodes the peptide sequence at SEQ ID NO 4350
atggcgaagccgacgccggtggcctcggcagaggaggcggcggcgatgcggcgccggctgaggcgcctggtggccgcggtggcggccgggagcgccgacgccgaggccttcgacgaggcggccgaggcgctcgccaagctcagggacgccgagcttggcccccgcaaggacaacagggcaggcgacggccacggcgacggtgggcagaacaggcgccgcacggagacggaggccgcggtgccggagcacttcctttgccccatatcctcggagatcatgagggatcccgtcgtcctcgcctccggccagacgtatgatcgtcgtttcattcaagaatggttaagtgctggaaaccggacatgcccgcagactcaacaagtcctttcaaatacaattatcatcccgaaccaccttgtgagaagcatgatctcacagtggtgcacagataatgggatcactctgccaccagttgagaaccaagatgaagatctggttacaaacaatgagcgaaagacatttagtaaaatatttgagaggatcgcatcgtcgtcaaacctatctgagcagagggaagccattaaagatctcaggctgctgacaaagtgcaacagttcactaagagcagccataggagagaaaccggattcaatctcacagatcatttccgtagcatccaacccagagctagaaaacaatgcagaagttctggaggatatggtgacaactattcttaatctttctattcatgagagcaacaagaagattattggagatgatccattggcaatcccgttcctcataaggaccttacaatcaggaaccatggaggcccggagcaatgctgcagctgccatcttcagtttatctgcccttgacagcaacaaggtgaagattggtgaactaggcgtgatgagacctctggtggatctcctcgaacatggcagcatgatagcgaagaaagatgcagcttcagctatcttcaacctctgcatgctgcacgagaacaaatcaagggccaccaagagtggggttattgacgtgaccctgaaggccatcactgatgactcgctggtggatgagtctctggccatccttgccctgctgtcaggtgaccacgagacagtagaggagatcggcgagaccggcggcgtggcctccatgctccatgttataaaggaagaccagtgcaagcgcaacaaggagaatgcagttgcggtgctcttcgcagtctgtatgtacgaccgcaccaaactgagagaggttgcggagcacgagaagctgaacgggtccctggcctggctcgtgcagaacggcacttcaagggcaaggcggaaggccgtcgggatccttgacaagatgaagaggaccctgcaccagccgcactactcgtgctag

SEQ ID NO: 4350 - protein, 464 aa, Sorghum bicolor
  misc_feature: Ceres ANNOT ID no. 6036725
  misc_feature (79)..(153): Pfam Id: U-box Pfam Desc: U-box domain
  misc_feature (291)..(331): Pfam Id: Arm Pfam Desc: Armadillo/beta-catenin-like repeat
  misc_feature (1)..(464): NCBI GI: 47848077 NCBI Desc: avr9/cf-9 rapidly elicited protein-like [oryza sativa (japonica cultivar-group)]
  misc_feature (1)..(446): NCBI GI: 115446171 NCBI Desc: os02g0488600 [oryza sativa (japonica cultivar-group)]
  misc_feature (100)..(464): NCBI GI: 38346501 NCBI Desc: osjnba0020i02.15 [oryza sativa (japonica cultivar-group)]
  misc_feature (100)..(464): NCBI GI: 116309282 NCBI Desc: osigba0130k07.9 [oryza sativa (indica cultivar-group)]
  misc_feature (12)..(461): NCBI GI: 92890428 NCBI Desc: u box [medicago truncatula]
  misc_feature: The sequence is a functional homolog of SEQ ID NO. 309 in the 11/188,298 US application
  misc_feature: The sequence is a functional homolog of SEQ ID NO. 528 in the 11/188,298 US application
  misc_feature: The sequence is a functional homolog of SEQ ID NO. 308 in the 11/188,298 US application
MAKPTPVASAEEAAAMRRRLRRLVAAVAAGSADAEAFDEAAEALAKLRDAELGPRKDNRAGDGHGDGGQNRRRTETEAAVPEHFLCPISSEIMRDPVVLASGQTYDRRFIQEWLSAGNRTCPQTQQVLSNTIIIPNHLVRSMISQWCTDNGITLPPVENQDEDLVTNNERKTFSKIFERIASSSNLSEQREAIKDLRLLTKCNSSLRAAIGEKPDSISQIISVASNPELENNAEVLEDMVTTILNLSIHESNKKIIGDDPLAIPFLIRTLQSGTMEARSNAAAAIFSLSALDSNKVKIGELGVMRPLVDLLEHGSMIAKKDAASAIFNLCMLHENKSRATKSGVIDVTLKAITDDSLVDESLAILALLSGDHETVEEIGETGGVASMLHVIKEDQCKRNKENAVAVLFAVCMYDRTKLREVAEHEKLNGSLAWLVQNGTSRARRKAVGILDKMKRTLHQPHYSC

SEQ ID NO: 4351 - DNA, 1077 bp, Sorghum bicolor
  misc_feature: Ceres ANNOT ID no. 6036855
  misc_feature: Encodes the peptide sequence at SEQ ID NO 4352
  misc_feature: Up-regulated in shoot tissues in response to salicylic acid treatment
atgtcggcctactgcggaaagtacaaggatgagctcatcaagaacgccgcatatattggcacccctggaaagggtatccttgctgctgatgagtccacaggcaccattggcaagcgactttcaagcatcaatgtcgagaacattgaggagaaccgccgtgcccttcgtgagctcctcttctgtgcccctggtgccctccagtacctcagcggtgtgatcctctttgaggagaccctctaccagaaaaccaaggatggcaagccctttgttgatgtcctcaatgagggaggtgtgctccccggcatcaaggttgacaagggcaccattgaggttgctggcaccaacaaggagaccaccacacaaggccatgatgaccttggcaagcgctgcgccaagtactatgaggctggtgcccgctttgccaagtggcgtgccgtcctcaacatcggccctaacgagccatcacagcttgccattgacttgaacgctcagggtcttgctcgctacgccatcatctgccaggagaatggtctggtgccaattgttgagcctgagatcctcgtcgatgggccacatgacattgagcgttgtgcctatgttacggagatggtccttgctgcctgctacaaggctctcaatgagcaccatgtcctccttgagggtaccctcctgaagcccaacatggttacccctggctctgactccaagaaggtggctcctgaggtgatcgctgagtacactgtgcgtgccctccagaggactgtccctgctgctgtgcccgccatcgtcttcctctctggtggacagagtgaggaggaggccacactaaacctgaatgccatgaacaagctcaacaccaagaagccgtggtccctatccttctcattcggccgtgcccttcaggcgagcaccctcaaggcctgggctggcaaggaggagaacgtggagaaggccagggctgccttcctcaccaggtgcaaggccaactcggaggccaccctcggcacatacaagggtgacgctgctgccggcgagggtgtctcggagagcctccacgtgaaggactacaagtactga

SEQ ID NO: 4352 - protein, 358 aa, Sorghum bicolor
  misc_feature: Ceres ANNOT ID no. 6036855
  misc_feature (11)..(358): Pfam Id: Glycolytic Pfam Desc: Fructose-bisphosphate aldolase class-I
  misc_feature (1)..(358): NCBI GI: 78099751 NCBI Desc: fructose-bisphosphate aldolase, cytoplasmic isozyme
  misc_feature (1)..(358): NCBI GI: 295850 NCBI Desc: fructose bisphosphate aldolase [zea mays]
  misc_feature (1)..(358): NCBI GI: 218157 NCBI Desc: cytoplasmic aldolase [oryza sativa]
  misc_feature (1)..(358): NCBI GI: 786178 NCBI Desc: aldolase c-1 [oryza sativa]
  misc_feature (1)..(358): NCBI GI: 10800924 NCBI Desc: fructose-bisphosphate aldolase [persea americana]
  misc_feature (1)..(358): SWISSPROT Homolog: EC 4.1.2.13 Fructose-bisphosphate aldolase cytoplasmic isozyme
  misc_feature: Useful for making plants with modulated phosphate use efficiency
  misc_feature: GREAT-hit functional homolog of the protein sequence given in SEQ ID NO 12920
  misc_feature: Useful for making plants with modulated phosphate use efficiency
  misc_feature: Functional homolog of the protein sequence given in SEQ ID NO 12920
  misc_feature: Useful for making plants with modulated biomass
  misc_feature: Functional homolog of the protein sequence given in SEQ ID NO 13636
  misc_feature: Up-regulated in shoot tissues in response to salicylic acid treatment
MSAYCGKYKDELIKNAAYIGTPGKGILAADESTGTIGKRLSSINVENIEENRRALRELLFCAPGALQYLSGVILFEETLYQKTKDGKPFVDVLNEGGVLPGIKVDKGTIEVAGTNKETTTQGHDDLGKRCAKYYEAGARFAKWRAVLNIGPNEPSQLAIDLNAQGLARYAIICQENGLVPIVEPEILVDGPHDIERCAYVTEMVLAACYKALNEHHVLLEGTLLKPNMVTPGSDSKKVAPEVIAEYTVRALQRTVPAAVPAIVFLSGGQSEEEATLNLNAMNKLNTKKPWSLSFSFGRALQASTLKAWAGKEENVEKARAAFLTRCKANSEATLGTYKGDAAAGEGVSESLHVKDYKY

SEQ ID NO: 4353 - DNA, 1611 bp, Sorghum bicolor
  misc_feature: Ceres ANNOT ID no. 6036911
  misc_feature: Encodes the peptide sequence at SEQ ID NO 4354
atggatgacattgcttggatgctagcccgcggttcggatttctttctgatggaccgaaacatgctcagtttcacgaagagcgccttcaccaacctgccccacccgcccgccgccaccgccgcccccctctccggcgccgtcactgcgagcgcccccgacggggtcgaccgcatcagctccctccccggcggaatcctccgcgacatcgtctcccgcctccccgtcaaggacgccgcgcgcactaccgtcctctccacgcgatggcgccgcgtctggcacaccacgccgctcgtcctcgtcgacgcccacctcctctccagcgcctccatcgggaccggccgcagccgcctcggcgccgatccgcgcgacctcttcggcacctcgcgcagcctcgccgacgcggtgtccaccgtcctcgccgcgcacccaggtcccttccgctgcgtctacctcaccggcaccccgatggagacgcatcccgacgagctcgcgctctggctccagcacctagccgccaagggcgtccaagaactcatttttctcagccgcacaacaaagttggactctgccgtgcatctccctgccacgctctttagatgcacctccctcacaaagctatacatcggcttctggtggtttccgccgacccccggcctccctcccaccgtcgcattcccctacctccgggagctcggcctcttctccctcgtcatgaccgaacaggacctcgccttcgtgctgaacagatgccccgtcctggagaagctcctgatgaccggatgccggtggccggtttgcctccgcgttcggagtcacagcctacggttggtggagttatgccagtgtatcgcaccagaaatcacagtggtgaacgctccacgcctggaaaggctcttgctttgggaagcttggggtgacggcggcttcaccaacatgtcctccacgatcaagattggccatgctccgaagctgcgtttcctgggattcttggtgcctggaatgcacaaattggagattgggaacactgccatcaaggctgagacaaaggcaagcccaaacaccactgtcccaagtgtccagatgctggcagttcaggtgaaacttggaactcgcattgaagctaggatgttacctagtttcctcagatgctttcccaatgtcgagacactctacatccagtcagagaacgatgacttcaaattctggggacctcaagcaactggcactggcaaactaaatctcaagttctggaaggaggcaggtcccattcaatgtgttcagcggcacatcaagaaggtggttctccgtgagttccgagggacaagaagcgagcttgacttcctcaagttcattgccgagcatgcacgagttcttgagaagatggtgattgtgttgacccatggacattccccttcaggtcccgtcggtaccaacctgaggactagaatggcttctgcaaattgggccaatgcatgctgtgagctgatgatttttcagactccatttcctcaagaaggtacagcttggtgctacctatcagcatttaatctttctagcacagacccttttgatgtttcaaaatgtgtcgatgggacatgtcaaggtcattag

SEQ ID NO: 4354 - protein, 536 aa, Sorghum bicolor
  misc_feature: Ceres ANNOT ID no. 6036911
  misc_feature (416)..(465): Pfam Id: FBD Pfam Desc: FBD
  misc_feature (56)..(103): Pfam Id: F-box Pfam Desc: F-box domain
  misc_feature (11)..(524): NCBI GI: 53793451 NCBI Desc: ribosomal rna apurinic site specific lyase-like [oryza sativa (japonica cultivar-group)]
  misc_feature (32)..(523): NCBI GI: 38346009 NCBI Desc: osjnba0035o13.11 [oryza sativa (japonica cultivar-group)]
  misc_feature (32)..(523): NCBI GI: 115457296 NCBI Desc: os04g0208500 [oryza sativa (japonica cultivar-group)]
  misc_feature (21)..(524): NCBI GI: 53793449 NCBI Desc: ribosomal rna apurinic site specific lyase-like [oryza sativa (japonica cultivar-group)]
  misc_feature (29)..(532): NCBI GI: 53793450 NCBI Desc: ribosomal rna apurinic site specific lyase-like [oryza sativa (japonica cultivar-group)]
MDDIAWMLARGSDFFLMDRNMLSFTKSAFTNLPHPPAATAAPLSGAVTASAPDGVDRISSLPGGILRDIVSRLPVKDAARTTVLSTRWRRVWHTTPLVLVDAHLLSSASIGTGRSRLGADPRDLFGTSRSLADAVSTVLAAHPGPFRCVYLTGTPMETHPDELALWLQHLAAKGVQELIFLSRTTKLDSAVHLPATLFRCTSLTKLYIGFWWFPPTPGLPPTVAFPYLRELGLFSLVMTEQDLAFVLNRCPVLEKLLMTGCRWPVCLRVRSHSLRLVELCQCIAPEITVVNAPRLERLLLWEAWGDGGFTNMSSTIKIGHAPKLRFLGFLVPGMHKLEIGNTAIKAETKASPNTTVPSVQMLAVQVKLGTRIEARMLPSFLRCFPNVETLYIQSENDDFKFWGPQATGTGKLNLKFWKEAGPIQCVQRHIKKVVLREFRGTRSELDFLKFIAEHARVLEKMVIVLTHGHSPSGPVGTNLRTRMASANWANACCELMIFQTPFPQEGTAWCYLSAFNLSSTDPFDVSKCVDGTCQGH

SEQ ID NO: 4355 - DNA, 1839 bp, Sorghum bicolor
  misc_feature: Ceres ANNOT ID no. 6036912
  misc_feature: Encodes the peptide sequence at SEQ ID NO 4356
atggaggtggtggacgaggtggtgcgggcgctcggcgccggcttcgacctcacgtccgacttccgcctgcggttcgccaaggccagcgagggccggcgcctggtggagctcggcgacgagacgagggacgtgccgctcccgggcggcgccggggccacgctccgcggggtgccccgcgacgtcggcgtcgacaagggcgaccgcatccgcttccgctccgacgtcctcgagttcaaccagatgtcagaattgcttaatcagaaatcttcagtccaagggaaagttccgtcaggctattttaacgctctctttgaattaagtggagcttggttgactgatgccaaagagaccaagcatctagcattcgatggatatttcatttctttgtacaacttgcacctaaaggcttctccattagttcttcgagatgaagtaaaaaaggctgttccatccaagtgggatcctgttgcattatcatggtttatcaagacttatgggacacatataattgttgaaatgggaatcggaggtcaggatgtcatatgtgttaaacaaagtcattcttcaaccgtttcaactgctgatcttaagttgcacatggaagaccttggtgatttcttattttctgatgggaagaaccactccccaatacatcgcaagacaaaggatggcaagagcaaggtgcctgatgtttttgtcaggatagtgcagcactctaataacctgcacctttctacctattctgaaacatcaaccaaggatggcctgacagttacatgttcgaagaggggaggagaagcatacctacccaaccactccaagtggctgcaaacagtggcaaagaaacctgatgccattatgttcaaatttgtccccatcacctctcttctaactggtattcctggtagtggttacctcagccatgccatcaatctatatcttcgctataaacctgatcttcaagacttgcaatatttcttggagtttcaagttcctctacaatgggcacctatgttcaacgagcttgtccttgggccccaaaagagaaaaggctcctacccttcaatgcagttcagatgtctcggccccaaactccatgtcagcacttctcaggtatctagttctcagaaaccggtggttggcctacggctatacctggagggcaggaagtgcaaccggttggccatccatgtccagcacctctccagtgttccaagcatgattggagactccgtggcatcttcaatgtcagaatggcgcgagtccgaagacagcgacccagggtacatcgaggccatccagtggaagaactactcgtgcgtctgcacctccgctgtcaagtacaacccggagtggcacaagagagcccccggcggagtcttcgtcgtcactggtgcccagctcgtcaccaaggggacctggtccaagaaggtcctccatctgcgcctcctctacacccacatccccaactgcaccatccagaggaccgagtggacgaacgctccggcgtcgtctcagaaggggagcttcctgacgacgatcagcacgacactgagctcccctttcacgcagcgtgacacccatcagcaggcgaagcatgagccggtgcagctgaactcaggtgtctacccggatggaccgcccgtcccgctccggtccaggaagctcctcaagttcgtcgacatttcggaggtggtaaaagggccacacgacgtcccgggccactggctggtgatcgcggcgaagcttgtgaaggagggagggaagatcgggatccatgtgaagtttgcactgctaggctacgaagggcaatcgcagggtgacagtttcatgagctga

SEQ ID NO: 4356 - protein, 612 aa, Sorghum bicolor
  misc_feature: Ceres ANNOT ID no. 6036912
  misc_feature (117)..(315): Pfam Id: MACPF Pfam Desc: MAC/Perforin domain
  misc_feature (2)..(601): NCBI GI: 92895124 NCBI Desc: membrane attack complex component/perforin/complement c9 [medicago truncatula]
  misc_feature (2)..(315): NCBI GI: 8778214 NCBI Desc: f10b6.18 [arabidopsis thaliana]
  misc_feature (2)..(599): NCBI GI: 92870237 NCBI Desc: membrane attack complex component/perforin/complement c9 [medicago truncatula]
  misc_feature (4)..(599): NCBI GI: 92875831 NCBI Desc: membrane attack complex component/perforin/complement c9 [medicago truncatula]
  misc_feature (219)..(508): NCBI GI: 140053390 NCBI Desc: aldehyde oxidase and xanthine dehydrogenase, a/b hammerhead; membrane attack complex component/perforin/complement c9 [medicago truncatula]
MEVVDEVVRALGAGFDLTSDFRLRFAKASEGRRLVELGDETRDVPLPGGAGATLRGVPRDVGVDKGDRIRFRSDVLEFNQMSELLNQKSSVQGKVPSGYFNALFELSGAWLTDAKETKHLAFDGYFISLYNLHLKASPLVLRDEVKKAVPSKWDPVALSWFIKTYGTHIIVEMGIGGQDVICVKQSHSSTVSTADLKLHMEDLGDFLFSDGKNHSPIHRKTKDGKSKVPDVFVRIVQHSNNLHLSTYSETSTKDGLTVTCSKRGGEAYLPNHSKWLQTVAKKPDAIMFKFVPITSLLTGIPGSGYLSHAINLYLRYKPDLQDLQYFLEFQVPLQWAPMFNELVLGPQKRKGSYPSMQFRCLGPKLHVSTSQVSSSQKPVVGLRLYLEGRKCNRLAIHVQHLSSVPSMIGDSVASSMSEWRESEDSDPGYIEAIQWKNYSCVCTSAVKYNPEWHKRAPGGVFVVTGAQLVTKGTWSKKVLHLRLLYTHIPNCTIQRTEWTNAPASSQKGSFLTTISTTLSSPFTQRDTHQQAKHEPVQLNSGVYPDGPPVPLRSRKLLKFVDISEVVKGPHDVPGHWLVIAAKLVKEGGKIGIHVKFALLGYEGQSQGDSFMS

SEQ ID NO: 4357 - DNA, 1473 bp, Sorghum bicolor
  misc_feature: Ceres ANNOT ID no. 6037049
  misc_feature: Encodes the peptide sequence at SEQ ID NO 4358
atggcgccagcgccccgcgcttccatcttcttctcggtgctcctcgtccttctcttcgcgctgttggtggagcgcgcggccgccaccggcgtcttccaggtgcgccgcaagttcccgcgccacggaggcggcggggatgtggcggagcacctcgcggcgctgcggaggcacgacgtcggccgccatggccggctccttggcgccgtcgacttgcccctcggcggcgtcgggctccccaccgcgaccggcctgtactacacgcagattgagatcggctcgccgtccaagggctactacgtgcaggtggacaccggcagcgatatcctctgggtcaactgcatccgctgcgacggctgccccaccacgagcggcctcgggatagaactgacgcagtacgaccctgccgggagcgggaccacggtggggtgcgaccaggagttctgcgtcgccaacagccccaacggcttgccccccgcgtgcccctcgacgtcgtcgccgtgccagttcaggatcgcctacggagatgggagctcaaccaccggcttctacgtctcagattccgtgcagtacaaccaggtgtccggcaacggccagaccaccccgtccaacgccagcatcacgtttgggtgtggtgctcagcttggtggggatttgggatcctcgagccaggcccttgatgggattcttgggttcggccaggcggattcgtcgatgctgtcgcagctggctgctgctcgtaaagtgagaaagatatttgctcactgcttggacactgtccatggtggtggcatcttcgctattgggaatgtggtacagcccaaagtgaagacgacgcccttggtgcaaaacgtgacacactacaatgtcaatctgcaaggaatttctgttggtggtgctacacttcagcttccatcgagtacttttgattctggtgacagtaaaggcactatcattgacagcgggacaacactggcatatcttccgagggaagtttataggactttgttgactgcggtatttgataagtatcaagatctggccttacataattatcaagacttcgtctgtttccagttttctggaagtatagatgatggatttcccgtagtcacctttagttttgagggagaaattacactgaatgtttacccacatgattaccttttccagaatgagaatgatttatactgtatgggattcctggatggtggagtgcagaccaaagatgggaaagatatggttctcttaggagacctggtcctctcaaataaactagtagtctatgacttggaaaaacaagttattggatgggcagactacaactgctcctcgagcattaaaattcaggatgacaagactggctcagtgtacactgtcgacgcacaaaatatctctgctgggtggagatttcaatggcacaagtccttgattctgttgttagtaacagcaacctggagctgtttggtgttgtag

SEQ ID NO: 4358 - protein, 490 aa, Sorghum bicolor
  misc_feature: Ceres ANNOT ID no. 6037049
  misc_feature (84)..(440): Pfam Id: Asp Pfam Desc: Eukaryotic aspartyl protease
  misc_feature (2)..(489): NCBI GI: 38344991 NCBI Desc: osjnba0008a08.5 [oryza sativa (japonica cultivar-group)]
  misc_feature (2)..(489): NCBI GI: 116309515 NCBI Desc: osigba0137o04.7 [oryza sativa (indica cultivar-group)]
  misc_feature (15)..(482): NCBI GI: 18390579 NCBI Desc: aspartyl protease family protein [arabidopsis thaliana]
  misc_feature (13)..(482): NCBI GI: 115457772 NCBI Desc: os04g0334700 [oryza sativa (japonica cultivar-group)]
  misc_feature (12)..(485): NCBI GI: 9759039 NCBI Desc: aspartyl protease-like [arabidopsis thaliana]
MAPAPRASIFFSVLLVLLFALLVERAAATGVFQVRRKFPRHGGGGDVAEHLAALRRHDVGRHGRLLGAVDLPLGGVGLPTATGLYYTQIEIGSPSKGYYVQVDTGSDILWVNCIRCDGCPTTSGLGIELTQYDPAGSGTTVGCDQEFCVANSPNGLPPACPSTSSPCQFRIAYGDGSSTTGFYVSDSVQYNQVSGNGQTTPSNASITFGCGAQLGGDLGSSSQALDGILGFGQADSSMLSQLAAARKVRKIFAHCLDTVHGGGIFAIGNVVQPKVKTTPLVQNVTHYNVNLQGISVGGATLQLPSSTFDSGDSKGTIIDSGTTLAYLPREVYRTLLTAVFDKYQDLALHNYQDFVCFQFSGSIDDGFPVVTFSFEGEITLNVYPHDYLFQNENDLYCMGFLDGGVQTKDGKDMVLLGDLVLSNKLVVYDLEKQVIGWADYNCSSSIKIQDDKTGSVYTVDAQNISAGWRFQWHKSLILLLVTATWSCLVL

SEQ ID NO: 4359 - DNA, 1143 bp, Sorghum bicolor
  misc_feature: Ceres ANNOT ID no. 6037130
  misc_feature: Encodes the peptide sequence at SEQ ID NO 4360
atggagtctctcctcgcatcgcgatccattaggtcttccttctccgccgtcgctagcaccaggggcgcttcctccaggccctcgcgcatcgccactctcgccggcgccggcgccggcgctcgcccgctccgtgccggccccaaggactcgattgttgaggcgctggcaaaggatgatatgctgaacgcaacagaggtggtccaatgggagaatggcatgacagtgaacggcatagcggctacgcaggggattcgcatctgcaggcactgccgccccactgcctccttgaaggagatacaggaggagctgggagcccctcgtaacatcctagagaagatcatttgggacaaggagattgaagtagccgaggggcatgctaagaagcctctggaggaggtgattcaggctgcacagaaggcacctccttcaagagacttctatggtgctttagaagctgcctacaagcgtaatggggtgcctgcgttgattgctgaggtcaagaaagcatccccaagtaggggcgtgctcagggagaacttcgatcctgttgaaattgctcaagcttatgaaaagaatggagctgcatgtttgagcattttgacagatgagaagtactttcagggaagctttgagaatcttgggaaggtgcgcacctcaggagtgaagtgcccccttctctgcaaagagtttgtcattgataagtggcaaatctataatgctcgctctaagggtgctgatgcaattctattaattgctgctgtgctaccagatgttgacataatgtactttattaagatttgcgcagagttgggaatgacagctcttattgaggttcatgatgaaagagagatggagcgtgtgctgaagataaatggagttaagcttattggtatcaataaccgaagccttgagacatttgttattgatacttcaaacaccaagatgttgctcgagaagcatggcaatagcatcagggagaagggaattttggttgttggtgaatcaggtctgtttactccggatgacgttgcttatgtgcagaatgctggcgtttctgctgttttggtgggggaatccctggtgaagcaagaatgccctggacgagccattgttgggttgtttggcaaagaactgctgcactga

SEQ ID NO: 4360 - protein, 380 aa, Sorghum bicolor
  misc_feature: Ceres ANNOT ID no. 6037130
  misc_feature (109)..(373): Pfam Id: IGPS Pfam Desc: Indole-3-glycerol phosphate synthase
  misc_feature (48)..(380): NCBI GI: 619732 NCBI Desc: indole-3-glycerol phosphate synthase
  misc_feature (99)..(378): NCBI GI: 116309729 NCBI Desc: osigba0115m15.12 [oryza sativa (indica cultivar-group)]
  misc_feature (73)..(378): NCBI GI: 145334777 NCBI Desc: indole-3-glycerol-phosphate synthase [arabidopsis thaliana]
  misc_feature (127)..(378): NCBI GI: 38606522 NCBI Desc: osjnba0016o02.9 [oryza sativa (japonica cultivar-group)]
  misc_feature (140)..(378): NCBI GI: 115458874 NCBI Desc: os04g0467700 [oryza sativa (japonica cultivar-group)]
  misc_feature (7)..(380): SWISSPROT Homolog: EC 4.1.1.48 Indole-3-glycerol phosphate synthase, chloroplast precursor
MESLLASRSIRSSFSAVASTRGASSRPSRIATLAGAGAGARPLRAGPKDSIVEALAKDDMLNATEVVQWENGMTVNGIAATQGIRICRHCRPTASLKEIQEELGAPRNILEKIIWDKEIEVAEGHAKKPLEEVIQAAQKAPPSRDFYGALEAAYKRNGVPALIAEVKKASPSRGVLRENFDPVEIAQAYEKNGAACLSILTDEKYFQGSFENLGKVRTSGVKCPLLCKEFVIDKWQIYNARSKGADAILLIAAVLPDVDIMYFIKICAELGMTALIEVHDEREMERVLKINGVKLIGINNRSLETFVIDTSNTKMLLEKHGNSIREKGILVVGESGLFTPDDVAYVQNAGVSAVLVGESLVKQECPGRAIVGLFGKELLH

SEQ ID NO: 4361 - DNA, 330 bp, Sorghum bicolor
  misc_feature: Ceres ANNOT ID no. 6037349
  misc_feature: Encodes the peptide sequence at SEQ ID NO 4362
atggtcggtcccatcatcgtcgccgtagcatctgccggggtcggcgcgttcatcggcgtagcggcggccgacaggtgctcggagtggaggccaccgctagccggtgccggcggcgcgcaggggccaagctgctcgacgtgcgctggcacagggaaggttgcatgcccctgctcccggtggtcggacggtgacgtcgggtgcaggacatgcactgggtcaggtcgcacagactgccgcagctgccgcggctccggcaccggcagacgcgctactgtccgggtcaccctgcgcgcgcagaggactctcgtggctgttaaaaaagccaaatga

SEQ ID NO: 4362 - protein, 109 aa, Sorghum bicolor
  misc_feature: Ceres ANNOT ID no. 6037349
  misc_feature (4)..(97): NCBI GI: 35187445 NCBI Desc: fiber protein fb25 [gossypium barbadense]
  misc_feature (2)..(97): NCBI GI: 37788355 NCBI Desc: drought-induced protein 1 [glycine latifolia]
  misc_feature (1)..(98): NCBI GI: 38347221 NCBI Desc: osjnba0044m19.3 [oryza sativa (japonica cultivar-group)]
  misc_feature (1)..(98): NCBI GI: 116309500 NCBI Desc: osigba0148p16.1 [oryza sativa (indica cultivar-group)]
  misc_feature (44)..(93): NCBI GI: 109732902 NCBI Desc: riken cdna d630042p16 gene [mus musculus]
  misc_feature: Useful for making plants with modulated nitrogen use efficiency
  misc_feature: Functional homolog of the protein sequence given in SEQ ID NO 13294
MVGPIIVAVASAGVGAFIGVAAADRCSEWRPPLAGAGGAQGPSCSTCAGTGKVACPCSRWSDGDVGCRTCTGSGRTDCRSCRGSGTGRRATVRVTLRAQRTLVAVKKAK

SEQ ID NO: 4363 - DNA, 1719 bp, Sorghum bicolor
  misc_feature: Ceres ANNOT ID no. 6037437
  misc_feature: Encodes the peptide sequence at SEQ ID NO 4364
atgtctcaatcttctcctttcttctccattgcccgagtgcacgctggagcaggagggcgagctgcggcagccgctctcctgctccgtcgctccatttctcagctgccacacagcattcatggcctaaggtgtttctcttcagccagagtgacacctgccaagacactgcaatcacacctcagcctcccccgcgccacactgtcctcttttgccgatgccgaagatggctccagtgccgaaggcagtgacaagaaggctggggaggagcagatcggggaatgcgagatgtcagagatggcgaaggcgttccatatctcaccacggatggcgatgtcgatctctgtgatgattgcattcgccgccctcactgtaccgctggcgatgcgctcactggtctgccatggaaccttcaaaatgaatgcgctggcatactttacgcttctgtcagggttctatatggcatggaatattggggccaatgatgttgcaaatgccatggggacgtcagttgggtccggagctttgacactccggcaggcggtggtgactgcagcagtgctagagttctccggtgcattccttatggggacccatgtcaccagcaccatgcagaagggaatactggttgcgtctgtcttccaaggaaaggactctctgctcttcgctggactgatatcctcccttgctgctgccggtacatggctgcaggttgcttcgtcatatggctggcctgtctcaactacacattgtatagttggggctatggttggttttgggctggtgtatggaggggtgaatgcagttttctggagttctctggctagagtatcttcatcttgggtcatttctccattgatgggtgcagcagtctcctttcttgtttacaagtgcatacggaggtttgtatacagcgcacccaatccaggccaggctgcagctgctgctgcaccaatcgcagtctttgctggtgtcactgcaatctcgtttgctgcttttcctctcagtaaggtgttttccattgccatcctgcaagcagtatccagtggggcaataggagccatcattgtttcccgagtgatcaaaaaacagctaggtgacttactgtcttcagaagcagaaaagatagcatccactgagaagtcaaatgttcagcaggcgggacttctttcggacattgctggccctacaggagctcagttgcagattgtgtatagtgtatttggttacatgcaagtcttatcggcatgcttcatgtcatttgctcatggaggaaatgacgtctccaatgccatagggcccctggctgcagctttgtccattcttcaaggtgtggcaagcagcgctgagatagtcatacctactgaagttcttgcttggggtggttttggaattgttgcagggcttacaatgtggggatatagggtgatagcaacaattggcaagaaaatcacagaactaacacctactaggggctttgctgcagagtttgcagcagcttcagttgtcttgtttgcatcaaagcttgggttgcctatatctgccacgcatacacttgttggagcggtgatgggtgtcggatttgcaagagggctcaatagagtcagagcagagacagttcgtgatattgtggcatcctggttggtcacaattccagttggtgctgtcctatctatcttctacacattgatcttgaccaaaattctggcatacttaatgtga

SEQ ID NO: 4364 - protein, 572 aa, Sorghum bicolor
  misc_feature: Ceres ANNOT ID no. 6037437
  misc_feature (157)..(557): Pfam Id: PHO4 Pfam Desc: Phosphate transporter family
  misc_feature (1)..(572): NCBI GI: 31580630 NCBI Desc: phosphate transporter 2-1 [triticum aestivum]
  misc_feature (74)..(572): NCBI GI: 30688378 NCBI Desc: phosphate transporter family protein [arabidopsis thaliana]
  misc_feature (58)..(572): NCBI GI: 22450125 NCBI Desc: phosphate hydrogen transporter [spinacia oleracea]
  misc_feature (53)..(572): NCBI GI: 24079961 NCBI Desc: phosphate transporter pht2-1 [medicago truncatula]
  misc_feature (57)..(572): NCBI GI: 47571341 NCBI Desc: chloroplast phosphate transporter precursor [solanum tuberosum]
  misc_feature: Useful for making plants with modulated phosphate use efficiency
  misc_feature: GREAT-hit functional homolog of the protein sequence given in SEQ ID NO 13405
  misc_feature: Useful for making plants with modulated phosphate use efficiency
  misc_feature: Functional homolog of the protein sequence given in SEQ ID NO 13405
  misc_feature: The sequence is a functional homolog of SEQ ID NO. 523 in the 11/188,298 US application
MSQSSPFFSIARVHAGAGGRAAAAALLLRRSISQLPHSIHGLRCFSSARVTPAKTLQSHLSLPRATLSSFADAEDGSSAEGSDKKAGEEQIGECEMSEMAKAFHISPRMAMSISVMIAFAALTVPLAMRSLVCHGTFKMNALAYFTLLSGFYMAWNIGANDVANAMGTSVGSGALTLRQAVVTAAVLEFSGAFLMGTHVTSTMQKGILVASVFQGKDSLLFAGLISSLAAAGTWLQVASSYGWPVSTTHCIVGAMVGFGLVYGGVNAVFWSSLARVSSSWVISPLMGAAVSFLVYKCIRRFVYSAPNPGQAAAAAAPIAVFAGVTAISFAAFPLSKVFSIAILQAVSSGAIGAIIVSRVIKKQLGDLLSSEAEKIASTEKSNVQQAGLLSDIAGPTGAQLQIVYSVFGYMQVLSACFMSFAHGGNDVSNAIGPLAAALSILQGVASSAEIVIPTEVLAWGGFGIVAGLTMWGYRVIATIGKKITELTPTRGFAAEFAAASVVLFASKLGLPISATHTLVGAVMGVGFARGLNRVRAETVRDIVASWLVTIPVGAVLSIFYTLILTKILAYLM

SEQ ID NO: 4365 - DNA, 1827 bp, Sorghum bicolor
  misc_feature: Ceres ANNOT ID no. 6037439
  misc_feature: Encodes the peptide sequence at SEQ ID NO 4366
atggacaagatacaatctgattgcccttatcctggatgtttcttttgtgtcatgaaggaggcaaacccaagtaaacgaagagcaagtgtgctaaagttctttagggaacttccttcccaagatgatgatggtcaagttctccctattagtggtctctggaacacagcaatggctcacccaaatgatcccgagttcatcaacttgggcatatttgaatgcatggcagctcttatatggaaagggttgaaaaacaggcgttggcttgcacatgatcaaaatatttacatcccatattatgcagctcacataattggatcatacacaatgaatatggaggagtttgcagagcgtgctgttcgtgctggtgtaatacctccattagtcgaactgttaagaggtaggctgacgtgggttgagcaaagagttgccgttagagctttggggcatttggctacatatcctagtacatttcctgcagttgctgatcatggggaagtacttgaacttgccattcaacttgcttcgagctccctagagattgtgtactctcacttttaccaatttgtggatcgaaggcttggctaccattgcgaccttcttactcgtggcatgggtggtgtggaaatggaatcccgcaaagctgaggaatgggcaagtcaactgcagtgctggtctttgcaactcattaactgctttgcatttaagcctgaattcctccatgatatttgtaagcccgattttctagttaagttacctggaatgtggggtggacttgtaaatgagaactcgcctgctggtgttggtttgctaagaacaatctgccagagcaaagttggccgaggtcatgttgctaacattcctggtactattgatgctttatgtaacattgctcgttcttcagatgactggcaatacatggcagttgattgtctgatctggttagtgcaggatgcaagtacctgtcagaaggttatagataaagttgcgccaacactgatagacttagcagatatttcgacactgggtgattataaaaaacttggtgacacaattgtcacagtcctccaagaatgtatgcaacagagtgggaactcacgcggtgcaatcagtgctcaaaccaaagcagaaattgatgagcttttgagatccaagcaaagtttgaaattggaaaagagtatgccaaaggaggatcttcatataaaacaagctgcagcattggtagtcaagttggaaggcaattcgctgttctcttcagggaacattgcaggtgctgcagagaaatactctgaagcacttgcactatgtccaatgaagtctaagaaagagcgggtggttctatacagcaatcgagctcaatgttaccttctcctgcagcagccattggctgccataagcgatgctactcgagcattgtgccttcatagccctgtgaatcgtcatgccaagagtttgtggagaagagctcaagcatacgatatgcttggttttgcaaaagagagcttgttggatgcaatccttttcataaacgagtgctctcagtcaaacgatcctgacttatccctgaagcaaaacaaagttcctgattatgctgagcgattggtgaagaagcagatgcgtgccgcttggctattcagggaagcagctctgaagcatggtggtgtccattgtgaaggagatgcgagcgatgcgtttggtcaagaggctgatgactctgagtgggaaacagctagcgaaagtgatgctgaaaatgatgccacaggagaagcagatgatgaaactgaatggaagaatgatggccaccaggaagatttctgtgagaaaagctga

SEQ ID NO: 4366 - protein, 608 aa, Sorghum bicolor
  misc_feature: Ceres ANNOT ID no. 6037439
  misc_feature (1)..(602): NCBI GI: 72384486 NCBI Desc: 80a08_17 [brassica rapa subsp. pekinensis]
  misc_feature (367)..(503): NCBI GI: 60678021 NCBI Desc: lp07287p [drosophila melanogaster]
  misc_feature (367)..(503): NCBI GI: 123227604 NCBI Desc: tetratricopeptide repeat domain 1 [mus musculus]
  misc_feature (388)..(503): NCBI GI: 125776948 NCBI Desc: ga13331-pa [drosophila pseudoobscura]
  misc_feature (356)..(538): NCBI GI: 116128141 NCBI Desc: ensangp00000014458 [anopheles gambiae str. pest]
  misc_feature: Useful for making plants with altered alkaloid content
  misc_feature: Useful for making plants with altered terpenoid content
  misc_feature: Functional homolog of the protein sequence given in SEQ ID NO 13192
MDKIQSDCPYPGCFFCVMKEANPSKRRASVLKFFRELPSQDDDGQVLPISGLWNTAMAHPNDPEFINLGIFECMAALIWKGLKNRRWLAHDQNIYIPYYAAHIIGSYTMNMEEFAERAVRAGVIPPLVELLRGRLTWVEQRVAVRALGHLATYPSTFPAVADHGEVLELAIQLASSSLEIVYSHFYQFVDRRLGYHCDLLTRGMGGVEMESRKAEEWASQLQCWSLQLINCFAFKPEFLHDICKPDFLVKLPGMWGGLVNENSPAGVGLLRTICQSKVGRGHVANIPGTIDALCNIARSSDDWQYMAVDCLIWLVQDASTCQKVIDKVAPTLIDLADISTLGDYKKLGDTIVTVLQECMQQSGNSRGAISAQTKAEIDELLRSKQSLKLEKSMPKEDLHIKQAAALVVKLEGNSLFSSGNIAGAAEKYSEALALCPMKSKKERVVLYSNRAQCYLLLQQPLAAISDATRALCLHSPVNRHAKSLWRRAQAYDMLGFAKESLLDAILFINECSQSNDPDLSLKQNKVPDYAERLVKKQMRAAWLFREAALKHGGVHCEGDASDAFGQEADDSEWETASESDAENDATGEADDETEWKNDGHQEDFCEKS

SEQ ID NO: 4367 - DNA, 468 bp, Sorghum bicolor
  misc_feature: Ceres ANNOT ID no. 6037440
  misc_feature: Encodes the peptide sequence at SEQ ID NO 4368
atggccgggctgagcgttctcctggagccccacagcaagagccacccctgcgggaaggggaaggcagcggcggcggcgcagatcatcagcaaggccaccctcgtgatccacggccccagccacaaccacaagcagcagccgccgcagcgggttccgcctgtctctccgacggccgcgggctccttcctgcagcgctgctgcctgtgccacgcagagctcgccgagggcatggacatcaacatgtacagaggcgaccgggcgttctgcagcgtggagtgccggtgcaggcagatcttcatggacgaggacgccctcagcaacggcgagggtgccggtgccggtaccgccaccgtgcggggcagccggcgagccgccgctcgtccccgtgggacccatcgctggcgcaacaaaaggaggagtagtacgtgcgtggcgtctggctggacccactggataagatggccatga

SEQ ID NO: 4368 - protein, 155 aa, Sorghum bicolor
  misc_feature: Ceres ANNOT ID no. 6037440
  misc_feature (61)..(133): NCBI GI: 115476698 NCBI Desc: os08g0451200 [oryza sativa (japonica cultivar-group)]
  misc_feature (37)..(118): NCBI GI: 71834744 NCBI Desc: 80c09_23 [brassica rapa subsp. pekinensis]
  misc_feature (60)..(103): NCBI GI: 116309823 NCBI Desc: h0307d04.5 [oryza sativa (indica cultivar-group)]
  misc_feature (42)..(107): NCBI GI: 30692533 NCBI Desc: senescence-associated protein-related [arabidopsis thaliana]
  misc_feature (42)..(107): NCBI GI: 66841344 NCBI Desc: at4g39795 [arabidopsis thaliana]
  misc_feature: Useful for making plants with modulated nitrogen use efficiency
  misc_feature: Functional homolog of the protein sequence given in SEQ ID NO 12897
MAGLSVLLEPHSKSHPCGKGKAAAAAQIISKATLVIHGPSHNHKQQPPQRVPPVSPTAAGSFLQRCCLCHAELAEGMDINMYRGDRAFCSVECRCRQIFMDEDALSNGEGAGAGTATVRGSRRAAARPRGTHRWRNKRRSSTCVASGWTHWIRWP

SEQ ID NO: 4369 - DNA, 897 bp, Sorghum bicolor
  misc_feature: Ceres ANNOT ID no. 6037441
  misc_feature: Encodes the peptide sequence at SEQ ID NO 4370
atgggctctcccacgcggccgcggaggacgaccggtttcgctctcctcctggtgctcctgttcctctcgccgctcgcgtcagctggacaaccaaaaggcgtatgtgtttcaccaggtggacggttccctgccttctcgtctgaaggcaagcctccaggaagagcacccaaggggcgcagagatctagcactttgtaggatattccgtcagaatacatgttgcgatgtgacgcagacatttcctgctctggtctcagtgagaaaccttgcattgactggtgaaggcagtcaagaatgtattcatttgtgggaattgctcgagtgctcaatatgtgatccacgagtgggtgtcagacctggacctcctgttgtatgcgcatcattctgtgatatggtcttcaaagcttgttcagaatcatacttctctgtagatatgaaaacacaggccttgtctccttgtggtttaggtgacatcctttgtggcaaagcacataaatgggtctctaatggcacagagttatgccgtcttgctggtttctctgttcaagtttctgagaccagctctgatggagttgatgacactttctgctatggtgggaaagcaagtttggattccatctctgattcatggacttcttcaaaagaacgtccaacattaagtggtgtggcttcatgggatgttcaagattttcagagatgggcaagagaaatgcctgtcggtgaaagagtttcatgggcaattggaggaatggttcttacagctggccttatttttatcagcaaaagaaagagctacagccatcgccagaagcaagctgctattgttcgcaatatgagattgagaaggctggatcctagagccaacccacaacaaacaagcggagctaggaaggcatag

SEQ ID NO: 4370 - protein, 298 aa, Sorghum bicolor
  misc_feature: Ceres ANNOT ID no. 6037441
  misc_feature (61)..(190): NCBI GI: 67623117 NCBI Desc: multi-pass transmembrane protein [cryptosporidium hominis]
  misc_feature (61)..(190): NCBI GI: 54659014 NCBI Desc: multi-pass transmembrane protein [cryptosporidium hominis]
MGSPTRPRRTTGFALLLVLLFLSPLASAGQPKGVCVSPGGRFPAFSSEGKPPGRAPKGRRDLALCRIFRQNTCCDVTQTFPALVSVRNLALTGEGSQECIHLWELLECSICDPRVGVRPGPPVVCASFCDMVFKACSESYFSVDMKTQALSPCGLGDILCGKAHKWVSNGTELCRLAGFSVQVSETSSDGVDDTFCYGGKASLDSISDSWTSSKERPTLSGVASWDVQDFQRWAREMPVGERVSWAIGGMVLTAGLIFISKRKSYSHRQKQAAIVRNMRLRRLDPRANPQQTSGARKA

SEQ ID NO: 4371 - DNA, 330 bp, Sorghum bicolor
  misc_feature: Ceres ANNOT ID no. 6037443
  misc_feature: Encodes the peptide sequence at SEQ ID NO 4372
atggcggaggccgagggaaaagcaaagcaaatggcggagggcccgagcaagatcgaatccatgaggaagtgggtcgtcgaccacaagctccgagccgtaggttgcctctggctaggtgggatcagcagttcgatcgcctacaactggtcgcggcccaatatgaagactagcgtcaagatcatccacgcaaggttgcatgcacaaggtctaaccctagctgcattagttggttctgcatgcgtggagtactatgacaataagtatggttcttctgggccaaaggtggacaaatacacaagccaatacctggcccatgcgcataaagattaa

SEQ ID NO: 4372 - protein, 109 aa, Sorghum bicolor
  misc_feature: Ceres ANNOT ID no. 6037443
  misc_feature (14)..(81): Pfam Id: HIG_1_N Pfam Desc: Hypoxia induced protein conserved region
  misc_feature (11)..(109): NCBI GI: 70609694 NCBI Desc: hypoxia-responsive family protein [citrus sinensis]
  misc_feature (11)..(87): NCBI GI: 92871677 NCBI Desc: hypoxia induced protein conserved region [medicago truncatula]
  misc_feature (18)..(87): NCBI GI: 92881101 NCBI Desc: hypoxia induced protein conserved region [medicago truncatula]
  misc_feature (7)..(89): NCBI GI: 119495501 NCBI Desc: mitochondrial hypoxia responsive domain protein [neosartorya fischeri nrrl 181]
  misc_feature (29)..(89): NCBI GI: 119397176 NCBI Desc: mitochondrial hypoxia responsive domain protein [aspergillus clavatus nrrl 1]
MAEAEGKAKQMAEGPSKIESMRKWVVDHKLRAVGCLWLGGISSSIAYNWSRPNMKTSVKIIHARLHAQGLTLAALVGSACVEYYDNKYGSSGPKVDKYTSQYLAHAHKD

SEQ ID NO: 4373 - DNA, 2262 bp, Sorghum bicolor
  misc_feature: Ceres ANNOT ID no. 6037469
  misc_feature: Encodes the peptide sequence at SEQ ID NO 4374
  misc_feature: Down-regulated in root tissues in response to salicylic acid treatment
atggggagaaggagcagccgcgcctgctcccttcttggttccgcccagctgctcctgctgctgctctcgctcgcgctcggctccgccgccgcccagaagggctccacatggaagaccctcagcggcaaggctccagtaatcgttgctaagggcgggttctctggtctatttcctgagtccagtctatatgcttatcagattcttgggagtcttagctcccctgacacagtcatgtggtgtgatgttcggttgacaaaggatggcggtggtatctgcctaccaagcatagacatggataactgcacaacgatagccaatttttttccacaagggaagaagacctacaatgttaatggtgtatctacggtgggatggttctccgtggactacacaagcactgatctgctaaatgtatctctgaagcaatcggtcctatctcgtaccggtgtatatgatggtatctttccaataattcctgttgaaaatgtttacacccagtttaatcccgttgctgtttggttaaatgtccagcaagacagtttctacagccagtttaagcttagcatgagaagctatatcctgtctttattgaaaaattttgttgtcgattacatctcatcgcctgaagtgaacttcctcaccagtatatctggaagagttagcaagaagacgaagcttgtgttccgctttcttgacgaacgctctattgagccatcgacaaatcagacttatggctcaatgttgaaaaatctaacgtttgtcaagacttttgcctctggaatacttgttcccaaaagctatatctggcctgttacaccagataattacctgctgccttatacttcagttgttgatgatgctcacaaagcagggctagaaatctatgctgctgattttgcaaatgactttactatcagctataactacagctatgatccattagcagaatatctttccttcattgataatggtgccttctctgtcgatggtgtattgagtgattttccaattactccttcagaggcagttgattgctttagtaacctgaacaacagcaagatcgatcatgctaaacctctagttatctctcataatggtgctagcggtgactacccagactgcaccgaccaagcttatgaaaaggcagttgctgatggtgcagatgtcattgactgtcctgttcaagtgaccaaagatggcatactgatatgcatgagttctgttgacctcatgaatgctactactgttgcaaaatcacaatttgcttcgcaagtaactaccatcaacgatctaaaggctgggcctggagtcttcaccttcaacctcacttgggatgatatttctaagaacctaaagcccatgatatcgaacccagcgatcggctttaaccagtacagaaatcccagaaacaagaatgcaggaaatttcatgagattatcagactttttgacctttgcaaagggaaaggatttgtcaggaatcatgataactgttgagcatgctgccttcatggcagaggagcttggatttggtgtggtagatgcagtgatcaaagcccttgatgactctggttatagcaagcagactgcccagagtgttatgattcagtcaaccaacagctcagttctagtgaagttcaagcaggaaaccaagtacaaccttgtctacatgattgaagaaaatgtcagagatgctgcaccttcctcccttgcagatattaagaagtttgctagtgctgtttctgttagcaccacatctgttttcccggaagaccattattatttgacaaaccagaccaataatcttgttaagtcccttaagtctgctggcctccaagtttacgcttacgtgctcatgaatgagtttggtactcaaccaaatgacttcttcgcagacgccactgtacagattaatgcttatgtgcatgtgcgaggtgctaatgtggatggggtcatcactgatttccctgggactgctcacagatacaaattgaactcctgcacgagcatgggaaagaacgcaccaccctttatgtcgcctccaaaacctggtgacctccttacaaccatgcccccatttgcacaaccaccagcagcggcgccaatgccgctcttgacggatgctgacgtcgcagaaccagccctacctccagtcagtaacaccaccacgcctgcatcgccttcggatgctgccctcatgatgcggactgatgtctcgatcctcatcacattgctgatgctatgtgcttccctcctcatctga

SEQ ID NO: 4374 - protein, 753 aa, Sorghum bicolor
  misc_feature: Ceres ANNOT ID no. 6037469
  misc_feature (364)..(658): Pfam Id: GDPD Pfam Desc: Glycerophosphoryl diester phosphodiesterase family
  misc_feature (4)..(749): NCBI GI: 38344811 NCBI Desc: osjnbb0022f23.4 [oryza sativa (japonica cultivar-group)]
  misc_feature (4)..(749): NCBI GI: 116310266 NCBI Desc: b0806h07.1 [oryza sativa (indica cultivar-group)]
  misc_feature (7)..(753): NCBI GI: 18416801 NCBI Desc: glycerophosphoryl diester phosphodiesterase family protein [arabidopsis thaliana]
  misc_feature (3)..(747): NCBI GI: 15219803 NCBI Desc: protein kinase family protein / glycerophosphoryl diester phosphodiesterase family protein [arabidopsis thaliana]
  misc_feature (247)..(675): NCBI GI: 4104060 NCBI Desc: s222 [triticum aestivum]
  misc_feature: Useful for making plants with altered cell wall content and/or composition
  misc_feature: GREAT-hit functional homolog of the protein sequence encoded by LOCUS at4g26690
  misc_feature: Useful for making plants with altered cell wall content and/or composition
  misc_feature: Functional homolog of the protein sequence given in SEQ ID NO 13867
  misc_feature: Down-regulated in root tissues in response to salicylic acid treatment
MGRRSSRACSLLGSAQLLLLLLSLALGSAAAQKGSTWKTLSGKAPVIVAKGGFSGLFPESSLYAYQILGSLSSPDTVMWCDVRLTKDGGGICLPSIDMDNCTTIANFFPQGKKTYNVNGVSTVGWFSVDYTSTDLLNVSLKQSVLSRTGVYDGIFPIIPVENVYTQFNPVAVWLNVQQDSFYSQFKLSMRSYILSLLKNFVVDYISSPEVNFLTSISGRVSKKTKLVFRFLDERSIEPSTNQTYGSMLKNLTFVKTFASGILVPKSYIWPVTPDNYLLPYTSVVDDAHKAGLEIYAADFANDFTISYNYSYDPLAEYLSFIDNGAFSVDGVLSDFPITPSEAVDCFSNLNNSKIDHAKPLVISHNGASGDYPDCTDQAYEKAVADGADVIDCPVQVTKDGILICMSSVDLMNATTVAKSQFASQVTTINDLKAGPGVFTFNLTWDDISKNLKPMISNPAIGFNQYRNPRNKNAGNFMRLSDFLTFAKGKDLSGIMITVEHAAFMAEELGFGVVDAVIKALDDSGYSKQTAQSVMIQSTNSSVLVKFKQETKYNLVYMIEENVRDAAPSSLADIKKFASAVSVSTTSVFPEDHYYLTNQTNNLVKSLKSAGLQVYAYVLMNEFGTQPNDFFADATVQINAYVHVRGANVDGVITDFPGTAHRYKLNSCTSMGKNAPPFMSPPKPGDLLTTMPPFAQPPAAAPMPLLTDADVAEPALPPVSNTTTPASPSDAALMMRTDVSILITLLMLCASLLI

SEQ ID NO: 4375 - DNA, 351 bp, Sorghum bicolor
  misc_feature: Ceres ANNOT ID no. 6037475
  misc_feature: Encodes the peptide sequence at SEQ ID NO 4376
atggcgtcgtccaagcgactcctcgtgttggttctcctgctcgccgccgttttccttgtcgcctcagcagctaacgagcaaacccagcacgagaacaacaacaaagctgacgtgcaggactaccgtggcggcggctacccgtacggcggctaccccggcggcggctggcgcggtgggggtggctaccccggcggccgtggcggctacccgggagggggcggcggccacggcggctactgccggtggggatgctgcggccgcgggtactacggcggctgccggtgctgctcgcgcgccgacgagatcccggagcccatgtaccgcccggagttcaccgaggtccacaactga

SEQ ID NO: 4376 - protein, 116 aa, Sorghum bicolor
  misc_feature: Ceres ANNOT ID no. 6037475
  misc_feature (1)..(93): Pfam Id: GRP Pfam Desc: Glycine rich protein family
  misc_feature (20)..(110): NCBI GI: 27461096 NCBI Desc: glycine-rich protein [lilium hybrid cv. 'star gazer']
  misc_feature (4)..(110): NCBI GI: 7024449 NCBI Desc: glycine-rich protein [citrus unshiu]
  misc_feature (43)..(104): NCBI GI: 295808 NCBI Desc: glycine-rich protein [hordeum vulgare subsp. vulgare]
  misc_feature (43)..(104): NCBI GI: 121644 NCBI Desc: glycine-rich cell wall structural protein precursor
  misc_feature (52)..(110): NCBI GI: 728596 NCBI Desc: glycine rich protein [hordeum vulgare subsp. vulgare]
MASSKRLLVLVLLLAAVFLVASAANEQTQHENNNKADVQDYRGGGYPYGGYPGGGWRGGGGYPGGRGGYPGGGGGHGGYCRWGCCGRGYYGGCRCCSRADEIPEPMYRPEFTEVHN

SEQ ID NO: 4377 - DNA, 381 bp, Sorghum bicolor
  misc_feature: Ceres ANNOT ID no. 6037562
  misc_feature: Encodes the peptide sequence at SEQ ID NO 4378
atgctggcagcctcccttctcgccctccgcctcctcctcctcgtcggcaccgccgcggcgggggcggtagggatgagtggtgggggccagctgtggtgcgttgccaagaacaacgcggaggacggcgcgctgcagagcgccatcgattgggcgtgcagtgttgacggcggccgcgccgactgcgcggcaatccagcagggtggcgcctgtttcgatccgcccgacctccagcagcacgcctcctacgccttcaacgactacttcctccgctccggcggcgccgcgagccccgccgcctgcgacttctccggcgccgccgcactcaccgcgctcaaccccagtaataaccccgaatctcttgtccacgctttgaatgattga

SEQ ID NO: 4378 - protein, 126 aa, Sorghum bicolor
  misc_feature: Ceres ANNOT ID no. 6037562
  misc_feature (31)..(117): Pfam Id: X8 Pfam Desc: X8 domain
  misc_feature (2)..(115): NCBI GI: 53793113 NCBI Desc: elicitor inducible beta-1,3-glucanase-like [oryza sativa (japonica cultivar-group)]
  misc_feature (9)..(114): NCBI GI: 18410877 NCBI Desc: glycosyl hydrolase family protein 17 [arabidopsis thaliana]
  misc_feature (29)..(114): NCBI GI: 140069636 NCBI Desc: x8 [medicago truncatula]
  misc_feature (26)..(114): NCBI GI: 22329437 NCBI Desc: glucan endo-1,3-beta-glucosidase-related [arabidopsis thaliana]
  misc_feature (17)..(114): NCBI GI: 90186653 NCBI Desc: beta-1,3-glucanase [medicago sativa]
  misc_feature: Useful for making plants with altered carbohydrate content
  misc_feature: Functional homolog of the protein sequence given in SEQ ID NO 13866
MLAASLLALRLLLLVGTAAAGAVGMSGGGQLWCVAKNNAEDGALQSAIDWACSVDGGRADCAAIQQGGACFDPPDLQQHASYAFNDYFLRSGGAASPAACDFSGAAALTALNPSNNPESLVHALND

SEQ ID NO: 4379 - DNA, 1191 bp, Sorghum bicolor
  misc_feature: Ceres ANNOT ID no. 6037623
  misc_feature: Encodes the peptide sequence at SEQ ID NO 4380
atggtgtcgtctgtagtagctgctgcagctgggactggaaatggcggaagaagcatcgccgagaggtggcgtgagctccagggctcgcgctcgtgggacggcctgcttgacccgttggacctggacctccgcaagtctctcatctcctacggcgagctcgtgtccgccaccggcgccggcttcaacaacgagaagcgctcgccgcactacggtctgtgcaggtactgccccgacgacctgcttgtcaagtccggggtggtcgacggcgcccgctactacagggtcaccaaattcgtgtacgccacggcggagctgctgttcggcctgtacaagcagaccacctggatggggtacgtcgcggtggccacggacgagggcgtggccgcgctcggcaggcgcgacatcgtcgtggcgtggcgcgggtcggcgacgcgcgcggagtgggccaaggacatcttcgagttcgtgccggcgcccgccgagtccgtgctgggctccgccgccgccgcgtacccatcggcgtacgtgcacagcggcttcctgtccttgtacaccaccagcaacgccgactctgagctcggcaagaccagcgccagggaccaggtgctccaggaggtgagcaggctggtggagctctacaaggacgaggaccaggagatgagcatcaccgtcgtcggccacagcctcggcgccgcgctctccatcctcaacgccgtcgacctcgtcagcaacggcgtgaacaactcctgcccggtggcagccgtcgtgttcgcctgcccgcatgttggcaacaactccttcaaagacgccttcgactccttcgacgacctcaaggcactccacgtgaagaacaagatagacttggtgcccctgctcatggactggttgcctgacctgggcgtgacgctgcccatcgacacgagcctgtcgccgtacctcaaggacccccagaacacggcccacgagctcgagtgctacttgcatggcgtcgccggggttcagggaagcgacgccggcggagggttcgacctggtggtggaccgcgacgtggcgctgctcaacaggagcgccgacgcgctcaaggacgagcacccggtgccggcgagctggtgggtggcggagcacaagagcatggtcaagaacgccaaaggcaagtgggagctcaaggatttcgagcagatcatatattaa

SEQ ID NO: 4380 - protein, 396 aa, Sorghum bicolor
  misc_feature: Ceres ANNOT ID no. 6037623
  misc_feature (136)..(293): Pfam Id: Lipase_3 Pfam Desc: Lipase (class 3)
  misc_feature (112)..(393): NCBI GI: 20146431 NCBI Desc: lipase-like [oryza sativa (japonica cultivar-group)]
  misc_feature (19)..(388): NCBI GI: 15221426 NCBI Desc: lipase class 3 family protein [arabidopsis thaliana]
  misc_feature (19)..(388): NCBI GI: 21537306 NCBI Desc: lipase-like protein [arabidopsis thaliana]
  misc_feature (93)..(392): NCBI GI: 7268648 NCBI Desc: lipase-like protein [arabidopsis thaliana]
  misc_feature (176)..(393): NCBI GI: 4103627 NCBI Desc: lipase [dianthus caryophyllus]
MVSSVVAAAAGTGNGGRSIAERWRELQGSRSWDGLLDPLDLDLRKSLISYGELVSATGAGFNNEKRSPHYGLCRYCPDDLLVKSGVVDGARYYRVTKFVYATAELLFGLYKQTTWMGYVAVATDEGVAALGRRDIVVAWRGSATRAEWAKDIFEFVPAPAESVLGSAAAAYPSAYVHSGFLSLYTTSNADSELGKTSARDQVLQEVSRLVELYKDEDQEMSITVVGHSLGAALSILNAVDLVSNGVNNSCPVAAVVFACPHVGNNSFKDAFDSFDDLKALHVKNKIDLVPLLMDWLPDLGVTLPIDTSLSPYLKDPQNTAHELECYLHGVAGVQGSDAGGGFDLVVDRDVALLNRSADALKDEHPVPASWWVAEHKSMVKNAKGKWELKDFEQIIY

SEQ ID NO: 4381 - DNA, 1191 bp, Sorghum bicolor
  misc_feature: Ceres ANNOT ID no. 6037633
  misc_feature: Encodes the peptide sequence at SEQ ID NO 4382
atggtgtcgtctgtagtagctggtgcagctgggactggaaatggcggaagaagcatcgccgagaggtggcgtgagctccagggctcgcgctcgtgggacggcctgcttgacccgttggacctggacctccgcaagtctctcatctcctacggcgagctcgtgtccgccaccggcgccggctttaacaacgagaagcgctcgccgcactacggtctgtgcaggtactgccccgacgacctgcttgtcaagtccggggtggtcgacggcgcccgctactacagggtcaccaaattcgtgtacgccacggcggagctgctgttcggcctgtacaagcagaccacctggatggggtacgtcgcggtggccacggacgagggcgtggctgcgctcggcaggcgcgacatcgtcgtggcgtggcgcgggtcggcgacggacgcggagtgggccaaggacatcatcgagttcgtgccggctcccgccgagtccgtgctgggctccgccgccgccgcgtacccatcggcgtacgtgcacagcggcttcctgtccttgtacaccaccagcaacgccgactctgagctcggcaagaccagcgccagggaccaggtgctccaggaggtgagcaggctggtggagctctacaaggacgaggaccaggagatgagcatcaccgtcgtcggccacagcctcggcgccgcgctctccatcctcaacgccgtcgacctcgtcagcaacggcgtgaacaactcctgcccggtggcagccgtcgtgttcgcctgcccgcatgttggcaacaactccttcaaagacgccttcgactccttcgacgacctcaaggcactccacgtgaagaacaagatagacttggtgccccagctcatggactggttgcctgacctgggcgtgacgctgcccatcgacacgagcctgtcgccgtacctcaaggaccccaagaacacggcccacgagctcgagtgctacttgcatggcgtcgccggggttcagggaagcgacgccggcggtgggttcgacctggtggtggaccgcgacgtggcgctgctcaacaggagcgtcgacgcgctcaaggacgagcacccggtgccggcgagctggtgggtggcggagcacaagagcatggtcaagaacgccaaaggcaagtgggagctcaaggatttcgagcagatcatatattaa

SEQ ID NO: 4382 - protein, 396 aa, Sorghum bicolor
  misc_feature: Ceres ANNOT ID no. 6037633
  misc_feature (136)..(293): Pfam Id: Lipase_3 Pfam Desc: Lipase (class 3)
  misc_feature (112)..(393): NCBI GI: 20146431 NCBI Desc: lipase-like [oryza sativa (japonica cultivar-group)]
  misc_feature (19)..(388): NCBI GI: 15221426 NCBI Desc: lipase class 3 family protein [arabidopsis thaliana]
  misc_feature (19)..(388): NCBI GI: 21537306 NCBI Desc: lipase-like protein [arabidopsis thaliana]
  misc_feature (93)..(392): NCBI GI: 7268648 NCBI Desc: lipase-like protein [arabidopsis thaliana]
  misc_feature (176)..(393): NCBI GI: 4103627 NCBI Desc: lipase [dianthus caryophyllus]
MVSSVVAGAAGTGNGGRSIAERWRELQGSRSWDGLLDPLDLDLRKSLISYGELVSATGAGFNNEKRSPHYGLCRYCPDDLLVKSGVVDGARYYRVTKFVYATAELLFGLYKQTTWMGYVAVATDEGVAALGRRDIVVAWRGSATDAEWAKDIIEFVPAPAESVLGSAAAAYPSAYVHSGFLSLYTTSNADSELGKTSARDQVLQEVSRLVELYKDEDQEMSITVVGHSLGAALSILNAVDLVSNGVNNSCPVAAVVFACPHVGNNSFKDAFDSFDDLKALHVKNKIDLVPQLMDWLPDLGVTLPIDTSLSPYLKDPKNTAHELECYLHGVAGVQGSDAGGGFDLVVDRDVALLNRSVDALKDEHPVPASWWVAEHKSMVKNAKGKWELKDFEQIIY

SEQ ID NO: 4383 - DNA, 1128 bp, Sorghum bicolor
  misc_feature: Ceres ANNOT ID no. 6037653
  misc_feature: Encodes the peptide sequence at SEQ ID NO 4384
atggcgcggcgatccgcccctctcctgcgccgcctcgtctccgcgtcctccttcccgcccgcgccgcagcccctcggcggcgtcctcgcgcggcgcacggtgacctacatgccccgacccggggacggcgccccgcgcgccgtcacgctcatcccgggcgacggcatcgggcccctcgtcacgggcgccgtgcgccaggtcatggaggccatgcacgcgcccgtctacttcgagacctacgacgtccacggcgacatgcccaccgttccgcccgccgtcatcgactccatccgccgcaacaaggtctgcatcaagggcggcctcgccacgcccgtcggcggcggggtctcctccctcaacatgcagctgcgcaaggagctcgacctctacgcatcgctcgtccactgctccaacctccccggcctgcccaccaggcaccagggtgtcgatatcgtcgtcatcagggagaacaccgagggcgagtactcggggctcgagcacgaggtcgtgcccggggtcgttgaaagcctcaaggtgatcacaaagttttgctctgagaggattgccaaatacgcgttcgagtatgcttaccttaacaaccgaaagaaagtcactgcagtgcataaagcaaacattatgaagcttgccgatggtttgttcttggagtcttgccgcgaggttgcttcaaagtaccctggtattcagtacaatgagatgattgttgacaactgctctatgcaacttgtttcaaagccagaacaatttgatgtcatggttacacctaatctttatggcaatttggtggctaacacggctgcaggtattgttggagggacaggcatcatgcctggaggcaatgtgggtcaggactatgctgtctttgagcaaggtgcttctgcaggaaatgttggaaatgagaacatcgtggagcagaagaaagcaaaccctgtcgcgctgcttctgtcatctgctatgatgttgaggcatttgcagttcccatcatttgctgaccgtctggaaacggcggtgaagcgcgttgttgcagaaggcacgcacagaacaaaggatttgggcggtaccagcaccacccaggaagttaccgacgctgtgattgccagtctggattag

SEQ ID NO: 4384 - protein, 375 aa, Sorghum bicolor
  misc_feature: Ceres ANNOT ID no. 6037653
  misc_feature (47)..(370): Pfam Id: Iso_dh Pfam Desc: Isocitrate/isopropylmalate dehydrogenase
  misc_feature (1)..(375): NCBI GI: 116309909 NCBI Desc: osigba0116m22.11 [oryza sativa (indica cultivar-group)]
  misc_feature (3)..(375): NCBI GI: 115458986 NCBI Desc: os04g0479200 [oryza sativa (japonica cultivar-group)]
  misc_feature (37)..(375): NCBI GI: 38605779 NCBI Desc: osjnba0044k18.22 [oryza sativa (japonica cultivar-group)]
  misc_feature (1)..(375): NCBI GI: 3790188 NCBI Desc: nad-dependent isocitrate dehydrogenase [nicotiana tabacum]
  misc_feature (1)..(375): NCBI GI: 22136588 NCBI Desc: at4g35260/f23e12_180 [arabidopsis thaliana]
  misc_feature (1)..(375): SWISSPROT Homolog: EC 1.1.1.41 Isocitrate dehydrogenase [NAD] regulatory subunit 1, mitochondrialprecursor
  misc_feature: The sequence is a functional homolog of SEQ ID NO. 460 in the 11/188,298 US application
  misc_feature: The sequence is a functional homolog of SEQ ID NO. 301 in the 11/188,298 US application
  misc_feature: The sequence is a functional homolog of SEQ ID NO. 317 in the 11/188,298 US application
MARRSAPLLRRLVSASSFPPAPQPLGGVLARRTVTYMPRPGDGAPRAVTLIPGDGIGPLVTGAVRQVMEAMHAPVYFETYDVHGDMPTVPPAVIDSIRRNKVCIKGGLATPVGGGVSSLNMQLRKELDLYASLVHCSNLPGLPTRHQGVDIVVIRENTEGEYSGLEHEVVPGVVESLKVITKFCSERIAKYAFEYAYLNNRKKVTAVHKANIMKLADGLFLESCREVASKYPGIQYNEMIVDNCSMQLVSKPEQFDVMVTPNLYGNLVANTAAGIVGGTGIMPGGNVGQDYAVFEQGASAGNVGNENIVEQKKANPVALLLSSAMMLRHLQFPSFADRLETAVKRVVAEGTHRTKDLGGTSTTQEVTDAVIASLD

SEQ ID NO: 4385 - DNA, 786 bp, Sorghum bicolor
  misc_feature: Ceres ANNOT ID no. 6037655
  misc_feature: Encodes the peptide sequence at SEQ ID NO 4386
atggcctggatctggatggtccccgtggcgggagccgtgctcctgtgggcgatctctctggggcggatcctctcctaccccgcgccgtcctgtgtgcccccgagcccgcagttcatgccccctctccgcgacgacaggaggagccggaacgtgctgctggtcgtcgcccaccccgacgacgagttctttgccccaactattcttttcctcaagtcaaaaggtcacagcattcacattctgtgcatgtctcgaggtgatgctgatggtctcggaaatactcgtaaagaagaactgtaccatgcctgtgacacccttaagattccacatgaacaagttaaagtcttggaccacccaaaattgcaggatggttttcatgagaaatgggaccatgggctagtagcagaacttactgtgcagcatgtccaactatggggcattgacacgattgtgacatttgattcatatggagtatcagggcacccaaaccacaaagatcttcatcacggcgtatgcaagtttctccatgcaaatgggcaaggaaacgatgaaacttgggaactagcaagcctgaatattcttcgcaagtacagtggtcctgttgacatatggctttcttccttgatatccttctcaaggtcaaagcaatcaatctatactgtggttaacagtagaccgtccaaaagctatgaggcaatggctgcacacagaagtcagtgggtttggtttagaagattgtttgtcatcttctcgagctatacgtatgcaaatgtgctaaagaaaatttaa

SEQ ID NO: 4386 - protein, 261 aa, Sorghum bicolor
  misc_feature: Ceres ANNOT ID no. 6037655
  misc_feature (52)..(174): Pfam Id: PIG-L Pfam Desc: GlcNAc-PI de-N-acetylase
  misc_feature (1)..(261): NCBI GI: 32487388 NCBI Desc: osjnbb0017i01.2 [oryza sativa (japonica cultivar-group)]
  misc_feature (1)..(148): NCBI GI: 90399046 NCBI Desc: h0402c08.18 [oryza sativa (indica cultivar-group)]
  misc_feature (149)..(261): NCBI GI: 20197670 NCBI Desc: similar to pig-l [arabidopsis thaliana]
  misc_feature (44)..(258): NCBI GI: 89287374 NCBI Desc: uncharacterized lmbe-like protein, cog2120 containing protein [tetrahymena thermophila sb210]
  misc_feature (1)..(258): NCBI GI: 119624903 NCBI Desc: phosphatidylinositol glycan, class l, isoform cra_b [homo sapiens]
MAWIWMVPVAGAVLLWAISLGRILSYPAPSCVPPSPQFMPPLRDDRRSRNVLLVVAHPDDEFFAPTILFLKSKGHSIHILCMSRGDADGLGNTRKEELYHACDTLKIPHEQVKVLDHPKLQDGFHEKWDHGLVAELTVQHVQLWGIDTIVTFDSYGVSGHPNHKDLHHGVCKFLHANGQGNDETWELASLNILRKYSGPVDIWLSSLISFSRSKQSIYTVVNSRPSKSYEAMAAHRSQWVWFRRLFVIFSSYTYANVLKKI

SEQ ID NO: 4387 - DNA, 1461 bp, Sorghum bicolor
  misc_feature: Ceres ANNOT ID no. 6037656
  misc_feature: Encodes the peptide sequence at SEQ ID NO 4388
atgagcgcccctatggaggtctccttctccgcgcccccacccgctccggacgccgcgtgtgccgccaccgctgccccgttgatgccacctgccgccgccgcccagacgctgccgccccctgtcgccgcggtctcctcctcgccgccgcagcagcagcaggcggctgcggctgcggccgtggtcgctccttccccggccgacgacaaggtcctcgtgtcagttgaggtactgttgcacgccgcgagcgcggctcgccacgaggacgtccaggtggcggtcgagaggatgctagaagctcgatgcttaagctatgttgatgggcctgtgccaattcctgctgataattcttttcttcttgaaaatgtcaaaaggatacgaatatgcgacactgatgagtgggttgggaatcgcaaagttcttttattttggcaagttaagcctgttgtgcatgtgttccagctgagtgaagatggtcctggtgaggaaccaagcgaggatgatacactctctagctttaacgagtgggccttacctgccaaagaatttgatggtttgtgggaaagtttactatatgaagttggtctcaagcagaggttgctgagatatgctgccagtgctttgctttttactgagagaggtgtggatacatgtctggtttcatggaaccggattgtacttttgcatggtccacctggaacaggaaagacttccttgtgtaaagcactagcacagaaactttccattcgcttcaagtcaaggtattctatgtgtcagttgattgaagtgaatgctcattcattgttcagcaagtggttttctgaaagtggaaaattggttgccaaacttttccagaagatccaggagatggtggaggaagaaagcaacctggtatttgtattgatagatgaagttgaaagccttgctgctgccagacaagctgccatatctggctctgaaccttcagactccattagagttgtgaatgcgctgctaacacaaatggacaaattgaagtcttggccaaatgttatcattttgacaacatcaaatatcactacagcaatagatattgcatttgttgacagggcagacattaaggcatatgtcggaccccctacgcttcaagcacgatacgagatcttgaggtcatgtatacaggaactcttaagagttggcattcttacatatcctcagggtagtagtgtgccatgtattctgaactattcgaccctggaggagaagaagcactgtcctgaggctgcagaaccccatggcgtgtttcaattatccagtctactctatgaagccgcaaaactgtgtgagggacttagtggccggtcattgaggaaactccctttcctggcacatgcctctgtcaccaacccttgctgtgatgcttctactttcttgcatacattgataaagactgcgcaaagagaagtattggagtcgcgtggttag

SEQ ID NO: 4388 - protein, 486 aa, Sorghum bicolor
  misc_feature: Ceres ANNOT ID no. 6037656
  misc_feature (224)..(420): Pfam Id: AAA Pfam Desc: ATPase family associated with various cellular activities(AAA)
  misc_feature (5)..(407): NCBI GI: 116309907 NCBI Desc: osigba0116m22.9 [oryza sativa (indica cultivar-group)]
  misc_feature (67)..(401): NCBI GI: 115458982 NCBI Desc: os04g0479000 [oryza sativa (japonica cultivar-group)]
  misc_feature (28)..(483): NCBI GI: 79485764 NCBI Desc: atp binding / atpase/ nucleoside-triphosphatase/ nucleotide binding [arabidopsis thaliana]
  misc_feature (57)..(485): NCBI GI: 85541056 NCBI Desc: thyroid receptor-interacting protein 13 (thyroid hormone receptor interactor 13) (trip-13) (human papillomavirus type 16 e1 protein-binding protein) (hpv16 e1 protein-binding
  misc_feature (57)..(485): NCBI GI: 85541056 (continued) protein) (16e1-bp)
  misc_feature (114)..(455): NCBI GI: 95102672 NCBI Desc: aaa family atpase [bombyx mori]
  misc_feature: The sequence is a functional homolog of SEQ ID NO. 462 in the 11/188,298 US application
  misc_feature: The sequence is a functional homolog of SEQ ID NO. 471 in the 11/188,298 US application
MSAPMEVSFSAPPPAPDAACAATAAPLMPPAAAAQTLPPPVAAVSSSPPQQQQAAAAAAVVAPSPADDKVLVSVEVLLHAASAARHEDVQVAVERMLEARCLSYVDGPVPIPADNSFLLENVKRIRICDTDEWVGNRKVLLFWQVKPVVHVFQLSEDGPGEEPSEDDTLSSFNEWALPAKEFDGLWESLLYEVGLKQRLLRYAASALLFTERGVDTCLVSWNRIVLLHGPPGTGKTSLCKALAQKLSIRFKSRYSMCQLIEVNAHSLFSKWFSESGKLVAKLFQKIQEMVEEESNLVFVLIDEVESLAAARQAAISGSEPSDSIRVVNALLTQMDKLKSWPNVIILTTSNITTAIDIAFVDRADIKAYVGPPTLQARYEILRSCIQELLRVGILTYPQGSSVPCILNYSTLEEKKHCPEAAEPHGVFQLSSLLYEAAKLCEGLSGRSLRKLPFLAHASVTNPCCDASTFLHTLIKTAQREVLESRG

SEQ ID NO: 4389 - DNA, 1167 bp, Sorghum bicolor
  misc_feature: Ceres ANNOT ID no. 6037658
  misc_feature: Encodes the peptide sequence at SEQ ID NO 4390
atgccggaggcggggcactacgggtacaagaagaccgacggcatctgcgacggcgtgtgcggcgagcctgtgtcaaaggcagctctgaccatgtcaaggctaaagtgcgcgctacggggatttgatttaagggcacttatggtcctcttgattggtgtgccaattctaattctgatgatatatgcacatggtcaaaaggtcacatacttcctccggccaatctgggaatctcctcccaagcccttcaagacaatccctcactactaccatgagaatgtaaccatggagaacctctgcaagttacatgggtggaaagtccgtgatatcccacgccgtgtctttgatgctgtactcttcagcaatgagcttgatatcctggagatccgttggaatgagcttagtccctatgtgtcagagtttgtgcttctagagtccaactcaacctttactggcattaaaaagcccctccacttcaaggaaaacgagcatcggtttgggtttgttaaatcacggctgtcatatggtagtattgggggaaggttcgtgaagggggagaacccatttgttgaggagtcatatcagagggttgccctggaccagcttcttaagcttgcaagaatagaagatgatgacctgctgatcatgtcggatgttgatgaaatcccaagcggtcacacaattgatctcttaaggtggtgcgatgacattccagacatacttcatcttcagctcaggaattacctttactcatttgagtttttcttggatgacaagagctggagggcatcaatacacaagtacaaatctggaaagacaaggtatgcacacttccggcagacagatgagcttcttgctgattcggggtggcactgcagcttttgcttccgttacataagcgattttgccttcaagatgcaagcgtacagccatgttgacaggatcagattcaagtacttcctgaaccctgaaaggattcaagatgtcatctgcagaggggcggatctttttgatatgcttccagaagagtacacattccaagaaatcattgccaagctggggccgatcccaagcacatattctggtgttcatcttccaagttatctactaaagaatgtcgagcggtttagataccttctaccgggcaactgcaggagagaaagtggctag

SEQ ID NO: 4390 - protein, 388 aa, Sorghum bicolor
  misc_feature: Ceres ANNOT ID no. 6037658
  misc_feature (28)..(387): Pfam Id: Glyco_transf_17 Pfam Desc: Glycosyltransferase family 17
  misc_feature (1)..(388): NCBI GI: 46805291 NCBI Desc: glycosyl transferase-like protein [oryza sativa (japonica cultivar-group)]
  misc_feature (31)..(388): NCBI GI: 46805293 NCBI Desc: glycosyl transferase-like protein [oryza sativa (japonica cultivar-group)]
  misc_feature (1)..(387): NCBI GI: 110742117 NCBI Desc: beta-1,4-n-acetylglucosaminyltransferase like protein [arabidopsis thaliana]
  misc_feature (1)..(387): NCBI GI: 30683061 NCBI Desc: glycosyl transferase family 17 protein [arabidopsis thaliana]
  misc_feature (5)..(388): NCBI GI: 61845111 NCBI Desc: beta 1,4 n-acetylglucosaminyltransferase [populus alba x populus tremula]
  misc_feature: Useful for making plants with altered carbohydrate content
  misc_feature: Functional homolog of the protein sequence given in SEQ ID NO 13868
MPEAGHYGYKKTDGICDGVCGEPVSKAALTMSRLKCALRGFDLRALMVLLIGVPILILMIYAHGQKVTYFLRPIWESPPKPFKTIPHYYHENVTMENLCKLHGWKVRDIPRRVFDAVLFSNELDILEIRWNELSPYVSEFVLLESNSTFTGIKKPLHFKENEHRFGFVKSRLSYGSIGGRFVKGENPFVEESYQRVALDQLLKLARIEDDDLLIMSDVDEIPSGHTIDLLRWCDDIPDILHLQLRNYLYSFEFFLDDKSWRASIHKYKSGKTRYAHFRQTDELLADSGWHCSFCFRYISDFAFKMQAYSHVDRIRFKYFLNPERIQDVICRGADLFDMLPEEYTFQEIIAKLGPIPSTYSGVHLPSYLLKNVERFRYLLPGNCRRESG

SEQ ID NO: 4391 - DNA, 3138 bp, Sorghum bicolor
  misc_feature: Ceres ANNOT ID no. 6037668
  misc_feature: Encodes the peptide sequence at SEQ ID NO 4392
atgcggctctacgtgtacgtgctggaggcgcgcgggctcccggcgccgcggccgcgccgcggcggcggcgtgctgttctacgcgaaggtgacggtggggaagcagcggttccggacgcgggcggtggaggcggcggagctggacggcggcgcggcggcggcgtggaacgaggagttcgtgttcgcggtgggggcggctgacggagctgccggggacgacgaggagttcgaggtcgccgtggcgcggcggcggcgggggggagggagcgggagggaggtggtgggcaaggtcaggctgcccgtgccgcccgccgccaccgctgctgctgcgccgggggagaggcggtctgtgccgccgacgtggttcacgctgcagcagccgcccgagggcggacgcggacggcggaagcgcggcgtcgtcgtcgacgaggtcgccgcggcggattgcgggaaaattctcctcagcttttcactttatggagaaaacaatgacaattctgtcgtccacatgtccccttcttcgagctccagaagttacactgatgccgaagtggagagatcacttgacatggaacattcaagttctaacggtgaggtggttgattctcccaggagccatgacacagagcggacttctctagataactctgaccatttcatacatgaagattccaattcaattactgaagttgatgacctagcagagactagtacagcaacagcaaatggtgcgagtgacaccgaacatatggctccagatgctagctttgaagaagctatggagatcatgaaatctagaagcacaccagaaatgccagaagatcttgatggcggcatcatatttgagcatacttaccttgtggagtcaaaagaactgaaccatcttctgttcagacctgattctcagttcttgaaaggcctgcgtgagcttcaaggtaccatggactatgaggagcagccgtggacatggaagagcatggatccacctagcttaactaggacatgccattacaccaaaggtgcatcaaagtttatgaaagctgtcaagactagtgaggagcagacatatcttaaagcagatggcaagaattttgtgattatgactcgtgttcgtactcctgaagtgccctttgggaactgttttgcagttgttttgctctacaagataatccactgcaccggattatcaggaggtgaagaaagtgcgcatctgactgtatcatacaatgtagagttccttcagagcaccatgatgagaagcatgattgaggggagtgttcgagatgggttgaaagaaaatttcgaaggttttgctgaagtattgtctaggcatgtcaaaatggctgattctgtagggatggataaagagcagttgctggcgccattgcaggtagaacaccagtcagatatcaggcttgcttacaagtattttttcaatttcactgccatttcgacggtgctatttgcactatatgttcttgtgcacatctttctgtcaaaaccaggcccaatcatgggcctcgagttcaatggtctagatctacctgactcattcggagagcttatcacagctggcatactagtccttcaattacagcgtttactgaatatggtgtctcattttgtactggcaaggttacagagaggaagtgatcacggggttaaagcaaatggtgacggttggctgttaactgtagctctgctagaggctacaagcttgccacccgtttcatgtggatcagttgacccttatgttgtgttcagctgtaatggcataacaagaacaagttctgtccaacttcagactcaggaacctcaatggaacgagataatggaatttgatgccatggaagaaccacctgccgtgttggatgttgaagttttcaatttcgatggtccattcgatttggctatttcccttggacatgctgaaattaatttcctgaaacacacatcagtagaactggcagacatatgggtgcccctggagggaaaacttgcccagacatgtcagagtcggttacatttgagagtatttctagagaacacaaaaggaccggagacatcgatgagagaatacctgagtaagatggagaaggaagttggtaaaaagttgcatgttcggtcgcctcacagaaactcaacattccagaagctttttaatctgccacacgaagaattccttatagcagattatgcatgctccctgaaaagaaagctgcctttgcaggggaggctgtttgtgtccgccagaatagttggtttctacgctaatctgtttggacacaaaacaaaattcttctttctgtgggaagacgtggaggagatcgaagtgctacagccatctttcacaacggtaggcaccccatcgctactatttattctgaagagtggccggggactcgacgcaaagagtggtgcgaagtcccaagacaaggaagggaggctgaagtttcagttccactcttttgcatcgttcagcaaggctagcaggacaataattggtctgtggaaaacgaaatcgtcggccattgaacacagggccaaactggaagaagatcatgaagaagatgcgagctccgttgatcttgatgaggttcaagctgtgttgagcattggagacgtgcctctctcgaaggagtatactttggaacatccgattgacgctgatctgctcatgggtgtgttcgacgggggagccctggagacgcggacgatgagccgggtcgggtgcctcgactactccgccaccccgtgggaggccgtcaggcctggcgtcctggagcggcacgtcagctacaagttcaaccgctacatgtccatcttcggcggcgaggtggtcagcacccagctcaagttcccggcggaggacggcggcgggtggaccatacacgacgtcgtcacgctccacaacgtccccttcggcgactacttccgggtccatctgaggtacaacgtgcagagcgccacgtcggaggcgccgagcagccggtgcgagatactggtcggcatcgagtggctcaagagcagcaagttccagaagaggatcgccaggaacatctgcgagaagctggcgcacagggccaaggaggtgctcgaagtggccgggaaggagatagcctcggctgtatcaggctag

SEQ ID NO: 4392 - protein, 1045 aa, Sorghum bicolor
  misc_feature: Ceres ANNOT ID no. 6037668
  misc_feature (714)..(780): Pfam Id: GRAM Pfam Desc: GRAM domain
  misc_feature (563)..(644): Pfam Id: C2 Pfam Desc: C2 domain
  misc_feature (1)..(1045): NCBI GI: 116310301 NCBI Desc: osigba0106g07.15 [oryza sativa (indica cultivar-group)]
  misc_feature (1)..(1045): NCBI GI: 38344486 NCBI Desc: osjnba0022h21.21 [oryza sativa (japonica cultivar-group)]
  misc_feature (1)..(1041): NCBI GI: 15218791 NCBI Desc: c2 domain-containing protein / gram domain-containing protein [arabidopsis thaliana]
  misc_feature (165)..(1041): NCBI GI: 51814441 NCBI Desc: no pollen; osnop [oryza sativa (japonica cultivar-group)]
  misc_feature (379)..(745): NCBI GI: 115458962 NCBI Desc: os04g0476600 [oryza sativa (japonica cultivar-group)]
MRLYVYVLEARGLPAPRPRRGGGVLFYAKVTVGKQRFRTRAVEAAELDGGAAAAWNEEFVFAVGAADGAAGDDEEFEVAVARRRRGGGSGREVVGKVRLPVPPAATAAAAPGERRSVPPTWFTLQQPPEGGRGRRKRGVVVDEVAAADCGKILLSFSLYGENNDNSVVHMSPSSSSRSYTDAEVERSLDMEHSSSNGEVVDSPRSHDTERTSLDNSDHFIHEDSNSITEVDDLAETSTATANGASDTEHMAPDASFEEAMEIMKSRSTPEMPEDLDGGIIFEHTYLVESKELNHLLFRPDSQFLKGLRELQGTMDYEEQPWTWKSMDPPSLTRTCHYTKGASKFMKAVKTSEEQTYLKADGKNFVIMTRVRTPEVPFGNCFAVVLLYKIIHCTGLSGGEESAHLTVSYNVEFLQSTMMRSMIEGSVRDGLKENFEGFAEVLSRHVKMADSVGMDKEQLLAPLQVEHQSDIRLAYKYFFNFTAISTVLFALYVLVHIFLSKPGPIMGLEFNGLDLPDSFGELITAGILVLQLQRLLNMVSHFVLARLQRGSDHGVKANGDGWLLTVALLEATSLPPVSCGSVDPYVVFSCNGITRTSSVQLQTQEPQWNEIMEFDAMEEPPAVLDVEVFNFDGPFDLAISLGHAEINFLKHTSVELADIWVPLEGKLAQTCQSRLHLRVFLENTKGPETSMREYLSKMEKEVGKKLHVRSPHRNSTFQKLFNLPHEEFLIADYACSLKRKLPLQGRLFVSARIVGFYANLFGHKTKFFFLWEDVEEIEVLQPSFTTVGTPSLLFILKSGRGLDAKSGAKSQDKEGRLKFQFHSFASFSKASRTIIGLWKTKSSAIEHRAKLEEDHEEDASSVDLDEVQAVLSIGDVPLSKEYTLEHPIDADLLMGVFDGGALETRTMSRVGCLDYSATPWEAVRPGVLERHVSYKFNRYMSIFGGEVVSTQLKFPAEDGGGWTIHDVVTLHNVPFGDYFRVHLRYNVQSATSEAPSSRCEILVGIEWLKSSKFQKRIARNICEKLAHRAKEVLEVAGKEIASAVSG

SEQ ID NO: 4393 - DNA, 1890 bp, Sorghum bicolor
  misc_feature: Ceres ANNOT ID no. 6037678
  misc_feature: Encodes the peptide sequence at SEQ ID NO 4394
atgatggtgcgcaagagattggtttatagatcccgtggccgtcgaattccaactatgccacgtgttccaaactcagctcggggaaaacgctctaccagaagaaacaaagatgagaatgatatgtgtgcatttgatttgctcgcaactgtagcaggaaacttattagcagatcaggacaattcatcgaatgttcctaataccaatgcagcaaaagctaaaaaaaggaaatcatttaaggaagaacacttcgacgaaattctgcctctaaaagatgtggctatggagaaagatgtgggttctgggagtgtcagtgcctttcctaggcaagctaacaactgcttggcagaaaactcgtcgacaagaaatgaagctgaatcaatattagagtcactaacaatgaaatcagatatgttagcaaaaattcctgagtgtggatctcatggaatacaccatccaggaccctccagttcagtagagcctgaacaagtgcagaaagctgaacctaaagtgatcagaagacaagcagatgggcatgctgtggcttacgatatatttgactccgtggatgtgaatggcaaaccaccggctttggttagttctgacagtagctcatgtgttcctctgagcagccatgacaaggaacatcaaacctcttccttgtatcagggtgaagtgcagtatgctgcagatagagatgatgatgaaaattcttctgggtgcacgcatccaagcaccatagaaaataagggttgcaaaccacaatatctaggtaaccataggataaggaaattgcttgcctcgaaggtaaggaaggcagcacgtaataagatttgtggagggattccgtcaaaaaagatctatggagggttgtcaaacaaaggtagcaagctaaacttatgtgggaaaaagatatccaccacacgtcaaaaggtgcaaaggacgattttcaagaagaaaaagctagcacatcatacaacatcttttgctaaagagatgctaactgaagttaagctaagaatcaaatcattcaacatcccagaattgttcattaaggtcccagaaaatgcaactattggatcactgaagagaactgtcatggatgttgtcaatagtataatggaaggtggtctacgcgttggtgttcttcttcaaggaaaggatatccaagacgacaacaagacacttcgtcaagctgggatatgccatgataaaaagctaaataacatagacttcacgttgcaatgcgaacgtgagcgagagtctccctctggagtcattataccagaacagatggatttcctcactgcagatatggtggagccattagctaggatgaagtgtgaagaaccttttcctgaagctgatgttggagatgacaaccagcattctaaagcaccttatcgaagccgctctctctctgatctctactctgttcagtgtcctgttgagatggcttcacaagacacatcagcaagctcccaagccatcatccccgtttcacctgcaccttcagacataggtgctctagccattgtgcccctttgtaagtccaagcgatctgaaattgggcaaaggcgcataaggaggcccttcactgttggtgaggttgaggcgctggtgggagcggttgaacagcttgggactggaaggtggagagctgttaaaacgcttgcctttgacaatatagagcacaggacctatgtcgaccttaaggacaagtggaagaccctggttcacactgcaagtatatccccgcaacagcgaagaggtcagccagttccacaagaactcctggaccgtgtcctcgcagcgcaggcctactggtcccagcacctccaggacaagccccggggcaaggctcgtcttctccctgagatttgctttccctag

SEQ ID NO: 4394 - protein, 629 aa, Sorghum bicolor
  misc_feature: Ceres ANNOT ID no. 6037678
  misc_feature (1)..(627): NCBI GI: 9716453 NCBI Desc: telomere binding protein-1; tbp1 [oryza sativa]
  misc_feature (336)..(623): NCBI GI: 483444 NCBI Desc: initiator-binding protein [zea mays]
  misc_feature (336)..(625): NCBI GI: 483490 NCBI Desc: initiator binding protein [zea mays]
  misc_feature (324)..(623): NCBI GI: 115452203 NCBI Desc: os03g0274300 [oryza sativa (japonica cultivar-group)]
  misc_feature (335)..(624): NCBI GI: 12043533 NCBI Desc: myb-like dna-binding protein [catharanthus roseus]
  misc_feature: The sequence is a functional homolog of SEQ ID NO 1240 in the 11/479,226US patent application
  misc_feature: The sequence is a functional homolog of SEQ ID NO 164 in the 10/374,780US patent application
  misc_feature: The sequence is a functional homolog of SEQ ID NO 566 in the 10/412,699US patent application
  misc_feature: The sequence is a functional homolog of SEQ ID NO 894 in the 10/225,066US patent application
  misc_feature: Useful for making plants with modulated growth and phenotype characteristics
  misc_feature: The sequence is a functional homolog of SEQ ID NO 566 in the 20040045049 US patent application
MMVRKRLVYRSRGRRIPTMPRVPNSARGKRSTRRNKDENDMCAFDLLATVAGNLLADQDNSSNVPNTNAAKAKKRKSFKEEHFDEILPLKDVAMEKDVGSGSVSAFPRQANNCLAENSSTRNEAESILESLTMKSDMLAKIPECGSHGIHHPGPSSSVEPEQVQKAEPKVIRRQADGHAVAYDIFDSVDVNGKPPALVSSDSSSCVPLSSHDKEHQTSSLYQGEVQYAADRDDDENSSGCTHPSTIENKGCKPQYLGNHRIRKLLASKVRKAARNKICGGIPSKKIYGGLSNKGSKLNLCGKKISTTRQKVQRTIFKKKKLAHHTTSFAKEMLTEVKLRIKSFNIPELFIKVPENATIGSLKRTVMDVVNSIMEGGLRVGVLLQGKDIQDDNKTLRQAGICHDKKLNNIDFTLQCERERESPSGVIIPEQMDFLTADMVEPLARMKCEEPFPEADVGDDNQHSKAPYRSRSLSDLYSVQCPVEMASQDTSASSQAIIPVSPAPSDIGALAIVPLCKSKRSEIGQRRIRRPFTVGEVEALVGAVEQLGTGRWRAVKTLAFDNIEHRTYVDLKDKWKTLVHTASISPQQRRGQPVPQELLDRVLAAQAYWSQHLQDKPRGKARLLPEICFP

SEQ ID NO: 4395 - DNA, 585 bp, Sorghum bicolor
  misc_feature: Ceres ANNOT ID no. 6037745
  misc_feature: Encodes the peptide sequence at SEQ ID NO 4396
atggtcagagggaaggtgcaaatgcgacaaattgagaaccctgtccacagaagggtaaccttctccaagcgccgggaaggactgctcaagaaggcaagagaactctcagtgctttgtggtgctgatgtaggtgtaatcatattttcctccactgggaaagtccatgaactagcgactaacgggtgcgttctacaaatttcatgttgttacatagtgaaccttaagtgcgacagaacttctgagatgttttcctttacactcaaaatgcaagaaacatgcaaagcttggttgagaggtaaaggagcatttggtttccttgttaaaggaagagatatgtctactgcagcatggtttaagatgcagatcatgcagcaagaaattcactttcttagaaataaggaaaacatacttaaatcagaaaatgaaattcttcaacagaaggaaggcatcctgaaagcagaaaacaaagttctccaacagaaggtgaatgagcagaatgaatttataaacaactgcttggcgttttctggatcttcgtatccgatgcattacaacataaatgagagtagcttgttcaagatatag

SEQ ID NO: 4396 - protein, 194 aa, Sorghum bicolor
  misc_feature: Ceres ANNOT ID no. 6037745
  misc_feature (9)..(59): Pfam Id: SRF-TF Pfam Desc: SRF-type transcription factor (DNA-binding and dimerisationdomain)
  misc_feature (1)..(184): NCBI GI: 91207150 NCBI Desc: mads-box transcription factor 33 (osmads33)
  misc_feature (1)..(61): NCBI GI: 95981898 NCBI Desc: mads-box transcription factor taagl32 [triticum aestivum]
  misc_feature (1)..(90): NCBI GI: 862650 NCBI Desc: mads-box protein agl12
  misc_feature (1)..(170): NCBI GI: 21586457 NCBI Desc: mads-box protein fdrmads3 [oryza sativa (indica cultivar-group)]
  misc_feature (1)..(170): NCBI GI: 45385972 NCBI Desc: mads-box protein rmads220 [oryza sativa (japonica cultivar-group)]
  misc_feature: The sequence is a functional homolog of SEQ ID NO 2232 in the 10/374,780US patent application
  misc_feature: The sequence is a functional homolog of SEQ ID NO 232 in the 10/225,068US patent application
  misc_feature: The sequence is a functional homolog of SEQ ID NO 310 in the 10/225,066US patent application
  misc_feature: Useful for making plants with modulated growth and phenotype characteristics
  misc_feature: The sequence is a functional homolog of SEQ ID NO 232 in the 20050120408 US patent application
  misc_feature: Useful for making plants with modulated flowering time
  misc_feature: Functional homolog of the protein sequence given in SEQ ID NO 13660
  misc_feature: Useful for making plants with modulated biomass
  misc_feature: Functional homolog of the protein sequence given in SEQ ID NO 13659
  misc_feature: The sequence is a functional homolog of SEQ ID NO 1701 in the 10/412,699 US patent application
  misc_feature: The sequence is a functional homolog of SEQ ID NO. 359 in the 11/188,298 US application
  misc_feature: The sequence is a functional homolog of SEQ ID NO. 361 in the 11/188,298 US application
  misc_feature: The sequence is a functional homolog of SEQ ID NO. 273 in the 11/188,298 US application
  misc_feature: The sequence is a functional homolog of SEQ ID NO. 518 in the 11/188,298 US application
  misc_feature: The sequence is a functional homolog of SEQ ID NO. 420 in the 11/188,298 US application
  misc_feature: The sequence is a functional homolog of SEQ ID NO. 377 in the 11/188,298 US application
MVRGKVQMRQIENPVHRRVTFSKRREGLLKKARELSVLCGADVGVIIFSSTGKVHELATNGCVLQISCCYIVNLKCDRTSEMFSFTLKMQETCKAWLRGKGAFGFLVKGRDMSTAAWFKMQIMQQEIHFLRNKENILKSENEILQQKEGILKAENKVLQQKVNEQNEFINNCLAFSGSSYPMHYNINESSLFKI

SEQ ID NO: 4397 - DNA, 1032 bp, Sorghum bicolor
  misc_feature: Ceres ANNOT ID no. 6037763
  misc_feature: Encodes the peptide sequence at SEQ ID NO 4398
atgtcttcctcctccgccgccgctcgccgccttctcctcctccgccaccgccatggccaccttctccccaaacgccacttctcttcctcgtccgctgccgacggcctcgacgacggcggccgcgtcaagatcttcgaccgcgacctgaagcgccggcaccgggaccgcgcggcgtgggcgatgcgtgagaccgacggtctcgtggatgccgtcgccgaaaacctcctcgaccgcctcgaggactgcaggaaagccttcccctccgcgctctgcctcgggggctccgccggtgccgtccgccgcttgctccgcggccgcggtggaattgagaggctgatcatgatggacatgtcagccgacatggtgaagaagtggcgagagtcagagaatggcactggtgacgaacctgagatgcactttgttgtcggtgatgaggagttccttccaatcaaagagagctcacaggatttgataataagctgtcttggacttcattggacaaatgatctacctggagcaatgatacagtgtaggctagcgttgcaacctgatggcctttttctggcagcaattcttggtggagaaacactgaaggagcttagaattgcatgcacagttgctcaaatggaacgcgaaggaggcatcagtcctcgaatgtcccctttagcacaagtccgtgacgcaggaaaccttttgacaagggcaggtttcacccttccaggagttgatgtcgatcagtatactgttaaatacaataatgctttggaacttgttgaacatcttagagcaatgggggaaacaaatgctctttttcaaagaaatcctgtgttgaaaagggataccgccttggcaactgcagcaatttaccagtcaatgtttggtttagaagacggatctattccagcaacctttcaagtaatttacatgactggctggagggagcatccatcacagcaaaaggctaagagaaggggttctgcgaccatatcattcagtgatatacagaaacaatttggtcccagtgaaaactga

SEQ ID NO: 4398 - protein, 343 aa, Sorghum bicolor
  misc_feature: Ceres ANNOT ID no. 6037763
  misc_feature (90)..(189): Pfam Id: Methyltransf_11 Pfam Desc: Methyltransferase domain
  misc_feature (198)..(343): NCBI GI: 115487776 NCBI Desc: os12g0203100 [oryza sativa (japonica cultivar-group)]
  misc_feature (17)..(305): NCBI GI: 3287681 NCBI Desc: ests gbz34075, gbz34835 and gbaa404888 come from this gene. [arabidopsis thaliana]
  misc_feature (42)..(334): NCBI GI: 144900146 NCBI Desc: sam-dependent methyltransferases [magnetospirillum gryphiswaldense msr-1]
  misc_feature (42)..(340): NCBI GI: 82945545 NCBI Desc: sam-dependent methyltransferase [magnetospirillum magneticum amb-1]
  misc_feature (23)..(336): NCBI GI: 62858439 NCBI Desc: loc549152 [xenopus tropicalis]
MSSSSAAARRLLLLRHRHGHLLPKRHFSSSSAADGLDDGGRVKIFDRDLKRRHRDRAAWAMRETDGLVDAVAENLLDRLEDCRKAFPSALCLGGSAGAVRRLLRGRGGIERLIMMDMSADMVKKWRESENGTGDEPEMHFVVGDEEFLPIKESSQDLIISCLGLHWTNDLPGAMIQCRLALQPDGLFLAAILGGETLKELRIACTVAQMEREGGISPRMSPLAQVRDAGNLLTRAGFTLPGVDVDQYTVKYNNALELVEHLRAMGETNALFQRNPVLKRDTALATAAIYQSMFGLEDGSIPATFQVIYMTGWREHPSQQKAKRRGSATISFSDIQKQFGPSEN

SEQ ID NO: 4399 - DNA, 2082 bp, Sorghum bicolor
  misc_feature: Ceres ANNOT ID no. 6037773
  misc_feature: Encodes the peptide sequence at SEQ ID NO 4400
atgcacgggcggccgcggcgcccggccaagcctgaggacgaggaggcggcgtcagcgaaagccgccaagctccgggacctccaggcccaggtcctgcacaaccaccatgcccgcacgtacaccaaggaggcgattgggctgagcttcaagctgcttgagataaatccagaggcctacaccgcatggaactaccggaagcttgcgtttcagcacaatgtcaaggagctttctgacccagaggccatcaagtctgctgttgatgatgagctgagagtggttgaggttgctttaaggcagaacccaaagtcttatggggcttggtatcaccggaagtggttgctaagccaaaagctagcgcctgtggatttcaaacgtgagtttggcctcttggataaattgttgaagatggacgccaggaatttccatggatggaattaccgtaggttccttgcaagattcatgggcgtgccagatgaggaggagctaaagtatacgatggataaaatcagtgacaatttcagtaattactcagcatggcataatcgtagtatacttctgtccaacctactaatccagcagagcaaaggttttgagtcaaagcagaagattttttccgaggagtttgaacttgttactcaagctctttttacagatccaagtgaccaaagtggatggttctatcacctctggcttttagctcaaacgtctagtccagataacccccagctgattgcttcatggccttctaatgctgcaaaaggcagtgcccctttgatcaaggaaaaggttgagcagcacacactatcatccatctggtcaaggactgtacccattgttctttattttaatgatcctgtcaaaggattaaatcaatcaagtgttaacttaaagtctgatttggaattcagtgatgatattcaatggaggcccctcacaatggcagactctgggtattctaactgttgggccacatatctccaaattacaaatgaatgtagcggtttacaggaatattctgttgaagtgagcataccctgctcagatgacattgtgtctagaagtggctctaactacaattgtcctgtgcattttacatttaacattcaactgatcagcaacgacgcagcccagggtttagatatgtttcataagccagttgcctggaattgctcagagtcattccagtctcatggaaaccgtgatcctatcccttttgatctgctaaacattactagtgccttggttgaacaggactcaaattggcattttgaaagactatctgaggaaatagatcttttcagagagttacctgatgacaatagcaagtttgggaagttgacattagcccggctattgcttgcttgtgctgctgtaaaatcccgtggaagatctctaattgaaaggaagggatactgtgaagaggcactggggctcttcactgacttgattcacctggatccatctcataagcagtactatgaggatgaacggagcttagtcctgatggataagttaacatgtgacatggagactttcatgaagcactgttcagttcagcttcaaccaaattcagctcccctgaatcatgtgcaactttgcagattgtctttaacacgcattggatttgttgagcgcttgttgtgggttcaaatgctggatctaagccataatagtcttagatcagtcgaaggtttggaggctttgcagcaccttgtgttcttgaatatcagcaacaatcagatcagtagtttcacagcacttgaaccccttacgaagataatctcattgaaagttctggatttatccttcaacaagattggagctcactcaattgacacaacacggtatatctgctcatctccattctcgcacaaaatcgaagcaagtgaagcttttgaagagtatcagaaggtaaatatcaacgtggaggaatactgggacaccatactgttcttcagatctctgaagttggcacagcttgatatcaaaggaaatgaagttgccagcaaggagaacttcagaagtcttgtcgtgacgctcattccttgtctaaaatggtttgatggtgaaggtgtgaattaa

SEQ ID NO: 4400 - protein, 693 aa, Sorghum bicolor
  misc_feature: Ceres ANNOT ID no. 6037773
  misc_feature (88)..(118): Pfam Id: PPTA Pfam Desc: Protein prenyltransferase alpha subunit repeat
  misc_feature (125)..(154): Pfam Id: PPTA Pfam Desc: Protein prenyltransferase alpha subunit repeat
  misc_feature (160)..(190): Pfam Id: PPTA Pfam Desc: Protein prenyltransferase alpha subunit repeat
  misc_feature (206)..(236): Pfam Id: PPTA Pfam Desc: Protein prenyltransferase alpha subunit repeat
  misc_feature (1)..(671): NCBI GI: 7269299 NCBI Desc: rab geranylgeranyl transferase like protein (fragment) [arabidopsis thaliana]
  misc_feature (1)..(657): NCBI GI: 4220541 NCBI Desc: rab geranylgeranyl transferase like protein [arabidopsis thaliana]
  misc_feature (1)..(689): NCBI GI: 10177366 NCBI Desc: geranylgeranyl transferase alpha subunit-like protein [arabidopsis thaliana]
  misc_feature (1)..(238): NCBI GI: 50415183 NCBI Desc: rabggta-prov protein [xenopus laevis]
  misc_feature (1)..(239): NCBI GI: 59858187 NCBI Desc: rab geranylgeranyltransferase, alpha subunit [bos taurus]
  misc_feature: The sequence is a functional homolog of SEQ ID NO. 348 in the 11/188,298 US application
MHGRPRRPAKPEDEEAASAKAAKLRDLQAQVLHNHHARTYTKEAIGLSFKLLEINPEAYTAWNYRKLAFQHNVKELSDPEAIKSAVDDELRVVEVALRQNPKSYGAWYHRKWLLSQKLAPVDFKREFGLLDKLLKMDARNFHGWNYRRFLARFMGVPDEEELKYTMDKISDNFSNYSAWHNRSILLSNLLIQQSKGFESKQKIFSEEFELVTQALFTDPSDQSGWFYHLWLLAQTSSPDNPQLIASWPSNAAKGSAPLIKEKVEQHTLSSIWSRTVPIVLYFNDPVKGLNQSSVNLKSDLEFSDDIQWRPLTMADSGYSNCWATYLQITNECSGLQEYSVEVSIPCSDDIVSRSGSNYNCPVHFTFNIQLISNDAAQGLDMFHKPVAWNCSESFQSHGNRDPIPFDLLNITSALVEQDSNWHFERLSEEIDLFRELPDDNSKFGKLTLARLLLACAAVKSRGRSLIERKGYCEEALGLFTDLIHLDPSHKQYYEDERSLVLMDKLTCDMETFMKHCSVQLQPNSAPLNHVQLCRLSLTRIGFVERLLWVQMLDLSHNSLRSVEGLEALQHLVFLNISNNQISSFTALEPLTKIISLKVLDLSFNKIGAHSIDTTRYICSSPFSHKIEASEAFEEYQKVNINVEEYWDTILFFRSLKLAQLDIKGNEVASKENFRSLVVTLIPCLKWFDGEGVN

SEQ ID NO: 4401 - DNA, 381 bp, Sorghum bicolor
  misc_feature: Ceres ANNOT ID no. 6037774
  misc_feature: Encodes the peptide sequence at SEQ ID NO 4402
atggaaggaggaggactaccagggccatcgcaatccatccaggtttccggagacgcgtactgcaacagctccgctgcgcccctggacgctgccggcagcagcagctcaccggccgtcgcgaagctccggaagctgctgttccggcggatgctcatcggcgtcaacgacggccgctacttccacggcctgttccactgcatcgacaagcagggcaacatcatcctccaggacgccgtggagtaccgcagcgccgcccgtcattgctcgcctcccacggagcagcgctgcctggggctcatcctcatcccggccgcctgccggtcgtcttgccaggttgattgctccgttgaagagaagatgtcgctcctcggtttggaatga

SEQ ID NO: 4402 - protein, 126 aa, Sorghum bicolor
  misc_feature: Ceres ANNOT ID no. 6037774
  misc_feature (22)..(126): NCBI GI: 22328770 NCBI Desc: small nuclear ribonucleoprotein-related / snrnp-related [arabidopsis thaliana]
  misc_feature (50)..(126): NCBI GI: 38566550 NCBI Desc: at4g18372 [arabidopsis thaliana]
  misc_feature (21)..(113): NCBI GI: 49115058 NCBI Desc: mgc80306 protein [xenopus laevis]
  misc_feature (26)..(123): NCBI GI: 66771181 NCBI Desc: ip06106p [drosophila melanogaster]
  misc_feature (26)..(123): NCBI GI: 24581280 NCBI Desc: cg31950-pa [drosophila melanogaster]
MEGGGLPGPSQSIQVSGDAYCNSSAAPLDAAGSSSSPAVAKLRKLLFRRMLIGVNDGRYFHGLFHCIDKQGNIILQDAVEYRSAARHCSPPTEQRCLGLILIPAACRSSCQVDCSVEEKMSLLGLE

SEQ ID NO: 4403 - DNA, 1938 bp, Sorghum bicolor
  misc_feature: Ceres ANNOT ID no. 6037776
  misc_feature: Encodes the peptide sequence at SEQ ID NO 4404
atggacgacggcgacggcggactgagcttcgacttcgagggcggcctcgactccgtcccggcggccggtggcgggggccccgtgccgtcctccaccgaccctggcgcgggcggaggcggaggcggcgatgggccgggtatgcacgggcgcggccgaggtcgcgggagctaccgccagacggtgtgccggcactggcttcggggcctctgcatgaagggcgaggcgtgcgggttcctgcaccagttcgacaaggcccgcatgcccgtatgccgcttcttccgcgacttcggcgagtgccgcgagcccgactgcgcgtacaagcactcgtacgacgacgtcaaggagtgcaacatgtacaagatgggtttttgtcccaatggtcctaattgccggtacaagcatatcaagctacctgggccaccaccttctgttgaggaagttcttcagaagattttgcagatgcgttctttcaacagatacggtcagaatagaaataataattataatcagcagggggagagacctcagcatccacagggttctgggatgcctaaccaaaattcggcagaaaatgctactgctgcggctccaccagctggtggacaacaagcacaaacgatgaatcaacagccaccacagcagcagcagaagccaaatacaaatgaccaggcccaaggtgtttcaaatggtcaacaggccactagaatcgccacaccgcttccacaaggaccatctaggtacttcattgttaaaagttgcaatcgggagaatctggaaatatcagttcagcaaggaatttgggccacgcagaggagtaacgaggctaaactcaatgaagcttttgaatccaccgagaatgttattttgatattctcaattaatagaactcgcaatttccagggttgtgcaaagatgacttctaggatcggtggctacattggtggtggaaactggaaatctgctcatggaacagcgcattatggtcggaatttctctatgcagtggcttaagctttgtgagttgtcatttcagaaaacccatcatctccgcaatccatacaatgataacctccctgttaagatcagcagagattgccaggaactagaacctttcattggtgagcagttggcttctctgctttatctggagccagacagcgaacttacggctatgctaattgcagcagaggccaagcgagaggaggaaaaagcaaagggtgtcagtgctgacgaggcagctgataatcaagatattgtgctgtttgacgacaatgaagaggatgaggaagaggaaagcgaggaggaagaagaagccaatggccaagagtctcaagggaggggaagaggaagggggatgatgtggcctcctcaaatgccgatgatgcgtgggccaatgatggcagggcgtggcttccctcccaacatgatgggtgatggctttggtttcggcggcggtttcggcatgcctgatccttttggcatgccacgtggcttcccaccatttgttggcccaaggttccccggggactttgctagaggcccgatgcctgggatgggcttccctggtaggcctccgcagcctttccctctaggtcttgacatgatgatgggccctggccgtggtccactgatgggaggcatgggaatgggcgggcctggacggcctaatcgccccatgggtatggcgcccttcatgcccccgccacctccaaataaccgtgctgcgaagcgggagcagagaaggccagggggtgaccgtggcgacaggttcgaaacagtgtcatcagaccagggcaacaggggccatgataacactggaaactctggggcagatggagccagagcccagtctggagacaggtatggtagaagcgcccttcgggatgatgacagtgagagtgaagaggaggcggctcccaggcgatcaagaaaacgatag

SEQ ID NO: 4404 - protein, 645 aa, Sorghum bicolor
  misc_feature: Ceres ANNOT ID no. 6037776
  misc_feature (289)..(383): Pfam Id: YTH Pfam Desc: YT521-B-like family
  misc_feature (1)..(645): NCBI GI: 115469520 NCBI Desc: os06g0677700 [oryza sativa (japonica cultivar-group)]
  misc_feature (23)..(645): NCBI GI: 52076911 NCBI Desc: zinc finger (c3hc4-type ring finger) protein-like [oryza sativa (japonica cultivar-group)]
  misc_feature (1)..(643): NCBI GI: 79356321 NCBI Desc: nucleic acid binding [arabidopsis thaliana]
  misc_feature (305)..(643): NCBI GI: 6634766 NCBI Desc: contains similarity to gbu07224 a2 (iv) basement membrane collagen from brugia malayi. [arabidopsis thaliana]
  misc_feature (245)..(380): NCBI GI: 42566517 NCBI Desc: yt521-b-like family protein [arabidopsis thaliana]
  misc_feature: Useful for making plants with altered alkaloid content
  misc_feature: GREAT-hit functional homolog of the protein sequence given in SEQ ID NO 13323
MDDGDGGLSFDFEGGLDSVPAAGGGGPVPSSTDPGAGGGGGGDGPGMHGRGRGRGSYRQTVCRHWLRGLCMKGEACGFLHQFDKARMPVCRFFRDFGECREPDCAYKHSYDDVKECNMYKMGFCPNGPNCRYKHIKLPGPPPSVEEVLQKILQMRSFNRYGQNRNNNYNQQGERPQHPQGSGMPNQNSAENATAAAPPAGGQQAQTMNQQPPQQQQKPNTNDQAQGVSNGQQATRIATPLPQGPSRYFIVKSCNRENLEISVQQGIWATQRSNEAKLNEAFESTENVILIFSINRTRNFQGCAKMTSRIGGYIGGGNWKSAHGTAHYGRNFSMQWLKLCELSFQKTHHLRNPYNDNLPVKISRDCQELEPFIGEQLASLLYLEPDSELTAMLIAAEAKREEEKAKGVSADEAADNQDIVLFDDNEEDEEEESEEEEEANGQESQGRGRGRGMMWPPQMPMMRGPMMAGRGFPPNMMGDGFGFGGGFGMPDPFGMPRGFPPFVGPRFPGDFARGPMPGMGFPGRPPQPFPLGLDMMMGPGRGPLMGGMGMGGPGRPNRPMGMAPFMPPPPPNNRAAKREQRRPGGDRGDRFETVSSDQGNRGHDNTGNSGADGARAQSGDRYGRSALRDDDSESEEEAAPRRSRKR

SEQ ID NO: 4405 - DNA, 2760 bp, Sorghum bicolor
  misc_feature: Ceres ANNOT ID no. 6037779
  misc_feature: Encodes the peptide sequence at SEQ ID NO 4406
atgaggctctcgtcgtcgtccggcagcgtcatcccggcggctcagccgggctcgccggaagctgtggaggagcacaagtgcctgaactcggagttgtggcatgcctgtgccggtccgcttgtttccttgcccgcggtgggtagccgggtcgtgtacttccctcagggccacagcgagcaggtagcagcatcaactaacaaggaaatggagtctcagatccccaattatcctaatctgccgccacagcttatatgccaactgcataatgtgacgatgcatgctgatgcagagacagacgaggtatatgcacagatgacactgcagccactcaacccgcaagaactgaaggacccatatttacctgcagaattaggttcggccaataaacagccaacaaactatttctgcaaaacattaacagcaagtgacacaagtacccatggtgggttctctgttccccgtcgagcagctgagaaagtgtttcctccactggatttcacccagcaacctccatgccaggagttgatggcaaaagatcttcatggcaatgagtggaaattccgtcacatctttcgtggtcagccaaagagacatcttctaactacaggttggagtgtctttgtaagtgcaaagagacttgttgctggtgactctgtcctttttatctggaatgacaataaccagcttctgcttggaattcgtcgggcaaatcggccgcaaactgtcatgccatcttcagtcttatcaagtgatagcatgcatattggtcttcttgctgcagctgctcatgctgcttcgacaaatagccggtttacaattttctacaacccaagggcaagcccttcagagtttgtcataccgcttgcaaagtatgttaaggctgtgtatcatacccgtatatccgtggggatgcgcttcaggatgctttttgagacagaagagtctagcgttaggagatacatgggaacaattaccggaatcagtgatcttgattccgttcggtggccaaattcacattggcgttctgttaaggttggctgggatgaatcaactgctggtgagaggcagcctagggtgtcactatgggagattgagcccctgacaactttcccaatgtatccatctccttttccgctcaggcttaagcgtccatggccaacaggcttgccttctctgcatggtgggaaggatgatgacctggctaactctctcatgtggcttcgagatgccgcaaatcctggttttcagtcgttaaattttggtggacttggtatgaacccttggatgcagccaaggctggatgcttccttacttggtctgcaacctgacatgtatcaggcgatggccacagctgctttccaggatccaacaaagcaggtatcatcacccacaatgctgcagttccagcaaccacagaacatagctggccgggctacgccacttctttcaagtcagattttgcagcaatcacatcctcaatttcagcagcaacagtaccttcaaaacatctcagagagtacaatccaagcgcagggtcagtctgagttcctcaaacagcagatccaacgcagccagtcgttcaatgagcagaagccccagctgcagccccagcagcaacagcaagaatcacagcagcagcagcagcagcaatcacagtgtctgcaagtccctcaacatcaacaaatgcaacaacataacatgaccaactatcagtctgtatctaatgcattgtcagcattttctcagctgtcgtcagcctctcagtcttcacctgtgtcactgcaaacaatattaccgttctcacaggcacagagctttacagatacaaatgtaagctcattgtctccatccaacaccaacaccatgcaaaatacactgaggccattctcatcagaagcagtttctcacctcagtatgccgaggcccactgcaatacctgtctccgacccatggtcatcgaagcgtgttgcagtggagtctttgcttccttctcggcctcaggtttcgtcccagatggaacaattggactctgcaccagccagtatacctcatagctctgcattggcaccgcttcctggaagaggatgcttggtggatcaagatgtgaactctgatcctcaaaatcatgtcttgtttggtgttagtatagattcacagtcactgctaatgcaaggaggcatccctggtctccaaaatgggaatgattcaactgctataccttattccacctccaatttcctgagcccttcacagaatgattttcctttagatcatacactaaattctccaggttgcttagatgattctgggtatgtgccgccatgttcagataattctgaccaagtgaaccgaccaccagcgaccttcgtgaaggtttacaaatctggaacctatggaaggtcgcttgatatcactaggtttagtagctatcatgagctccgtagggaactagggcgcctatttggccttgagggccagttggaagaccctttgagatcaggctggcagcttgtattcgtcgaccgtgaggaggatgtccttctcgtgggcgacgacccttggcaggaattcgtgagcacggtgtcctgcataaagatactctcgccgcaggaggtgcagcagatgggcaagcaggggctggagctcctgagctcaggccctgcgcggaggctaggtagcagctgtgacgactacgttagcaggcaggagtcgagaagcctgagcaccgggatcgcgtccgtcgggtcggtcgagttctga

SEQ ID NO: 4406 - protein, 919 aa, Sorghum bicolor
  misc_feature: Ceres ANNOT ID no. 6037779
  misc_feature (261)..(344): Pfam Id: Auxin_resp Pfam Desc: Auxin response factor
  misc_feature (134)..(239): Pfam Id: B3 Pfam Desc: B3 DNA binding domain
  misc_feature (19)..(919): NCBI GI: 102139794 NCBI Desc: transcriptional factor b3 family protein [musa acuminata]
  misc_feature (18)..(919): NCBI GI: 47496696 NCBI Desc: auxin response factor 3 [cucumis sativus]
  misc_feature (1)..(919): NCBI GI: 144923737 NCBI Desc: transcriptional factor b3; auxin response factor; aux/iaa_arf_dimerisation [medicago truncatula]
  misc_feature (1)..(888): NCBI GI: 79318949 NCBI Desc: arf6 (auxin response factor 6) [arabidopsis thaliana]
  misc_feature (18)..(888): NCBI GI: 4102600 NCBI Desc: arf6 [arabidopsis thaliana]
  misc_feature: The sequence is a functional homolog of SEQ ID NO 1001 in the 10/666,642US patent application
  misc_feature: The sequence is a functional homolog of SEQ ID NO 1003 in the 10/666,642US patent application
  misc_feature: The sequence is a functional homolog of SEQ ID NO 1004 in the 10/666,642US patent application
  misc_feature: The sequence is a functional homolog of SEQ ID NO 1424 in the 10/666,642US patent application
  misc_feature: The sequence is a functional homolog of SEQ ID NO 16 in the 10/412,699US patent application
  misc_feature: The sequence is a functional homolog of SEQ ID NO 1621 in the 10/374,780US patent application
  misc_feature: The sequence is a functional homolog of SEQ ID NO 1623 in the 10/374,780US patent application
  misc_feature: The sequence is a functional homolog of SEQ ID NO 1624 in the 10/374,780US patent application
  misc_feature: The sequence is a functional homolog of SEQ ID NO 1654 in the 10/412,699US patent application
  misc_feature: The sequence is a functional homolog of SEQ ID NO 1656 in the 10/412,699US patent application
  misc_feature: The sequence is a functional homolog of SEQ ID NO 1657 in the 10/412,699US patent application
  misc_feature: The sequence is a functional homolog of SEQ ID NO 18 in the 10/412,699US patent application
  misc_feature: The sequence is a functional homolog of SEQ ID NO 1826 in the 10/412,699US patent application
  misc_feature: The sequence is a functional homolog of SEQ ID NO 2070 in the 10/374,780US patent application
  misc_feature: Useful for making plants with modulated growth and phenotype characteristics
  misc_feature: The sequence is a functional homolog of SEQ ID NO 16 in the 20040045049 US patent application
  misc_feature: The sequence is a functional homolog of SEQ ID NO 16 in the 20040045049 US patent application
  misc_feature: The sequence is a functional homolog of SEQ ID NO 1654 in the 20040045049 US patent application
  misc_feature: The sequence is a functional homolog of SEQ ID NO 1656 in the 20040045049 US patent application
  misc_feature: The sequence is a functional homolog of SEQ ID NO 1657 in the 20040045049 US patent application
  misc_feature: The sequence is a functional homolog of SEQ ID NO 18 in the 20040045049 US patent application
  misc_feature: The sequence is a functional homolog of SEQ ID NO 1826 in the 20040045049 US patent application
  misc_feature: The sequence is a functional homolog of SEQ ID NO 1004 in the 10/666,642 US patent application
  misc_feature: The sequence is a functional homolog of SEQ ID NO 1624 in the 10/374,780 US patent application
  misc_feature: The sequence is a functional homolog of SEQ ID NO 1657 in the 10/412,699 US patent application
  misc_feature: The sequence is a functional homolog of SEQ ID NO 1001 in the 10/666,642 US patent application
  misc_feature: The sequence is a functional homolog of SEQ ID NO 1621 in the 10/374,780 US patent application
  misc_feature: The sequence is a functional homolog of SEQ ID NO 1654 in the 10/412,699 US patent application
  misc_feature: The sequence is a functional homolog of SEQ ID NO 1424 in the 10/666,642 US patent application
  misc_feature: The sequence is a functional homolog of SEQ ID NO 1826 in the 10/412,699 US patent application
  misc_feature: The sequence is a functional homolog of SEQ ID NO 2070 in the 10/374,780 US patent application
  misc_feature: The sequence is a functional homolog of SEQ ID NO 1003 in the 10/666,642 US patent application
  misc_feature: The sequence is a functional homolog of SEQ ID NO 1623 in the 10/374,780 US patent application
  misc_feature: The sequence is a functional homolog of SEQ ID NO 1656 in the 10/412,699 US patent application
  misc_feature: The sequence is a functional homolog of SEQ ID NO 224 in the 10/666,642 US patent application
  misc_feature: The sequence is a functional homolog of SEQ ID NO 278 in the 10/374,780 US patent application
  misc_feature: The sequence is a functional homolog of SEQ ID NO 830 in the 10/225,066 US patent application
  misc_feature: The sequence is a functional homolog of SEQ ID NO 894 in the 10/412,699 US patent application
  misc_feature: The sequence is a functional homolog of SEQ ID NO 202 in the 10/225,066 US patent application
  misc_feature: The sequence is a functional homolog of SEQ ID NO 2342 in the 10/374,780 US patent application
  misc_feature: The sequence is a functional homolog of SEQ ID NO 286 in the 10/412,699 US patent application
  misc_feature: The sequence is a functional homolog of SEQ ID NO 100 in the 10/666,642 US patent application
  misc_feature: The sequence is a functional homolog of SEQ ID NO 298 in the 10/412,699 US patent application
  misc_feature: The sequence is a functional homolog of SEQ ID NO 300 in the 10/412,699 US patent application
MRLSSSSGSVIPAAQPGSPEAVEEHKCLNSELWHACAGPLVSLPAVGSRVVYFPQGHSEQVAASTNKEMESQIPNYPNLPPQLICQLHNVTMHADAETDEVYAQMTLQPLNPQELKDPYLPAELGSANKQPTNYFCKTLTASDTSTHGGFSVPRRAAEKVFPPLDFTQQPPCQELMAKDLHGNEWKFRHIFRGQPKRHLLTTGWSVFVSAKRLVAGDSVLFIWNDNNQLLLGIRRANRPQTVMPSSVLSSDSMHIGLLAAAAHAASTNSRFTIFYNPRASPSEFVIPLAKYVKAVYHTRISVGMRFRMLFETEESSVRRYMGTITGISDLDSVRWPNSHWRSVKVGWDESTAGERQPRVSLWEIEPLTTFPMYPSPFPLRLKRPWPTGLPSLHGGKDDDLANSLMWLRDAANPGFQSLNFGGLGMNPWMQPRLDASLLGLQPDMYQAMATAAFQDPTKQVSSPTMLQFQQPQNIAGRATPLLSSQILQQSHPQFQQQQYLQNISESTIQAQGQSEFLKQQIQRSQSFNEQKPQLQPQQQQQESQQQQQQQSQCLQVPQHQQMQQHNMTNYQSVSNALSAFSQLSSASQSSPVSLQTILPFSQAQSFTDTNVSSLSPSNTNTMQNTLRPFSSEAVSHLSMPRPTAIPVSDPWSSKRVAVESLLPSRPQVSSQMEQLDSAPASIPHSSALAPLPGRGCLVDQDVNSDPQNHVLFGVSIDSQSLLMQGGIPGLQNGNDSTAIPYSTSNFLSPSQNDFPLDHTLNSPGCLDDSGYVPPCSDNSDQVNRPPATFVKVYKSGTYGRSLDITRFSSYHELRRELGRLFGLEGQLEDPLRSGWQLVFVDREEDVLLVGDDPWQEFVSTVSCIKILSPQEVQQMGKQGLELLSSGPARRLGSSCDDYVSRQESRSLSTGIASVGSVEF

SEQ ID NO: 4407 - DNA, 1296 bp, Sorghum bicolor
  misc_feature: Ceres ANNOT ID no. 6037783
  misc_feature: Encodes the peptide sequence at SEQ ID NO 4408
atgtcgtggcggtgggctctcgcgcgccgcgtcgccgcgctggccgcgaccagcggcggcggcggcggtgcggcccaggcgcagaggctcctgcccacctcgtcggccgccgctagcactggcctcctggggcggcaccacatgcccctcgcctctcagattcggagcaaggtggttggttgcagaggagctgctctcgtgagctccagatggttgcatgatgcccaataccaggttcgccaggatggggcttcaagagctcaggaacagcaagatccatttgaattggtcgccgatgagctatcacttcttgcaaataggttacgatcaatggtggctgctgaggtccccaaactggcatcagcagccgagtactttttcaaggtgggagcagagggaaaaagattccgacctacggtattgttgctcatggcatcagctctgaaattccctttgtcagaatcaacagaaggcggagttctcagtatattggcagataaactccgcacacggcaacagaacattgcagagataactgaaatgattcatgttgcaagccttctgcatgatgatgttcttgatgatgctgatactaggcgtggcgtcagttcattgaatctcatcatggggaacaagctttctgtgttggctggtgacttcctgctgtctagagcatgtgtggcacttgcagcactcgggaatacagaggtggtttctctaatggcaactgctgtagaacatctagttactggtgaaactatgcagatctctacaagcagagagcaacgacgaagcatggagtactacctgcaaaagacatactacaaaacggcatcattgatatcaaatagttgcaaggctgttgctattcttgcagggcacacagctgaggtctcggtgcttgcatacgaatatggtcgaaacctgggtctagccttccagttaattgatgatgttcttgatttcaccggcacctctgcatcccttgggaagggttcattgtctgatattcgccatggagtcattactgcccccatgctgtatgcgatggaggaattcccgcaactacaagaagttgttgaccggggttttgataatcctgcaaacattgaaattgcccttgactatctcaggaagagccgtgggattgaaaggacaaaggagctcgcacgagaacatgctgatcgtgcagtcaaggctatagaatccctcccagacagtgatgacgaggatgtcctgacttcaaggcgtgctcttattgatatcacagagagagtcatcacaaggacaaaatag

SEQ ID NO: 4408 - protein, 431 aa, Sorghum bicolor
  misc_feature: Ceres ANNOT ID no. 6037783
  misc_feature (118)..(391): Pfam Id: polyprenyl_synt Pfam Desc: Polyprenyl synthetase
  misc_feature (57)..(431): NCBI GI: 12055493 NCBI Desc: geranyl diphosphat synthase [quercus robur]
  misc_feature (57)..(431): NCBI GI: 82659078 NCBI Desc: geranyl pyrophosphate synthase [lycopersicon esculentum]
  misc_feature (42)..(431): NCBI GI: 27261729 NCBI Desc: geranylgeranyl diphosphate synthase [citrus unshiu]
  misc_feature (61)..(431): NCBI GI: 79324330 NCBI Desc: dimethylallyltranstransferase [arabidopsis thaliana]
  misc_feature (61)..(431): NCBI GI: 11322965 NCBI Desc: geranyl diphosphate synthase [arabidopsis thaliana]
MSWRWALARRVAALAATSGGGGGAAQAQRLLPTSSAAASTGLLGRHHMPLASQIRSKVVGCRGAALVSSRWLHDAQYQVRQDGASRAQEQQDPFELVADELSLLANRLRSMVAAEVPKLASAAEYFFKVGAEGKRFRPTVLLLMASALKFPLSESTEGGVLSILADKLRTRQQNIAEITEMIHVASLLHDDVLDDADTRRGVSSLNLIMGNKLSVLAGDFLLSRACVALAALGNTEVVSLMATAVEHLVTGETMQISTSREQRRSMEYYLQKTYYKTASLISNSCKAVAILAGHTAEVSVLAYEYGRNLGLAFQLIDDVLDFTGTSASLGKGSLSDIRHGVITAPMLYAMEEFPQLQEVVDRGFDNPANIEIALDYLRKSRGIERTKELAREHADRAVKAIESLPDSDDEDVLTSRRALIDITERVITRTK

SEQ ID NO: 4409 - DNA, 333 bp, Sorghum bicolor
  misc_feature: Ceres ANNOT ID no. 6037786
  misc_feature: Encodes the peptide sequence at SEQ ID NO 4410
atgtcaggagtgatcacaaagttcgccgtcacatccatgttgatgtggatggcccccgtcgcgatcatgtatgggttctactaccaggtgttcccaggtgtgagtcagatgtcatcctcggcacagacactcgccagcgggtttctggcggtgatatcagttaatctggtgatcggattttacatattcacggcgatgaaggagactccacaccaggagccacagccggatcctgccttcctggcgaacgcgaaagcgagtttcaaccagccaacaacagcatcctctcaagtgagtgatgatgaagccaaggggaagggaaaggtcgagtag

SEQ ID NO: 4410 - protein, 110 aa, Sorghum bicolor
  misc_feature: Ceres ANNOT ID no. 6037786
  misc_feature (1)..(110): NCBI GI: 115460500 NCBI Desc: os04g0612900 [oryza sativa (japonica cultivar-group)]
  misc_feature: The plant produces a reduced number of seeds.
  misc_feature: Useful for biocontainment applications
  misc_feature: GREAT-hit functional homolog of the protein sequence given in SEQ ID NO 13243
MSGVITKFAVTSMLMWMAPVAIMYGFYYQVFPGVSQMSSSAQTLASGFLAVISVNLVIGFYIFTAMKETPHQEPQPDPAFLANAKASFNQPTTASSQVSDDEAKGKGKVE

SEQ ID NO: 4411 - DNA, 1203 bp, Sorghum bicolor
  misc_feature: Ceres ANNOT ID no. 6037794
  misc_feature: Encodes the peptide sequence at SEQ ID NO 4412
atgggttggaggcggggaggaggcgcggatggcgtggccaggaggtgggtgctgctgctctgcgtcgggagcttctgcctcggcctgctcttcaccgacaggatgtggactttgcctgaagcagatgaggtagaagtaccaaatttaagaagagggggagaggctgagcttaagactggagactgtaatgtgcgcaaagttcaaggaaaacacaattacaatgacatgttgcgtatctcagatactcaccataattcacagactttagataagacaatagcgaacttggagacagagctgtctgcggcgagaactctacaagattcttttctcaacggatctccagtgcaagaagactacaaggcttctgagtctaccggtaggcgcaagtaccttatggtaataggtatcaacactgcttttagcagtcgcaagagaagggattctatacgcaacacctggatgcctaaaggggaaacaaggaaaaagctggaggaagaaaaggggatcataattcgttttgtaattggccacagtgctatttcaggtggaattgtcgatagagcaattcaggcagaggataagaaacatggagacttcatgaggctggatcatgttgaaggataccttgaactgtcagggaaaaccaggacatactttgcaacagctgttgctttatgggatgctaacttctatgtgaaggttgacgatgatgtacatgttaatatagctacacttggaaatatcttatccaaacatatttcaaagcccagggtatacattggatgcatgaagtctggccctgtcctctctgacaaggatgtgaggtactatgaacctgagcactggaaatttggagaagtgggtaacaaatattttcggcatgccaccggtcaactatatgctatttcaaaagatttggcagcttacatatcactaaacaagcatgtcttgcacaagtatatcaacgaggatgtgtctttgggagcttggttgatagggttagatgttgagcatattgatgaccgcagactatgctgcggcactccacctgattgcgaatggaaagctcaggctgggaacacctgcgctgcctcattcgattggaaatgcagtggtatctgcaactctgtgcagaacatctggggggttcataagaagtgttcagaagatgaaaaggcgctgctgaccgcatctttctaa

SEQ ID NO: 4412 - protein, 400 aa, Sorghum bicolor
  misc_feature: Ceres ANNOT ID no. 6037794
  misc_feature (145)..(343): Pfam Id: Galactosyl_T Pfam Desc: Galactosyltransferase
  misc_feature (12)..(400): NCBI GI: 21360399 NCBI Desc: at1g05170/yup8h12_22 [arabidopsis thaliana]
  misc_feature (12)..(400): NCBI GI: 145323746 NCBI Desc: galactosyltransferase family protein [arabidopsis thaliana]
  misc_feature (12)..(400): NCBI GI: 21553519 NCBI Desc: avr9 elicitor response-like protein [arabidopsis thaliana]
  misc_feature (12)..(400): NCBI GI: 7269547 NCBI Desc: avr9 elicitor response like protein [arabidopsis thaliana]
  misc_feature (75)..(399): NCBI GI: 15221085 NCBI Desc: galactosyltransferase family protein [arabidopsis thaliana]
  misc_feature: Useful for making plants with altered carbohydrate content
  misc_feature: Functional homolog of the protein sequence given in SEQ ID NO 13851
MGWRRGGGADGVARRWVLLLCVGSFCLGLLFTDRMWTLPEADEVEVPNLRRGGEAELKTGDCNVRKVQGKHNYNDMLRISDTHHNSQTLDKTIANLETELSAARTLQDSFLNGSPVQEDYKASESTGRRKYLMVIGINTAFSSRKRRDSIRNTWMPKGETRKKLEEEKGIIIRFVIGHSAISGGIVDRAIQAEDKKHGDFMRLDHVEGYLELSGKTRTYFATAVALWDANFYVKVDDDVHVNIATLGNILSKHISKPRVYIGCMKSGPVLSDKDVRYYEPEHWKFGEVGNKYFRHATGQLYAISKDLAAYISLNKHVLHKYINEDVSLGAWLIGLDVEHIDDRRLCCGTPPDCEWKAQAGNTCAASFDWKCSGICNSVQNIWGVHKKCSEDEKALLTASF

SEQ ID NO: 4413 - DNA, 2256 bp, Sorghum bicolor
  misc_feature: Ceres ANNOT ID no. 6037797
  misc_feature: Encodes the peptide sequence at SEQ ID NO 4414
atgagcgtggtcggcttcgacgtcggcaacgacaccctggtggcggcggcggcgcggcagcggggcatcgacgtgctcctcaacgccgagtccaagcgcgagtcccccgccgccgtcgccttctcccacaacgcgcgcctcatcggctgccacgccgcgtccgcctcctccgcgcacgcccccttctccagcgtcaagcgcctcctcgtgggggccacggggaggcacccggacgcctccctccaccgcgacctgccccgcctccccttccccgtctccaccggcgacggcggcgccgtcgtccacgccgaccacgtcggccgccgcatcgcgctctcaccgacccacctcctctccatgctgctcgcctacctcaagcagctcgcagagtccgacctcggcggcgtccccgtcgccgactgcgtgatctccgtgccctgctacttcactcaggcccagcgccgcgcctacctcgacgccgccgccgtcgcggggctcagaccgctccgcctcatgcacgacctcgccgccaccgcgcttggctacggcctctaccgctctgacctcggcggcgccgggggacccacctgcgtcgcgttcgtcgacgtcggccagtgcgacacgcaggtcgcggtcgtctccttcgacgcgtcggggatgaaggtgctgtctcacggcttcgatgcggacctcgggggcagggactttgacgaggtgctgttcgagcatttcgcccaggagttcagggacaggtacaggattgatgtcgtggggaatgtgaaggccagtatgaggttgagggcagcttgtgagaaggcgaagaaggttctgagcgcaaatgcggaggctgtggtgaacattgagtgcctgatggaggagaaggatgtgaggggggtgatccgaagggaggactttgagaagctatgtgccagactgctggagagggttgttgaaccttgcaagagggcggtggcagattcaggggttggcttggagaggctgcattctgtggaactcgttgggtcaggttctcgggtgcctgccattgccaaggtgcttgcgggattcttcagaagggaacctagtcgcacgctcaatgctagtgagtgtgtggctcggggatgcgcattgcaatgtgcaatgcttagtcctacattccgtgttcgggaatacgaggtgcaggatgcaatccctgcttccattggattttacactagtgatggcccagtttcaacattgtcaagtgatgtattgttccggagaggccttccctttcccagtgttaagatcattactctacacaagaattgcagttttagctctgatgcatattatgcggatgcaaatgaattgccccctggtacctcgacagacatcggtacttttcagattggcccattccaagcacatacggaagcttctaaagtcaaagtaaaaattcgtttgaatttacatggtttgatttcagtcgaatctgctgctttgatagatgattatcaaaggaatgccaattctgctgacaatatggaggtggataccagcggtgatgacacgggtcacaagtcacgaagtgaaaggtctatccagcggcaggagttgccaatcactgagtacatctatggtgcaatgagcaagcaggaattgctggaagctcaagagcaagagcagcaattggcttatcaggataaacttatggaacggacaaaggacaggaagaatgcattagaatcttatgtatacgacacccgtaacaagctttctgagaggtaccggagctttgctactgattcagaaagggaacaaatctcagttaatctacaacagactgaagaatggctttacgaagaaggtgatgatgagacagaagcggtttacagtagcaaacttgaggagctgaaaaagcttgtagatccaattgaaaatcgttgtaaagatgacgaagtgagagctgaagccacaagggaccttttgaagtgcattgttgaccacagaatggctgccaggtcattatccacacctgaaagagatgctgttgacaatgagtgcaataaagctgagcagtggctaagggagggatcccaacttcaagaaaccttgcctaagaatgtggacccagtactttggtcctgtgaaatcaagagaaaggaagaagagctggatatgttctgtcgaaacatagcaaggtataagggctctccagcaaggacagatggcagcaggggttcagatcacatgcctacaccggatagagattag

SEQ ID NO: 4414 - protein, 751 aa, Sorghum bicolor
  misc_feature: Ceres ANNOT ID no. 6037797
  misc_feature (3)..(645): Pfam Id: HSP70 Pfam Desc: Hsp70 protein
  misc_feature (1)..(745): NCBI GI: 4835791 NCBI Desc: strong similarity to gbz70314 heat-shock protein from arabidopsis thaliana and is a member of the pf00012 hsp70 protein family
  misc_feature (1)..(650): NCBI GI: 1495251 NCBI Desc: heat-shock protein [arabidopsis thaliana]
  misc_feature (1)..(525): NCBI GI: 50417466 NCBI Desc: hsp105-prov protein [xenopus laevis]
  misc_feature (1)..(574): NCBI GI: 62631867 NCBI Desc: heat shock protein apg-2 [canis familiaris]
  misc_feature (1)..(574): NCBI GI: 38327039 NCBI Desc: heat shock 70kda protein 4 isoform a [homo sapiens]
MSVVGFDVGNDTLVAAAARQRGIDVLLNAESKRESPAAVAFSHNARLIGCHAASASSAHAPFSSVKRLLVGATGRHPDASLHRDLPRLPFPVSTGDGGAVVHADHVGRRIALSPTHLLSMLLAYLKQLAESDLGGVPVADCVISVPCYFTQAQRRAYLDAAAVAGLRPLRLMHDLAATALGYGLYRSDLGGAGGPTCVAFVDVGQCDTQVAVVSFDASGMKVLSHGFDADLGGRDFDEVLFEHFAQEFRDRYRIDVVGNVKASMRLRAACEKAKKVLSANAEAVVNIECLMEEKDVRGVIRREDFEKLCARLLERVVEPCKRAVADSGVGLERLHSVELVGSGSRVPAIAKVLAGFFRREPSRTLNASECVARGCALQCAMLSPTFRVREYEVQDAIPASIGFYTSDGPVSTLSSDVLFRRGLPFPSVKIITLHKNCSFSSDAYYADANELPPGTSTDIGTFQIGPFQAHTEASKVKVKIRLNLHGLISVESAALIDDYQRNANSADNMEVDTSGDDTGHKSRSERSIQRQELPITEYIYGAMSKQELLEAQEQEQQLAYQDKLMERTKDRKNALESYVYDTRNKLSERYRSFATDSEREQISVNLQQTEEWLYEEGDDETEAVYSSKLEELKKLVDPIENRCKDDEVRAEATRDLLKCIVDHRMAARSLSTPERDAVDNECNKAEQWLREGSQLQETLPKNVDPVLWSCEIKRKEEELDMFCRNIARYKGSPARTDGSRGSDHMPTPDRD

SEQ ID NO: 4415 - DNA, 2883 bp, Sorghum bicolor
  misc_feature: Ceres ANNOT ID no. 6037812
  misc_feature: Encodes the peptide sequence at SEQ ID NO 4416
atgggcgcgctccgggcgatgctcctccgccgcttggcgctgctcgccgtggccgtggccgtgcccacggtcacggcggcggcggcgccgcccagcgaggtggccgtgggcgcgctcttcacctacgactccaccattggccgcgccgcgcgtctcgccatggagctcgccgtcgacgacgtcaacgccgaccgcaccgtcctcgcgggcacacacctcagcttgctgttccaggacaccaactgcagcggctttcttggcaccatcgaagcattgcagctaatggaaagaaatgtggttgctgttattggcccgcaatcctctgggataggccatgtcatctcccatgttgttaatgagctacatgtacctcttctatcatttgcggctacagatccaactctttctgcatcagagtatccgtacttcatcaggacaaccataagtgactacttccaaatgaatgccgttgctagcattgttgattactatcagtggaaagaggtgactgctatattcgttgatgatgattatgggcgaggtggtgtgtccgcccttggtgatgcgcttgcagcaaagagggcaaggatttcatataaagcagccattcctccaaattcaaatacagatgtgatcaacgatgtactgtttaaagcaaatatgatggaatcaagggtcatggttgtgcatgtcaatcctgacacagggatgagaatattttctgttgctaacaagctccaaatgatggccagtggctatgtctggatagtaactgattggctagctgctgtcttggattcctcaatgcctagagatcgtaaagatatgagtcatcttcagggactaattgttcttcgccagcacactcctgaatctgatgccaagaaaaagttcatatctaaatggaataatgcagctcgtaatagaagtattacttatggcttgaactcttatggtttttatgcttatgactcagtttgggctgttgctcgtggtatcgatcaatttctcaatagtgggcagcagatcaacttttctccagatccaatgttgcatgattctaatggcagcactttgcatctatcaactctcaagatatttgatggtggtgagcagatgctacagcaacttctgctcacaaattttacaggcctaactggtccagtccaatttaattcagatcgcaatttggtacacccagcatatgacatcctaaacctcggtggttctgaatcccggttgattggctattggtccaattactcaggcctctctgttgctcctcctgaaattttgtatcagaagccaccaaatacttcttcacttgtccagcggctccacaatgtggtttggcccggtgattccaccactactcctaaggggtgggttttcccgaacaatggccagcctctaagggttggtgtcccaatcaaaccaagctttaaggaattagtggcaggtggaaagggccctgataatgtgactggttattgcattgatatattcaatgcagcagttaaattgcttccttacccagttccatgccaattcataacagttggggatggcagaaagaatcctaactatgatgccattattaatatggttgccgccaattcccttgatgcagctgtaggcgactttgctattgtgagaaacagaacaaagattgcagaattcacacagccttatattgagtcagggcttgtgatagtagcaccagtgaaacaagcaacttcaagtgcctgggctttccttaaaccgttcacgttggagatgtggtgtgtaacaggtgctctttttatttttgtggggatagttgtttggattcttgaacatcggagtaatgaggagtttcgaggctctccacgacgacaacttataacaatattttggtttagcttctcaacaatgttcttttcacacagacagaacactgtaagtgcgctagggcggtttgtgttgatcatatggttgttcgttgtgctgatcatcaactcaagttatactgctagcttgacgtcaatcctcacagtccaacagctcgcaacaggaataactggaatcgacagtttggtttcaagtggtttacctattggatatcaggatggaaaatttaccaaaaattacctgattgatgagctcaacattcctgagtatcgattggtaccactaaatacaatccaggagtatgctgatgcccttaaacgtggaccaaaagacggcggtgttgctgcaattgttgatgagatgccatatgttgagatcttcctgtcataccactgcaatttcagaatagtaggacaggagttcaccaaggagggatggggctttgcattcaagagagactccccccttgctgcagacttgtcgacagccatccttcaactctcagagagtggccagcttcagagaatacacgacgagtggttcacagggcctagttgctcctctgatgacagcgaagtgggagcaaccaggcttggcctcggaagcttttggggccttttcctcgcgtgtgccctgatatgtctcttggctctggtagtgtttttcatacggatatgctggcagtataacaagtactccaattctgaagccgctggtgagcccagtgcagcagcaacagctgcagctgctgcagcagccgcagatgttgctgctgctgctgctgctgccactgatgctgtggaaagacagcggaagccatcacgccttggcagcttcaaagagattatacagtttgtcgacaagaaggaggaggaaattaagagaacgatgaaacgaagattaagcgagaaagataaccaagctgcaggatcctcagataaagataaccaagctgcaggatcctcagatgctcatgcagtggcttcagcatag

SEQ ID NO: 4416 - protein, 960 aa, Sorghum bicolor
  misc_feature: Ceres ANNOT ID no. 6037812
  misc_feature (49)..(409): Pfam Id: ANF_receptor Pfam Desc: Receptor family ligand binding region
  misc_feature (590)..(854): Pfam Id: Lig_chan Pfam Desc: Ligand-gated ion channel
  misc_feature (58)..(948): NCBI GI: 115469546 NCBI Desc: os06g0680500 [oryza sativa (japonica cultivar-group)]
  misc_feature (31)..(926): NCBI GI: 5713181 NCBI Desc: ligand-gated channel-like protein precursor [arabidopsis thaliana]
  misc_feature (31)..(632): NCBI GI: 11358470 NCBI Desc: ionotropic glutamate receptor homolog glr4 [imported] - arabidopsis thaliana
  misc_feature (25)..(947): NCBI GI: 41017241 NCBI Desc: glutamate receptor 3.5 precursor (ligand-gated ion channel 3.5) (ionotropic glutamate receptor glr6)
  misc_feature (25)..(947): NCBI GI: 5759100 NCBI Desc: ionotropic glutamate receptor ortholog glr6 [arabidopsis thaliana]
MGALRAMLLRRLALLAVAVAVPTVTAAAAPPSEVAVGALFTYDSTIGRAARLAMELAVDDVNADRTVLAGTHLSLLFQDTNCSGFLGTIEALQLMERNVVAVIGPQSSGIGHVISHVVNELHVPLLSFAATDPTLSASEYPYFIRTTISDYFQMNAVASIVDYYQWKEVTAIFVDDDYGRGGVSALGDALAAKRARISYKAAIPPNSNTDVINDVLFKANMMESRVMVVHVNPDTGMRIFSVANKLQMMASGYVWIVTDWLAAVLDSSMPRDRKDMSHLQGLIVLRQHTPESDAKKKFISKWNNAARNRSITYGLNSYGFYAYDSVWAVARGIDQFLNSGQQINFSPDPMLHDSNGSTLHLSTLKIFDGGEQMLQQLLLTNFTGLTGPVQFNSDRNLVHPAYDILNLGGSESRLIGYWSNYSGLSVAPPEILYQKPPNTSSLVQRLHNVVWPGDSTTTPKGWVFPNNGQPLRVGVPIKPSFKELVAGGKGPDNVTGYCIDIFNAAVKLLPYPVPCQFITVGDGRKNPNYDAIINMVAANSLDAAVGDFAIVRNRTKIAEFTQPYIESGLVIVAPVKQATSSAWAFLKPFTLEMWCVTGALFIFVGIVVWILEHRSNEEFRGSPRRQLITIFWFSFSTMFFSHRQNTVSALGRFVLIIWLFVVLIINSSYTASLTSILTVQQLATGITGIDSLVSSGLPIGYQDGKFTKNYLIDELNIPEYRLVPLNTIQEYADALKRGPKDGGVAAIVDEMPYVEIFLSYHCNFRIVGQEFTKEGWGFAFKRDSPLAADLSTAILQLSESGQLQRIHDEWFTGPSCSSDDSEVGATRLGLGSFWGLFLACALICLLALVVFFIRICWQYNKYSNSEAAGEPSAAATAAAAAAAADVAAAAAAATDAVERQRKPSRLGSFKEIIQFVDKKEEEIKRTMKRRLSEKDNQAAGSSDKDNQAAGSSDAHAVASA

SEQ ID NO: 4417 - DNA, 2793 bp, Sorghum bicolor
  misc_feature: Ceres ANNOT ID no. 6037815
  misc_feature: Encodes the peptide sequence at SEQ ID NO 4418
atggggggtgcggctcagttggtggtggtgactgtgctcttggccactgccgccgcggcgtcggcggcggggccgcggccgagcgaggtggccgtgggcgcgctcttcacgtacgactccacgattggccgcgccgcgcagctcgccatcgagctcgccgtcgacgacgtcaacgcggacgccaaggtgctcaagggaaccaagctcaacttgattcccatggacaccaactgcagcggcttccttggcaccatcaaagctttggagctaatggagaaaaatgtagttgctgtgattggcccacaatcctctgagataggccatgtcatctctcaagttgtcaatgagttacatgttcctcttctatcatttgcggcgacggatccaactctttctgcatcagagtatccttacttcataaggacaaccacaagtgactacttccaaatgaatgccgttgctagcattgttgattactatcaatggaaaagagtgactgctatatacgtcgatgacgattatgggcgaggtggtgtctcggctcttggcgatgcgcttgcattgaagagggcacaggtttcatataaagcagctattcctccaaattcagacacagacgtgatccgtgatgtactgtttagagcaaacatgatggaatcaaggatcatggttgtgcatgtcaatcctgacacgggtttgagggtattttctgcagctaagaagctccagatgatgaccagtggctatgtctggatagtaactgattggctagctgctgtcctcgattcctcccccgcatctagagatcctaaaaacataagtaatattcagggagtaattgttcttcgtcagcacactcctgattctgatgccaagaaaaagttcatatctagatggaacactgtggctcgtaacagaagtatgacttctggactgaactcatatgctttctacgcttatgactcagtttgggccgttgctcgctctgtcgaccaatttctcaatgctgggcaacagatcaacttctcaacagatccaaggctgcatgatccaaacggcaccactttgcgtctgtcaactctcaagatattcgatggtggtgaccagatgctgcagcaacttctcctcacaaacttcacaggtctaacaggtccagtccgatttgattcaagcggcaatttggtacgcccagcttatgatatcctcaatgttggcccctccggtgccagcttggtcggctattggtccaactattcaggcctttctgtgtctgctcctgaaattttgtatcagatgccatcaaatgcatccagtgactatcagctgaagaatgtggtatggcctggtgattcaactgatatacctaggggctgggtgtttccgaacaatggccagcctctcagagttgggatcccagttaaaccaagcttcaagacattggtgtcaggcagtagccctgatactgtgaggggttactgcattgatgttttcaagtcagcaattaaactgctcccttacccagttccttaccagtttgtacctattggggatggcacaaagaaccctagttacgtcggcattgttgggatggttgcttccaatacacttgatgtagctgtaggcgactttgcgatagtgagaaatggaacacggcttgcagagtacacacagccttacattgattcagggcttgtgatagtggcgccagtgaaacatgtaagctcaagcgcctgggctttccttaaacctttcacatgggagatgtggtttgtcacaggcgctcttttcgttttggtgggaattgtggtgtggctactcgaacatcggactaatgaggaatttcgagggcctccacgtaatcaaatcataacaatattctggttcagcttctcaacaatgttcttctcacacaggcagaacaccggaaccgcgctcgggcgtttcgtgctgatcatatggatgttcgtcgtgttgatcatcacttcaagctacactgccagcttgacgtcaatcctgacggtccaacagctcgcgacaggaattacaggacttgatagtctcatatcaagctctttacctattggataccagaccggaaaattcaccaaaaaatacctgatgataaacctcaacattcctgagtctcgattggtgcatctgaacacgatccaagaatacgctgatgcccttacccgtggaccaaaaaatggcggcgttgctgcaattatcgacgagaagccatatatcgatatcttcctgtcacactactgcaacttcaagattgtgggacagcagttcacaagggaaggatggggatttgcattccagaaagagtccccccttgctgcagatatgtcaaccgccatccttcagctttcagagagtggcaagcttcagagcatccatgacgagtggttcacaaagccgagctgcgccaccgacgatgagagcaatctgggagcaaccaggcttggcctcggaagcttctggggccttttcctcatctgtgccctgatctgtctcttagctctggtgatgttcttcatacaagtctgctggcagtacaagcagtactccaattctgaagatgctgatgagtccagtgcagctggcgctgatggtgctggcaaaagacagcggaggctgtcaggccttggcagcttcaaagagatagtaaagtttgtcgacatgaaggaggaggaaatcatgaagaagtcgacgaaacgccggtcaggcgagaaagataaccatgctgcaggattgtcatatgctcaatcggtggcttcagcatag

SEQ ID NO: 4418 - protein, 930 aa, Sorghum bicolor
  misc_feature: Ceres ANNOT ID no. 6037815
  misc_feature (45)..(406): Pfam Id: ANF_receptor Pfam Desc: Receptor family ligand binding region
  misc_feature (585)..(850): Pfam Id: Lig_chan Pfam Desc: Ligand-gated ion channel
  misc_feature (54)..(928): NCBI GI: 115469546 NCBI Desc: os06g0680500 [oryza sativa (japonica cultivar-group)]
  misc_feature (21)..(914): NCBI GI: 41017241 NCBI Desc: glutamate receptor 3.5 precursor (ligand-gated ion channel 3.5) (ionotropic glutamate receptor glr6)
  misc_feature (21)..(914): NCBI GI: 5759100 NCBI Desc: ionotropic glutamate receptor ortholog glr6 [arabidopsis thaliana]
  misc_feature (27)..(922): NCBI GI: 5713181 NCBI Desc: ligand-gated channel-like protein precursor [arabidopsis thaliana]
  misc_feature (15)..(627): NCBI GI: 11358470 NCBI Desc: ionotropic glutamate receptor homolog glr4 [imported] - arabidopsis thaliana
MGGAAQLVVVTVLLATAAAASAAGPRPSEVAVGALFTYDSTIGRAAQLAIELAVDDVNADAKVLKGTKLNLIPMDTNCSGFLGTIKALELMEKNVVAVIGPQSSEIGHVISQVVNELHVPLLSFAATDPTLSASEYPYFIRTTTSDYFQMNAVASIVDYYQWKRVTAIYVDDDYGRGGVSALGDALALKRAQVSYKAAIPPNSDTDVIRDVLFRANMMESRIMVVHVNPDTGLRVFSAAKKLQMMTSGYVWIVTDWLAAVLDSSPASRDPKNISNIQGVIVLRQHTPDSDAKKKFISRWNTVARNRSMTSGLNSYAFYAYDSVWAVARSVDQFLNAGQQINFSTDPRLHDPNGTTLRLSTLKIFDGGDQMLQQLLLTNFTGLTGPVRFDSSGNLVRPAYDILNVGPSGASLVGYWSNYSGLSVSAPEILYQMPSNASSDYQLKNVVWPGDSTDIPRGWVFPNNGQPLRVGIPVKPSFKTLVSGSSPDTVRGYCIDVFKSAIKLLPYPVPYQFVPIGDGTKNPSYVGIVGMVASNTLDVAVGDFAIVRNGTRLAEYTQPYIDSGLVIVAPVKHVSSSAWAFLKPFTWEMWFVTGALFVLVGIVVWLLEHRTNEEFRGPPRNQIITIFWFSFSTMFFSHRQNTGTALGRFVLIIWMFVVLIITSSYTASLTSILTVQQLATGITGLDSLISSSLPIGYQTGKFTKKYLMINLNIPESRLVHLNTIQEYADALTRGPKNGGVAAIIDEKPYIDIFLSHYCNFKIVGQQFTREGWGFAFQKESPLAADMSTAILQLSESGKLQSIHDEWFTKPSCATDDESNLGATRLGLGSFWGLFLICALICLLALVMFFIQVCWQYKQYSNSEDADESSAAGADGAGKRQRRLSGLGSFKEIVKFVDMKEEEIMKKSTKRRSGEKDNHAAGLSYAQSVASA

SEQ ID NO: 4419 - DNA, 2781 bp, Sorghum bicolor
  misc_feature: Ceres ANNOT ID no. 6037819
  misc_feature: Encodes the peptide sequence at SEQ ID NO 4420
  misc_feature: Up-regulated in shoot tissues in response to salicylic acid treatment
atgggcgccgctcagttggtgattctgttcttggcgcttggcgccgcgatgcgggcggcgtcggcggcgggggcgcggccgagcgaggtgaccgttggcgctctcttcacgtacgactccacaattggtcgcgcggcgcagcttgccatcgagctcgccgtcgatgacgtcaacgcggacggcaaggtcctcccggggacccagctcaatttggtgccccaggacaccaactgcagcggctttattgggaccatcgaagcgttgcggctaatggaaaaaagcgtagttgcggtgattggcccgcaatcctctgggataggccatgtcatctcccatgttgttaatgagctacatgtacctcttctatcatttgcggctacagatccaactctctctgcatcagagtatccgtacttcatcaggacaaccataagtgactacttccaaatgaatgccgttgctagcattgttgattactatcaatggaaaagggtgactgctatattcgttgatgatgattatgggcgaggtggcatggaagccctcggtgatgcgcttgcattaaagagggcaaagatttcatataaagcagctattcctccaaattcaaatacggatgtgatcaatgatgtactatttagagcaaatatgatggaatcaagggtcatggttgtgcatgtcaatcctgacacggggatgagaatattttctgtagctaagaacctccaaatgatggccagtggctatgtatggatagtaactgattggctagctgctgtccttgattcctcagcatatagagatcttaaagatatgggtcatattcagggactaattgttctgcgtcagcacattcctgaatctgaagccaaggataagttcatatctaaatggaatgatgtggctcgtaacagaagtattacttctggcttgaactcatatggtttttatgcttatgactcggtttgggctgttgctcgtgctgtcgataaatttctcagtagtgggcaacagatcaacttctcaacagatcccagattacaaaatttaaatgacagcacgttgcatctatcaactctgaagatatttgatggtggtgagcagatgctgcagcaacttctactctccaaatttacaggtgttacaggtccagtccagtttgattcagaccacaatttggtacgcccagcgtatgatatccttaatattgctggctctggctcccgcttgattggctattggtctaactattctgggctttcggtggctgctcctgaaattttgtatcagatgccacgaaatacatctacaagtgcccagcagctgcatgatgtggtatggcctggtgattccactactaagcctcagggatggatattcccaaacactggccaacctctgagagttggggttccaattaaagcaagctttaaggaattagtgtcaggcagaggagataacatgagtggttattgcgtcgagatattcaacgcagcaattaaactgcttccttacccagttccttaccaatttataactattggggatggcacaaaaaaccctagctatattgacatcattagaatggttgctgccaattcacttgatgcagctgtaggcgactttgctatagtgagaaatggaacgcagcttgcagaatacacacagccttatattgagtcagggcttgtgatagtagcgcctgtgaaacacgtaacttcaagtgcctgggctttccttgaacctttcacattggagatgtggtgtgtcacagttgctctttttattttggtgggtgtagtagtttggcttcttgaacatcgtactaatgaggaatttcgaggatctccaaggcgacaagtcataacaatgttatggtttagcttctcaacaatgttcttcgcacacagagagaacactgtaagcacacttgggcggttcgtgttgataatatggttgttcgttgtgctgatcatcacttcaagttacactgctagcttgacgtcaatcctcactgtccaacagctctcaactggaattacagggattgatagtttggtttcaagttctttacctattggataccagaatggaaaatttaccaaaaggtacctgagtgaaaacttcaatgttcctctctctcgactggtgccactgaatacgatccaggaatatgctgatgcccttaaccgtggaccaaaatacggtggtgttgctgcaattgttgatgagaagccatatatagatatcttcctgtcaaactactgcaaattcagaatagtgggagaggaattcacaaaggaaggatggggctttgcattccagagagactcccccctcgctgcagatttatcaaccgccatccttcaactttcagagagtggccaacttcagagaatccacgacgagtggttctcacggtctagttgctcctcagatgacagcgaagtgggagcaaccaggcttggcctcggaagcttttggggcctcttccttgtgtgtgccctgatatgcctcttcgctctgctggtattcttcatacgggtctgctggcagtacaaccagtactccagttctgaatcttctggcgagcccagcgcagccacccctggtcctgtcataagacagcggcgactatcacgccttggcagcttcaaagagctgatccagtttgtcgacaagaaggaggaggagattaagaaaacgatgaaacgaagatcaagcgataaagatagccaagctgcaggattctcatacgctcagtcagtggcttcagcttag

SEQ ID NO: 4420 - protein, 926 aa, Sorghum bicolor
  misc_feature: Ceres ANNOT ID no. 6037819
  misc_feature (45)..(405): Pfam Id: ANF_receptor Pfam Desc: Receptor family ligand binding region
  misc_feature (584)..(848): Pfam Id: Lig_chan Pfam Desc: Ligand-gated ion channel
  misc_feature (54)..(924): NCBI GI: 115469546 NCBI Desc: os06g0680500 [oryza sativa (japonica cultivar-group)]
  misc_feature (21)..(915): NCBI GI: 41017241 NCBI Desc: glutamate receptor 3.5 precursor (ligand-gated ion channel 3.5) (ionotropic glutamate receptor glr6)
  misc_feature (27)..(918): NCBI GI: 5713181 NCBI Desc: ligand-gated channel-like protein precursor [arabidopsis thaliana]
  misc_feature (21)..(915): NCBI GI: 5759100 NCBI Desc: ionotropic glutamate receptor ortholog glr6 [arabidopsis thaliana]
  misc_feature (26)..(626): NCBI GI: 11358470 NCBI Desc: ionotropic glutamate receptor homolog glr4 [imported] - arabidopsis thaliana
  misc_feature: Up-regulated in shoot tissues in response to salicylic acid treatment
MGAAQLVILFLALGAAMRAASAAGARPSEVTVGALFTYDSTIGRAAQLAIELAVDDVNADGKVLPGTQLNLVPQDTNCSGFIGTIEALRLMEKSVVAVIGPQSSGIGHVISHVVNELHVPLLSFAATDPTLSASEYPYFIRTTISDYFQMNAVASIVDYYQWKRVTAIFVDDDYGRGGMEALGDALALKRAKISYKAAIPPNSNTDVINDVLFRANMMESRVMVVHVNPDTGMRIFSVAKNLQMMASGYVWIVTDWLAAVLDSSAYRDLKDMGHIQGLIVLRQHIPESEAKDKFISKWNDVARNRSITSGLNSYGFYAYDSVWAVARAVDKFLSSGQQINFSTDPRLQNLNDSTLHLSTLKIFDGGEQMLQQLLLSKFTGVTGPVQFDSDHNLVRPAYDILNIAGSGSRLIGYWSNYSGLSVAAPEILYQMPRNTSTSAQQLHDVVWPGDSTTKPQGWIFPNTGQPLRVGVPIKASFKELVSGRGDNMSGYCVEIFNAAIKLLPYPVPYQFITIGDGTKNPSYIDIIRMVAANSLDAAVGDFAIVRNGTQLAEYTQPYIESGLVIVAPVKHVTSSAWAFLEPFTLEMWCVTVALFILVGVVVWLLEHRTNEEFRGSPRRQVITMLWFSFSTMFFAHRENTVSTLGRFVLIIWLFVVLIITSSYTASLTSILTVQQLSTGITGIDSLVSSSLPIGYQNGKFTKRYLSENFNVPLSRLVPLNTIQEYADALNRGPKYGGVAAIVDEKPYIDIFLSNYCKFRIVGEEFTKEGWGFAFQRDSPLAADLSTAILQLSESGQLQRIHDEWFSRSSCSSDDSEVGATRLGLGSFWGLFLVCALICLFALLVFFIRVCWQYNQYSSSESSGEPSAATPGPVIRQRRLSRLGSFKELIQFVDKKEEEIKKTMKRRSSDKDSQAAGFSYAQSVASA

SEQ ID NO: 4421 - DNA, 1446 bp, Sorghum bicolor
  misc_feature: Ceres ANNOT ID no. 6037825
  misc_feature: Encodes the peptide sequence at SEQ ID NO 4422
atgatggaccaccgagacgtgatgttgcccttgtccctccgaaccctagccacccgtacccttctcctgctcgtcatcgcgtccgccgtttcctgctcttgcttgccgccggaggacggcatccgggtcgtctctgcagagaaaaggatcgacctcatgggtcccatcgtcaaagtcttcctaacattgaaggttgagaatgctcccactgcctctgaagcatcaggagttcttctcgcgttcacgcccacagaggctcaacatctctctattgccaaagccacaagagtggaggggaagcgcaagaagaaggcattcatacccctctcgatcacagcttctgagctcaccaccaccgctcctgatgcccctcgcctctactctgttctgctcagcactcctctgaaacctggcgatgcaaccactctagaagtgttatacatgctcactcactctttggagccctttcccgctgagattagccagtcagagtcccagctggtttactaccgtgacagtgcagtgcttctctccccctaccatgtcctggagcaggttacctatatcaaaatgccaagcaataggattgaatccttcacaagggttgatcctaccacacgggctggttctgaagtgaaatatggcacatacaataaccagatgccaaactcctatttgccaattcttgtgcattatgagaataaccgtccatttgctgttgttgaggaacttgtacgcaaggtggagatttctcactggggaaacatccaaatcaccgagcagtataaactgaaacacggcggtgctcgtcacaaaggagtcttttccaggcttgagtatcagtctaggccatctgtcagtggagcttcgtcctttaagaatcttcttgcaaggctgccacctcgggttcattcagtttactatcgtgatgagattggtaacatctcctcatcccacctgcgcaccgattcacacaagtctgagctagaaattgagcccagatatccattatttggtggctggcattgcacgttcaccattggctatggtcttccattgcaagattttgtgttcgagtcagttgatggccggcgctacatcaaccttacttttggttgccctctattggatactgtggttgatgatcttacagttaaagttgtgcttcctgaaggatcaaaaaatccacagcctgtagttccttttgtgacagagaaacatcttgagactagttattcataccttgacgttgttggaaggacgacagttgtactgaagaagaaaaatgttgtaggagagcacaacgttcctttccaggtgtactatgaattcaatccgatcttcatgctggcagaaccattgatgctgatatctgcagtgttgctgttttttgttgccttcattgcctaccttcacatggatctttccatcagaaaatcatcatag

SEQ ID NO: 4422 - protein, 481 aa, Sorghum bicolor
  misc_feature: Ceres ANNOT ID no. 6037825
  misc_feature (40)..(472): Pfam Id: Ribophorin_I Pfam Desc: Ribophorin I
  misc_feature (21)..(480): NCBI GI: 140064986 NCBI Desc: ribophorin i [medicago truncatula]
  misc_feature (43)..(481): NCBI GI: 92875103 NCBI Desc: ribophorin i [medicago truncatula]
  misc_feature (10)..(481): NCBI GI: 115463069 NCBI Desc: os05g0301500 [oryza sativa (japonica cultivar-group)]
  misc_feature (22)..(479): NCBI GI: 28277278 NCBI Desc: mgc52808 protein [xenopus laevis]
  misc_feature (21)..(479): NCBI GI: 47523726 NCBI Desc: ribophorin i [sus scrofa]
MMDHRDVMLPLSLRTLATRTLLLLVIASAVSCSCLPPEDGIRVVSAEKRIDLMGPIVKVFLTLKVENAPTASEASGVLLAFTPTEAQHLSIAKATRVEGKRKKKAFIPLSITASELTTTAPDAPRLYSVLLSTPLKPGDATTLEVLYMLTHSLEPFPAEISQSESQLVYYRDSAVLLSPYHVLEQVTYIKMPSNRIESFTRVDPTTRAGSEVKYGTYNNQMPNSYLPILVHYENNRPFAVVEELVRKVEISHWGNIQITEQYKLKHGGARHKGVFSRLEYQSRPSVSGASSFKNLLARLPPRVHSVYYRDEIGNISSSHLRTDSHKSELEIEPRYPLFGGWHCTFTIGYGLPLQDFVFESVDGRRYINLTFGCPLLDTVVDDLTVKVVLPEGSKNPQPVVPFVTEKHLETSYSYLDVVGRTTVVLKKKNVVGEHNVPFQVYYEFNPIFMLAEPLMLISAVLLFFVAFIAYLHMDLSIRKSS

SEQ ID NO: 4423 - DNA, 1206 bp, Sorghum bicolor
  misc_feature: Ceres ANNOT ID no. 6037841
  misc_feature: Encodes the peptide sequence at SEQ ID NO 4424
atggccaagacatctcttcctcctggattccggtttcatccaactgatgtagaactcacagtctactatttaaagaggaagctactgggaaaacacttacgctgcaatgctattactgagattgatctatacaagttcgccccttgggatcttccagagagagcttccttggagagtaatgatctagtgtggtatttcttttgcccacgcgataggaaatattctagtgggttaaggactaatcgctcaactggagttggatattggaaagctaccgggaaggacaggccggtggtatataatgctaggactgttgggatgaagagaactttagtgtttcatcttggcaagccaccacgaggtgatagaactgactgggtaatgtacgaatataggctggaggacgaggaactagctgcttctggtgttaaactggatgcctgcgttctatgcaaaatctttcagaaaagtggtccagggcccaagactggggcacagtatggtgctccattcaacgaagaagactggaacgatgccagcaatgtagaatgttctccatgtgccccttctgtggcccctcgggtacctgaatcaagtaatggtgtgttgaattctgctggtcaacacctggctgtgagttatgatggcaaggtttcctcgggctccgcagcagaaagtatcaacagacctgctatcaatggagttcatcctgatattcctaatgattgcatacacatacaactgctagctgagattatcagatgttcctcgatgcatcttttatgtactggtggtgaagatggtttgctgcctgattcaactgctgactatgatagtgacaatagagtgtctttggatgatgttgaaacaatattctgtgaggtggatgagcttgggccccatgctctggtgaacaacactaaccattgtgactcatgtgctgaacatttgattcaccctgtgctggtagcacgaggagccgagcagtacttagagctaaatgacctgtccttttctctcactgatggtcctggttcctgtggcatgctgttttccaacgatgtatctgttgagcagccaccagatcttgagctcaggtttgagcaggtctctccagcccacatctccaataccgctaatgcttccacatcaacaactgctggttcatctgcttcagtacccttggcggaggatcacaggacctga

SEQ ID NO: 4424 - protein, 401 aa, Sorghum bicolor
  misc_feature: Ceres ANNOT ID no. 6037841
  misc_feature (6)..(134): Pfam Id: NAM Pfam Desc: No apical meristem (NAM) protein
  misc_feature (1)..(361): NCBI GI: 53981732 NCBI Desc: unknow protein [oryza sativa (japonica cultivar-group)]
  misc_feature (1)..(219): NCBI GI: 7716952 NCBI Desc: nac1 [medicago truncatula]
  misc_feature (1)..(230): NCBI GI: 92878398 NCBI Desc: no apical meristem (nam) protein [medicago truncatula]
  misc_feature (6)..(205): NCBI GI: 21105732 NCBI Desc: nam-like protein 2 [petunia x hybrida]
  misc_feature (5)..(178): NCBI GI: 6456751 NCBI Desc: nac2 [arabidopsis thaliana]
  misc_feature: The sequence is a functional homolog of SEQ ID NO 58 in the 10/666,642US patent application
  misc_feature: The sequence is a functional homolog of SEQ ID NO 582 in the 10/666,642US patent application
  misc_feature: The sequence is a functional homolog of SEQ ID NO 853 in the 10/374,780US patent application
  misc_feature: Useful for making plants with modulated growth and phenotype characteristics
  misc_feature: The sequence is a functional homolog of SEQ ID NO 853 in the 20060162006 US patent application
  misc_feature: The sequence is a functional homolog of SEQ ID NO 58 in the 20070033671 US patent application
  misc_feature: The sequence is a functional homolog of SEQ ID NO 582 in the 20070033671 US patent application
  misc_feature: The sequence is a functional homolog of SEQ ID NO 891 in the 10/374,780 US patent application
  misc_feature: The sequence is a functional homolog of SEQ ID NO 853 in the 10/374,780 US patent application
  misc_feature: The sequence is a functional homolog of SEQ ID NO 2478 in the 10/374,780 US patent application
  misc_feature: The sequence is a functional homolog of SEQ ID NO 572 in the 10/225,066 US patent application
  misc_feature: Useful for making plants with modulated oxidative stress sensitivity
  misc_feature: Functional homolog of the protein sequence given in SEQ ID NO 13621
  misc_feature: Useful for making plants with altered lignin content
  misc_feature: Functional homolog of the protein sequence given in SEQ ID NO 13250
  misc_feature: The sequence is a functional homolog of SEQ ID NO 808 in the 10/225,066 US patent application
  misc_feature: The sequence is a functional homolog of SEQ ID NO 926 in the 11/435,388 US patent application
  misc_feature: The sequence is a functional homolog of SEQ ID NO 98 in the 10/374,780 US patent application
  misc_feature: The sequence is a functional homolog of SEQ ID NO 2346 in the 10/374,780 US patent application
  misc_feature: The sequence is a functional homolog of SEQ ID NO 238 in the 10/225,068 US patent application
  misc_feature: The sequence is a functional homolog of SEQ ID NO 338 in the 10/412,699 US patent application
  misc_feature: The sequence is a functional homolog of SEQ ID NO 774 in the 11/479,226 US patent application
  misc_feature: The sequence is a functional homolog of SEQ ID NO 2060 in the 10/374,780 US patent application
  misc_feature: The sequence is a functional homolog of SEQ ID NO 516 in the 10/412,699 US patent application
  misc_feature: Useful for making plants with modulated water use efficiency
  misc_feature: Functional homolog of the protein sequence given in SEQ ID NO 13869
  misc_feature: Useful for making plants with modulated light quality response
  misc_feature: Functional homolog of the protein sequence given in SEQ ID NO 13870
  misc_feature: The sequence is a functional homolog of SEQ ID NO 890 in the 10/374,780 US patent application
  misc_feature: Useful for making plants with modulated nitrogen use efficiency
  misc_feature: Functional homolog of the protein sequence given in SEQ ID NO 13624
  misc_feature: The sequence is a functional homolog of SEQ ID NO 26 in the 10/286,264 US patent application
  misc_feature: The sequence is a functional homolog of SEQ ID NO 336 in the 10/412,699 US patent application
  misc_feature: The sequence is a functional homolog of SEQ ID NO 770 in the 11/479,226 US patent application
  misc_feature: The sequence is a functional homolog of SEQ ID NO. 362 in the 11/188,298 US application
  misc_feature: The sequence is a functional homolog of SEQ ID NO. 466 in the 11/188,298 US application
  misc_feature: The sequence is a functional homolog of SEQ ID NO. 335 in the 11/188,298 US application
MAKTSLPPGFRFHPTDVELTVYYLKRKLLGKHLRCNAITEIDLYKFAPWDLPERASLESNDLVWYFFCPRDRKYSSGLRTNRSTGVGYWKATGKDRPVVYNARTVGMKRTLVFHLGKPPRGDRTDWVMYEYRLEDEELAASGVKLDACVLCKIFQKSGPGPKTGAQYGAPFNEEDWNDASNVECSPCAPSVAPRVPESSNGVLNSAGQHLAVSYDGKVSSGSAAESINRPAINGVHPDIPNDCIHIQLLAEIIRCSSMHLLCTGGEDGLLPDSTADYDSDNRVSLDDVETIFCEVDELGPHALVNNTNHCDSCAEHLIHPVLVARGAEQYLELNDLSFSLTDGPGSCGMLFSNDVSVEQPPDLELRFEQVSPAHISNTANASTSTTAGSSASVPLAEDHRT

SEQ ID NO: 4425 - DNA, 1491 bp, Sorghum bicolor
  misc_feature: Ceres ANNOT ID no. 6037849
  misc_feature: Encodes the peptide sequence at SEQ ID NO 4426
  misc_feature: Up-regulated in shoot tissues in response to methyl jasmonate treatment
  misc_feature: Up-regulated in root tissues in response to methyl jasmonate treatment
  misc_feature: Up-regulated in shoot tissues in response to salicylic acid treatment
atgctgcttctcttcctctccctcttggtgcttctgccattgccccccctcccccacgcatccgccgacgccgacatctgcatcgtcggcggtggcatctccggcgcctccaccgccttcttcctcaccaactacaccacctccctcgctggagcgcagctgcgcgtcttcgagcgccgtcacaaggtgggcggccgcctcggcaccgtcactctcgcgggcgacagcttcgaggccgggggctccattatccacccccgcaacctccacgcgcgccgcttcaccgacctcctgggcctcgccgccaaggccggcggcgacgacgacgactggctagggatctgggacggcaaaagcttcatcttccagacgctccgcccaccgccaaccggcagctcctggtggcgtcgcaagctgcacagcctcgtcaactcgctgctgctgctcaggcgatatggcatgtccctgctcaagatggacaagtttgtccaggaaatgctgcaacggtttatgctcttctacaatggcttggagtctcgccctgtctttgacacggttgaggagatgctccaatggacgggtctctatggcctcacccgcaggacccttgaggaggagctgctcgatgccggcctcaacacccaaacaatagcagagcttgtcactgttatcacaaggatcaactatggccaaagcacacacataagtggcctggctggcgccgtgtctttagctggatctgagtcaggattatgggctgtcgaagggggcaactggcagctagctgctggattgctaaagacctctaacgcaaccttgcatcttcaagaaggcatcgactcaatcactgatgctggggattactatgttctgagatccaatactgggagcgaatacaactgtacggtgactgtagtggcaacaccacttgacgaggtgaacattacgtttagccctccaatctccattccgctgaggaagatgcagcacacacatgcgacctttgtcagaggcctattgaaccctgtatattttggtctaaactcagcatcaaatattccagagctgattggcaccctagagctccctgatatccctttctcgtgcatctcagttctgaagaggtacagcgaagatgacatggcctacaagatgttctcacgtgcaaagctggatgatggtttactggatcagatattcagcaagaggaaagagacgatccggataaactgggctgcttacccgcactaccaagcccccgaagagtttgctccgatagtgctggacgggaagcagctgtactacgtgaacacctttgagagcgcggcgagcgccatagagacgggtgccgtggcagcagagaatgtggcacggctcatcatttcgaggcgttctctaccgcagcgaggagtggagcctgatgctcctcatatcaagccattcgcggagcaggaggaagaaggatcccagcgtcggcatgtagacctgtga

SEQ ID NO: 4426 - protein, 496 aa, Sorghum bicolor
  misc_feature: Ceres ANNOT ID no. 6037849
  misc_feature (135)..(475): Pfam Id: Prenylcys_lyase Pfam Desc: Prenylcysteine lyase
  misc_feature (25)..(459): Pfam Id: DAO Pfam Desc: FAD dependent oxidoreductase
  misc_feature (33)..(461): Pfam Id: Amino_oxidase Pfam Desc: Flavin containing amine oxidoreductase
  misc_feature (8)..(164): NCBI GI: 38567840 NCBI Desc: osjnbb0020j19.18 [oryza sativa (japonica cultivar-group)]
  misc_feature (1)..(345): NCBI GI: 33620751 NCBI Desc: prenylcysteine oxidase 1 [homo sapiens]
  misc_feature (1)..(345): NCBI GI: 4240305 NCBI Desc: kiaa0908 protein [homo sapiens]
  misc_feature (26)..(346): NCBI GI: 62858765 NCBI Desc: pcyox1 [xenopus tropicalis]
  misc_feature (1)..(345): NCBI GI: 37183244 NCBI Desc: pcl1 [homo sapiens]
  misc_feature: Up-regulated in shoot tissues in response to methyl jasmonate treatment
  misc_feature: Up-regulated in root tissues in response to methyl jasmonate treatment
  misc_feature: Up-regulated in shoot tissues in response to salicylic acid treatment
MLLLFLSLLVLLPLPPLPHASADADICIVGGGISGASTAFFLTNYTTSLAGAQLRVFERRHKVGGRLGTVTLAGDSFEAGGSIIHPRNLHARRFTDLLGLAAKAGGDDDDWLGIWDGKSFIFQTLRPPPTGSSWWRRKLHSLVNSLLLLRRYGMSLLKMDKFVQEMLQRFMLFYNGLESRPVFDTVEEMLQWTGLYGLTRRTLEEELLDAGLNTQTIAELVTVITRINYGQSTHISGLAGAVSLAGSESGLWAVEGGNWQLAAGLLKTSNATLHLQEGIDSITDAGDYYVLRSNTGSEYNCTVTVVATPLDEVNITFSPPISIPLRKMQHTHATFVRGLLNPVYFGLNSASNIPELIGTLELPDIPFSCISVLKRYSEDDMAYKMFSRAKLDDGLLDQIFSKRKETIRINWAAYPHYQAPEEFAPIVLDGKQLYYVNTFESAASAIETGAVAAENVARLIISRRSLPQRGVEPDAPHIKPFAEQEEEGSQRRHVDL

SEQ ID NO: 4427 - DNA, 1998 bp, Sorghum bicolor
  misc_feature: Ceres ANNOT ID no. 6037861
  misc_feature: Encodes the peptide sequence at SEQ ID NO 4428
atggcgttcggccacacacggctcgatgtccggcgtgcgccgcagtcctcctacttctcctgctccacaaccaccgtcgccgtattcgtcgctctctgcctggttgctgtgtggatggcatcgtccatgctcgtcacccctaccgaattctctccatttcagcccaaagtccgtccattgccgcctcaagactcacctcctgacaccggaagcttaaccagtgctggtcaggatgatggcatccgtgaaatggaacgggatgtgcccgttgatccaccacctgttacacaacaattgcctcctgtaacagacagcatggataagcgcggaccatggcaaacgaaggctgcacaatctaacaaggacgctaaggagcaaaccttgacgtccagtagcccagtgagctttacttgggtgctatgcaacgtcgacgctggaacagattatattccatgccttgacaacacagaagctatcaagaagctccgttccaccaagcactacgaacatcgagaaaggcattgccccgagaaacctcctacctgccttgttcctctaccagagggctacaggaatcgaataaggtggcctaagagcagagatcagatatggtacaacaatgttcctcatactaagctggttgaatacaagggacaccaaaactgggttaaggtttctggagagtacctcatcttcccgggaggtgggactcagtttaaacatggtgcgttgcactacattgattttattcaggaggcaaagaaggacgtagcatggggaaaacgaagtcgtgtagttttagatgttggctgtggagtagctagcttcggaggatatctatttgacagagatgtgattactatgtcatttgcacctaaagatgagcatgaagctcaggttcaatttgctcttgaaagaggaatacctgctatatcagctgttatgggtacaaaaaggctcccattttccagcagggtctttgatgttgttcattgtgcacgatgtagggtaccatggcatattgaaggcggtaaactcttgcttgaactggacagactgttgcgtcctggtggttactttgtgtggtctgctacacctgtataccagaagctgcccgaagatgttgagatatggcaagccatgtctgctctaaccagttcaatgtgctggaaaatggtcaacaaagtaaaggatagggtgaatagagtgggtatagcaatttacagaaagccaacagacaacagctgctacgaagcaagatctgaaacaaaccctccactctgtggagagtatgatgatcctgatgctgcctggaacatatcgttgggggcttgtatgcataagttgcctgtagatcctaccattcgtggttcacagtggcctgagttatggccactgagactggagaagccaccttattggctgagaggttctgaggctggagtatatgggaaacctgccccagaggatttccaagcagactatgaacactggaagcgagttgtgagcaattcatacatgaatggtttgggtattgattggtcttctgttagaaatgttatggatatgaaagctgtatatgcagggttcgcagcagctttgcgcaatctcaaggtgtgggtcatgaatgtggttccaattgattcacccgacacgcttccaattatatatgaacgtgggctgtttggactgtaccatgactggtgtgagtcgtttagcacctatccgaggacttacgatcttctgcatgctaaccatctgttctccaaggttaagaagaggtgcgaactattacctgttatcgtggaagtggatcgggtgttgaggccagaaggccggctaattgtcagagacaacattgaaacaataagtgaggtggagaacattgtgaaatctctccactgggaggtccacatgtcttactcccaggataaagaaggcttgctgtttgtgcaaaagacgacatggcgaccaaatgaaactgaagataagctatga

SEQ ID NO: 4428 - protein, 665 aa, Sorghum bicolor
  misc_feature: Ceres ANNOT ID no. 6037861
  misc_feature (267)..(362): Pfam Id: Methyltransf_11 Pfam Desc: Methyltransferase domain
  misc_feature (1)..(665): NCBI GI: 115461536 NCBI Desc: os04g0692400 [oryza sativa (japonica cultivar-group)]
  misc_feature (1)..(634): NCBI GI: 38567836 NCBI Desc: osjnbb0020j19.14 [oryza sativa (japonica cultivar-group)]
  misc_feature (104)..(662): NCBI GI: 115441471 NCBI Desc: os01g0883900 [oryza sativa (japonica cultivar-group)]
  misc_feature (74)..(662): NCBI GI: 10176951 NCBI Desc: ankyrin-like protein [arabidopsis thaliana]
  misc_feature (77)..(662): NCBI GI: 21928175 NCBI Desc: at5g64030/mbm17_13 [arabidopsis thaliana]
  misc_feature: The sequence is a functional homolog of SEQ ID NO 484 in the 11/435,388US patent application
  misc_feature: Useful for making plants with modulated growth and phenotype characteristics
  misc_feature: The sequence is a functional homolog of SEQ ID NO 484 in the 20060272060 US patent application
  misc_feature: The sequence is a functional homolog of SEQ ID NO 484 in the 11/435,388 US patent application
  misc_feature: The sequence is a functional homolog of SEQ ID NO 508 in the 11/435,388 US patent application
  misc_feature: The sequence is a functional homolog of SEQ ID NO 562 in the 10/412,699 US patent application
  misc_feature: The sequence is a functional homolog of SEQ ID NO 626 in the 11/435,388 US patent application
  misc_feature: The sequence is a functional homolog of SEQ ID NO 198 in the 10/666,642 US patent application
MAFGHTRLDVRRAPQSSYFSCSTTTVAVFVALCLVAVWMASSMLVTPTEFSPFQPKVRPLPPQDSPPDTGSLTSAGQDDGIREMERDVPVDPPPVTQQLPPVTDSMDKRGPWQTKAAQSNKDAKEQTLTSSSPVSFTWVLCNVDAGTDYIPCLDNTEAIKKLRSTKHYEHRERHCPEKPPTCLVPLPEGYRNRIRWPKSRDQIWYNNVPHTKLVEYKGHQNWVKVSGEYLIFPGGGTQFKHGALHYIDFIQEAKKDVAWGKRSRVVLDVGCGVASFGGYLFDRDVITMSFAPKDEHEAQVQFALERGIPAISAVMGTKRLPFSSRVFDVVHCARCRVPWHIEGGKLLLELDRLLRPGGYFVWSATPVYQKLPEDVEIWQAMSALTSSMCWKMVNKVKDRVNRVGIAIYRKPTDNSCYEARSETNPPLCGEYDDPDAAWNISLGACMHKLPVDPTIRGSQWPELWPLRLEKPPYWLRGSEAGVYGKPAPEDFQADYEHWKRVVSNSYMNGLGIDWSSVRNVMDMKAVYAGFAAALRNLKVWVMNVVPIDSPDTLPIIYERGLFGLYHDWCESFSTYPRTYDLLHANHLFSKVKKRCELLPVIVEVDRVLRPEGRLIVRDNIETISEVENIVKSLHWEVHMSYSQDKEGLLFVQKTTWRPNETEDKL

SEQ ID NO: 4429 - DNA, 732 bp, Sorghum bicolor
  misc_feature: Ceres ANNOT ID no. 6037864
  misc_feature: Encodes the peptide sequence at SEQ ID NO 4430
atggcgtcgtcgaagctgcagctgccggctgacgacagcgtcctcctgctcgtcacccactccaatctctccaccttcgcagccgacatccgcgtctcgcaacagaccaccgtcgaggcgctcaaggacaagctctggcgcaagaccggcaccgccgtcgcctccatgcgtctccagctccgcgacgacaccggcgccaagatcgccgacctcgatgacgacgccgcgccgctcgcggcctacgccccctacaacggctaccggatccatgttgttgatctcgatccttcctcactcacctcgggtggctggttggaagacacttcccttgtcgacaagtacaaaatgtccgatgaagcatacgataagctcgacactaactttcgaaaattcaaagaaaagatggtcccgaaaaactctccgtcagaggataaagaacaattagaaaagcatatggaggaactatgctccaaaatcaaggtgggagatagatgtgaagtcgaacctggtgccaagaggggcactgtaaaatttgttggtagagctgaagcccttggacgtggattctgggttggagtgcaatatgatgagccacttggaaagcatgatggcatggtgaaaggcattcgcttctttgagtgccctcaaggtcatggggcaattgtgagaccagagaaagtaaaggttggcgacttcccggagagagacccatttgaagatgacgagatatag

SEQ ID NO: 4430 - protein, 243 aa, Sorghum bicolor
  misc_feature: Ceres ANNOT ID no. 6037864
  misc_feature (161)..(228): Pfam Id: CAP_GLY Pfam Desc: CAP-Gly domain
  misc_feature (2)..(243): NCBI GI: 115461530 NCBI Desc: os04g0692100 [oryza sativa (japonica cultivar-group)]
  misc_feature (1)..(243): NCBI GI: 51970674 NCBI Desc: tubulin folding cofactor b [arabidopsis thaliana]
  misc_feature (1)..(243): NCBI GI: 20514259 NCBI Desc: tubulin folding cofactor b [arabidopsis thaliana]
  misc_feature (1)..(243): NCBI GI: 51971605 NCBI Desc: tubulin folding cofactor b [arabidopsis thaliana]
  misc_feature (3)..(145): NCBI GI: 106879611 NCBI Desc: tubulin-folding cofactor [plantago major]
MASSKLQLPADDSVLLLVTHSNLSTFAADIRVSQQTTVEALKDKLWRKTGTAVASMRLQLRDDTGAKIADLDDDAAPLAAYAPYNGYRIHVVDLDPSSLTSGGWLEDTSLVDKYKMSDEAYDKLDTNFRKFKEKMVPKNSPSEDKEQLEKHMEELCSKIKVGDRCEVEPGAKRGTVKFVGRAEALGRGFWVGVQYDEPLGKHDGMVKGIRFFECPQGHGAIVRPEKVKVGDFPERDPFEDDEI

SEQ ID NO: 4431 - DNA, 1041 bp, Sorghum bicolor
  misc_feature: Ceres ANNOT ID no. 6037865
  misc_feature: Encodes the peptide sequence at SEQ ID NO 4432
atggaggacggcggcaaggcgccggccagcctgggcaccctgcgcgcggtgctcgccatcctccagtggtggggcttcaacgtcaccgtcatcatcatgaacaagtggatcttccagaaactggatttcaagtttcctctcaccgtgtcctgtgtccacttcatctgctcttcaattggagcttacattgcaatccatgtgcttaaggcgaaaccgctgattcaagttgaaccggaggaccgctggaagcggatatttccaatgtcgttcgtcttctgcataaacattgtgctgggaaatgtgagcctgcgctacattccagtctccttcatgcagacaatcaaatctttcactcctgcaaccacagttattctgcagtggctagtctggaataagcatttcgagtggcgcatatgggcttcgctcgtccccatagttgggggaatactcctgacttcggtgacagagcttagcttcaacatttttggtttttgtgctgccatggttggctgcctggctacatctacaaagaccatcttggcagagtccctgctccatggatacaaatttgacagcattaacacggtgtactacatggcaccctttgccaccatgatactggctctaccagcaatgttgcttgaaggaggtggtgtaatcaactggttctacacacatgattccatcgtttctgcgttgattatcatcctaggttcaggggtgcttgcgttttgccttaacttctccatcttctatgtcatccattcaacgacagcagtgactttcaacgttgctggcaaccttaaagttgcggtggctgtgttagtgtcatggttgatcttccggaatccaatctctgcaatgaatgcaattggatgtggaatcaccctggttggttgcactttctatggctacgtgaggcatctgatctcacaacggcaggctgcagccccagggagtccaggaacagcgcctgcgaacctttcaagaaatcagatggaaatgcttccccttgtggacaacaagcaagaaaaggtttag

SEQ ID NO: 4432 - protein, 346 aa, Sorghum bicolor
  misc_feature: Ceres ANNOT ID no. 6037865
  misc_feature (163)..(305): Pfam Id: TPT Pfam Desc: Triose-phosphate Transporter family
  misc_feature (16)..(311): Pfam Id: UAA Pfam Desc: UAA transporter family
  misc_feature (15)..(344): NCBI GI: 29329825 NCBI Desc: gonst5 golgi nucleotide sugar transporter [arabidopsis thaliana]
  misc_feature (9)..(303): NCBI GI: 9759107 NCBI Desc: phosphate/phosphoenolpyruvate translocator protein-like [arabidopsis thaliana]
  misc_feature (9)..(303): NCBI GI: 52421287 NCBI Desc: at5g05820 [arabidopsis thaliana]
  misc_feature (20)..(303): NCBI GI: 61651608 NCBI Desc: plastidic phosphate translocator-like protein2 [mesembryanthemum crystallinum]
  misc_feature (13)..(304): NCBI GI: 21536504 NCBI Desc: phosphate/phosphoenolpyruvate translocator-like protein [arabidopsis thaliana]
  misc_feature: The sequence is a functional homolog of SEQ ID NO. 360 in the 11/188,298 US application
  misc_feature: The sequence is a functional homolog of SEQ ID NO. 484 in the 11/188,298 US application
MEDGGKAPASLGTLRAVLAILQWWGFNVTVIIMNKWIFQKLDFKFPLTVSCVHFICSSIGAYIAIHVLKAKPLIQVEPEDRWKRIFPMSFVFCINIVLGNVSLRYIPVSFMQTIKSFTPATTVILQWLVWNKHFEWRIWASLVPIVGGILLTSVTELSFNIFGFCAAMVGCLATSTKTILAESLLHGYKFDSINTVYYMAPFATMILALPAMLLEGGGVINWFYTHDSIVSALIIILGSGVLAFCLNFSIFYVIHSTTAVTFNVAGNLKVAVAVLVSWLIFRNPISAMNAIGCGITLVGCTFYGYVRHLISQRQAAAPGSPGTAPANLSRNQMEMLPLVDNKQEKV

SEQ ID NO: 4433 - DNA, 5751 bp, Sorghum bicolor
  misc_feature: Ceres ANNOT ID no. 6037877
  misc_feature: Encodes the peptide sequence at SEQ ID NO 4434
  misc_feature: Up-regulated in root tissues in response to salicylic acid treatment
  misc_feature: Up-regulated in root tissues in response to methyl jasmonate treatment
  misc_feature: Up-regulated in shoot tissues in response to methyl jasmonate treatment
atggcggagtcggggaaggaggccgccgccgccgccgccgccgcccccgagcccgggtccggcccgccgcacgaggacgaggatgcgctgctcgcccgcgcccacaccgtcatctccaggatcctcgaccgcgagctcgaccccaacccccgcctcctccacaccctcgccaccatgtgcgagctccacgaagccagatatattgagttatgtgcagctgacccaacgttcaataacacaaacacaaggaccacatctacaattgggaagctggccaatttgctccgggacaatgacgagttttacgagttggtgttttgtaagttcttgtcagacacctcctactctgttgctgtacgtgctgccgctgctaggctgctcctgagctgtcaatctgcctggacgcctccatatccccacgtctttgaagactctatcatagataatattaaaaagtgggtaacggaggatcctgaagcgtctaatgaatgtgaatggaagtatctaggaaaaaataaacccacagatgctgagatgctgagaacatatgcgatcgggttgctcgctatggctttgtgcagcggtgggcaattggtagaggatgtcttgactttgggggtatcagcgaagctcatgcgttttttgcgcataagagtccttggggattcctcatcttctcagagagatgctaatcatccacaagacaccaagtatcctcgaggcagagacgatagtaggggtaaatctcgtctggcccaagatggttctcgattggatggaacaagggttgggtatggagtattattaaccaacccaacagcagagaaggacaatgagcctggtgttggaatgaggcaagcatatggagaaaggtcattggatgacactgttgcttcattggataattctgatgtccccgaggctgattggaccaatgatcggtgttatggcacaagtgtttgtgacacaaagtcaaaatatggggaaaaaaattctgtgacgaggcttcttaaagatgaagagatcagtgaaaatggcgaagtgttgaaaagaaagctgggtcgagcgccctcgcgacttagagtgaagggaaaatcaggagacaacttgcctgaatgtgaaatgacacctttatcaccaacctctggattgagaataggaggtcggcctactagagacaggaatgtggtgagggttgatgatccaaagaaggcaactgatgtgaacaatagatctgcaggcctcgagtcgtttagcgctatttccaaagaagaatacgaggatcggttcagggattgcattattggtttgaaggatatatctgacattgttttgaaggcagtgagagctgctgaggctgaggccagatcagcaaatgcacctgatgaagctgtgaaagcagcaggtgatgctgctgccgagcttgtgaaatctgctgctttggaggtttggaaaagcgaaaataatagtgatgcagttgtagtagcggcagagaaagctgcatctgctgttgttgaggctgcagtgtcaactagtgtctcacgaagtgcaaatcaagttggtgaagagcgtgcagtggaagaagctgtccaaaccagtgaagaccaggatttggaaaattttgttatcagtgacaaagcacagctcttacaacttagagaaaaatatagcatccagtgtctacagattttgggagaatatgttgaagctttgggtcctgttctccatgaaaaaggtgttgatgtttgcctcacgttattgcaaaggggcatgaaagatcaggagggacgtgaccactttgctcaactccctgatgtccttaaattaatttgtgcactggctgctcatcgaaaatttgctgcactctttgttgatcgtggtggtattcagaagatcctttctattcctagaattacccagacatatatgggtctttctgcctgcttattcacttttgggtctcttcagtctaccatggaacgtgtttgtgcgctttcctctgacacacttgacagtgttgttgaattagcacttcaacttcttgagtgcccacaagatttagctagaaaaaatgtggccatctttttcgctgctgcttttgtgttcaaagctgttctggatctatttgatgcccgggatgggatgcaaaagcttctcgatatcctatgtggatgtgcatctggaaggtctggcagtaattctggaggagcaggatcctccaatgtaaatcaaaggaatgatcgaccacctgctgaagttttaactgcatcagagaagcaagttgcataccatacttgtgttgctctacggcaatactttagagctcatctccttcagcttgttgattccattcggccaagcaaaagcatccgtagtattgcccggaatacttctagtgcaagagctggctacaaaccttttgacattagcaatgaagctatggatgctgtctttcgtcagatccagcgggacagaaagttaggccttgctcttgtgagagctcgttggcctgtgttggataaatttgttgcctcaaatggtcacatgactatgctggagttgtgtaagtttcaggcacatggtgatcggtatttgcgtgacttaactcaatatgcaattggagttcttcacatcataacacttatgccacagccacatgtccgcaaatcaatagtgcagggaacattaagcaacaatcgtgctggtatggctgttttattagacacggtgaaaagtctcgactatattgatcatgaggtgatctgtccagcactgaatgtcctcgtcaatcttgtatgcccacctccttctatcagcaacaaaccattgtcgactgccaatcagcaacctgcagctgcgcaagcgcttgcttcagaaagcagagataagaactttgaaaaaagtattttagataggaatctacttgcaaatcagggtgaatctcgtgaaagatctggtgatggcaaccctgctgaaaggaacaataccttgcatcaaggaactcctagcacacctgttgtgccatctggagtagtcggtgatcggagaataacactaggagttggaggtggtggtcctggtcttgctgctcaattggaacaaggatatcgtcaagctcgagaagttgtaagagccaataatggcataaaaattcttttacagcttcttggttctcggatggttacacatcctgtggctatagattctattcgagcccttgcctgccgtgtcctgcttggcctggctagagacgatacaattgcacatatactgacaaagctccaggtgggaaagaaattatcagaactgatccgtgataccagtgcccagacgtctgggggcgataatggaagatggcaggctgagctgacccaagtggcaattgaactaattgcggtattgacaaattctggaaaagaaacaacattagcggcaactgatgctgctgctccagcattgagacgcattgagcgagctgggatagccgctgctactcctatctcctatcactcaagggaactgatgcagttgatacatgaacatctccttgggtctggtttcactgccactgctgccatgctccagaaggaggctggccttgcacctttaccattgacagcagcagtgcttcctgcccaccaagttgctgccctggaagcatcatctgttcagcaacagtggccctctggacgtgttcagggatttctctcagataaaataaatatgtcgacagatcaatctgcccagagatcagattctatcctgccttcatctaagaaaaaggcactgaccttctcatccagtttctcacgaagagctctgtctccgcatcctatttctggtagcagagcaagcaacatccttaaaagtcctgtacctattgcggctgatattggagatgcagaaatgttgaataaaacaccactgtcgctgccacttaagaggaagcttgtggatgtgaaggataataattccgcatcagcatcgaagcgcctcgcagcaactgatcaaatgtaccaaccatctgcattccaaactcctgctcccactcgcaaaggtctgtcggttgcagtagattctcctacttcatttcaatgtggtcggacaaacttcaacaatatttctactgacaacttggacaattctcaaggcacaccaggagcattgaccactacagcacttcctggtgtgaatgatcaacaatcaggaaatttggagcgtatgacacttgactcactggttgtacaatacttgaaacatcaacaccgtcagtgtcctgctccagttacaactttgccaccactctctcttttgcaccctcatgtttgccctgagcctagtcgcagccttagtgcacctgcaaacatagctgctcgtatgggaagccgtgagataagtaggcaatttagtgggatacagatacctcgtagggatcgtcattttatatacagtaggttcaagcagtgtcgtgtttgtcgtgatgaggcatcactgttgacttgcatgacatttcttggagatgcatctcgagttgcagctggtaaccacacaggtgaattaaggatatttgactgcaacacggcaaatctcctagagactcaaacgtgccaccaacatcttgttacaatgatggagtcgacatattctggtggaaatgagctgattctcacatccagcctaaatgaggttaagatctgggatgcctactcgctatcagcagggcctttgcacacatttgatgactgcaaagctgctaggtttaaccactctggaacttcatttgctgccctttctactgatacagctcaacgggaggttcagttgtatgatgtacagacatatacccttgctacacggcttcctgataacactagcagttcaggttcaggccggggttacgtacaacccattatacatttcagtccttcagacacaatgttgctttggaatggagtgctgtgggatacgaggcaaccaactcctgttcatcagtttgaccagttcacagattactgtggtggtggattccatccagcaggaaatgaggtgatcttaaattcggaggtgtgggatctgaggaagtttaagcttttgaggagtgttccttccctggaccagacagtaataaagttcaatggaactggtgatgttatctatgccatcctgaggcgtaatcttgaggacgtgacagcatccatcaatgctcgtagggtcaggcaacctcttttccctgcattccgcacgattgatgcggtgacttactcagatattgcaaccgtccaaatcgaccgctgtgtacttgatcttgccactgagcccaatgattctcttattggggtggttgctatggacgatcaccaggagcttttctcttctgctcgtttgttcgaagttggcaggaagcggataactgatgatgattcagatccagaggacgcaggtgaatctgatgatgaggacgatgatgacaatgatgactctgatgatgatgttcttcttgcgccagtgctggaaggggatacagattctgaagagttaagcagcagtggcgatgatggtgatgaagatggtggcgacgatatccccagttcggatgacattgaagatgacccagagttcattgatgatggcggtgactttgaagggggaggggacttgatggatcttttgggtgacgatgaaggggaggacgacgagagtgatacgatggaatcctttagcagtggcgacgaggagggttggatcatgtag

SEQ ID NO: 4434 - protein, 1916 aa, Sorghum bicolor
  misc_feature: Ceres ANNOT ID no. 6037877
  misc_feature (1172)..(1198): Pfam Id: LisH Pfam Desc: LisH
  misc_feature (8)..(1916): NCBI GI: 90399257 NCBI Desc: b0518a01.3 [oryza sativa (indica cultivar-group)]
  misc_feature (8)..(1916): NCBI GI: 115461514 NCBI Desc: os04g0691200 [oryza sativa (japonica cultivar-group)]
  misc_feature (8)..(1874): NCBI GI: 32487488 NCBI Desc: osjnbb0020j19.2 [oryza sativa (japonica cultivar-group)]
  misc_feature (1306)..(1911): NCBI GI: 140043228 NCBI Desc: lissencephaly type-1-like homology motif; wd40-like [medicago truncatula]
  misc_feature (1326)..(1901): NCBI GI: 82571434 NCBI Desc: vprbp protein [homo sapiens]
  misc_feature: Up-regulated in root tissues in response to salicylic acid treatment
  misc_feature: Up-regulated in root tissues in response to methyl jasmonate treatment
  misc_feature: Up-regulated in shoot tissues in response to methyl jasmonate treatment
MAESGKEAAAAAAAAPEPGSGPPHEDEDALLARAHTVISRILDRELDPNPRLLHTLATMCELHEARYIELCAADPTFNNTNTRTTSTIGKLANLLRDNDEFYELVFCKFLSDTSYSVAVRAAAARLLLSCQSAWTPPYPHVFEDSIIDNIKKWVTEDPEASNECEWKYLGKNKPTDAEMLRTYAIGLLAMALCSGGQLVEDVLTLGVSAKLMRFLRIRVLGDSSSSQRDANHPQDTKYPRGRDDSRGKSRLAQDGSRLDGTRVGYGVLLTNPTAEKDNEPGVGMRQAYGERSLDDTVASLDNSDVPEADWTNDRCYGTSVCDTKSKYGEKNSVTRLLKDEEISENGEVLKRKLGRAPSRLRVKGKSGDNLPECEMTPLSPTSGLRIGGRPTRDRNVVRVDDPKKATDVNNRSAGLESFSAISKEEYEDRFRDCIIGLKDISDIVLKAVRAAEAEARSANAPDEAVKAAGDAAAELVKSAALEVWKSENNSDAVVVAAEKAASAVVEAAVSTSVSRSANQVGEERAVEEAVQTSEDQDLENFVISDKAQLLQLREKYSIQCLQILGEYVEALGPVLHEKGVDVCLTLLQRGMKDQEGRDHFAQLPDVLKLICALAAHRKFAALFVDRGGIQKILSIPRITQTYMGLSACLFTFGSLQSTMERVCALSSDTLDSVVELALQLLECPQDLARKNVAIFFAAAFVFKAVLDLFDARDGMQKLLDILCGCASGRSGSNSGGAGSSNVNQRNDRPPAEVLTASEKQVAYHTCVALRQYFRAHLLQLVDSIRPSKSIRSIARNTSSARAGYKPFDISNEAMDAVFRQIQRDRKLGLALVRARWPVLDKFVASNGHMTMLELCKFQAHGDRYLRDLTQYAIGVLHIITLMPQPHVRKSIVQGTLSNNRAGMAVLLDTVKSLDYIDHEVICPALNVLVNLVCPPPSISNKPLSTANQQPAAAQALASESRDKNFEKSILDRNLLANQGESRERSGDGNPAERNNTLHQGTPSTPVVPSGVVGDRRITLGVGGGGPGLAAQLEQGYRQAREVVRANNGIKILLQLLGSRMVTHPVAIDSIRALACRVLLGLARDDTIAHILTKLQVGKKLSELIRDTSAQTSGGDNGRWQAELTQVAIELIAVLTNSGKETTLAATDAAAPALRRIERAGIAAATPISYHSRELMQLIHEHLLGSGFTATAAMLQKEAGLAPLPLTAAVLPAHQVAALEASSVQQQWPSGRVQGFLSDKINMSTDQSAQRSDSILPSSKKKALTFSSSFSRRALSPHPISGSRASNILKSPVPIAADIGDAEMLNKTPLSLPLKRKLVDVKDNNSASASKRLAATDQMYQPSAFQTPAPTRKGLSVAVDSPTSFQCGRTNFNNISTDNLDNSQGTPGALTTTALPGVNDQQSGNLERMTLDSLVVQYLKHQHRQCPAPVTTLPPLSLLHPHVCPEPSRSLSAPANIAARMGSREISRQFSGIQIPRRDRHFIYSRFKQCRVCRDEASLLTCMTFLGDASRVAAGNHTGELRIFDCNTANLLETQTCHQHLVTMMESTYSGGNELILTSSLNEVKIWDAYSLSAGPLHTFDDCKAARFNHSGTSFAALSTDTAQREVQLYDVQTYTLATRLPDNTSSSGSGRGYVQPIIHFSPSDTMLLWNGVLWDTRQPTPVHQFDQFTDYCGGGFHPAGNEVILNSEVWDLRKFKLLRSVPSLDQTVIKFNGTGDVIYAILRRNLEDVTASINARRVRQPLFPAFRTIDAVTYSDIATVQIDRCVLDLATEPNDSLIGVVAMDDHQELFSSARLFEVGRKRITDDDSDPEDAGESDDEDDDDNDDSDDDVLLAPVLEGDTDSEELSSSGDDGDEDGGDDIPSSDDIEDDPEFIDDGGDFEGGGDLMDLLGDDEGEDDESDTMESFSSGDEEGWIM

SEQ ID NO: 4435 - DNA, 1638 bp, Sorghum bicolor
  misc_feature: Ceres ANNOT ID no. 6037884
  misc_feature: Encodes the peptide sequence at SEQ ID NO 4436
atgggctccactgccgccgcctccgtgctcccggtgtccgccggcaccggccagaacctcgtcctcatcctcgactacggctcgcagtacacccacctcatcacccgccgcgtgcgccagctcggcgtcctctccctatgcgtgtccggcacggcgccgctcgcctccctcgagggcctgcgcccgcgcgccgtcatcctctccggcgggccccactccgtccacgccccgggcgcgcctgcctttcccgaggggttcctggacttcgcggccgccgcgggcgcgcacgtgctcggcgtctgctacgggatgcagctcctcgtgcagtccctcggcggcgccgtcgtgcccggggagcgccaggagtacggcaagatggacgttcaggtgacggcggcctcctccgcgctctacggggaagcggagacggggaagcgccagacggtgtggatgagccatggcgacgaggtggtcacgctgccgcaaggctttgaggtggttgcgcgcagtgtgcagggcgccgtcgccgccatcgagtaccgggagaagcgcttttatgggctccaataccacccagaggttacacattcagcccaaggaatggaaacactgcgccgctttctttttgatgtttgtgggatcaaagctgattggaagatgcaagatgtgctcgatgaagaaatcaagaccatccaaagcaccgttggccctgatgagcatgttatctgtgcattgtcaggtggagttgattcgacggtcgcggccactctcgttcacaaggcaataggagataggcttcactgtgtttttgttgacaatggtctattgaggtacaaggagagagaacgagtaatgacaacctttgaaagtgatttgcacctgccagttacatgtgttgatgcctcagagcaatttctcagcaagttaaagggtgtcgaggacccagagcagaaaaggaagattattggcagggaattcatagctgtctttgatgactttgctcacaagctggaacagaagatagggaaaaggcctgaatatttagttcaagggactttgtaccctgatgtaattgaatcatgcccacctcctgggagtggaaggacacattcccacaccatcaaaagccatcacaatgtcggcggccttccaaaagatatgaagttaaaactcattgaaccactcaagctcctattcaaggatgaggtgcggaaattggggagtattttgaatgtcccagattcatttttgaagcgacacccatttcctgggcctggtcttgctgtacgtgtcctaggtgatgttacacaaggcaatgctttggaggttcttcgtcaggtggatgagatatttgttcaagctattaaagatgcaggcctctatgataaaatatggcaagcctttgctgttttcctgccagtacaaacagttggggttcagggtgaccagcgaacccattccaatgctgttgttttaagggcaatcaccagtgaggatggcatgactgcagattggtactattttgaccatgcattcctggtagatgtggtaaacaagatctgcaacaatgtgcggggcataaaccgtgtttgccaggacatcacatctaagccgcctgcaacggtggagtgggagtag

SEQ ID NO: 4436 - protein, 545 aa, Sorghum bicolor
  misc_feature: Ceres ANNOT ID no. 6037884
  misc_feature (452)..(544): Pfam Id: GMP_synt_C Pfam Desc: GMP synthase C terminal domain
  misc_feature (22)..(211): Pfam Id: GATase Pfam Desc: Glutamine amidotransferase class-I
  misc_feature (19)..(193): Pfam Id: Peptidase_C26 Pfam Desc: Peptidase C26
  misc_feature (10)..(545): NCBI GI: 28630437 NCBI Desc: gmp synthetase [chlamydomonas reinhardtii]
  misc_feature (21)..(545): NCBI GI: 108760981 NCBI Desc: gmp synthase [myxococcus xanthus dk 1622]
  misc_feature (21)..(545): NCBI GI: 94968820 NCBI Desc: gmp synthase [acidobacteria bacterium ellin345]
  misc_feature (21)..(545): NCBI GI: 115377691 NCBI Desc: gmp synthase (glutamine-hydrolyzing) [stigmatella aurantiaca dw4/3-1]
  misc_feature (21)..(545): NCBI GI: 86158770 NCBI Desc: gmp synthase [anaeromyxobacter dehalogenans 2cp-c]
  misc_feature (13)..(545): SWISSPROT Homolog: EC 6.3.5.2 GMP synthase [glutamine-hydrolyzing]
  misc_feature: The sequence is a functional homolog of SEQ ID NO. 469 in the 11/188,298 US application
MGSTAAASVLPVSAGTGQNLVLILDYGSQYTHLITRRVRQLGVLSLCVSGTAPLASLEGLRPRAVILSGGPHSVHAPGAPAFPEGFLDFAAAAGAHVLGVCYGMQLLVQSLGGAVVPGERQEYGKMDVQVTAASSALYGEAETGKRQTVWMSHGDEVVTLPQGFEVVARSVQGAVAAIEYREKRFYGLQYHPEVTHSAQGMETLRRFLFDVCGIKADWKMQDVLDEEIKTIQSTVGPDEHVICALSGGVDSTVAATLVHKAIGDRLHCVFVDNGLLRYKERERVMTTFESDLHLPVTCVDASEQFLSKLKGVEDPEQKRKIIGREFIAVFDDFAHKLEQKIGKRPEYLVQGTLYPDVIESCPPPGSGRTHSHTIKSHHNVGGLPKDMKLKLIEPLKLLFKDEVRKLGSILNVPDSFLKRHPFPGPGLAVRVLGDVTQGNALEVLRQVDEIFVQAIKDAGLYDKIWQAFAVFLPVQTVGVQGDQRTHSNAVVLRAITSEDGMTADWYYFDHAFLVDVVNKICNNVRGINRVCQDITSKPPATVEWE

SEQ ID NO: 4437 - DNA, 1092 bp, Sorghum bicolor
  misc_feature: Ceres ANNOT ID no. 6037892
  misc_feature: Encodes the peptide sequence at SEQ ID NO 4438
atggcaagatcaggcaacaacgtcgtcgtccatgtcctggtggccatggtcgtcctgtgggacggagccgcagcaggggcggcggcgttgcctctgcctgatttggagacgacgacgacgatgaacgacacggtcacggggagcttgtcggcggacttccatttggagtcgtgcccggacctgcatagcatggtgcggtccgccgtgcaggccgcgcggaaccaggacgtgcagatcaccgcgggcctcctgcgcatcttcttccacgactgcttcccgcaggggtgcgacgcgtcgctgctgctggacaagacccaccccggcagcgagcagcacgtccacccgcagaacgcgggcctgaaccacaaggcgctgcagctcatcgagagcatccgagacatggtgcacaggaggtgtggagaaagaagcgtctcgtgcgccgacatcctcgccgtcgcaaccagccacgccgtcaacctggccggtggccctttcatcaacatgcaactcggccaccgtgatagcgtggaccctgcacaaccatggcaagtgcagaccttgccggcccccaccgccgacgtcaccacgctcttcaacagcttcgccggcaagggcttcgtcaacgccatcgacgtagtggcgctctccggcgcccacaccgtcggcaaggcgcgctgcagctccttcagcgaccgcaccaacaaccccaacgacgacggcttcgccagggagctcgccgccttctgcgccggcgacggcaaccgccagcacaacctggacgtgatcacgccggactcgttcgacaacaggtactttgctgacctcatcaacaggaagggagtgctcacctccgaccaggcgctcaccaacgacggccgcaccgcctggatcgtcaacgtcttcgcccacgaccaggccaacttcttccaaaagtttgcgcaggccatggagaagatgagcaggctgacgagccccggaggcgtcaaagcccgccgcaactgcttcaagcgcgacgccggcgtcaacatccagaccaccgttgcagctgctggctcaggcgacgacgagagccagcttgcggcctctgcttga

SEQ ID NO: 4438 - protein, 363 aa, Sorghum bicolor
  misc_feature: Ceres ANNOT ID no. 6037892
  misc_feature (65)..(304): Pfam Id: peroxidase Pfam Desc: Peroxidase
  misc_feature (1)..(355): NCBI GI: 5777628 NCBI Desc: caa303716.1 protein [oryza sativa]
  misc_feature (49)..(363): NCBI GI: 55700991 NCBI Desc: tpa: class iii peroxidase 62 precursor [oryza sativa (japonica cultivar-group)]
  misc_feature (22)..(363): NCBI GI: 38345511 NCBI Desc: osjnba0039k24.14 [oryza sativa (japonica cultivar-group)]
  misc_feature (27)..(336): NCBI GI: 38345508 NCBI Desc: osjnba0039k24.10 [oryza sativa (japonica cultivar-group)]
  misc_feature (44)..(363): NCBI GI: 5777624 NCBI Desc: caa303712.1 protein [oryza sativa]
MARSGNNVVVHVLVAMVVLWDGAAAGAAALPLPDLETTTTMNDTVTGSLSADFHLESCPDLHSMVRSAVQAARNQDVQITAGLLRIFFHDCFPQGCDASLLLDKTHPGSEQHVHPQNAGLNHKALQLIESIRDMVHRRCGERSVSCADILAVATSHAVNLAGGPFINMQLGHRDSVDPAQPWQVQTLPAPTADVTTLFNSFAGKGFVNAIDVVALSGAHTVGKARCSSFSDRTNNPNDDGFARELAAFCAGDGNRQHNLDVITPDSFDNRYFADLINRKGVLTSDQALTNDGRTAWIVNVFAHDQANFFQKFAQAMEKMSRLTSPGGVKARRNCFKRDAGVNIQTTVAAAGSGDDESQLAASA

SEQ ID NO: 4439 - DNA, 879 bp, Sorghum bicolor
  misc_feature: Ceres ANNOT ID no. 6037901
  misc_feature: Encodes the peptide sequence at SEQ ID NO 4440
atgcggactcccgcgatgcgcgctgccacctccgcctccccatggacgatgaagaccctgccgatgctgggcaaccacctccgcgaccccacgcgcctcgccggcgcctcctcgtccttccacagcacgcccgcctccttcgccaagtggaggaataaatgggactgccacaagagcgaaaaaggagcacgaaaggcatccaggaattatgagaggtacgtggttcggcaaaaacgagcagaaggaaagaaggctctaaaagattatcttctttatggaaagtcatcgcctcatttgcaggatggaagcacaggtagctttgctaactcgcatgcaattccgaggttcaaaacgtttaggaaaggacctcaaactcactggtcatcgaagtctcagcaaagtgtacacaatcaaagaaagagtaaaaaggacaaggaaaggttctgcaacttcttccatgaggaccgttatgtgcaccctgatgacatctttgaagccatcttcggtgcacatcatggttttacttggtctcacatatcgtgggagggttttcacttcggggacaaatcgttcaaatttagatggagtggtggtgaatcacgcaagcagagaattccaagtgacagcgaagacgaagaaagcgagggaaatgagagcagggaaacaaccagcgttggttcacatgcgcacagggtcatccttggattaccaccatgtggtccactaactctagaagatgttaaaactgctttccgggcatctgctctgcggtggcatcctgacaggcacccagggtcatcacaggccatggctgaggagaagtttaagctgtgcgtgaacgcgtataattcactctgcagtgtcctcaaggctgcttag

SEQ ID NO: 4440 - protein, 292 aa, Sorghum bicolor
  misc_feature: Ceres ANNOT ID no. 6037901
  misc_feature (229)..(290): Pfam Id: DnaJ Pfam Desc: DnaJ domain
  misc_feature (6)..(292): NCBI GI: 38345831 NCBI Desc: osjnba0070m12.14 [oryza sativa (japonica cultivar-group)]
  misc_feature (99)..(292): NCBI GI: 5777634 NCBI Desc: caa303722.1 protein [oryza sativa]
  misc_feature (25)..(292): NCBI GI: 92876008 NCBI Desc: heat shock protein dnaj, n-terminal [medicago truncatula]
  misc_feature (245)..(285): NCBI GI: 118137586 NCBI Desc: chain a, solution structure of the j domain of dnaj homolog subfamily b member 8
  misc_feature (238)..(287): NCBI GI: 121077782 NCBI Desc: hsp40-like heat shock protein [volvox carteri f. nagariensis]
MRTPAMRAATSASPWTMKTLPMLGNHLRDPTRLAGASSSFHSTPASFAKWRNKWDCHKSEKGARKASRNYERYVVRQKRAEGKKALKDYLLYGKSSPHLQDGSTGSFANSHAIPRFKTFRKGPQTHWSSKSQQSVHNQRKSKKDKERFCNFFHEDRYVHPDDIFEAIFGAHHGFTWSHISWEGFHFGDKSFKFRWSGGESRKQRIPSDSEDEESEGNESRETTSVGSHAHRVILGLPPCGPLTLEDVKTAFRASALRWHPDRHPGSSQAMAEEKFKLCVNAYNSLCSVLKAA

SEQ ID NO: 4441 - DNA, 636 bp, Sorghum bicolor
  misc_feature: Ceres ANNOT ID no. 6037906
  misc_feature: Encodes the peptide sequence at SEQ ID NO 4442
atgagtgaagaggataaggttgctgcttctgctgagcagcctaagaggacccctaagctcaatgaaaggatcctctcttctctgtccaggaggtctgtagctgctcatccgtggcatgatcttgagatcggtcctggtgctcctgctgtattcaatgttgttgttgagatcacaaagggaagcaaagttaaatatgagcttgacaagaaaactggactgattaaggttgatcgagtcctctactcatcggttgtataccctcacaattatggtttcattccgaggactctgtgtgaagacaatgacccaatggatgtgttggtcctgatgcaggagcctgttattcctggttcgtttctccgagcaagagcaattggccttatgcccatgattgaccagggtgagaaggatgacaagataatagcagtctgtgctgatgatcctgaataccgtcactacaatgacatcagtgagctgtctcctcaccgcctgcaagagatcaagcgtttctttgaagattacaagaaaaatgagaacaaagaggttgctgtcgatgcattcttgcctgcgaccacagctcgagatgccattcaggatctgtatgcgcagtacatcttgcaaagcttgaggcagtag

SEQ ID NO: 4442 - protein, 211 aa, Sorghum bicolor
  misc_feature: Ceres ANNOT ID no. 6037906
  misc_feature (52)..(206): Pfam Id: Pyrophosphatase Pfam Desc: Inorganic pyrophosphatase
  misc_feature (1)..(211): NCBI GI: 4033424 NCBI Desc: soluble inorganic pyrophosphatase (pyrophosphate phospho-hydrolase) (ppase)
  misc_feature (1)..(211): NCBI GI: 38345829 NCBI Desc: osjnba0070m12.12 [oryza sativa (japonica cultivar-group)]
  misc_feature (1)..(208): NCBI GI: 52550777 NCBI Desc: inorganic pyrophosphatase [oryza sativa (japonica cultivar-group)]
  misc_feature (1)..(211): NCBI GI: 4033417 NCBI Desc: soluble inorganic pyrophosphatase (pyrophosphate phospho-hydrolase) (ppase)
  misc_feature (1)..(211): NCBI GI: 84619270 NCBI Desc: soluble inorganic pyrophosphatase [papaver rhoeas]
  misc_feature (1)..(211): SWISSPROT Homolog: EC 3.6.1.1 Soluble inorganic pyrophosphatase
  misc_feature: Useful for making plants with modulated nitrogen use efficiency
  misc_feature: GREAT-hit functional homolog of the protein sequence given in SEQ ID NO 13344
  misc_feature: Useful for making plants with modulated nitrogen use efficiency
  misc_feature: Functional homolog of the protein sequence given in SEQ ID NO 13344
MSEEDKVAASAEQPKRTPKLNERILSSLSRRSVAAHPWHDLEIGPGAPAVFNVVVEITKGSKVKYELDKKTGLIKVDRVLYSSVVYPHNYGFIPRTLCEDNDPMDVLVLMQEPVIPGSFLRARAIGLMPMIDQGEKDDKIIAVCADDPEYRHYNDISELSPHRLQEIKRFFEDYKKNENKEVAVDAFLPATTARDAIQDLYAQYILQSLRQ

SEQ ID NO: 4443 - DNA, 1242 bp, Sorghum bicolor
  misc_feature: Ceres ANNOT ID no. 6037915
  misc_feature: Encodes the peptide sequence at SEQ ID NO 4444
atggccgccggctccggccccgacacggccgcggaggcgcagcccccgccgccgatccaccacctgccgccggacgcgctccacaacgtgctgctccgcctgcagctgcgcgacgccgtcgtgtgccgccccgtctcgcgcctcttcaacgagaccctctcgccgcagctcctcgcgctgctcccgaccctgcgcctcctcctcctccgccacccgcgccccgacggcggcggatgcctccacgccttcgaccccgcgcgccgcacctggctccgcctccccttcgcccacttcctcccctatcagtccttctcccccgtcgcctcctccacgtcgctcctctacctctgggtcgagacctcctccaccaccacctcgcccctggccctcccgtccacctccacgtcttcgtcctccaaagcctcgcccgtgcacccgcccaaatccctcgccgtctgcaaccccttcgccggcacgtaccgcctcttgccccagctcggatccgcctgggcgcgccacggcaccgtcctagccggccccggcggcacggtgctcgtcctcaccgagctcgccgcgctgtcctacaccccctccggatccagcaagtggatgaagcatcccctctcgctgccgtccaagccgcggagccccatactggcctccgccgccgccgccgtcttcgccctctgcgacgtcggcacgccgtggcgcagccagtggaagctcttctcctgcccgctttccatgctcaccgggggctgggcccccgtggagcgagcagcgtggggagacgtcttcgagatcctcaagcgtccccggctccttgctggggccggcggccgccgggtccttatgatcggcggcctcaggtcctcgttcgccatggacgcgccctgctccacggtgctcatactccgcctagatctgcagaccatggagtgggacgaagctgggcgcatgccgcccaatatgtaccgctgcttcactggcctctgcgaggctgcttcacagggcaacgccgtgcctgctgctgctgccgggggtaacaataaggtcaaggttttcggaggcgatgggaaggtgtggtttgctggtaagcgagtgcgcgggaagcttgcaatgtgggaggaagatgagatggggagcggtggcaactgggactgggtggatggtgttcctggttatggtgatggtgtataccgtggatttgtgttcgatggtgggttcacagcaattccttga

SEQ ID NO: 4444 - protein, 413 aa, Sorghum bicolor
  misc_feature: Ceres ANNOT ID no. 6037915
  misc_feature (270)..(321): Pfam Id: Kelch_2 Pfam Desc: Kelch motif
  misc_feature (17)..(64): Pfam Id: F-box Pfam Desc: F-box domain
  misc_feature (5)..(413): NCBI GI: 115461458 NCBI Desc: os04g0686700 [oryza sativa (japonica cultivar-group)]
  misc_feature (207)..(413): NCBI GI: 38345827 NCBI Desc: osjnba0070m12.10 [oryza sativa (japonica cultivar-group)]
MAAGSGPDTAAEAQPPPPIHHLPPDALHNVLLRLQLRDAVVCRPVSRLFNETLSPQLLALLPTLRLLLLRHPRPDGGGCLHAFDPARRTWLRLPFAHFLPYQSFSPVASSTSLLYLWVETSSTTTSPLALPSTSTSSSSKASPVHPPKSLAVCNPFAGTYRLLPQLGSAWARHGTVLAGPGGTVLVLTELAALSYTPSGSSKWMKHPLSLPSKPRSPILASAAAAVFALCDVGTPWRSQWKLFSCPLSMLTGGWAPVERAAWGDVFEILKRPRLLAGAGGRRVLMIGGLRSSFAMDAPCSTVLILRLDLQTMEWDEAGRMPPNMYRCFTGLCEAASQGNAVPAAAAGGNNKVKVFGGDGKVWFAGKRVRGKLAMWEEDEMGSGGNWDWVDGVPGYGDGVYRGFVFDGGFTAIP

SEQ ID NO: 4445 - DNA, 1224 bp, Sorghum bicolor
  misc_feature: Ceres ANNOT ID no. 6037919
  misc_feature: Encodes the peptide sequence at SEQ ID NO 4446
atggcggcggctctgcaagccacgccgctcaaaaccctagccatctcccgccggcgcgtcggcgtcgcgggggtgcggcagcggccgatggtggcgagcttccggtgctccgcggcggcgcggagctacaacatcacgctcctccccggggacggcatcggcccggaggtggtcgccgtcgccaaggacgtgctctccctcgccggcgccctcgaaggcgtcgagctccggttccaggagaagctggtgggcggctccgcgctggacgccaccggcgtgcctctccccgacgagacgctcgacgcggccaagggttccgacgccatcctcctcggtgccattggaggctataagtgggataacaatgagaagcacctcaagcctgagaccggcctgctgcagctccgtgctggactcggggtttttgccaatctgcgaccagctgcagtgttgccgcagttggtagacgcatccactctgaagaaagaggtagctgaaggtgttgacatcatggttgtcagagagcttactggaggcatctacttcggcaaacccaggggttttggaacaaatgacaagggagaggatattggcttcaacacagaagtttattcagcttctgagattgatcgtattgcacgtgttgcatttgaggttgctcgcaagagaagagggaaactatgctcagttgacaaagcaaatgtgctggaggcatccatgctttggaggaaaagggtgactgcactagcttctgaattccctgacattgagctctcacacatgtatgttgataatgctgcgatgcagcttgttaggaatcctaagcagtttgacacaattgtcacaaacaatatttttggtgacatattatctgatgaagcatcaatgattacgggaagcattggaatgcttccatctgccagtgttggtgaatcgggacctggtctttttgaacctattcatggctctgcccctgatattgctggacaggacaaggccaatccattagctacaattcttagtgcagcgatgctattgcgatatggcctaggagaagaaaatgctgcaaagagaattgaagctgcagttacagcaacactgaaccatgggttccgaaccggggacatatattctcctggaacaacattggttggatgcaagcagatgggggaagaagtcttgaagacagttgagtcgctaaaggaagtggctgctgtaaactga

SEQ ID NO: 4446 - protein, 407 aa, Sorghum bicolor
  misc_feature: Ceres ANNOT ID no. 6037919
  misc_feature (44)..(393): Pfam Id: Iso_dh Pfam Desc: Isocitrate/isopropylmalate dehydrogenase
  misc_feature (27)..(404): NCBI GI: 115454413 NCBI Desc: os03g0655700 [oryza sativa (japonica cultivar-group)]
  misc_feature (1)..(399): NCBI GI: 17827 NCBI Desc: 3-isopropylmalate dehydrogenase [brassica napus]
  misc_feature (1)..(399): NCBI GI: 4512615 NCBI Desc: strong similarity to gbx59970 3-isopropylmalate dehydrogenase (imdh) from brassica napus. est gbf14478 comes from this gene. [arabidopsis thaliana]
  misc_feature (35)..(399): NCBI GI: 18377879 NCBI Desc: at5g14200/mua22_20 [arabidopsis thaliana]
  misc_feature (35)..(380): NCBI GI: 79327847 NCBI Desc: 3-isopropylmalate dehydrogenase/ oxidoreductase [arabidopsis thaliana]
  misc_feature (1)..(399): SWISSPROT Homolog: EC 1.1.1.85 3-isopropylmalate dehydrogenase 2, chloroplast precursor
  misc_feature: The plant is abnormally small.
  misc_feature: Useful for making plants with modulated biomass
  misc_feature: GREAT-hit functional homolog of the protein sequence given in SEQ ID NO 12950
  misc_feature: Useful for making plants with modulated biomass
  misc_feature: Functional homolog of the protein sequence given in SEQ ID NO 12950
  misc_feature: The sequence is a functional homolog of SEQ ID NO. 301 in the 11/188,298 US application
  misc_feature: The sequence is a functional homolog of SEQ ID NO. 460 in the 11/188,298 US application
  misc_feature: The sequence is a functional homolog of SEQ ID NO. 317 in the 11/188,298 US application
MAAALQATPLKTLAISRRRVGVAGVRQRPMVASFRCSAAARSYNITLLPGDGIGPEVVAVAKDVLSLAGALEGVELRFQEKLVGGSALDATGVPLPDETLDAAKGSDAILLGAIGGYKWDNNEKHLKPETGLLQLRAGLGVFANLRPAAVLPQLVDASTLKKEVAEGVDIMVVRELTGGIYFGKPRGFGTNDKGEDIGFNTEVYSASEIDRIARVAFEVARKRRGKLCSVDKANVLEASMLWRKRVTALASEFPDIELSHMYVDNAAMQLVRNPKQFDTIVTNNIFGDILSDEASMITGSIGMLPSASVGESGPGLFEPIHGSAPDIAGQDKANPLATILSAAMLLRYGLGEENAAKRIEAAVTATLNHGFRTGDIYSPGTTLVGCKQMGEEVLKTVESLKEVAAVN

SEQ ID NO: 4447 - DNA, 3249 bp, Sorghum bicolor
  misc_feature: Ceres ANNOT ID no. 6037922
  misc_feature: Encodes the peptide sequence at SEQ ID NO 4448
  misc_feature: Down-regulated in shoot tissues in response to salicylic acid treatment
atgggcgttgcccgtcgcggcgtgcctcgtggccgtcaggcggagaagaggacgccgcgcgcgggagtgcctgaggttttggcacttattgctctaaagaaaggcactcaactccttaaatacggccgcaaaggaaagccgaagttcaccccattcagactatcaaatgatgaatcgactcttatttgggtttcaaataacaaagataaaagtttgaaactagcttctgtgtctaggattctctcaggccaaagaacgctggtttttcaacgtttcctgctccctgaaaaggaccatttatccttctccctcatatataatggtggcaagcggtctcttgatctgatctgcaaggataaaattgaggcggaggcttggtttactggtcttagtgccttgatatgtccaggacagcatggatcccaggcccaacacatagatggaatccggattgctggactttcttttgatggtgcaagagaaagtagcctaagcagtagctctactttcacttcggattcccttgagaataagttgagctcagcaaactctaccaaggatcgttcttcaggagaatatacatattcagaaaggaccgatgtgtcagatatgcaagtgaaaagtgtttcttcttcggacattcgaatcagtgtttccagtgcccttagcacatccagtcatggctctggaggtgaagattctgaatcgtttggagatatttatgtatggggggaagtcatctgtgataccatctcaagatcagggtctgatagaagtgcttactctcctggcacaactacagatgttcttgtaccaaagcccctagagtcaaatgtaatgctcgatgtgagttatgtggcttgtggtgtgaaacatgctgcccttgttacaagacagtctgaggtatttacgtggggagaagaatgcagcgggcgtctcggtcatggcactggaacaaatgttttccagccacgtcttgttgagtcattatcgatctgcaatgttgaactaattgcctgtggtgaattccatacttgtgctgtcactgcaactggtgatctctacacttggggagatggcacacacaatgcaggattgcttggtcatggtagtaatgtgagccactggatcccgaaaagagtctcaggtccactggatggtcttccggtatcaactgtatcttgcggcacatggcatacggccttgataactagttctgggcagttatacacatttggtgatggcacatttggagtcttaggtcatggaaatcgagcatcatgctcatatccaaaggaagtggaatctttgaagggtttaaggacaatttctgtttcgtgtggtgtgtggcatactgctgctgttgttgaggttatcatttcacagtcaaatgcttcatctggaaagttgttcacttggggcgatggagacaaatatcgcctggggcatggtgataggtcttcaaaactgaaaccaacctgcatcccttcgttaatagattacaactttcataaggctgcatgtggtcatactcttacgattgggttgactacttcagggcacatttttactgttggaagctctgtgtatggacagcttggtaatccaaataatgatggaagatatcctcgcctggttgaagaacaacttgggggtggcggtgttgtggaggttgcttgcggatcttatcatgtcgcggttttgacaaatgctggtgaagtttacacatggggtaagggtgcaaatggtagattaggtcatggtgatattgctgatcgtaaagtgcctacacttgttgaggctttaagggataggtctgtaaaacgtgttgcttgtggatcaagctttacagctgcaatttgtcagcataaatgggtgtctgggatggagcaatctcagtgctcggcatgtaggcagccatttggtttcactcggaaaaggcacaactgttacaattgtggcttagtacactgccattcatgcagttcaaaaaaagctctaagagcagcattgtctccaaatccgggaaagccataccgtgtatgtgattcatgctatgtgaaattaagtaaagttttggactctggtgtcagttatagcagaaatactattcctcggatacctggtgatacaaaggctgagagaatagacacaaaggcaaacaaagttgcaccatctagtagttcagatatgattaggaatttagatgtgaaggcagctaagcagacgaagaagtctgactactcgtctcaagttccagcaatgttacagctgaaagacatccctttcatcagtgcacctgacctgcagaactcgtctacagtggctaatcaattcccttatgactccagatctactttaccatttctgaggatgccatatctgaactattccagctctctgtcctcggaaagctcagagagtcttagggatgcaaatgaacttctgaagcaagaggttcaaaaactacaagcagaggttaatagtttgagacaagaacgtgaacagcaagatactgagctgaagaaatcagaggcaaaagcccatgaagcaatgaaccttgctactgaggaagcatccaaattgaagaccgcaaaggatgtcataaaagcactaacagctcagctaaaagaaatgtctgaaaggcttcctccaggagcatgtgatgtgaagaacggacaccttatgggtgctttagcatctgaaatggggagagagaaccagatgagatatgatcaaaacagcattcagtaccctcaaactcatgcttctgttgcatctgctcggtttggtggattgcctgctcagattcaccaaacaagcaactacaatgaaacagtcatggttccacaagagagcaggggtgagcacctcaatggtatccgagagttctcccctgtgcaacagagtgccaatggagggcctattgggtatcgttacagaccagatgatcatgaccgaagggaagtagacaggttccagataaatctgcagaacttgaacatgagaagttctagttcccccaataaccaagtcgacgcagagtggatagaacagtatgagccaggagtatacctaactctagtttctctctgtgatggaaccaaagagctgaaacgagtacggttcagccgaaggagatttggtgaacaccaagcagaatcatggtggaatgacaaccgtgaaaaagtgtatgagaagtacaatgtctgcggaacagatcgtctctcttcagtaacgacagcctaa

SEQ ID NO: 4448 - protein, 1082 aa, Sorghum bicolor
  misc_feature: Ceres ANNOT ID no. 6037922
  misc_feature (351)..(403): Pfam Id: RCC1 Pfam Desc: Regulator of chromosome condensation (RCC1)
  misc_feature (406)..(455): Pfam Id: RCC1 Pfam Desc: Regulator of chromosome condensation (RCC1)
  misc_feature (467)..(516): Pfam Id: RCC1 Pfam Desc: Regulator of chromosome condensation (RCC1)
  misc_feature (519)..(568): Pfam Id: RCC1 Pfam Desc: Regulator of chromosome condensation (RCC1)
  misc_feature (571)..(620): Pfam Id: RCC1 Pfam Desc: Regulator of chromosome condensation (RCC1)
  misc_feature (1033)..(1068): Pfam Id: DZC Pfam Desc: Disease resistance/zinc finger/chromosome condensation-likeregion
  misc_feature (623)..(691): Pfam Id: FYVE Pfam Desc: FYVE zinc finger
  misc_feature (28)..(1082): NCBI GI: 38345822 NCBI Desc: osjnba0070m12.5 [oryza sativa (japonica cultivar-group)]
  misc_feature (28)..(1082): NCBI GI: 90399178 NCBI Desc: h0723c07.10 [oryza sativa (indica cultivar-group)]
  misc_feature (28)..(1082): NCBI GI: 27363446 NCBI Desc: at1g76950/f22k20_5 [arabidopsis thaliana]
  misc_feature (28)..(1082): NCBI GI: 15811367 NCBI Desc: zinc finger protein [arabidopsis thaliana]
  misc_feature (195)..(750): NCBI GI: 145357939 NCBI Desc: ran gtpase binding / chromatin binding / zinc ion binding [arabidopsis thaliana]
  misc_feature: Down-regulated in shoot tissues in response to salicylic acid treatment
MGVARRGVPRGRQAEKRTPRAGVPEVLALIALKKGTQLLKYGRKGKPKFTPFRLSNDESTLIWVSNNKDKSLKLASVSRILSGQRTLVFQRFLLPEKDHLSFSLIYNGGKRSLDLICKDKIEAEAWFTGLSALICPGQHGSQAQHIDGIRIAGLSFDGARESSLSSSSTFTSDSLENKLSSANSTKDRSSGEYTYSERTDVSDMQVKSVSSSDIRISVSSALSTSSHGSGGEDSESFGDIYVWGEVICDTISRSGSDRSAYSPGTTTDVLVPKPLESNVMLDVSYVACGVKHAALVTRQSEVFTWGEECSGRLGHGTGTNVFQPRLVESLSICNVELIACGEFHTCAVTATGDLYTWGDGTHNAGLLGHGSNVSHWIPKRVSGPLDGLPVSTVSCGTWHTALITSSGQLYTFGDGTFGVLGHGNRASCSYPKEVESLKGLRTISVSCGVWHTAAVVEVIISQSNASSGKLFTWGDGDKYRLGHGDRSSKLKPTCIPSLIDYNFHKAACGHTLTIGLTTSGHIFTVGSSVYGQLGNPNNDGRYPRLVEEQLGGGGVVEVACGSYHVAVLTNAGEVYTWGKGANGRLGHGDIADRKVPTLVEALRDRSVKRVACGSSFTAAICQHKWVSGMEQSQCSACRQPFGFTRKRHNCYNCGLVHCHSCSSKKALRAALSPNPGKPYRVCDSCYVKLSKVLDSGVSYSRNTIPRIPGDTKAERIDTKANKVAPSSSSDMIRNLDVKAAKQTKKSDYSSQVPAMLQLKDIPFISAPDLQNSSTVANQFPYDSRSTLPFLRMPYLNYSSSLSSESSESLRDANELLKQEVQKLQAEVNSLRQEREQQDTELKKSEAKAHEAMNLATEEASKLKTAKDVIKALTAQLKEMSERLPPGACDVKNGHLMGALASEMGRENQMRYDQNSIQYPQTHASVASARFGGLPAQIHQTSNYNETVMVPQESRGEHLNGIREFSPVQQSANGGPIGYRYRPDDHDRREVDRFQINLQNLNMRSSSSPNNQVDAEWIEQYEPGVYLTLVSLCDGTKELKRVRFSRRRFGEHQAESWWNDNREKVYEKYNVCGTDRLSSVTTA

SEQ ID NO: 4449 - DNA, 570 bp, Sorghum bicolor
  misc_feature: Ceres ANNOT ID no. 6037924
  misc_feature: Encodes the peptide sequence at SEQ ID NO 4450
atggccagccgatcgtcgtccagcatgacggagccggcgccgctgctgcagcgccaccacgagctgcagctgcagggcccgcgcccggcaccgctcaaggtcagcaccagcacgacgggcgcggaaatggtcgtcaagaagcggcggctgcaccaggcgcctccgcggcagccggtgatcatctacgtggagtcgccgagagtcgtgcacgcgcacccggccgagttcaagtccgtcgtgcagcgcctcacgggcgcaccggcggcgccggcaccatcgccgccgaggacgatggtgttctcggcgtctgctccgccaccgctgcagctgcagttcccgtttcagtttccgttggtgggagctgcaggcagcgccggccccctgctgccgctgacgagtagcatcatgtcggcggtgactgttgccgatgctagtggctcatcatcagtccaggagaatctctctagcgatccatttctgctgccgctgccgtcgtcgtctcttgccgcgtgttatcatcaacaccacgccggcgccggcggtgatctcttcatcgcccaccaccagtaa

SEQ ID NO: 4450 - protein, 189 aa, Sorghum bicolor
  misc_feature: Ceres ANNOT ID no. 6037924
  misc_feature (62)..(92): Pfam Id: VQ Pfam Desc: VQ motif
  misc_feature (47)..(95): NCBI GI: 39545720 NCBI Desc: osjnba0033g16.10 [oryza sativa (japonica cultivar-group)]
  misc_feature (26)..(105): NCBI GI: 22329705 NCBI Desc: vq motif-containing protein [arabidopsis thaliana]
  misc_feature (1)..(102): NCBI GI: 115470691 NCBI Desc: os07g0161900 [oryza sativa (japonica cultivar-group)]
MASRSSSSMTEPAPLLQRHHELQLQGPRPAPLKVSTSTTGAEMVVKKRRLHQAPPRQPVIIYVESPRVVHAHPAEFKSVVQRLTGAPAAPAPSPPRTMVFSASAPPPLQLQFPFQFPLVGAAGSAGPLLPLTSSIMSAVTVADASGSSSVQENLSSDPFLLPLPSSSLAACYHQHHAGAGGDLFIAHHQ

SEQ ID NO: 4451 - DNA, 219 bp, Sorghum bicolor
  misc_feature: Ceres ANNOT ID no. 6037925
  misc_feature: Encodes the peptide sequence at SEQ ID NO 4452
atggagaagacgacgacgacgccgcagccggtctgcgcgcaggagtcgctggcgctgctcaactgcatcgcctcggccccctacgaccgggataggtgcctcgccctcgtcgacgccctccgtgaatgcatcgtgcacaagagggtgaagaagttttccctggcagaaccaagctccaccacatccactgaagctccaaagagcgacccgaagcactga

SEQ ID NO: 4452 - protein, 72 aa, Sorghum bicolor
  misc_feature: Ceres ANNOT ID no. 6037925
MEKTTTTPQPVCAQESLALLNCIASAPYDRDRCLALVDALRECIVHKRVKKFSLAEPSSTTSTEAPKSDPKH

SEQ ID NO: 4453 - DNA, 1662 bp, Sorghum bicolor
  misc_feature: Ceres ANNOT ID no. 6037946
  misc_feature: Encodes the peptide sequence at SEQ ID NO 4454
atggcgaccacctccacctccccccattcagccggcggcggcggcatcatcggcgacgacctccacggcttactccgctacggcctccgcactcactcctccgttctctgcgcacacgccttcctcctccgccgcggcctcctcctcggccacgccgtccccgccggcctcctcctcaccgcctctgcctgctccgccgcctcgccgcccgcccacatcctccgcctcctccaccacctacctcctcccctgccggtcttctccatcgacctcgcactccgcgccgtaggccctcgcatccccttctccaccctcctctccctcttcgcggccctcctccgctcccaccaaccggtcttccccgatcacttctccttccctcctctcctctcagctgccgcctccgctgcctccccgcgactccacctccgctccgcgctcgccctccacgggcaggtcctccgccgcggcctcctcttctccccgccgccccacgctgccaacgcactcctccacttctatgccactgccggcggcctctcgtccgcccgctacctgttcgacgaaatgccattcagggacatcgtgtcctacaacaccctgatgacggccttagctagcacacctggtggcattgatgccgcacgccagctgttcgagggaatgcacctgagaagtgcagtgtcatggaacatcatgattaatgggtatgtcaaggcgaagtggcctgaacaggcactggaggtggtccggtggatggcaaaggcaggagtgagggggacggcagcagccatggtcggggcagccacggcgtgtgctaggctggggaggctaggggctgggaaggaggtgcactgtgtgttcctgcgccgttttgaggatgataacctgttagtttggactgcattgattgatatgtatggcaagtgtcggaggtctggggttgcaaggaagctgtttgatcggctcagaatgaggaacgtggtatgctggaatgcgatgatcatagggcactgtgtgtatggtgaacccggtgatgggatcaaactgttccagcatatgatcacactggggaatgtgcagccagatggagtcactttcattggtgttctctgcgcctgtgcccgtttaggcctcttggaggacggaagggcatattttgagcagatgagcaccgtgtacaacctcaagccgacatttgcgcactactggtgcgtggccaatctgtatgggagtgttgggcttctggaagaagccgagggcctcttacagagtataccagaggatatgaaggcacgagcattgggtagtttgcttgggttatgtcggttccggaaggattggagacttggggaacggatagctctcaggttgattgagcttgaaccgagcaacaatgctcactatgcactgctttgcaatgtgtacgctgctgtagggaggtgggaagaagttcacagggtgaaggctatcatgaaagggagagatgagaggttcaggcctggacatcgtctggtgaacttaaatgagattgttgatgaattcaaaattagggagagtcaacctgagaatcaggagatatatgccatcatggatgacttagcgacaaggctgaagcttgattgcaaagaaaaggaccaaagtgattttggaataaagtaa

SEQ ID NO: 4454 - protein, 553 aa, Sorghum bicolor
  misc_feature: Ceres ANNOT ID no. 6037946
  misc_feature (228)..(262): Pfam Id: PPR Pfam Desc: PPR repeat
  misc_feature (82)..(527): NCBI GI: 46805412 NCBI Desc: pentatricopeptide (ppr) repeat-containing protein-like [oryza sativa (japonica cultivar-group)]
  misc_feature (105)..(527): NCBI GI: 115448933 NCBI Desc: os02g0769900 [oryza sativa (japonica cultivar-group)]
  misc_feature (108)..(534): NCBI GI: 144923302 NCBI Desc: asp/glu racemase; tetratricopeptide-like helical [medicago truncatula]
  misc_feature (118)..(527): NCBI GI: 46805413 NCBI Desc: pentatricopeptide (ppr) repeat-containing protein-like [oryza sativa (japonica cultivar-group)]
  misc_feature (39)..(539): NCBI GI: 140070676 NCBI Desc: tetratricopeptide-like helical [medicago truncatula]
MATTSTSPHSAGGGGIIGDDLHGLLRYGLRTHSSVLCAHAFLLRRGLLLGHAVPAGLLLTASACSAASPPAHILRLLHHLPPPLPVFSIDLALRAVGPRIPFSTLLSLFAALLRSHQPVFPDHFSFPPLLSAAASAASPRLHLRSALALHGQVLRRGLLFSPPPHAANALLHFYATAGGLSSARYLFDEMPFRDIVSYNTLMTALASTPGGIDAARQLFEGMHLRSAVSWNIMINGYVKAKWPEQALEVVRWMAKAGVRGTAAAMVGAATACARLGRLGAGKEVHCVFLRRFEDDNLLVWTALIDMYGKCRRSGVARKLFDRLRMRNVVCWNAMIIGHCVYGEPGDGIKLFQHMITLGNVQPDGVTFIGVLCACARLGLLEDGRAYFEQMSTVYNLKPTFAHYWCVANLYGSVGLLEEAEGLLQSIPEDMKARALGSLLGLCRFRKDWRLGERIALRLIELEPSNNAHYALLCNVYAAVGRWEEVHRVKAIMKGRDERFRPGHRLVNLNEIVDEFKIRESQPENQEIYAIMDDLATRLKLDCKEKDQSDFGIK

SEQ ID NO: 4455 - DNA, 516 bp, Sorghum bicolor
  misc_feature: Ceres ANNOT ID no. 6037948
  misc_feature: Encodes the peptide sequence at SEQ ID NO 4456
atgcagatgcattgcatgctctttcaagtggccttgccctccctccctgccttccttttcttatatgtgccccgcaacttccgtctgctggaggagctggagcgcggggagaagggcatcggcgacggcagcgtcagctacggcatggacgacgacggcgacgacatcttcatgcgctcatggaccgggaccatcataggcccgctcaactgcgcgcacgagggtcgcatctaccagctgaagctggtgtgtgacaaggactaccccgacaagccgccggcggtgcggttccactcccggatcaacctggcctgcgtgcacccggacaccggggtggtggaagccgacaagctgccgacgctgcgggagtggcggcgggagtacacgatggagcacctcctcacccagctcaagaaggagatggccgcgccgcacaaccgcaggctgccccagccacccgaaggcaccttcttctcctccgattccaattccagttccaccaccaccagtagctag

SEQ ID NO: 4456 - protein, 171 aa, Sorghum bicolor
  misc_feature: Ceres ANNOT ID no. 6037948
  misc_feature (28)..(171): Pfam Id: UQ_con Pfam Desc: Ubiquitin-conjugating enzyme
  misc_feature (23)..(158): NCBI GI: 32488709 NCBI Desc: osjnba0088h09.10 [oryza sativa (japonica cultivar-group)]
  misc_feature (23)..(158): NCBI GI: 78191460 NCBI Desc: ubiquitin-conjugating enzyme family protein-like [solanum tuberosum]
  misc_feature (23)..(158): NCBI GI: 30686662 NCBI Desc: ubiquitin-conjugating enzyme family protein [arabidopsis thaliana]
  misc_feature (34)..(158): NCBI GI: 115461424 NCBI Desc: os04g0684800 [oryza sativa (japonica cultivar-group)]
  misc_feature (23)..(158): NCBI GI: 145330372 NCBI Desc: mmz3 (mms zwei homologe 3) [arabidopsis thaliana]
  misc_feature: The sequence is a functional homolog of SEQ ID NO. 431 in the 11/188,298 US application
MQMHCMLFQVALPSLPAFLFLYVPRNFRLLEELERGEKGIGDGSVSYGMDDDGDDIFMRSWTGTIIGPLNCAHEGRIYQLKLVCDKDYPDKPPAVRFHSRINLACVHPDTGVVEADKLPTLREWRREYTMEHLLTQLKKEMAAPHNRRLPQPPEGTFFSSDSNSSSTTTSS

SEQ ID NO: 4457 - DNA, 285 bp, Sorghum bicolor
  misc_feature: Ceres ANNOT ID no. 6037949
  misc_feature: Encodes the peptide sequence at SEQ ID NO 4458
atgagcgaacagggcaagaggccgacgatggccggcggcgggtcggcggcagagtcgccggcgagctcgtgcgtgtcgtcggacgcggaggacgaggtggtggtgcagccgcagccgaagccgatggtggtggtggggtgcccgcagtgcctcatgtacgtgatgctgtccggggaggagcagcagcccaagtgcccgcggtgcaagagccccgtgctgctgcacttcctccgcgccggcgacgacatcaacggcggcaagctgccggcggccggccggcagtaa

SEQ ID NO: 4458 - protein, 94 aa, Sorghum bicolor
  misc_feature: Ceres ANNOT ID no. 6037949
  misc_feature (10)..(77): NCBI GI: 90399140 NCBI Desc: h0913c04.5 [oryza sativa (indica cultivar-group)]
  misc_feature (10)..(76): NCBI GI: 15290114 NCBI Desc: p0423b08.15 [oryza sativa (japonica cultivar-group)]
  misc_feature (18)..(84): NCBI GI: 116309338 NCBI Desc: h0622f05.5 [oryza sativa (indica cultivar-group)]
  misc_feature (15)..(70): NCBI GI: 54873553 NCBI Desc: cyclin b-like protein [nicotiana tabacum]
  misc_feature: Useful for biocontainment applications
  misc_feature: Functional homolog of the protein sequence given in SEQ ID NO 13871
MSEQGKRPTMAGGGSAAESPASSCVSSDAEDEVVVQPQPKPMVVVGCPQCLMYVMLSGEEQQPKCPRCKSPVLLHFLRAGDDINGGKLPAAGRQ

SEQ ID NO: 4459 - DNA, 510 bp, Sorghum bicolor
  misc_feature: Ceres ANNOT ID no. 6037960
  misc_feature: Encodes the peptide sequence at SEQ ID NO 4460
atgggtgcagcagagtcatcttccaagctcgctagctcagtccatggctttagcgtcaaggatgcgaggggaaatgatgtggagttgagtagatacaaggggaaggttctgcttatcgtgaatgtggcttcccaatgtggtctgacaaattccaactatactgagttgggatcactccacaagaaatatggcgaaaaaggatttgagatactggcgttcccatgcaaccagtttgttggacaagagccaggtaccaatgaacagattgctgagtttgcttgcacccgtttcaaagcagattttcctgtttttggcaaggttgatgtgaatggcgggaaggctgctccgctgtataagttcctgaagtcagagagaggcggtctgtttggagaacgcatcaaatggaacttcaccaagtttttggttgacaaagatgggcacgttgtgagcagatatgcaccaaccagctccccgttgagtattgaggtgataatttatactagtatataa

SEQ ID NO: 4460 - protein, 169 aa, Sorghum bicolor
  misc_feature: Ceres ANNOT ID no. 6037960
  misc_feature (14)..(122): Pfam Id: GSHPx Pfam Desc: Glutathione peroxidase
  misc_feature (1)..(162): NCBI GI: 6179602 NCBI Desc: glutathione peroxidase-like protein gpx15hv [hordeum vulgare subsp. vulgare]
  misc_feature (1)..(162): NCBI GI: 27544804 NCBI Desc: phospholipid hydroperoxide glutathione peroxidase-like protein [hordeum vulgare]
  misc_feature (4)..(162): NCBI GI: 125620186 NCBI Desc: glutathione peroxidase [nelumbo nucifera]
  misc_feature (1)..(162): NCBI GI: 6179600 NCBI Desc: gpx12hv, glutathione peroxidase-like protein [hordeum vulgare subsp. vulgare]
  misc_feature (3)..(162): NCBI GI: 44663004 NCBI Desc: phospholipid-hydroperoxide glutathione peroxidase [setaria italica]
  misc_feature (13)..(162): SWISSPROT Homolog: EC 1.11.1.12 Phospholipid hydroperoxide glutathione peroxidase 1, chloroplast precursor
  misc_feature (13)..(162): SWISSPROT Homolog: EC 1.11.1.9 Glutathione peroxidase 1
  misc_feature (21)..(165): SWISSPROT Homolog: EC 1.11.1.15 Peroxiredoxin HYR1
  misc_feature: Useful for making plants with modulated flowering time
  misc_feature: Functional homolog of the protein sequence given in SEQ ID NO 12921
  misc_feature: Useful for making plants with modulated nitrogen use efficiency
  misc_feature: Functional homolog of the protein sequence given in SEQ ID NO 13071
MGAAESSSKLASSVHGFSVKDARGNDVELSRYKGKVLLIVNVASQCGLTNSNYTELGSLHKKYGEKGFEILAFPCNQFVGQEPGTNEQIAEFACTRFKADFPVFGKVDVNGGKAAPLYKFLKSERGGLFGERIKWNFTKFLVDKDGHVVSRYAPTSSPLSIEVIIYTSI

SEQ ID NO: 4461 - DNA, 3039 bp, Sorghum bicolor
  misc_feature: Ceres ANNOT ID no. 6037961
  misc_feature: Encodes the peptide sequence at SEQ ID NO 4462
atggggacgtataagctgggtgtggaggtcgtaagtgctcatgacctgatgcccaaggatgggcatggttctgcaagcgcttgtgtcgagctcacctttgatgggcagcgcttccgaactgttgtcaaggagaaggacctgaacccagtctggaatgagcgcttctacttcaacatatcagatccttctaatcttcgtgagcttgcccttgaagcatatgtctacaatgtcaacaaaactcttgaaagttccaggtccttccttgggaaggtcatgattgctggcacctcatttgtgtccttccctgacgccgtggtcatgcattatccattagagaagcgagggatgttctctcgtgtcaaaggagaactgggtatgaaagtatacatcaccaatgaccctgccatcaaagcttcaaaccctcttcctgcaatggatcctgtttccaataatcctcctgcagccccaagtccagcagaacagattgcagctgatataactggtactaatctgcacacatctcaggagcataggtccgaggcaaagaccttacacaccattgctaaggaggtgcaacaccatcataaccatggccatcttccagctagttttggtgggcagccttccaagtactctgttgaccagatgaaacctcaatctcagccacccaggattgtgagaatgtattcagcggcctcccagcagcccatggactacgcacttaaagaaaccagtccgtttcttggtggtgggcaggttgttggtggccgggtcatacgtggcgaaaagaatgctagcacttatgaccttgtggagcgaatgcagtatctgtttgtacgtgtggtcaaggcacgggacttgcccgacatggacatcactggaagcctggatccttatgttgaagtgagagttggcaactatagggggataactaagcactttgaaaagcaaaagaacccagagtggaatgcagtctttgctttttccagggaacgtatgcaggcatccgtgcttgaagttgtggtcaaagacaaagatttgattaaggatgactttgttggctttgtgcgatttgatttgaatgacgtcccaatacgtgtgccccctgacagccctctggctccagaatggtacaggcttgttggtaagagtggagataagtccatgggtgagctcatgcttgcagtttgggtcggcacccaagctgatgaagcatttcctgatgcctggcattcagatgcggcaacacttgaagatccatctgcagtaacgcacatgaagtctaaagtttatcatgctcctagattgtggtacctgcgagtcaatatagttgaggcccaagatgttgctatatttgataagacccgctttccagatgtatttgtgagagcacaggtggggcatcaacttgggaggacaaaacctgtgcaggctagaaatttcaaccctttttggaatgaagaccttatgtttgtggctgctgaaccatttgaagatcaccttgttttgactcttgaggatcgtgtaggtccgaacaaagatgaactgcttggtcgtgtaatcatacctttggcaatgattgatagacgtgccgatgaccgtattgtccatggaaagtggttcaatctcgagaagcctgttcttgttgatgtggaccaactgaagaaggaaaagttctctactcggcttcatctccgtctctgtctggatggaggttaccatgttcttgacgagtctacaaactacagcagtgacttgagaccaactgccaagcaactctggaagccgtctattggtttgcttgaacttggtgtccttggtgctcaagggattgttcccatgaaaactcgagatggaaaaggttcatcagacacctactgtgttgctaagtatgggtcgaaatggataaggacacggaccatcatgaacaacccaaatcccagattcaatgagcagtacacctgggaagtctacgatcctgcaactgtcctgactgttggtgtttttgacaatggccaacttggagagaagagtggggagaggacatctagtggcaaagatgggaagataggcaaggttcggatacgcctttccacactcgaaactggtcgtgtgtacacccactcatatcctcttctggttctacactcatcaggggtcaaaaagatgggtgaactgcatctggcaattcgattttcatcaacatctctggtaaacatgttgtacctgtactctaggcctttgcttccaaaaatgcactatgtgcgcccaataccagtgcttcaggttgatatgctgcgccatcaagctgtccagattgtggctgcccgacttagtcggatggagccacctttgagaaaggaagttgttgaatacatgacagattttgattctcacttgtggagcatgaggaaaagcaaagcaaacttcttcagactcatgacagttttctcaggcttgtttgcagttagcaagtggttcaatggtgtatgttcatggaagaaccccattaccactgtgctagttcacatcctctttataatgctggtgtgctttcctgagctcatacttccaacagtgttcctgtacatgtttcttatagggatttggaacttccgctaccgacctcgttatcctccacacatgaataccaagatctctcatgcagaggctgttcaccctgatgaacttgatgaggagtttgatacattcccaaccagccgcaaccctgaggttgtgaggatgaggtatgacagactcaggagtgttgctggaaggatacaaacagtggttggtgatattgcaacacaaggggagagggttcaagcattgcttagctggagggaccctcgggccacagcagtctttgtcctattttgtttgatagcagcaatagtcctctatgttacaccgcttcaagttattgctgcattaggagggttctatgtgatgaggcacccaaggttcagacataggttgccttcagtaccagtcaacttcttcagacggttgccagcaaggaccgactctatgctataa

SEQ ID NO: 4462 - protein, 1012 aa, Sorghum bicolor
  misc_feature: Ceres ANNOT ID no. 6037961
  misc_feature (857)..(1012): Pfam Id: PRT_C Pfam Desc: Plant phosphoribosyltransferase C-terminal
  misc_feature (6)..(92): Pfam Id: C2 Pfam Desc: C2 domain
  misc_feature (277)..(357): Pfam Id: C2 Pfam Desc: C2 domain
  misc_feature (439)..(521): Pfam Id: C2 Pfam Desc: C2 domain
  misc_feature (601)..(694): Pfam Id: C2 Pfam Desc: C2 domain
  misc_feature (1)..(1012): NCBI GI: 32488702 NCBI Desc: osjnba0088h09.3 [oryza sativa (japonica cultivar-group)]
  misc_feature (5)..(1012): NCBI GI: 124360769 NCBI Desc: c2 [medicago truncatula]
  misc_feature (236)..(1012): NCBI GI: 6729531 NCBI Desc: anthranilate phosphoribosyltransferase-like protein [arabidopsis thaliana]
  misc_feature (236)..(1012): NCBI GI: 110739553 NCBI Desc: anthranilate phosphoribosyltransferase-like protein [arabidopsis thaliana]
  misc_feature (236)..(1012): NCBI GI: 21464555 NCBI Desc: at3g57880/t10k17_90 [arabidopsis thaliana]
MGTYKLGVEVVSAHDLMPKDGHGSASACVELTFDGQRFRTVVKEKDLNPVWNERFYFNISDPSNLRELALEAYVYNVNKTLESSRSFLGKVMIAGTSFVSFPDAVVMHYPLEKRGMFSRVKGELGMKVYITNDPAIKASNPLPAMDPVSNNPPAAPSPAEQIAADITGTNLHTSQEHRSEAKTLHTIAKEVQHHHNHGHLPASFGGQPSKYSVDQMKPQSQPPRIVRMYSAASQQPMDYALKETSPFLGGGQVVGGRVIRGEKNASTYDLVERMQYLFVRVVKARDLPDMDITGSLDPYVEVRVGNYRGITKHFEKQKNPEWNAVFAFSRERMQASVLEVVVKDKDLIKDDFVGFVRFDLNDVPIRVPPDSPLAPEWYRLVGKSGDKSMGELMLAVWVGTQADEAFPDAWHSDAATLEDPSAVTHMKSKVYHAPRLWYLRVNIVEAQDVAIFDKTRFPDVFVRAQVGHQLGRTKPVQARNFNPFWNEDLMFVAAEPFEDHLVLTLEDRVGPNKDELLGRVIIPLAMIDRRADDRIVHGKWFNLEKPVLVDVDQLKKEKFSTRLHLRLCLDGGYHVLDESTNYSSDLRPTAKQLWKPSIGLLELGVLGAQGIVPMKTRDGKGSSDTYCVAKYGSKWIRTRTIMNNPNPRFNEQYTWEVYDPATVLTVGVFDNGQLGEKSGERTSSGKDGKIGKVRIRLSTLETGRVYTHSYPLLVLHSSGVKKMGELHLAIRFSSTSLVNMLYLYSRPLLPKMHYVRPIPVLQVDMLRHQAVQIVAARLSRMEPPLRKEVVEYMTDFDSHLWSMRKSKANFFRLMTVFSGLFAVSKWFNGVCSWKNPITTVLVHILFIMLVCFPELILPTVFLYMFLIGIWNFRYRPRYPPHMNTKISHAEAVHPDELDEEFDTFPTSRNPEVVRMRYDRLRSVAGRIQTVVGDIATQGERVQALLSWRDPRATAVFVLFCLIAAIVLYVTPLQVIAALGGFYVMRHPRFRHRLPSVPVNFFRRLPARTDSML

SEQ ID NO: 4463 - DNA, 1593 bp, Sorghum bicolor
  misc_feature: Ceres ANNOT ID no. 6037964
  misc_feature: Encodes the peptide sequence at SEQ ID NO 4464
atggccaccacgctgacggcgctgctcaaggaggcggcggccgccttcccggcccgccgcgccgtcgccgtcccgggtaagctggagctcacgcacgccgccctcgacgcgctcgtcgacgcggcggccgcgcgactcgccgtcgacgccggagtcctcccgggccacgtcgtcgcgctcgctttccccaacaccgtcgagctggtgatcatgttcctggcggtcatccgcgcgcgcgccgtggcggcaccgctcaacccggcctacacgcaggaggagttcgagttctacctctccgactcggaggcgcgcctcctgatcaccaacgccgagggcaacgcggcggcgcaggcggcggccgccaagctcgggctcgtccacgccgccgcaaccctccacgacgcggccggcccggtccacctcgccggcctcccactggccttggcgaacgggaacggaaccaagagcaacgggtcgcaccaaggcggcgcggcggagggctctcccaacgacaacgacccgtcggacgtggcgctgttcctgcatacctccggcacgacgagccggcccaagggcgtccccctgacgcagcgcaacctggcggcgtcggtgcggaacatccggtccgtgtaccggctgtccgagtccgacgccacggtggtggtgctgccgctgttccacgtgcacgggctcctctgcgcgctgctgagctcgctggcgtcgggcgcgtccgtggcgctcccggcggcggggcggttctcggggtccacgttctgggccgacatgcgtgcgtcgggcgccacgtggtacacggcggtgccgacgatccaccagatcatcctggaccgtcacgcgtcgcggccggaggcggagggatatccggcgctgcggttcatccgcagctgcagcgcgtcgctggcgccggcgatcctggagcggctggaggcggcgttcggcgcgccggtgctggaggcgtacgcgatgacggaggcgtcgcacctgatgacatcgaacccgctgcctgaggacggtgcccggaagcccgggtcggtggggcgcgccgtcgggcaggagctggcggtgctggacgaggaagggcggcgcgtggcggcggggagccccggggaggtgtgcatccgcggggacaacgtgacggccgggtacaaggggaacccggaggcgaacgaggcggcgttccggttcgggtggttccacacgggggacatcggcgtggtggacgaggaggggtacgtccgccttgtggggcggatcaaggagctcatcaaccgcggcggggagaagatctccccgatcgaggtggacgccgtgctgctgggcgcccccggcgtggcgcaggccgtgtcgttcggggtgcccgacgacaagtacggggaggagatcaactgcgcggtgatcccgcgggacgggtcggcgctccgggaggaggaggtgctggcgcactgccggcggaacctggcgtcgttcaaggtgcccaagaaggtgttcatcaccgacgaccttcccaagacggccaccggcaagatacagcgccgcatcgtggcgcagcacttcgtgcagccggccagtgcctga

SEQ ID NO: 4464 - protein, 530 aa, Sorghum bicolor
  misc_feature: Ceres ANNOT ID no. 6037964
  misc_feature (31)..(455): Pfam Id: AMP-binding Pfam Desc: AMP-binding enzyme
  misc_feature (4)..(527): NCBI GI: 90399214 NCBI Desc: h0306f12.7 [oryza sativa (indica cultivar-group)]
  misc_feature (4)..(527): NCBI GI: 32488701 NCBI Desc: osjnba0088h09.2 [oryza sativa (japonica cultivar-group)]
  misc_feature (4)..(527): NCBI GI: 115461408 NCBI Desc: os04g0683700 [oryza sativa (japonica cultivar-group)]
  misc_feature (4)..(526): NCBI GI: 21593705 NCBI Desc: 4-coumarate-coa ligase-like protein [arabidopsis thaliana]
  misc_feature (99)..(460): NCBI GI: 116743285 NCBI Desc: 4-coumarate-coa ligase-like protein [coffea arabica]
MATTLTALLKEAAAAFPARRAVAVPGKLELTHAALDALVDAAAARLAVDAGVLPGHVVALAFPNTVELVIMFLAVIRARAVAAPLNPAYTQEEFEFYLSDSEARLLITNAEGNAAAQAAAAKLGLVHAAATLHDAAGPVHLAGLPLALANGNGTKSNGSHQGGAAEGSPNDNDPSDVALFLHTSGTTSRPKGVPLTQRNLAASVRNIRSVYRLSESDATVVVLPLFHVHGLLCALLSSLASGASVALPAAGRFSGSTFWADMRASGATWYTAVPTIHQIILDRHASRPEAEGYPALRFIRSCSASLAPAILERLEAAFGAPVLEAYAMTEASHLMTSNPLPEDGARKPGSVGRAVGQELAVLDEEGRRVAAGSPGEVCIRGDNVTAGYKGNPEANEAAFRFGWFHTGDIGVVDEEGYVRLVGRIKELINRGGEKISPIEVDAVLLGAPGVAQAVSFGVPDDKYGEEINCAVIPRDGSALREEEVLAHCRRNLASFKVPKKVFITDDLPKTATGKIQRRIVAQHFVQPASA

SEQ ID NO: 4465 - DNA, 3303 bp, Sorghum bicolor
  misc_feature: Ceres ANNOT ID no. 6037976
  misc_feature: Encodes the peptide sequence at SEQ ID NO 4466
atgggtaagcccaagcagcaagtgctttcccgcttcttctccccgaagcccgggcccgcgcccgccgccgccgacccgccgccgccacctccccctccccctaacccgaaaccctccgcggcgcatccgcccatctccaccgtcgcctccttctccccagccaagcgcgcgcgcgccctctccctctccccaaaaccccccgccgccaaacggcccaatcccacccctcctccttcccgtgacgccgtccgccgcaggctcctggagccgctcgacccgccgccgcctcgctccctgaaacctactgcccccggcggcggtggcaagggctacaccccgctggagcagcaggtggtcgacctcaaggcccgccaccccgacgtgctcctcatggtcgaggtgggctaccgcttccgcttcttcggcgaggacgctgccgtcgccgccgcggtgctcggcatcgtcgcgcacccggaccgcagcttcctcaccgccagcatccccaccttccgcctcggcttccacgtccgccgcctcgtcgccgcgggccacaaggtcggggtcgtgcgccagactgagaccgccgccatcaaggccgcggccgggggcgcgggaggcgccccgtttgcgcggggattgtccgcggtgtacacgcgcgccacgatagaggccgcggcaggcgagctggagggtggcggcgccgccacgcccgaggaggggagcagctacctcgtctgcgtcgtggataaggaggtggaggcggcggggagggaggggcttcaagtgaaggttgggatggtcgcgatcgaggtgtccacgggtgaggtcatccacggggagttcctggacagcgactccaggagcggactcgaagctgtgctgcttggattggcgcctgtggaggtcatcctcgggacaccactctcttttgccacagataagattatgaaggcatatttgggacccacctctaatgtgcgggttgagcgtgtatcatgtgaatgttttggcgagggtggtgctttagctgaactgataactttatttgaaaagtctttggacaatgcttctagggctgaagatgatagaaagctgatacaaacaaatgatgacaacaacaatcttcatgggattgagggtatcatggcgatgccagagctagttgttcaagcattagcattatcagttcggtatctcaaaggtttcggcatggaaaggataatatgctttggttcttcattccggccattttctgctggtacagaattttccttatcagcaaacgctcttcaacaacttgaggtgttcagaaacaactcagatggtgcaacagaagggtctctgttccaaactatgaacaatacatgcacatcttttgggtctagactgtttagaaactggttaacgcatcccttatgcgatagacatctgatttgtgctcgtcatgatgcggtatctgagatttttgaatcaatgggatcacagcattcagttaacaatcttcaggatggaggggatagatcctgcacagcttcagcacgtagtgatttgtgtactgtcctttcgtcagttttggcattgcttggaagatcacttgacattcaaagaggaataacaagggtttttcattgcaaagccacagctaaagagtttgttggtgttatccagtctatcctcacagttgggaagcagctgcagaagcttgttcttgaagatattggcactgtctcttctcagcataaacctgtgcactcctctttactgagaaggctaataagtacagcttcgtcacccactgtacttaatagtgctgtgaaacttctgtcttgtcttaacaaagatgcagctgatcaaggagatatgctgaacctattcattgcatctgtggatcagttcccagaggttacagaaggtcatgtaaatgtaaaaatggctgatcataaacttgatttattgatcgtggagtaccgaaagcaacttggtatgcgcaacttggagtttaaaaccgtagctggaaccacccatttgatcgaactaccagtagatagaagggtaccatcaaattggataaagataaatagcacaaaaaaggccatcagataccatacccctgaaatactgaagaacctagacaatctattactggctaaggaggagctagctgttatatgcaggtctatgtggcataaattcctcacagattttggcgagtactatgcacagtttcaagcagttgttgaatctcttgcagctctggactgcctctactcatttgcagttcttgcaaagcagaataattatatacggcctatttttgtccatgataatgaaccaagtcagattcacatcaaagatggacgccatccggttctggagtctttgctgggaaacaattttgttccaaatgacacagagcttcacacagatggtgagtactgccagattgtcacaggaccaaacatgggaggaaagagttgctacattcgccaagttgcactaattaccatgatggcccaggttggttcctttgtaccagcttcatcagctatgttgcatgttgttgatggaatttatacccgaatgggtgcatctgacagtattcaacaaggaacaagtaccttccatgaagagatgaatgaagcttcaaacatattgcgtaactgctcagctcgatccctagttatcattgatgagcttggtcgaggcacaagcacacacgatggcgttgctattgcttacgctactttacactatcttctcaaagagaaaaaatgcattgtcatttttgtcactcattatccaaagatccttgatattcagagagaatttgaaggttctgttggggcatatcatgtttcgtatctagccacaatgaagcttttggaagttactgataaaccggtggaaactagcccagaggcaaataatcttggagaaattattttcttgtacaaacttgttgctggagcttcagatagaagctttggtcttaatgttgccctgcttgcacagcttccgtctagatgtataaagagggcatcagtcatggcagccaaactacaagaagagttaagtgcgcgtgaggaaaataagcttcggaggacaacggatgcaccaaccgtggacggaccatctgaaagttctgcagaagttggtttgctttgttcacagccttaccaacaattggcagaaacatgtcgcaagatactactgaacatcacgttggctcaaagcaataatgatgtagtggacacacttccatctttgaagaatgcacaggaaattgcacggaagatgatataa

SEQ ID NO: 4466 - protein, 1100 aa, Sorghum bicolor
  misc_feature: Ceres ANNOT ID no. 6037976
  misc_feature (767)..(1023): Pfam Id: MutS_V Pfam Desc: MutS domain V
  misc_feature (112)..(226): Pfam Id: MutS_I Pfam Desc: MutS domain I
  misc_feature (420)..(764): Pfam Id: MutS_III Pfam Desc: MutS domain III
  misc_feature (1)..(1100): NCBI GI: 32488645 NCBI Desc: osjnba0032f06.21 [oryza sativa (japonica cultivar-group)]
  misc_feature (1)..(810): NCBI GI: 115461400 NCBI Desc: os04g0682900 [oryza sativa (japonica cultivar-group)]
  misc_feature (1)..(1052): NCBI GI: 3319876 NCBI Desc: msh3 protein [arabidopsis thaliana]
  misc_feature (263)..(1100): NCBI GI: 49615728 NCBI Desc: dna mismatch repair protein [petunia x hybrida]
  misc_feature (519)..(1037): NCBI GI: 68299763 NCBI Desc: muts homolog 3 [mus musculus]
MGKPKQQVLSRFFSPKPGPAPAAADPPPPPPPPPNPKPSAAHPPISTVASFSPAKRARALSLSPKPPAAKRPNPTPPPSRDAVRRRLLEPLDPPPPRSLKPTAPGGGGKGYTPLEQQVVDLKARHPDVLLMVEVGYRFRFFGEDAAVAAAVLGIVAHPDRSFLTASIPTFRLGFHVRRLVAAGHKVGVVRQTETAAIKAAAGGAGGAPFARGLSAVYTRATIEAAAGELEGGGAATPEEGSSYLVCVVDKEVEAAGREGLQVKVGMVAIEVSTGEVIHGEFLDSDSRSGLEAVLLGLAPVEVILGTPLSFATDKIMKAYLGPTSNVRVERVSCECFGEGGALAELITLFEKSLDNASRAEDDRKLIQTNDDNNNLHGIEGIMAMPELVVQALALSVRYLKGFGMERIICFGSSFRPFSAGTEFSLSANALQQLEVFRNNSDGATEGSLFQTMNNTCTSFGSRLFRNWLTHPLCDRHLICARHDAVSEIFESMGSQHSVNNLQDGGDRSCTASARSDLCTVLSSVLALLGRSLDIQRGITRVFHCKATAKEFVGVIQSILTVGKQLQKLVLEDIGTVSSQHKPVHSSLLRRLISTASSPTVLNSAVKLLSCLNKDAADQGDMLNLFIASVDQFPEVTEGHVNVKMADHKLDLLIVEYRKQLGMRNLEFKTVAGTTHLIELPVDRRVPSNWIKINSTKKAIRYHTPEILKNLDNLLLAKEELAVICRSMWHKFLTDFGEYYAQFQAVVESLAALDCLYSFAVLAKQNNYIRPIFVHDNEPSQIHIKDGRHPVLESLLGNNFVPNDTELHTDGEYCQIVTGPNMGGKSCYIRQVALITMMAQVGSFVPASSAMLHVVDGIYTRMGASDSIQQGTSTFHEEMNEASNILRNCSARSLVIIDELGRGTSTHDGVAIAYATLHYLLKEKKCIVIFVTHYPKILDIQREFEGSVGAYHVSYLATMKLLEVTDKPVETSPEANNLGEIIFLYKLVAGASDRSFGLNVALLAQLPSRCIKRASVMAAKLQEELSAREENKLRRTTDAPTVDGPSESSAEVGLLCSQPYQQLAETCRKILLNITLAQSNNDVVDTLPSLKNAQEIARKMI

SEQ ID NO: 4467 - DNA, 750 bp, Sorghum bicolor
  misc_feature: Ceres ANNOT ID no. 6037980
  misc_feature: Encodes the peptide sequence at SEQ ID NO 4468
atggccgccgcggggaggaatgcgggcgtcctcgcgctcttcgatgtcgacggcactctcacagcgccgcgcaaggtggtgacgccagagatgctagagttcatgaagcagctgcgccagcatgtgactgtgggcgtggttggcggatccgatcttgtgaagattactgagcagctcggcaatacagttattactgattatgattacgtcttctccgaaaacggcctggttgcacacaaaaatggccaactaattggaactcaaagtttgaaatcatttgtcggagaagacaagctaaaggaatttattaacttcactcttcattacattgctgacttggatatcccaattaaaaggggtacgttcatagagttccgaagtggaatgattaatgtatctcctataggaagaaactgtagccaagaagaacgtgatgaatttgagaagtatgataaggtgcataacattcgacctaaaatggtgtcagtgcttcgtgaaaagtttgcacacttgaacctgacattttctattggagggcagattagttttgatgtatttccccaaggttgggacaaaacttactgcttgagatatcttgaggaatttcaagaaatccatttctttggggataagacatacaagggtggcaatgactatgagatatttgaatctgaaagaacagttggccatacagttaccagccccaatgacacagctcagcaatgcagatctctcttcatgtcgaagtga

SEQ ID NO: 4468 - protein, 249 aa, Sorghum bicolor
  misc_feature: Ceres ANNOT ID no. 6037980
  misc_feature (31)..(248): Pfam Id: PMM Pfam Desc: Eukaryotic phosphomannomutase
  misc_feature (3)..(249): NCBI GI: 90399073 NCBI Desc: h0124b04.12 [oryza sativa (indica cultivar-group)]
  misc_feature (1)..(249): NCBI GI: 90762172 NCBI Desc: phosphomannomutase [triticum aestivum]
  misc_feature (4)..(247): NCBI GI: 90762150 NCBI Desc: phosphomannomutase [glycine max]
  misc_feature (4)..(247): NCBI GI: 87162644 NCBI Desc: had-superfamily hydrolase subfamily iib [medicago truncatula]
  misc_feature (4)..(249): NCBI GI: 90762161 NCBI Desc: phosphomannomutase [nicotiana tabacum]
  misc_feature (11)..(246): SWISSPROT Homolog: EC 5.4.2.8 Phosphomannomutase
MAAAGRNAGVLALFDVDGTLTAPRKVVTPEMLEFMKQLRQHVTVGVVGGSDLVKITEQLGNTVITDYDYVFSENGLVAHKNGQLIGTQSLKSFVGEDKLKEFINFTLHYIADLDIPIKRGTFIEFRSGMINVSPIGRNCSQEERDEFEKYDKVHNIRPKMVSVLREKFAHLNLTFSIGGQISFDVFPQGWDKTYCLRYLEEFQEIHFFGDKTYKGGNDYEIFESERTVGHTVTSPNDTAQQCRSLFMSK

SEQ ID NO: 4469 - DNA, 954 bp, Sorghum bicolor
  misc_feature: Ceres ANNOT ID no. 6037990
  misc_feature: Encodes the peptide sequence at SEQ ID NO 4470
atggcgggctccgcggtggccgtcgtcttcctttcggccgtcgcgctgctctgcctgtacaaccacctccacctctccctctccgacccggcatccgtcgtccccgtccccgtccccgccgccgccgtccgctcgcaccgccgcgccggtggccaccgtaccaacaccactccgtccgggtccggcaacatcgtcctccgcttcggcatgtccgggcagccgctccgcgtctactcccccgcccccacccccaccgctggcggcggcatccctgacatcgacacgttccgcgacaagctcgaccggctgctgcccgactggtcgcgcttcgacggcgagctcggccccatgcaccggtacttcgggctggacgggccgctggacgtgcgtcagcggctcgcgtacctgttcgtgatccttgaccggtcgcctagggacggaggcgtcggcgtcgacgagctggaggcgtggctgcgccggcaggccgtcgcccggctggacgccgtcacgcggagggagatggcccggcacgacagggaccgcaacggtgccgtcacgctgcgcgaattcttcgcagtaatatttgtttggttggtttgggtggagaacagtgagatggaccatgacggagatggaaggataaacttggaggagtttgtcgcccaatctgatcttgagcgtgccgaagctgaagagaagttcagagaattggacgccgacatggacaactacttgacggtggaagaagcacgctctgtactgcaaagcctcattacaggggagttctcatatgctacttcacatgccaaatttttgatgaaggctgatgttaaccaagacggcaaattgtcgctggaggagatgctagatgactacgtatccttctacagcaccgtttatacggatgatcattacagcaatgaagttgatagtgattcccacgacgagctatga

SEQ ID NO: 4470 - protein, 317 aa, Sorghum bicolor
  misc_feature: Ceres ANNOT ID no. 6037990
  misc_feature (33)..(193): NCBI GI: 38345557 NCBI Desc: osjnba0032f06.6 [oryza sativa (japonica cultivar-group)]
  misc_feature (33)..(193): NCBI GI: 115461380 NCBI Desc: os04g0681500 [oryza sativa (japonica cultivar-group)]
  misc_feature (33)..(193): NCBI GI: 90399062 NCBI Desc: h0124b04.1 [oryza sativa (indica cultivar-group)]
  misc_feature (197)..(317): NCBI GI: 140070233 NCBI Desc: calcium-binding ef-hand [medicago truncatula]
  misc_feature (173)..(317): NCBI GI: 46806523 NCBI Desc: calcium-binding ef hand family protein-like [oryza sativa (japonica cultivar-group)]
MAGSAVAVVFLSAVALLCLYNHLHLSLSDPASVVPVPVPAAAVRSHRRAGGHRTNTTPSGSGNIVLRFGMSGQPLRVYSPAPTPTAGGGIPDIDTFRDKLDRLLPDWSRFDGELGPMHRYFGLDGPLDVRQRLAYLFVILDRSPRDGGVGVDELEAWLRRQAVARLDAVTRREMARHDRDRNGAVTLREFFAVIFVWLVWVENSEMDHDGDGRINLEEFVAQSDLERAEAEEKFRELDADMDNYLTVEEARSVLQSLITGEFSYATSHAKFLMKADVNQDGKLSLEEMLDDYVSFYSTVYTDDHYSNEVDSDSHDEL

SEQ ID NO: 4471 - DNA, 1758 bp, Sorghum bicolor
  misc_feature: Ceres ANNOT ID no. 6037996
  misc_feature: Encodes the peptide sequence at SEQ ID NO 4472
atggcgggcggcgagggctcggccgcggtcgcggaggagggggagatgcggtcgctggcgctcacgccgacgtggtccgtcgccaccgtgctcaccctcctcgtcgccggctcgctcctcatcgagcgctccatccaccgcctcagcaattggctgaagaaaacccaccggaatccactgtacaaagcaatggagaagatgaaagaagaaatgatgttgcttggattcatatctttgcttctggctgcaacttcaagaatcatctctggggtctgcatcgattccaagtactacaacagcagattctccccatgcaccaaagaagaggttgaagaatcgataaatgcagagcatgccattgctcacgcacgcaagcatctgctggaggtcatcctgcagcattcactgaggagaaatctaaaaactagttaccataaccatcaaggctgccgtgaggggtacgagtcatttgtttcgcatgaaggtttggagcagctgcaccggtttatatttgtaatggctgtgactcatgtggcatatagctgcttgacaatgttactagcaatactcaagatccataaatggagaaaatgggaggatgaagcattcagggataatcatgaatcattttctcagatcgcatatgagtcagcaactagaaggcaaccagcacttaccaaatcctattcattccgcttttggagccaaaataatgtggtcatgtggcttgtttgctttgttgcacaatttggtcagtctgttgttcgagcagactaccttatcctccgcaagggttttataatgacccacaatcttccgccaacatatgatttccacaattacatgatacgctcaatggaagaggagtttgagaagattgttggagtgagtggactgttgtggggcttcgttgtttgttttatgttatttaatgtagacggatcgaacctgtacttttggatagcaattcttcctgtaactcttgttcttctggtgggtgcaaagctgcagcatgtcatcgcaactctaacagcagagggtgcaaagatgagcacctatgggccaaggatacagccaagggatgatctcttttggttcaagaaaccagagtttctcctttggttaatacacttcgttctctttcagtggcaatttggttatgattcatgcttcatcaaaaaccaccttttggtatattgccgccttatactaggttacagtacattgcctgtttatgcgctggtcactcagatggggtccaaatacaaggcggcgctgatcccgcggaggatcagagagaccatacatgggtgggggaaggcgacgaggaagaagcgtcgtcgccgccgcggcgacgactcgacggcccgcacggagacgagcacggtgtgctcgctcacggacgacgacgaggacgacttcgacgaccaccaccacgggccgtcggacgagaccccgaggcccggggcccggggccgcccgccgtacctgaagatcgagatgcttcgtcagtcgggcagcggccacgacggccccaggcccggcaccccatgcttccaccccgcgcccatgccgacgccgggcggcggccgcggcagcgggcacgccatgctcctgcagcaggcctccgtctccgcgccgtcgtcgccgtcgtaccgcggaggcaacgtgaccaggtcggcgtccatgcccgggttcgccgcgctgaggatgggctccggcacgccgacgcgcatgagccatgaggagcccacgtga

SEQ ID NO: 4472 - protein, 585 aa, Sorghum bicolor
  misc_feature: Ceres ANNOT ID no. 6037996
  misc_feature (14)..(471): Pfam Id: Mlo Pfam Desc: Mlo family
  misc_feature (134)..(407): NCBI GI: 13784991 NCBI Desc: seven transmembrane protein mlo9 [zea mays]
  misc_feature (1)..(574): NCBI GI: 32487408 NCBI Desc: osjnbb0017i01.22 [oryza sativa (japonica cultivar-group)]
  misc_feature (13)..(407): NCBI GI: 14091598 NCBI Desc: membrane protein mlo14 [arabidopsis thaliana]
  misc_feature (11)..(405): NCBI GI: 13784981 NCBI Desc: seven transmembrane protein mlo4 [zea mays]
  misc_feature (15)..(405): NCBI GI: 14091578 NCBI Desc: membrane protein mlo4 [arabidopsis thaliana]
MAGGEGSAAVAEEGEMRSLALTPTWSVATVLTLLVAGSLLIERSIHRLSNWLKKTHRNPLYKAMEKMKEEMMLLGFISLLLAATSRIISGVCIDSKYYNSRFSPCTKEEVEESINAEHAIAHARKHLLEVILQHSLRRNLKTSYHNHQGCREGYESFVSHEGLEQLHRFIFVMAVTHVAYSCLTMLLAILKIHKWRKWEDEAFRDNHESFSQIAYESATRRQPALTKSYSFRFWSQNNVVMWLVCFVAQFGQSVVRADYLILRKGFIMTHNLPPTYDFHNYMIRSMEEEFEKIVGVSGLLWGFVVCFMLFNVDGSNLYFWIAILPVTLVLLVGAKLQHVIATLTAEGAKMSTYGPRIQPRDDLFWFKKPEFLLWLIHFVLFQWQFGYDSCFIKNHLLVYCRLILGYSTLPVYALVTQMGSKYKAALIPRRIRETIHGWGKATRKKRRRRRGDDSTARTETSTVCSLTDDDEDDFDDHHHGPSDETPRPGARGRPPYLKIEMLRQSGSGHDGPRPGTPCFHPAPMPTPGGGRGSGHAMLLQQASVSAPSSPSYRGGNVTRSASMPGFAALRMGSGTPTRMSHEEPT

SEQ ID NO: 4473 - DNA, 792 bp, Sorghum bicolor
  misc_feature: Ceres ANNOT ID no. 6038016
  misc_feature: Encodes the peptide sequence at SEQ ID NO 4474
atggcgtggatctggatggtcctcgcggcgggagccgtgctcctgtgggcgatttctctggggcggattctctcctactcctctccgtcctgtgtgcccctgagcccgcagttcatgccccctctccgcggcgacaggaggagccggaacgtgctgctcgtcgtcgcccaccccgacgacgagtccatgttttttgctccaactattctttttcttaagtcaaaaggtcacaacattcacattctgtgcatgtctcgaggtaatgctgatggtcttggaaatactcgtaaagaagaattgtaccatgcatgtgaaacccttaagattccacatgaacaagttaaagtcttggaccacccgaaattgcaggatggatttcatgagcaatgggaccatggactagtagcagaacttaccatggagcatgtcctgctatgggccattgacacgattgtaacatttgattcatatggagtatcaggccatccaaaccacaaagatgttcatcatggcatatgcaagtttctccatgcaaacaggcaaggaaatgttgaagcttgggaactagcaagcctgaatattcttcgcaagtacagtggtccagttgacatttggctttcttccttgatctccttctcaaggtcaaagcagtcaatctatactctagttaacagtagcccgtcccgaagctatgaggcaatggctgcacacagaagtcagtgggtttggtttagaagattgtttgtcatgttctctagttatacgtacataaatacgctacagaaaatttaa

SEQ ID NO: 4474 - protein, 263 aa, Sorghum bicolor
  misc_feature: Ceres ANNOT ID no. 6038016
  misc_feature (52)..(176): Pfam Id: PIG-L Pfam Desc: GlcNAc-PI de-N-acetylase
  misc_feature (1)..(263): NCBI GI: 32487388 NCBI Desc: osjnbb0017i01.2 [oryza sativa (japonica cultivar-group)]
  misc_feature (1)..(150): NCBI GI: 90399046 NCBI Desc: h0402c08.18 [oryza sativa (indica cultivar-group)]
  misc_feature (151)..(263): NCBI GI: 20197670 NCBI Desc: similar to pig-l [arabidopsis thaliana]
  misc_feature (43)..(260): NCBI GI: 89287374 NCBI Desc: uncharacterized lmbe-like protein, cog2120 containing protein [tetrahymena thermophila sb210]
  misc_feature (42)..(263): NCBI GI: 134059625 NCBI Desc: n-acetylglucosaminylphosphatidylinositoldeacety la se [leishmania braziliensis]
MAWIWMVLAAGAVLLWAISLGRILSYSSPSCVPLSPQFMPPLRGDRRSRNVLLVVAHPDDESMFFAPTILFLKSKGHNIHILCMSRGNADGLGNTRKEELYHACETLKIPHEQVKVLDHPKLQDGFHEQWDHGLVAELTMEHVLLWAIDTIVTFDSYGVSGHPNHKDVHHGICKFLHANRQGNVEAWELASLNILRKYSGPVDIWLSSLISFSRSKQSIYTLVNSSPSRSYEAMAAHRSQWVWFRRLFVMFSSYTYINTLQKI

SEQ ID NO: 4475 - DNA, 519 bp, Sorghum bicolor
  misc_feature: Ceres ANNOT ID no. 6038019
  misc_feature: Encodes the peptide sequence at SEQ ID NO 4476
atggagtggccgccgccatcaacgtcgccgtcgccgtcgctggtggtgcgcagccccagacagacggtcagcctgatccgcaaccgccgaccccaccgcgactgggccccctcctcgaggtccccctccttcgccgcccgcgaccatggccccaagccgtcggaggtgtacggcttcgtcggatccatcaccacagtcatcgccaccgctgtctacctcgcctgggcatacacgcctgagcccgtcctccggtctctcggcatcacctactaccctagcaagtattgggcactggcggtgccatcgtttgtgattgtggctgtggcgctgtccatgggcatctacatgggtctcaacttcgttgccacgcctcctccaacttccttcagtactatcttcgatgaaaacagtcgggagcgcacaacgttttctcctgccattgaggaggagagacccatcgaacccatctcagacattagcattgatcagataaacaatcttatgtttggtgatagatga

SEQ ID NO: 4476 - protein, 172 aa, Sorghum bicolor
  misc_feature: Ceres ANNOT ID no. 6038019
  misc_feature (52)..(170): Pfam Id: PIG-P Pfam Desc: PIG-P
  misc_feature (15)..(127): NCBI GI: 78709033 NCBI Desc: new cdna-based gene [oryza sativa (japonica cultivar-group)]
  misc_feature (4)..(169): NCBI GI: 28828932 NCBI Desc: similar to homo sapiens (human). npd010 [dictyostelium discoideum]
  misc_feature (39)..(169): NCBI GI: 11359866 NCBI Desc: down syndrome critical region protein 5 beta - human
  misc_feature (39)..(169): NCBI GI: 8698817 NCBI Desc: dscr5b [homo sapiens]
  misc_feature (39)..(169): NCBI GI: 119630129 NCBI Desc: phosphatidylinositol glycan, class p, isoform cra_a [homo sapiens]
MEWPPPSTSPSPSLVVRSPRQTVSLIRNRRPHRDWAPSSRSPSFAARDHGPKPSEVYGFVGSITTVIATAVYLAWAYTPEPVLRSLGITYYPSKYWALAVPSFVIVAVALSMGIYMGLNFVATPPPTSFSTIFDENSRERTTFSPAIEEERPIEPISDISIDQINNLMFGDR

SEQ ID NO: 4477 - DNA, 2109 bp, Sorghum bicolor
  misc_feature: Ceres ANNOT ID no. 6038024
  misc_feature: Encodes the peptide sequence at SEQ ID NO 4478
atgtgtgtcaatcacatagatagtaaagctggccaactgggtgtaagagatgataacaggtctgattttgaggagccctttaaaatttctgggatgtggcaatgctccatctgcacgcatgaaaattctacagataatttatcttgtgagctatgtggtgtacttcgtgatctctcactgtatttcaataatatcagtgaagccaaagatggagctaaatgcagacacaagtattctggggtatccatactcgcaagatctctttttacaccatctagtacaaagtcaaaggctattgttttttctgatggtttcaaagacagtagaaatacaacagggaataagcaagctaccatggatgctctacataagacatacatgactcgcaaaaagcgccacattaacatagtgcctttcaagtttgatacaccatctccagatgacatggtcgttacaggcttaaaatcatccagaaactttagaaaagttgacacaaaggttctagttaaagattctgttgacgtgaccggaaagaagatgatagataataatattcttctaactgaaaagagtacaagtatggacccaagtgcatcagtacaattggatgaagttggtggatctagtagcaatgttccttccagtagtcaaaatacaactcttgttttggaccataagctacaacatttgagtttggagagcaaaccaaagaacagtaaacccaatattaagaaagcaacttccgtttcacactacaagccagaaccatggatgctcgagagtgaagatcaagaaatctgtaaacagctaagtcttgccattgttggtcatgtggattctgggaaatcaactttatgtggtcgattacgacatgctctgggattgatttcaaaaaaacaaatgcataaatatgagaaagaagctaaagaaaaggggaaagggtcatttgcatatgcttgggctatggatgagagcagtgacgagagggagcgtggcattacaatgactgtggctgtagcatactttaatagtgaaaaataccgtgtggttttgcttgactcccctggtcacaaggattttgttcctaatatgatatctggtgctacacaagctgatgcagccatcctagttgtcgatgcatctataggctcatttgaagctggcatgggtgttaatggaattggtcagacaaaggaacactcacaacttattaggagctttggtgttgagaacttgatagttgctgttaataagatggatgtggtggaatattcgaaggagcggtttcagtccattaaatcacaacttggtatctttcttcgttcatgtgggtacaaagactcttcagtcacctgggttcctttgagtgcaatggcaaatgaaaatttagtcacagcttcttcagattctcgtcttctatcatggtacaatggagattgtctgctgaaagccattgactcattacctcctccccatcgtgacgtttcaaggccactgcgccttccaatatgtgatgttattgcatctcacacgctgggtcaggtggctgtttgtggtaaagtagagtctggagggatccgaactggctctaaggtacttgtcatgccttctggagatatagctacagtaagaaccattgagcgggattcctctacttgcagcttggctagagccggggacaatgttgccattggtctgcatgggatcgaccctggccatattgtgtcaggtggagttctttgccatccagatttccccgtgcgcgtcgcttctcacttggagctgaaagttttggttctagaaatcaccatgccaatactggttggtcttcagtttgagctacacatacatcacgcgagggtgtcagcgaggttggttaaaatactgtcgtcgttggaccagaagactggcaaggccttaaagaaaatgccacgtttgctcaccgcgaggcaggccgccgtggttgaagtgaagctggacaaagaagtgtgcgtggaagaattctcgacgctgaaggcccttgggcgggtgttcctgcggtctcagggtaacaccgttgcagtgggcattgtgactcgaattctggatcaggatttgaacctcgattaa

SEQ ID NO: 4478 - protein, 702 aa, Sorghum bicolor
  misc_feature: Ceres ANNOT ID no. 6038024
  misc_feature (268)..(490): Pfam Id: GTP_EFTU Pfam Desc: Elongation factor Tu GTP binding domain
  misc_feature (587)..(695): Pfam Id: GTP_EFTU_D3 Pfam Desc: Elongation factor Tu C-terminal domain
  misc_feature (514)..(581): Pfam Id: GTP_EFTU_D2 Pfam Desc: Elongation factor Tu domain 2
  misc_feature (270)..(420): Pfam Id: MMR_HSR1 Pfam Desc: GTPase of unknown function
  misc_feature (18)..(697): NCBI GI: 115461336 NCBI Desc: os04g0677800 [oryza sativa (japonica cultivar-group)]
  misc_feature (18)..(697): NCBI GI: 38344203 NCBI Desc: osjnba0064g10.19 [oryza sativa (japonica cultivar-group)]
  misc_feature (189)..(697): NCBI GI: 140055706 NCBI Desc: zinc finger, ranbp2-type; translation elongation factor tu [medicago truncatula]
  misc_feature (137)..(700): NCBI GI: 115460266 NCBI Desc: os04g0595300 [oryza sativa (japonica cultivar-group)]
  misc_feature (191)..(700): NCBI GI: 115434174 NCBI Desc: os01g0116600 [oryza sativa (japonica cultivar-group)]
MCVNHIDSKAGQLGVRDDNRSDFEEPFKISGMWQCSICTHENSTDNLSCELCGVLRDLSLYFNNISEAKDGAKCRHKYSGVSILARSLFTPSSTKSKAIVFSDGFKDSRNTTGNKQATMDALHKTYMTRKKRHINIVPFKFDTPSPDDMVVTGLKSSRNFRKVDTKVLVKDSVDVTGKKMIDNNILLTEKSTSMDPSASVQLDEVGGSSSNVPSSSQNTTLVLDHKLQHLSLESKPKNSKPNIKKATSVSHYKPEPWMLESEDQEICKQLSLAIVGHVDSGKSTLCGRLRHALGLISKKQMHKYEKEAKEKGKGSFAYAWAMDESSDERERGITMTVAVAYFNSEKYRVVLLDSPGHKDFVPNMISGATQADAAILVVDASIGSFEAGMGVNGIGQTKEHSQLIRSFGVENLIVAVNKMDVVEYSKERFQSIKSQLGIFLRSCGYKDSSVTWVPLSAMANENLVTASSDSRLLSWYNGDCLLKAIDSLPPPHRDVSRPLRLPICDVIASHTLGQVAVCGKVESGGIRTGSKVLVMPSGDIATVRTIERDSSTCSLARAGDNVAIGLHGIDPGHIVSGGVLCHPDFPVRVASHLELKVLVLEITMPILVGLQFELHIHHARVSARLVKILSSLDQKTGKALKKMPRLLTARQAAVVEVKLDKEVCVEEFSTLKALGRVFLRSQGNTVAVGIVTRILDQDLNLD

SEQ ID NO: 4479 - DNA, 2763 bp, Sorghum bicolor
  misc_feature: Ceres ANNOT ID no. 6038026
  misc_feature: Encodes the peptide sequence at SEQ ID NO 4480
atgacgaccaacaccaagcgcgcctacaagctccaggagtttgtggcgcactcttccaatgttaactgcctcaagattgggaggaagacctcgcgggttcttgtcacaggaggagaggatcataaggtcaatctttgggctattgggaagcccaattcaatattgagtttatcagggcacacaagtgctgtggagtcggttggttttgattccacggaagtgtttgtggctgcaggagcagccagtggaacaataaaactatgggatttggaggaggcaaagattgtccgcactcttactgggcatagatcaaactgtatgtcagttgatttccatccgtttggggaattctttgcctctgggtcgttggacactaatctgaagatatgggatataagaaggaagaattgcatccatacatacaaaggtcacacacgaggggtgaatgctattagattcacacccgatggtcggtgggttgtgtctggtggtgaagataatatagtaaagctctgggatctgactgctggaaagttattacatgaattcaagtgtcatgagggtcagatccagtgcatagatttccacccccacgagttccttctggcaacaggttcagctgataaaactgtcaagttctgggatttggagacttttgagttgattggttctactggacctgagacaacaggtgttcgatccatgacattcaatcctgacggaagatctttgttatgtgggttgcatgaaagcttaaaggttttctcctgggagccaataagatgccatgatactgtggatgtgggatggtctaaacttgctgatttgaatgtccacgagggaaaacttcttggttgttctttcaatcaaagttgtgtaggaatatgggttgttgatctgacgcgtcttgagccatatgcaacgggtacttcaacaaaactaaatggtcattctgaattgaagactgtgtctagcggcactttgcctttacaaaatgatagtggctcaagggctaacatagggcgatcatcaaccttgcaaacttcagagaataacctaaaagcttcttcaggaagattgtcggcacaaaactcagattctgcacccaaagagactaaattggcaccctcaagcgggttggtcccaagcacaccacaaagggctggagttagctccaataatagatctgttggaaattcagcttttcaatctggtggtaccaccttaaagagaagttcattgcggagtaacagtgcatctaatgtccacaatttcagtaaagctgatgtagtgccagtcattgttcccagaactagctcaggaggggagttggctactgattctagaagtgatgctgctgatgtggcacctgttcttcctaaggtaaccagaagggttgatcctgctactgattctagaaaagaaagtaatgatgtggatcttgttattcctaaagcaagctcaagagtggaaatagcctctgattcagcacccgtttctactttcaagtcaggcagaaggttggaggctgcccctgattcaaaaaaagaaagtgctgatacaacacctgttgttcccaatcctagggcaaatgcaagaatggagatggcctctgattctgcgcctgctctttcaaaggcaaacagaaagctagattctggtactgattcaaagaaagaaagtgttgatgcagtacctgccattgtacccagagcaaattctagaatggaaatgaattctgattctaggagagaaccctctgctggaagagtatcaccattcagaatccagtcaagatatgctgagctacggaagctaacccatgccaaaattgatgcaaacaaagttgacagtggaagtaaaattactgaaacagatgacttcaattgccaaatatttcttccccgtagaaatggtgtttttcaaataagttctgaagaatcccgcgaagatgtaaagtgtggtccagctgacaggatgggattttcaaattcgtcagaaccaaatgcaagtgtccgcagtgagaattatgtttctagaatgcgcaaaccaagagataactgctatattgaagtttcaagagcagggagagcaaggtcaaatgtctctaattgggaagggagggatcagtcccctagtcacgaagaaccgacaacaagcagttcttcgctggctcctacaggccgtccatattcatctagaggaagcaaacaagcttctgaaactccaatcatagttagtgatgaagatgttctatcacttctcatggaacaacatgacttatttctaagctcaacaaagtctcggctgacaaaattgcagattattcatcaaatgtgggaaagaaatgacatcaggggtgtgctctccgcgatggagaggatgggtgatcatgctgtctgtgctgatatggctagtgttctgatggagaaaagtgaaataataacacttgatttatgtacctctatcctgcctgctgtcactgatcttctggagagtaaaattgacagacacttgtccgtcacattggaattgttggtgaagcttgtaaggacttttggtccaatgatacattcaacagtatcatcaggtccttgtgttggcgtagaccttgaagcagagcaaaggagggagcgctgcaacttatgcttcattgaattggagaaggccaaaaataagcttccgtctctaacaagaagaaaaggggcggttgcaaatgctgcacaagagcttgctcttgtcttccaggaaatcatgagttga

SEQ ID NO: 4480 - protein, 920 aa, Sorghum bicolor
  misc_feature: Ceres ANNOT ID no. 6038026
  misc_feature (8)..(47): Pfam Id: WD40 Pfam Desc: WD domain, G-beta repeat
  misc_feature (51)..(89): Pfam Id: WD40 Pfam Desc: WD domain, G-beta repeat
  misc_feature (93)..(131): Pfam Id: WD40 Pfam Desc: WD domain, G-beta repeat
  misc_feature (135)..(173): Pfam Id: WD40 Pfam Desc: WD domain, G-beta repeat
  misc_feature (177)..(215): Pfam Id: WD40 Pfam Desc: WD domain, G-beta repeat
  misc_feature (1)..(919): NCBI GI: 38344202 NCBI Desc: osjnba0064g10.18 [oryza sativa (japonica cultivar-group)]
  misc_feature (12)..(721): NCBI GI: 90398971 NCBI Desc: h0801d08.1 [oryza sativa (indica cultivar-group)]
  misc_feature (12)..(721): NCBI GI: 115461334 NCBI Desc: os04g0677700 [oryza sativa (japonica cultivar-group)]
  misc_feature (4)..(522): NCBI GI: 10178281 NCBI Desc: katanin p80 subunit-like protein [arabidopsis thaliana]
  misc_feature (6)..(458): NCBI GI: 53792220 NCBI Desc: katanin p80 (wd40-containing) subunit b 1-like protein [oryza sativa (japonica cultivar-group)]
  misc_feature: The sequence is a functional homolog of SEQ ID NO. 502 in the 11/188,298 US application
  misc_feature: The sequence is a functional homolog of SEQ ID NO. 485 in the 11/188,298 US application
MTTNTKRAYKLQEFVAHSSNVNCLKIGRKTSRVLVTGGEDHKVNLWAIGKPNSILSLSGHTSAVESVGFDSTEVFVAAGAASGTIKLWDLEEAKIVRTLTGHRSNCMSVDFHPFGEFFASGSLDTNLKIWDIRRKNCIHTYKGHTRGVNAIRFTPDGRWVVSGGEDNIVKLWDLTAGKLLHEFKCHEGQIQCIDFHPHEFLLATGSADKTVKFWDLETFELIGSTGPETTGVRSMTFNPDGRSLLCGLHESLKVFSWEPIRCHDTVDVGWSKLADLNVHEGKLLGCSFNQSCVGIWVVDLTRLEPYATGTSTKLNGHSELKTVSSGTLPLQNDSGSRANIGRSSTLQTSENNLKASSGRLSAQNSDSAPKETKLAPSSGLVPSTPQRAGVSSNNRSVGNSAFQSGGTTLKRSSLRSNSASNVHNFSKADVVPVIVPRTSSGGELATDSRSDAADVAPVLPKVTRRVDPATDSRKESNDVDLVIPKASSRVEIASDSAPVSTFKSGRRLEAAPDSKKESADTTPVVPNPRANARMEMASDSAPALSKANRKLDSGTDSKKESVDAVPAIVPRANSRMEMNSDSRREPSAGRVSPFRIQSRYAELRKLTHAKIDANKVDSGSKITETDDFNCQIFLPRRNGVFQISSEESREDVKCGPADRMGFSNSSEPNASVRSENYVSRMRKPRDNCYIEVSRAGRARSNVSNWEGRDQSPSHEEPTTSSSSLAPTGRPYSSRGSKQASETPIIVSDEDVLSLLMEQHDLFLSSTKSRLTKLQIIHQMWERNDIRGVLSAMERMGDHAVCADMASVLMEKSEIITLDLCTSILPAVTDLLESKIDRHLSVTLELLVKLVRTFGPMIHSTVSSGPCVGVDLEAEQRRERCNLCFIELEKAKNKLPSLTRRKGAVANAAQELALVFQEIMS

SEQ ID NO: 4481 - DNA, 1542 bp, Sorghum bicolor
  misc_feature: Ceres ANNOT ID no. 6038030
  misc_feature: Encodes the peptide sequence at SEQ ID NO 4482
atggcgaacatcgacatggcgaagatcctggcggacctggaccgcggcgccggcgacgcgcgggtgcccaagaccaagctcgtctgcacgctcggcccggcctcccgcaccgtgcctatgctcgagaagctgcttcgcgccggcatgaacgtcgcgcgcttcaacttctcccacggcacccacgagtaccaccaggagacgctcgacaacctccgacaggccatgcacaacaccggcatcctctgcgccgtcatgctcgacaccaagggtcctgagattcgtacagggtttttgaaggatggtaaaccaattaagctaaccaagggtcaagaaatcactgtcaccactgattatgatatcaagggtgatgaaaatatgattgctatgagttacaagaaactgcctgttgacgtgaagcctggaaatgtcatactctgcgcagatggtactatctctctggccgttctgtcttgcgatcctgatgctggaactgtgaggtgtaggtgtgagaacactgcaatgcttggtgagagaaagaactgcaatttgccaggaattgttgtggatcttcctacattaactgagaaagataaagaagacattttgggctggggtgttccaaatgatattgacatgattgctctatcctttgtccgtaaaggatcagatctggtgactgtcagacaggttcttgggcagcatgccaagcgcattaagttgatgtcaaaggttgaaaaccaagagggtgttgtaaactttgatgagatcttgagggagactgatgcttttatggttgctagaggtgatctgggaatggagattccagttgagaagattttccttgcacagaagatgatgatctacaagtgcaacattgctggcaaacctgttgttactgctacccagatgctcgagtcaatgatcaaatctcctaggccaacacgtgctgaggccactgatgttgcaaatgccgttcttgatggaactgactgtgtcatgctcagtggtgagagtgctgctggagcctaccctgaggtggctgtgaagatcatggctcgtatctgcattgaagcagaatcttccctggaccacgaggcagttttcaaggcgatgatcaggtccgcgcctcttccaatgagtcctctggagtctcttgcatcatctgctgtgcgaactgccaacaaggccaaggccgccctgattgtcgtcttgactcgcggtggcaccacggccaagctggtcgccaagtaccgccccagggttcccatcctctctgttgtcgtacctgtgctaacgacggattctttcgactggaccatcagctccgagggcccagctaggcacagcctgatctacagaggtctcattcccctccttgctgagggctctgcaaaggctacagattcagagtcgacagaggtgatcttggaggctgcgctgaagtcggctgtgcagaagcagctttgcaagcctggtgattccatcgtggctcttcaccgtattggcgtcgcctctgtcatcaagatctgcatcgtgaagtga

SEQ ID NO: 4482 - protein, 513 aa, Sorghum bicolor
  misc_feature: Ceres ANNOT ID no. 6038030
  misc_feature (22)..(368): Pfam Id: PK Pfam Desc: Pyruvate kinase, barrel domain
  misc_feature (382)..(511): Pfam Id: PK_C Pfam Desc: Pyruvate kinase, alpha/beta domain
  misc_feature (1)..(513): NCBI GI: 90399037 NCBI Desc: h0402c08.9 [oryza sativa (indica cultivar-group)]
  misc_feature (1)..(513): NCBI GI: 38344200 NCBI Desc: osjnba0064g10.16 [oryza sativa (japonica cultivar-group)]
  misc_feature (1)..(513): NCBI GI: 68138979 NCBI Desc: pyruvate kinase [citrus sinensis]
  misc_feature (1)..(513): NCBI GI: 22296818 NCBI Desc: pyruvate kinase [glycine max]
  misc_feature (1)..(513): NCBI GI: 2497538 NCBI Desc: pyruvate kinase, cytosolic isozyme (pk)
  misc_feature (1)..(513): SWISSPROT Homolog: EC 2.7.1.40 Pyruvate kinase, cytosolic isozyme
MANIDMAKILADLDRGAGDARVPKTKLVCTLGPASRTVPMLEKLLRAGMNVARFNFSHGTHEYHQETLDNLRQAMHNTGILCAVMLDTKGPEIRTGFLKDGKPIKLTKGQEITVTTDYDIKGDENMIAMSYKKLPVDVKPGNVILCADGTISLAVLSCDPDAGTVRCRCENTAMLGERKNCNLPGIVVDLPTLTEKDKEDILGWGVPNDIDMIALSFVRKGSDLVTVRQVLGQHAKRIKLMSKVENQEGVVNFDEILRETDAFMVARGDLGMEIPVEKIFLAQKMMIYKCNIAGKPVVTATQMLESMIKSPRPTRAEATDVANAVLDGTDCVMLSGESAAGAYPEVAVKIMARICIEAESSLDHEAVFKAMIRSAPLPMSPLESLASSAVRTANKAKAALIVVLTRGGTTAKLVAKYRPRVPILSVVVPVLTTDSFDWTISSEGPARHSLIYRGLIPLLAEGSAKATDSESTEVILEAALKSAVQKQLCKPGDSIVALHRIGVASVIKICIVK

SEQ ID NO: 4483 - DNA, 1101 bp, Sorghum bicolor
  misc_feature: Ceres ANNOT ID no. 6038036
  misc_feature: Encodes the peptide sequence at SEQ ID NO 4484
atgctgccgtcgcacctcaacgggcactccgccctcggtcgcggccgcccgcgcctctccgccgccgccgcctccggggatttcgcggcagcggggataggggcggcggctccgctggaggagcacgaccgcatctacttccagtcttactcccacctcggcatccacgaggctatgatcaaggatcgcgtcaggactgatgcttaccacacagctatcatgcgccaccagaaatttgtcgaggggaaggttgtgctggatgtggggtgtgggactggaatactctctgtgttctgtgctcgtgctggtgcaaagcgagctcgtgaaatcgtaaaagcaaacaacctaactgatcaggttgtagtcatccatggacgtgtcgaggatgttgaccttgaggagaaggttgatgtgataatatcagaatggatgggctatatgcttctctatgagagtatgctgccaagcgtcctatttgcaagagataaatggcttaagcctgggggtcttattcttccttctcatgctacgctcttcatggctcccataacaaatcccgagagatatgaaagcagtgttgatttctggcgtgatgtctatggcataaacatgtctgctcttgtgccacttgccaaaaagtttacatctgaggaaccttccattgaaacaattggtggagagaatgttataagttggccagctgtgttcaagcacatcgattgctataattttacagctgaggaattcaaatctattaccacaaaatacaaagtttcatcaatgatgttagctcctattcatggctttggtttctggtttgaggtggagttcaatgggcctgcagagtcctctcataattttccttccaatttggatccacttgagattattcagaagaaaaggagacgatcatcagaagatgcagttttgtccacagcccccgaggatgagccaactcattggcaacaggtgaagcaggaccaaattatagaaggttctgtaacagtgtcccagagcgaggagaacccacgttttctgaatattcatctagagtgcaccacaggaggacagacattggtaaaggactgcgccatgcgatga

SEQ ID NO: 4484 - protein, 366 aa, Sorghum bicolor
  misc_feature: Ceres ANNOT ID no. 6038036
  misc_feature (1)..(366): NCBI GI: 38344195 NCBI Desc: osjnba0064g10.11 [oryza sativa (japonica cultivar-group)]
  misc_feature (37)..(366): NCBI GI: 140067418 NCBI Desc: sam (and some other nucleotide) binding motif [medicago truncatula]
  misc_feature (38)..(323): NCBI GI: 30685597 NCBI Desc: protein arginine n-methyltransferase family protein [arabidopsis thaliana]
  misc_feature (38)..(323): NCBI GI: 145332651 NCBI Desc: protein arginine n-methyltransferase family protein [arabidopsis thaliana]
  misc_feature (38)..(366): NCBI GI: 9293956 NCBI Desc: protein arginine n-methyltransferase-like protein [arabidopsis thaliana]
MLPSHLNGHSALGRGRPRLSAAAASGDFAAAGIGAAAPLEEHDRIYFQSYSHLGIHEAMIKDRVRTDAYHTAIMRHQKFVEGKVVLDVGCGTGILSVFCARAGAKRAREIVKANNLTDQVVVIHGRVEDVDLEEKVDVIISEWMGYMLLYESMLPSVLFARDKWLKPGGLILPSHATLFMAPITNPERYESSVDFWRDVYGINMSALVPLAKKFTSEEPSIETIGGENVISWPAVFKHIDCYNFTAEEFKSITTKYKVSSMMLAPIHGFGFWFEVEFNGPAESSHNFPSNLDPLEIIQKKRRRSSEDAVLSTAPEDEPTHWQQVKQDQIIEGSVTVSQSEENPRFLNIHLECTTGGQTLVKDCAMR

SEQ ID NO: 4485 - DNA, 1305 bp, Sorghum bicolor
  misc_feature: Ceres ANNOT ID no. 6038039
  misc_feature: Encodes the peptide sequence at SEQ ID NO 4486
atggccaacgcgaagggctcgtccgccggcgccgccggcgcaggccacgccgacctcggcagggccatttcacacgagcaacaccaggcgttcatgatggcttccgtgcaccgggccgccccgggggccgcgaacgtgcaccagcagcacttccaccagtaccccgccggcctgatccgggcgccggtgccaatgccggttcatgtaccggtgtcacagaccccgtactccgcccagatcgcggtgccgccgccgcagccgctcatcccaccgccagaccaccgcctgcactccctgccgcctaccggatgttaccaggattattctccatatggcaacacagcatctttgcagcacacagcagcaaggggttttgcagactggggagtgcacaacaatgcaattgtgtccttggctcatgccactagttttgccaacgggagcaacaatatcaacagcaatggattattacatcaaaatttatccccgtataccacccatacatggactactacttacgtgcagaggccttacaacactgcttatgctcctgcaacaatgaatatgctccaaactccttcctttcacagcaacaaccatgaaaaagagtcaggtgcagttttttcaaatagctttaacatgggcccatcagggacacctacctccccttttcaacttacgtctccaagctcaaccaactacacttccactcaaatctttgaggaaaccaacaacttagaggacacttcaagagtctttggaggtggggataatgaaagcaacaacagtgaggaaccagatcccactccggctgtggagatggaagacctaaaccagggcaatgggcatattagttttacaaataaaaaagtcaactgtcaagattaccgtatggtcttgcgcaaggacttgacaaacagtgatgttggaaacattggaagaattgtgctgccaaagaaagatgcagagcctaaccttccaatcttggaagataaggatggcctgatactggaaatggacgactttgagctcccagctgtatggaagtttaagtacaggtactggcctaataataagagtaggatgtatatcttggaaactactggtgaatttgttaagaggcatggacttcaagctaaggacatcctcatcatttacaggaacaagagatctggcagatatgttgcccgcgcggtgaaggctgagcacataccagcgccaggatgtgagtgcattaaggcaggcaatcccagagaagagtgcggcttctccgtcagtccttcggtcaagaagattatcacgtag

SEQ ID NO: 4486 - protein, 434 aa, Sorghum bicolor
  misc_feature: Ceres ANNOT ID no. 6038039
  misc_feature (299)..(402): Pfam Id: B3 Pfam Desc: B3 DNA binding domain
  misc_feature (248)..(431): NCBI GI: 32487512 NCBI Desc: osjnba0064g10.7 [oryza sativa (japonica cultivar-group)]
  misc_feature (1)..(431): NCBI GI: 32487511 NCBI Desc: osjnba0064g10.6 [oryza sativa (japonica cultivar-group)]
  misc_feature (42)..(403): NCBI GI: 38637288 NCBI Desc: transcription factor viviparous 1-like [oryza sativa (japonica cultivar-group)]
  misc_feature (294)..(400): NCBI GI: 109150382 NCBI Desc: abscisic acid insensitive 3 [arabidopsis thaliana]
  misc_feature (294)..(400): NCBI GI: 9279793 NCBI Desc: abscisic acid-insensitive protein 3 [arabidopsis thaliana]
  misc_feature: The plant flowers significantly late compared to wild-type.
  misc_feature: The sequence is a functional homolog of SEQ ID NO 44 in the 10/838,616US patent application
  misc_feature: The sequence is a functional homolog of SEQ ID NO 46 in the 10/838,616US patent application
  misc_feature: Useful for making plants with altered Lignin content
  misc_feature: Useful for making plants with altered terpenoid content
  misc_feature: Useful for making plants with modulated drought sensitivity
  misc_feature: Useful for making plants with modulated flowering time
  misc_feature: Useful for making plants with modulated growth and phenotype characteristics
  misc_feature: Functional homolog of the protein sequence given in SEQ ID NO 13233
  misc_feature: Functional homolog of the protein sequence given in SEQ ID NO 13375
  misc_feature: The sequence is a functional homolog of SEQ ID NO 44 in the 20060008874 US patent application
  misc_feature: The sequence is a functional homolog of SEQ ID NO 46 in the 20060008874 US patent application
MANAKGSSAGAAGAGHADLGRAISHEQHQAFMMASVHRAAPGAANVHQQHFHQYPAGLIRAPVPMPVHVPVSQTPYSAQIAVPPPQPLIPPPDHRLHSLPPTGCYQDYSPYGNTASLQHTAARGFADWGVHNNAIVSLAHATSFANGSNNINSNGLLHQNLSPYTTHTWTTTYVQRPYNTAYAPATMNMLQTPSFHSNNHEKESGAVFSNSFNMGPSGTPTSPFQLTSPSSTNYTSTQIFEETNNLEDTSRVFGGGDNESNNSEEPDPTPAVEMEDLNQGNGHISFTNKKVNCQDYRMVLRKDLTNSDVGNIGRIVLPKKDAEPNLPILEDKDGLILEMDDFELPAVWKFKYRYWPNNKSRMYILETTGEFVKRHGLQAKDILIIYRNKRSGRYVARAVKAEHIPAPGCECIKAGNPREECGFSVSPSVKKIIT

SEQ ID NO: 4487 - DNA, 1413 bp, Sorghum bicolor
  misc_feature: Ceres ANNOT ID no. 6038043
  misc_feature: Encodes the peptide sequence at SEQ ID NO 4488
atgtcgtcgtcggctgcggcgctcgcgtggcgccgcaccctccgcgacgccctcctgcgcggctccgcgtgccgcggcgcggcgcccgtgcggtacgccagcacggcctcggcgtccggcgcggcggcagaggccgcagctacagccgcgccgaagaaggtgcccccgccaccccgcaagggaaggcttttaactggggccatgatagcgttggccattggtggaggtgcttatgtgagtaccgcagatgaaggaaagttttgtggctggttattcaagtcgacagaactcgtgaacccactatttgcactgctggatgcagagtttgctcatagtttagctgttaaagctgctgcccatggatttgttccaagagaaaagagacctgatccaccagttcttgggctagaggtttggggaaggaagtttgcaaacccaattggtcttgctgctggctttgataaaaatgctgaggcagttgaaggtctcttaggcatgggatttggctttgtggaagttggctctgtgacacctcttcctcaagagggaaatcccaagcctcgaattttcagattaaaggagcatggtgctgtaatcaaccgatgcggattcaacagtgaaggaattgtagttgttgctaagcgtcttggggcacaacatggtaagcggaagatggaagaaacttcaagctccacgcctcccgcaaccagtgacataaagcaaggaggaaaagcaggacctggaatcttgggagtcaatcttggcaagaacaagactagtgaagatgctgctgctgactatgtgcaaggggttcatacattgtcacaatatgctgattacttggtcataaatatttcttccccaaatactcctggtcttcgcaaattacaaggtagaaagcaactgaaagatattgtgaagaaggtgcaagctgcacgagatgagatgcagtgggctgaagatggacctccaccattgcttgtgaagattgcaccagacttgtctaagcaggatcttgaggatattgctgcagttgcccttgctcttaggttggatggcctgattatatcaaacaccaccgtttccagaccaccacctgcagataaagatccattggctcaggaaattggtgggttaagtgggaaacctttgtttgacttatctactaacattctcagggagatgtatatgcttacacggggcaagattcccctcataggctgtggtggtgtgagcagtggtgaggatgcatacaagaagatccggtctggagctacacttgttcaactttatactgctcttgcatatggtggtccagctcttatacccagaataaagactgagctagcagaatgtttggaaagagatggtttcaaatctgttcaggaagcagtcggtgctgatttcagatga

SEQ ID NO: 4488 - protein, 470 aa, Sorghum bicolor
  misc_feature: Ceres ANNOT ID no. 6038043
  misc_feature (133)..(453): Pfam Id: DHO_dh Pfam Desc: Dihydroorotate dehydrogenase
  misc_feature (1)..(470): NCBI GI: 90399310 NCBI Desc: h0101f08.3 [oryza sativa (indica cultivar-group)]
  misc_feature (1)..(470): NCBI GI: 9909094 NCBI Desc: dihydroorotate dehydrogenase [oryza sativa (japonica cultivar-group)]
  misc_feature (47)..(470): NCBI GI: 18420660 NCBI Desc: dihydroorotate dehydrogenase, mitochondrial / dihydroorotate oxidase / dhodehase (pyrd) [arabidopsis thaliana]
  misc_feature (47)..(446): NCBI GI: 10177819 NCBI Desc: dihydroorotate dehydrogenase precursor [arabidopsis thaliana]
  misc_feature (47)..(440): NCBI GI: 16449 NCBI Desc: dihydroorotate dehydrogenase [arabidopsis thaliana]
  misc_feature (47)..(470): SWISSPROT Homolog: EC 1.3.3.1 Dihydroorotate dehydrogenase, mitochondrial precursor
MSSSAAALAWRRTLRDALLRGSACRGAAPVRYASTASASGAAAEAAATAAPKKVPPPPRKGRLLTGAMIALAIGGGAYVSTADEGKFCGWLFKSTELVNPLFALLDAEFAHSLAVKAAAHGFVPREKRPDPPVLGLEVWGRKFANPIGLAAGFDKNAEAVEGLLGMGFGFVEVGSVTPLPQEGNPKPRIFRLKEHGAVINRCGFNSEGIVVVAKRLGAQHGKRKMEETSSSTPPATSDIKQGGKAGPGILGVNLGKNKTSEDAAADYVQGVHTLSQYADYLVINISSPNTPGLRKLQGRKQLKDIVKKVQAARDEMQWAEDGPPPLLVKIAPDLSKQDLEDIAAVALALRLDGLIISNTTVSRPPPADKDPLAQEIGGLSGKPLFDLSTNILREMYMLTRGKIPLIGCGGVSSGEDAYKKIRSGATLVQLYTALAYGGPALIPRIKTELAECLERDGFKSVQEAVGADFR

SEQ ID NO: 4489 - DNA, 2163 bp, Sorghum bicolor
  misc_feature: Ceres ANNOT ID no. 6038049
  misc_feature: Encodes the peptide sequence at SEQ ID NO 4490
  misc_feature: Down-regulated in shoot tissues in response to salicylic acid treatment
atggcgacctctgcgctggactccctcccggcgccgctccggtcgctgcggctcaagacgaagcagcaggagctcctgctccgcgtctcggcgctggcgctcatctacgtgctcgccttcgccgtccgcctcttctccgtcctccgctacgagtccatgatccacgagttcgacccctacttcaactaccgcaccacgctcttcctcaccgagaacggcttcagcgagttctggaactggttcgactccgagagctggtacccgctcggccgcgtcgtcgggggcacgctcttcccgggtctcatggtgaccgccgcactgctccaccgcctcctccgcgcgctctccctcgccgtccacatccgcgaggtctgcgtactcacggcgcccttcttcgccgccaacaccacgctcgtcgcctacgccttcggccgcgagatctgggactccggggcggggctcgtcgccgccgcgctcatcgccatcgttcctggctacatctcccgctccgttgcggggtcctacgataacgagggcgtcgccatcttcgccctgctgctcaccttctacctcttcgtgcgcgccgtcaacacggggtcgctcgcctgggcgcttgcctcggcgttcggctacttctacatggtgtcggcgtggggaggctacgtgttcatcatcaatctaatcccactctacgtgcttgtgctgcttgtcactgggaggtattcgcagaggctctacgtggcctacaattgcatgtatgtgcttgggatgttgcttgcgatgcagatccgttttgttggattccagcatgtgcagtccggggagcacatggctgctatgggagtcttcttcctcttgcaggttttcttcttcttggactgggtgaaatacctgctaaatgatgccagactattcaagtcattccttcgaactactcttacatgtgtgattactgttggcaccctggctcttggaattggtactgcatcaggttacatctccccttggacaggacggttttactccctgcttgatcctacctatgcaaaggaccatataccaatcattgcgtctgtttctgagcatcagccaacagcatggtcatctttcatgtttgacttccacatcctccttttcctgttcccagctggcctttatttctgtttcaaacgcctgtcagatgccactatattcattgttatgtatggcctcacgagtatgtactttgctggtgtgatggtccggttaattcttgtggcagcaccagccgtttgtcttattagtgctattgctgcatctgctacaataaagaatctgaccactttgatccgggcaaagagcagaagtccacagactacttctggaaaaacaactggctcaaaggcagctgcaaagggtgcagttgatcaaagtttaccattccaacacaatgcagctattgctcttcttctgggtgccttttacttgctaagtaggtatgccatacactgcacttgggtgacatctgaggcttattcttctccatctatagttttggccgcaaggggtcataatggtggaagagtcatctttgatgattatcgtgaggcatactattggcttcgtcagaacactcctcctgatgctaagattatgtcttggtgggactatggataccaaattacagctatgggtaacagaactgtcattgttgataataatacatggaataacacacacatagctacagttggacgtgctatgtcatcttatgaagatgaagcatatgagatcatgcaatcacttgatgtgaactacgtgcttgttgtatttggaggtgttaccggatattcttcagatgatatcaacaagttcttatggatggtacgcattggtggaggagttttccctgtaatcaaagagccagattaccttgttaatggggagtatcgtattgacaagggggcagcaccaaaaatgctgaactatgcatggtacaagctttgttactaccgatttggagaacttaccacggaatatggaaagcctccagggtatgatcgtgtaagaggagtggagattggcaacaaagacataaaacttgaatacttggaggaggcatttacaacttcaaactggatagtgcgcatatacaaggtgaaacccccaaagaacaggtcctga

SEQ ID NO: 4490 - protein, 720 aa, Sorghum bicolor
  misc_feature: Ceres ANNOT ID no. 6038049
  misc_feature (26)..(671): Pfam Id: STT3 Pfam Desc: Oligosaccharyl transferase STT3 subunit
  misc_feature (2)..(720): NCBI GI: 90399055 NCBI Desc: h0103c06.8 [oryza sativa (indica cultivar-group)]
  misc_feature (2)..(720): NCBI GI: 38344929 NCBI Desc: osjnba0018m05.20 [oryza sativa (japonica cultivar-group)]
  misc_feature (23)..(464): NCBI GI: 60466846 NCBI Desc: oligosaccharyl transferase, stt3 subunit [dictyostelium discoideum]
  misc_feature (16)..(719): NCBI GI: 108880169 NCBI Desc: oligosaccharyl transferase [aedes aegypti]
  misc_feature (22)..(719): NCBI GI: 20129103 NCBI Desc: cg1518-pa [drosophila melanogaster]
  misc_feature (16)..(719): SWISSPROT Homolog: EC 2.4.1.119 Dolichyl-diphosphooligosaccharide--protein glycosyltransferase subunitSTT3A
  misc_feature: Useful for making plants with altered carbohydrate content
  misc_feature: Functional homolog of the protein sequence given in SEQ ID NO 13872
  misc_feature: Down-regulated in shoot tissues in response to salicylic acid treatment
MATSALDSLPAPLRSLRLKTKQQELLLRVSALALIYVLAFAVRLFSVLRYESMIHEFDPYFNYRTTLFLTENGFSEFWNWFDSESWYPLGRVVGGTLFPGLMVTAALLHRLLRALSLAVHIREVCVLTAPFFAANTTLVAYAFGREIWDSGAGLVAAALIAIVPGYISRSVAGSYDNEGVAIFALLLTFYLFVRAVNTGSLAWALASAFGYFYMVSAWGGYVFIINLIPLYVLVLLVTGRYSQRLYVAYNCMYVLGMLLAMQIRFVGFQHVQSGEHMAAMGVFFLLQVFFFLDWVKYLLNDARLFKSFLRTTLTCVITVGTLALGIGTASGYISPWTGRFYSLLDPTYAKDHIPIIASVSEHQPTAWSSFMFDFHILLFLFPAGLYFCFKRLSDATIFIVMYGLTSMYFAGVMVRLILVAAPAVCLISAIAASATIKNLTTLIRAKSRSPQTTSGKTTGSKAAAKGAVDQSLPFQHNAAIALLLGAFYLLSRYAIHCTWVTSEAYSSPSIVLAARGHNGGRVIFDDYREAYYWLRQNTPPDAKIMSWWDYGYQITAMGNRTVIVDNNTWNNTHIATVGRAMSSYEDEAYEIMQSLDVNYVLVVFGGVTGYSSDDINKFLWMVRIGGGVFPVIKEPDYLVNGEYRIDKGAAPKMLNYAWYKLCYYRFGELTTEYGKPPGYDRVRGVEIGNKDIKLEYLEEAFTTSNWIVRIYKVKPPKNRS

SEQ ID NO: 4491 - DNA, 1485 bp, Sorghum bicolor
  misc_feature: Ceres ANNOT ID no. 6038051
  misc_feature: Encodes the peptide sequence at SEQ ID NO 4492
atgcctgcgcttctcgtgaacaccgtctcggtctcccctgccgccccaaggccaggctcctcgtggccccccacgcccacggcacggcgagcaagcactcgccacaggtgccgagccgaagcatccggcagcggcaccaacggcggcgacagcggctacaggccggggggcgtccgcggctcgtgggtgtcggactacgacctgtacgagctgctgggcgtggagcggtcgtcgccgcagtcggagatcaaggcggcgtaccggtccctgcagaagcgatgccacccggacgtggccggcgccgcgggcgggcatgacatggctgtcgtcctcaacgaggtgtacgcgctgctctccgaccccgacgcgcgcctcgcctacgaccaggagcaggcgcgccgctccgagttcgccggctacacgggccgcccgctctactcctcctggctgggccccgagtccgagcgccgggcggtgttcgtcgacgaggtgcgctgcgtcggctgcctcaagtgcgcgctccacgcgtcccggaccttcgccgtcgagtccgtctacggccgtgcccgcgccgtcgctcagtgggccgacgatgaggacaggatcgtcgacgccatcaacacatgccccgtcgactgcatctcgatggtggagaggtcggacctggcggctctcgagttcttgatgtccaagcagccgcgcggcagagtccgcgtctccgaaggcaacgccgtgggagctcgcgcgcccaacgtcttcaacgaagtcgccaagttccagaaaagattcgaggagatgaagcagaaatctgcgaccagagaatcccaggagtcagaggaggcacggcagtcgaggacctcagcggtccacaccatcagatccatgtcgaactggtggtactggcggccattcgggttcggggcatcggccccggccaccattatccgcgcttcgcggctcctgccgccgccgctggcggcggcggcggcagcggcgcccgctgaccccgtgacggagaggctccaagaagccgccgctgcccggcgcaaaacggaaggcgcggccacggcacacgcccggcgcgacgactactggagcccacagctggacctgccgtcgtcagcttctccgccgagcattcaccagaggggaagggacactcccgctccccagggccacggccgcaggcgaggagcagcgggtgaggcggccgccggcgccgggaggaagggcataagcatcgacctgacggcgccgctgcttctggggatagtcgcggcggggttcgtgggttacaacggggagaaggttgccggaggtggcagcggcattcaggagcatgttggcggcgccgttgctcttggagtcgtgaacagttttgaaatgaaggtcatgctggccggggtgacttggttcatcatcggcgcagccattgccggtgtgattcaggtacttggaagaagggaagagaacatttggaaatga

SEQ ID NO: 4492 - protein, 494 aa, Sorghum bicolor
  misc_feature: Ceres ANNOT ID no. 6038051
  misc_feature (67)..(128): Pfam Id: DnaJ Pfam Desc: DnaJ domain
  misc_feature (1)..(494): NCBI GI: 38344928 NCBI Desc: osjnba0018m05.19 [oryza sativa (japonica cultivar-group)]
  misc_feature (67)..(273): NCBI GI: 144923250 NCBI Desc: 4fe-4s ferredoxin, iron-sulfur binding; heat shock protein dnaj [medicago truncatula]
  misc_feature (75)..(278): NCBI GI: 92871859 NCBI Desc: 4fe-4s ferredoxin, iron-sulfur binding; heat shock protein dnaj [medicago truncatula]
  misc_feature (146)..(232): NCBI GI: 126657909 NCBI Desc: ferredoxin [cyanothece sp. ccy0110]
  misc_feature (121)..(226): NCBI GI: 16331960 NCBI Desc: ferredoxin (bacterial type ferredoxin family) [synechocystis sp. pcc 6803]
MPALLVNTVSVSPAAPRPGSSWPPTPTARRASTRHRCRAEASGSGTNGGDSGYRPGGVRGSWVSDYDLYELLGVERSSPQSEIKAAYRSLQKRCHPDVAGAAGGHDMAVVLNEVYALLSDPDARLAYDQEQARRSEFAGYTGRPLYSSWLGPESERRAVFVDEVRCVGCLKCALHASRTFAVESVYGRARAVAQWADDEDRIVDAINTCPVDCISMVERSDLAALEFLMSKQPRGRVRVSEGNAVGARAPNVFNEVAKFQKRFEEMKQKSATRESQESEEARQSRTSAVHTIRSMSNWWYWRPFGFGASAPATIIRASRLLPPPLAAAAAAAPADPVTERLQEAAAARRKTEGAATAHARRDDYWSPQLDLPSSASPPSIHQRGRDTPAPQGHGRRRGAAGEAAAGAGRKGISIDLTAPLLLGIVAAGFVGYNGEKVAGGGSGIQEHVGGAVALGVVNSFEMKVMLAGVTWFIIGAAIAGVIQVLGRREENIWK

SEQ ID NO: 4493 - DNA, 1836 bp, Sorghum bicolor
  misc_feature: Ceres ANNOT ID no. 6038054
  misc_feature: Encodes the peptide sequence at SEQ ID NO 4494
atggcgcggttgatgacgacggcgaccaagacgccggccaccttggcggtagccgcgtcgttcctcctcctcgccgcggcggcggcgtccgcctcgtcggcgccgttcgactacgccggcgcgttcgacaagtgcctgcagttctttgaggcgcagcggtccgggaagctccccgccgaccgccgcgtccactggcgcggcgactccgccctcaccgacggcttctcccagggggtggacttggtgggcgggtactacgactccggcgaccacgtcaagttcgggttccccatggcgtacgcggtgacgatgctggcgtggggggtgctggagttcgagaaggagatggtggccgccaacaaccaccagcgcgcgctcgatgccatccgctggggcaccaactacttcgtgaaggcccataccgagcccaacgtcctctgggtccaggtgggcgacggggacagcgaccacctctgctgggagcgcgccgaggacatgtcgacgccgcggacggcgttcaagatcgacacgaaccacccggggtccgaggtcgccgccgagacggccgccgcgcttgccgccgcgtccaaggccttccgcccctacgactccatgtacgccgacctcctcctggtgcacgcaaagcagctcttcacgtttgccgacacgttcagaggcagatacgatgactccctgctgagcgccaagaagttctatccttccggttctggctacgaggacgagctgctctgggcggcggcgtggctacacgaggcgaccggcgacgagaagtacctgcagtacgtgtcccggaacgcggaggatttcggcgggatcggcatgtccatgctcgagttctcctgggacaacaagtacgccggcctgcaggtgctcctctccaaggcggtcctcgcccacggcggcggcggcggcgagtacgccgacacgctgcggcagtaccaggcgaaggcggagttcttcctgtgcgcgtgcctgcagaagaacggcgggcacaacatgaagctcaccccgggcgggctcctgcacgtggacgagtggaacaacatgcagtacgtcagctccgccagcttcctcctcaccgtctacgccgactacctctcggcgtcgcgcggcgcgctcaggtgccccgacggcgaggtgaagcccggcgagatggtccggttcgcccggtcccaggcggactacgtcctgggcaagaacccccggggcatgagctacatggtcggctacggcagctacttcccgacgcacgtgcaccaccgcggcgcctctatcccgtccgtccacgccatggggtctgtggtcgggtgcatggacggcttcgacaggttcttcaacagcaagggcgccgaccccaacgtcctccagggcgccgtcgtcggcgggcccgacgctaacgacggcttcgtcgacgaccgctgcaactaccagcaggccgagcccaccctcgccgggaacgcgcccatctgcggcgtcttcgctcgcctcgcctccgagccggccgacgcctccgggtctccgctggagttcgtgcacacggtgagcaactcgtggacgacgaacggggtggagtactaccggcacgtggtgacggcgaagaacacgtgcgggcaccccataacgtacctgaagctgcacgtcaaggggctgtcgggccccatctacggcgtgtcggccgccaccgccaaggagaaggacacgtacgagctccccgcgtggctcaccagcctcgccgccggcgagcagctcaccatcgtgtacatccagggcggccccgcggccaagttctccgtggtcagctacaagactgcttga

SEQ ID NO: 4494 - protein, 611 aa, Sorghum bicolor
  misc_feature: Ceres ANNOT ID no. 6038054
  misc_feature (37)..(501): Pfam Id: Glyco_hydro_9 Pfam Desc: Glycosyl hydrolase family 9
  misc_feature (4)..(611): NCBI GI: 38344925 NCBI Desc: osjnba0018m05.16 [oryza sativa (japonica cultivar-group)]
  misc_feature (4)..(611): NCBI GI: 114149308 NCBI Desc: endoglucanase 13 precursor (endo-1,4-beta glucanase 13) (osglu6)
  misc_feature (4)..(611): NCBI GI: 90399204 NCBI Desc: h0403d02.19 [oryza sativa (indica cultivar-group)]
  misc_feature (15)..(505): NCBI GI: 75107443 NCBI Desc: endoglucanase 2 precursor (endo-1,4-beta glucanase 2) (osglu5)
  misc_feature (15)..(505): NCBI GI: 118421054 NCBI Desc: endo-beta-1,4-d-glucanase [oryza sativa]
  misc_feature (4)..(611): SWISSPROT Homolog: EC 3.2.1.4 Endoglucanase 13 precursor
  misc_feature: Useful for making plants with altered cell wall content and/or composition
  misc_feature: GREAT-hit functional homolog of the protein sequence encoded by LOCUS at1g48930
  misc_feature: Useful for making plants with altered cell wall content and/or composition
  misc_feature: Functional homolog of the protein sequence given in SEQ ID NO 13873
  misc_feature: Useful for making plants with altered carbohydrate content
  misc_feature: Functional homolog of the protein sequence given in SEQ ID NO 13874
  misc_feature: Useful for making plants with altered lignin content
  misc_feature: Functional homolog of the protein sequence given in SEQ ID NO 13875
MARLMTTATKTPATLAVAASFLLLAAAAASASSAPFDYAGAFDKCLQFFEAQRSGKLPADRRVHWRGDSALTDGFSQGVDLVGGYYDSGDHVKFGFPMAYAVTMLAWGVLEFEKEMVAANNHQRALDAIRWGTNYFVKAHTEPNVLWVQVGDGDSDHLCWERAEDMSTPRTAFKIDTNHPGSEVAAETAAALAAASKAFRPYDSMYADLLLVHAKQLFTFADTFRGRYDDSLLSAKKFYPSGSGYEDELLWAAAWLHEATGDEKYLQYVSRNAEDFGGIGMSMLEFSWDNKYAGLQVLLSKAVLAHGGGGGEYADTLRQYQAKAEFFLCACLQKNGGHNMKLTPGGLLHVDEWNNMQYVSSASFLLTVYADYLSASRGALRCPDGEVKPGEMVRFARSQADYVLGKNPRGMSYMVGYGSYFPTHVHHRGASIPSVHAMGSVVGCMDGFDRFFNSKGADPNVLQGAVVGGPDANDGFVDDRCNYQQAEPTLAGNAPICGVFARLASEPADASGSPLEFVHTVSNSWTTNGVEYYRHVVTAKNTCGHPITYLKLHVKGLSGPIYGVSAATAKEKDTYELPAWLTSLAAGEQLTIVYIQGGPAAKFSVVSYKTA

SEQ ID NO: 4495 - DNA, 1683 bp, Sorghum bicolor
  misc_feature: Ceres ANNOT ID no. 6038056
  misc_feature: Encodes the peptide sequence at SEQ ID NO 4496
atggacaagctcggcacgaacccggccaactcctgcccgctcacgccgctgggcttcctggagcgcaccgccaccgtgttcggcgactgcccctccgtcgtctaccacgacaccgtctacacctggtcgcagacgcaccggcgctgcctccgcctcgcctccgcgctcgtctccctcggtgtctcccgcggcgacatcgtgtccgtgctgctgcccaacgtgccggccatgtacgagatgcacttcggggtgcccatgagcggcgccgtgctcaacaccatcaacacgcgcctggacgcgcgcacggtcgccgtcctgctccgccactccggctccaagctcgtcttcgccgacccggcgagcgtgccgctcgtccgggacgcgctgaggcagctcccgccggggcaccgggcgccgcgcgtcgtccccgtcgaggacccgcacgagaaggagttccccgcggcgccgcccgggacgctgacgtacgaggcgctcctcgacaggggcgacccggagttcgcttgggtgcggccgcgcagcgagtgggacccgatgatactgaactacacctccggcacgacgtcggcgcctaagggcgtggtgcactgccaccgcggcatcttcctggtcaccgtcgacacgctggtggaatgggcggtgccgaagcagccgacgtacctgtggacgctgcccatgttccacgccaacgggtggtgcttcccgtgggggatggcggcggtgggcggcaccaacgtgtgcctgcgccgcgtccacgccgccgaggtgtacgccaccatcgcgcggcgcggggtggaccacctctgcggcgcgcccgtcgtgctcaacatgctggccaacgccccggacgccgcgcggcggccgctcccggggaaggtgcgcatcctcaccgccggcgcaccgccgccggccgccgtgctccaccgcaccgagtccatcggcttcgaggtcacccacgggtacgggctgacggagacggcggggctggtggtgagctgcgcgtggaagggggagtggaacaagctgccggcgtcggagcgcgcgcggctcaaggcgaggcagggcgtgcgcacgcccgccatggccgaggtcgacatcgtcgacggcgagaccggccacagcgtgccccgcgacgggtccacgatgggcgagatcgtgcttcgtggcgggtgcgtcatgctcggctacctcaacgacgacacggccaccagggcggcgatacgggacaacgggtggttctacacgggggacgtcggcgtgatgcacccagacgggtacatggagatccgggatcggtccaaggacgtgatcatcagcggcggggagaacatcagcagcgtggaggtggagtccgtgctctacaaccacccggcggtgaacgaggcggcggtggtggctcggcccgacgagttctggggcgagacgccgtgcgcgttcgtgagcctcaaggaggagaggtcggggtcgccgggcgcggtcaccgcggcggatgtgatcgcgtggtgccgggaccgcatgccgcactacatggtgcccaagacggtggtgctccgcgccgagctgcccaagacctccaccgggaagatccagaagtacgtgctccggaaccttgccaaggatatgggacccacccgcaagggcgccagtagcagcagcaggatgtag

SEQ ID NO: 4496 - protein, 560 aa, Sorghum bicolor
  misc_feature: Ceres ANNOT ID no. 6038056
  misc_feature (41)..(470): Pfam Id: AMP-binding Pfam Desc: AMP-binding enzyme
  misc_feature (1)..(560): NCBI GI: 90399203 NCBI Desc: h0403d02.18 [oryza sativa (indica cultivar-group)]
  misc_feature (1)..(550): NCBI GI: 38344924 NCBI Desc: osjnba0018m05.15 [oryza sativa (japonica cultivar-group)]
  misc_feature (9)..(547): NCBI GI: 20799725 NCBI Desc: adenosine monophosphate binding protein 8 ampbp8 [arabidopsis thaliana]
  misc_feature (1)..(547): NCBI GI: 1903034 NCBI Desc: amp-binding protein [brassica napus]
  misc_feature (1)..(547): NCBI GI: 20799717 NCBI Desc: adenosine monophosphate binding protein 4 ampbp4 [arabidopsis thaliana]
MDKLGTNPANSCPLTPLGFLERTATVFGDCPSVVYHDTVYTWSQTHRRCLRLASALVSLGVSRGDIVSVLLPNVPAMYEMHFGVPMSGAVLNTINTRLDARTVAVLLRHSGSKLVFADPASVPLVRDALRQLPPGHRAPRVVPVEDPHEKEFPAAPPGTLTYEALLDRGDPEFAWVRPRSEWDPMILNYTSGTTSAPKGVVHCHRGIFLVTVDTLVEWAVPKQPTYLWTLPMFHANGWCFPWGMAAVGGTNVCLRRVHAAEVYATIARRGVDHLCGAPVVLNMLANAPDAARRPLPGKVRILTAGAPPPAAVLHRTESIGFEVTHGYGLTETAGLVVSCAWKGEWNKLPASERARLKARQGVRTPAMAEVDIVDGETGHSVPRDGSTMGEIVLRGGCVMLGYLNDDTATRAAIRDNGWFYTGDVGVMHPDGYMEIRDRSKDVIISGGENISSVEVESVLYNHPAVNEAAVVARPDEFWGETPCAFVSLKEERSGSPGAVTAADVIAWCRDRMPHYMVPKTVVLRAELPKTSTGKIQKYVLRNLAKDMGPTRKGASSSSRM

SEQ ID NO: 4497 - DNA, 4146 bp, Sorghum bicolor
  misc_feature: Ceres ANNOT ID no. 6038057
  misc_feature: Encodes the peptide sequence at SEQ ID NO 4498
  misc_feature: Up-regulated in root tissues in response to methyl jasmonate treatment
  misc_feature: Down-regulated in shoot tissues in response to methyl jasmonate treatment
  misc_feature: Down-regulated in shoot tissues in response to salicylic acid treatment
atgtcgtcgtctctagtgtccaccccattcgccgccgcggcgcagaagcagctcctggcggcgcccgtgccgctgcactcgttcctcctgagcagccggcgccagccggggcgtcgtggcggtgccggcgccatccggtgcgcggtcgccggcggcaacggcctgttcacgcagaccaagcccgaggtgcggcgcgtggtgccgaccgacccgcggggcctgccgcgggtcaaggtcgtctacgtcgtgctggaggcgcagtatcagtcgtccgtcacggccgccgtgcagcaactcaacgccgacccgcgccgcgccgcggcgttcgaggtcgtgggatacctcgtcgaggagctccgcgacgaggacacctacgccaccttctgcgccgacctcgccgacgccaacgtcttcatcggctccctcatcttcgtcgaggagctggcgctcaaggtcaaggctgccgtcgagaaggagcgcgaccgcatggacgccgtcctcgtcttcccctccatgcccgaggtcatgcgcctcaacaagctcggctccttcagcatgtcgcagctggggcagtccaagagccccttcttccagctcttcaagcgcaacaagtccaactccagcaacttcgccgacagcatgctcaagctcgtgcgcacgctgcccaaggtgctcaagtacctgccctccgacaaggcgcaggacgccaggctctacatcctcagcctccagttctggctcggcggctcgccggacaacctccagaacttcctcaagatgatcgccggctcctacgtgccggcgctcaggggcgccggcatcaagtacgacgaccctgtgctctacctcgactccggcatctggcacccgctggcgcccaccatgtacgaggacgtcaaggagtacctcaactggtacggcacgcgccgggacaccaacgacaggctcaaggaccccaacgcgcccgtcatcggcctcgtcctgcagaggagccacattgtcaccggcgacgacgggcactacgtcgccgtcatcatggagctcgaggccaagggcgccaaggtcatacccatcttcgccggcggtctcgacttctccgggcccacccaacgctacctggtcgacccgattactggcaagccgttcgtgaacgccgtggtgtctctcaccgggttcgcgctcgttggcgggccggcgaggcaggaccaccccaaggccattgccgcgttgcagaagctcgacgtgccgtacattgttgcgcttccgctcgtgttccagaccacggaggagtggctcaacagcaccttggggcttcaccccattcaggtggcgctgcaggtcgcgctgccggagctcgacggtgggatggagcccatcgtattcgccggccgggaccccaggacaggaaaatcacatgcattgcataagagagtggagcagctctgcactagagccatcagatgggcacaactgaagaggaaaactaaggaggagaagaaactggcaatcactgttttcagtttcccacctgacaagggcaacgtggggactgcagcatatctgaatgtgttcaactccatctactctgtgctgtcagacctcaagaaggacggctacaacgttgagggtctcccagacacaccggaagccctcatcgaggaggttatccatgacaaggaggctcagttcaacagccccaacctcaatgtggcttaccgcatgaatgtgagggagtaccaggcactcacctcctatgcctccttgctggaggagaactgggggaagccacctgggcacctcaactctgatggcgagaacctccttgtctatgggaagcagtacggcaatgtcttcatcggagtgcagcccacttttgggtatgaaggcgatccgatgcggcttctgttctcaaagtctgccagccctcaccatggctttgcagcatactacacctttgttgagaagatcttccaggccgatgctgttctgcactttggaacacacgggtccctggagttcatgcctggcaagcaggttgggatgagtgatgcttgcttccctgacagcctcattggcaacatccccaacatctactactatgccgcaaacaacccatcagaggctacggtcgccaagcgccggagctatgcaaacaccatcagctacctgacaccaccagctgagaatgccggtctctacaaggggctcaagcagctatcagagctcatctcctcttaccagtctctcaaggacactgggcgtggtactcagattgtgagctcaatcatcagcactgcaaaacagtgcaaccttgacaaggatgtcccactgcccgaggaaggggaggagctcccaccaagtgaacgtgacctggtcgttggaaaggtgtactccaagatcatggagatagagtcacggctccttccctgtggtctacatgtgatcggtgagccaccgagcgccatcgaagctgtggccacactggtgaacatagctgctctcgaccgcccagaggatggcataatctcgctgcctggcatacttgctgccacagtgggcagggagattgaagatgtgtacaggggaagtgacaagggcatactggctgacgtcgagcttttgaggcagataactgaagcttcgcgtggcgccatcaccgcctttgtagagaagaccacaaacagcaaagggcaagtcgtcaatgttgccaacaacctcagcaacatacttggctttggtctgtcagagccatgggtgcagtacctgtccacgaccaagttcatcagggcagacagagagaagctgagggttttgtttggattcctgggggaatgcttgaagctcgtcgtgcaagacaatgagctgggcagcttgaagctcgcccttgagggaagctatgtcgagcctggccctggtggtgacccgatccgtaacccgaaggtgcttccgactgggaagaacatccatgctcttgacccacaggccatcccaaccacagctgccttgaagagtgccaagatcgtcgtcgaccgtctcctggagaggcagaaggccgacaatggcggcaagtacccagagacagttgcacttgtcttgtggggcactgacaacatcaagacctatggtgagtcactggcccaggtgctgtggatgattggtgtacggccagttgctgacaccttcggccgtgtcaaccgtgtggagcctgtcagccttgaggagcttggacgtccaaggattgacgtcgtcgtcaattgctctggtgtcttcagagaccttttcatcaaccagatgaacctgctggaccgggcggtgaagatggtcgccgaactggacgagccagcagagatgaattacgtgcgcaagcatgcccaggagcaggcagaggagctcggcgtctcgctgagagaggcggcgacgagggtgttctcgaacgcatcaggctcctactcgtcgaacgtgaacctggcggtggagaacgcgtcgtggacagacgagaagcagctccaggacatgtacctgagccggaaatccttcgcgttcgacagcgacgctccaggggcaggcatgaaggagaagcgcaaggcgttcgagctcgctctggcgacggcggacgccacgttccagaacctcgactcgtcggagatctcgctgacggacgtgagccactacttcgactcggacccgacgaagctcgtgcaggggctgcgcaaggacggccgggcgccgtcgtcgtacattgctgacactaccacggcgaacgcccaggtgaggacgctgtcggagacggtgcgcctcgacgcgaggaccaagctgctgaaccccaagtggtacgaggggatgatgaagagcggatacgagggcgtcagggagatcgagaagcggctcaccaacaccgttgggtggagcgcgacgtctgggcaggtcgacaactgggtgtacgaggaggcgaactccacgttcatcgaagacgaggcgatgaggaagaggctcatggagaccaaccccaattcgttcaggaagctggtgcagaccttcctggaagccagtggcagaggctactgggagacatcggaggagaacctggacaggctcagggagctctactcggaggttgaagacaagattgaggggattgacaggtaa

SEQ ID NO: 4498 - protein, 1381 aa, Sorghum bicolor
  misc_feature: Ceres ANNOT ID no. 6038057
  misc_feature (324)..(1303): Pfam Id: CobN-Mg_chel Pfam Desc: CobN/Magnesium Chelatase
  misc_feature (3)..(1381): NCBI GI: 14861035 NCBI Desc: mg-chelatase subunit xantha-f [hordeum vulgare]
  misc_feature (3)..(1381): NCBI GI: 861199 NCBI Desc: protoporphyrin ix mg-chelatase subunit precursor
  misc_feature (3)..(1381): NCBI GI: 3059095 NCBI Desc: magnesium chelatase subunit [glycine max]
  misc_feature (3)..(1381): NCBI GI: 312129 NCBI Desc: protoporphyrin ix:mg chelatase [antirrhinum majus]
  misc_feature (3)..(1381): NCBI GI: 2318137 NCBI Desc: mg protoporphyrin ix chelatase [nicotiana tabacum]
  misc_feature: Up-regulated in root tissues in response to methyl jasmonate treatment
  misc_feature: Down-regulated in shoot tissues in response to methyl jasmonate treatment
  misc_feature: Down-regulated in shoot tissues in response to salicylic acid treatment
MSSSLVSTPFAAAAQKQLLAAPVPLHSFLLSSRRQPGRRGGAGAIRCAVAGGNGLFTQTKPEVRRVVPTDPRGLPRVKVVYVVLEAQYQSSVTAAVQQLNADPRRAAAFEVVGYLVEELRDEDTYATFCADLADANVFIGSLIFVEELALKVKAAVEKERDRMDAVLVFPSMPEVMRLNKLGSFSMSQLGQSKSPFFQLFKRNKSNSSNFADSMLKLVRTLPKVLKYLPSDKAQDARLYILSLQFWLGGSPDNLQNFLKMIAGSYVPALRGAGIKYDDPVLYLDSGIWHPLAPTMYEDVKEYLNWYGTRRDTNDRLKDPNAPVIGLVLQRSHIVTGDDGHYVAVIMELEAKGAKVIPIFAGGLDFSGPTQRYLVDPITGKPFVNAVVSLTGFALVGGPARQDHPKAIAALQKLDVPYIVALPLVFQTTEEWLNSTLGLHPIQVALQVALPELDGGMEPIVFAGRDPRTGKSHALHKRVEQLCTRAIRWAQLKRKTKEEKKLAITVFSFPPDKGNVGTAAYLNVFNSIYSVLSDLKKDGYNVEGLPDTPEALIEEVIHDKEAQFNSPNLNVAYRMNVREYQALTSYASLLEENWGKPPGHLNSDGENLLVYGKQYGNVFIGVQPTFGYEGDPMRLLFSKSASPHHGFAAYYTFVEKIFQADAVLHFGTHGSLEFMPGKQVGMSDACFPDSLIGNIPNIYYYAANNPSEATVAKRRSYANTISYLTPPAENAGLYKGLKQLSELISSYQSLKDTGRGTQIVSSIISTAKQCNLDKDVPLPEEGEELPPSERDLVVGKVYSKIMEIESRLLPCGLHVIGEPPSAIEAVATLVNIAALDRPEDGIISLPGILAATVGREIEDVYRGSDKGILADVELLRQITEASRGAITAFVEKTTNSKGQVVNVANNLSNILGFGLSEPWVQYLSTTKFIRADREKLRVLFGFLGECLKLVVQDNELGSLKLALEGSYVEPGPGGDPIRNPKVLPTGKNIHALDPQAIPTTAALKSAKIVVDRLLERQKADNGGKYPETVALVLWGTDNIKTYGESLAQVLWMIGVRPVADTFGRVNRVEPVSLEELGRPRIDVVVNCSGVFRDLFINQMNLLDRAVKMVAELDEPAEMNYVRKHAQEQAEELGVSLREAATRVFSNASGSYSSNVNLAVENASWTDEKQLQDMYLSRKSFAFDSDAPGAGMKEKRKAFELALATADATFQNLDSSEISLTDVSHYFDSDPTKLVQGLRKDGRAPSSYIADTTTANAQVRTLSETVRLDARTKLLNPKWYEGMMKSGYEGVREIEKRLTNTVGWSATSGQVDNWVYEEANSTFIEDEAMRKRLMETNPNSFRKLVQTFLEASGRGYWETSEENLDRLRELYSEVEDKIEGIDR

SEQ ID NO: 4499 - DNA, 768 bp, Sorghum bicolor
  misc_feature: Ceres ANNOT ID no. 6038062
  misc_feature: Encodes the peptide sequence at SEQ ID NO 4500
atggcgctcgcgtccacctccgccaccgcgcccgctgccgtgctcaagaccccgtcgttcctcggtgccaggcgcgcgctcgccaatgccgccgccgctgccaagcccgcgccgcgccgctcgctcgtcgtcgtcgccgcggtcgcccccaagaagtcgtggatccccgccttcaagagcgacgccgagttcatcaacccgccatggctcgacggctcgctccccggcgacttcgggttcgacccgctggggctgggcaaggacccggcgttcctcaagtggtaccgggaggcggagctgatccacgggcggtgggcgatggcggccgtgctgggcatcttcgtggggcaggcgtggagcgggatcccgtggttcgaggccggcgccgacccgggcgccatcgcgcccttctccttcggctcgctgctgggcacgcagctgctgctcatggggtgggtggagtccaagcgctgggtggacttcttcaacccggactcgcagtccgtcgagtgggccacgccctggtcccgcaccgccgaaaacttcgccaacttcaccggcgagcaaggctaccccggcggcaagttcttcgacccgctcggcctcgccggcaccgtcaaggacggcgtctacatccccgacgtcgacaagctcgagcggctcaagctcgccgagatcaagcacgcccgcctcgccatgctcgccatgctcatcttctacttcgaggccggacagggcaagacgccgctcggcgcgctcggcctatga

SEQ ID NO: 4500 - protein, 255 aa, Sorghum bicolor
  misc_feature: Ceres ANNOT ID no. 6038062
  misc_feature (65)..(244): Pfam Id: Chloroa_b-bind Pfam Desc: Chlorophyll A-B binding protein
  misc_feature (1)..(255): NCBI GI: 21740892 NCBI Desc: osjnba0036b21.6 [oryza sativa (japonica cultivar-group)]
  misc_feature (1)..(255): NCBI GI: 116309995 NCBI Desc: h0523f07.10 [oryza sativa (indica cultivar-group)]
  misc_feature (20)..(255): NCBI GI: 733458 NCBI Desc: chlorophyll a/b-binding apoprotein cp24 precursor
  misc_feature (8)..(255): NCBI GI: 110377772 NCBI Desc: chloroplast pigment-binding protein cp24 [nicotiana tabacum]
  misc_feature (3)..(255): NCBI GI: 115834 NCBI Desc: chlorophyll a-b binding protein cp24 10b, chloroplast precursor (cab-10b) (lhcp)
MALASTSATAPAAVLKTPSFLGARRALANAAAAAKPAPRRSLVVVAAVAPKKSWIPAFKSDAEFINPPWLDGSLPGDFGFDPLGLGKDPAFLKWYREAELIHGRWAMAAVLGIFVGQAWSGIPWFEAGADPGAIAPFSFGSLLGTQLLLMGWVESKRWVDFFNPDSQSVEWATPWSRTAENFANFTGEQGYPGGKFFDPLGLAGTVKDGVYIPDVDKLERLKLAEIKHARLAMLAMLIFYFEAGQGKTPLGALGL

SEQ ID NO: 4501 - DNA, 768 bp, Sorghum bicolor; identical to SEQ ID NO: 4499
  misc_feature: Ceres ANNOT ID no. 6038066
  misc_feature: Encodes the peptide sequence at SEQ ID NO 4502

SEQ ID NO: 4502 - protein, 255 aa, Sorghum bicolor; identical to SEQ ID NO: 4500
  misc_feature: Ceres ANNOT ID no. 6038066
  misc_feature (65)..(244): Pfam Id: Chloroa_b-bind Pfam Desc: Chlorophyll A-B binding protein
  misc_feature (1)..(255): NCBI GI: 21740892 NCBI Desc: osjnba0036b21.6 [oryza sativa (japonica cultivar-group)]
  misc_feature (1)..(255): NCBI GI: 116309995 NCBI Desc: h0523f07.10 [oryza sativa (indica cultivar-group)]
  misc_feature (20)..(255): NCBI GI: 733458 NCBI Desc: chlorophyll a/b-binding apoprotein cp24 precursor
  misc_feature (8)..(255): NCBI GI: 110377772 NCBI Desc: chloroplast pigment-binding protein cp24 [nicotiana tabacum]
  misc_feature (3)..(255): NCBI GI: 115834 NCBI Desc: chlorophyll a-b binding protein cp24 10b, chloroplast precursor (cab-10b) (lhcp)

SEQ ID NO: 4503 - DNA, 2850 bp, Sorghum bicolor
  misc_feature: Ceres ANNOT ID no. 6038068
  misc_feature: Encodes the peptide sequence at SEQ ID NO 4504
atgtccaccgggcgcgcgcggggcgcccaactgccgctgcagaacggcgcgggggtcgatgacggggacgacgagcgcgaggaggaggaagtgggcgatgatgaggaggaggaggacgaggaggaggaggaggagccgcggctcaagtaccagcggctgggcgggagcgtgccggcgatcctctccaccgacgccgcggctgctatcgccgtcgccgaccgcatggtcgcgctcggcacccacaacggcaccctccacatcctcgatttccagggcaaccaggtgaaagaaattgctgctcacacagcaactatcaacgacataagttttgatggggacggtgaatatataggaagctgctcagatgatggcacagtgacaataaacagcctcttcactgatgaaaaactaaagtttgagtaccatcgccccatgaaggcaattgctctagaccctaattatgcccggaactatagaagatttgctactggtggtttggcaggccaagtacttgtgttgacaaagaagtcttggggaggttaccataagaaggttttacgtgatggtgaagggccaatccattcgatgaagtggagggcggaccttcttgcttgggctaacgatgcaggggtgaaagtgcatgatatgaggacagacaaaggaattgcattcatagagagaccaaaaggcattcctcgaccagagttcttgcttccccacttagtctggcaggatgatacagtcttagttattggatggggaacaagtgtcaagattgcagcgattcgaacagatttatctcagggactcaatggcctacaaaggactatcaccacagctagttctgagaagtatgtggacattgtgggctcattccaaacaggctaccacatatctgggattgctccatttggtgaccttttagttgtgcttgcctatattcctgacgaggatgaaaaagagaaaacatttagtacttctgttacttcacgacagggaactgcacagcgtccagaaatacatcttgtatcatggaaaaatgatgaacttactacagatgctctgcctattcatggttatgagcattacaaggcaaaagactatgctcttgcgcatgcgcctttctcaggaagtagcaatgcaggtggacagtgggctgctggtgatgaacctttgtattacattgtgtctcctaaggacatagtggttgcaaagccaagagatgctgaagatcatattgcttggcttcttcaacatggttgccatgaaaaagcattggctgcagttgaggcagggcaaggacgcactgagcttcttgatgaggtgggttccagataccttgatcacttgataattgaaagaaaatatgctgaagctgctcagcgctgcccaaagttgctgcgaggatctccttcagcatgggagagatgggtcttccactttgctcatcttcgccaacttcctgttttggtcccttatatacctacagaaaatcctcagctgagtgatactgcatatgaggttgcgcttgttgctctaaccaccaatccttccttccatgaacttctcttgactactataaaaaattggccaccaacattatactcagcttcaccggtcatatctgccattgagccacagctaaactcctcatcgatgactgattcattgaaagaggcattagcagaattgtatgtgatcaatggtcaatatgaaaaggcactttccctttatgctgaactcctgaagcctgaagtattcgagtttattgagaaatacaacttgcatgatgccattcgtgataaggttgtcaatcttatgatagtggataataaaagaacagttcacctactgatccaacatcgtgatatcattcccccatatgaagttgtggagcagttgttgcataccagtaaaaactgtgacaagagatatttgttacacctatatttgcatgctttatttgagatagatatccatgctggaaaggattttcatgatatgcaggtggagctttatgcagaatatgagccaaggatgctactacccttcctccgaaccagtcagcattacaggcttgacaaggcatatgaaatctttgcacaaaaggaacttgtaagggagcaggtttttgtccttggtcgaatgggcaatgctaaggaagctctttcgacaattataaacaaactggaagacatgcaggaggctgttgaatttgttacggagcaacatgatgatgaactgtgggaggaactgattagacaatgcctccagaagcctgaaatggtagggaatctattggaacatactgttggcaatcttgatcctctgtacattgtcagtttggttcctgatggcttagaaatacctcggttgcgggatcgtcttgtgaaaattgtgacggattaccggacagaaacttcattgcgtaatggatgcaatgatatacttaaggctgactgtgttaaccttttggttaaatactaccatgaggctcggcgtggggtctacatggcaagcatggacgaggaggtacatggaaacagagctgatgatggatcctcacgggggcatgagagatcatctagcatccgggctctagatatgaagtccagaacgagatgtggtgcccggtgttgcttgtgcttcgatccattgcctatccaggacatctctgtcatcatgttctactgctgccatgcatatcatctgtcttgccttgaaggtggtctagactcgatgagatcaaacagtaatcaggatagtgacagcggcacagacgatgaggatggttccccatcagggcagtctcgtatgcgctgtgtattgtgcactactgctgctgcataa

SEQ ID NO: 4504 - protein, 949 aa, Sorghum bicolor
  misc_feature: Ceres ANNOT ID no. 6038068
  misc_feature (92)..(130): Pfam Id: WD40 Pfam Desc: WD domain, G-beta repeat
  misc_feature (1)..(949): NCBI GI: 38346540 NCBI Desc: osjnba0040d17.15 [oryza sativa (japonica cultivar-group)]
  misc_feature (12)..(929): NCBI GI: 2499115 NCBI Desc: vacuolar assembly protein vps41 homolog
  misc_feature (9)..(742): NCBI GI: 6579196 NCBI Desc: t23g18.5 [arabidopsis thaliana]
  misc_feature (384)..(844): NCBI GI: 57977130 NCBI Desc: mvam2 [mus musculus]
  misc_feature (384)..(844): NCBI GI: 29612446 NCBI Desc: vps41 protein [mus musculus]
MSTGRARGAQLPLQNGAGVDDGDDEREEEEVGDDEEEEDEEEEEEPRLKYQRLGGSVPAILSTDAAAAIAVADRMVALGTHNGTLHILDFQGNQVKEIAAHTATINDISFDGDGEYIGSCSDDGTVTINSLFTDEKLKFEYHRPMKAIALDPNYARNYRRFATGGLAGQVLVLTKKSWGGYHKKVLRDGEGPIHSMKWRADLLAWANDAGVKVHDMRTDKGIAFIERPKGIPRPEFLLPHLVWQDDTVLVIGWGTSVKIAAIRTDLSQGLNGLQRTITTASSEKYVDIVGSFQTGYHISGIAPFGDLLVVLAYIPDEDEKEKTFSTSVTSRQGTAQRPEIHLVSWKNDELTTDALPIHGYEHYKAKDYALAHAPFSGSSNAGGQWAAGDEPLYYIVSPKDIVVAKPRDAEDHIAWLLQHGCHEKALAAVEAGQGRTELLDEVGSRYLDHLIIERKYAEAAQRCPKLLRGSPSAWERWVFHFAHLRQLPVLVPYIPTENPQLSDTAYEVALVALTTNPSFHELLLTTIKNWPPTLYSASPVISAIEPQLNSSSMTDSLKEALAELYVINGQYEKALSLYAELLKPEVFEFIEKYNLHDAIRDKVVNLMIVDNKRTVHLLIQHRDIIPPYEVVEQLLHTSKNCDKRYLLHLYLHALFEIDIHAGKDFHDMQVELYAEYEPRMLLPFLRTSQHYRLDKAYEIFAQKELVREQVFVLGRMGNAKEALSTIINKLEDMQEAVEFVTEQHDDELWEELIRQCLQKPEMVGNLLEHTVGNLDPLYIVSLVPDGLEIPRLRDRLVKIVTDYRTETSLRNGCNDILKADCVNLLVKYYHEARRGVYMASMDEEVHGNRADDGSSRGHERSSSIRALDMKSRTRCGARCCLCFDPLPIQDISVIMFYCCHAYHLSCLEGGLDSMRSNSNQDSDSGTDDEDGSPSGQSRMRCVLCTTAAA

SEQ ID NO: 4505 - DNA, 684 bp, Sorghum bicolor
  misc_feature: Ceres ANNOT ID no. 6038069
  misc_feature: Encodes the peptide sequence at SEQ ID NO 4506
  misc_feature: Down-regulated in root tissues in response to salicylic acid treatment
atgctgggcgcgcgtgtgcagctgaaggggtggcaacaggcggctgttgcatttggttctgcgtttggggccttgcttgacccaagaagggctgatcttatagctgctcttggagagactactgggaagccagcgtttgagcgtgtgctgcaacgaatgaagaacagtgcagaaggcagggaagttcttttggagcgtcctcgcgttatatcctcgcaggtttcccatgcctgggacatgcctcagaacacatttggtgcggcgtatgctcagtttatgggatcaaggaacttctcaccagatgatcgcccacctgtccgtttcatggacactgatgagcttgcctacgttgcaacccgtgcccgtgaggtgcatgacttttggcatgtgctatttggccttccaacaaacctgattggggagactgccctcaaggtgatagaatttgaacagatgttcctgccaatgtgcatgctgtcagttgtcgggggctctgcaaggttcagtgagaaacaaaggacgctgtttttccagcattacttcccatgggcaacaaaagcgggtctcaagtgtactgatctgatgtctgtatattacgagaagcactttcatgaggacctggaggaagtgagaagaaactggggaattctaccatgccctaatccccaaaagagcaatgtatag

SEQ ID NO: 4506 - protein, 227 aa, Sorghum bicolor
  misc_feature: Ceres ANNOT ID no. 6038069
  misc_feature (3)..(218): Pfam Id: Coq4 Pfam Desc: Coenzyme Q (ubiquinone) biosynthesis protein Coq4
  misc_feature (1)..(227): NCBI GI: 54287457 NCBI Desc: putaitve coenzyme q biosynthesis protein [oryza sativa (japonica cultivar-group)]
  misc_feature (1)..(209): NCBI GI: 115462489 NCBI Desc: os05g0188800 [oryza sativa (japonica cultivar-group)]
  misc_feature (5)..(216): NCBI GI: 108868875 NCBI Desc: ubiquinone biosynthesis protein [aedes aegypti]
  misc_feature (5)..(216): NCBI GI: 116128319 NCBI Desc: ensangp00000010400 [anopheles gambiae str. pest]
  misc_feature (2)..(216): NCBI GI: 24665922 NCBI Desc: cg32174-pb [drosophila melanogaster]
  misc_feature: Down-regulated in root tissues in response to salicylic acid treatment
MLGARVQLKGWQQAAVAFGSAFGALLDPRRADLIAALGETTGKPAFERVLQRMKNSAEGREVLLERPRVISSQVSHAWDMPQNTFGAAYAQFMGSRNFSPDDRPPVRFMDTDELAYVATRAREVHDFWHVLFGLPTNLIGETALKVIEFEQMFLPMCMLSVVGGSARFSEKQRTLFFQHYFPWATKAGLKCTDLMSVYYEKHFHEDLEEVRRNWGILPCPNPQKSNV

SEQ ID NO: 4507 - DNA, 759 bp, Sorghum bicolor
  misc_feature: Ceres ANNOT ID no. 6038071
  misc_feature: Encodes the peptide sequence at SEQ ID NO 4508
atggcgatggcggtggcgcgggtgactagcctcggcctcgcctgcgctccccgacaggcgcagcatcgccgccgccgccatagccttcccccgccgcgcgctttgggtgcggtggaggtgcgggtctgcacgaaccgcacatgcgcgcggcagggcgggcgcgacgtcctggctgcgctcgtgggcctcgcgccgccgccggtcgacgtggcctcctgcggttgcctcgggcgctgcggcgctgggcccaacgtcgcggcgtccgtcgctgggagcgccgcggtgttccgccacgtgggcacggcggcgcgcggcgcgcagctactggaacacctcctcggccccgcggagttcgacgcggccctagggctcaccgcgctggccacgagggagaaggcggaggctgccctcgagaagggaaacgcggatgaagcggaagcccttctgaccgaggttattgggttcaatgcttgtggcggtctgcatttggtgtacaggagcaggtctaaggcgagattggcaatgggggatatctctggtgcacttgaggacgctgaggaagcaataagaatagctcccagatttcctcaggctcacttattgcgaggcgacgcactttttgcaatgggtgaatattctgttgcggaagatgcctatgcacatgccttggatattgatccatctattcgccggtccaagtctttcagggcccgtgtggaaaggctacgagagaagcttgttggtgccaataatccgtag

SEQ ID NO: 4508 - protein, 252 aa, Sorghum bicolor
  misc_feature: Ceres ANNOT ID no. 6038071
  misc_feature (196)..(229): Pfam Id: TPR_2 Pfam Desc: Tetratricopeptide repeat
  misc_feature (196)..(229): Pfam Id: TPR_1 Pfam Desc: Tetratricopeptide repeat
  misc_feature (3)..(250): NCBI GI: 90399197 NCBI Desc: h0403d02.12 [oryza sativa (indica cultivar-group)]
  misc_feature (3)..(250): NCBI GI: 38344917 NCBI Desc: osjnba0018m05.8 [oryza sativa (japonica cultivar-group)]
  misc_feature (3)..(250): NCBI GI: 115461272 NCBI Desc: os04g0674100 [oryza sativa (japonica cultivar-group)]
  misc_feature (39)..(236): NCBI GI: 140055172 NCBI Desc: thioredoxin-like fold [medicago truncatula]
  misc_feature (131)..(240): NCBI GI: 86610308 NCBI Desc: tetratricopeptide repeat protein [cyanobacteria bacterium yellowstone b-prime]
MAMAVARVTSLGLACAPRQAQHRRRRHSLPPPRALGAVEVRVCTNRTCARQGGRDVLAALVGLAPPPVDVASCGCLGRCGAGPNVAASVAGSAAVFRHVGTAARGAQLLEHLLGPAEFDAALGLTALATREKAEAALEKGNADEAEALLTEVIGFNACGGLHLVYRSRSKARLAMGDISGALEDAEEAIRIAPRFPQAHLLRGDALFAMGEYSVAEDAYAHALDIDPSIRRSKSFRARVERLREKLVGANNP

SEQ ID NO: 4509 - DNA, 513 bp, Sorghum bicolor
  misc_feature: Ceres ANNOT ID no. 6038076
  misc_feature: Encodes the peptide sequence at SEQ ID NO 4510
atggctgccgctgctgctccgtcagtgtccccctccccgtccccggcgacggcgccggcgccgaaggtcgtgtcgcccaaggccggcgacaggaaggtggtgccggtggacgctgtggaggtggagctcaagctggagctggaggagaagcacgtgctggcggtggacgacagctccgtcgaccgcgccgtcatcgccaagatcctccgcagctccaagtacagagtgaccaccgtggaatcggcgacgcgtgctctggagctgctcgcgctgggtctgctccccgacgtgaacatgatcatcacggactactggatgccagggatgaccggctacgagctcctcaagcacgtcaaggagtcgtcggagctgagggagatcccggtcgtgatcatgtcgtcggagaacgtgcccacccgcatcacccgctgcctggaggagggcgccgaggacttcctcctcaagcccgtccgcccctccgacgtgtcccgcctctgcagccggatcagatga

SEQ ID NO: 4510 - protein, 170 aa, Sorghum bicolor
  misc_feature: Ceres ANNOT ID no. 6038076
  misc_feature (50)..(170): Pfam Id: Response_reg Pfam Desc: Response regulator receiver domain
  misc_feature (16)..(170): NCBI GI: 5689236 NCBI Desc: zmrr2 [zea mays]
  misc_feature (1)..(170): NCBI GI: 71273485 NCBI Desc: type a response regulator 6 [oryza sativa (indica cultivar-group)]
  misc_feature (16)..(170): NCBI GI: 6009895 NCBI Desc: response regulator 1 [zea mays]
  misc_feature (51)..(169): NCBI GI: 11041692 NCBI Desc: response regulator [zea mays]
  misc_feature (51)..(169): NCBI GI: 57834122 NCBI Desc: osjnbb0065j09.13 [oryza sativa (japonica cultivar-group)]
  misc_feature: The sequence is a functional homolog of SEQ ID NO 932 in the 10/666,642US patent application
  misc_feature: Useful for making plants with altered Lignin content
  misc_feature: Useful for making plants with altered carotene content
  misc_feature: Useful for making plants with altered terpenoid content
  misc_feature: Useful for making plants with modulated growth and phenotype characteristics
  misc_feature: Useful for making plants with modulated low light sensitivity
  misc_feature: Functional homolog of the protein sequence given in SEQ ID NO 13292
  misc_feature: Functional homolog of the protein sequence given in SEQ ID NO 13463
  misc_feature: The sequence is a functional homolog of SEQ ID NO 932 in the 20070033671 US patent application
  misc_feature: The sequence is a functional homolog of SEQ ID NO 932 in the 10/666,642 US patent application
  misc_feature: Useful for making plants with modulated low light sensitivity
  misc_feature: Functional homolog of the protein sequence given in SEQ ID NO 13290
  misc_feature: Useful for making plants with modulated nitrogen use efficiency
  misc_feature: Functional homolog of the protein sequence given in SEQ ID NO 13599
  misc_feature: Useful for making plants with altered carotene content
  misc_feature: Useful for making plants with altered lignin content
  misc_feature: Useful for making plants with altered terpenoid content
  misc_feature: Functional homolog of the protein sequence given in SEQ ID NO 13463
  misc_feature: The sequence is a functional homolog of SEQ ID NO. 378 in the 11/188,298 US application
MAAAAAPSVSPSPSPATAPAPKVVSPKAGDRKVVPVDAVEVELKLELEEKHVLAVDDSSVDRAVIAKILRSSKYRVTTVESATRALELLALGLLPDVNMIITDYWMPGMTGYELLKHVKESSELREIPVVIMSSENVPTRITRCLEEGAEDFLLKPVRPSDVSRLCSRIR

SEQ ID NO: 4511 - DNA, 2460 bp, Sorghum bicolor
  misc_feature: Ceres ANNOT ID no. 6038095
  misc_feature: Encodes the peptide sequence at SEQ ID NO 4512
  misc_feature: Down-regulated in shoot tissues in response to salicylic acid treatment
atgagctcctcgtccggggcaagcatcgggcagccgccgccgccgccgcccgcgccgccgccggaggaagagaagaagtgcctcaactcggagctgtggcacgcgtgcgccggcccgctcgtctgcctccccaccgtcggcacccgcgtcgtctacttcccgcagggccacagtgagcaggtggcagcgtcgacgaacaaggaggtcgacgggcacatccccaactaccccaacctgccgccgcagctgatctgccagctccatgatgtcacaatgcatgcggatgtggagacggacgaagtgtacgcgcagatgacgctgcagccgctcaacccacaagagcagaacgacgcgtacctgcccgcggagatgggaatcatgagcaagcagccgacgaattacttctgcaagacgctgactgcgagcgacaccagcacgcatggcggcttctccgtgccccgtcgtgctgccgagcgcgtcttcccccctctggatttcacacagcagcctccagcacaggagcttattgcacgggatattcatgatgtcgagtggaaattcaggcatatcttccgaggccagcccaaaagacacctgctgactactggctggagtgtgtttgtcagtgctaagagacttgttgctggagattctgtgctattcatatggaatgagaaaaaccagcttttgcttggaatcagacgtgccagccgtccacagactgtgatgccctcttctgttctttcaagtgacagcatgcacattgggctccttgcagcagcagctcatgctgctgcaacaaacagccgcttcacaattttctataatcctagggcaagtccatcagaatttgttatacccctttcgaaatacatcaaggctgtttttcacacgcggatatcagttgggatgcgattcaggatgttgtttgagactgaggaatctagtgtccgcaggtacatggggacaataacagaagtgagtgatgctgacccagtgcgttggcctagctcctattggagatcagtgaaggttggttgggatgaatcaacagcaggggaaaggccacctagagtttctctgtgggaaattgagccactgacaacctttcctatgtatccatccctgttcccactgcgagttaagcatccttggtattcaggagttgctgctcttcatgatgacagcaatgctttgatgtggctgagaggagttgctggtgaagggggctttcagtctttgaacttccagtcacctggtataggttcctggggacaacagaggctccatccatccttacttagcaatgatcatgatcagtatcaagcagtggttgctgcagcagctgcctcccagtccggtggttatctgaagcagcaattcctacaccttcaacagcctatgcaatccccacaggagcagtgcaatctcaatccgctgttgcagcaacaaatactacagcaagcgagccaacagcagatggttagtcctgatgctcaaaacattcagtccgtgctcagcccaaatgctattcagcagcagctccaccaactccagcagatgcagcatgctcataatgaccagaagcagaagattcaaccagatcaaccgtatcaagttcctagcagtgcggttctcccaagtccaacatcattaccaagccatttgcgtgaaaaatttggcttttctgatcctaatgtgaactcttctagcttcatcagctctagcagcaacgaaaacatgctggaatcaaacttccttcagggaagctcaaaatctgtggatttgtctagattcaaccaaccagtagttagcgagcagcagcagcagcagcagcaacaggcatggaagcagaagtttatgggctcacaatcgatgtcttttgggggcttggtttcgcttaactcacccactagcaaagatggttctgctgacaacaaaattggccgtgatgtgcagaaccagtccctttttagccctcaagttgactcttcctccctgctgtacaatatggtacctaatttgacctcaaatgttgcggataataatatatcagtgattccttctggatcaacatatctgcagagtccaatgtatggttgtctggatgactcttctggtttattgcaaaatacaggagagaatgatccggcagctagaactttcgttaaggtttacaagtcaggatcagtggggagatccttggacatcacccggttctctaattatgctgaacttcgagaggaactgggtcagatgttcggcatcaagggtcagttggacgaccctgatagatcaggctggcagcttgtatttgtcgacagggagaacgatgtgcttctccttggagacgacccatgggagtcatttgtgaatagtgtatggtacatcaagatactttcaccggaggatgtgcataagatgggaaagccaggaaatgatccacgctacctatcttaa

SEQ ID NO: 4512 - protein, 819 aa, Sorghum bicolor
  misc_feature: Ceres ANNOT ID no. 6038095
  misc_feature (261)..(344): Pfam Id: Auxin_resp Pfam Desc: Auxin response factor
  misc_feature (134)..(239): Pfam Id: B3 Pfam Desc: B3 DNA binding domain
  misc_feature (1)..(819): NCBI GI: 115461244 NCBI Desc: os04g0671900 [oryza sativa (japonica cultivar-group)]
  misc_feature (1)..(819): NCBI GI: 90265252 NCBI Desc: h0624f09.13 [oryza sativa (indica cultivar-group)]
  misc_feature (24)..(819): NCBI GI: 19352049 NCBI Desc: auxin response factor 8 [oryza sativa]
  misc_feature (319)..(792): NCBI GI: 70663942 NCBI Desc: osjnbb0004a17.6 [oryza sativa (japonica cultivar-group)]
  misc_feature (23)..(812): NCBI GI: 4104931 NCBI Desc: auxin response factor 8 [arabidopsis thaliana]
  misc_feature: The sequence is a functional homolog of SEQ ID NO 1002 in the 10/666,642US patent application
  misc_feature: The sequence is a functional homolog of SEQ ID NO 16 in the 10/412,699US patent application
  misc_feature: The sequence is a functional homolog of SEQ ID NO 1622 in the 10/374,780US patent application
  misc_feature: The sequence is a functional homolog of SEQ ID NO 1655 in the 10/412,699US patent application
  misc_feature: The sequence is a functional homolog of SEQ ID NO 224 in the 10/666,642US patent application
  misc_feature: The sequence is a functional homolog of SEQ ID NO 278 in the 10/374,780US patent application
  misc_feature: The sequence is a functional homolog of SEQ ID NO 830 in the 10/225,066US patent application
  misc_feature: The sequence is a functional homolog of SEQ ID NO 894 in the 10/412,699US patent application
  misc_feature: Useful for making plants with modulated growth and phenotype characteristics
  misc_feature: The sequence is a functional homolog of SEQ ID NO 16 in the 20040045049 US patent application
  misc_feature: The sequence is a functional homolog of SEQ ID NO 1655 in the 20040045049 US patent application
  misc_feature: The sequence is a functional homolog of SEQ ID NO 894 in the 20040045049 US patent application
  misc_feature: The sequence is a functional homolog of SEQ ID NO 1002 in the 10/666,642 US patent application
  misc_feature: The sequence is a functional homolog of SEQ ID NO 1622 in the 10/374,780 US patent application
  misc_feature: The sequence is a functional homolog of SEQ ID NO 1655 in the 10/412,699 US patent application
  misc_feature: The sequence is a functional homolog of SEQ ID NO 224 in the 10/666,642 US patent application
  misc_feature: The sequence is a functional homolog of SEQ ID NO 278 in the 10/374,780 US patent application
  misc_feature: The sequence is a functional homolog of SEQ ID NO 830 in the 10/225,066 US patent application
  misc_feature: The sequence is a functional homolog of SEQ ID NO 894 in the 10/412,699 US patent application
  misc_feature: The sequence is a functional homolog of SEQ ID NO 1001 in the 10/666,642 US patent application
  misc_feature: The sequence is a functional homolog of SEQ ID NO 1621 in the 10/374,780 US patent application
  misc_feature: The sequence is a functional homolog of SEQ ID NO 1654 in the 10/412,699 US patent application
  misc_feature: The sequence is a functional homolog of SEQ ID NO 1004 in the 10/666,642 US patent application
  misc_feature: The sequence is a functional homolog of SEQ ID NO 1624 in the 10/374,780 US patent application
  misc_feature: The sequence is a functional homolog of SEQ ID NO 1657 in the 10/412,699 US patent application
  misc_feature: The sequence is a functional homolog of SEQ ID NO 1424 in the 10/666,642 US patent application
  misc_feature: The sequence is a functional homolog of SEQ ID NO 1826 in the 10/412,699 US patent application
  misc_feature: The sequence is a functional homolog of SEQ ID NO 2070 in the 10/374,780 US patent application
  misc_feature: The sequence is a functional homolog of SEQ ID NO 1003 in the 10/666,642 US patent application
  misc_feature: The sequence is a functional homolog of SEQ ID NO 1623 in the 10/374,780 US patent application
  misc_feature: The sequence is a functional homolog of SEQ ID NO 1656 in the 10/412,699 US patent application
  misc_feature: The sequence is a functional homolog of SEQ ID NO 298 in the 10/412,699 US patent application
  misc_feature: Useful for biocontainment applications
  misc_feature: Useful for making plants with modulated flowering time
  misc_feature: Functional homolog of the protein sequence given in SEQ ID NO 13656
  misc_feature: Down-regulated in shoot tissues in response to salicylic acid treatment
MSSSSGASIGQPPPPPPAPPPEEEKKCLNSELWHACAGPLVCLPTVGTRVVYFPQGHSEQVAASTNKEVDGHIPNYPNLPPQLICQLHDVTMHADVETDEVYAQMTLQPLNPQEQNDAYLPAEMGIMSKQPTNYFCKTLTASDTSTHGGFSVPRRAAERVFPPLDFTQQPPAQELIARDIHDVEWKFRHIFRGQPKRHLLTTGWSVFVSAKRLVAGDSVLFIWNEKNQLLLGIRRASRPQTVMPSSVLSSDSMHIGLLAAAAHAAATNSRFTIFYNPRASPSEFVIPLSKYIKAVFHTRISVGMRFRMLFETEESSVRRYMGTITEVSDADPVRWPSSYWRSVKVGWDESTAGERPPRVSLWEIEPLTTFPMYPSLFPLRVKHPWYSGVAALHDDSNALMWLRGVAGEGGFQSLNFQSPGIGSWGQQRLHPSLLSNDHDQYQAVVAAAAASQSGGYLKQQFLHLQQPMQSPQEQCNLNPLLQQQILQQASQQQMVSPDAQNIQSVLSPNAIQQQLHQLQQMQHAHNDQKQKIQPDQPYQVPSSAVLPSPTSLPSHLREKFGFSDPNVNSSSFISSSSNENMLESNFLQGSSKSVDLSRFNQPVVSEQQQQQQQQAWKQKFMGSQSMSFGGLVSLNSPTSKDGSADNKIGRDVQNQSLFSPQVDSSSLLYNMVPNLTSNVADNNISVIPSGSTYLQSPMYGCLDDSSGLLQNTGENDPAARTFVKVYKSGSVGRSLDITRFSNYAELREELGQMFGIKGQLDDPDRSGWQLVFVDRENDVLLLGDDPWESFVNSVWYIKILSPEDVHKMGKPGNDPRYLS

SEQ ID NO: 4513 - DNA, 1476 bp, Sorghum bicolor
  misc_feature: Ceres ANNOT ID no. 6038104
  misc_feature: Encodes the peptide sequence at SEQ ID NO 4514
atggaccagccaccgaatggattcgccgccggaggatttttcacgcacattgatgggcaaaaccgctctcccccttctgtaattgtaatcgggggagggatttcaggcatcgcagccgcacgtgctttgtccaatgcttcatttaaggtcacactcttggagtcgagggaccgagttggtggccgtgtgcacactgactattcttttggttgccccattgacatgggagcttcatggttgcatggtgtttgcaacgagaattctttggcgccattgattaggatgcttgggcttagattatatcgcacaagcggtgataactctgttctgtatgaccatgatttggaaagttatgctctatttgataagcatggtcagcaagttccccaggagatagttagcaaagttggagagacatttgagaaaattcttaaggagactgtcaaagtaagagatgaacatgcaaatgacatgcctcttattcaagccatggcaattgtgcttaacaggaatccacatatgaagttggagggcctggaatatgaggtactgcagtggtgtatatgtagactggaagcatggttcgctactgacatggacaatatatctctgaagaattgggatcaggaacatgtgcttaccggtggacatggtcttatggtgaatggctatgatcctgtcatcaaagctctagctcaaggtcttgacattcatctcaaccacagggtcacaaagatcatacaacgttataataaggttattgtttgtgtggaagatggggcaagtttcgttgcagatgctgctataataacggtccctctcggggtactaaaggcaaatatcatcaagtttgaacctgagctaccaagagaaaagctttcagcaatcgctgatcttggcgttggcatcgaaaacaagatagcccttaagttcaacactgtattttggcccaacgttgaagtgctaggtaggatcgccccaacgtcaaatgcctgtggctactttctcaaccttcacaaagccacaggaaacccagtcctggtatgcatggtagctggaagattcgcatacgagatcgagaagctgtctgatgaagaatccgtcaactttgttatgtcccagctcaggaaaatgctaccgcaggcaactgaaccggttcagtatttggtttcacgttggggcagtgacccaaactcacttggctcctactcgtgcgacctggtggggaaaccggctgacctgtatgaaagattctgtgctccggttggcaacctgttcttcgctggggaggccgcctgcattgaccactccgggtcggtgcatggagcttattcgtcaggcattgccgctgcagaggactgccgaaggcgtctgtcgacgcagctaggcatctccgacctgttccaggtcgcgaaggttgtcatgagggaggagatgaatgaagtcatggttccctttcagatatcgaggctgtaa

SEQ ID NO: 4514 - protein, 491 aa, Sorghum bicolor
  misc_feature: Ceres ANNOT ID no. 6038104
  misc_feature (34)..(455): Pfam Id: Amino_oxidase Pfam Desc: Flavin containing amine oxidoreductase
  misc_feature (26)..(457): Pfam Id: DAO Pfam Desc: FAD dependent oxidoreductase
  misc_feature (1)..(491): NCBI GI: 90265249 NCBI Desc: h0624f09.10 [oryza sativa (indica cultivar-group)]
  misc_feature (1)..(491): NCBI GI: 115461238 NCBI Desc: os04g0671300 [oryza sativa (japonica cultivar-group)]
  misc_feature (5)..(490): NCBI GI: 90265248 NCBI Desc: h0624f09.9 [oryza sativa (indica cultivar-group)]
  misc_feature (5)..(490): NCBI GI: 32488409 NCBI Desc: osjnba0043a12.39 [oryza sativa (japonica cultivar-group)]
  misc_feature (5)..(389): NCBI GI: 6686400 NCBI Desc: f1e22.18 [arabidopsis thaliana]
MDQPPNGFAAGGFFTHIDGQNRSPPSVIVIGGGISGIAAARALSNASFKVTLLESRDRVGGRVHTDYSFGCPIDMGASWLHGVCNENSLAPLIRMLGLRLYRTSGDNSVLYDHDLESYALFDKHGQQVPQEIVSKVGETFEKILKETVKVRDEHANDMPLIQAMAIVLNRNPHMKLEGLEYEVLQWCICRLEAWFATDMDNISLKNWDQEHVLTGGHGLMVNGYDPVIKALAQGLDIHLNHRVTKIIQRYNKVIVCVEDGASFVADAAIITVPLGVLKANIIKFEPELPREKLSAIADLGVGIENKIALKFNTVFWPNVEVLGRIAPTSNACGYFLNLHKATGNPVLVCMVAGRFAYEIEKLSDEESVNFVMSQLRKMLPQATEPVQYLVSRWGSDPNSLGSYSCDLVGKPADLYERFCAPVGNLFFAGEAACIDHSGSVHGAYSSGIAAAEDCRRRLSTQLGISDLFQVAKVVMREEMNEVMVPFQISRL

SEQ ID NO: 4515 - DNA, 1464 bp, Sorghum bicolor
  misc_feature: Ceres ANNOT ID no. 6038106
  misc_feature: Encodes the peptide sequence at SEQ ID NO 4516
atggaccccaatggcctcaaaactggaggccttttgctcccgaccattgagaggcggtgcacgtctcctccatccgtcattgtcatcggtggtggcatctctggcgttgcagctgcccgtgccctctccaattcttcatttaaggtgactgttttggagtcgagagatcgtattggcgggcgtgttcatactgattactcatttggatgcccaattgatatgggagcctcatggctgcatggcgtgtgtaatgagaattcattggcgccattgattggctatcttgggctgaggttatatcgcacaagcgatgacaactcagttctgtatgatcatgatttagaaagctatgctctctttgataaggatggtaatcaggtcccaaaggagacagtcgataaagttggagaaacttttgagagaattcttgaagagacggtgaaagtgcgtgatgagcaggaacatgacatgccacttctacaggcgatttctattgtgtttgagaggcacccccatctaaagctagaagggctagatgatcaggtcttgcaatggtgtgtctgccggcttgaggcatggtttgctgcagatgcagatgaaatatctctgaagaactgggatcaggagcgtgttcttactggtggacatggactaatggtgaatggatactatcctgttattgaagctcttgctcaaggtcttgacatcaggcttaaccaaagggttaccgaaattacccgccaatacaatggagtcaaggtcactactgaagatggcacaagctacttcgctgacgcttgcataatctccgtgccacttggtgtgctcaaggcgaacgtaataaaatttgaacctgagctgccctcatggaagagctctgccattgcggacctcggcgtcggcgtcgagaacaagatcgctatgcactttgacagagtcttctggcccaacgttgaggtgctgggaatggttgggccgacgcctaaagcctgtgggtacttcctgaacctgcacaaagcgaccggcaatccggtcctcgtctacatggctgccggaaggtttgcccaggaagtggagaaattgtcggataaggaagccgtcagcttggtcgtttctcacctgaagaagatgcttccagatgcctctgaaccaacgcagtacctggtgtcacgctggggctccgacccgaactctctggggtcctactcctgcgacctggtcggaaagccggccgacgtgtgcgcgaggttctccgcccccgtggataacctgtacttcgccggcgaggcggccagcgccgagcactcggggtcggtgcacggcgcctactcgtcgggcattgccgcagccgaagaatgcaggaagcgcctactgacgctgaagggcatcccggacctggtccaggtcgcggcatgggaggagatggccggagctgtggctcccctgcagatttgcaggacctga

SEQ ID NO: 4516 - protein, 487 aa, Sorghum bicolor
  misc_feature: Ceres ANNOT ID no. 6038106
  misc_feature (33)..(454): Pfam Id: Amino_oxidase Pfam Desc: Flavin containing amine oxidoreductase
  misc_feature (25)..(456): Pfam Id: DAO Pfam Desc: FAD dependent oxidoreductase
  misc_feature (1)..(487): NCBI GI: 90265248 NCBI Desc: h0624f09.9 [oryza sativa (indica cultivar-group)]
  misc_feature (1)..(487): NCBI GI: 32488409 NCBI Desc: osjnba0043a12.39 [oryza sativa (japonica cultivar-group)]
  misc_feature (4)..(486): NCBI GI: 90265249 NCBI Desc: h0624f09.10 [oryza sativa (indica cultivar-group)]
  misc_feature (4)..(486): NCBI GI: 115461238 NCBI Desc: os04g0671300 [oryza sativa (japonica cultivar-group)]
  misc_feature (17)..(486): NCBI GI: 18650598 NCBI Desc: at2g43020/mfl8.12 [arabidopsis thaliana]
MDPNGLKTGGLLLPTIERRCTSPPSVIVIGGGISGVAAARALSNSSFKVTVLESRDRIGGRVHTDYSFGCPIDMGASWLHGVCNENSLAPLIGYLGLRLYRTSDDNSVLYDHDLESYALFDKDGNQVPKETVDKVGETFERILEETVKVRDEQEHDMPLLQAISIVFERHPHLKLEGLDDQVLQWCVCRLEAWFAADADEISLKNWDQERVLTGGHGLMVNGYYPVIEALAQGLDIRLNQRVTEITRQYNGVKVTTEDGTSYFADACIISVPLGVLKANVIKFEPELPSWKSSAIADLGVGVENKIAMHFDRVFWPNVEVLGMVGPTPKACGYFLNLHKATGNPVLVYMAAGRFAQEVEKLSDKEAVSLVVSHLKKMLPDASEPTQYLVSRWGSDPNSLGSYSCDLVGKPADVCARFSAPVDNLYFAGEAASAEHSGSVHGAYSSGIAAAEECRKRLLTLKGIPDLVQVAAWEEMAGAVAPLQICRT

SEQ ID NO: 4517 - DNA, 870 bp, Sorghum bicolor
  misc_feature: Ceres ANNOT ID no. 6038109
  misc_feature: Encodes the peptide sequence at SEQ ID NO 4518
atggcggggatctctcgcgcgatccgggcctgcgccgccgcgtcccggcggacgctggccgctgcttcgggggcggcgctgccgaaggaggaagcggcagcggcgggggcgggggtgagagcggcggcgaccgggcgcagggggcgggatcaggaggacgggaggcgcgtgcagtgggtgttcctcgggtgccccggggtgggcaagggcacctacgccagtcgcctctcgcagctgctcggcgtcccgcacatcgccaccggcgacctcgtccgcgacgccctggccacccctggccccttctcgaagaagcttgctgagatcgtgaatcatggaaagctggtgtctgatgagatcatcataaatctgctgtcaagacgcctggaagagggagaagaaaagggtgaattggggttcatccttgatggctttcctcgaaccataagacaagcggagatacttgaaggagtgacagatattgatttggtgatcaatctcaagctccgagaagaagctctgcttgcaaaatgccttggcagaaggatgtgcagccagtgtggcggaaacttcaatgtggcctccattgatatcgagggtgaaaatggtggagctcgaatgtacatgcctccactattgcctcctccacagtgtgaatcgaagctaataaccagagcagatgatactgaagaagtggtaaaagagcggctacgtgtgtaccatgatttgactgaaccagtggaggaattctacagaacacgtgggaaactcttagagttcaatctacctggtggaatacccgaatcatggccaaagttattgcaagccttgaacatagaagaccctgacaataagagatctgcagcagcatga

SEQ ID NO: 4518 - protein, 289 aa, Sorghum bicolor
  misc_feature: Ceres ANNOT ID no. 6038109
  misc_feature (61)..(255): Pfam Id: ADK Pfam Desc: Adenylate kinase
  misc_feature (1)..(289): NCBI GI: 90265247 NCBI Desc: h0624f09.8 [oryza sativa (indica cultivar-group)]
  misc_feature (1)..(289): NCBI GI: 32488408 NCBI Desc: osjnba0043a12.38 [oryza sativa (japonica cultivar-group)]
  misc_feature (1)..(289): NCBI GI: 115461234 NCBI Desc: os04g0671100 [oryza sativa (japonica cultivar-group)]
  misc_feature (1)..(289): NCBI GI: 25990718 NCBI Desc: adenylate kinase [solanum tuberosum]
  misc_feature (60)..(272): NCBI GI: 76664061 NCBI Desc: adenylate kinase 2 [nyctotherus ovalis]
  misc_feature (1)..(289): SWISSPROT Homolog: EC 2.7.4.3 Adenylate kinase, chloroplast precursor
MAGISRAIRACAAASRRTLAAASGAALPKEEAAAAGAGVRAAATGRRGRDQEDGRRVQWVFLGCPGVGKGTYASRLSQLLGVPHIATGDLVRDALATPGPFSKKLAEIVNHGKLVSDEIIINLLSRRLEEGEEKGELGFILDGFPRTIRQAEILEGVTDIDLVINLKLREEALLAKCLGRRMCSQCGGNFNVASIDIEGENGGARMYMPPLLPPPQCESKLITRADDTEEVVKERLRVYHDLTEPVEEFYRTRGKLLEFNLPGGIPESWPKLLQALNIEDPDNKRSAAA

SEQ ID NO: 4519 - DNA, 1392 bp, Sorghum bicolor
  misc_feature: Ceres ANNOT ID no. 6038112
  misc_feature: Encodes the peptide sequence at SEQ ID NO 4520
atggcgggcgatcccccgacggccgcggagaaggagaccctggtctcatccttcctcgagatcgccgccggccagacacccgagactgccacccagttcctacagatgacgagctggcacctggaagaggcgctgcagctgttctacatcgacggcgagtccgccctcggcgccgcgcatccagcggtcccgccgcctgcggccgcggctgcgtccgcgtcggcgttggcggcggcggctggggtggaagaggcgatgaggttcgctccacccccggcggctgccctgggcgatgcaatgtcacatggatttggggttggggaggacgatgacgtccgcgcgcctctgcctgtgaagagggagactctctacggcgagggcatcgtgtctgtcatgcgacctaatgcatcagctgcatttcgtaattttgaacaagaggcaagacaatctgctgtctgggactctgaccagaatgctacatctagttctggtgataatcttgcttctttgtaccgtccacctttttctttgatgttcaatggaccctttgacaaggcaaagttagaggcttcttccctggacaaatggctattaatcaatttgcagtcgacagaggaatttagctctcacatgcttaatcgagacacctggggaaatgaagcggtggctcagttgattcggtcaaattttattttctggcaggtttattatgacaccagtgaggggaggaaggtatgcacctactaccatttggtgtccatgcctgctattctcctaattgaccccgtcactgggcaaaaaatgcatgcttggaatggaatggttcaccccgaccgtttactcgaggatttactaccttacctggataaaggtccgaaggagcaccatgcagctcaacctcagaagcgcccaaggaaagttgatcaggaagcttctacaggcaagcaaggcaaaatagctgtagaggatgaagatgaagaactagcacgggcagtagcagcttcgctagaggagggtaaagaaatcattgaagcatcagacgctagtgatgacatggctgaagctgaacctcaggtggacaatgagccaagcttaaacatcaagcctgattatcctcctctccctgaagaacctacaggaagcagggaccgtctctgcagggttgcgattcggctaccgaacaatcggaggatccaaagaaacttccttcacacagatcctatcaagctcttgtggtcattctgcgctcctcaggttgaggacggtgagaagagggcgttccacttcgtacaggccattcctggagcatcccagaagctggagttcagaagcgaccaaacattcaaggaagccgggctggccaactcgatgatcaacctcttgtgggactga

SEQ ID NO: 4520 - protein, 463 aa, Sorghum bicolor
  misc_feature: Ceres ANNOT ID no. 6038112
  misc_feature (381)..(462): Pfam Id: UBX Pfam Desc: UBX domain
  misc_feature (1)..(463): NCBI GI: 90265245 NCBI Desc: h0624f09.6 [oryza sativa (indica cultivar-group)]
  misc_feature (1)..(463): NCBI GI: 38345301 NCBI Desc: osjnba0043a12.36 [oryza sativa (japonica cultivar-group)]
  misc_feature (132)..(463): NCBI GI: 115461232 NCBI Desc: os04g0670800 [oryza sativa (japonica cultivar-group)]
  misc_feature (134)..(463): NCBI GI: 7527718 NCBI Desc: t5e21.7 [arabidopsis thaliana]
  misc_feature (7)..(463): NCBI GI: 145323892 NCBI Desc: ubx domain-containing protein [arabidopsis thaliana]
MAGDPPTAAEKETLVSSFLEIAAGQTPETATQFLQMTSWHLEEALQLFYIDGESALGAAHPAVPPPAAAAASASALAAAAGVEEAMRFAPPPAAALGDAMSHGFGVGEDDDVRAPLPVKRETLYGEGIVSVMRPNASAAFRNFEQEARQSAVWDSDQNATSSSGDNLASLYRPPFSLMFNGPFDKAKLEASSLDKWLLINLQSTEEFSSHMLNRDTWGNEAVAQLIRSNFIFWQVYYDTSEGRKVCTYYHLVSMPAILLIDPVTGQKMHAWNGMVHPDRLLEDLLPYLDKGPKEHHAAQPQKRPRKVDQEASTGKQGKIAVEDEDEELARAVAASLEEGKEIIEASDASDDMAEAEPQVDNEPSLNIKPDYPPLPEEPTGSRDRLCRVAIRLPNNRRIQRNFLHTDPIKLLWSFCAPQVEDGEKRAFHFVQAIPGASQKLEFRSDQTFKEAGLANSMINLLWD

SEQ ID NO: 4521 - DNA, 1371 bp, Sorghum bicolor
  misc_feature: Ceres ANNOT ID no. 6038114
  misc_feature: Encodes the peptide sequence at SEQ ID NO 4522
atgaagcggctccccgtcctggccgtccccgtcctcctgctcctcgtctccctctccttcttcctcttccggcctaccaccccgccggtcctcagctcgcggcaagccttcgagcccgaccgccgtctcagggtctacgtggcggacctcccccgcgcgctcaactacggtctgctcgacagctactggtccctccgcgccgcggactcccgcatcgaggcctcgtccgacccggaccacccgcccccgaacgaccactcgccgtaccccgagaaccccctcatcaagcagtacagcgccgagtactggctcctcgcctccctccgcgcggcggcgacggctgccgtgagggtcgtcacggactggagggaagccgatgtcgtctttgtccccttcttcgcgacgctgtccgcggagatggagctcgggtggggaaccaagggcgcctttcgcaagaaggacggcaacgaggactaccggcggcagcgggaggtcgtcgaccgcgtcacctcccaccccgcgtggcggaggtccggtggccgcgaccatgtcttcgtcatgacagaccctgtggctatgtggcacgtccgtgctgagattgctcccgcaattcttttggtggttgattttggaggatggtataaagttgactcaaagtccgcaaacagaaactcgtctcgtatgatacagcacacccaagtgtcattgcttaaggatgttattgtgccttacacgcatttgcttccgacactcctcttatcagagaataaagatcgtcccacccttctctacttcaagggtgcaaagcataggcatcggggtggtttagtgcgagagaaattatgggatttgctaggtaatgagcctgatgttatcatggaagaaggcttccctaatgccaccggacgtgaacaatcgataaaagggatgcagacatcggaattttgcttacacccagctggtgacaccccaacttcttgtcgcctctttgatgctattgccagtctttgcataccagtcattgttagtgatgaggttgagctcccttatgaagggatgatagactacacagaattctccatttttgtgtcggttagaaatgctatgagacccaaatggctaacaagctacttgaggaatattcccaagcagcagaaggatgagttccgaaaaaacttggctcgtgtccaacctatctttgagtacaacaccagttactccataagcagaggctctacctccattgatggtgctgtgagtcacatatggaagaagattcatcagaaactgccaatgattcaggaggcaatcatcagggagaagcggaagcctgatggcgcgtcaatcccactccgttgtcattgtacatga

SEQ ID NO: 4522 - protein, 456 aa, Sorghum bicolor
  misc_feature: Ceres ANNOT ID no. 6038114
  misc_feature (45)..(393): Pfam Id: Exostosin Pfam Desc: Exostosin family
  misc_feature (1)..(456): NCBI GI: 32488405 NCBI Desc: osjnba0043a12.35 [oryza sativa (japonica cultivar-group)]
  misc_feature (187)..(456): NCBI GI: 115461230 NCBI Desc: os04g0670600 [oryza sativa (japonica cultivar-group)]
  misc_feature (10)..(455): NCBI GI: 27817890 NCBI Desc: exostosin family protein-like protein [oryza sativa (japonica cultivar-group)]
  misc_feature (10)..(455): NCBI GI: 115472841 NCBI Desc: os07g0567000 [oryza sativa (japonica cultivar-group)]
  misc_feature (75)..(442): NCBI GI: 22330483 NCBI Desc: exostosin family protein [arabidopsis thaliana]
  misc_feature: Useful for making plants with altered cell wall content and/or composition
  misc_feature: GREAT-hit functional homolog of the protein sequence encoded by LOCUS at1g34270
  misc_feature: Useful for making plants with altered cell wall content and/or composition
  misc_feature: Functional homolog of the protein sequence given in SEQ ID NO 13876
MKRLPVLAVPVLLLLVSLSFFLFRPTTPPVLSSRQAFEPDRRLRVYVADLPRALNYGLLDSYWSLRAADSRIEASSDPDHPPPNDHSPYPENPLIKQYSAEYWLLASLRAAATAAVRVVTDWREADVVFVPFFATLSAEMELGWGTKGAFRKKDGNEDYRRQREVVDRVTSHPAWRRSGGRDHVFVMTDPVAMWHVRAEIAPAILLVVDFGGWYKVDSKSANRNSSRMIQHTQVSLLKDVIVPYTHLLPTLLLSENKDRPTLLYFKGAKHRHRGGLVREKLWDLLGNEPDVIMEEGFPNATGREQSIKGMQTSEFCLHPAGDTPTSCRLFDAIASLCIPVIVSDEVELPYEGMIDYTEFSIFVSVRNAMRPKWLTSYLRNIPKQQKDEFRKNLARVQPIFEYNTSYSISRGSTSIDGAVSHIWKKIHQKLPMIQEAIIREKRKPDGASIPLRCHCT

SEQ ID NO: 4523 - DNA, 915 bp, Sorghum bicolor
  misc_feature: Ceres ANNOT ID no. 6038115
  misc_feature: Encodes the peptide sequence at SEQ ID NO 4524
  misc_feature: Up-regulated in shoot tissues in response to salicylic acid treatment
atggctgctgcgacggcgtggcccggcgccgcagcctccaactcgctgcttctctcgcgctcgccgccccacgccgccgccgccgcgctcgcgctcgcgccttcgccggggagctccatgcggaggcggctcatcctcggcgtcggcacgccggccgtagcggcgctggcggccgcggcgccgccggcggtgctgcaggacggggccgtcacggtgctcatcactgccggcgcctactctcttgtgcgcgtcttcgacgagctcaccgagcggcggctcatcgaaaagagtttgagcaggaaggttgtgcacgtgctatccggcgtcctgttcatgtcatcttggccgctgttcagcaattcgacagaagcacggtatttcgctgcagttgttccactcttgaactccataaggcttctgatatatggactccgtctctacactgatgaagctctagtaaaatcagtgacacgtgaaggaaaaccagaggaattgctgagaggtccactgtattatgtgttggtgctgttgttcagtgttttagtcttctggcgggagtcccctgttgggattgtctctttgtcaatgatgagtggtggcgatgggttcgctgacattgttgggagaaggtatggctcagtgaagctgccattcaataagaagaagagctgggccgggagcatctctatgttcatttctggttttctgctgtccgcgatgatgatgttctacttctcaagccttggttacattgatgttatttggcaggaggcacttggtaagctggcgcttgttgcactggcagcaaccgtagtggagtgtattcctgtgactgaagttgtagatgacaatatatctgttcctttggccaccatgctggtagcttttctattgtttagctccaacgcacaatga

SEQ ID NO: 4524 - protein, 304 aa, Sorghum bicolor
  misc_feature: Ceres ANNOT ID no. 6038115
  misc_feature (98)..(301): Pfam Id: CTP_transf_1 Pfam Desc: Cytidylyltransferase family
  misc_feature (1)..(302): NCBI GI: 76443931 NCBI Desc: phytol kinase [zea mays]
  misc_feature (1)..(302): NCBI GI: 76443935 NCBI Desc: phytol kinase [glycine max]
  misc_feature (40)..(302): NCBI GI: 76443929 NCBI Desc: phytol kinase [zea mays]
  misc_feature (11)..(299): NCBI GI: 90265243 NCBI Desc: h0624f09.4 [oryza sativa (indica cultivar-group)]
  misc_feature (11)..(299): NCBI GI: 32488404 NCBI Desc: osjnba0043a12.34 [oryza sativa (japonica cultivar-group)]
  misc_feature: Up-regulated in shoot tissues in response to salicylic acid treatment
MAAATAWPGAAASNSLLLSRSPPHAAAAALALAPSPGSSMRRRLILGVGTPAVAALAAAAPPAVLQDGAVTVLITAGAYSLVRVFDELTERRLIEKSLSRKVVHVLSGVLFMSSWPLFSNSTEARYFAAVVPLLNSIRLLIYGLRLYTDEALVKSVTREGKPEELLRGPLYYVLVLLFSVLVFWRESPVGIVSLSMMSGGDGFADIVGRRYGSVKLPFNKKKSWAGSISMFISGFLLSAMMMFYFSSLGYIDVIWQEALGKLALVALAATVVECIPVTEVVDDNISVPLATMLVAFLLFSSNAQ

SEQ ID NO: 4525 - DNA, 1275 bp, Sorghum bicolor
  misc_feature: Ceres ANNOT ID no. 6038129
  misc_feature: Encodes the peptide sequence at SEQ ID NO 4526
  misc_feature: Down-regulated in shoot tissues in response to methyl jasmonate treatment
  misc_feature: Down-regulated in root tissues in response to methyl jasmonate treatment
  misc_feature: Down-regulated in shoot tissues in response to salicylic acid treatment
atgaccgcggaggcggagcaaggcttccgcccgctggacgaggcgtccttagtcgcctacatcaagaccacgccggcgctcgcctcccgcctcggcggcggcagcctggactccctcgagatcaaggaggtcggcgacggcaacgtcaacttcgtctacatcgtgcggtccgaagctggcgcgatcgtcgtcaaacaggcgctcccgtacgtgcgctccgtgggggactcgtggccgatgacgcgggagcgcgtctacttcgaggcctccacgctgcgtgagcacggccgcctgtgcccggagcacacccccgaggtgtaccacttggaccgggccatgtcgctgatggcgatgcgttacatcgagcccccgcacatcatcctccgcaagggcttcatcgccggcgtcgagtacccgctgctcgccgaccacatgtccgattacatggccaagacgctcttcttcacctccctcctctataacaacaccacggatcataagaaaggagttgctaagtactctgcgaacgtggagatgtgtaggctcacggagcaatttgtgttctcggatccataccgcgtctcgaaatttaatcggtggacctcaccttatcttgacaaagatgctgaggcagttcgagaggatgaggagctcaagttggaagcggctgaattgaaatcgctgtttatggagagagctcaggctctgattcatggagatctccacactgcttctatcatggtgaccacaggttcaactcaaatcattgattcagagtttgggttctatgggccaatgggttatgacattggagccttccttggaaacctgattttggcatactatgcacagaatgggcatgctgatcaagcgaacgatcgtaaggcttacaagaaatggatcttgaagacaattgaagagtcgtggaatttgttccagaaaaagtttgttgaactatggaataaacacaaagaagggaatggggaggcgtacctgcctgatatatacaacaactcaaagcttttgagcgttgctcaaaagaagtacatgacaaacctatttcatgatagccttgggtttggttcagccaaaatgatcaggcgaatagtcggaatcgctcacgtcgaggatctcgagtcaattaaggatgccagcaggagagcagagtgcgagcgtgctgccctcaattgtgcaaagacgatcctcaagggaagacgccaatttgagaccatcgagcaagtcattgtgcatattcaatcgtttgatcaggactga

SEQ ID NO: 4526 - protein, 424 aa, Sorghum bicolor
  misc_feature: Ceres ANNOT ID no. 6038129
  misc_feature (40)..(300): Pfam Id: APH Pfam Desc: Phosphotransferase enzyme family
  misc_feature (4)..(424): NCBI GI: 90399160 NCBI Desc: h0818h01.11 [oryza sativa (indica cultivar-group)]
  misc_feature (4)..(424): NCBI GI: 32488395 NCBI Desc: osjnba0043a12.25 [oryza sativa (japonica cultivar-group)]
  misc_feature (4)..(424): NCBI GI: 46883147 NCBI Desc: methylthioribose kinase [oryza sativa (japonica cultivar-group)]
  misc_feature (38)..(415): NCBI GI: 89286107 NCBI Desc: 5-methylthioribose kinase family protein [tetrahymena thermophila sb210]
  misc_feature (6)..(414): NCBI GI: 113872041 NCBI Desc: 5-methylthioribose kinase [sinorhizobium medicae wsm419]
  misc_feature: Down-regulated in shoot tissues in response to methyl jasmonate treatment
  misc_feature: Down-regulated in root tissues in response to methyl jasmonate treatment
  misc_feature: Down-regulated in shoot tissues in response to salicylic acid treatment
MTAEAEQGFRPLDEASLVAYIKTTPALASRLGGGSLDSLEIKEVGDGNVNFVYIVRSEAGAIVVKQALPYVRSVGDSWPMTRERVYFEASTLREHGRLCPEHTPEVYHLDRAMSLMAMRYIEPPHIILRKGFIAGVEYPLLADHMSDYMAKTLFFTSLLYNNTTDHKKGVAKYSANVEMCRLTEQFVFSDPYRVSKFNRWTSPYLDKDAEAVREDEELKLEAAELKSLFMERAQALIHGDLHTASIMVTTGSTQIIDSEFGFYGPMGYDIGAFLGNLILAYYAQNGHADQANDRKAYKKWILKTIEESWNLFQKKFVELWNKHKEGNGEAYLPDIYNNSKLLSVAQKKYMTNLFHDSLGFGSAKMIRRIVGIAHVEDLESIKDASRRAECERAALNCAKTILKGRRQFETIEQVIVHIQSFDQD

SEQ ID NO: 4527 - DNA, 750 bp, Sorghum bicolor
  misc_feature: Ceres ANNOT ID no. 6038132
  misc_feature: Encodes the peptide sequence at SEQ ID NO 4528
atgagtagcctggtccgcttcctcttcaccctcgccgcggccatcgccgcagcctcgctcctcgtcgcctccctccgccgccgcgcgccgcctcccgggcttcccgcaaagctcatcccctcctcccacatggcgggacgcaaccggagcttcgtactgtggctgcacggcctcggcgattctggcccagccaacgagcccatccgcaacctcttctctgccccggagttccggctcgccaagtggtcgttcccctccgccccccgcgcccccgtctcctgcaacaatggttttgtcatgccgtcgtggttcgatatccacgagcttcccatgagcgctgggtccccgcaagatgaggctggggttctcaaggctgtggaaaaggtgcacgccatgatagacagggaagtagccgatggcatccaccctgagaacatatttgtttgtggatttagccaaggaggtggaggagcagtgttcagcggttgggtgcctttcggttcatcagtcaccgagaagatttcacctgaagcgaggaagaccccatttctttggtcacatggaatggctgacaaagtagtattgtttgaagctggtcaagctggtccaccatttttgcaaagtgcgggtgttaactgtgaattcaaggcatatccagatctgggccattccctttccaaagaagagctactttatctcgagtcatggatcaagagtcgtctaaatgcctctcaagaaaaggacggttaa

SEQ ID NO: 4528 - protein, 249 aa, Sorghum bicolor
  misc_feature: Ceres ANNOT ID no. 6038132
  misc_feature (44)..(241): Pfam Id: Abhydrolase_2 Pfam Desc: Phospholipase/Carboxylesterase
  misc_feature (1)..(155): NCBI GI: 90399156 NCBI Desc: h0818h01.7 [oryza sativa (indica cultivar-group)]
  misc_feature (1)..(248): NCBI GI: 115461208 NCBI Desc: os04g0669500 [oryza sativa (japonica cultivar-group)]
  misc_feature (45)..(248): NCBI GI: 32488391 NCBI Desc: osjnba0043a12.21 [oryza sativa (japonica cultivar-group)]
  misc_feature (49)..(244): NCBI GI: 145341423 NCBI Desc: carboxylic ester hydrolase [arabidopsis thaliana]
  misc_feature (49)..(244): NCBI GI: 126723800 NCBI Desc: sober1-like protein [arabidopsis thaliana]
MSSLVRFLFTLAAAIAAASLLVASLRRRAPPPGLPAKLIPSSHMAGRNRSFVLWLHGLGDSGPANEPIRNLFSAPEFRLAKWSFPSAPRAPVSCNNGFVMPSWFDIHELPMSAGSPQDEAGVLKAVEKVHAMIDREVADGIHPENIFVCGFSQGGGGAVFSGWVPFGSSVTEKISPEARKTPFLWSHGMADKVVLFEAGQAGPPFLQSAGVNCEFKAYPDLGHSLSKEELLYLESWIKSRLNASQEKDG

SEQ ID NO: 4529 - DNA, 1584 bp, Sorghum bicolor
  misc_feature: Ceres ANNOT ID no. 6038136
  misc_feature: Encodes the peptide sequence at SEQ ID NO 4530
atggggccggactcgtcgcccaagaagtggagcctcaaggagcagcgcgccgcctacctccagtggttcgccctcgccgacgaagacggagatggccgcctgacggggaacgatgcgctcaggttcttcgccatgtccaatctctccaagcccgagctgaagcaggtttgggcgatcgctgattccaaacgtcagggatatcttggattcttcgagtttatgactgcaatgcagctggtttctctcgcacaagcagggaatgaaatcaatcaagacaccctttcgaactcagatctcgagaggttgcagctccccacaatggaagggctggctaaaaaactagtatgtcacgcatgccatccatcagaatcacctatatctgccagctggttcaactccaagtcaggaaagaagattcctttgaaatcagtcacttcgatcatcgatgggctaaagaaatcatacattgagaagttgaggcctttggaaaaaacctatcagttccatgattttgtgtctcccttgatgactagcagtgattttgatgcgaagccaatggtcatgctgttgggtcaatactcaacgggaaaaacaacattcattaagcatttattaaagacaagttatccaggcgctcatattggaccagagcctacaacagacagatttgttgtcatcacttctggaccggatgaaagatgcattcctggaaacacaattgccgttcaagctgacatgccatacagtggcctgtcatctttcggaacagcatttttatcaaagtttgaatgttctcagatgccacatccattattagagcatgtaaccttcgtggatactcctggagttttatcaggggagaagcagcgaacgcagcgcagctacgatttcactggagttacatcatggtttgcggcaaagtgtgaccttattcttctcctgtttgatccacataaacttgacatcagcgatgagttcaagcgtgtgatcggatcactccgtgggcatgatgacaaaatacgcatagttctcaacaaggcagaccaactgatgagagtgtatggagcactgctatggtcgctggggaaagtcctgaacacaccagaagtcatgcgtgtctacataggttcattcaacgacaagccgatcagggagacagcggctggcccactgggcatggagctattccagaaagaacaagatgacttgctctcggacctgaacgacatccccaagaaggcctgtgatcgtcggatcaacgagtttgtgaagcgcgcgagggctgccaaagtccatgctcacataatcagccatctgaagaaagagatgcctgcactgatgggcaaggccaaggctcagcagaagctgcttgacagcctggacgatcacttcgccaaggtccagaaggagctgcacctgccgccaggggacttcccgagcgtggaggagtacagggagcttctgagcgcctacaacttcgacaggttcgagaggctgaggcccaagatggttcagggcgtggatgacatgctggcctacgacatcccggacctcctgaagaagttcaggaacccctacgactga

SEQ ID NO: 4530 - protein, 527 aa, Sorghum bicolor
  misc_feature: Ceres ANNOT ID no. 6038136
  misc_feature (187)..(347): Pfam Id: Dynamin_N Pfam Desc: Dynamin family
  misc_feature (185)..(348): Pfam Id: MMR_HSR1 Pfam Desc: GTPase of unknown function
  misc_feature (1)..(527): NCBI GI: 38345297 NCBI Desc: osjnba0043a12.19 [oryza sativa (japonica cultivar-group)]
  misc_feature (110)..(421): NCBI GI: 90399246 NCBI Desc: b0811b10.21 [oryza sativa (indica cultivar-group)]
  misc_feature (13)..(527): NCBI GI: 92878920 NCBI Desc: eps15 homology (eh); actin-binding, actinin-type [medicago truncatula]
  misc_feature (13)..(527): NCBI GI: 92884328 NCBI Desc: eps15 homology (eh); dynamin; actin-binding, actinin-type [medicago truncatula]
  misc_feature (12)..(527): NCBI GI: 42572841 NCBI Desc: calcium-binding ef hand family protein [arabidopsis thaliana]
MGPDSSPKKWSLKEQRAAYLQWFALADEDGDGRLTGNDALRFFAMSNLSKPELKQVWAIADSKRQGYLGFFEFMTAMQLVSLAQAGNEINQDTLSNSDLERLQLPTMEGLAKKLVCHACHPSESPISASWFNSKSGKKIPLKSVTSIIDGLKKSYIEKLRPLEKTYQFHDFVSPLMTSSDFDAKPMVMLLGQYSTGKTTFIKHLLKTSYPGAHIGPEPTTDRFVVITSGPDERCIPGNTIAVQADMPYSGLSSFGTAFLSKFECSQMPHPLLEHVTFVDTPGVLSGEKQRTQRSYDFTGVTSWFAAKCDLILLLFDPHKLDISDEFKRVIGSLRGHDDKIRIVLNKADQLMRVYGALLWSLGKVLNTPEVMRVYIGSFNDKPIRETAAGPLGMELFQKEQDDLLSDLNDIPKKACDRRINEFVKRARAAKVHAHIISHLKKEMPALMGKAKAQQKLLDSLDDHFAKVQKELHLPPGDFPSVEEYRELLSAYNFDRFERLRPKMVQGVDDMLAYDIPDLLKKFRNPYD

SEQ ID NO: 4531 - DNA, 1839 bp, Sorghum bicolor
  misc_feature: Ceres ANNOT ID no. 6038141
  misc_feature: Encodes the peptide sequence at SEQ ID NO 4532
atgtcccccaacctggacagcgccatcaagagccaggtgccggcgctgctcctgaggcgtctcttcggagcgtcccggcgggacgaggccaagcagctccagcggaccccggcgccggcgccggtggggaggcggcgggtgttcgtgcagacggagacaggctgcgtgcttggcatggacctggaccctcgcgctcacgtgcccaccggcgagacctcgctcaccttcggcgatcgcatcctggagaacgacctctccttcatacgcccggactcgccgctgctgctcacccggaacagcatcaaccggagctgctccaccccgtgcctctgccccgtctccaaggacttcgagcacaaggactgcagcggcctggttgagatgctcggctgctccagcagctgcgcccgggtgaagcgcctcgtcgacgacgtggtgactgccatcaggagcggcgtggatccggtctccatcagcagcggccttggtggctcatactacttcaggaacgtcttgggcgacagggttgctattgtgaagccgacggacgaggagccctttgcgccaaacaatcccaaggggttcgtcgggagggcgcttggtcagccgggcctgaagaaatctgtgcgagtgggagagacagggtttagggaggttgctgcgttcctgttggaccatgataactttgccaatgtccctgccacagctctggtgaagataacacactccattttcaacataaattgtccggtaaatggaggaaatctggcaccggctcatgaccagcaacagcaagttaacagcaagattgcttcgttccagcagttcatcgcccatgactttgacgccagcgaccatggcacttcaagcttccctgttgctgctgttcataggatcggcatactcgatatccggattttcaacactgacaggcatgccggcaatgtgctggtgaggaagcttaatggtggcacaggtcgctttggttgccagacagagctgttcccaattgatcatggcatgtgcttgccggagaacttggaggacccttacttcgagtggattcattgggctcaggcgtccattccgttctctgaggaggaactcgagtacatcaggaatcttgatccaacgaaagatgtgcagatgctgcgcagagaacttccaatgatacgtgaggcctgccttcgtgtcctggtcctgtgcacgatcttccttaaggaggctgcagctttcggactctgcttggcagagataggtgagatgatgacaagggagttcagagggatggaggaggaaccaagccagctggaggttgtgtgtatggaggccaggaagagagtagcagagtgggagcccttctctgccacagctgaacatggagaagatactgatttccaattctccatggatgtgttaggagaatacaatgatgtaatgcgatcaccaaggttcagcggcccgggttccaaggggtccagtttcagaagccctttgtctaagctcatcgagagcgttgacgagggcagtgatggccatgaagatcaaatcgagtctgatcgagtcttctatgctggatggaatacacccaacaatcctagcagcagcaaacctataggtcagaatggcattgcttcaaaaagtgccatgaacaggagtgctgatgaacaacttccatcaagtatgtgttttgtcaggctgtcggatatgagtgcagatgagtgggatgtattccttgaaaaattcaaggaactgctgaaagaggcactacacgagagcgcaaggacagcagcaggtcaaaggatgaagcagcgcctgggcacttcatgcaagttttga

SEQ ID NO: 4532 - protein, 612 aa, Sorghum bicolor
  misc_feature: Ceres ANNOT ID no. 6038141
  misc_feature (161)..(426): Pfam Id: PI3_PI4_kinase Pfam Desc: Phosphatidylinositol 3- and 4-kinase
  misc_feature (1)..(612): NCBI GI: 90399241 NCBI Desc: b0811b10.16 [oryza sativa (indica cultivar-group)]
  misc_feature (1)..(612): NCBI GI: 32488384 NCBI Desc: osjnba0043a12.14 [oryza sativa (japonica cultivar-group)]
  misc_feature (1)..(524): NCBI GI: 55297407 NCBI Desc: phosphatidylinositol 3- and 4-kinase family-like [oryza sativa (japonica cultivar-group)]
  misc_feature (1)..(515): NCBI GI: 50726629 NCBI Desc: phosphatidylinositol 3- and 4-kinase family-like [oryza sativa (japonica cultivar-group)]
  misc_feature (1)..(508): NCBI GI: 92894700 NCBI Desc: phosphatidylinositol 3- and 4-kinase, catalytic [medicago truncatula]
  misc_feature: Useful for making plants with altered protein content
  misc_feature: Useful for making plants with modulated biomass
  misc_feature: Useful for making plants with modulated drought sensitivity
  misc_feature: Useful for making plants with modulated heat sensitivity
  misc_feature: Functional homolog of the protein sequence given in SEQ ID NO 13434
  misc_feature: Functional homolog of the protein sequence given in SEQ ID NO 13476
  misc_feature: Functional homolog of the protein sequence given in SEQ ID NO 13479
  misc_feature: Useful for making plants with altered protein content
  misc_feature: Functional homolog of the protein sequence given in SEQ ID NO 13479
MSPNLDSAIKSQVPALLLRRLFGASRRDEAKQLQRTPAPAPVGRRRVFVQTETGCVLGMDLDPRAHVPTGETSLTFGDRILENDLSFIRPDSPLLLTRNSINRSCSTPCLCPVSKDFEHKDCSGLVEMLGCSSSCARVKRLVDDVVTAIRSGVDPVSISSGLGGSYYFRNVLGDRVAIVKPTDEEPFAPNNPKGFVGRALGQPGLKKSVRVGETGFREVAAFLLDHDNFANVPATALVKITHSIFNINCPVNGGNLAPAHDQQQQVNSKIASFQQFIAHDFDASDHGTSSFPVAAVHRIGILDIRIFNTDRHAGNVLVRKLNGGTGRFGCQTELFPIDHGMCLPENLEDPYFEWIHWAQASIPFSEEELEYIRNLDPTKDVQMLRRELPMIREACLRVLVLCTIFLKEAAAFGLCLAEIGEMMTREFRGMEEEPSQLEVVCMEARKRVAEWEPFSATAEHGEDTDFQFSMDVLGEYNDVMRSPRFSGPGSKGSSFRSPLSKLIESVDEGSDGHEDQIESDRVFYAGWNTPNNPSSSKPIGQNGIASKSAMNRSADEQLPSSMCFVRLSDMSADEWDVFLEKFKELLKEALHESARTAAGQRMKQRLGTSCKF

SEQ ID NO: 4533 - DNA, 861 bp, Sorghum bicolor
  misc_feature: Ceres ANNOT ID no. 6038146
  misc_feature: Encodes the peptide sequence at SEQ ID NO 4534
atgtcggccatggcggcgggccgccgcctcctccatctgccggggctcgagctgtgcctgcggtcccgtgcgcttaccctcctctcctcctcgcgggcagatgggatggctcgttactggcgcgagcctccgcgccggaagcttgtgacctgtcggcaaggtgctttcgaagagggaaatgcagtgagggataaggctgtgccgatttcagatgaactgctcggccattgcaaggatgccaatggcagggctctagacctagagcccattggaaagagctctgccaatgagtctgtgcaattgtctttcgaagaggaggagagtgacgacgtggtgtgcgaaattagcgaaagcttggtgcgagatgtggagaaggctgcaattgaattgcttgctgccagagctttcactgtttctgagcttaggaagaaactacgaagtaagaagtatccttttgatacaattgatgctgtaattgctaatttcaagtcaaggggtttgttgaatgatggtttttatgctgaatcattttcgcgatcccggtggctatcatcaacatggggtccaaggcgaataaaacaggcacttcgccaaaagggtgtgccagaggcagaagtagatcaggcaacaagacgagtgttccaggatggccatggccatggaaaagaggcaacgtttggcatatctgaagcttccatggatcatctgtttgctcaggcatccaaacagtggcagcgtgggcaaagcttgaccctggagaatcgccgtgcacgcattgtgaggtggcttcagtaccgaggcttcaactgggctgtgaccaattccatcatcaggaggctggaggctcaacaccctccctga

SEQ ID NO: 4534 - protein, 286 aa, Sorghum bicolor
  misc_feature: Ceres ANNOT ID no. 6038146
  misc_feature (2)..(286): NCBI GI: 115461184 NCBI Desc: os04g0667900 [oryza sativa (japonica cultivar-group)]
  misc_feature (77)..(284): NCBI GI: 21592783 NCBI Desc: contains similarity to regulatory protein recx [arabidopsis thaliana]
  misc_feature (108)..(283): NCBI GI: 83757270 NCBI Desc: regulatory protein recx [salinibacter ruber]
  misc_feature (96)..(209): NCBI GI: 38258531 NCBI Desc: regulatory protein recx
  misc_feature (127)..(278): NCBI GI: 118581578 NCBI Desc: regulatory protein recx [pelobacter propionicus dsm 2379]
MSAMAAGRRLLHLPGLELCLRSRALTLLSSSRADGMARYWREPPRRKLVTCRQGAFEEGNAVRDKAVPISDELLGHCKDANGRALDLEPIGKSSANESVQLSFEEEESDDVVCEISESLVRDVEKAAIELLAARAFTVSELRKKLRSKKYPFDTIDAVIANFKSRGLLNDGFYAESFSRSRWLSSTWGPRRIKQALRQKGVPEAEVDQATRRVFQDGHGHGKEATFGISEASMDHLFAQASKQWQRGQSLTLENRRARIVRWLQYRGFNWAVTNSIIRRLEAQHPP

SEQ ID NO: 4535 - DNA, 429 bp, Sorghum bicolor
  misc_feature: Ceres ANNOT ID no. 6038149
  misc_feature: Encodes the peptide sequence at SEQ ID NO 4536
atggccgccaagaaggtggtgctgaagctggacctgcacgacaacaaggacaagcagaaggtgctcaaggcggtctccactctccacggtatcgactccatctccgtggacatgaaggactcgaagctgacggtggtcgggctggtggatcccgtcgacgtcgtggccaagctgcgcaaggtcggcgccgccgccatcgtctcggtcggcccggccaaggaggagaagaaggacggcgacaagaaagacggcgacaagaaggatggcgacaagaaggacggcgacaagaagacgccgccgccggtcatactgtacccgcaccaccagtggtacccgtacgccgccgcgcagtaccacccccacccgtacccgccgcagtacgtcgtccacagcgccgaggaggaccccaactcctgcgtcatctgctga

SEQ ID NO: 4536 - protein, 142 aa, Sorghum bicolor
  misc_feature: Ceres ANNOT ID no. 6038149
  misc_feature (6)..(73): Pfam Id: HMA Pfam Desc: Heavy-metal-associated domain
  misc_feature (1)..(142): NCBI GI: 32488374 NCBI Desc: osjnba0043a12.4 [oryza sativa (japonica cultivar-group)]
  misc_feature (4)..(141): NCBI GI: 140066203 NCBI Desc: heavy metal transport/detoxification protein [medicago truncatula]
  misc_feature (30)..(142): NCBI GI: 115461178 NCBI Desc: os04g0667600 [oryza sativa (japonica cultivar-group)]
  misc_feature (4)..(118): NCBI GI: 21929737 NCBI Desc: barley stem rust resistance protein [hordeum vulgare subsp. vulgare]
  misc_feature (4)..(118): NCBI GI: 21929727 NCBI Desc: barley stem rust resistance protein [hordeum vulgare subsp. vulgare]
MAAKKVVLKLDLHDNKDKQKVLKAVSTLHGIDSISVDMKDSKLTVVGLVDPVDVVAKLRKVGAAAIVSVGPAKEEKKDGDKKDGDKKDGDKKDGDKKTPPPVILYPHHQWYPYAAAQYHPHPYPPQYVVHSAEEDPNSCVIC

SEQ ID NO: 4537 - DNA, 888 bp, Sorghum bicolor
  misc_feature: Ceres ANNOT ID no. 6038156
  misc_feature: Encodes the peptide sequence at SEQ ID NO 4538
atggaggcgtccgcggaggcgggggcggcggccgccgccgccgcgcgaacgttgaggtgggcgggccgcgcggggcacctgggcggcctcccgcgcgccgcggtgttcgccgccgtgggcgcgttcgccaaggcgtacgcgtcgctgctcaacaccaccacggtccacaacgccgacgcgctcctccgcctcgtctcgtcgcgggctcccgggacgccgctcctcaccgtcagcaaccacatgtccacgttagatgatccgcttatgtggggattcaagggttttccaacttctgatgcaaaacttggaaggtgggtgctgacagcagaagatatatgcttcaagaatgcagtaatgtcctacatgtttcgacttgggaaatgcattccaatcacaagagggggtgggatctatcaagaacacatgaatgaagcccttgacgtacttagaaatggaggctggttgcatacgttccctgaaggaaaaatagtccaagacgatcagccaatcagaagattgaagtggggaactgccagtcttattgtccgagcacctataactccaatagttttgccaattgttcactctggctttgaaaaggtcatgccagaaaaatcattctttggacggcgaccgccagtgccactctgcagtaagaagatagatatcattgttggagagccaatagagtttgacatgccaagtttgaagcaagaagcatcaatggtacctcatgattcatcctctgagcagaaggggtggccacccattacaccagatgggctagacgaggtcgcccagagatggctttaccagaagatgtcagacaaggtccagtctgtgatggagagattgcggaaaacagttatcaacctgaagcagcattga

SEQ ID NO: 4538 - protein, 295 aa, Sorghum bicolor
  misc_feature: Ceres ANNOT ID no. 6038156
  misc_feature (52)..(192): Pfam Id: Acyltransferase Pfam Desc: Acyltransferase
  misc_feature (1)..(295): NCBI GI: 32488671 NCBI Desc: osjnba0087o24.21 [oryza sativa (japonica cultivar-group)]
  misc_feature (16)..(286): NCBI GI: 140066977 NCBI Desc: phospholipid/glycerol acyltransferase [medicago truncatula]
  misc_feature (16)..(286): NCBI GI: 3834324 NCBI Desc: similar to gbx92762 tafazzins protein from homo sapiens. [arabidopsis thaliana]
  misc_feature (1)..(154): NCBI GI: 115461166 NCBI Desc: os04g0667000 [oryza sativa (japonica cultivar-group)]
  misc_feature (30)..(152): NCBI GI: 48527570 NCBI Desc: tafazzin [pan troglodytes]
MEASAEAGAAAAAAARTLRWAGRAGHLGGLPRAAVFAAVGAFAKAYASLLNTTTVHNADALLRLVSSRAPGTPLLTVSNHMSTLDDPLMWGFKGFPTSDAKLGRWVLTAEDICFKNAVMSYMFRLGKCIPITRGGGIYQEHMNEALDVLRNGGWLHTFPEGKIVQDDQPIRRLKWGTASLIVRAPITPIVLPIVHSGFEKVMPEKSFFGRRPPVPLCSKKIDIIVGEPIEFDMPSLKQEASMVPHDSSSEQKGWPPITPDGLDEVAQRWLYQKMSDKVQSVMERLRKTVINLKQH

SEQ ID NO: 4539 - DNA, 543 bp, Sorghum bicolor
  misc_feature: Ceres ANNOT ID no. 6038159
  misc_feature: Encodes the peptide sequence at SEQ ID NO 4540
atgccgccagcccccaagtccggcgacgccctcttcgccagcgtggatcgcgtcaatgccgagctgttcacgctcacgtacggcgccatcgtgcggcagctgctcacggatctggaggaggtcgaggaggtcaacaagggttacaacattggaactcgattggttgatgagttcttagcaaagtcaaatgtatcaaggtgtgttgacttcaaggagactgccgatgttattgcaaagcttggcttcaaaatgttcttgggtgtgactgccactgtgaccaattgggatgcggagggtacaagttgcagccttgtcctggaagacaaccctcttgttgattttgttgagctccctgacacttgccaaggccttcagtattgcaatttgttaagtggagttattaggggggcattagaaatggtgtcaatgaagacagaggtgacatgggtccgtgacatgcttcgtggggatgatgcctatgagatgcgggtgaaacttatcaagcaagtcccggaggaatacccctacaaggatgatgactag

SEQ ID NO: 4540 - protein, 180 aa, Sorghum bicolor
  misc_feature: Ceres ANNOT ID no. 6038159
  misc_feature (22)..(167): Pfam Id: TRAPP_Bet3 Pfam Desc: Transport protein particle (TRAPP) component, Bet3
  misc_feature (17)..(179): NCBI GI: 50417151 NCBI Desc: zgc:101005 protein [danio rerio]
  misc_feature (17)..(175): NCBI GI: 32450223 NCBI Desc: trappc3-prov protein [xenopus laevis]
  misc_feature (17)..(179): NCBI GI: 63146086 NCBI Desc: bet 3 [oxyuranus scutellatus scutellatus]
  misc_feature (17)..(175): NCBI GI: 56605828 NCBI Desc: bet3 homolog [rattus norvegicus]
  misc_feature (17)..(175): NCBI GI: 62901828 NCBI Desc: bet3 [synthetic construct]
MPPAPKSGDALFASVDRVNAELFTLTYGAIVRQLLTDLEEVEEVNKGYNIGTRLVDEFLAKSNVSRCVDFKETADVIAKLGFKMFLGVTATVTNWDAEGTSCSLVLEDNPLVDFVELPDTCQGLQYCNLLSGVIRGALEMVSMKTEVTWVRDMLRGDDAYEMRVKLIKQVPEEYPYKDDD

SEQ ID NO: 4541 - DNA, 528 bp, Sorghum bicolor
  misc_feature: Ceres ANNOT ID no. 6038164
  misc_feature: Encodes the peptide sequence at SEQ ID NO 4542
atgaagcacgctgagaataagctcccgtacccgtcgtcccgcggcgcatcgtcatcgcagccgcccgcgcaccggcggctctcccacgccatcgcgaaggcgccgccgcggaagatcaggatcatccacgtcctggcgccgcacatcatcaagacggaggcccggcacttccgcgagctcgtccagcggctcaccgggaagccaccccagaagggctcctgcgcgttgtcgtcggcctcgtccaccggcggggacgcgtcgccgtcgccgtcgccgtcgccgccgacttcggtctcgtcgtaccacacggcgggcgacgagggcctcggcgccgcggcggggatcgagatgaaggagaaggagcaggaggccgagacgtcgtcgtctccgtcgggtggagaagggggagggttcctgcgcgcgcttgagttggacggctacgacgacggcttctaccagggccagggcctcgacgatttcctcttcagctcctgcgacatggacgccgtggccgattttcatttctga

SEQ ID NO: 4542 - protein, 175 aa, Sorghum bicolor
  misc_feature: Ceres ANNOT ID no. 6038164
  misc_feature (43)..(73): Pfam Id: VQ Pfam Desc: VQ motif
MKHAENKLPYPSSRGASSSQPPAHRRLSHAIAKAPPRKIRIIHVLAPHIIKTEARHFRELVQRLTGKPPQKGSCALSSASSTGGDASPSPSPSPPTSVSSYHTAGDEGLGAAAGIEMKEKEQEAETSSSPSGGEGGGFLRALELDGYDDGFYQGQGLDDFLFSSCDMDAVADFHF

SEQ ID NO: 4543 - DNA, 3273 bp, Sorghum bicolor
  misc_feature: Ceres ANNOT ID no. 6038168
  misc_feature: Encodes the peptide sequence at SEQ ID NO 4544
  misc_feature: Down-regulated in shoot tissues in response to salicylic acid treatment
atgtcaacgaatcctgatgagcctaagagtcgtgcccgaacagactttttgctcaacaatgaatcagaggttcagaagttttgggatgagaacaaggtttttgaggctgatcctggcaatgagcctccaagccccggggaaaaattctttgggaactttccatacccttacatgaatggcttgctgcatctgggccatgccttctcgttgtccaagcttgagttcggtgctgcataccacaggcttcgtggctccaatgtccttttgccctttgctttccactgcactggaatgcccatcaaggcctcagctgataagcttgctagggaaatccaacaatatggatatcctccggtgtttcccgtggcagaggattctggtgctgcagtagcagatgctatccaagccgaccaggctgatgttgttgccccggataagtttaaggggaagaagtccaaggctactgcaaaggctggcgcacaaaagtaccagtgggagatcatgaagagctttggtctggatgatgaagaaattgccaaatttcaagatccttatcactggttgtctcacttccctccattggcaaaggaggttctcaagaaatttggcttgggttgtgactggaggaggtcattcataactactgacatgaatccgtactatgatgcttttgttaagtggcagatgaggaagctgaagaaattgggcaaggttgttaaagacatgaggtacactatctactctccgttggatggccaaccttgtgctgatcatgatagggcaacaggtgaaggtgtgcagccacaagaatacgtcttgattaaaatggaggtgatatcaccttttcctcccaagctgaacgcattggaagggaggaaggtgtatttggcagctgctacactaagacctgagacgatgtatggacagacaaattgctgggtccttcctgatggaatctatggtgcttttgagatcaacgacactgatgtcttcatccttacagccaggtctgctcttaatcttgcataccaacacctatccagggtctctgaaaaaccaacctgcttatgtgagctgtctggcaatgatctgattggtttgccactgaaatctcctcttgccttcaatgaaaccatatatgctcttccaatgctcacggtcttgactgacaaaggtactggcattgtgactagtgttccaagtgattcacctgatgatttcatggcactgcaagatttagtcacaaagccagcattgagaacaaagtatggagtgaaagatgagtgggttcttccttatgagattataccaataatccacattcctgaatttggagacaagtcagcagagaaggtttgccatgatcttaagattaaaagccagaacgacaaggagaagcttgctgaagcaaaaagaatgacatatctgaagggatttactgatggaacaatgattgtaggtgagttcagtggtagaaaggttcaagaagcaaagccgctgattaaaagcaagcttttggaagaaggcacagccgtgttgtatagtgagccggagaagaaggtcatgtctagatctggtgatgaatgtgttgttgccctcactgatcagtggtacataacttatggtgaggctgaatggaagcagaaggcagccaaatgtttggaccgcatgaatacattctcaactgaaacccgtaatggttttgaacacacattgggctggctgaaccagtgggcttgttcgcgttcttttggccttggtactcgaatcccatgggatgagcagttccttgtagaatctctttctgattcaaccctatacatggcttattatacagttgcacattatttgcaaaatggtaatatgtatgggaaagaaatatcttcagtaaggccagaacaaatgacagatgaagtctgggattttgtgttttgtgatggtccagcaccaaaaagtgacatccctgctgctctgttgaataaaatgaagcaggaatttgagtactggtacccgtttgatatccgtgtgtctggtaaagaccttattcaaaaccatctgacattctgcatatataatcatacagcacttcttcctgagcaccattggcctcttggtttccgctgcaatgggcatcttatgcttaattctgaaaaaatgtccaagtcaacagggaatttcttaactcttgaagatgccatcaaaaagtattcttctgatgccactagatttgcccttgctgatgctggtgatggtatggatgacgcaaactttgtcactgacattgcaaattctgctgtgctgaggcttacaaaagaaatttcatggatggaagaggttacagctgctgaatctaaattaagaactgggccgcccactacatatgctgaccgtgtgtttgcaaacgagatgaacattgcaatcgaagaaactgagaagagctatgatgctttcatgttcaaggaggccctgacgtctgggttctatgacctccaatcggccagagatgagtacaggctctcttgtggcgcagcaggcatgaaccgggatctgttgtggcgatttatggatgtccagaccaggcttatcacccccttttgcccacactatgctgagcacgtttggcagaagatcatgaagaaagaaggctttgcaataaaagctggctggccagtcgcagacaccccggatcctacactgagaattgcaaatacatacttgcaggattccatagtttcgttcaggaagctgcttcagaagcaagagtctggtttcaagaaacctaagaagggagctgcaccagcacctccatccgagaaaaaaaagatgagcattggccttatatatgtggacgagcactactctggctggaaagagcagtgcttgagggtgctgcagtctaagttcgacagccaaagtcgctccttcgcacctgataaggaaatagcagaagctctgaaggagtgttccgtcgggcaggaaatgaacttgaagcaagttctgaagctgtgcatgcccttcatcaaggataagaaggacgaggcaagggtggttggtccgcaggcgctggacttgaagcttcccttcagtgagatagatgtactccaggagaacttggagctgatcaagaggcagcttggccttgagcaagtcgaggtgctctcggcgtccaatgaagctgctcgcgctaaggccggtgagcatgcttcgctgctggaggaaagaccaccatcccctggtgtccccatcgccatcttcctcagcagacagagctga

SEQ ID NO: 4544 - protein, 1090 aa, Sorghum bicolor
  misc_feature: Ceres ANNOT ID no. 6038168
  misc_feature (796)..(933): Pfam Id: Anticodon_1 Pfam Desc: Anticodon-binding domain
  misc_feature (23)..(758): Pfam Id: tRNA-synt_1 Pfam Desc: tRNA synthetases class I (I, L, M and V)
  misc_feature (412)..(770): Pfam Id: tRNA-synt_1g Pfam Desc: tRNA synthetases class I (M)
  misc_feature (1)..(1028): NCBI GI: 115479999 NCBI Desc: os09g0503400 [oryza sativa (japonica cultivar-group)]
  misc_feature (7)..(1088): NCBI GI: 2160156 NCBI Desc: strong similarity to s. pombe leucyl-trna synthetase (gbz73100). [arabidopsis thaliana]
  misc_feature (7)..(1090): NCBI GI: 79339972 NCBI Desc: atp binding / leucine-trna ligase/ trna ligase [arabidopsis thaliana]
  misc_feature (13)..(1088): NCBI GI: 124360700 NCBI Desc: aminoacyl-trna synthetase, class ia [medicago truncatula]
  misc_feature (7)..(1056): NCBI GI: 7804450 NCBI Desc: leucyl trna synthetase [homo sapiens]
  misc_feature (7)..(1056): SWISSPROT Homolog: EC 6.1.1.4 Leucyl-tRNA synthetase, cytoplasmic
  misc_feature: Down-regulated in shoot tissues in response to salicylic acid treatment
MSTNPDEPKSRARTDFLLNNESEVQKFWDENKVFEADPGNEPPSPGEKFFGNFPYPYMNGLLHLGHAFSLSKLEFGAAYHRLRGSNVLLPFAFHCTGMPIKASADKLAREIQQYGYPPVFPVAEDSGAAVADAIQADQADVVAPDKFKGKKSKATAKAGAQKYQWEIMKSFGLDDEEIAKFQDPYHWLSHFPPLAKEVLKKFGLGCDWRRSFITTDMNPYYDAFVKWQMRKLKKLGKVVKDMRYTIYSPLDGQPCADHDRATGEGVQPQEYVLIKMEVISPFPPKLNALEGRKVYLAAATLRPETMYGQTNCWVLPDGIYGAFEINDTDVFILTARSALNLAYQHLSRVSEKPTCLCELSGNDLIGLPLKSPLAFNETIYALPMLTVLTDKGTGIVTSVPSDSPDDFMALQDLVTKPALRTKYGVKDEWVLPYEIIPIIHIPEFGDKSAEKVCHDLKIKSQNDKEKLAEAKRMTYLKGFTDGTMIVGEFSGRKVQEAKPLIKSKLLEEGTAVLYSEPEKKVMSRSGDECVVALTDQWYITYGEAEWKQKAAKCLDRMNTFSTETRNGFEHTLGWLNQWACSRSFGLGTRIPWDEQFLVESLSDSTLYMAYYTVAHYLQNGNMYGKEISSVRPEQMTDEVWDFVFCDGPAPKSDIPAALLNKMKQEFEYWYPFDIRVSGKDLIQNHLTFCIYNHTALLPEHHWPLGFRCNGHLMLNSEKMSKSTGNFLTLEDAIKKYSSDATRFALADAGDGMDDANFVTDIANSAVLRLTKEISWMEEVTAAESKLRTGPPTTYADRVFANEMNIAIEETEKSYDAFMFKEALTSGFYDLQSARDEYRLSCGAAGMNRDLLWRFMDVQTRLITPFCPHYAEHVWQKIMKKEGFAIKAGWPVADTPDPTLRIANTYLQDSIVSFRKLLQKQESGFKKPKKGAAPAPPSEKKKMSIGLIYVDEHYSGWKEQCLRVLQSKFDSQSRSFAPDKEIAEALKECSVGQEMNLKQVLKLCMPFIKDKKDEARVVGPQALDLKLPFSEIDVLQENLELIKRQLGLEQVEVLSASNEAARAKAGEHASLLEERPPSPGVPIAIFLSRQS

SEQ ID NO: 4545 - DNA, 1176 bp, Sorghum bicolor
  misc_feature: Ceres ANNOT ID no. 6038170
  misc_feature: Encodes the peptide sequence at SEQ ID NO 4546
atggtgtccgaccaggagatcgcaagctgcgtcgagtccgtcctccgtggctccgccggcgggcccggggaggcctcgctcgccgccgtgttgcagcaggcggaggccacgctcggcgtcgacctctcccacaaggcgggcttcatccgcgaccagatggacctcttcttcggcccgaacctccagccgcagccgccgaccaagccccagccggcgcctcccccgcctcaggccctcgttgcctcctcggccgctgtgccgcagctccagcctcagcatcagcatcaggtcctgccgcaggtgcaggggcagccgcaagcgccgcctccggaccaacagctgcagccacagctcccgcaactccagccgcggctcgtcttccagaccattccgcagctccccgccatggcccccgtccccgcggtttccgcgccgcccgccgtgccggccatggcgttctacccgccgccgccgctcgccttccgctacaccaccggcctcgctggggccgccacgggtggcaccgtctccttccagcagccggcccctggggctggtggcactgctccccccaccgccgctgcaccgcaggtcgcgggcgacaacaaggaaagcgcttctaagcggaagagaggtggacctggtggtttaaataaagtttgtgcaatttcacctgaacttcaaaccattgttggtgagactgccatgtcaagaactcagctctgggcctatatcaggcagaacaatcttcaagatcctgatgacaaaaggaagatcatttgcaatgacgaacttcgcgtggtttttgaaactgacaccaccgacatgtttaaaatgaataaattgttggctaagcacataaccccacttgacccaaaagatcaagtaaaaagaatgaaggctcctaccgtggctcctcaacctggccctcccattaatcagccctccgtagttatttctgacgcactagcaaagttcattggaacagatggaacatttcctcaagatgatgcccagaaatacctgtgggattacataaaagcaaaccaacttgaggatgtcatcaatgaatcaatattatgtgattcaaaacttcaagagctatttggctgtgagagcattcctatgtcaggactatcagaaatgcttggtcaccacttcatcaagaaaacatag

SEQ ID NO: 4546 - protein, 391 aa, Sorghum bicolor
  misc_feature: Ceres ANNOT ID no. 6038170
  misc_feature (217)..(288): Pfam Id: SWIB Pfam Desc: SWIB/MDM2 domain
  misc_feature (314)..(388): Pfam Id: SWIB Pfam Desc: SWIB/MDM2 domain
  misc_feature (3)..(58): Pfam Id: DEK_C Pfam Desc: DEK C terminal domain
  misc_feature (53)..(391): NCBI GI: 32488657 NCBI Desc: osjnba0087o24.7 [oryza sativa (japonica cultivar-group)]
  misc_feature (53)..(391): NCBI GI: 116308843 NCBI Desc: h1005f08.9 [oryza sativa (indica cultivar-group)]
  misc_feature (179)..(390): NCBI GI: 42408131 NCBI Desc: parathymosin-like [oryza sativa (japonica cultivar-group)]
  misc_feature (204)..(291): NCBI GI: 15230276 NCBI Desc: swib complex baf60b domain-containing protein [arabidopsis thaliana]
  misc_feature (204)..(307): NCBI GI: 42562626 NCBI Desc: swib complex baf60b domain-containing protein [arabidopsis thaliana]
  misc_feature: The plant flowers significantly late compared to wild-type.
  misc_feature: The plant is abnormally large.
  misc_feature: Useful for making plants with modulated biomass
  misc_feature: Useful for making plants with modulated flowering time
  misc_feature: Useful for making plants with modulated drought sensitivity
  misc_feature: Functional homolog of the protein sequence given in SEQ ID NO 12918
  misc_feature: Useful for making plants with modulated biomass
  misc_feature: Useful for making plants with modulated drought sensitivity
  misc_feature: Useful for making plants with modulated flowering time
  misc_feature: Functional homolog of the protein sequence given in SEQ ID NO 12918
MVSDQEIASCVESVLRGSAGGPGEASLAAVLQQAEATLGVDLSHKAGFIRDQMDLFFGPNLQPQPPTKPQPAPPPPQALVASSAAVPQLQPQHQHQVLPQVQGQPQAPPPDQQLQPQLPQLQPRLVFQTIPQLPAMAPVPAVSAPPAVPAMAFYPPPPLAFRYTTGLAGAATGGTVSFQQPAPGAGGTAPPTAAAPQVAGDNKESASKRKRGGPGGLNKVCAISPELQTIVGETAMSRTQLWAYIRQNNLQDPDDKRKIICNDELRVVFETDTTDMFKMNKLLAKHITPLDPKDQVKRMKAPTVAPQPGPPINQPSVVISDALAKFIGTDGTFPQDDAQKYLWDYIKANQLEDVINESILCDSKLQELFGCESIPMSGLSEMLGHHFIKKT

SEQ ID NO: 4547 - DNA, 1218 bp, Sorghum bicolor
  misc_feature: Ceres ANNOT ID no. 6038172
  misc_feature: Encodes the peptide sequence at SEQ ID NO 4548
atggcgtcatccgctgccgcctcctcctcggcttccgcgctcgtccgcctcccggggccgggccacctgcgcgcactgccacgaagcgggtggcgagaccacaggcggccccgtcgcgcgatagtgcggtgctcgttcgcgccggtggagacggcgcggataaaggtggtgggcgtcggcggcggcggcaacaacgccgtcaaccgcatgatcggcagcggcctgcagggtattgaattttatgctataaacaccgattcccaagcccttattaattcacaagcgcaatatcctctgcaaattggagagcagttgactcgtggactaggtactggtggaaatccaaatttgggagagcaggctgctgaggaatcaagagaagccatagccactgccctgagggattcagatcttgtcttcataacagctgggatgggagggggtactggatctggtgctgctccagttgttgcccagatatcaaaggaagctggttatcttactgttggtgttgtcacctatccattcagtttcgagggccgtaagcgctctctacaggcattggaagcattagagaagctggaaaagagtgtagacacacttattgtgattccaaacgataaattgttagatgttgctgatgaaaacatgcccttgcaagatgcatttctccttgcagatgacgtcctacgtcagggtgttcaaggaatatcagacattatcacaatacctggactcgtcaatgttgattttgctgatgtaaaagctgtcatgaaaaactctggaactgccatgcttggtgttggtgtttcttccagcaaaaatcgggcccaagaagctgctgaacaggcaacacttgctcctttgataggatcatccattgaggcagctactggtgttgtgtacaatattactggtgggaaggacatcactttgcaagaagtgaacaaggtgtcccagattgtgacaagcctggctgatccttctgcaaacataatttttggtgccgttgttgatgatcgttacactggtgagatacatgtgacaatcattgcgacaggatttccacaatccttccagaaatcccttttggctgatcccaagggagcacgaatagtggaatccaacgagaaagcagcaaacctcgaccataaagcaccaattgctgcagttcaaacggtccctgcttctgcttggtcccgaagactcttctcctga

SEQ ID NO: 4548 - protein, 405 aa, Sorghum bicolor
  misc_feature: Ceres ANNOT ID no. 6038172
  misc_feature (52)..(245): Pfam Id: Tubulin Pfam Desc: Tubulin/FtsZ family, GTPase domain
  misc_feature (247)..(369): Pfam Id: Tubulin_C Pfam Desc: Tubulin/FtsZ family, C-terminal domain
  misc_feature (3)..(405): NCBI GI: 32488656 NCBI Desc: osjnba0087o24.6 [oryza sativa (japonica cultivar-group)]
  misc_feature (3)..(405): NCBI GI: 14495344 NCBI Desc: plastid division protein ftsz [oryza sativa]
  misc_feature (3)..(405): NCBI GI: 116308841 NCBI Desc: h1005f08.7 [oryza sativa (indica cultivar-group)]
  misc_feature (7)..(404): NCBI GI: 8896066 NCBI Desc: ftsz1 [tagetes erecta]
  misc_feature (33)..(404): NCBI GI: 1079732 NCBI Desc: cpftsz
MASSAAASSSASALVRLPGPGHLRALPRSGWRDHRRPRRAIVRCSFAPVETARIKVVGVGGGGNNAVNRMIGSGLQGIEFYAINTDSQALINSQAQYPLQIGEQLTRGLGTGGNPNLGEQAAEESREAIATALRDSDLVFITAGMGGGTGSGAAPVVAQISKEAGYLTVGVVTYPFSFEGRKRSLQALEALEKLEKSVDTLIVIPNDKLLDVADENMPLQDAFLLADDVLRQGVQGISDIITIPGLVNVDFADVKAVMKNSGTAMLGVGVSSSKNRAQEAAEQATLAPLIGSSIEAATGVVYNITGGKDITLQEVNKVSQIVTSLADPSANIIFGAVVDDRYTGEIHVTIIATGFPQSFQKSLLADPKGARIVESNEKAANLDHKAPIAAVQTVPASAWSRRLFS

SEQ ID NO: 4549 - DNA, 264 bp, Sorghum bicolor
  misc_feature: Ceres ANNOT ID no. 6038173
  misc_feature: Encodes the peptide sequence at SEQ ID NO 4550
atggcgacggcacaggcagcgtcggcggcccctacccaccaccgcgcgtctccagggacttcgccgccgcagccgccgtaccccagcgccgccaggattgccgactccgcctgcttcccccagtacaccgcctcgctcaagtgtttggaggccaaccaggacaagagcaagtgccagcagcagttcgacgattacaaggagtgcaagaagaaagagagggaggctcggctcgaacggaataaaacaagatcactctttgggtga

SEQ ID NO: 4550 - protein, 87 aa, Sorghum bicolor
  misc_feature: Ceres ANNOT ID no. 6038173
  misc_feature (31)..(71): Pfam Id: CHCH Pfam Desc: CHCH domain
  misc_feature (16)..(87): NCBI GI: 115461148 NCBI Desc: os04g0665000 [oryza sativa (japonica cultivar-group)]
  misc_feature (38)..(82): NCBI GI: 74609630 NCBI Desc: cytochrome c oxidase-assembly factor cox23, mitochondrial precursor
  misc_feature (38)..(80): NCBI GI: 44981049 NCBI Desc: abr130wp [eremothecium gossypii]
  misc_feature (38)..(80): NCBI GI: 45185360 NCBI Desc: abr130wp [eremothecium gossypii]
  misc_feature (38)..(80): NCBI GI: 74695310 NCBI Desc: cytochrome c oxidase-assembly factor cox23, mitochondrial precursor
MATAQAASAAPTHHRASPGTSPPQPPYPSAARIADSACFPQYTASLKCLEANQDKSKCQQQFDDYKECKKKEREARLERNKTRSLFG

SEQ ID NO: 4551 - DNA, 1800 bp, Sorghum bicolor
  misc_feature: Ceres ANNOT ID no. 6038174
  misc_feature: Encodes the peptide sequence at SEQ ID NO 4552
atggcggggctcccgctgtccgtcgtcgccttccacctgtgcctcctcgcgtcgtcgtcgtcgtcgtctgctcttcggccggcgacaaccgcgagcgagagcgacggcggcggcagccgtgccggcaggaccgcctaccacttccagcccgccaagaactggcagaacgatccgaatgggccgatgtactacaacggcatgtaccatttcttctaccagtacaacccgcacggcgcgctctgggacatcggcaatctctcctggggccactccgtctccggcgacctcgtcaactgggccgcactggacacggcgctggacccgacgtcgcccttcgacgccaacggctgctggtcgggctccgccaccatcctccccggcggcaccccggccatcctctacacgggcatcgacgccagcggggagcaggtgcagaacgtggcgttcccgaggaaccctgccgaccctctcctccgcgagtgggacaagcccagctacaaccccgtcatcccgctccccgccgacgtccccggcgacaagttccgggacccctcgacggcgtggctgggccgcgacgggctgtggcgcatcgtggtgtccgccgaggtccgcggcgtggcgtccacgctcgtgtaccggagcccggacttcctccgctgggagcgcgcggccaccgcgccgctgcacgcctcgcgcgccgcgggtatggtggagtgcccggacctgttcccggtgaaggaggagagcggtggcgacgacgacggtgaagggctcgacgcgtcggcgagcggcgatggggtgcggcacgtgttgaagctcagcgtgatggacacgctccaggactactacatggtggggcggtacgacgccgcggcggacgcgttcgtgccggcggagcccgagcgcggcgacgacgtgcgcgcctggcggcggctggactacggccacgtgtacgcgtccaagtccttcttcgacgcgcgccacagccggcgcgtgctgtgggcgtgggccaacgagtccgacagccaggccgacgacgtcgccaagggctggtccggcgttcagacgttcccgaggaagctgtggctggacgaggacgggaagcagctgcggcagtggccggtggaggagatcgagacgctacggaggaagcgcgtcggcctgcgccgcggaacggtgctgagcgccggaggcatgaacgagatcgtcggcgtcgccgggtcgcaggcggacgtggaggtcgagttcaaggtcccgagcctggctgaggccgaggcgctggacgccaaccggctgctggacccgcagaagctgtgcggggagaagggcgcctcggtgccgggcggcgtcgggccgttcgggctcatcgtgttggcctccggcgacctgcgggagcacaccaccgtcttcttccgggtgttcaggcaccagggcaggtacaggcttctcatgtgcaccgacctaacgaggtcgacgacgagggccggcgtgtacaagccgccatacggaggattcgtggacgtcgacgtagaggagcacgagaccatcaaattgagaaccctgattgatcactcgatgctggagagcttcggagctgaagggcggatctgcatcactgctcgagtgtaccctgagcacgcggagacgagcaacagccacttgttcgtgttcaacaatggcacgggcaaggtggaggtgcccaagctcgaggcatgggagctcgccgcggcgaccgtgaatgctgttggggatgccggcctgatcgtgtctcaatctaaagacgaaagtgaatcctattaa

SEQ ID NO: 4552 - protein, 599 aa, Sorghum bicolor
  misc_feature: Ceres ANNOT ID no. 6038174
  misc_feature (47)..(374): Pfam Id: Glyco_hydro_32N Pfam Desc: Glycosyl hydrolases family 32 N terminal
  misc_feature (416)..(534): Pfam Id: Glyco_hydro_32C Pfam Desc: Glycosyl hydrolases family 32 C terminal
  misc_feature (1)..(596): NCBI GI: 4105125 NCBI Desc: cell wall invertase; beta-fructosidase; incw4 [zea mays]
  misc_feature (3)..(599): NCBI GI: 5052007 NCBI Desc: apoplastic invertase [oryza sativa subsp. indica]
  misc_feature (3)..(588): NCBI GI: 73920073 NCBI Desc: beta-fructofuranosidase, insoluble isoenzyme 7 precursor (sucrose hydrolase 7) (invertase 7) (cell wall beta-fructosidase 7) (oscin7)
  misc_feature (3)..(588): NCBI GI: 50844567 NCBI Desc: cell-wall invertase 7 [oryza sativa (japonica cultivar-group)]
  misc_feature (2)..(582): NCBI GI: 83697983 NCBI Desc: fructan 6-exohydrolase [triticum aestivum]
  misc_feature (3)..(588): SWISSPROT Homolog: EC 3.2.1.26 Beta-fructofuranosidase, insoluble isoenzyme 7 precursor
  misc_feature: Useful for making plants with altered carbohydrate content
  misc_feature: Functional homolog of the protein sequence given in SEQ ID NO 13880
  misc_feature: Useful for making plants with modulated biomass
  misc_feature: Functional homolog of the protein sequence given in SEQ ID NO 13761
MAGLPLSVVAFHLCLLASSSSSSALRPATTASESDGGGSRAGRTAYHFQPAKNWQNDPNGPMYYNGMYHFFYQYNPHGALWDIGNLSWGHSVSGDLVNWAALDTALDPTSPFDANGCWSGSATILPGGTPAILYTGIDASGEQVQNVAFPRNPADPLLREWDKPSYNPVIPLPADVPGDKFRDPSTAWLGRDGLWRIVVSAEVRGVASTLVYRSPDFLRWERAATAPLHASRAAGMVECPDLFPVKEESGGDDDGEGLDASASGDGVRHVLKLSVMDTLQDYYMVGRYDAAADAFVPAEPERGDDVRAWRRLDYGHVYASKSFFDARHSRRVLWAWANESDSQADDVAKGWSGVQTFPRKLWLDEDGKQLRQWPVEEIETLRRKRVGLRRGTVLSAGGMNEIVGVAGSQADVEVEFKVPSLAEAEALDANRLLDPQKLCGEKGASVPGGVGPFGLIVLASGDLREHTTVFFRVFRHQGRYRLLMCTDLTRSTTRAGVYKPPYGGFVDVDVEEHETIKLRTLIDHSMLESFGAEGRICITARVYPEHAETSNSHLFVFNNGTGKVEVPKLEAWELAAATVNAVGDAGLIVSQSKDESESY

SEQ ID NO: 4553 - DNA, 1641 bp, Sorghum bicolor
  misc_feature: Ceres ANNOT ID no. 6038180
  misc_feature: Encodes the peptide sequence at SEQ ID NO 4554
atgggcgcgtcctcctcgaccggcaacccgtccccagaggcgcacgagcagcgggagcaggagaccctcgcctccgccgccctctccctcccgctcctccgcgttgccttctcccgctccgccgccgccgccaacgccaacgcgctgccggatgccctcgccccgccgcccgcctcctaccgtctgcccggatccccgccgctgccgccgcacttccacggcatcctctcggggctcggtccgaccatcgcctcccagttcttcggccacggagctgccgcgacgccggagggggacgccgggtgggtccctttcctcagggggttcaaccgctgctgcgcgcgcgtgccggcctcccgctcgctcgcgctgctcctccgcgtgtacgccgccgcctgcgccggcgcgggggcaccgtgcggcgtcctgctccagccggacgagggcggtgacgaggacgggaaggtcgttggggagctcacgccggaggagatcgcggtgttcctctggatgtgctgggtcatggcgtggagcgcttcggcctcgagggtggccggtgatggaggggaaaagtcggagcccgtcgcggtgctgctcccggacgtgacgcacctggtgctatcggcgctcgtctcggccggcgccgtcgcggatgacgcgggcgtttggggctgggacatctccagcggtgggaaggggctgaaggtccaggagttcacgtcgtgggtgctgtccacgcctgtcggccttgggaactgcctctcgcgctatgtgcgggacagattccgcgcgctggctgctgactctgtggaggagagctctgtttcaactgttaacacaacctttgatacctctgatgtttatctgctaacacggggaagagcatgggcaatcgctctcagcctaagaaacaagttgagtgaaaagctgttgtcagcttctgtaattggaatggacacagaagaccttctttataggtcatctgttcatgggaaaggactgagccggttctggtcttgtgttgaggggtacaaagggccaatgctgattctactttcagcattctcaaagagtgctggtgagaatgttgattctgatcgaagatgggtgattggtgtattgaccgaggaaggatttgagagcaaagataccttttatggtagctctggattcctttgtgctgcacatccaatattccgcatgctaccaccatctggtaaggagaagaacttcatgtactgccacctacatcctcagataagagcttatgaagcaaatccaaagcctgttggattagcatttggtggaacaattgggaatgagaggatctttcttgatgaagacttctcaagagttttggttcgacaccatgctgttgataaaacttatcaacatggttctctcatccccaatcagggttatttacctgttgaggcttcagtacttgatgttgaagtatgggggctgggtggggaaacaataaaaagacagcagaatttgtacaagaagagggaggacattttctcagagcagcgaagaaaggttgatctcaaaacttttgctagctgggaagattctccagagaaaatgatgatggacatgatgtctgacccaaacacggttcgacgagaagatcggtga

SEQ ID NO: 4554 - protein, 546 aa, Sorghum bicolor
  misc_feature: Ceres ANNOT ID no. 6038180
  misc_feature (323)..(490): Pfam Id: TLD Pfam Desc: TLD
  misc_feature (1)..(546): NCBI GI: 38346079 NCBI Desc: osjnba0084k01.19 [oryza sativa (japonica cultivar-group)]
  misc_feature (1)..(546): NCBI GI: 116309857 NCBI Desc: osigba0099l20.7 [oryza sativa (indica cultivar-group)]
  misc_feature (1)..(546): NCBI GI: 29028740 NCBI Desc: at5g39590/mij24_60 [arabidopsis thaliana]
  misc_feature (1)..(546): NCBI GI: 92875989 NCBI Desc: tldc [medicago truncatula]
  misc_feature (75)..(546): NCBI GI: 144924091 NCBI Desc: tldc [medicago truncatula]
MGASSSTGNPSPEAHEQREQETLASAALSLPLLRVAFSRSAAAANANALPDALAPPPASYRLPGSPPLPPHFHGILSGLGPTIASQFFGHGAAATPEGDAGWVPFLRGFNRCCARVPASRSLALLLRVYAAACAGAGAPCGVLLQPDEGGDEDGKVVGELTPEEIAVFLWMCWVMAWSASASRVAGDGGEKSEPVAVLLPDVTHLVLSALVSAGAVADDAGVWGWDISSGGKGLKVQEFTSWVLSTPVGLGNCLSRYVRDRFRALAADSVEESSVSTVNTTFDTSDVYLLTRGRAWAIALSLRNKLSEKLLSASVIGMDTEDLLYRSSVHGKGLSRFWSCVEGYKGPMLILLSAFSKSAGENVDSDRRWVIGVLTEEGFESKDTFYGSSGFLCAAHPIFRMLPPSGKEKNFMYCHLHPQIRAYEANPKPVGLAFGGTIGNERIFLDEDFSRVLVRHHAVDKTYQHGSLIPNQGYLPVEASVLDVEVWGLGGETIKRQQNLYKKREDIFSEQRRKVDLKTFASWEDSPEKMMMDMMSDPNTVRREDR

SEQ ID NO: 4555 - DNA, 1296 bp, Sorghum bicolor
  misc_feature: Ceres ANNOT ID no. 6038185
  misc_feature: Encodes the peptide sequence at SEQ ID NO 4556
atggtaaggctttttctttcggaggattccccttctcaagctggattaagaccgcaggacaatctccaagcaaaaggctcatggttaatgcatgcagctggcccaagctcagatgattcgctgccacctggcttcgaatcgttgcagccaaccagcgatctcaaaattgacatatcccaaatccctcttattaggtggagatgcccaccacagatattgtataatcctgattggcttgttgttgctggggaagaaagtgaggaggttgccttgcagaatgagaggatatttggagcacttgaggctatatatccgcggccatcgaacattcctccaaacccattggttactcctgatgtgaaagactcccaatttgatgattcccgaacccagttggttccgttgatcccagttgaagaggatgatgcctctgaccagttggaagaaccacctgttggtctaccaagtagtcaccaccagtcagataagtatgactccgcaatattcagggcaccaccagcctcagatgctccctttacacagccgaatggttccatcaatgcaacaaggtctggtgcccccgttgagccggatgcagtggctgctgcatctgccgcttacactgcaattatgcaaagcaaccaaatgggaaacatgattgaccaagatctgcttatcaaaatattaagtgaccctgcccaaattgagaggttgatgaaagaatatggtgcgcttaaacatgaacagtcaaccaacagttctgtcgtcccaatggtgcaaggtccaccgccccagatgacagccagtgttcctgtctccttcccagatcatagcactacatttcacaatgtaaaccctacactgccacctccacctgttttgaatcatctacctccagctattccttcaggtaccatgaatgccccagcaagttcaagtcaagcaattagttttccaagtggcccagccaggggtttgaactattaccagtccctgatccatcagcatggaggggagaggcaggagccacttcaacagcatggaaggcagtttgcaatgcatcaccagcctgttgcgtcacaggctagtgccactgatattgtcagtagtggtactatggcagctagggataataagcaaaggcctacgaagccttgtgcttactttaacagcgcaagaggatgccggaacggtgcgaactgcacgtttctgcatgatatgtctgccgcaaggaaagaacagccgaagggatccaaaaggattaagctagacagcagaatagccgggcggtattga

SEQ ID NO: 4556 - protein, 431 aa, Sorghum bicolor
  misc_feature: Ceres ANNOT ID no. 6038185
  misc_feature (58)..(422): NCBI GI: 115461124 NCBI Desc: os04g0663200 [oryza sativa (japonica cultivar-group)]
  misc_feature (2)..(152): NCBI GI: 92873156 NCBI Desc: zinc finger, ccch-type [medicago truncatula]
  misc_feature (2)..(324): NCBI GI: 23308223 NCBI Desc: at3g51180/f24m12_220 [arabidopsis thaliana]
  misc_feature (64)..(382): NCBI GI: 5805319 NCBI Desc: flowering-time protein isoform alpha [zea mays]
  misc_feature (64)..(405): NCBI GI: 47086891 NCBI Desc: protein phosphatase 1, regulatory subunit 10 [danio rerio]
MVRLFLSEDSPSQAGLRPQDNLQAKGSWLMHAAGPSSDDSLPPGFESLQPTSDLKIDISQIPLIRWRCPPQILYNPDWLVVAGEESEEVALQNERIFGALEAIYPRPSNIPPNPLVTPDVKDSQFDDSRTQLVPLIPVEEDDASDQLEEPPVGLPSSHHQSDKYDSAIFRAPPASDAPFTQPNGSINATRSGAPVEPDAVAAASAAYTAIMQSNQMGNMIDQDLLIKILSDPAQIERLMKEYGALKHEQSTNSSVVPMVQGPPPQMTASVPVSFPDHSTTFHNVNPTLPPPPVLNHLPPAIPSGTMNAPASSSQAISFPSGPARGLNYYQSLIHQHGGERQEPLQQHGRQFAMHHQPVASQASATDIVSSGTMAARDNKQRPTKPCAYFNSARGCRNGANCTFLHDMSAARKEQPKGSKRIKLDSRIAGRY

SEQ ID NO: 4557 - DNA, 1641 bp, Sorghum bicolor
  misc_feature: Ceres ANNOT ID no. 6038189
  misc_feature: Encodes the peptide sequence at SEQ ID NO 4558
atgtcggcaagcgccgagcccgagaaggacgccgcggccgcggccgccgccgagggcgacgagaagacggaggcgaagggcaccggctccggctgggagctgctgtactgcggcgggacgagcttcgacgccatgggccggaaggtggtaggcggggcgcagggcaacctggtgtcgccgacgcggctgcggccgctcgtgggcgttgatatccgcttcgtcgcctctggatgcactgcttgccactgtgttgctttagatgctgaaggcaaatgttatacatggggtcgcaatgagcagaagggacagctaggacatggagatactcttctacgtaacctgccgactgttgtttctcaactatcaaaatacaaaatcatcaaagcaagtgttggaagaaaccatacagtcgttgtaactgatgatgggaaatccttctctttcggccataacaagcatggacagctagggacagagattgagtcatcgccagtgtcctgtattgttgcggaagcaaccaacgttgtctgtggggctgattttactgtctggttgtcatctgtggaaggctcttctatacttacagcaggccttccccaatacggtcaacttgggcatggaactgataatgagtacaatgctaaagaatcgtctgtcaggctgacctatgatccccagccccgcccaagagcaatagctgcattttctgggaaaactgttgttaaagttgcatgtggaactaaccatacagttgattccagtggctttgtttacacctggggttttggtggatatggaaggttggggcatagagaacagaaggatgaatggcaacctcgcattgtagaagttttccagaagcacaatgttctgcctcctaatgctattgtctcagctggttctgcaagttctgcatgcactgctggtggtggtcagttgtatatgtggggaaagatgaagaatacaggcgatgattggatgtacccaaaacctgtgatggatttaagtggttggaacattcgctgcatggcttctggtaacatgcaccatgttgttggtgctgatgattcttgcataagctggggtgtcgcccagaatggagagcttggttatgggcctaacggtcagaaatcatcagcaaatcccaaaaaggttgacattcttgagggcatgcatgttacaagtgttggctgtggatttggactgtctctgattgttgtggacagagcaaatgttggtgatcgacttgatcagctggaaatttatgatggcgatacctctcctgaagtagagaaggtggaggtgcaagtaaccaagaaggcttctgccagcaccaattcacgtgccaacaagcgcaagaaaactaaggatgtttctgaatctgaatctgaagaggatgatgatgatgatgatgaaagtggagatgatgaaaatggtgatatagaagagccaaagggtaggcgtggccgcaaaccctctagagggagaggcaggggagccaaaaaggcaacccctgaggcaaagccatctggaaggggcagaggccgccctaagaaaaccgagagtcctgctcagaaagctggaacctcaggcagccgtggtggaaagagaggaggaaaaagaggacgaccacgtaagtga

SEQ ID NO: 4558 - protein, 546 aa, Sorghum bicolor
  misc_feature: Ceres ANNOT ID no. 6038189
  misc_feature (89)..(139): Pfam Id: RCC1 Pfam Desc: Regulator of chromosome condensation (RCC1)
  misc_feature (1)..(546): NCBI GI: 115461118 NCBI Desc: os04g0662800 [oryza sativa (japonica cultivar-group)]
  misc_feature (14)..(546): NCBI GI: 30686578 NCBI Desc: regulator of chromosome condensation (rcc1) family protein [arabidopsis thaliana]
  misc_feature (12)..(406): NCBI GI: 37360404 NCBI Desc: mkiaa1470 protein [mus musculus]
  misc_feature (21)..(406): NCBI GI: 7959201 NCBI Desc: kiaa1470 protein [homo sapiens]
  misc_feature (21)..(406): NCBI GI: 119615244 NCBI Desc: regulator of chromosome condensation 2, isoform cra_a [homo sapiens]
MSASAEPEKDAAAAAAAEGDEKTEAKGTGSGWELLYCGGTSFDAMGRKVVGGAQGNLVSPTRLRPLVGVDIRFVASGCTACHCVALDAEGKCYTWGRNEQKGQLGHGDTLLRNLPTVVSQLSKYKIIKASVGRNHTVVVTDDGKSFSFGHNKHGQLGTEIESSPVSCIVAEATNVVCGADFTVWLSSVEGSSILTAGLPQYGQLGHGTDNEYNAKESSVRLTYDPQPRPRAIAAFSGKTVVKVACGTNHTVDSSGFVYTWGFGGYGRLGHREQKDEWQPRIVEVFQKHNVLPPNAIVSAGSASSACTAGGGQLYMWGKMKNTGDDWMYPKPVMDLSGWNIRCMASGNMHHVVGADDSCISWGVAQNGELGYGPNGQKSSANPKKVDILEGMHVTSVGCGFGLSLIVVDRANVGDRLDQLEIYDGDTSPEVEKVEVQVTKKASASTNSRANKRKKTKDVSESESEEDDDDDDESGDDENGDIEEPKGRRGRKPSRGRGRGAKKATPEAKPSGRGRGRPKKTESPAQKAGTSGSRGGKRGGKRGRPRK

SEQ ID NO: 4559 - DNA, 546 bp, Sorghum bicolor
  misc_feature: Ceres ANNOT ID no. 6038218
  misc_feature: Encodes the peptide sequence at SEQ ID NO 4560
atgaggaagctcgcgttccacgagcggaagcggctcaagagggtcaacttgctggactacgacaagggcaaggggcgccgcgagggccgcgtgacgcagcgctaccacatcgtcgagagggacgactacaccaagtacaatgggatatgcctgatggtgcagaagcaagtgagcattatcaggcagatggacccgcgggaccctttcaggatccagatgacggacatgctgctcgataagtataatatgggtgtaatttcgataaaagagagcttggtaaaatgtgagaaactttcagcgagctccttctgcagacgaagactagcaacagttatgacgaggatcaagatggcagagcacctcaaagaggccgtgacatacattgaacagggccatgtgcgtgttggccctgaggtcgtcaccgatccagcctttcttgtaaccaggaacatggaggacttcatcacctgggtggattcctcaaagatcaagaaaaaagtcatggagtacaatgatgcattggatgattatgatgccatgggttga

SEQ ID NO: 4560 - protein, 181 aa, Sorghum bicolor
  misc_feature: Ceres ANNOT ID no. 6038218
  misc_feature (106)..(153): Pfam Id: S4 Pfam Desc: S4 domain
  misc_feature (1)..(180): NCBI GI: 38346067 NCBI Desc: osjnba0084k01.7 [oryza sativa (japonica cultivar-group)]
  misc_feature (1)..(180): NCBI GI: 51968508 NCBI Desc: ribosomal protein-like [arabidopsis thaliana]
  misc_feature (1)..(180): NCBI GI: 21554411 NCBI Desc: ribosomal protein-like [arabidopsis thaliana]
  misc_feature (1)..(180): NCBI GI: 9755620 NCBI Desc: ribosomal protein-like [arabidopsis thaliana]
  misc_feature (1)..(178): NCBI GI: 49250357 NCBI Desc: mgc69249 protein [xenopus tropicalis]
MRKLAFHERKRLKRVNLLDYDKGKGRREGRVTQRYHIVERDDYTKYNGICLMVQKQVSIIRQMDPRDPFRIQMTDMLLDKYNMGVISIKESLVKCEKLSASSFCRRRLATVMTRIKMAEHLKEAVTYIEQGHVRVGPEVVTDPAFLVTRNMEDFITWVDSSKIKKKVMEYNDALDDYDAMG

SEQ ID NO: 4561 - DNA, 519 bp, Sorghum bicolor
  misc_feature: Ceres ANNOT ID no. 6038221
  misc_feature: Encodes the peptide sequence at SEQ ID NO 4562
atggccacatcatcatcgtatcctccacctcctccattttaccgattgtacaagaattttgagcaagatgcctcatccgcaccagaaccaccaccaccaattgatggaccattcaaagccttgggtgttgattacacaggagatgttgtgattccaagcttggagagtcataatgttcgtcagctttatccaaagggccccaatattgacttcaaaaaggagctaaggaccctcaacagagagcttcaattgcatattttggagctggcagatattttagttgagagaccatctcaatatgctcgtagggtagaagatattacactcatattcaagaacttacatcatcttctcaattccctacgacctcatcaggcaagggccacattgattcacatgcttgagagccaaattcagcaccgcaagcaagcaattgaagatataaagcagaggagagaggaagcacaaaaactgcttggggaatcactgcatatcttggatggaagccaaactaattaa

SEQ ID NO: 4562 - protein, 172 aa, Sorghum bicolor
  misc_feature: Ceres ANNOT ID no. 6038221
  misc_feature (2)..(167): Pfam Id: MED7 Pfam Desc: MED7 protein
  misc_feature (1)..(170): NCBI GI: 32489035 NCBI Desc: osjnba0084k01.4 [oryza sativa (japonica cultivar-group)]
  misc_feature (1)..(168): NCBI GI: 21618057 NCBI Desc: transcription co-activator-like protein [arabidopsis thaliana]
  misc_feature (1)..(168): NCBI GI: 20453355 NCBI Desc: at5g03505/c320epl23m [arabidopsis thaliana]
  misc_feature (5)..(163): NCBI GI: 60653613 NCBI Desc: cofactor required for sp1 transcriptional activation subunit 9 33kda [synthetic construct]
  misc_feature (5)..(163): NCBI GI: 61361434 NCBI Desc: cofactor required for sp1 transcriptional activation subunit 9 [synthetic construct]
MATSSSYPPPPPFYRLYKNFEQDASSAPEPPPPIDGPFKALGVDYTGDVVIPSLESHNVRQLYPKGPNIDFKKELRTLNRELQLHILELADILVERPSQYARRVEDITLIFKNLHHLLNSLRPHQARATLIHMLESQIQHRKQAIEDIKQRREEAQKLLGESLHILDGSQTN

SEQ ID NO: 4563 - DNA, 1983 bp, Sorghum bicolor
  misc_feature: Ceres ANNOT ID no. 6038223
  misc_feature: Encodes the peptide sequence at SEQ ID NO 4564
atgctgcaggtggaggaggcgctggcggcggtgctgtccgcggcggcaggccacgcggcgccgcgtgccgtaccgctgcacgacgcgctggggctcgtcctcgcggaggacgtccgcgcccccgacccgctccctcccttccgcgcctccatcaaggacgggtacgccgtcgtggcctccgacgggccaggggagtacccggtggtcacggagtcgagggcgggcgacgacgccctcggcgtggtcgtcgctcctggtacggtcgcctacgtcaccaccggagggccgattcccgatggcgccgacgccgtcgtgcaggtggaggacaccgagcaggtcaccagcggagcggatggggccaagagggttaggattctggcgcgggccgccgaggggcaggacatccgcaatgtgggatgtgacatagagaaggattcattagtactcaactctggcgagcatataggtcccgcagaaattgggctgcttgcaacagtgggtgtaaccactgtcaaggtgtaccctcgaccaaccatcgctatattctccacaggggatgagctagtgcagccagccactgccaccctcagtcgtggtcagattcgtgattccaatcgagccatgcttctagctgctgctattcagcagaaatgcaaagtggttgacctgggtattgcagaagacactgaagaaagtctcaaggagcatatggatgcagctttgcgttctgatgctgatataatcattacttctggtggtgtttccatgggcgacagagatcttgtcaaaccttgcctggcaaagatgggtaaaattcactttgagaagatccagatgaaaccaggaaagccattaacatttgctgagatcaccacacaagacacgtcaaagccatctaaaacagttcttgcatttggtttgcctggaaatccagtgagctgtatggtttgcttcaatctttttgttgttcctgcaattcgtctcctctctggctggtcaaatcctaatctgcaaagggtgcatgtacgcctatcacatcctttaagagcagactcacatcgtacagagtttcaccgtgcagtaattagatgggtgcttgatgatggatctggtcgacctggttttgttgctgagagcactggccatcaggctagtagccgcctccttagtatgaaatctgctaatgctctgctagaagtaccatccactggacaaatattggcagctgggacatctatccaagccatacttatttcagacataataacttctcctttagataaactgcctgctccctcaaatccgcatccatcacattttggtccttctgcaaaaagtatttccacagatgtatctcagattgcatctccacaggatgctgaagttaaagttgcaattctgactgtaagtgacactgtttcatcaggtgctggccctgataggagtggcccaagagctgtatctattgtgaattcttcatcagagaaactgggtggtgcaactgtggttgccacttcagttgttcctgatgaagtggacaagatcaagggcattctgatacaatggagtgatattgaccatgttaacctcattctgacattaggtgggactggcttcacacccagggatgtcacaccagaagcaacaaaatctgtgatacagaaagaagcgcctggtctgacatttgttatgcttcaagaaagtttgaagattacaccattcgcaatgctatcccgggctacagctggaatcagaggatcgacactaatcatcaacatgcctggcaacccaaatgctgtggcagagtgcatggaagcacttctcccggcactcaagcacgccctgaagcagatcaagggtgacaagagggagaagcaccctcgccataccccacacgccgcagcagcacctgtggaccagtgggagcggagcttcagagccgcatcagctggtagtggcagggggtgctcgtgtgatccctga

SEQ ID NO: 4564 - protein, 660 aa, Sorghum bicolor
  misc_feature: Ceres ANNOT ID no. 6038223
  misc_feature (180)..(328): Pfam Id: MoCF_biosynth Pfam Desc: Probable molybdopterin binding domain
  misc_feature (465)..(613): Pfam Id: MoCF_biosynth Pfam Desc: Probable molybdopterin binding domain
  misc_feature (1)..(167): Pfam Id: MoeA_N Pfam Desc: MoeA N-terminal region (domain I and II)
  misc_feature (341)..(419): Pfam Id: MoeA_C Pfam Desc: MoeA C-terminal region (domain IV)
  misc_feature (1)..(660): NCBI GI: 78192233 NCBI Desc: molybdenum cofactor biosynthesis protein [zea mays]
  misc_feature (1)..(660): NCBI GI: 32489033 NCBI Desc: osjnba0084k01.2 [oryza sativa (japonica cultivar-group)]
  misc_feature (1)..(660): NCBI GI: 116310045 NCBI Desc: h0112g12.13 [oryza sativa (indica cultivar-group)]
  misc_feature (1)..(660): NCBI GI: 8118717 NCBI Desc: molybdenum cofactor biosynthesis protein cnx1 [hordeum vulgare]
  misc_feature (1)..(658): NCBI GI: 15242124 NCBI Desc: molybdopterin biosynthesis cnx1 protein / molybdenum cofactor biosynthesis enzyme cnx1 (cnx1) [arabidopsis thaliana]
  misc_feature: The sequence is a functional homolog of SEQ ID NO. 410 in the 11/188,298 US application
MLQVEEALAAVLSAAAGHAAPRAVPLHDALGLVLAEDVRAPDPLPPFRASIKDGYAVVASDGPGEYPVVTESRAGDDALGVVVAPGTVAYVTTGGPIPDGADAVVQVEDTEQVTSGADGAKRVRILARAAEGQDIRNVGCDIEKDSLVLNSGEHIGPAEIGLLATVGVTTVKVYPRPTIAIFSTGDELVQPATATLSRGQIRDSNRAMLLAAAIQQKCKVVDLGIAEDTEESLKEHMDAALRSDADIIITSGGVSMGDRDLVKPCLAKMGKIHFEKIQMKPGKPLTFAEITTQDTSKPSKTVLAFGLPGNPVSCMVCFNLFVVPAIRLLSGWSNPNLQRVHVRLSHPLRADSHRTEFHRAVIRWVLDDGSGRPGFVAESTGHQASSRLLSMKSANALLEVPSTGQILAAGTSIQAILISDIITSPLDKLPAPSNPHPSHFGPSAKSISTDVSQIASPQDAEVKVAILTVSDTVSSGAGPDRSGPRAVSIVNSSSEKLGGATVVATSVVPDEVDKIKGILIQWSDIDHVNLILTLGGTGFTPRDVTPEATKSVIQKEAPGLTFVMLQESLKITPFAMLSRATAGIRGSTLIINMPGNPNAVAECMEALLPALKHALKQIKGDKREKHPRHTPHAAAAPVDQWERSFRAASAGSGRGCSCDP

SEQ ID NO: 4565 - DNA, 408 bp, Sorghum bicolor
  misc_feature: Ceres ANNOT ID no. 6038227
  misc_feature: Encodes the peptide sequence at SEQ ID NO 4566
atgtcgaaggtgacggtgctcaaggtggacacctcctgcgccaaatgcaagcgcaaggtcctgcaggccgtcaccggcctccacggtgttgacaaggtcgaggtggactcggagaagagcacgatgacggtgacgggcaccgtggacccggtggacgtgatcgtgcaggcgaggaaggccgggaggcgcgcgtccgtgctcaccatcggcccgccgcccaagccggccgaggagaagaagcccgccgccgagcaggataagaagaagacggcggcggacgcggagaagaaggcgctggagacgccggccacggtgttcgtccaccacgtcccgtcgtggccttcgtgtcccaggtaccaggagagagtggtgtacgagcaggaccccccgccttgctccatcatgtaa

SEQ ID NO: 4566 - protein, 135 aa, Sorghum bicolor
  misc_feature: Ceres ANNOT ID no. 6038227
  misc_feature (6)..(66): Pfam Id: HMA Pfam Desc: Heavy-metal-associated domain
  misc_feature (1)..(120): NCBI GI: 116310040 NCBI Desc: h0112g12.8 [oryza sativa (indica cultivar-group)]
  misc_feature (1)..(120): NCBI GI: 32488323 NCBI Desc: osjnba0015k02.17 [oryza sativa (japonica cultivar-group)]
  misc_feature (1)..(96): NCBI GI: 140048981 NCBI Desc: heavy metal transport/detoxification protein [medicago truncatula]
  misc_feature (3)..(134): NCBI GI: 32488374 NCBI Desc: osjnba0043a12.4 [oryza sativa (japonica cultivar-group)]
  misc_feature (1)..(135): NCBI GI: 140066203 NCBI Desc: heavy metal transport/detoxification protein [medicago truncatula]
MSKVTVLKVDTSCAKCKRKVLQAVTGLHGVDKVEVDSEKSTMTVTGTVDPVDVIVQARKAGRRASVLTIGPPPKPAEEKKPAAEQDKKKTAADAEKKALETPATVFVHHVPSWPSCPRYQERVVYEQDPPPCSIM

SEQ ID NO: 4567 - DNA, 1101 bp, Sorghum bicolor
  misc_feature: Ceres ANNOT ID no. 6038240
  misc_feature: Encodes the peptide sequence at SEQ ID NO 4568
atgaagctcgtccaccgcaacctcgtccgcaacgggcctggctccgtcaagttggtgccggaggaagaggacgacttgtggcacgcgtacaacctcattgctgtcggtgacaacctccaggccgtcaccgttcggaaagtgctgagagaggtggcatctggaggacgtgatgccgagcgtgtgaagcttaagttagaaattgtagttgagtctgtagactatgacaaggagggatctgtcttacgtgtgcgtggaaaaaatatcactgagaatgatcatgtgaagattggccagttccacacattagagcttgagctgaaaagaccttttgttctacgaaaggaaatttgggattggttggcacttgagaccatccagcaagcatgtgatcctgctgcaagtgctgatctagcagttattctcatgcaagaaggacttgcccacttattcctcattggcagaagcataacagcaacccgggcacgtattgaaacatcaattccgaggaagcatggccctgcaattgctggctacgagacggccctcaagaagttctttgagcatgttttgcaagcattgctgaaacacattgattttgaagtagtccagtgtgttgtaattgcaagcccaggttttacgaaggatcagttccgtgattatttgtttcttgaagctgcacggcgagatttaagagtaataattgagaacaagcaacgccttgttctggcacatgcaacatcaggttacaagcatagtttgaaggaagttttggatacccctggtgtgatggcactgataaaagatacaaaagcagcacaagaggacccagctcgtgcttgttatggaccaaagcatgttgagattgcacatgaacaatatgctgctgtccagactcttttaataactgatactttgtttcggaacactgacattgctacgaggcaaaagtatgtgaacttggttgaaaatgtcaagaaaagtaatagcacagtgcacatattttcctcaatgcatgtctccggcgaacagttagcgcaactgacaggaatagcagctatacttcgttttccccttcctcaactagaggacatcgagatgtga

SEQ ID NO: 4568 - protein, 366 aa, Sorghum bicolor
  misc_feature: Ceres ANNOT ID no. 6038240
  misc_feature (1)..(131): Pfam Id: eRF1_1 Pfam Desc: eRF1 domain 1
  misc_feature (136)..(268): Pfam Id: eRF1_2 Pfam Desc: eRF1 domain 2
  misc_feature (265)..(358): Pfam Id: eRF1_3 Pfam Desc: eRF1 domain 3
  misc_feature (1)..(366): NCBI GI: 38346417 NCBI Desc: osjnba0011f23.23 [oryza sativa (japonica cultivar-group)]
  misc_feature (59)..(366): NCBI GI: 6735351 NCBI Desc: pelota-like protein [arabidopsis thaliana]
  misc_feature (1)..(363): NCBI GI: 973224 NCBI Desc: pelota
  misc_feature (1)..(363): NCBI GI: 17136914 NCBI Desc: cg3959-pa [drosophila melanogaster]
  misc_feature (1)..(363): NCBI GI: 54644689 NCBI Desc: ga17805-pa [drosophila pseudoobscura]
MKLVHRNLVRNGPGSVKLVPEEEDDLWHAYNLIAVGDNLQAVTVRKVLREVASGGRDAERVKLKLEIVVESVDYDKEGSVLRVRGKNITENDHVKIGQFHTLELELKRPFVLRKEIWDWLALETIQQACDPAASADLAVILMQEGLAHLFLIGRSITATRARIETSIPRKHGPAIAGYETALKKFFEHVLQALLKHIDFEVVQCVVIASPGFTKDQFRDYLFLEAARRDLRVIIENKQRLVLAHATSGYKHSLKEVLDTPGVMALIKDTKAAQEDPARACYGPKHVEIAHEQYAAVQTLLITDTLFRNTDIATRQKYVNLVENVKKSNSTVHIFSSMHVSGEQLAQLTGIAAILRFPLPQLEDIEM

SEQ ID NO: 4569 - DNA, 1101 bp, Sorghum bicolor
  misc_feature: Ceres ANNOT ID no. 6038242
  misc_feature: Encodes the peptide sequence at SEQ ID NO 4570
atgctgtcctcctccccggcgccgccacgagagggcgccgccgttccctcctcctgggcggaagccgcgtccgcggcggcgctccggcactaccgctccctggccaagaaagggaagccgcaggggcgagagtccacggtcctcgccgccttcctcctctccactccgcatgacccgcgcagcctcactgtcctctccatgggcaccggcaccaagtgcctcggtgcctcgatgctcagcgaccgcggggacctcgtccacgacgcgcacgccgaggtcatcgctcgccgcgcgctgctccgcctcgtctactctgagatcggccgcggcgccccgcctgattggctggttgcttccggggatggtggagtcatggcagtaccactgtcacagtccgagttaccacgggaacagctggatagtgtgaatggagatattagctttgttcagaggaagccagggcggggtgatacaacattgtccatgagctgctttgacaaaatcacccgctggagtgttgtaggaattcaaggtgcattgctgtcacatacactggaacccttgtatttgtccacaattactattgggcaattacctggtggtgctcctgaatgtttctctgttgaaaataatattaagaaagccctcgatgctcgtctgtcctctctatccagcaaattgccatctccttttaaagtgcagaagccaaaggtttttgaagcagctgtcccaccaacagagtttcaacagatttctggagacgtaccccccttgacatgcgggtactcgatctgttggaataaatctggattgcatgaagttgtcttaggaacaactggtaggaaacaaggaacctcatcaaaggcagcacacttgccctccaccgagtcattgctctgcaagagaagactgctagaagcattcatgtcccttgaacatccattggtagggcaactcaagtgtgaggagctatcttaccgtgcacttaaggatacggctcatgaataccatcacacgcttgagctcctcaggaagaccccattttttggctgctggccagctaagcctacatttgttgattcgtttccagtttcacggtga

SEQ ID NO: 4570 - protein, 366 aa, Sorghum bicolor
  misc_feature: Ceres ANNOT ID no. 6038242
  misc_feature (66)..(358): Pfam Id: A_deamin Pfam Desc: Adenosine-deaminase (editase) domain
  misc_feature (3)..(366): NCBI GI: 38345564 NCBI Desc: osjnba0032f06.25 [oryza sativa (japonica cultivar-group)]
  misc_feature (122)..(366): NCBI GI: 90399212 NCBI Desc: h0306f12.5 [oryza sativa (indica cultivar-group)]
  misc_feature (123)..(261): NCBI GI: 115461404 NCBI Desc: os04g0683500 [oryza sativa (japonica cultivar-group)]
  misc_feature (132)..(261): NCBI GI: 8671846 NCBI Desc: contains similarity to rna adenosine deaminase gene, exon 15 from homo sapiens gbu75503. it contains the adenosine-deaminase (editase) domain pf02137. [arabidopsis
  misc_feature (132)..(261): NCBI GI: 8671846 (continued) thaliana]
  misc_feature (132)..(301): NCBI GI: 91805727 NCBI Desc: adenosine-deaminase family/editase family protein [arabidopsis thaliana]
MLSSSPAPPREGAAVPSSWAEAASAAALRHYRSLAKKGKPQGRESTVLAAFLLSTPHDPRSLTVLSMGTGTKCLGASMLSDRGDLVHDAHAEVIARRALLRLVYSEIGRGAPPDWLVASGDGGVMAVPLSQSELPREQLDSVNGDISFVQRKPGRGDTTLSMSCFDKITRWSVVGIQGALLSHTLEPLYLSTITIGQLPGGAPECFSVENNIKKALDARLSSLSSKLPSPFKVQKPKVFEAAVPPTEFQQISGDVPPLTCGYSICWNKSGLHEVVLGTTGRKQGTSSKAAHLPSTESLLCKRRLLEAFMSLEHPLVGQLKCEELSYRALKDTAHEYHHTLELLRKTPFFGCWPAKPTFVDSFPVSR

SEQ ID NO: 4571 - DNA, 2361 bp, Sorghum bicolor
  misc_feature: Ceres ANNOT ID no. 6038248
  misc_feature: Encodes the peptide sequence at SEQ ID NO 4572
atgaatcggagcgggaagaggagaaagaggaagaagcgcggcgatgaaagggccgctgccggtgcgccctcgctctcctccgcctccttcgaccgccacgtgttccccatcctcttcgccgccgcccgagccacccgccaaaccagcagctcctcctccccgcccgctgcgctcgcggcccgcctcctgcgccgtgtgctctcccgctcgccgcagacgctctcccctctcccgggctccttcgtcgcgctcctccccctcctcctctcctccagctgctcttctgtcgccgcgctgagctgcgaggtgctcggcgcggcagcgttgcggtgcatggagaccggcgagatgctggcttccgacagcggcatcgccagcggcctggcgagggcgctaggaagtagaagccagcgagtgattgaggctgcctgtaattctatattggatctctcggcgtcttcagtcggcagggagcgacttgcaggctcacctgttctgcccaggacattgcatctattttgtcaggtggaatctgtttatggatttgcccaaagcggaagcactgagtctacagaaagtcctacagaagcaaataaaatcctgtgcttgatcattgacacaatggtgctcttggtgaactcttgtaagattgacaatttgcagagtctacagcaggagctagtaaggaacgttctgtcgttgttgtacaaaatctggaagaaaactcaactcttgagatcgtcaactgattgcaacatgtggaagaataaacttcaaagtaaagaatatgagatatctgaggctattttcaggctttcgattggtcttgcttctccagcctgcccagagcctgatgtggtcaggaaaagtatttttggccaagcagtgtccgactttgaaacttttgtcctggcctactgggagaagttgcctaatttgtacaggaggaaacaaagcactcaaatggatagttctgtgttcgctgcactgcacagtgcttttaatcttggaacagcacctgattctatcattgaatcattaataaagggtcttgtttcttgccctgctattgcttctgatgaacttgacataaattcatttctccatgaggttcatgattccttgggtgattctgtaaagtacaggcaagacattagagtcatcagaacacaagatccaaatgaccaaacttcaaggggatgtatgaccgaggagcattttttcgatgatggagcagtcttcatggatgaagatgcattcatcggaagatgtaaacatgcctttaagaatggttattcgattgccttgcgtggcatggagttccggtctgagaaggttgctgctatagcttctgccctggctgatctatttgggcagccttctgtaggagccaacatatacttctcacctgcaagatctcaaggcctggcccgacactatgacgatcactgtgtacttgtttggcagctacttggtagcaagaaatggatgatttggcctaatccgaagccacttttgcccagactatatgatccgtttgaccctttagatggtactttagacaagaacattgggagagtggaggttttacttgaaggggacatgatgtacgtccccagaggctatgttcatgaggctcgcactgatgttggtggatcagaggtgaatgcatacgctgattactcactccatctgacccttgctattgaggtcgagccaccctttgagtgggaaggttttgcacatatcgcccttcattgttggacagagaagcagcagcttagagattctcaatttgtcgagttcaaggggaaagtggaaacttccttatttgctattgtactgcatgtggccatcaggttgcactccgacagtgatcctgttttcaggaaggcatgcatggttgcggcaaagcttccatcatccagtacctgcacaacgactcacttgaaggctcttcaaagcagccagaggtcaactttcgatgagatactgaggaagatcgatcagaactgcagcatcaaggaagcgttgaagcgcatcacgttggccgtgaaagagggagaagatgaagccttccagtggatgagctggctcaggcacctgcctcagcaaggagttgacagaatcgatttctgcaatatttttggagccctggaagagctgcttgaggctttcaactctaaccctgaccatgccatggctgacttcacagccttcaagtcagggttttgccagcgcgtcgtgtatgaggacgtgtgcgagagctttgagactttgcttgagatgtacaggacgactaggactcggtacatgaggggaatgctggcgttgcacggggcaggtgcacatgtgagctga

SEQ ID NO: 4572 - protein, 786 aa, Sorghum bicolor
  misc_feature: Ceres ANNOT ID no. 6038248
  misc_feature (364)..(658): Pfam Id: Cupin_4 Pfam Desc: Cupin superfamily protein
  misc_feature (8)..(779): NCBI GI: 116310856 NCBI Desc: osigba0132e09-osigba0108l24.12 [oryza sativa (indica cultivar-group)]
  misc_feature (381)..(567): NCBI GI: 144900526 NCBI Desc: myc induced nuclear antigen [magnetospirillum gryphiswaldense msr-1]
  misc_feature (422)..(564): NCBI GI: 118464331 NCBI Desc: cupin superfamily protein [mycobacterium avium 104]
  misc_feature (386)..(570): NCBI GI: 115375458 NCBI Desc: mina protein [stigmatella aurantiaca dw4/3-1]
  misc_feature (441)..(551): NCBI GI: 23200593 NCBI Desc: mina53 form-3 [homo sapiens]
MNRSGKRRKRKKRGDERAAAGAPSLSSASFDRHVFPILFAAARATRQTSSSSSPPAALAARLLRRVLSRSPQTLSPLPGSFVALLPLLLSSSCSSVAALSCEVLGAAALRCMETGEMLASDSGIASGLARALGSRSQRVIEAACNSILDLSASSVGRERLAGSPVLPRTLHLFCQVESVYGFAQSGSTESTESPTEANKILCLIIDTMVLLVNSCKIDNLQSLQQELVRNVLSLLYKIWKKTQLLRSSTDCNMWKNKLQSKEYEISEAIFRLSIGLASPACPEPDVVRKSIFGQAVSDFETFVLAYWEKLPNLYRRKQSTQMDSSVFAALHSAFNLGTAPDSIIESLIKGLVSCPAIASDELDINSFLHEVHDSLGDSVKYRQDIRVIRTQDPNDQTSRGCMTEEHFFDDGAVFMDEDAFIGRCKHAFKNGYSIALRGMEFRSEKVAAIASALADLFGQPSVGANIYFSPARSQGLARHYDDHCVLVWQLLGSKKWMIWPNPKPLLPRLYDPFDPLDGTLDKNIGRVEVLLEGDMMYVPRGYVHEARTDVGGSEVNAYADYSLHLTLAIEVEPPFEWEGFAHIALHCWTEKQQLRDSQFVEFKGKVETSLFAIVLHVAIRLHSDSDPVFRKACMVAAKLPSSSTCTTTHLKALQSSQRSTFDEILRKIDQNCSIKEALKRITLAVKEGEDEAFQWMSWLRHLPQQGVDRIDFCNIFGALEELLEAFNSNPDHAMADFTAFKSGFCQRVVYEDVCESFETLLEMYRTTRTRYMRGMLALHGAGAHVS

SEQ ID NO: 4573 - DNA, 1302 bp, Sorghum bicolor
  misc_feature: Ceres ANNOT ID no. 6038249
  misc_feature: Encodes the peptide sequence at SEQ ID NO 4574
atggcggcgcaggcggtggtgccggcgatgcagtgccaggtcggagtgaaggcggcggcgggcgcccgggcgaggccggcggcggcgggaggcagggtgtggggcgtcaggagtaggaccggccgcggcggcgcctcgccggggttcaaggtcatggccgtcagcacgggcagcaccggggtggtgccacgcctggagcagctgctcaacatggacaccacgccctacaccgacaagatcatcgccgagtacatctgggtcggaggatctggaatcgacatcagaagcaaatcaaggacaatttcaaaaccggtggaggatccctcagaactaccgaaatggaactatgatgggtcaagcacagggcaagcccccggagaagacagtgaagtcattctatacccccaggctatcttcaaggacccattccgaggtggcaacaacattttggttatctgtgatacctacacgccacagggtgaaccccttcctactaacaaacggcacagggctgcgcaaatttttagtgacccaaaggtcgttgaacaagtgccatggtttggcatagagcaagagtacactttgctccagaaagatgtgaattggcctcttggttggcctgttggaggctaccctggtccccagggtccctactactgtgctgtaggagcagacaaatcatttggccgtgacatatcagatgctcactacaaggcttgcctttatgctggaattaacattagtggaacaaacggggaggtcatgcctggtcagtgggagtaccaagttggacctagtgttggcattgaagcaggagatcacatatggatttcaagatacattctcgagagaatcacagagcaagctggggttgtccttacccttgatccaaaaccaattcagggtgactggaatggagctggctgccacacaaattacagcacaaagaccatgcgtgaagatggaggatttgaagatatcaagagagcaatcctgaatctttctctgcgccatgatttgcatattagtgcatacggagaaggaaatgaaagaagattgacagggaagcatgagaccgctagcatcgagaccttctcatggggtgtggcaaaccgtggctgctctgttcgtgtggggcgagataccgaggcaaaagggaaaggttacctagaagaccgtcgcccggcatcaaacatggacccatacattgtgacggggctactggctgaaacaacaattctctggcaaccaacccttgaagcggaggttcttgccgccaagaagctggcgctgaaggtatga

SEQ ID NO: 4574 - protein, 433 aa, Sorghum bicolor
  misc_feature: Ceres ANNOT ID no. 6038249
  misc_feature (164)..(416): Pfam Id: Gln-synt_C Pfam Desc: Glutamine synthetase, catalytic domain
  misc_feature (78)..(158): Pfam Id: Gln-synt_N Pfam Desc: Glutamine synthetase, beta-Grasp domain
  misc_feature (3)..(433): NCBI GI: 434334 NCBI Desc: glutamine synthetase [zea mays]
  misc_feature (3)..(433): NCBI GI: 44885918 NCBI Desc: plastidic glutamine synthetase [phragmites australis]
  misc_feature (3)..(433): NCBI GI: 44885920 NCBI Desc: plastidic glutamine synthetase [phragmites australis]
  misc_feature (3)..(433): NCBI GI: 38346409 NCBI Desc: osjnba0011f23.15 [oryza sativa (japonica cultivar-group)]
  misc_feature (3)..(433): NCBI GI: 116310855 NCBI Desc: osigba0132e09-osigba0108l24.11 [oryza sativa (indica cultivar-group)]
  misc_feature (3)..(433): SWISSPROT Homolog: EC 6.3.1.2 Glutamine synthetase, chloroplast precursor
  misc_feature: Useful for making plants with modulated water use efficiency
  misc_feature: Functional homolog of the protein sequence given in SEQ ID NO 13877
  misc_feature: The sequence is a functional homolog of SEQ ID NO. 371 in the 11/188,298 US application
MAAQAVVPAMQCQVGVKAAAGARARPAAAGGRVWGVRSRTGRGGASPGFKVMAVSTGSTGVVPRLEQLLNMDTTPYTDKIIAEYIWVGGSGIDIRSKSRTISKPVEDPSELPKWNYDGSSTGQAPGEDSEVILYPQAIFKDPFRGGNNILVICDTYTPQGEPLPTNKRHRAAQIFSDPKVVEQVPWFGIEQEYTLLQKDVNWPLGWPVGGYPGPQGPYYCAVGADKSFGRDISDAHYKACLYAGINISGTNGEVMPGQWEYQVGPSVGIEAGDHIWISRYILERITEQAGVVLTLDPKPIQGDWNGAGCHTNYSTKTMREDGGFEDIKRAILNLSLRHDLHISAYGEGNERRLTGKHETASIETFSWGVANRGCSVRVGRDTEAKGKGYLEDRRPASNMDPYIVTGLLAETTILWQPTLEAEVLAAKKLALKV

SEQ ID NO: 4575 - DNA, 1677 bp, Sorghum bicolor
  misc_feature: Ceres ANNOT ID no. 6038254
  misc_feature: Encodes the peptide sequence at SEQ ID NO 4576
atgggcggcgccgccaccgcaaaagcgggcgccgaaggcaccgccattgcgcggggcctggggtcctggaaaaccgggacccgggagggcgcgggccgctacctcctctccgaatttctggccggcttcgggggggggctcttcggcaccgaacttcttaaggtctgggaagggctctttttttggttctgggacgccgaaaagccgctctaccagaactccgtcgccacgcgcctcgcgtccgccgtctccgcgccgccgtcccccgccgacggcgccgccttcctcgccgcctgcctcaccacgctccgccgcgagtgggcccacatcgacgtccaccgcctcgataagttctacctcctcaaccgccggttcctccaccacgccttcctgctcctcagcgccaattccttcgcccccgacgtcacctcccaggtcgtgtccgtcctgtcggataaggccctgctcccggaagccgataacgtggctgccggcacctccaggggcctcggataccatgtcgccgaggcgttccttgacgagctcttgcccgtgctccccgtgagcctggagacggtggacgcactgctggctccgttcttcactgtgttggagaagtcgacggatcgggtgatggtgagtaaggtgaaggctggcgtgtttgagaggttactggagagcggcagtcggttgcttgagatggtgaagaaaggggaggaggtggagaagggtagcgctgaggagaagctcgggaaaattggattgctatttggactcagcaagaggttcctggatattggtgcaaaggcagagacggtgcaatcgaaccggaaggtggtctttgggctgagggatgcatttgtgaagattgagaagggtttgcagctatctggtcttgggatcactgtgccaaagtttgaggctactgaggtgccagtgccgccaaatgcaggtgaggaaaaggcacaaaagaagaagaaaaaggccaagaaggctgcattggctgcaggtgagatggaggaggccaaggatttgaagcgtgagaagaaggtaaagaaagacaagaaggagaagaaagagaagaagaaaaagaggaaggtggaggttgttgatgaagggaacaccactgagaagagtaccgatgctcctgtagatgaccaacagatgggtgatggtactgatggcattacatttgatgagacattgaagtccaatcttcagaagcagtttgagatggcggcagtagaagctggtatggccaaagagggcagcagctcaagcgctttaccagtgacaccagttagtgggaaaatggcaacaaagaggaagcgctcaaaatctgctgataagatgtctgaagcttctgatgggcatgatggcagcgaaggtaatattcttgcccaggatggagagaagagtggtaagagggtgaggttctcgatgaagaataatttagtttggaaacctcacaatcctttgccaccgcagtgtttgaggctgccaccttcggctactccaaggggaagcgcactaaaaaagggcgttctgccagggcccataacaccgacaccattgaagaaggctaagccaaaggcaaaatctgcaaagaaggtcttgaagaagcagccttcatctgctgtgaagcgcttgcgcaaattgcagagtttctcagcatga

SEQ ID NO: 4576 - protein, 558 aa, Sorghum bicolor
  misc_feature: Ceres ANNOT ID no. 6038254
  misc_feature (12)..(224): Pfam Id: Nop52 Pfam Desc: Nucleolar protein,Nop52
  misc_feature (9)..(558): NCBI GI: 115461058 NCBI Desc: os04g0658600 [oryza sativa (japonica cultivar-group)]
  misc_feature (4)..(558): NCBI GI: 116310851 NCBI Desc: osigba0132e09-osigba0108l24.7 [oryza sativa (indica cultivar-group)]
  misc_feature (5)..(558): NCBI GI: 20152975 NCBI Desc: similar to h. sapiens nnp-1 / nop52 ap001752 (score = 92; e= 9e-18) [hordeum vulgare subsp. vulgare]
  misc_feature (45)..(542): NCBI GI: 28374422 NCBI Desc: nnp1 protein [danio rerio]
  misc_feature (16)..(252): NCBI GI: 120419458 NCBI Desc: nucleolar protein nop52 [bos taurus]
MGGAATAKAGAEGTAIARGLGSWKTGTREGAGRYLLSEFLAGFGGGLFGTELLKVWEGLFFWFWDAEKPLYQNSVATRLASAVSAPPSPADGAAFLAACLTTLRREWAHIDVHRLDKFYLLNRRFLHHAFLLLSANSFAPDVTSQVVSVLSDKALLPEADNVAAGTSRGLGYHVAEAFLDELLPVLPVSLETVDALLAPFFTVLEKSTDRVMVSKVKAGVFERLLESGSRLLEMVKKGEEVEKGSAEEKLGKIGLLFGLSKRFLDIGAKAETVQSNRKVVFGLRDAFVKIEKGLQLSGLGITVPKFEATEVPVPPNAGEEKAQKKKKKAKKAALAAGEMEEAKDLKREKKVKKDKKEKKEKKKKRKVEVVDEGNTTEKSTDAPVDDQQMGDGTDGITFDETLKSNLQKQFEMAAVEAGMAKEGSSSSALPVTPVSGKMATKRKRSKSADKMSEASDGHDGSEGNILAQDGEKSGKRVRFSMKNNLVWKPHNPLPPQCLRLPPSATPRGSALKKGVLPGPITPTPLKKAKPKAKSAKKVLKKQPSSAVKRLRKLQSFSA

SEQ ID NO: 4577 - DNA, 1314 bp, Sorghum bicolor
  misc_feature: Ceres ANNOT ID no. 6038256
  misc_feature: Encodes the peptide sequence at SEQ ID NO 4578
atggccaccacctccgtcgccgctcgctccccccacccccacctctcccacccccgccgccagaaccccagcaccacctccacctccagagcctcgattcggggccggcttccgcccatccggtgctcgtccgcctcctcgccgccgccgccggccaccggcggcgaggaaggggagtcggggtcccggcggctgtcaaagcagtcgtcgtgggagtcgaaggacgcggagggggacgactacctctaccgcctcgggaaggaggcggacaacctgaacgtcaccgtcggcgcacgggccggcatcgtcgacgacctcttcgttggaaacttcctcgggaaagactctgatattgtgttcgattaccggcagaaggcaacaagaacattcgagtacctgcagggggattactatatcgcacctgccttcctcgagagccataactcaaatttagcatgccacattgtaaagaactacattggacatcttctaaataatatcaagattcccttaatacttggggtttggggtggaaaaggtcaagggaaaacatttcagactgaacttatatttaaagcaatgggtgttgaacctgttattatgtctgctggggaactagaatcagaaaaagcaggtgaaccagggaggctaatacgtgatcgatacagaactgcctcccaagtaatccaaaaccaagggaaactgagttgcttgatgatcaacgatctagatgctggtgttggaagatttggaaacacgcagatgacagtcaataatcaaatagctgtcggaactttgatgaacttggcagataatcctaacagggtgagcatcggccagaaatggagagaatctgatgttacacacagagtgccaataatagttactggaaatgatttttcaactctatatgcacccttaattcgtgatgggagaatggaaaaattctactggcagcccacccgtgaagatataattagtattgttcatggcatgtatagaaaggatggattatctgctgaagaagtagcaagagttgtagacacatttccaaaccaagctctggacttctatggagctttgagatccaggacatatgatcgggctatcttggagtgggtcgaagaaattggtggacatgaacagctaagggcaaagcttcttaagcgaaagaaaggagaggagcttccaacatttatagccccaaagccatcactggaggcattgattgagtcagggtactcgctggtgaaggagcaagaactaataatgaactcaaaactatcaaaagagtatatgaagaacttagaatag

SEQ ID NO: 4578 - protein, 437 aa, Sorghum bicolor
  misc_feature: Ceres ANNOT ID no. 6038256
  misc_feature (172)..(375): Pfam Id: AAA Pfam Desc: ATPase family associated with various cellular activities(AAA)
  misc_feature (1)..(437): NCBI GI: 38346401 NCBI Desc: osjnba0011f23.7 [oryza sativa (japonica cultivar-group)]
  misc_feature (1)..(437): NCBI GI: 116310848 NCBI Desc: osigba0132e09-osigba0108l24.4 [oryza sativa (indica cultivar-group)]
  misc_feature (43)..(437): NCBI GI: 71834884 NCBI Desc: rubisco activase 2 [mesembryanthemum crystallinum]
  misc_feature (194)..(437): NCBI GI: 5903100 NCBI Desc: highly similar to ribulose-1,5-bisphosphate carboxylase/oxygenase activase [arabidopsis thaliana]
  misc_feature (23)..(433): NCBI GI: 19855034 NCBI Desc: ribulose-1,5-bisphosphate carboxylase/oxygenase activase precursor [zea mays]
MATTSVAARSPHPHLSHPRRQNPSTTSTSRASIRGRLPPIRCSSASSPPPPATGGEEGESGSRRLSKQSSWESKDAEGDDYLYRLGKEADNLNVTVGARAGIVDDLFVGNFLGKDSDIVFDYRQKATRTFEYLQGDYYIAPAFLESHNSNLACHIVKNYIGHLLNNIKIPLILGVWGGKGQGKTFQTELIFKAMGVEPVIMSAGELESEKAGEPGRLIRDRYRTASQVIQNQGKLSCLMINDLDAGVGRFGNTQMTVNNQIAVGTLMNLADNPNRVSIGQKWRESDVTHRVPIIVTGNDFSTLYAPLIRDGRMEKFYWQPTREDIISIVHGMYRKDGLSAEEVARVVDTFPNQALDFYGALRSRTYDRAILEWVEEIGGHEQLRAKLLKRKKGEELPTFIAPKPSLEALIESGYSLVKEQELIMNSKLSKEYMKNLE

SEQ ID NO: 4579 - DNA, 1008 bp, Sorghum bicolor
  misc_feature: Ceres ANNOT ID no. 6038261
  misc_feature: Encodes the peptide sequence at SEQ ID NO 4580
atgtcggcctcggcgtcgtcgccgccggcgggagaggagaacaagcaggaggcggcgccagtcaggcactgcaagggcgtcaacgacctcgacaaggtcgtgctccgcgaggtccggggcagctccgcagaggtgtacttgtacggtgggcatgtgacatcatggaaagatgagcatggagacgagttactttttgttagcaataaggctattttcaagcctccaaaagctatacgtggaggaataccgatctgctttccacagttttccaactttgggaatctggaacaacatggatttgcaaggaatagaacatggtgtgttgatgatgatcctccaccatttccagtgccaacctccaatacagcttttgtggacttgatcctcaaacctactgaagaggatttgaagatctggcctcatagttttgagtaccgcctgagggttgcacttagtcctggtggtgatttgatgctaacttcacgtataagaaacactaatgcagatgggaagtcattctctttcacttttgcataccacacatacttcaagatttctgatatcagtgaggtgcgagtagaaggtttggaaactctggattacctagataacttacaagatagagcccgtttcactgaacaaggcgatgcaattgtttttgaatccgaactggacagaatatatctgggcactccgtcaaaaattgcgattattgaccatgagaagaaaagaacatttgttgtgaggaaaggaggccttcctgatgctgttgtttggaacccctgggataaaaaagcgaaggctatgtcagattttggggatgatgaatataaacgaatggtatgcgtggaggcggcggctatagagaagcctgtcactctgaagcctggtgaggagtggactggaaagttggaactttctgctgtgccatctagttattacagtggtcagctagatcctgaccgtgtgattcaggattctactgtcccggaggactcaatcagctag

SEQ ID NO: 4580 - protein, 335 aa, Sorghum bicolor
  misc_feature: Ceres ANNOT ID no. 6038261
  misc_feature (31)..(307): Pfam Id: Aldose_epim Pfam Desc: Aldose 1-epimerase
  misc_feature (25)..(327): NCBI GI: 124360080 NCBI Desc: galactose mutarotase-like [medicago truncatula]
  misc_feature (3)..(325): NCBI GI: 38344152 NCBI Desc: osjnba0041a02.19 [oryza sativa (japonica cultivar-group)]
  misc_feature (3)..(325): NCBI GI: 116309662 NCBI Desc: osigba0118p15.1 [oryza sativa (indica cultivar-group)]
  misc_feature (3)..(324): NCBI GI: 549984 NCBI Desc: possible apospory-associated protein
  misc_feature (13)..(324): NCBI GI: 92881599 NCBI Desc: galactose mutarotase-like [medicago truncatula]
MSASASSPPAGEENKQEAAPVRHCKGVNDLDKVVLREVRGSSAEVYLYGGHVTSWKDEHGDELLFVSNKAIFKPPKAIRGGIPICFPQFSNFGNLEQHGFARNRTWCVDDDPPPFPVPTSNTAFVDLILKPTEEDLKIWPHSFEYRLRVALSPGGDLMLTSRIRNTNADGKSFSFTFAYHTYFKISDISEVRVEGLETLDYLDNLQDRARFTEQGDAIVFESELDRIYLGTPSKIAIIDHEKKRTFVVRKGGLPDAVVWNPWDKKAKAMSDFGDDEYKRMVCVEAAAIEKPVTLKPGEEWTGKLELSAVPSSYYSGQLDPDRVIQDSTVPEDSIS

SEQ ID NO: 4581 - DNA, 2712 bp, Sorghum bicolor
  misc_feature: Ceres ANNOT ID no. 6038264
  misc_feature: Encodes the peptide sequence at SEQ ID NO 4582
atgatgcagcagctccgtcgcagccagccgagcccgtgtcatctccgcggctcgcgcttcacgggcgcggggctgccggcacgcccgatgctcgctctcggcgcggcagcagctcgccgttcgcggcccgaaaccgtgcaactgagcgcctgccacgccgcggccgcgtcggcccagccccgtccccgtgccgtcgccgactcggcgctgggagcctcgtcgacgagcgtgcaggttagaggcaagctgctgctgcagaacttcttcgccgacgacggctccgacagccagcggcagctcaggctctccatccagcttgtcagcgccaccgtcgccggtcccgatgggcgcggggtgaaggcggaggcgtcggtgctggacgccgtcgttggcagcggggacaccgagctcgacgtggacctgacctgggacgaggcgctgggcgcgcccggcgccgtggtggtgaagaaccactccgacttccccgtgtacctgaggctgctgagcatgccgaccagagtcctcggcgccgacgacaaggccgccaccaccgccgccgtccacttcgcgtgcaacggatgggtctatcccgtcgacaagcacccgtaccgcctcttcttcaccaacgatgcgtgtgtcaaggaagaaacgccaagctccctgctcaagtacagggaggacgagctcgccgtgctccggggagacggcgagacggcagaccggccgttccagccgtgggaccgcgtgtacgactacgcgctgtacaacgacctggggaacccagaccttcgaagggacttggcgcgccccgtgctgggaggatctcgagagtacccctaccctcggcgtaccaagaccggccggccagccgccaaaacagatcctcagtcggagagcagagcgccgctggacgaagagatctacgtcccctgcgacgagcgcgtcggcttcggcagcgtccccgcgccgacgcttccgccgctgggcgggcacttcagctcgctcgcggacgtctaccgtctcttcggcctcgacgacgtcggccggctcccggaggccaagggggtcatcaacagcggcgcgccgttccccgttgttccccaggtcatctcagtgaacccgacacactggcggaaggacgaggagttcgctcggcaaatgatcgccggggcgaacccggtgtgcatcaagcgcgtcaccaagttcccgctgacgagcgagcttgaccgcggagtgttcggcgaccaggacagcaagataaccgaggaccatgttgagaagaacatgggtggcatgacgctgcagcaggccgtagaggagggaaggctgtacgtcgtggaccaccacgactgggtgatgccatacctgaagcgcatcaacgagctcccaggcgaggaggagaaggccgaggtgtcgcagaggaaggtgtacgccgccagaacgcttctgttcctgaatcgcgaggactcgacgctcaaaccgctcgcgatcgagctcagctcgccgcacccggagaaggagcagctcggcgcggtgagcacggtgtacactccaccggacagcagggacgacgacgacgacggcatcacggccgggaggttctcggtttgggagctggccaaggcccacgccgccgccaacgacaccgtcgagaacaacttcgtcactcactggctcaacacgcacgcgtccatggagccgatcgtgatcgcggcgaaccggcagctgagcgtgctgcacccgatccacaggctcctcaagccgcacttccggaagacgctccacatcaacgccgtcgcgcgccagatcgtcgtcggctcgggcgaccaaagaaaggacggcagcgtcttccgtggcatacacgaggtcacctacttccccagcaggtacaacatggagatgtcctccatggcatacagggcctggaacttcacaggccttgctctccccaatgatctcatcaacagaggtgtggcaaaaggggacgcgaagaagccagagacgctggagctggtgataaaggacgactacccatacgcggcggacgggctcgaaatgtgggcggcgatcaaggactgggtggcggactactgcgccatctactacggcgacgacggcgccgtggcgagggacagcgagctgcaggggtggtggagcgaggtgaggaacgtggggcacggcgacctgtcggacgcgccgtggtggccggcgatggactgcctcgcggacctcgtggagacctgcaccaccatcgtctggctgggctcggcgtaccacgcggccatcagcttcgggcagtacgactaccagggcttcatcccgaacgggccctcactcaccacgcggccggtgccggatccggaggtgacggtgacggtggcggagtcggacttcctggagagcgtcacgccggtggccgaggcgctcgggttcatgtccatctcctcgggcccgctggggctggtggggacggaggtgtacctggggcagcggccggacacggagcagtggacgagcgagcggagcgcggccgaggcgctggcggtgttccgggcgaggttggaggaggtcgcggggaacatcgagaggcggaacgctgaccctgcgttgaagaaccggacggggcccgtggaggtgccctatacgctgctcaagccgacggcacagcctggaccggtgctccgtggcatacccaacagcatcaccgtttga

SEQ ID NO: 4582 - protein, 903 aa, Sorghum bicolor
  misc_feature: Ceres ANNOT ID no. 6038264
  misc_feature (218)..(887): Pfam Id: Lipoxygenase Pfam Desc: Lipoxygenase
  misc_feature (102)..(207): Pfam Id: PLAT Pfam Desc: PLAT/LH2 domain
  misc_feature (1)..(903): NCBI GI: 84626289 NCBI Desc: lipoxygenase [zea mays]
  misc_feature (535)..(903): NCBI GI: 16904543 NCBI Desc: lipoxygenase [corylus avellana]
  misc_feature (535)..(903): NCBI GI: 8649004 NCBI Desc: lipoxygenase [prunus dulcis]
  misc_feature (526)..(903): NCBI GI: 1407705 NCBI Desc: lipoxygenase [solanum tuberosum]
  misc_feature (526)..(903): NCBI GI: 899344 NCBI Desc: lipoxygenase [nicotiana tabacum]
MMQQLRRSQPSPCHLRGSRFTGAGLPARPMLALGAAAARRSRPETVQLSACHAAAASAQPRPRAVADSALGASSTSVQVRGKLLLQNFFADDGSDSQRQLRLSIQLVSATVAGPDGRGVKAEASVLDAVVGSGDTELDVDLTWDEALGAPGAVVVKNHSDFPVYLRLLSMPTRVLGADDKAATTAAVHFACNGWVYPVDKHPYRLFFTNDACVKEETPSSLLKYREDELAVLRGDGETADRPFQPWDRVYDYALYNDLGNPDLRRDLARPVLGGSREYPYPRRTKTGRPAAKTDPQSESRAPLDEEIYVPCDERVGFGSVPAPTLPPLGGHFSSLADVYRLFGLDDVGRLPEAKGVINSGAPFPVVPQVISVNPTHWRKDEEFARQMIAGANPVCIKRVTKFPLTSELDRGVFGDQDSKITEDHVEKNMGGMTLQQAVEEGRLYVVDHHDWVMPYLKRINELPGEEEKAEVSQRKVYAARTLLFLNREDSTLKPLAIELSSPHPEKEQLGAVSTVYTPPDSRDDDDDGITAGRFSVWELAKAHAAANDTVENNFVTHWLNTHASMEPIVIAANRQLSVLHPIHRLLKPHFRKTLHINAVARQIVVGSGDQRKDGSVFRGIHEVTYFPSRYNMEMSSMAYRAWNFTGLALPNDLINRGVAKGDAKKPETLELVIKDDYPYAADGLEMWAAIKDWVADYCAIYYGDDGAVARDSELQGWWSEVRNVGHGDLSDAPWWPAMDCLADLVETCTTIVWLGSAYHAAISFGQYDYQGFIPNGPSLTTRPVPDPEVTVTVAESDFLESVTPVAEALGFMSISSGPLGLVGTEVYLGQRPDTEQWTSERSAAEALAVFRARLEEVAGNIERRNADPALKNRTGPVEVPYTLLKPTAQPGPVLRGIPNSITV

SEQ ID NO: 4583 - DNA, 1218 bp, Sorghum bicolor
  misc_feature: Ceres ANNOT ID no. 6038267
  misc_feature: Encodes the peptide sequence at SEQ ID NO 4584
atgtcgtcgctgctgcacgctgtgtcctcgtcatccggtggagctcctgccgccctcgaagccgaggtcgaggagaagctcgtcctgtacgacgacgacgacaacgcgccgccaccggcagcaccgccacagatcaagcgaggggagcggcgcctgcagcctcgtcgtgagggcagcgccgccgacgtcgtcggtgaccaccgcgagaggttcctccgcgcatacgatcgcctccgggacgagctcctcgacgacgactcgtgcgagctcaccgatgaggccacgcgctgggtcgcgcagatgatcgactacaacgtgcctggagggaaactgaatcgaggtctgtcagtgatcgatagttacttgctgttgaaacaaggaagcgaggttgctgaagatgaattcttccttgcctgtgttcttggttggtgtgtcgagtggtttcaagcatgtgcactgctacttgacgatatcatggatgattctcatacaaggagagatcagatttgttggtaccgacggcctgaggttggtcttcacggcataaacgacggtattctactaaaatgtcacatcgcacgtttgataaaaaaatactttagagaaaagccttactacatagacatctgtgaattatggaacgagatagctttgcagacttctctcggacagatgcttgatcttatcagcacacataatgtggcgaatgacgtcgcaaaatacaatattgaagggtcccgccacaatgtcaagtacaagacatcttactactctttttatcttcccgtagcttgcgcattgctgttgtgtggcacaaaacttgaaaacatcagtgggctaagggatgtgcttattgaaatgggcatatattttcaggcacaggatgattacttggattgctttgcagatcctaatacaatagggaagattggaactgatattgaagatcacaagtgttcctggctaattgtgcaagctcttagccatgccaacagtaacgagatagaagtattgctgaaaaactacggaaagaaggattcaacttcagtttccaaagtgaaaaacacttattcaactcttgatttgaaggacatcttctctgagttcgaagatcgagcttacaaacacttggtcacttctattgaagatcaacatgaccacgcggtgcaggagatcctcaaatccttcctaaagaaaatccaccgccggaagaagtag

SEQ ID NO: 4584 - protein, 405 aa, Sorghum bicolor
  misc_feature: Ceres ANNOT ID no. 6038267
  misc_feature (97)..(368): Pfam Id: polyprenyl_synt Pfam Desc: Polyprenyl synthetase
  misc_feature (14)..(405): NCBI GI: 116309645 NCBI Desc: osigba0158d24.4 [oryza sativa (indica cultivar-group)]
  misc_feature (14)..(405): NCBI GI: 115461042 NCBI Desc: os04g0657100 [oryza sativa (japonica cultivar-group)]
  misc_feature (56)..(405): NCBI GI: 39545740 NCBI Desc: osjnba0071i13.18 [oryza sativa (japonica cultivar-group)]
  misc_feature (58)..(405): NCBI GI: 18958450 NCBI Desc: farnesyl pyrophosphare synthase [musa acuminata]
  misc_feature (50)..(405): NCBI GI: 38684029 NCBI Desc: farnesyl diphosphate synthetase [ginkgo biloba]
  misc_feature: Useful for making plants with modulated salt sensitivity
  misc_feature: Functional homolog of the protein sequence given in SEQ ID NO 13288
  misc_feature: Useful for making plants with modulated salt sensitivity
  misc_feature: Functional homolog of the protein sequence given in SEQ ID NO 13288
MSSLLHAVSSSSGGAPAALEAEVEEKLVLYDDDDNAPPPAAPPQIKRGERRLQPRREGSAADVVGDHRERFLRAYDRLRDELLDDDSCELTDEATRWVAQMIDYNVPGGKLNRGLSVIDSYLLLKQGSEVAEDEFFLACVLGWCVEWFQACALLLDDIMDDSHTRRDQICWYRRPEVGLHGINDGILLKCHIARLIKKYFREKPYYIDICELWNEIALQTSLGQMLDLISTHNVANDVAKYNIEGSRHNVKYKTSYYSFYLPVACALLLCGTKLENISGLRDVLIEMGIYFQAQDDYLDCFADPNTIGKIGTDIEDHKCSWLIVQALSHANSNEIEVLLKNYGKKDSTSVSKVKNTYSTLDLKDIFSEFEDRAYKHLVTSIEDQHDHAVQEILKSFLKKIHRRKK

SEQ ID NO: 4585 - DNA, 4236 bp, Sorghum bicolor
  misc_feature: Ceres ANNOT ID no. 6038268
  misc_feature: Encodes the peptide sequence at SEQ ID NO 4586
atggcaagcaatctattacgcacagaaggcttttctggaaatatgggacaaagatatggtttaattgctgcaagaagtcttggattaagaaggttgcgaatgactcaacattgcttccatcaacaacatctttgttggcgacatgtacaaagtggtgtggttcataatatccgatcatcatcatctcctggggctgttgtatccaaggggtttgacagcccattagttgagaaacctgatacttcattggatgttggaattattcacttgtaccgcgtaccatttcttcaagaaagtgaaaccatggagctgctcaagaaagtgaaggcgaaggtttctgctaatattgttgatatactgaccgagcagtgcttcaatattcaattggataatccactcacccctgagaaactttcaacgcttcattggctcttagcagaaacttatgaaccagataagttgcaaagtaggagctttctggaggaggaagaatctagtagttcctatgctgtcattgttgaggttggtccccggatgacattttcaacggcattctcaaccaatgctgtctcaatttgtaaatctctctcattagtagaagtgagcagactggagaggtcaagaagataccttttgcgccttgagcctggtagtgatccacttgatgaaagtcagctcaaagaatttgctgcattggttcacgatagaatgacagagtgcatttatcccaaaaagctcacatcatttcagtcagatatagttcctgaacctgtccgtgttgttccagtcattgaaagaggagaagaagcattggaagaaataaatgtgaagatggggcttgcttttgataaacaagatattgactattatacacacctgttcagagatgatattaaacgcaatccgactacagtggaactttttgatattgcacaatccaatagcgaacatagtagacattggtttttcaatggaaaacttgttatagatggacagaccatgcctgccactttgttccagttagtgaagaggcctctgaaagccaaccccaataactctgtcatcggattcaaggataactcaagtgcaataaaaggattcccagtaaaccatctacgcccaacaattccaggttccacttcaccattatccatcatgatgcgtgagcttgatattttattcacagcagaaacccataattttccatgtgctgttgcaccatacccgggagccgagacaggtgcaggtggccgtataagagacacacatgccactggaaagggttcttttgttgttgcttccactgctggttactgtgttggtaatcttcgaattgacaattcaaatgcaccctgggaggacccttcattttcttacccagtgaatctggcctctccattgcaaattcttgtcgatgctagtgatggtgcctctgactatggtaacaagtttggtgagcctctaattcagggatataccagaacatttgggatgaggttgccaaatggggagcggcgtgaatggttgaagcctataatgttcagtggagctattgggcaaattgaccatgcacacatatcgaagtgtgatccagaaattggcatgctagttgtgaagattggtggtccagcatacagaattggtatgggcggtggtgctgcctcgagtatggttagtggccagaacgacgcagagcttgatttcaatgctgtacagcgtggagatgctgagatggcacagaaattgtatcgtgtggtcagggcatgtgcagaaatgggagagaataaccctatcattagcatccatgatcagggcgcaggaggaaactgtaatgtcgttaaggaaataatatatccaaagggtgctgaaattgatatccgttcaattgttgttggtgatcatacattgtcggtcttggagatatggggtgctgagtaccaggaacaggatgcgctacttgtgcaacctgggagcagaagcctgttagagtcgctttgtgatagggaaagagttccaatggctgtcattgggaaaattgatggctgtgggaaaattgtgttgattgatagcgctgctgtagagcatgccaagttgaatggcctccctcctccaccccctgttgaagaacttgagcttgaaaaagttttaggagacatgcctcagaagacctttgagttcaagcgtgtttctcatgccacagagcctttagacattgctcctgaggtaacacttttggatgctctgaagcgagtattaaggctcccatctgtgtgttcaaagcgtttcttgaccacaaaggttgataggtgtgtgacaggccttgttgcacaacagcagacagttgggcctctccaacttcctcttgctgatgtggctgtgattgcacagacatacacagacctaacaggtggtgcttgcagcattggagaacaaccaataaagggtttgcttaatcctaaggccatggccagacttgctgttggggaggccttgactaatcttgtctgggctaaggttacatcactttctgatgtcaaagcaagtgggaattggatgtatgctgcaaagcttgatggcgaaggtgcagatatgtatgatgcagctgtcgcattggctgactgcatgattgaacttggtattgcaatagatgggggaaaagacagcctttccatggcagcccaatgtgatggtgaagtcgtcaaggctcctggaaatcttgtcatcagtacttatgtgacatgtcctgatataacattgacagtaacccctgatttgaagcttggtaatgatggaatccttctgcatattgacctctctaaaggaaatcgccgtcttggtggttctgctcttgcacaagcatttgatcaaattggaaatgattgcccagacattgatgatgttctgtacctgaagaaggtatttgaggccattcaggaattgctcagtcaacgtcttatttcagcaggccatgacataagtgatggtggccttattgtgagtgttcttgagatggcatttgctggtaattgtggttttaagcttgacatagacttggaagataggagcctccttgaaggactttttgcagaggaactcggccttgttattgaagtgcactcgaaatgtctcaatatcgtgaagcaaaagcttgaagcaacaggcatttctgctaatgtaattggagaagttacttgctcaccagaaatagaagtttttgttgatggcaatctgcatctcaaggaaaaaacttcagatctcagggatctctgggaggaaacgagcttccagcttgaggagttacaacgtctgaaatcttgtgttaaacttgagaaagaaggattaaaatgcagaacatcgccgtcatggtctctgtcttttactcccaaatttacagatgagaaactgttgattgcttcctcaaaaccaaaggtcgctatcattcgtgaagaagggagcaatggggacagggaaatggctgctgcattccatgctgctgggtttgaaccatgggatatcacaatgtcagacctcttggctgggaagtcttctctaacagagttccgtgggattgcgtttgttggtggttttagctatgcagatgtgctagattcagcgaaaggttgggctgcatcaatcaggtttaacaaacccctcattcagcaatttcaggatttctatcacaggccagatacgttcagccttggagtatgtaatggttgtcagcttatggctcttcttggctgggtgccaggatctgatgttggaggttctcttggtaaaggtggagatatgtcccagcccaggtttattcacaatgaatccggccgtttcgagtgccggtttacgagtgtgtccattggggattctcctgctatcatgttcaaagggatggaaggttctaccttgggtgtttggagtgctcatggcgagggaagagctttcttcccagatgaaaatgttctatctactgttgtgaagtctaatctggcacctgtgagatattgcgatgattttaacaacataaccgagacctatcccttcaatcctaatggttctccactaggtattggagcactttgctcccctgatgggaggcaccttgctatgatgccgcatccagagcgttgcttcatgatgtggcaatacccatggtatcccaaggaatggcaggttgagaagagtggccccagcccttggctgcggatgttccagaatgctagggaatggtgttcatag

SEQ ID NO: 4586 - protein, 1411 aa, Sorghum bicolor
  misc_feature: Ceres ANNOT ID no. 6038268
  misc_feature (532)..(690): Pfam Id: AIRS_C Pfam Desc: AIR synthase related protein, C-terminal domain
  misc_feature (928)..(1074): Pfam Id: AIRS_C Pfam Desc: AIR synthase related protein, C-terminal domain
  misc_feature (347)..(522): Pfam Id: AIRS Pfam Desc: AIR synthase related protein, N-terminal domain
  misc_feature (58)..(1409): NCBI GI: 145337526 NCBI Desc: catalytic [arabidopsis thaliana]
  misc_feature (121)..(1411): NCBI GI: 18071664 NCBI Desc: formylglycinamide ribonucleotide amidotransferase [vigna unguiculata]
  misc_feature (96)..(1411): NCBI GI: 27883937 NCBI Desc: phosphoribosylformylglycinamidine synthase [glycine max]
  misc_feature (96)..(1141): NCBI GI: 27883939 NCBI Desc: fgam synthase [glycine max]
  misc_feature (619)..(1410): NCBI GI: 115441519 NCBI Desc: os01g0888500 [oryza sativa (japonica cultivar-group)]
  misc_feature (87)..(1409): SWISSPROT Homolog: EC 6.3.5.3 Phosphoribosylformylglycinamidine synthase
MASNLLRTEGFSGNMGQRYGLIAARSLGLRRLRMTQHCFHQQHLCWRHVQSGVVHNIRSSSSPGAVVSKGFDSPLVEKPDTSLDVGIIHLYRVPFLQESETMELLKKVKAKVSANIVDILTEQCFNIQLDNPLTPEKLSTLHWLLAETYEPDKLQSRSFLEEEESSSSYAVIVEVGPRMTFSTAFSTNAVSICKSLSLVEVSRLERSRRYLLRLEPGSDPLDESQLKEFAALVHDRMTECIYPKKLTSFQSDIVPEPVRVVPVIERGEEALEEINVKMGLAFDKQDIDYYTHLFRDDIKRNPTTVELFDIAQSNSEHSRHWFFNGKLVIDGQTMPATLFQLVKRPLKANPNNSVIGFKDNSSAIKGFPVNHLRPTIPGSTSPLSIMMRELDILFTAETHNFPCAVAPYPGAETGAGGRIRDTHATGKGSFVVASTAGYCVGNLRIDNSNAPWEDPSFSYPVNLASPLQILVDASDGASDYGNKFGEPLIQGYTRTFGMRLPNGERREWLKPIMFSGAIGQIDHAHISKCDPEIGMLVVKIGGPAYRIGMGGGAASSMVSGQNDAELDFNAVQRGDAEMAQKLYRVVRACAEMGENNPIISIHDQGAGGNCNVVKEIIYPKGAEIDIRSIVVGDHTLSVLEIWGAEYQEQDALLVQPGSRSLLESLCDRERVPMAVIGKIDGCGKIVLIDSAAVEHAKLNGLPPPPPVEELELEKVLGDMPQKTFEFKRVSHATEPLDIAPEVTLLDALKRVLRLPSVCSKRFLTTKVDRCVTGLVAQQQTVGPLQLPLADVAVIAQTYTDLTGGACSIGEQPIKGLLNPKAMARLAVGEALTNLVWAKVTSLSDVKASGNWMYAAKLDGEGADMYDAAVALADCMIELGIAIDGGKDSLSMAAQCDGEVVKAPGNLVISTYVTCPDITLTVTPDLKLGNDGILLHIDLSKGNRRLGGSALAQAFDQIGNDCPDIDDVLYLKKVFEAIQELLSQRLISAGHDISDGGLIVSVLEMAFAGNCGFKLDIDLEDRSLLEGLFAEELGLVIEVHSKCLNIVKQKLEATGISANVIGEVTCSPEIEVFVDGNLHLKEKTSDLRDLWEETSFQLEELQRLKSCVKLEKEGLKCRTSPSWSLSFTPKFTDEKLLIASSKPKVAIIREEGSNGDREMAAAFHAAGFEPWDITMSDLLAGKSSLTEFRGIAFVGGFSYADVLDSAKGWAASIRFNKPLIQQFQDFYHRPDTFSLGVCNGCQLMALLGWVPGSDVGGSLGKGGDMSQPRFIHNESGRFECRFTSVSIGDSPAIMFKGMEGSTLGVWSAHGEGRAFFPDENVLSTVVKSNLAPVRYCDDFNNITETYPFNPNGSPLGIGALCSPDGRHLAMMPHPERCFMMWQYPWYPKEWQVEKSGPSPWLRMFQNAREWCS

SEQ ID NO: 4587 - DNA, 1014 bp, Sorghum bicolor
  misc_feature: Ceres ANNOT ID no. 6038269
  misc_feature: Encodes the peptide sequence at SEQ ID NO 4588
atggcgagagccggcggcggtggtctcctcgtcttcctcctgcgcggcgcggcgctggtgacggtggcggccgtgctgctggtgggcgcggcgagggcggcgcagctgcggcagaactactacggcagctcgtgccccagcgcggagtccacggtccgctccgtcatctcgcagcgcctccagcagagcttcgccgtcgggcccggaacgctccgcctcttcttccacgactgcttcgtcagaggatgcgacgcgtcggtgatgctgatggcgcccaacggggacgacgagagccacagcggcgcggacgcgacgctgtcgccggacgccgtggacgccatcaacaaggcgaaggcggccgtggaggcgctccccgggtgcgccggcaaggtctcgtgcgcggacatcctcgccatggccgcacgtgacgtcgtctccctgttgggcgggccgaactacgcggtggagctggggcggctggacggcaagacgttcaacagggccatcgtgaagcacgtcctcccgggccctggcttcaacctggaccagctcaactccctcttcgcccagaacggcctcacgcagacggacatgatcgccctctcaggcgcgcacacgatcggggtgacgcactgcgacaagttcgttcggcggatctacacgttcaagcagcggctggcgtggaacccgccgatgaacctcgacttcctgcggtcgctgcggcgggtgtgtcccatcaactacagccccacggcgttcgccatgctggacgtgaccacgcccaaggtcttcgacaacgcctacttcaacaacctccgctacaacaagggcctgctggcgtccgaccaggtgctcttcaccgaccgccgatccagacccaccgtcaacgtcttcgccgccaacagcaccgccttctacgaggccttcatcgccgccatggccaagctcggcaggatcggggtcaagaccggcggcgacggcgagatacgccgcgtctgcaccgccgtcaactag

SEQ ID NO: 4588 - protein, 337 aa, Sorghum bicolor
  misc_feature: Ceres ANNOT ID no. 6038269
  misc_feature (52)..(301): Pfam Id: peroxidase Pfam Desc: Peroxidase
  misc_feature (1)..(337): NCBI GI: 39545735 NCBI Desc: osjnba0071i13.13 [oryza sativa (japonica cultivar-group)]
  misc_feature (1)..(337): NCBI GI: 115461040 NCBI Desc: os04g0656800 [oryza sativa (japonica cultivar-group)]
  misc_feature (33)..(334): NCBI GI: 62526567 NCBI Desc: secretory peroxidase px3 [manihot esculenta]
  misc_feature (21)..(337): NCBI GI: 1620369 NCBI Desc: peroxidase atp22a [arabidopsis thaliana]
  misc_feature (25)..(337): NCBI GI: 92876674 NCBI Desc: haem peroxidase, plant/fungal/bacterial [medicago truncatula]
  misc_feature (14)..(337): SWISSPROT Homolog: EC 1.11.1.7 Peroxidase 16 precursor
  misc_feature: Useful for making plants with altered cell wall content and/or composition
  misc_feature: Functional homolog of the protein sequence encoded by LOCUS at2g18980
  misc_feature: Functional homolog of the protein sequence encoded by LOCUS at4g30170
  misc_feature: Useful for making plants with altered carbohydrate content
  misc_feature: Functional homolog of the protein sequence given in SEQ ID NO 13878
  misc_feature: Useful for making plants with altered cell wall content and/or composition
  misc_feature: Functional homolog of the protein sequence given in SEQ ID NO 13879
MARAGGGGLLVFLLRGAALVTVAAVLLVGAARAAQLRQNYYGSSCPSAESTVRSVISQRLQQSFAVGPGTLRLFFHDCFVRGCDASVMLMAPNGDDESHSGADATLSPDAVDAINKAKAAVEALPGCAGKVSCADILAMAARDVVSLLGGPNYAVELGRLDGKTFNRAIVKHVLPGPGFNLDQLNSLFAQNGLTQTDMIALSGAHTIGVTHCDKFVRRIYTFKQRLAWNPPMNLDFLRSLRRVCPINYSPTAFAMLDVTTPKVFDNAYFNNLRYNKGLLASDQVLFTDRRSRPTVNVFAANSTAFYEAFIAAMAKLGRIGVKTGGDGEIRRVCTAVN

SEQ ID NO: 4589 - DNA, 1203 bp, Sorghum bicolor
  misc_feature: Ceres ANNOT ID no. 6038270
  misc_feature: Encodes the peptide sequence at SEQ ID NO 4590
atgatgaacttatcggctgccgccaacgccgcctgcgatgagttcccctacgtgccgtccaacgcgggcgccgctcccccttctctgctcccaatcatggaccaggagaacagcatccagagggagcatcatcatcagctgggctacaacctcgaggccaactccctggctctgctccccccgtccaacgccgccgccgcccaccaccaccaccaccacgccaccaccatcgccggccacagcccccacgacatccttcagttctaccctgcctccgcctcgcactaccttgctagcggcggcggcggcggcaacccctacagccacttcggctccgccgggaccgggagcaccttccaccagtcgtcgtactacccgccggcagcgcccgagtactacttccccaccctcgtcagctccgccgaggagaacatggccagcttcgccgccacgcagctggggctcaacctcaactaccggacctacttcccgccgagaggcgggtacacgtacggccaccacccgccgcgctgccaggccgagggatgcaaggccgatctctccagcgccaagcgctaccaccgccgacacaaggtgtgcgagcaccactccaaggcgcccgtcgtcgtcaccgccggtggactgcatcagaggttctgccagcagtgcagcagattccatctcctggatgagttcgatgatgccaagaagagctgcaggaaacgcctagcggaccacaaccgtcgtcgccgcaagtcaaagccatcggatgctgatgccggggacaagaaaagggcacatgggaacaaagcagctgctgctaaagacaaagcaggaagcagcagcaagaacatggacattggagatgggttgggtacacagatactgggaagtgcactcttgtccaaagaacaagatcaagccatggatcttggagaggtggtgaaagaagcagtggatcccaaggggaaggcatcaatgcaacagcatcacggcatccatcaacagcatcacggcttccccttccattcatcatcagcaggctcttgcttcccccagacccaagccgtctcgagtgataccacatcaaatatagctcaagtgcaagagccaagcttagggttccaccatcagcaccaccaccaacacagcaacatcttgcagctcggccaggctatgtttgatctcgacttcgatcactag

SEQ ID NO: 4590 - protein, 400 aa, Sorghum bicolor
  misc_feature: Ceres ANNOT ID no. 6038270
  misc_feature (177)..(256): Pfam Id: SBP Pfam Desc: SBP domain
  misc_feature (1)..(400): NCBI GI: 17940734 NCBI Desc: liguleless1 [zea mays]
  misc_feature (1)..(400): NCBI GI: 116309643 NCBI Desc: osigba0158d24.2 [oryza sativa (indica cultivar-group)]
  misc_feature (1)..(400): NCBI GI: 39545734 NCBI Desc: osjnba0071i13.12 [oryza sativa (japonica cultivar-group)]
  misc_feature (129)..(400): NCBI GI: 78609203 NCBI Desc: liguleless-like protein [hordeum vulgare]
  misc_feature (168)..(355): NCBI GI: 5931784 NCBI Desc: sbp-domain protein 4 [zea mays]
  misc_feature: The sequence is a functional homolog of SEQ ID NO 104 in the 10/666,642US patent application
  misc_feature: Useful for making plants with modulated growth and phenotype characteristics
  misc_feature: The sequence is a functional homolog of SEQ ID NO 104 in the 20070033671 US patent application
  misc_feature: Useful for making plants with altered terpenoid content
  misc_feature: Useful for making plants with modulated flowering time
  misc_feature: Functional homolog of the protein sequence given in SEQ ID NO 13706
  misc_feature: The sequence is a functional homolog of SEQ ID NO. 452 in the 11/188,298 US application
MMNLSAAANAACDEFPYVPSNAGAAPPSLLPIMDQENSIQREHHHQLGYNLEANSLALLPPSNAAAAHHHHHHATTIAGHSPHDILQFYPASASHYLASGGGGGNPYSHFGSAGTGSTFHQSSYYPPAAPEYYFPTLVSSAEENMASFAATQLGLNLNYRTYFPPRGGYTYGHHPPRCQAEGCKADLSSAKRYHRRHKVCEHHSKAPVVVTAGGLHQRFCQQCSRFHLLDEFDDAKKSCRKRLADHNRRRRKSKPSDADAGDKKRAHGNKAAAAKDKAGSSSKNMDIGDGLGTQILGSALLSKEQDQAMDLGEVVKEAVDPKGKASMQQHHGIHQQHHGFPFHSSSAGSCFPQTQAVSSDTTSNIAQVQEPSLGFHHQHHHQHSNILQLGQAMFDLDFDH

SEQ ID NO: 4591 - DNA, 1956 bp, Sorghum bicolor
  misc_feature: Ceres ANNOT ID no. 6038279
  misc_feature: Encodes the peptide sequence at SEQ ID NO 4592
atgaagcacctcgtggaggtggagccggcgaaggaggcggccggcggggcgccatcggcggggccgacgtaccgatgcgcggctgctgacaacggcgcgtcgccgcccgccttgccggggctcgacagctgctgggacatattccgcttgtccgtggagaagtaccccgacaacaacatgctgggccgccgcgaaattgtcgacgggaaggctggcagctacacatggctgacttacaagcaggtatacgacaccgtcctcaaggttggggctgccatccggagctgtggcgtcgccaagggcggccggtgcggcatctatggagccaattctcctgagtgggttatcagtatgcaggcctgcaatgcccttggcatttactgtgttccactgtatgacacgcttggtgccggggcagtagaattcgtattgtgccatgcagaggtacaaattgcttttgttgaggaaaagaagattggagagatggtcaagacatttcccaatgcaaccaaatatttgaagacaattgtaagcttcggtaaggttgatcttgggcacaaggaaaaagttgaacaaaatggcttgtccatctactcatgggaagagtttctgcaactgggaggtgaagagaagtttgaacttccacccaaggaaaaggatggcatatgcacaataatgtacaccagtgggacgactggtgatcccaagggagtactaatctcgaacaagagcattgttactattgtttcagcaatatatgagttccttagcaactcaaacgagcagcttcacgaggatgatgtttacatttcctatcttccacttgctcatatcttcgaccgggtgcttgaggaggtgttcattcaccatggtgcttcaatcgggttttggcgtggggatgtgaaactcttggttgaagacattggagaactcaaaccaacaatattttgtgctgttccacgtgttctgggcagaatttatgggggattgcaagataaaattacagctggtggtttcctgaagaaaaccttgttcaatgttgcttacaaatacaaactaggcaatatgttgaagggaagcaagcatgaagaggctgctgcagtctttgataaattggtcttcaccaaggtgaaatggggactaggtggaagggttcgactgattatatctggcggagctcccctatctagacatgttgaggagtatttgcgtgtggtgacatgctcccatgtccttcaagcatacggactcacggaaacctgtgggtccttcatttccctgccgaacaacatgtccatgttgggaactgttggccctccactcccacacgtcgaagtacgactggagtctgttcctgagatgggttatgatgcagtgtcgagcgaaacgcctcgtggtgaaatttgcatcaaaggggacaccttgttcttagggtactacaagcgagaggacctaacaaacgaagttttggtcgatggctggttccacacaggagacattggggagtggcagtttgacggaagcatgaagatcattgaccgcaagaagaacattttcaagctctcacaaggagagtatgttgcagtcgagaatatagagaacatctttggtcaaactcctggtgttgattcgatttgggtctacggcaacagcttcgagtcaagcttggttacagttgtgaaccctaacaagcaagcactggagcattgggcacagacaaacggggtaactggggactttgccacgatatgcgaagaccctaaagtgaaagagtttatcttgagagaacttacaaagacggggaaagaaaataagctcaaaggcttcgagctagtcagggctgttcacctagaccctgcaccgttcgacaaggaccgtgaccttatcaccccaacgtacaagaagaagcggccgcagctgctgaagcactatcaggtatggcgcagtttcaggtaa

SEQ ID NO: 4592 - protein, 651 aa, Sorghum bicolor
  misc_feature: Ceres ANNOT ID no. 6038279
  misc_feature (78)..(547): Pfam Id: AMP-binding Pfam Desc: AMP-binding enzyme
  misc_feature (1)..(645): NCBI GI: 115439199 NCBI Desc: os01g0681200 [oryza sativa (japonica cultivar-group)]
  misc_feature (4)..(645): NCBI GI: 74147576 NCBI Desc: acs-like protein [gossypium hirsutum]
  misc_feature (5)..(645): NCBI GI: 83320523 NCBI Desc: acs1 [ricinus communis]
  misc_feature (3)..(645): NCBI GI: 74147588 NCBI Desc: acs-like protein [gossypium hirsutum]
  misc_feature (2)..(645): NCBI GI: 1617270 NCBI Desc: acyl-coa synthetase [brassica napus]
MKHLVEVEPAKEAAGGAPSAGPTYRCAAADNGASPPALPGLDSCWDIFRLSVEKYPDNNMLGRREIVDGKAGSYTWLTYKQVYDTVLKVGAAIRSCGVAKGGRCGIYGANSPEWVISMQACNALGIYCVPLYDTLGAGAVEFVLCHAEVQIAFVEEKKIGEMVKTFPNATKYLKTIVSFGKVDLGHKEKVEQNGLSIYSWEEFLQLGGEEKFELPPKEKDGICTIMYTSGTTGDPKGVLISNKSIVTIVSAIYEFLSNSNEQLHEDDVYISYLPLAHIFDRVLEEVFIHHGASIGFWRGDVKLLVEDIGELKPTIFCAVPRVLGRIYGGLQDKITAGGFLKKTLFNVAYKYKLGNMLKGSKHEEAAAVFDKLVFTKVKWGLGGRVRLIISGGAPLSRHVEEYLRVVTCSHVLQAYGLTETCGSFISLPNNMSMLGTVGPPLPHVEVRLESVPEMGYDAVSSETPRGEICIKGDTLFLGYYKREDLTNEVLVDGWFHTGDIGEWQFDGSMKIIDRKKNIFKLSQGEYVAVENIENIFGQTPGVDSIWVYGNSFESSLVTVVNPNKQALEHWAQTNGVTGDFATICEDPKVKEFILRELTKTGKENKLKGFELVRAVHLDPAPFDKDRDLITPTYKKKRPQLLKHYQVWRSFR

SEQ ID NO: 4593 - DNA, 1122 bp, Sorghum bicolor
  misc_feature: Ceres ANNOT ID no. 6038300
  misc_feature: Encodes the peptide sequence at SEQ ID NO 4594
atggagcccacctcgtcggcgtcgatcgcgcggcagacgtgggagctggagaataacatccccgcggcggccaccgacccggacgcgatggacgcgatctaccgctacgacgactcggtgcaggcgagagcgcagcaggagaagccctgggccaacgacccgcaccacttccgccgcaccaagatctccgcgctcgcgctgctcaagatggtcgtccacgcccgcgccgggggcaccatcgaggtcatggggctcatgcagggcaagtgcgagggcgacgccatcatcgtcatggacgccttcgcgctccccgtcgagggcaccgagaccagggtcaatgcccaggccgatgcctacgagtacatggttgagtactcaaccatcaacaagcaggctgggaggttggagaatgtggttggctggtatcactcacaccctggttatggatgctggctgtcaggaatcgacgtgtcaactcagatgcttaaccaacaattcacagaaccattcttggctgttgtgatagaccccacaaggactgtttctgctggtaaagtggagattggagcttttaggacatacccaaaagattacaagccaccagatgagcctgtgtctgagtaccagactattccactcaacaagatagaagattttggagtccattgcaaatcgtactatgctttggatataacttatttcaagtcatccctggactctcacctccttgatctgctctggaacaaatactgggtcaacacactatcttcatcaccacttctaggcaacagggattatgttgctgggcagatctttgatttagctgataaactagagcaagctgaaggccagctggcacacagtcgatttggtggtatgattatgccatcacaacgaaagaaagagcaagaggagtctccactggctaaggtaacacgagatagctccaaaatcacagctgagcaggttcatggtctcatgtcacaggtcataaaagacatcctcttcaactctgtccacccctcaatcaaggcaagcacaagtgctccagattcatcaagtgctccggattcatcaagtgctccagattcatccggtcctgagcctatggttgaagcctaa

SEQ ID NO: 4594 - protein, 373 aa, Sorghum bicolor
  misc_feature: Ceres ANNOT ID no. 6038300
  misc_feature (55)..(169): Pfam Id: Mov34 Pfam Desc: Mov34/MPN/PAD-1 family
  misc_feature (1)..(373): NCBI GI: 38343968 NCBI Desc: osjnbb0022f16.7 [oryza sativa (japonica cultivar-group)]
  misc_feature (1)..(373): NCBI GI: 3420299 NCBI Desc: jab1 protein [oryza sativa subsp. indica]
  misc_feature (1)..(373): NCBI GI: 17025926 NCBI Desc: jun-activation-domain-binding protein homolog [oryza sativa]
  misc_feature (1)..(373): NCBI GI: 116309651 NCBI Desc: osigba0147j19.5 [oryza sativa (indica cultivar-group)]
  misc_feature (132)..(373): NCBI GI: 39545724 NCBI Desc: osjnba0071i13.2 [oryza sativa (japonica cultivar-group)]
  misc_feature: The sequence is a functional homolog of SEQ ID NO 12 in the 10/286,264US patent application
  misc_feature: The sequence is a functional homolog of SEQ ID NO 122 in the 10/286,264US patent application
  misc_feature: The sequence is a functional homolog of SEQ ID NO 1844 in the 10/412,699US patent application
  misc_feature: The sequence is a functional homolog of SEQ ID NO 190 in the 10/412,699US patent application
  misc_feature: The sequence is a functional homolog of SEQ ID NO 2088 in the 10/374,780US patent application
  misc_feature: The sequence is a functional homolog of SEQ ID NO 401 in the 11/479,226US patent application
  misc_feature: The sequence is a functional homolog of SEQ ID NO 766 in the 10/412,699US patent application
  misc_feature: The sequence is a functional homolog of SEQ ID NO 938 in the 10/225,066US patent application
  misc_feature: Useful for making plants with altered alkaloid content
  misc_feature: Useful for making plants with altered terpenoid content
  misc_feature: Useful for making plants with modulated growth and phenotype characteristics
  misc_feature: Useful for making plants with modulated low light sensitivity
  misc_feature: Functional homolog of the protein sequence given in SEQ ID NO 12892
  misc_feature: GREAT-hit functional homolog of the protein sequence given in SEQ ID NO 13056
  misc_feature: GREAT-hit functional homolog of the protein sequence given in SEQ ID NO 13186
  misc_feature: The sequence is a functional homolog of SEQ ID NO 12 in the 20030093837 US patent application
  misc_feature: The sequence is a functional homolog of SEQ ID NO 122 in the 20030093837 US patent application
  misc_feature: Useful for making plants with modulated light quality sensitivity
  misc_feature: Functional homolog of the protein sequence given in SEQ ID NO 13881
  misc_feature: The sequence is a functional homolog of SEQ ID NO 122 in the 10/286,264 US patent application
  misc_feature: The sequence is a functional homolog of SEQ ID NO 1844 in the 10/412,699 US patent application
  misc_feature: The sequence is a functional homolog of SEQ ID NO 2088 in the 10/374,780 US patent application
  misc_feature: The sequence is a functional homolog of SEQ ID NO 766 in the 10/412,699 US patent application
  misc_feature: The sequence is a functional homolog of SEQ ID NO 938 in the 10/225,066 US patent application
  misc_feature: Useful for making plants with altered terpenoid content
  misc_feature: Useful for making plants with modulated low light sensitivity
  misc_feature: Functional homolog of the protein sequence given in SEQ ID NO 13186
MEPTSSASIARQTWELENNIPAAATDPDAMDAIYRYDDSVQARAQQEKPWANDPHHFRRTKISALALLKMVVHARAGGTIEVMGLMQGKCEGDAIIVMDAFALPVEGTETRVNAQADAYEYMVEYSTINKQAGRLENVVGWYHSHPGYGCWLSGIDVSTQMLNQQFTEPFLAVVIDPTRTVSAGKVEIGAFRTYPKDYKPPDEPVSEYQTIPLNKIEDFGVHCKSYYALDITYFKSSLDSHLLDLLWNKYWVNTLSSSPLLGNRDYVAGQIFDLADKLEQAEGQLAHSRFGGMIMPSQRKKEQEESPLAKVTRDSSKITAEQVHGLMSQVIKDILFNSVHPSIKASTSAPDSSSAPDSSSAPDSSGPEPMVEA

SEQ ID NO: 4595 - DNA, 1317 bp, Sorghum bicolor
  misc_feature: Ceres ANNOT ID no. 6038309
  misc_feature: Encodes the peptide sequence at SEQ ID NO 4596
atggagactcctcaaatcgagatgggcggtttcaaggtcaacagcccgcaagtgcctaacggtgggttgcggcccaccgtgtcttcctcctggaactcgcgagggacggtcgagagggcgatcaagagcatcaggatcgtcgttttcacttccaagctcaacgtgctcatgccgttcggccctgcgtccatcattctccacttcacgactaggaggcatggattggttttccttttcagcatgctaggcataacacctttagcagagcgattgggatatgcaactgagcagcttgcaatatacactggtccaacagttggtggccttctgaatgctacatttggaaatgcaactgaaatgatcattgcaatatatgctttgaaaaatggaatgatccgagtagtgcagcagtcactattgggttccattttgtcaaatatgctgttggttatgggctgtgctttctttgctggtggtattgttcatcgcaacaaagaccaagtcttcagtaaggcaactgcagttgtcaactcaggtttactgctgatggctgtcatgggattgatgtttcctgccgttcttcattttactcattcagaagtgcggcaaggagcatcagaggttgctctttcaaggttcagtagttgtattatgcttgtggcgtacgcaagctatctctatttccaattaagtggacggagcaacatgtacagtccaataggcagtgaagagacgcctaatgaggatactgtggaagaagatgaagaagctgagattggcatgtgggaggcagtaacatggcttgcggtgttaacactctgggtgtcttttctttctgagtacctagttaacgccattgagggagcatctgattcattgaacctaccggtggcttttatcagtgttattttgcttcctattgtgggcaatgcagctgaacatgcaagcgcaataatgtttgccatgaaagataaacttgacataacactcggtgttgcaattggttcatcaacacagatatcaatgtttgtgattccattttgtgttgttattggttggatgatgggacataagatggacttgaattttcaactatttgagacagcaactctcttcataacagtacttgtggtggcatttatgctacaggatggcacggcgaactacttgaaaggacttatgctgattctgtgttatctaatagttgctgccagtttctttgttcatgttgatccacaatcgagtgagtatgctattttccttattccagcgccgcttcttctcctctccctgaagaccggactcgcgctgccataa

SEQ ID NO: 4596 - protein, 438 aa, Sorghum bicolor
  misc_feature: Ceres ANNOT ID no. 6038309
  misc_feature (82)..(229): Pfam Id: Na_Ca_ex Pfam Desc: Sodium/calcium exchanger protein
  misc_feature (273)..(406): Pfam Id: Na_Ca_ex Pfam Desc: Sodium/calcium exchanger protein
  misc_feature (8)..(416): NCBI GI: 14587811 NCBI Desc: ca2+/h+ antiporter [zea mays]
  misc_feature (1)..(416): NCBI GI: 73917678 NCBI Desc: vacuolar cation/proton exchanger 3 (ca(2+)/h(+) exchanger 3) (oscax3)
  misc_feature (8)..(416): NCBI GI: 37723957 NCBI Desc: calcium-proton antiporter [oryza sativa (japonica cultivar-group)]
  misc_feature (8)..(416): NCBI GI: 67906158 NCBI Desc: cation/h+ exchanger [hordeum vulgare]
  misc_feature (22)..(415): NCBI GI: 57157351 NCBI Desc: cation/proton exchanger 2 [oryza sativa (japonica cultivar-group)]
METPQIEMGGFKVNSPQVPNGGLRPTVSSSWNSRGTVERAIKSIRIVVFTSKLNVLMPFGPASIILHFTTRRHGLVFLFSMLGITPLAERLGYATEQLAIYTGPTVGGLLNATFGNATEMIIAIYALKNGMIRVVQQSLLGSILSNMLLVMGCAFFAGGIVHRNKDQVFSKATAVVNSGLLLMAVMGLMFPAVLHFTHSEVRQGASEVALSRFSSCIMLVAYASYLYFQLSGRSNMYSPIGSEETPNEDTVEEDEEAEIGMWEAVTWLAVLTLWVSFLSEYLVNAIEGASDSLNLPVAFISVILLPIVGNAAEHASAIMFAMKDKLDITLGVAIGSSTQISMFVIPFCVVIGWMMGHKMDLNFQLFETATLFITVLVVAFMLQDGTANYLKGLMLILCYLIVAASFFVHVDPQSSEYAIFLIPAPLLLLSLKTGLALP

SEQ ID NO: 4597 - DNA, 627 bp, Sorghum bicolor
  misc_feature: Ceres ANNOT ID no. 6038310
  misc_feature: Encodes the peptide sequence at SEQ ID NO 4598
atggccctcgcgctcgccacgaccccactcacgcacctcgccgttgcgccgctcccgatctccggctcccagtcctcgctgctgctgctcccgcgccgcgcgtcgcacgcccccgtctctctctccctccccctccggtcccgcctcatcgcggccgtcgcgaccaaggaggaacccgagctcggcggcggcggatcaggaggcgacgacggtgcgggagggagcggcggcggcggcggaagcgacccgaaggaaggagggcaggaaggggaaggggaggaagagaagatggagcagggcctgtccttgtcgcagaaactcactctcgcctacgccgcgctcgtcggagccggtggtgtaatgggatatatgaagagtggaagccagaaatccttggctgcaggaggcatatcagccctggttctgtacttcgtccatactcaactcccagtgcgacctgtctttgcatcgtcgatcggtttaggtatagcggctgcgcttctgtcagtgatggggtcgcgcttcaagaagtccgggaagatattcccagctggtgtcgtgtcccttgtatccctggtcatggtcggaggctacttccacgggatccttcgtagctcgcacgcgtga

SEQ ID NO: 4598 - protein, 208 aa, Sorghum bicolor
  misc_feature: Ceres ANNOT ID no. 6038310
  misc_feature (105)..(202): Pfam Id: TMEM14 Pfam Desc: Transmembrane proteins 14C
  misc_feature (1)..(208): NCBI GI: 32488879 NCBI Desc: osjnba0060d06.17 [oryza sativa (japonica cultivar-group)]
  misc_feature (107)..(200): NCBI GI: 55234950 NCBI Desc: ensangp00000014189 [anopheles gambiae str. pest]
  misc_feature (111)..(196): NCBI GI: 51593474 NCBI Desc: mgc85236 protein [xenopus laevis]
  misc_feature (111)..(195): NCBI GI: 90103444 NCBI Desc: transmembrane protein 14c-like [ictalurus punctatus]
  misc_feature (111)..(195): NCBI GI: 19705513 NCBI Desc: p11 protein [rattus norvegicus]
MALALATTPLTHLAVAPLPISGSQSSLLLLPRRASHAPVSLSLPLRSRLIAAVATKEEPELGGGGSGGDDGAGGSGGGGGSDPKEGGQEGEGEEEKMEQGLSLSQKLTLAYAALVGAGGVMGYMKSGSQKSLAAGGISALVLYFVHTQLPVRPVFASSIGLGIAAALLSVMGSRFKKSGKIFPAGVVSLVSLVMVGGYFHGILRSSHA

SEQ ID NO: 4599 - DNA, 648 bp, Sorghum bicolor
  misc_feature: Ceres ANNOT ID no. 6038316
  misc_feature: Encodes the peptide sequence at SEQ ID NO 4600
atggcaactgctcctgcaacatcctccgtggctacgaactccccctgcctgcggctgcctagcatgcccctgaggcgtgcacctggcgccatctcgttcccttctcgcccatggccagccacactgacctcatgcactggattgtcgcggcgctcagacgtggtcgccgccgcagggcaccagaagttgatgggatctttgaccaacaacgaggggctcaggtttggggtggttgtggcacggttcaacgaggtcgtgacaaatttgttactgcagggtgctctagaaactttcgagcgatactctgttaaagcagaaaatataacagttgttagtgttcctggaagctttgaagttcctataacggcacaaaagcttggcaaatctggaaaatttgatgcaattctgtgcattggagctgtgattagaggtgacacaacccactatgatgctgttgcaaactcagctgcatcaggtgtactcaatgctggattatctgctggtgttccttgtgtatttggtgttctaacctgtgaagacatggaccaggcgctaaaccgtgctggtggcaaggctggaaacaagggtgctgaaactgctcttactgccattgagatggcctctctgttccggcatcacttaggctga

SEQ ID NO: 4600 - protein, 215 aa, Sorghum bicolor
  misc_feature: Ceres ANNOT ID no. 6038316
  misc_feature (70)..(213): Pfam Id: DMRL_synthase Pfam Desc: 6,7-dimethyl-8-ribityllumazine synthase
  misc_feature (2)..(214): NCBI GI: 38345388 NCBI Desc: osjnba0067k08.17 [oryza sativa (japonica cultivar-group)]
  misc_feature (5)..(214): NCBI GI: 5532608 NCBI Desc: 6,7-dimethyl-8-ribityllumazine synthase precursor [nicotiana tabacum]
  misc_feature (5)..(214): NCBI GI: 33312438 NCBI Desc: 6,7-dimethyl-8-ribityllumazine synthase precursor [nicotiana tabacum]
  misc_feature (4)..(214): NCBI GI: 5532606 NCBI Desc: 6,7-dimethyl-8-ribityllumazine synthase precursor [spinacia oleracea]
  misc_feature (62)..(214): NCBI GI: 9954993 NCBI Desc: chain t, crystal structures of a pentameric fungal and an icosahedral plant lumazine synthase reveals the structural basis for differences in assembly
  misc_feature (51)..(214): SWISSPROT Homolog: EC 2.5.1.9 6,7-dimethyl-8-ribityllumazine synthase, chloroplast precursor
MATAPATSSVATNSPCLRLPSMPLRRAPGAISFPSRPWPATLTSCTGLSRRSDVVAAAGHQKLMGSLTNNEGLRFGVVVARFNEVVTNLLLQGALETFERYSVKAENITVVSVPGSFEVPITAQKLGKSGKFDAILCIGAVIRGDTTHYDAVANSAASGVLNAGLSAGVPCVFGVLTCEDMDQALNRAGGKAGNKGAETALTAIEMASLFRHHLG

SEQ ID NO: 4601 - DNA, 738 bp, Sorghum bicolor
  misc_feature: Ceres ANNOT ID no. 6038317
  misc_feature: Encodes the peptide sequence at SEQ ID NO 4602
atgggcgcgtcggcctccgtgttctcgctccccacggccgccgcgctccccgcagccgccaccgccgtcgccggggccgccggctgcttcgcgctgggctaccttctcgccctcacacgcctcccgcgccacgccgccgccccaggttctgggggcccctccgatgacgattccgaggatgactcggaagaagatgatgatgacgaaaactccggccgcagccgcgccgcgaagcgggcgggcggcgggcagaagaggaccgggctccggctgctctactgggcacggaacgtggtgaccaagtccgactcggccagggagacggagaggtcccagtctcaggccgccgccagccccctggagatcgagaaccttgctgagataatagaagatttcaaaatggtgctggtcgtgaggaatgatctgaagatgggtaaagggaagattgccgcacaatgcagccatgcaactcttgggctattcaaaaaactccaacagagagctccgaaatcactaagaaggtgggagcggtgtgggcaagttaaagtggttgtgaaagtagaaagcgaggaggatatgcttgttttacaagggagagcaaagtctttgaatctgccaactcacataaccatagacgctggaagaacacagattgctccaaattcaaggacagtcatggctattctggggccagctgatatggttgatgacgttactggcggtctgaagcttttgtag

SEQ ID NO: 4602 - protein, 245 aa, Sorghum bicolor
  misc_feature: Ceres ANNOT ID no. 6038317
  misc_feature (141)..(233): Pfam Id: PTH2 Pfam Desc: Peptidyl-tRNA hydrolase PTH2
  misc_feature (1)..(245): NCBI GI: 38345901 NCBI Desc: osjnba0060d06.11 [oryza sativa (japonica cultivar-group)]
  misc_feature (107)..(245): NCBI GI: 115492719 NCBI Desc: peptidyl-trna hydrolase 2, mitochondrial precursor [aspergillus terreus nih2624]
  misc_feature (112)..(244): NCBI GI: 119614800 NCBI Desc: peptidyl-trna hydrolase 2 [homo sapiens]
  misc_feature (112)..(244): NCBI GI: 62865879 NCBI Desc: bcl-2 inhibitor of transcription isoform a [homo sapiens]
  misc_feature (131)..(244): NCBI GI: 40889415 NCBI Desc: chain b, crystal structure of bit1
  misc_feature (112)..(244): SWISSPROT Homolog: EC 3.1.1.29 Peptidyl-tRNA hydrolase 2, mitochondrial precursor
MGASASVFSLPTAAALPAAATAVAGAAGCFALGYLLALTRLPRHAAAPGSGGPSDDDSEDDSEEDDDDENSGRSRAAKRAGGGQKRTGLRLLYWARNVVTKSDSARETERSQSQAAASPLEIENLAEIIEDFKMVLVVRNDLKMGKGKIAAQCSHATLGLFKKLQQRAPKSLRRWERCGQVKVVVKVESEEDMLVLQGRAKSLNLPTHITIDAGRTQIAPNSRTVMAILGPADMVDDVTGGLKLL

SEQ ID NO: 4603 - DNA, 888 bp, Sorghum bicolor
  misc_feature: Ceres ANNOT ID no. 6038319
  misc_feature: Encodes the peptide sequence at SEQ ID NO 4604
atgggcgtgctcctgcttgttcacgtcctcctcgtcgcggtggcggcgagcgctccggcggccgacgcatggggcaaggaggggcactacatggtgtgcaagatcgccgagagctttctgacggaagaggcctcgacggcggtgaaggagctgctgccggggtgggccggcggcgacctcgcggaggcgtgctcgtgggcggacacggtgaggttccggtacaaatggtccagccccctgcacttcgccgacacgccgggggactgcgagttcaactacgcccgggactgccacaacaccaaaggagagaaggacatgtgcgtggttggagccatcaacaactacaccgcggcgctcaaagactcatcaagtccatgtaagcactcattcgatgatccgagcgagagcctgatgttcctggcgcacttcgtcggcgacatccaccagccgctccactgcggccacaccgacgacctcggcggcaacaccatcaaagtccattggtacaggaggcagagcaaccttcacaaggtatgggatgtgaacgtcatcgagaccgccatgaaggacttctacgacaatgatcagagcaccatgatacaggccatccagcagaacatcacggaggagtgggctaacgaagagaagcagtgggagacgtgccgtagccggacaaagacttgcgctgaaaagtacgctgcagagagcgcgaagctggcatgcacggcgtacgagggtgtcgagcaggaatccaccttagaagatgactacttcttcgctgcactgccggtggttcagaagaggattgctcaagggggtgtccggctggccgcaatactaaacaagatatttggtgggaagagcaggcttcagattcagagcagttga

SEQ ID NO: 4604 - protein, 295 aa, Sorghum bicolor
  misc_feature: Ceres ANNOT ID no. 6038319
  misc_feature (24)..(285): Pfam Id: S1-P1_nuclease Pfam Desc: S1/P1 Nuclease
  misc_feature (4)..(295): NCBI GI: 38345900 NCBI Desc: osjnba0060d06.10 [oryza sativa (japonica cultivar-group)]
  misc_feature (1)..(291): NCBI GI: 5672692 NCBI Desc: nuclease i [hordeum vulgare]
  misc_feature (1)..(291): NCBI GI: 3242403 NCBI Desc: endonuclease [hordeum vulgare subsp. vulgare]
  misc_feature (17)..(284): NCBI GI: 4099835 NCBI Desc: bifunctional nuclease [zinnia elegans]
  misc_feature (9)..(285): NCBI GI: 4099833 NCBI Desc: bifunctional nuclease [zinnia elegans]
MGVLLLVHVLLVAVAASAPAADAWGKEGHYMVCKIAESFLTEEASTAVKELLPGWAGGDLAEACSWADTVRFRYKWSSPLHFADTPGDCEFNYARDCHNTKGEKDMCVVGAINNYTAALKDSSSPCKHSFDDPSESLMFLAHFVGDIHQPLHCGHTDDLGGNTIKVHWYRRQSNLHKVWDVNVIETAMKDFYDNDQSTMIQAIQQNITEEWANEEKQWETCRSRTKTCAEKYAAESAKLACTAYEGVEQESTLEDDYFFAALPVVQKRIAQGGVRLAAILNKIFGGKSRLQIQSS

SEQ ID NO: 4605 - DNA, 966 bp, Sorghum bicolor
  misc_feature: Ceres ANNOT ID no. 6038332
  misc_feature: Encodes the peptide sequence at SEQ ID NO 4606
atggcgccctgccggcagaccttcgcccgctacaccatggcgctgctgtttgctgcggctgctgtctcagcgcagctctccaccgacttctacggtgagacatgccccgacgcgctggacatcattgagtccgccgtgagagccgctatctccaaggagtcccgcatgggggcctccctgctccgcctccatttccacgactgctttgtcaatggctgtgacgggtcagtgctgctcgacgacaccacgggcttcaccggcgagaagacggcgaagccgaacaagaactcgctccgtgggttcgacgtggttgacgacatcaaggcgcagctcgaggactcctgccagcagacggtctcctgcgccgacatcctcgccgtcgccgcccgcgactccgtcgtcgccctcggtgggcctacgtgggacgtggagctcggccgccgtgacgggacgacggcgagcctggacgacgcgaacaacgacctcccggcgccgaccctggacctcggcgacctcatcaaggccttcgccaagaagggcctgagcgcgaacgaaatgatcgcgctgtcgggcgggcacacgatcgggcaggcgcggtgcgtcaacttccgcggccgcctctacaacgagaccaccagcctggacgcgtcgctggcgtcgtcgctgaagccgcggtgcccgagcgcggacggcaccggcgacgacaacacgtcgccgctggacccggccacgtcctacgtcttcgacaacttctactacaggaacctgctgcggaacaagggcctgctccactcggaccagcagctcttcaacggcggctccgcggacacgcagaccacctcctacgcgtccgacaaggccggcttcttcgatgatttccgcgacgccatggtgaagatgggtgccatcggcgtcgtcactgggtccggagggcaggtcaggctgaactgccggaagacgaactaa

SEQ ID NO: 4606 - protein, 321 aa, Sorghum bicolor
  misc_feature: Ceres ANNOT ID no. 6038332
  misc_feature (42)..(285): Pfam Id: peroxidase Pfam Desc: Peroxidase
  misc_feature (1)..(321): NCBI GI: 38345909 NCBI Desc: osjnbb0059k02.17 [oryza sativa (japonica cultivar-group)]
  misc_feature (6)..(321): NCBI GI: 55701129 NCBI Desc: tpa: class iii peroxidase 131 precursor [oryza sativa (japonica cultivar-group)]
  misc_feature (8)..(321): NCBI GI: 55701139 NCBI Desc: tpa: class iii peroxidase 136 precursor [oryza sativa (japonica cultivar-group)]
  misc_feature (15)..(321): NCBI GI: 34393250 NCBI Desc: peroxidase [oryza sativa (japonica cultivar-group)]
  misc_feature (15)..(321): NCBI GI: 2429288 NCBI Desc: peroxidase [oryza sativa]
  misc_feature (23)..(321): SWISSPROT Homolog: EC 1.11.1.7 Cationic peroxidase 1 precursor
  misc_feature: Useful for making plants with altered cell wall content and/or composition
  misc_feature: Functional homolog of the protein sequence encoded by LOCUS at5g05340
  misc_feature: Useful for making plants with altered cell wall content and/or composition
  misc_feature: Functional homolog of the protein sequence given in SEQ ID NO 13605
  misc_feature: Useful for making plants with altered carbohydrate content
  misc_feature: Functional homolog of the protein sequence given in SEQ ID NO 13606
  misc_feature: Useful for making plants with modulated oxidative stress sensitivity
  misc_feature: Functional homolog of the protein sequence given in SEQ ID NO 13607
MAPCRQTFARYTMALLFAAAAVSAQLSTDFYGETCPDALDIIESAVRAAISKESRMGASLLRLHFHDCFVNGCDGSVLLDDTTGFTGEKTAKPNKNSLRGFDVVDDIKAQLEDSCQQTVSCADILAVAARDSVVALGGPTWDVELGRRDGTTASLDDANNDLPAPTLDLGDLIKAFAKKGLSANEMIALSGGHTIGQARCVNFRGRLYNETTSLDASLASSLKPRCPSADGTGDDNTSPLDPATSYVFDNFYYRNLLRNKGLLHSDQQLFNGGSADTQTTSYASDKAGFFDDFRDAMVKMGAIGVVTGSGGQVRLNCRKTN

SEQ ID NO: 4607 - DNA, 2457 bp, Sorghum bicolor
  misc_feature: Ceres ANNOT ID no. 6038333
  misc_feature: Encodes the peptide sequence at SEQ ID NO 4608
atgccgacgcggccctcctccacccccgcttcccgattcctccagctattcctggtcgtcgtgatcgcctgcgccgttccgggggtgagatgctccgaccggcggttcccgcacctcgaccgcgtccgcaagctccaccgccgggagggctcgtcatcggccgagcaggaggccgccgcgcggggacttctcgcgcgcctcctaccgtcacactccaccagcttcgagttcagggtcatctccacggaacaatgtggtgggaaggcatgtttcatcatcaacaaccacccgttgtttgatgaagggactacagaaatattgatactcggagcaagtggggtggaaatttctgctggctttcattggtacttgaaacactactgtgcagcacatatatcttggtataaaaccggtggtgcacaactatcatccattccgcgtcctgggtcactacctcgtgttcctgatggtggtgtattgattcaaagacccattgactggagctactaccagaacgcagtttcatccagctattcttttgcttggtgggattgggagcgctgggagaaggaaattgactggatggctcttcaaggaatcaatttgcctcttgctttcactgggcaagagtctatatggcagagggtttttcagaggtacaacattagcaaatcagatctggatgatttctttggtgggccagcctttcttgcatggtctcgaatggctaatatgcatggatggggtggacctctccctcagacttggcttgatgaccaactagctcttcaaaagaaaatcctatctaggatgtacgcttttggcatgttcccagttcttccagccttttctggcaacatcccagctgcattaaagtcaaaattcccttcagctaaagtcactcaccttggaaactggtttacagttgacagcaatccaaggtggtgctgcacatatcttcttgatgcatctgatcctttattcgtagaaattgggaagttgtttatagaagaacaaatcagagaatatggtaggacaagtcacatctacaactgtgatacttttgatgagaacactcctccactaagtgacccgaattatatatcttcgttgggtgctgcaacgtttaggggtatgcaaagcggtgacaacgatgctatttggttgatgcaaggttggttgtttacctatgatcctttctgggaacctccacaaatgaaggcactactgcattctgttcctgttggcaaaatgattgttcttgatctttacgctgaagttaaaccagtgtggataaattctgatcagttctatgattttgaaatgtatggtgttttggatgctttggcttctgggcctattgatgctcgattaagcgataactccacaatggttggagttggtatgtctatggaaggtattgagcaaaatcctattgtttatgaccttatgtcagaaatggccttccatcacagacaagttgatcttcaggtttgggtcgagacatatccaacaagaagatatggaaaaccagtgaagggactgcaagatgcttggtggattttatatcaaactttatataactgcacagatggtaaaaatgacaaaaatcgggacgtgatagtggccttcccagatgttgaaccttttgttattgagacaccagggttgtatgtgaatactagacaaatgtattctacaatgccatcgaagaattacatagggaaggatgcctctagtgatgcatatgatcatcctcatctatggtacgatactaatgccgttatccctgccctggaactttttcttcaacatggagatgaagtatctgacagcaacaccttcaggtatgaccttgtggatttgactcgtcaagttctggctaaatatgccaatgacgtttttctgaagatcatcgagagctacaaatcaaacaaaatgaatcaagtcaccatcctgtgcaagcactttctcaaccttgtaaatgatcttgacacactactatcctctcatgagggttttctgcttgggccttggttggaaagtgccaagggccttgcacgaaacagtgagcaagaaatacagtatgaatggaatgctagaacacaaattacaatgtggtttgacaacacggaaacaaaagcaagtttattgcgcgactatgcaaacaagtactggagtggcctgctgcgagattactatgggccaagggccgccatctacttcaagcacttgttattaagcatggagaagaatgcacctttcgcgctcgaggaatggaggagggaatggatcagcctcaccaacaactggcagagcgataggaaggtgttttcaaccacacctacaggagactctctgaacatatcatggtcgctttacataaagtacttaagcaacactgatccacttgagctagaaggtacaggctcccctgggaagtctgcaagcttataa

SEQ ID NO: 4608 - protein, 818 aa, Sorghum bicolor
  misc_feature: Ceres ANNOT ID no. 6038333
  misc_feature (100)..(797): Pfam Id: NAGLU Pfam Desc: Alpha-N-acetylglucosaminidase (NAGLU)
  misc_feature (9)..(808): NCBI GI: 38345908 NCBI Desc: osjnbb0059k02.16 [oryza sativa (japonica cultivar-group)]
  misc_feature (83)..(427): NCBI GI: 90399367 NCBI Desc: h0212b02.15 [oryza sativa (indica cultivar-group)]
  misc_feature (349)..(808): NCBI GI: 115460990 NCBI Desc: os04g0650900 [oryza sativa (japonica cultivar-group)]
  misc_feature (42)..(549): NCBI GI: 4160292 NCBI Desc: alpha-n-acetylglucosaminidase [nicotiana tabacum]
  misc_feature (48)..(547): NCBI GI: 14861378 NCBI Desc: lysosomal alpha-n-acetyl glucosaminidase [dromaius novaehollandiae]
MPTRPSSTPASRFLQLFLVVVIACAVPGVRCSDRRFPHLDRVRKLHRREGSSSAEQEAAARGLLARLLPSHSTSFEFRVISTEQCGGKACFIINNHPLFDEGTTEILILGASGVEISAGFHWYLKHYCAAHISWYKTGGAQLSSIPRPGSLPRVPDGGVLIQRPIDWSYYQNAVSSSYSFAWWDWERWEKEIDWMALQGINLPLAFTGQESIWQRVFQRYNISKSDLDDFFGGPAFLAWSRMANMHGWGGPLPQTWLDDQLALQKKILSRMYAFGMFPVLPAFSGNIPAALKSKFPSAKVTHLGNWFTVDSNPRWCCTYLLDASDPLFVEIGKLFIEEQIREYGRTSHIYNCDTFDENTPPLSDPNYISSLGAATFRGMQSGDNDAIWLMQGWLFTYDPFWEPPQMKALLHSVPVGKMIVLDLYAEVKPVWINSDQFYDFEMYGVLDALASGPIDARLSDNSTMVGVGMSMEGIEQNPIVYDLMSEMAFHHRQVDLQVWVETYPTRRYGKPVKGLQDAWWILYQTLYNCTDGKNDKNRDVIVAFPDVEPFVIETPGLYVNTRQMYSTMPSKNYIGKDASSDAYDHPHLWYDTNAVIPALELFLQHGDEVSDSNTFRYDLVDLTRQVLAKYANDVFLKIIESYKSNKMNQVTILCKHFLNLVNDLDTLLSSHEGFLLGPWLESAKGLARNSEQEIQYEWNARTQITMWFDNTETKASLLRDYANKYWSGLLRDYYGPRAAIYFKHLLLSMEKNAPFALEEWRREWISLTNNWQSDRKVFSTTPTGDSLNISWSLYIKYLSNTDPLELEGTGSPGKSASL

SEQ ID NO: 4609 - DNA, 1413 bp, Sorghum bicolor
  misc_feature: Ceres ANNOT ID no. 6038338
  misc_feature: Encodes the peptide sequence at SEQ ID NO 4610
atggccaagcggctcgctgccgccgagaaagaggtgctcgtcgaggtggtgcggttcacgcagaagaacggcctcagaggctgtgacggcgggtggaaggatttcctggcccggaacgacaggaagtttggcgcgtcggtgagcgaccccaggaagcgcaccagggatgtgctgctcgccttcctgcaaaccttctccaaggatttccagaagtacttcggcaaattggtgaagcgtcataaggaaagaagtgatgttcagcagtatatgactgatttccctgatgaagtttctcccgagcagaaacttgttcaactgacggcagagcacccggagtacagaaaacactactgcttcccatcataccaggaggggtggaaagtattgaggataggagaagtctctagtttaatgagctcaagtgctatgttggcaattgactgtgagatggtcctttgcagtgatggcacagaggctgtggtcagagtatgtgttgtagatgacaagctcaaggctaagctggacatacttgtaaacccctcaaaagctattgctgactacagaacagacatcactggtgtatctaagaatgatttagaaggagtcacatcatcattagttgatgttcagaaatcgctgaagagaatgttatcgaaaggaaatattttgattggccatagcttgcatagagatttatgcgtcttaaagcttgattactctcaagttattgatacagcatacatatttaagtatgcaaatttacctactactgcatcaccttccttaaacagtttgtgcaaggctattctggggtattctgttcgagaagaaggagaaccacataattgcttaaaggatgcagaagctgcgatgaatctagttcttgcaaaacttaagaatgggtttaatgaccccattgaaattgctgcaagtagtgtaattgaatctgatgtggtgaagttgcttgctcatagaattccagtgtacctgccttgccaagagctgtgcaaaattttctctgggaccccaacattgatgacaagattgattcgcgtatacgaggactcaggtgggagacttcaaaagcatgtagtgctgaagcgtgacaatggagatgtcgtaagcttctacgttcggaagatggtatacggttcctggcccaaacagctcgaagttccaaagaatagaccagagcctacggaggattcagagccaaagaaagagcatgccgagggagttcagcaaaaaaagaagagaaataacttcgtgagagataatgaggatccagagccaaagaggagaccagagcctactttggatccagagccaaagaaagatcatgccgagggggttcagcaaaagaagaagagaagtaaaaaacacacagacaaggaaaatgcgtcggtggtgtaa

SEQ ID NO: 4610 - protein, 470 aa, Sorghum bicolor
  misc_feature: Ceres ANNOT ID no. 6038338
  misc_feature (143)..(294): Pfam Id: Exonuc_X-T Pfam Desc: Exonuclease
  misc_feature (1)..(469): NCBI GI: 115460984 NCBI Desc: os04g0650600 [oryza sativa (japonica cultivar-group)]
  misc_feature (1)..(345): NCBI GI: 126352268 NCBI Desc: at3g50100 [arabidopsis thaliana]
  misc_feature (143)..(314): NCBI GI: 42568083 NCBI Desc: exonuclease family protein [arabidopsis thaliana]
  misc_feature (34)..(301): NCBI GI: 4056553 NCBI Desc: spac637.09 [schizosaccharomyces pombe]
  misc_feature (112)..(308): NCBI GI: 44985463 NCBI Desc: agl332wp [eremothecium gossypii]
MAKRLAAAEKEVLVEVVRFTQKNGLRGCDGGWKDFLARNDRKFGASVSDPRKRTRDVLLAFLQTFSKDFQKYFGKLVKRHKERSDVQQYMTDFPDEVSPEQKLVQLTAEHPEYRKHYCFPSYQEGWKVLRIGEVSSLMSSSAMLAIDCEMVLCSDGTEAVVRVCVVDDKLKAKLDILVNPSKAIADYRTDITGVSKNDLEGVTSSLVDVQKSLKRMLSKGNILIGHSLHRDLCVLKLDYSQVIDTAYIFKYANLPTTASPSLNSLCKAILGYSVREEGEPHNCLKDAEAAMNLVLAKLKNGFNDPIEIAASSVIESDVVKLLAHRIPVYLPCQELCKIFSGTPTLMTRLIRVYEDSGGRLQKHVVLKRDNGDVVSFYVRKMVYGSWPKQLEVPKNRPEPTEDSEPKKEHAEGVQQKKKRNNFVRDNEDPEPKRRPEPTLDPEPKKDHAEGVQQKKKRSKKHTDKENASVV

SEQ ID NO: 4611 - DNA, 1395 bp, Sorghum bicolor
  misc_feature: Ceres ANNOT ID no. 6038352
  misc_feature: Encodes the peptide sequence at SEQ ID NO 4612
atgggcgcctccaccaccacgtcgctggcggcggcggcggcagcgctgctgctgctcgtgtcgctcgccgcggcggcggacatgtcgatcatctcctacggggagcggagcgaggaggagacgcggcggatgtacgcggagtggatggcgacgcacggccggacctacaacgccatcggcgaggaggagaggcggtatcaggtgttcagggacaacctccgcatcatcgacgagcacaacgccgccgccgacgcgggcgtccactccttccgcctggggctcaaccgcttcgccgacctcaccaacgaagagtaccgcgccacctacctcggcgtcaggaccaagccgcagagggagaggaagctcagcgccaggtaccacgccgacgataacgaggacctgccggagtccgttgattggaggaccaagggcgccgtcgcggaggtcaaggaccagggcagctgcgggagttgctgggctttctcaacaatagcagctgtggaaggcatcaaccagattgttacgggcgacttgatctccttgtctgagcaggagcttgtcgactgtgacacttcatacaaccaggggtgcaatggaggtctgatggactatgcgtttgagttcatcatcaacaatggtggaatcgacacagagtctgattacccttacaagggcacagatggccggtgtgatgccaacaagaaaaacgcgaaggttgttactatcgacagctatgaagatgtaccagcgaacagtgagaagagtctgcagaaagcagttgcaaaccagcccgtcagtgttgctattgaggctggtggcaatgcatttcagctctacagctcgggtatcttcactggaaagtgtggaacagcgttggaccatggtgtcacggccgtcggctatggcacagagaatggaaaggactactggatcgttaagaactcatggggcagcagctggggcgagtccggttacatcaggatggagcgcaacatcaaggactccagcggcaagtgcggtatcgccgttgagccatcgtaccccctgaaggagggcgccaaccccccgaaccctggcccgactccgccgtcccccaccccagagcccagcgtctgcgacaactactactcgtgccctgagagcaccacctgctgctgcatctacgagtatggcaagtactgcttcgcctggggctgctgcccgctcgagggcgccacctgctgtgacgatcactacagctgctgcccccatgactaccccatctgcaacgtccagcagggaacctgcctcatgggcaaggacagcccactgtcagtgaaggctacgaagcgcaccctggccaagccgcactgggctttctctggcaacactgatggcatgaagagcagcgcttga

SEQ ID NO: 4612 - protein, 464 aa, Sorghum bicolor
  misc_feature: Ceres ANNOT ID no. 6038352
  misc_feature (134)..(349): Pfam Id: Peptidase_C1 Pfam Desc: Papain family cysteine protease
  misc_feature (45)..(105): Pfam Id: Inhibitor_I29 Pfam Desc: Cathepsin propeptide inhibitor domain (I29)
  misc_feature (384)..(431): Pfam Id: Granulin Pfam Desc: Granulin
  misc_feature (3)..(464): NCBI GI: 6682829 NCBI Desc: cysteine protease component of protease-inhibitor complex [zea mays]
  misc_feature (1)..(464): NCBI GI: 2425066 NCBI Desc: cysteine proteinase mir3 [zea mays]
  misc_feature (8)..(464): NCBI GI: 109939734 NCBI Desc: oryzain alpha chain precursor
  misc_feature (8)..(464): NCBI GI: 115460974 NCBI Desc: os04g0650000 [oryza sativa (japonica cultivar-group)]
  misc_feature (8)..(464): NCBI GI: 38345906 NCBI Desc: osjnbb0059k02.8 [oryza sativa (japonica cultivar-group)]
  misc_feature (8)..(358): SWISSPROT Homolog: EC 3.4.22.14 Actinidain precursor
  misc_feature (134)..(348): SWISSPROT Homolog: EC 3.4.22.15 Cathepsin L
MGASTTTSLAAAAAALLLLVSLAAAADMSIISYGERSEEETRRMYAEWMATHGRTYNAIGEEERRYQVFRDNLRIIDEHNAAADAGVHSFRLGLNRFADLTNEEYRATYLGVRTKPQRERKLSARYHADDNEDLPESVDWRTKGAVAEVKDQGSCGSCWAFSTIAAVEGINQIVTGDLISLSEQELVDCDTSYNQGCNGGLMDYAFEFIINNGGIDTESDYPYKGTDGRCDANKKNAKVVTIDSYEDVPANSEKSLQKAVANQPVSVAIEAGGNAFQLYSSGIFTGKCGTALDHGVTAVGYGTENGKDYWIVKNSWGSSWGESGYIRMERNIKDSSGKCGIAVEPSYPLKEGANPPNPGPTPPSPTPEPSVCDNYYSCPESTTCCCIYEYGKYCFAWGCCPLEGATCCDDHYSCCPHDYPICNVQQGTCLMGKDSPLSVKATKRTLAKPHWAFSGNTDGMKSSA

SEQ ID NO: 4613 - DNA, 1008 bp, Sorghum bicolor
  misc_feature: Ceres ANNOT ID no. 6038417
  misc_feature: Encodes the peptide sequence at SEQ ID NO 4614
atggacggcggcggcgcgggcgcgggcgtgggcggctcggagggggagctcacggcgcaggagacggcgctctacgaccgccagatccgcgtctggggcgtcgatgcccagaagagactaagtaagtcgcacgtgcttgtgtgcggcatgaacggaaccaccatcgagttctgcaagaatattgttctagctggagttggaagtttatccttgatggatgatcatgtagtcacagaagatgatctgaatgcaaattttctaattcctcctgatgagagcatatatggtggtagatctcgagccgaagtttgctgcgagtctttggtagatttcaatcctatggttcgagtttctgttgaaaagggtgatccatcactaattgatggagaattccttgacaagtttgacattgttgtacttagccgtgcatctcttaaaacaaagttgtttattaatgaaaactgccgaaagagaagcaaacacattgcattttatactatagattgcaaggattcatgtggtgagatatttgttgatttacagaagcatagctatgttcagaaaaagcctggaggatcaactgaacaacaggagttgacatatcctagtcttcaggaagctatctctgtaccgtggagtaatctaccgaagaagacatcaaaattatacttcgccatgagagtactggaggattatgaattatctgaagggcgcagccctggcgaaacaactctttctgatatacatgcagttttggctcggaggaaggatatgtgtgataaaatgtctttgaatgagtctcgtattcctacaactctcgtggaacgactgctagcagctggaaagaaggaacatcctcctgtatgtgctatcctaggtggtattcttggtcaggaggtgattaaatcaatatcctgcaagggtgatccagtcaagaatttcttctattttgatgtggctgatggcaaaggtgtcatcgaggatatcccaccacctcctgcaaactga

SEQ ID NO: 4614 - protein, 335 aa, Sorghum bicolor
  misc_feature: Ceres ANNOT ID no. 6038417
  misc_feature (41)..(178): Pfam Id: ThiF Pfam Desc: ThiF family
  misc_feature (9)..(331): NCBI GI: 77550979 NCBI Desc: ubiquitin activating enzyme - like protein [oryza sativa (japonica cultivar-group)]
  misc_feature (16)..(329): NCBI GI: 23197772 NCBI Desc: ubiquitin activating enzyme - like protein [arabidopsis thaliana]
  misc_feature (16)..(329): NCBI GI: 22652852 NCBI Desc: sumo activating enzyme 1b [arabidopsis thaliana]
  misc_feature (16)..(329): NCBI GI: 7269344 NCBI Desc: ubiquitin activating enzyme-like protein [arabidopsis thaliana]
  misc_feature (16)..(329): NCBI GI: 21554965 NCBI Desc: ubiquitin activating enzyme [arabidopsis thaliana]
MDGGGAGAGVGGSEGELTAQETALYDRQIRVWGVDAQKRLSKSHVLVCGMNGTTIEFCKNIVLAGVGSLSLMDDHVVTEDDLNANFLIPPDESIYGGRSRAEVCCESLVDFNPMVRVSVEKGDPSLIDGEFLDKFDIVVLSRASLKTKLFINENCRKRSKHIAFYTIDCKDSCGEIFVDLQKHSYVQKKPGGSTEQQELTYPSLQEAISVPWSNLPKKTSKLYFAMRVLEDYELSEGRSPGETTLSDIHAVLARRKDMCDKMSLNESRIPTTLVERLLAAGKKEHPPVCAILGGILGQEVIKSISCKGDPVKNFFYFDVADGKGVIEDIPPPPAN

SEQ ID NO: 4615 - DNA, 462 bp, Sorghum bicolor
  misc_feature: Ceres ANNOT ID no. 6038496
  misc_feature: Encodes the peptide sequence at SEQ ID NO 4616
atgggcaagctgtggacgatcctatctcaccttcactccttagcagggccaactgtcactctgctttaccccttatatgcatcggtgcaggcgatggagagctcgtctaagctcgacgacgagcagtggctagcctactggatcctgtattcattcatcacactcatggagatgctcctgcagtctctaatctactggattcctgtttggtatgagttgaagctgctgttcatggcctggctggttcttccaaacttcaggggagcagcattcatctacaacaagtttgtgagggagcaggtgaaaaagcatatttctattcaggctgcaggtgctggcagcactagcaacaacaacgttactgctaacaaagataagaagatcgtttctacttctccaaaagagaagaagtccaaggggaagctactttccatggtcattccaaagaagctcaagttttga

SEQ ID NO: 4616 - protein, 153 aa, Sorghum bicolor
  misc_feature: Ceres ANNOT ID no. 6038496
  misc_feature (4)..(101): Pfam Id: TB2_DP1_HVA22 Pfam Desc: TB2/DP1, HVA22 family
  misc_feature (1)..(150): NCBI GI: 77551026 NCBI Desc: abscisic acid-induced-like protein [oryza sativa (japonica cultivar-group)]
  misc_feature (1)..(104): NCBI GI: 404589 NCBI Desc: a22
  misc_feature (1)..(104): NCBI GI: 57012614 NCBI Desc: hva22-like protein e (athva22e)
  misc_feature (21)..(118): NCBI GI: 7269346 NCBI Desc: abscisic acid-induced-like protein [arabidopsis thaliana]
  misc_feature (26)..(128): NCBI GI: 115476816 NCBI Desc: os08g0467500 [oryza sativa (japonica cultivar-group)]
MGKLWTILSHLHSLAGPTVTLLYPLYASVQAMESSSKLDDEQWLAYWILYSFITLMEMLLQSLIYWIPVWYELKLLFMAWLVLPNFRGAAFIYNKFVREQVKKHISIQAAGAGSTSNNNVTANKDKKIVSTSPKEKKSKGKLLSMVIPKKLKF

SEQ ID NO: 4617 - DNA, 945 bp, Sorghum bicolor
  misc_feature: Ceres ANNOT ID no. 6038585
  misc_feature: Encodes the peptide sequence at SEQ ID NO 4618
atgtcaatggcggccgccgccgccgccgcggcatcatccacgctgctgcgggcaagcaacatctctgtcgcgcgccccgtcccagtcgccgccggtcagcagctggtcccaagcggcgttgcctgctgcatccgcaccgtgagtgggcgcagagctgcggccgtgcgcgcggcagcggcaggcgatgggaccgccccggccggtgcccttccggcggcgctgttgttcgattgcgacggtgtgctggtggacaccgagaaggacggccaccgcatctccttcaacgaaaccttcgccgagaaggaattaggtgtgagctgggatgttgaactgtatggagaattgctcaagataggcggtggaaaggaaaggatgacagcttacttcaaccagacaggatggccagctaaagcaccaaagactgatgagcaaagaaaggagttcattgcttctcttcacaagaggaaaacagaactattcatggccctaattgagaaaaagttgcttcctctgcgtccaggtgttcaaaggttaattgatgaggctttaggaaaggcagttaaagttgcagtgtgcagtacatcaaatgagaaagctgtttcagcaatagtgtcatacttattggggcctgatagagctgaaaggattaccatatttgctggagatgtggttcctcgcaaaaaacctgacccagcaatctacatattagcagcaactacacttggagttgatccacaaagctgtgttgttgttgaagacagtactatagggcttgcagcggcaaaagctgccggcatgaagtgtatcgtaacaaaaagcggctacactgcagaagaggactttgagacagcggacgctgtgttcgattgcattggtgatccaccagaagtgcgcttcgatttggatttctgtgccaacttgctccagaaacaatatgtaagctga

SEQ ID NO: 4618 - protein, 314 aa, Sorghum bicolor
  misc_feature: Ceres ANNOT ID no. 6038585
  misc_feature (71)..(274): Pfam Id: Hydrolase Pfam Desc: haloacid dehalogenase-like hydrolase
  misc_feature (73)..(294): NCBI GI: 86608232 NCBI Desc: had-superfamily hydrolase, subfamily ia, variant 3 [cyanobacteria bacterium yellowstone b-prime]
  misc_feature (63)..(294): NCBI GI: 22298345 NCBI Desc: cbby family protein [thermosynechococcus elongatus bp-1]
  misc_feature (73)..(294): NCBI GI: 86606698 NCBI Desc: had-superfamily hydrolase, subfamily ia, variant 3 [cyanobacteria bacterium yellowstone a-prime]
  misc_feature (73)..(296): NCBI GI: 119489540 NCBI Desc: cbby family protein [lyngbya sp. pcc 8106]
  misc_feature (73)..(294): NCBI GI: 74056203 NCBI Desc: had-superfamily hydrolase subfamily ia, variant 3 [thiobacillus denitrificans atcc 25259]
MSMAAAAAAAASSTLLRASNISVARPVPVAAGQQLVPSGVACCIRTVSGRRAAAVRAAAAGDGTAPAGALPAALLFDCDGVLVDTEKDGHRISFNETFAEKELGVSWDVELYGELLKIGGGKERMTAYFNQTGWPAKAPKTDEQRKEFIASLHKRKTELFMALIEKKLLPLRPGVQRLIDEALGKAVKVAVCSTSNEKAVSAIVSYLLGPDRAERITIFAGDVVPRKKPDPAIYILAATTLGVDPQSCVVVEDSTIGLAAAKAAGMKCIVTKSGYTAEEDFETADAVFDCIGDPPEVRFDLDFCANLLQKQYVS

SEQ ID NO: 4619 - DNA, 1737 bp, Sorghum bicolor
  misc_feature: Ceres ANNOT ID no. 6038810
  misc_feature: Encodes the peptide sequence at SEQ ID NO 4620
atggcatacttccctgaggaagtagtggagtacatccttggctatgtaacctcacaccgggaccgcaacgccgcgtccttggtgtgccgggtatggtacgacattgagcgccgtggccgccgttcggtgcttgtaagcaactgctacgcggtgcacccagagcgtgtacatatgcggtttcccaacatgcgtgcactgagtgtgaagggtaaaccgcactttgctgacttcaaccttgtcccggcgggttggggtgccagtgcagagccatgggtggatgcgtgcgcccgtgcatgcccaggtcttgaggagctccggctgaagcgtatggttgtgactgatgaatgcctcaagttgctttcttgctcttttaccaactttgaatcacttgtccttgtctgctgcgaggggttcagtactgctgggcttgctaacattgccaccaattgcaggtttcttaaggaactcgacttacaagagagttgtgtgaaacatcaaggccatcagtggattaattgttttcccaagccttcaacatcactagaatgcttgaatttttcttgcttgactggggaggtaaatgccgttgcattggaggaacttgttgcaaggagtccaaatcttaaaagtttaaggctgaatccttcagttccaattgatgtcttgcccagaatcctttctcacacacctatgctagaggatttaggtacaggatcttttgtactaggcaataacgctggtgcatatatcagtctatacagagctcttggaaagtgcactttgctgaagagtttatctggtttttgggatgctccgggcttgtatgttcgaggaatgttgttgccgatttgcaggaccagggcccttacatgcctgaatctcagctatgctcctttgattcagagtgaccagcttatcagtattgttcgtcagtgtacaaggctccacgtcttatgggtattagatcacattggtgatgaaggattgaaggttttgtcctattcttgtcctgatcttcaggagttgagggtatatccaagtgatccaaatgctgcagcaagaactagtgtgacggaggaagggttggcagccatatctttctgtcggaagttagagtgtgtgctcttcttctgtgatcgaatgacaaatactgcgctcatcactatagcaaagtactgtccactgctaacatccttcagactatgcattctggagcctaggtcagcagatgctgtgacagggcagccactggacgaaggctttggggcaatagtgcagtcctgcaaaggcctgaggcgtttcgccatgtcgggcctcctcacggacagtgtgttcctgtacatcggcatgtacgcggagaagctggagatgctctccgtagcattcgcaggggatactgacgacggcatggtctacgtgctcaacggctgcaagaacctcaagaagctggaaatcagggacagcccctttggtgatgcggctctccttgcgggcgcgcacaggtacgagtcgatgcgctctctctggatgtcgtcctgcgagatcaccctgggggcctgcaagacccttgcggcggccatgccaaacatcaatgtcgaggtcatcagtgaggcgggggcgagcgttggtgcgacggatgatggcatcagcaatgcgaggaaggtggataagctatacctctaccggactatcgccggacccaggagcgatacgccaggattcgtttcgatattgtga

SEQ ID NO: 4620 - protein, 578 aa, Sorghum bicolor
  misc_feature: Ceres ANNOT ID no. 6038810
  misc_feature (1)..(575): NCBI GI: 110225915 NCBI Desc: auxin-responsive factor tir1-like protein [populus tomentosa]
  misc_feature (1)..(575): NCBI GI: 109729860 NCBI Desc: transport inhibitor response 1 [gossypium hirsutum]
  misc_feature (132)..(576): NCBI GI: 115485655 NCBI Desc: os11g0515500 [oryza sativa (japonica cultivar-group)]
  misc_feature (4)..(575): NCBI GI: 12658970 NCBI Desc: grr1-like protein 1 [arabidopsis thaliana]
  misc_feature (5)..(568): NCBI GI: 115462133 NCBI Desc: os05g0150500 [oryza sativa (japonica cultivar-group)]
  misc_feature: Useful for making plants with altered carbohydrate content
  misc_feature: Functional homolog of the protein sequence given in SEQ ID NO 13641
MAYFPEEVVEYILGYVTSHRDRNAASLVCRVWYDIERRGRRSVLVSNCYAVHPERVHMRFPNMRALSVKGKPHFADFNLVPAGWGASAEPWVDACARACPGLEELRLKRMVVTDECLKLLSCSFTNFESLVLVCCEGFSTAGLANIATNCRFLKELDLQESCVKHQGHQWINCFPKPSTSLECLNFSCLTGEVNAVALEELVARSPNLKSLRLNPSVPIDVLPRILSHTPMLEDLGTGSFVLGNNAGAYISLYRALGKCTLLKSLSGFWDAPGLYVRGMLLPICRTRALTCLNLSYAPLIQSDQLISIVRQCTRLHVLWVLDHIGDEGLKVLSYSCPDLQELRVYPSDPNAAARTSVTEEGLAAISFCRKLECVLFFCDRMTNTALITIAKYCPLLTSFRLCILEPRSADAVTGQPLDEGFGAIVQSCKGLRRFAMSGLLTDSVFLYIGMYAEKLEMLSVAFAGDTDDGMVYVLNGCKNLKKLEIRDSPFGDAALLAGAHRYESMRSLWMSSCEITLGACKTLAAAMPNINVEVISEAGASVGATDDGISNARKVDKLYLYRTIAGPRSDTPGFVSIL

SEQ ID NO: 4621 - DNA, 432 bp, Sorghum bicolor
  misc_feature: Ceres ANNOT ID no. 6038883
  misc_feature: Encodes the peptide sequence at SEQ ID NO 4622
atggccaccttgtccgccatctccgccaaggccggctactgcaaggcaccaacgctgagctggaagggaagcagagtttcagcccggaatgtggtctccatggcgaccacccggagaggaggcctcgtctccctaagatcccctcggtttcgcgtctacgcggcaaaggcggagacggtgagcaaggtgatggacatcgtgaagcagcagctggcgctggcggcggacgtggggctgacggcggagtccaagttcgcggacctgggcgccgactcgctggacacggtggagatcgtcatggcgctggaggaggagttcaagatcaccgtcgaggaggacaacgcccagagcatcaccaccatccaggaggccgccgacctcatcgacaagctcgtcgaccagaacccagcggcggcggcgccgccggcatga

SEQ ID NO: 4622 - protein, 143 aa, Sorghum bicolor
  misc_feature: Ceres ANNOT ID no. 6038883
  misc_feature (61)..(128): Pfam Id: PP-binding Pfam Desc: Phosphopantetheine attachment site
  misc_feature (1)..(138): NCBI GI: 21536937 NCBI Desc: acyl carrier-like protein [arabidopsis thaliana]
  misc_feature (1)..(134): NCBI GI: 51457938 NCBI Desc: acyl carrier protein [lycopersicon esculentum]
  misc_feature (46)..(137): NCBI GI: 37515400 NCBI Desc: acyl carrier protein 1 [cicer arietinum]
  misc_feature (1)..(134): NCBI GI: 1838961 NCBI Desc: acyl carrier protein [casuarina glauca]
  misc_feature (24)..(137): NCBI GI: 3293271 NCBI Desc: acyl carrier protein [fragaria x ananassa]
MATLSAISAKAGYCKAPTLSWKGSRVSARNVVSMATTRRGGLVSLRSPRFRVYAAKAETVSKVMDIVKQQLALAADVGLTAESKFADLGADSLDTVEIVMALEEEFKITVEEDNAQSITTIQEAADLIDKLVDQNPAAAAPPA

SEQ ID NO: 4623 - DNA, 1563 bp, Sorghum bicolor
  misc_feature: Ceres ANNOT ID no. 6039189
  misc_feature: Encodes the peptide sequence at SEQ ID NO 4624
atgctcccgccgttcggcaacccgctctgggtaccggaggacgtcaacgatcagcagcagcagcacgcgcctccgccgacgcccatggggttggtgacggtgccggcgcagcaggggcacgaggagcagaacctcctggccctggcctccgccgccgccatgggggtcggtggtgttttcagctcgccggcggtgctcgatgacgactggtgcttcgaccccgtggctgcggcctccgccgccggcgcgcaggggcacctgctactggcgccgccggcgccggcccccggcgccgggtcgcagatgttctcgctcttcaacgttggcggcgcgacgttcgacgtccacgggttcgacctcggcctcggtggcctcggcggcggggccggtggggaactggtcccgttcgccggcgccgggaacgcgtcgaattccgcgtccttttccctgataccggcagggaacgccggcttcctcggctcgttcggcggcttcggcacagcgccagcgcaaatgccggactttggcggcctcggcgggttcgacatgttcaacaacggcgccggctcctccaccgcggcgccccctcctgcctcggtgtccctgacggcgccgttctctgggcgcgggaaggctgctgtgctccgcccgctggagatcttcccgcccgtgggcgcgcagccgacgctgttccagaagcgcgcgctccgccggaacgccggcgaggaggacgacgacaagaagcgcaaggctgaggccatcaccgcggctgcgggagcttcgtcggctggtggcggtgacacggtgctggacgacgccgacgacgatgacggcgggagcatcgacgcgtccgggctcaactacgactcggaggacgccaggggcgtcgaggacagtgaaaagaaggacggtaaggattccaacgccaacagcacggtgacaggcggcagcaccggcgacgggaagggtaagaggaagggattgccggccaagaacctcatggcggagcgccgtcgccggaagaagcttaatgaccggctctacatgctccggtctgtcgtgcccaagatcagcaagatggacagggcctccattcttggcgacgcgatcgagtacctcaaggagctgctgcagaagatcaatgatcttcagaatgagctggagtcatccccttccacagcctcactgcctccaacacccacaagcttccacccactgactccgacactgcccactctaccatctcgtgtgaaggaagaggtgtgcccaagtgcattgcctagccctacttcccagcaaccaagggttgaggttaggatgagggaaggccgggcggtcaacatccacatgctctgtgctcgcaggcctggtcttctgctttctgctatgagggcgatcgaaggcctcggactcgatgtccagcaagctgttatcagttgcttcaatggattttccttggacatcttcaaggctgagctatgcaatgaaggccctgggcttctgccagaagagatcaagtccgtgctcctgcaatctgctgggttccatggcgtgatgccatga

SEQ ID NO: 4624 - protein, 520 aa, Sorghum bicolor
  misc_feature: Ceres ANNOT ID no. 6039189
  misc_feature (330)..(377): Pfam Id: HLH Pfam Desc: Helix-loop-helix DNA-binding domain
  misc_feature (193)..(516): NCBI GI: 115485687 NCBI Desc: os11g0523700 [oryza sativa (japonica cultivar-group)]
  misc_feature (104)..(519): NCBI GI: 125863280 NCBI Desc: inducer of cbf expression 1 [populus trichocarpa]
  misc_feature (294)..(519): NCBI GI: 15222101 NCBI Desc: basic helix-loop-helix (bhlh) family protein / f-box family protein [arabidopsis thaliana]
  misc_feature (247)..(519): NCBI GI: 45934582 NCBI Desc: inducer of cbf expression 1 protein [capsella bursa-pastoris]
  misc_feature (141)..(519): NCBI GI: 95106187 NCBI Desc: inducer of cbf expression 1 protein [populus suaveolens]
  misc_feature: The sequence is a functional homolog of SEQ ID NO 1378 in the 10/374,780US patent application
  misc_feature: The sequence is a functional homolog of SEQ ID NO 148 in the 10/225,068US patent application
  misc_feature: The sequence is a functional homolog of SEQ ID NO 1499 in the 10/412,699US patent application
  misc_feature: The sequence is a functional homolog of SEQ ID NO 216 in the 10/374,780US patent application
  misc_feature: The sequence is a functional homolog of SEQ ID NO 228 in the 10/225,066US patent application
  misc_feature: The sequence is a functional homolog of SEQ ID NO 42 in the 11/375,241US patent application
  misc_feature: The sequence is a functional homolog of SEQ ID NO 56 in the 10/286,264US patent application
  misc_feature: The sequence is a functional homolog of SEQ ID NO 714 in the 10/412,699US patent application
  misc_feature: The sequence is a functional homolog of SEQ ID NO 862 in the 11/435,388US patent application
  misc_feature: The sequence is a functional homolog of SEQ ID NO 96 in the 10/374,780US patent application
  misc_feature: The sequence is a functional homolog of SEQ ID NO 960 in the 10/374,780US patent application
  misc_feature: Useful for making plants with altered Lignin content
  misc_feature: Useful for making plants with modulated growth and phenotype characteristics
  misc_feature: Functional homolog of the protein sequence given in SEQ ID NO 12905
  misc_feature: The sequence is a functional homolog of SEQ ID NO 56 in the 20030093837 US patent application
  misc_feature: The sequence is a functional homolog of SEQ ID NO 1499 in the 20040045049 US patent application
  misc_feature: The sequence is a functional homolog of SEQ ID NO 96 in the 20060162006 US patent application
  misc_feature: The sequence is a functional homolog of SEQ ID NO 960 in the 20060162006 US patent application
  misc_feature: Useful for making plants with altered lignin content
  misc_feature: Functional homolog of the protein sequence given in SEQ ID NO 12905
  misc_feature: The sequence is a functional homolog of SEQ ID NO. 414 in the 11/188,298 US application
  misc_feature: The sequence is a functional homolog of SEQ ID NO. 483 in the 11/188,298 US application
MLPPFGNPLWVPEDVNDQQQQHAPPPTPMGLVTVPAQQGHEEQNLLALASAAAMGVGGVFSSPAVLDDDWCFDPVAAASAAGAQGHLLLAPPAPAPGAGSQMFSLFNVGGATFDVHGFDLGLGGLGGGAGGELVPFAGAGNASNSASFSLIPAGNAGFLGSFGGFGTAPAQMPDFGGLGGFDMFNNGAGSSTAAPPPASVSLTAPFSGRGKAAVLRPLEIFPPVGAQPTLFQKRALRRNAGEEDDDKKRKAEAITAAAGASSAGGGDTVLDDADDDDGGSIDASGLNYDSEDARGVEDSEKKDGKDSNANSTVTGGSTGDGKGKRKGLPAKNLMAERRRRKKLNDRLYMLRSVVPKISKMDRASILGDAIEYLKELLQKINDLQNELESSPSTASLPPTPTSFHPLTPTLPTLPSRVKEEVCPSALPSPTSQQPRVEVRMREGRAVNIHMLCARRPGLLLSAMRAIEGLGLDVQQAVISCFNGFSLDIFKAELCNEGPGLLPEEIKSVLLQSAGFHGVMP

SEQ ID NO: 4625 - DNA, 2565 bp, Sorghum bicolor
  misc_feature: Ceres ANNOT ID no. 6039190
  misc_feature: Encodes the peptide sequence at SEQ ID NO 4626
  misc_feature: Up-regulated in root tissues in response to methyl jasmonate treatment
  misc_feature: Up-regulated in shoot tissues in response to methyl jasmonate treatment
atgacttcggcggcggccgcggcccaggcggcgggagggggtggaggaggaggaggagtctgcgagggggatgccgctgccgcggcgcgaggcggaggcggaggcggaacggaggacggcatgtacacggagctctggagcctctgcgccggcccgctggtcacggtgcccagggtcggggacaaggtctactacttcccacagggccatatcgagcaggtggaggcatcgaccaaccaggtggctgagcagcacatgcaactttacaatctcccatggaagatcctgtgtgaggtcatgaatgttgaattgaaggctgagccggacaatgatgaggtttatgcccagctcactctgctacctgaatcgaagccagaggagaatggctctagtcaggaggagatgcctgctgcacctcctgctgcacttgcaaggccacgtgtgcactccttctgcaagacattgacagcctctgacaccagcacacatggtggtttctcggtgctgcgtcgccatgcagatgaatgccttccaccgctggatatgagtcgtcaacctccaacacaagagcttgtggccaaggatctgcatggtgtggaatggcgctttcgtcacatattcagaggtcaaccccgaaggcatcttttgcagagtggctggagtgtttttgttagtgcaaagcgtcttgttgctggggatgccttcatctttctgagaggtgataatggggagctgcgtgtgggagtcaggcgtgccatgaggcagcaagcaaatgttccgtcttcagtaatatcaagccacagcatgcatcttggtgttcttgctactgcatggcatgctgttaacactgggaccatgttcactgtctactacaaacctaggacaagtccagctgagtttgttgtcccctgtgatcgctatacggagtcactgaaacgaaattaccctatagggatgagatttaaaatgaggtttgaaggtgaagaggctccagagcaaaggttcactgggacgattgttggaaatgtggatcctgaacaagctggatgggctgaatctaaatggcgttacctcaaggtgaggtgggatgaagcttcctccattccacgtcctgaaagggtttctccttggcaaatagaacctgcagtcagccctccccctgtcaatccacttccagtacacaggcccaagaggcctcgctctaatgctgtagcttctctggctgagtcttcagctccaacaaaagaagctgctccgaaggtcacattagagactcaacaacatgccctgcaaaggcccttgcagacccaggataatgcggccccaaaaagtggttttggtgataacagtgagttggacgctgctcataagtcagccctgcgaccatcagggtttgatctagagaagaacaccattggcatgcagaggaagctgggttcagatagttggatgcatatgaacagacctgaaggatacaatgaaatgttatctggatatcaacaacctaataaagatgtacagaatccacagggtttctgttctttacctgatcagattgctgccggtcgtcctaatttctggcacaccgtaaatgctcattatcaagaccagcaaggcaatcacaatctattccctggttcatggtccatgatgccttcaagtactggctttgggttgaacagacagagctatccaatgatgcaggaagttggtgggttgtctcagagtgctacgaacaccaagtttgggaatggagcttatgctgcactacctggtcatggcattgatcaatactcttctggatggtttgggcacatgatacctggtgctcgcatggacgatgtccagccacgcgtgattaagcctcaacctttggtccttgctcatggtgaagctcagaaaatgaaaggcaattcatgcaagctttttggaattcaccttgatagcccagccaaatctgaacctttgaaatctccaccaagtgttgcctatgatgggatgccacaaactccagcagcagctgaatggcggatggttgattcaattgaagcagacagatgttctgatccacttaagatgccaaagcaactcgatgctacacaggtagatcctgttccagagaaatgttcacaagtttcaagaggcacacagtgcaaatcacaaggtggatcaactaggagctgcaagaaggtccacaagcaaggaatcgcacttggcaggtctgtggatcttacaaagttcaatggctacacggaattgattgctgagctggatgagatgtttgacttcaatggggagctgaaaggttctaacaaggaatggatggttgtgtacaccgacaatgaaggtgatatgatgctggttggggatgatccctggaatgagttctgcaacatggtccacaagatcttcatctacacaagggaggaggtccagaggatgaatccgggcaccctgaattcaaggtccgaggacagccttgctaattcaatggaaaggggctctactgctagggagacacctggcagcctatccgcctcttcccttgactctgagaactgctaa

SEQ ID NO: 4626 - protein, 854 aa, Sorghum bicolor
  misc_feature: Ceres ANNOT ID no. 6039190
  misc_feature (277)..(359): Pfam Id: Auxin_resp Pfam Desc: Auxin response factor
  misc_feature (150)..(255): Pfam Id: B3 Pfam Desc: B3 DNA binding domain
  misc_feature (625)..(818): Pfam Id: AUX_IAA Pfam Desc: AUX/IAA family
  misc_feature (31)..(854): NCBI GI: 23893346 NCBI Desc: auxin response factor 1 [oryza sativa (japonica cultivar-group)]
  misc_feature (30)..(853): NCBI GI: 85069279 NCBI Desc: auxin response factor 2 [lycopersicon esculentum]
  misc_feature (38)..(854): NCBI GI: 30027167 NCBI Desc: auxin response factor-like protein [mangifera indica]
  misc_feature (38)..(851): NCBI GI: 62319903 NCBI Desc: arf1-binding protein [arabidopsis thaliana]
  misc_feature (38)..(851): NCBI GI: 62319897 NCBI Desc: arf1-binding protein [arabidopsis thaliana]
  misc_feature: The sequence is a functional homolog of SEQ ID NO 108 in the 10/225,066US patent application
  misc_feature: The sequence is a functional homolog of SEQ ID NO 296 in the 10/412,699US patent application
  misc_feature: The sequence is a functional homolog of SEQ ID NO 692 in the 11/479,226US patent application
  misc_feature: The sequence is a functional homolog of SEQ ID NO 84 in the 10/374,780US patent application
  misc_feature: Useful for making plants with altered tocopherol content
  misc_feature: Useful for making plants with modulated biomass
  misc_feature: Useful for making plants with modulated growth and phenotype characteristics
  misc_feature: Useful for making plants with modulated seed size
  misc_feature: GREAT-hit functional homolog of the protein sequence given in SEQ ID NO 13376
  misc_feature: GREAT-hit functional homolog of the protein sequence given in SEQ ID NO 13377
  misc_feature: The sequence is a functional homolog of SEQ ID NO 296 in the 20040045049 US patent application
  misc_feature: Useful for making plants with modulated biomass
  misc_feature: Useful for making plants with modulated seed size
  misc_feature: Functional homolog of the protein sequence given in SEQ ID NO 13377
  misc_feature: The sequence is a functional homolog of SEQ ID NO 108 in the 10/225,066 US patent application
  misc_feature: The sequence is a functional homolog of SEQ ID NO 296 in the 10/412,699 US patent application
  misc_feature: The sequence is a functional homolog of SEQ ID NO 692 in the 11/479,226 US patent application
  misc_feature: The sequence is a functional homolog of SEQ ID NO 84 in the 10/374,780 US patent application
  misc_feature: The sequence is a functional homolog of SEQ ID NO 298 in the 10/412,699 US patent application
  misc_feature: The sequence is a functional homolog of SEQ ID NO 300 in the 10/412,699 US patent application
  misc_feature: Useful for biocontainment applications
  misc_feature: Useful for making plants with modulated flowering time
  misc_feature: Functional homolog of the protein sequence given in SEQ ID NO 13656
  misc_feature: The sequence is a functional homolog of SEQ ID NO 1003 in the 10/666,642 US patent application
  misc_feature: The sequence is a functional homolog of SEQ ID NO 1623 in the 10/374,780 US patent application
  misc_feature: The sequence is a functional homolog of SEQ ID NO 1656 in the 10/412,699 US patent application
  misc_feature: Up-regulated in root tissues in response to methyl jasmonate treatment
  misc_feature: Up-regulated in shoot tissues in response to methyl jasmonate treatment
MTSAAAAAQAAGGGGGGGGVCEGDAAAAARGGGGGGTEDGMYTELWSLCAGPLVTVPRVGDKVYYFPQGHIEQVEASTNQVAEQHMQLYNLPWKILCEVMNVELKAEPDNDEVYAQLTLLPESKPEENGSSQEEMPAAPPAALARPRVHSFCKTLTASDTSTHGGFSVLRRHADECLPPLDMSRQPPTQELVAKDLHGVEWRFRHIFRGQPRRHLLQSGWSVFVSAKRLVAGDAFIFLRGDNGELRVGVRRAMRQQANVPSSVISSHSMHLGVLATAWHAVNTGTMFTVYYKPRTSPAEFVVPCDRYTESLKRNYPIGMRFKMRFEGEEAPEQRFTGTIVGNVDPEQAGWAESKWRYLKVRWDEASSIPRPERVSPWQIEPAVSPPPVNPLPVHRPKRPRSNAVASLAESSAPTKEAAPKVTLETQQHALQRPLQTQDNAAPKSGFGDNSELDAAHKSALRPSGFDLEKNTIGMQRKLGSDSWMHMNRPEGYNEMLSGYQQPNKDVQNPQGFCSLPDQIAAGRPNFWHTVNAHYQDQQGNHNLFPGSWSMMPSSTGFGLNRQSYPMMQEVGGLSQSATNTKFGNGAYAALPGHGIDQYSSGWFGHMIPGARMDDVQPRVIKPQPLVLAHGEAQKMKGNSCKLFGIHLDSPAKSEPLKSPPSVAYDGMPQTPAAAEWRMVDSIEADRCSDPLKMPKQLDATQVDPVPEKCSQVSRGTQCKSQGGSTRSCKKVHKQGIALGRSVDLTKFNGYTELIAELDEMFDFNGELKGSNKEWMVVYTDNEGDMMLVGDDPWNEFCNMVHKIFIYTREEVQRMNPGTLNSRSEDSLANSMERGSTARETPGSLSASSLDSENC

SEQ ID NO: 4627 - DNA, 3048 bp, Sorghum bicolor
  misc_feature: Ceres ANNOT ID no. 6039226
  misc_feature: Encodes the peptide sequence at SEQ ID NO 4628
atgggccccgttcgactcgtcctcctcctcctcgccgccgtcttcgctgccgcgggcgtgggcgaggcggtgtacatcccctacaacacgtcggcgggggtggtgccggggaagctcaacgtgcacgtcgtgccgcacacccacgacgacgtcggctggctcaagaccgtggaccagtactacgtcggatccaacaactcaatccagggggcatgcgtgcagaacgtgctggattcgctcatcccggcgctgctcaaggacgagaaccgaaagttcatctatgttgagcaggcattcttccaaagatggtggaggaaccagaatgacatgatcaaggatacggtgaaagggctcatcagctctggacgaaatggtggcatgtgcatgcatgatgaggcggctgtacactacattgacatgatcgatcagactacacttgggcacaggtacatcaaggaggagtttggccagatcccacggattggctggcagattgatccgtttgggcactctgcagttcaggcttaccttcttggtgcagaagtaggatttgatgctttctatttcttccggattgattaccaagaccgtgatacacggaagggaacaaaagaacttgaggttgtatggaggggctccaagaccttgggctcatcagctgatatctttgctggcatctttccaaaaaactacgaaccacctcctggtgaattttattttgaagttgatgataattcccctgttgtccaggatgatccccttcttttcgattataatgttgaggaacgagtaaatgattttgttgctgcagctgtagcacaggcaaatatcacgaggacaaaccatatcatgtttacgatgggaacagacttcaaataccaatatgcagagagttggttcagaaatatggacaaactaattcactatgtgaacaaggatggccgtgtcaatgctctttattccacaccttcaatttataccgatgcgaaatatgctgcaaatgagctgtggcctctcaagactaatgatttcttcccatatgcagacaacccaaatgcctattggacagggtactttacaagcagacctgccttaaaacgatatgtccgcatgatgagtgggtattacctggcagctagacagctggagttctttaaagggagacatagctcaggtctctcaacagatagtctaggtgatgctctagctcttgcgcagcaccatgatgctgttacaggaacagagaaacaacatgttgcaaatgattatgcaaagagattgtcaattggatatacacaagcccaggagctcgtttcaacttctcttgcttgcttgacagagtcaggctcaaaatcgcattgctcatccccaatgacgaaattttcacaatgtcttctgctaaatgttacatattgccctccttctgagatggacttaacaaaaggaaaaagcttggttgttcttgtatacaactcgcttgggtggaaacgagaagacatccttcgtataccagttttcagtgattccattgttgttcatgattctgaaggaagagaaattgaatcacaacttctgcctatagctactgcctcgttgaacataagagacaagcatgtcaaggcttacctgggcacaacgccaggtgcaaagcccaagttttggcttgcttttcctgtgtctataccacctcttggtttcaatacttattttgtctcaaactcgaagaaatcagcacatatgtcttcaaagtccagtcagtactcacctcaaggaagtgaaagtagtaatctacaagttggtcaagggaacttgaaacttcaatataatgcagctggaacattatccctgtactccgatagtaagactcaggttcaagcaaattttgagcagaaatacaagtattacattggacaggatggaaatgcaactgatcctcaggcttctggagcatacatattccgccctaatggcacagttccaatcaagactgatgatcaggttcctcttacggttctgcgtgggcccatagtggatgaagtgcaccagcagataaattcatggatatatcagattaccagagtttacaaggggaaggactatgtggaaactgaatttatagttggacctataccagtagatgatggaaatgggaaagaattagcaactgaaattgttacaaacatggcgacaaacaaaacattttacactgattccagtggacgtgatttcatcaaaaggataagagattatcgatcggagtggaagattgaagtgcaccagcctattgctggaaactattatcctattaatcttggcatttatgtggaggatggcaacaaagagttgtctgtactggtagacaggtcaattggaggttccagtataaaggatggacaaatagaactaatgctacacaggaggctactccatgatgatgggcgaggcgtcgccgaggcgctaaatgaaacagtctgtctcgataagcaatgtgaaggactaattatacaaggaaaatactacgttaaaatagatccacaaggagaaggagctcggtggcgtcggacatttggccaggaaatatactctcctctcctccttgctttcacagagcaggatggaggcaactgggcgaattcgcatgttgcaaaattctctgccatggattcaacttacagcttgcctgataatgttgcaatgcttacccttgaggagcttgaagatggaagtgttctccttcggtttgctcatctatacgaggccggggaggacaaggatctttcagctttagcgagtattgacctcaagagagtgttcccagataataagattggcaagatcatcgagacaagcctatcggcaaaccaagaacgcacggccatggagaagaagcgcttgaagtggaaggtgcaaggttctgctgctgacgagaaggtggtccggggtggtcctgtggatccttctaagcttgttgttgagctggggccaatggagatccgcacattcatcgtcagtttcgatcacaacattagggacaaacagctgctctga

SEQ ID NO: 4628 - protein, 1015 aa, Sorghum bicolor
  misc_feature: Ceres ANNOT ID no. 6039226
  misc_feature (485)..(1002): Pfam Id: Glyco_hydro_38C Pfam Desc: Glycosyl hydrolases family 38 C-terminal domain
  misc_feature (40)..(349): Pfam Id: Glyco_hydro_38 Pfam Desc: Glycosyl hydrolases family 38 N-terminal domain
  misc_feature (353)..(427): Pfam Id: Alpha-mann_mid Pfam Desc: Alpha mannosidase, middle domain
  misc_feature (5)..(1015): NCBI GI: 77551210 NCBI Desc: alpha-mannosidase [oryza sativa (japonica cultivar-group)]
  misc_feature (22)..(1006): NCBI GI: 23198186 NCBI Desc: alpha-mannosidase [arabidopsis thaliana]
  misc_feature (22)..(1006): NCBI GI: 10177664 NCBI Desc: alpha-mannosidase [arabidopsis thaliana]
  misc_feature (9)..(1009): NCBI GI: 21360397 NCBI Desc: at3g26720/mlj15_12 [arabidopsis thaliana]
  misc_feature (22)..(919): NCBI GI: 79327811 NCBI Desc: alpha-mannosidase [arabidopsis thaliana]
MGPVRLVLLLLAAVFAAAGVGEAVYIPYNTSAGVVPGKLNVHVVPHTHDDVGWLKTVDQYYVGSNNSIQGACVQNVLDSLIPALLKDENRKFIYVEQAFFQRWWRNQNDMIKDTVKGLISSGRNGGMCMHDEAAVHYIDMIDQTTLGHRYIKEEFGQIPRIGWQIDPFGHSAVQAYLLGAEVGFDAFYFFRIDYQDRDTRKGTKELEVVWRGSKTLGSSADIFAGIFPKNYEPPPGEFYFEVDDNSPVVQDDPLLFDYNVEERVNDFVAAAVAQANITRTNHIMFTMGTDFKYQYAESWFRNMDKLIHYVNKDGRVNALYSTPSIYTDAKYAANELWPLKTNDFFPYADNPNAYWTGYFTSRPALKRYVRMMSGYYLAARQLEFFKGRHSSGLSTDSLGDALALAQHHDAVTGTEKQHVANDYAKRLSIGYTQAQELVSTSLACLTESGSKSHCSSPMTKFSQCLLLNVTYCPPSEMDLTKGKSLVVLVYNSLGWKREDILRIPVFSDSIVVHDSEGREIESQLLPIATASLNIRDKHVKAYLGTTPGAKPKFWLAFPVSIPPLGFNTYFVSNSKKSAHMSSKSSQYSPQGSESSNLQVGQGNLKLQYNAAGTLSLYSDSKTQVQANFEQKYKYYIGQDGNATDPQASGAYIFRPNGTVPIKTDDQVPLTVLRGPIVDEVHQQINSWIYQITRVYKGKDYVETEFIVGPIPVDDGNGKELATEIVTNMATNKTFYTDSSGRDFIKRIRDYRSEWKIEVHQPIAGNYYPINLGIYVEDGNKELSVLVDRSIGGSSIKDGQIELMLHRRLLHDDGRGVAEALNETVCLDKQCEGLIIQGKYYVKIDPQGEGARWRRTFGQEIYSPLLLAFTEQDGGNWANSHVAKFSAMDSTYSLPDNVAMLTLEELEDGSVLLRFAHLYEAGEDKDLSALASIDLKRVFPDNKIGKIIETSLSANQERTAMEKKRLKWKVQGSAADEKVVRGGPVDPSKLVVELGPMEIRTFIVSFDHNIRDKQLL

SEQ ID NO: 4629 - DNA, 699 bp, Sorghum bicolor
  misc_feature: Ceres ANNOT ID no. 6039428
  misc_feature: Encodes the peptide sequence at SEQ ID NO 4630
atggcggccaatgttggggaatcaacaagcggcagcagcagtggcgctgatgctgggggtagctttgagtgcaacatatgcttcgagctgccacaggagccgatcgtgacgctgtgcgggcacctcttctgctggccgtgcctctacaaatggttgcgcatccactcgcactcccccgagtgcccagtgtgcaaggccatcgtcgaggaggacaagctcgtccccctgtacggccgtggcaaggaccgtgtggacccaaggtcaaagaacgtccccggggcggcagacatccccaaccgtccggctggacagaggcctgccacggctccgcaggtcgaccccaacacccacttccccaacgccaacccgaacccgtggttcatgggcgggggcatcccgctggcgaacgcgcggtgggggaactacaccttctcggcggcattcgggggcctgttcccgctgctcagcttccaggtgcatgggttcccggacgccaccgcctatggccagcctgctgggttcccttacggatatggccacggccatggccatgcgttccatggcgggcatgctggaggacatgcccacgccgccgcagctcctcggcatgggcagcagcagcagcaggcggatgtgtacctcaaggcgctgctcatcctggttggctttctggtgattgcgagcctcatcacgttctag

SEQ ID NO: 4630 - protein, 232 aa, Sorghum bicolor
  misc_feature: Ceres ANNOT ID no. 6039428
  misc_feature (24)..(64): Pfam Id: zf-C3HC4 Pfam Desc: Zinc finger, C3HC4 type (RING finger)
  misc_feature (1)..(232): NCBI GI: 115440149 NCBI Desc: os01g0766200 [oryza sativa (japonica cultivar-group)]
  misc_feature (21)..(111): NCBI GI: 48095378 NCBI Desc: similar to cg8974-pc [apis mellifera]
  misc_feature (10)..(106): NCBI GI: 109451836 NCBI Desc: rnf185 [synthetic construct]
  misc_feature (10)..(106): NCBI GI: 119580350 NCBI Desc: ring finger protein 185, isoform cra_d [homo sapiens]
  misc_feature (10)..(106): NCBI GI: 119580348 NCBI Desc: ring finger protein 185, isoform cra_b [homo sapiens]
  misc_feature: The sequence is a functional homolog of SEQ ID NO 76 in the 10/666,642US patent application
  misc_feature: Useful for making plants with altered Lignin content
  misc_feature: Useful for making plants with modulated growth and phenotype characteristics
  misc_feature: Functional homolog of the protein sequence given in SEQ ID NO 12963
  misc_feature: The sequence is a functional homolog of SEQ ID NO 76 in the 20070033671 US patent application
  misc_feature: Useful for making plants with altered lignin content
  misc_feature: Functional homolog of the protein sequence given in SEQ ID NO 12963
  misc_feature: The sequence is a functional homolog of SEQ ID NO. 329 in the 11/188,298 US application
  misc_feature: The sequence is a functional homolog of SEQ ID NO. 424 in the 11/188,298 US application
MAANVGESTSGSSSGADAGGSFECNICFELPQEPIVTLCGHLFCWPCLYKWLRIHSHSPECPVCKAIVEEDKLVPLYGRGKDRVDPRSKNVPGAADIPNRPAGQRPATAPQVDPNTHFPNANPNPWFMGGGIPLANARWGNYTFSAAFGGLFPLLSFQVHGFPDATAYGQPAGFPYGYGHGHGHAFHGGHAGGHAHAAAAPRHGQQQQQADVYLKALLILVGFLVIASLITF

SEQ ID NO: 4631 - DNA, 981 bp, Sorghum bicolor
  misc_feature: Ceres ANNOT ID no. 6039433
  misc_feature: Encodes the peptide sequence at SEQ ID NO 4632
atggaggttgaggccgacgccgaggtgcggcactggaccgcggatgtcaacggcatttcgctccacgtcgccgagcgcggccccgccgacgggccggcggtcctcctcatccacggcttccctgagctctggctctcctggcgccaccagatggccgcgctcgccgcccgcggcttccgcgcgctggcccccgacctccgtggttacggcgactcgtccgtgcccaccgaccccgccgcctactccatcctccacatcgtcggcgacttggttgcgctccttgaccacctccaactcacaaaggtgttcgtggttgggcatgactggggcgcgcaggtggcgtggcacctctgcctgttccggccggaccgggtgcgcgccgccgttgtcctggggattccctacttcccgcgcggctctcgcccgttgacggacagatttgtcccgctcggtgatggctattacatcaatcagttcctggagccagggagaactgaaagggcatttgctcgctatgatgttgctacagtcctaaagaagttctacgccatggaaatcgatgagatacttgctcctcctggggtagagatcatagactttcttcaggcaccttcgtcgccaattccctggatgacagatgaagaactgggacagtttgccgaaaagtttgagaagactggcttcacaggacccctcaactactaccgcatgcttgtaacaaactggagactcactgcaccttggagtggatcgaaaatcacagtgcctgcaaaattcatactcagcaagaacgacgttggtctgcagtcctttggaactgaggagtacgtcaagagtggcggtttaaaggagaatgttccagatcttgaggtttcaatcattgagggacaccatttcgtccagcaagaagaggccgagagtgtgaattcggaaatactgtccttccttaacaagtttgccaccgagggaggatcagcatga

SEQ ID NO: 4632 - protein, 326 aa, Sorghum bicolor
  misc_feature: Ceres ANNOT ID no. 6039433
  misc_feature (59)..(314): Pfam Id: Abhydrolase_1 Pfam Desc: alpha/beta hydrolase fold
  misc_feature (8)..(319): NCBI GI: 46090793 NCBI Desc: soluble epoxide hydrolase [citrus jambhiri]
  misc_feature (9)..(319): NCBI GI: 124360004 NCBI Desc: epoxide hydrolase [medicago truncatula]
  misc_feature (11)..(319): NCBI GI: 25044843 NCBI Desc: epoxide hydrolase [ananas comosus]
  misc_feature (9)..(319): NCBI GI: 124360008 NCBI Desc: epoxide hydrolase [medicago truncatula]
  misc_feature (8)..(319): NCBI GI: 2764804 NCBI Desc: epoxide hydrolase [glycine max]
MEVEADAEVRHWTADVNGISLHVAERGPADGPAVLLIHGFPELWLSWRHQMAALAARGFRALAPDLRGYGDSSVPTDPAAYSILHIVGDLVALLDHLQLTKVFVVGHDWGAQVAWHLCLFRPDRVRAAVVLGIPYFPRGSRPLTDRFVPLGDGYYINQFLEPGRTERAFARYDVATVLKKFYAMEIDEILAPPGVEIIDFLQAPSSPIPWMTDEELGQFAEKFEKTGFTGPLNYYRMLVTNWRLTAPWSGSKITVPAKFILSKNDVGLQSFGTEEYVKSGGLKENVPDLEVSIIEGHHFVQQEEAESVNSEILSFLNKFATEGGSA

SEQ ID NO: 4633 - DNA, 972 bp, Sorghum bicolor
  misc_feature: Ceres ANNOT ID no. 6039434
  misc_feature: Encodes the peptide sequence at SEQ ID NO 4634
atggacgcaggcgaggtgcggcactggaacgcggacgtcaacggcgtctctatccacgtcgccgagcggggccccgaggatgggccggcggtgctcctcctccacggctttccggagctctggctctcgtggcgccaccagatggccgcgctcgccgcccgcgggttccgcgcgctggcccccgacctccgcggctacggcgactcctccgcgccgtccgaccccgccgcctactccatcttccacatcgtcggcgacgtcgtcgcgctccttgagcacctccaactcacaaaggtgttcgtggttgggcatgactggggcgcgcaggtggcgtggcacctctgcctgttccggccggacctggtgcgcgccgccgtcgttctgggggtaccgtacttcgctcgtcaccctcgcccggtcatggaggtcttcgcagcgtttggcgatggcttttacataaaccagttccaggagcctggaagagctgaaagctcatttgctcgttatgatgtggcgactgtcctaaaaaagttctattccattgaaatagataatctcagtgctccttctggagtggagatcatagactttctcgaggcatctccctcaccacttccttggatcagtgaggaagaactaggccaatatgctgaaaagtttcagaagtctgggttcactgcgcccctcaactactaccgcatgtgggagacgaattggaggcttcttgcaccctggaacggagccaagattacagtccctgtgaagttcataggtggtgataaggacatcggtgtccagtcctttgggactgagaagtacatcaacagcggggcattcaagtccattgttccagatcttgaagtcaccgtcattgaaggccaccattttctccagcaagagcaggccgagagggtgaattcggagatgatttcctacctcgtcaagtttactagccaggaggcatcatcttga

SEQ ID NO: 4634 - protein, 323 aa, Sorghum bicolor
  misc_feature: Ceres ANNOT ID no. 6039434
  misc_feature (56)..(311): Pfam Id: Abhydrolase_1 Pfam Desc: alpha/beta hydrolase fold
  misc_feature (5)..(316): NCBI GI: 46090793 NCBI Desc: soluble epoxide hydrolase [citrus jambhiri]
  misc_feature (8)..(316): NCBI GI: 25044843 NCBI Desc: epoxide hydrolase [ananas comosus]
  misc_feature (6)..(316): NCBI GI: 124360008 NCBI Desc: epoxide hydrolase [medicago truncatula]
  misc_feature (6)..(316): NCBI GI: 124360005 NCBI Desc: epoxide hydrolase [medicago truncatula]
  misc_feature (6)..(316): NCBI GI: 124360004 NCBI Desc: epoxide hydrolase [medicago truncatula]
MDAGEVRHWNADVNGVSIHVAERGPEDGPAVLLLHGFPELWLSWRHQMAALAARGFRALAPDLRGYGDSSAPSDPAAYSIFHIVGDVVALLEHLQLTKVFVVGHDWGAQVAWHLCLFRPDLVRAAVVLGVPYFARHPRPVMEVFAAFGDGFYINQFQEPGRAESSFARYDVATVLKKFYSIEIDNLSAPSGVEIIDFLEASPSPLPWISEEELGQYAEKFQKSGFTAPLNYYRMWETNWRLLAPWNGAKITVPVKFIGGDKDIGVQSFGTEKYINSGAFKSIVPDLEVTVIEGHHFLQQEQAERVNSEMISYLVKFTSQEASS

SEQ ID NO: 4635 - DNA, 1779 bp, Sorghum bicolor
  misc_feature: Ceres ANNOT ID no. 6039440
  misc_feature: Encodes the peptide sequence at SEQ ID NO 4636
atggcgcccatggccaccgcgacggcgttcgcggcgcaggtgctgcgggggcggtggttcatggcgtacggctccttcctcatcatgtcggctgccggcgccacctacatcttcgccgtctactccaaggacatcaagtcgacgctgggttacacgcaggagcagctcaacaccgtcggtttcttcaaggacgtcggcgccaacgtcggcatccacgccggcctcatcgccgagctcactccaccatggttagtcctggccctcggcgccgccatgaacctcggcggctacctcatgctctacctctccgtcacgggccgcggtggcgtcagcccggcggccacgccgctcttgctcgtctgcttctacatcgccgtcggcgccaactcccaggccttcgccaacaccggcgcgctcgtcacctgcgtcaagaacttcccggagagccgcggcgtcatgctcgggctcctcaagggcttcgtcggcctcagcggcgccatcttcacccagctctaccttgccttctacggccccggcggcggcggcgacaccagaccgctcatcctcctcgtgggctggctcccggctgccgtctccgtcgccttcctcgccaccatccggatcatacgcgcgccgcgctcgccggccgcggcacgccgggagtacggcgcgttctgtgccttcctctacgtgtcgctcgcgctcgccgcctaccttctcgtcgccatcgtcctgcagaagcggttccagttcacacggccagagtacgccgccagcgccgccgtcgtgttcctgatgctgctgcttccgctcggaatcgtcctgcgtgaggaggccacgctgttcaagtccaacatcaccaacacatcagctgaagagcaagcggcaacgacgccggctctgcccgcggtggccgcggcgacgaaacggccacctgcaccagcgacggggtgtcaaaggttgctgctttcgcttcgtccgccgccgcgcggcgaggactacacgatcctgcaggcgctggtgagcgtggacatgctgcttctgttcacggcgacggtgttcggggtgggcggcacgctgacggcgatcgacaacatgggccagatcggcgagtctctcggttacccgcagcggagcgtggccaccttcgtctccctcatcagcatctggaactacctgggccgcgtcgccgccggattcgcctcggaggcgctgctgtcccggcgccgcatcccacggccgctcatcctcgccggtgtgctcctgctcaccgtgccgggccacctactgatcgctttcggcgtgccggggtcgctgtacgtggcgtcggtggtgatcgggttctgcttcggcgccgcgcagccgctcatcctcgccaccgtgtcggagctgtttgggctcaggtactactccaccatgtacaacttctgcggcacggccagccccctggggtcctacgttctcaacgtccgcgtcgccggccgcatgtacgaccgcgaggcggcgcggcagaacgccccggcggcggccgggaagggggtcacgtgcattggcgtccggtgctacaaagagtccttcttggtcatcacggcggtcaccgtggccgcggcggtggtgacgctggcgctcgcatggaggactcgggagttctacgcgggagacatctacgccaagtttaagacggaaacagcttgtagttgtagcagtggtgatgatggtggtaatgctgccattgctggtgaagacaaggtccgagtacaagtagaacccaaggaataa

SEQ ID NO: 4636 - protein, 592 aa, Sorghum bicolor
  misc_feature: Ceres ANNOT ID no. 6039440
  misc_feature (18)..(275): Pfam Id: Nodulin-like Pfam Desc: Nodulin-like
  misc_feature (3)..(573): NCBI GI: 115489774 NCBI Desc: os12g0637800 [oryza sativa (japonica cultivar-group)]
  misc_feature (2)..(583): NCBI GI: 3402684 NCBI Desc: nodulin-like protein [arabidopsis thaliana]
  misc_feature (10)..(560): NCBI GI: 20259958 NCBI Desc: nodulin-like protein [arabidopsis thaliana]
  misc_feature (9)..(576): NCBI GI: 57545995 NCBI Desc: nitrate and chloride transporter [glycine max]
  misc_feature (10)..(562): NCBI GI: 140059352 NCBI Desc: nodulin-like [medicago truncatula]
  misc_feature: The sequence is a functional homolog of SEQ ID NO. 454 in the 11/188,298 US application
MAPMATATAFAAQVLRGRWFMAYGSFLIMSAAGATYIFAVYSKDIKSTLGYTQEQLNTVGFFKDVGANVGIHAGLIAELTPPWLVLALGAAMNLGGYLMLYLSVTGRGGVSPAATPLLLVCFYIAVGANSQAFANTGALVTCVKNFPESRGVMLGLLKGFVGLSGAIFTQLYLAFYGPGGGGDTRPLILLVGWLPAAVSVAFLATIRIIRAPRSPAAARREYGAFCAFLYVSLALAAYLLVAIVLQKRFQFTRPEYAASAAVVFLMLLLPLGIVLREEATLFKSNITNTSAEEQAATTPALPAVAAATKRPPAPATGCQRLLLSLRPPPRGEDYTILQALVSVDMLLLFTATVFGVGGTLTAIDNMGQIGESLGYPQRSVATFVSLISIWNYLGRVAAGFASEALLSRRRIPRPLILAGVLLLTVPGHLLIAFGVPGSLYVASVVIGFCFGAAQPLILATVSELFGLRYYSTMYNFCGTASPLGSYVLNVRVAGRMYDREAARQNAPAAAGKGVTCIGVRCYKESFLVITAVTVAAAVVTLALAWRTREFYAGDIYAKFKTETACSCSSGDDGGNAAIAGEDKVRVQVEPKE

SEQ ID NO: 4637 - DNA, 456 bp, Sorghum bicolor
  misc_feature: Ceres ANNOT ID no. 6039441
  misc_feature: Encodes the peptide sequence at SEQ ID NO 4638
atgcctcgcggcggccgcagctctgggggaggagggataagatcttattccagtgccaaaacagccaaagcgcctgcaccggcagccaagggtggcggcggcgctcctgctccagcaactagtaccggcggtggcggcggcggcggcttgttgagcaacgccgcatccgtgtttgctgagggatggatctggtgcaccagttgggccttggcaaacagggccatggatgctgtccttggcccccgtaccttccgcatcgaacacactgctgctgctgctactactacgaccaccagtcccagtgatgcgtcgtctagcccttgcgaaatccatgccatggccttccaagactgcatcaaccagaatgggagcgacatcagcaagtgccagttctacgtcaacattctcaatgactgccgccgcagaggccaagtcgccgccgaaacatccggatag

SEQ ID NO: 4638 - protein, 151 aa, Sorghum bicolor
  misc_feature: Ceres ANNOT ID no. 6039441
  misc_feature (101)..(142): Pfam Id: CHCH Pfam Desc: CHCH domain
  misc_feature (6)..(141): NCBI GI: 140071761 NCBI Desc: chch [medicago truncatula]
  misc_feature (30)..(142): NCBI GI: 87162756 NCBI Desc: p8mtcp1; chch [medicago truncatula]
  misc_feature (30)..(142): NCBI GI: 144922953 NCBI Desc: chch [medicago truncatula]
  misc_feature (13)..(106): NCBI GI: 37681676 NCBI Desc: merozoite surface protein 2 [plasmodium falciparum]
  misc_feature (14)..(106): NCBI GI: 37681702 NCBI Desc: merozoite surface protein 2 [plasmodium falciparum]
MPRGGRSSGGGGIRSYSSAKTAKAPAPAAKGGGGAPAPATSTGGGGGGGLLSNAASVFAEGWIWCTSWALANRAMDAVLGPRTFRIEHTAAAATTTTTSPSDASSSPCEIHAMAFQDCINQNGSDISKCQFYVNILNDCRRRGQVAAETSG

SEQ ID NO: 4639 - DNA, 1335 bp, Sorghum bicolor
  misc_feature: Ceres ANNOT ID no. 6039455
  misc_feature: Encodes the peptide sequence at SEQ ID NO 4640
atgccgccatggccgcagtgcctcctccagcccaccctcaccaccgctcgccgcgccacagccttctctaggacgacctgtctctcttctatccccgcctctccggcctacgagcaggggcaacacgaggaggagccgtcgttggtcgtggtggggggcggcgcggcgggcgtgtacgcctccataagggccaagacccttgctccgcgcctcaacgtcgcggtcgtcgagaaaggaaggttcttgtccaaggtcaagatctccggcggtggccgctgcaacgtgaccaatggccatcatattgagcccatgggcttggcgagaaattaccctaggggggacaaggagctccgaggatccttcttcaccactcacggtccgcaggataccatgcgctggttcacagaccacggtgtcgaccttaagacggaggacgatggcagagtcttccctgtcactgacaattcagcttcagttgtagactgtctactgaacgaagccggcaaagctgtgtctagtgcatctgttgctcaagatggaaagtttgttctcaaggttgagaagcgtacctctgattttgttgactatatcaatgctaactatgtcttggttgctacaggtagcagccaacagggttattcaattgctgcacagcttggtcattccattattgcaccagtgcccagcttgttcacatttaaaatcgcagacaagcggctggctgatctcgctggggttacatttcccatagtcaaagcaaagctgaagctggatggtgttcagaaaagtgttcccgaattaactcagactgggcctatgttagttacacactgggggcttagtgggcctgttgtgctgcggttgtcggcatggggagcacgtgaactacatcagtgcaactaccaaggaaagcttgtggttgattttgtacctgatattcatatcgaggacgtgaagcgcatcctattccagtacaaagatcagcatgcgagtttaaatggtgacacacactgggcctccatgccaaataatcatctaaatgcaatagcccttcggttgaaacaatggatgtttgagattgtcggaaagggccaatttaaagatgaatttgtgactgcaggaggtgttccaatttcagaggtatcacttggcactatggaaagcaagaaacagccaaatctgttctttgcaggagaggttcttaatgttgatggggtcacaggcggattcaattttcagaatgcatggaccggtgggtatatagctgggacgagcgtaggcacactggcatcgactagcaatctctcagagcagcagtcatgtttgcaattgtaa

SEQ ID NO: 4640 - protein, 444 aa, Sorghum bicolor
  misc_feature: Ceres ANNOT ID no. 6039455
  misc_feature (46)..(425): Pfam Id: HI0933_like Pfam Desc: HI0933-like protein
  misc_feature (46)..(328): NCBI GI: 75908716 NCBI Desc: fumarate reductase/succinate dehydrogenase flavoprotein-like [anabaena variabilis atcc 29413]
  misc_feature (47)..(328): NCBI GI: 119509198 NCBI Desc: fumarate reductase/succinate dehydrogenase flavoprotein-like protein [nodularia spumigena ccy9414]
  misc_feature (48)..(328): NCBI GI: 119489541 NCBI Desc: fumarate reductase/succinate dehydrogenase flavoprotein-like protein [lyngbya sp. pcc 8106]
  misc_feature (43)..(331): NCBI GI: 24213215 NCBI Desc: pyridine nucleotide-disulphide oxidoreductase [leptospira interrogans serovar lai str. 56601]
  misc_feature (43)..(319): NCBI GI: 81300876 NCBI Desc: hi0933-like protein [synechococcus elongatus pcc 7942]
MPPWPQCLLQPTLTTARRATAFSRTTCLSSIPASPAYEQGQHEEEPSLVVVGGGAAGVYASIRAKTLAPRLNVAVVEKGRFLSKVKISGGGRCNVTNGHHIEPMGLARNYPRGDKELRGSFFTTHGPQDTMRWFTDHGVDLKTEDDGRVFPVTDNSASVVDCLLNEAGKAVSSASVAQDGKFVLKVEKRTSDFVDYINANYVLVATGSSQQGYSIAAQLGHSIIAPVPSLFTFKIADKRLADLAGVTFPIVKAKLKLDGVQKSVPELTQTGPMLVTHWGLSGPVVLRLSAWGARELHQCNYQGKLVVDFVPDIHIEDVKRILFQYKDQHASLNGDTHWASMPNNHLNAIALRLKQWMFEIVGKGQFKDEFVTAGGVPISEVSLGTMESKKQPNLFFAGEVLNVDGVTGGFNFQNAWTGGYIAGTSVGTLASTSNLSEQQSCLQL

SEQ ID NO: 4641 - DNA, 2574 bp, Sorghum bicolor
  misc_feature: Ceres ANNOT ID no. 6039460
  misc_feature: Encodes the peptide sequence at SEQ ID NO 4642
atgcaaatgcccttctgttgggacaagcggagcccggctcatgcgccggcggacaaccacgtcgccatcaatggcaccgtcgtcgtctcctgccacttgggcctctcgtcgccggggaagaccaccacgctccggctcttcagcaccacgcagatggatcccaacacggggaaggggaagctgagcccggaggcgccgctgaggagcggcaagaagaccaaggcgaagcagggcgccgtgaagaccaccaccatgacgtaccaggtcaccttcttcgtggacgccgacttcggcacgccgggcgccgtcgtcgtcaagagcgggctcaggaacgaccacttcttcctccgccacgtgcaggtccacatgcccgaggccggccggaccatccacttcgagtgcaactcctgggtctaccccttcaagaagaccaacgccgaccgcgtcttcttcatcaacacgagctacctccctgacaagacgcccgaggcccttcgtctgctgcgcgacgaggagctgcggagcctccgtggcagcggccgcggcgagctcaaggactgggagcgcgtctacgactacgacttgtacaacgacctgggcaacccggacaaggaggagcacgcccgcccggtgctgggcggcatcacctccgtgtacccgtacccgcggcgctgccgcaccggccgccctctcttcaagaccgacggcgcgacggagacgcgcaagcacatgatcaacctcgacttctacatcccgccggacgagcggttcagccccaccaagctggcggaggtgctcacgctggcggtgcaggccgtcacccacttcgtcctcccggaatctaaggcgctcttccatggcaacatcaacagcttccggtccttggagcagctcaagggcgacctgtacaggaagccggtcgtggatgggcaggtggtcatggacaagctcaagacgtcggtgccgtcgcacaagacctacaagcaggtctccaagatggtcaaggagacgcccgtcaagttccccatccctcaagtcatccagaatgagccagaggcatggcgaagcgacgaggaattcgcgagggagatgctggcggggctgaacccggtggtgatcaagagactagaggtgttcccgccggtgagcagaggaggcaagcagagctccattaccgctgcgcatatcgagaggcaggggcagctcgaaggacgaacggtgcacaaggcattagatgagaagaggttgtatattcttgaccaccatgactacctgatgccgtacctgcggcgcatcaacacgcaggaacaaggggtgtgcgtgtacgcgtcgcgcacgctgctcttcctcaaggacgacggcaccctcaagcctctcgtcatagagctcagcctgcccagcgacggcgccggcgccgacggcgagatcagcagggtcttcctccctgcgagcccagggacgaccgatggacacctgtggtggcttgctaaggctcatgtctccgtcaatgattcaggctaccatcagctcatcagccactggttgttcactcacgcgacggtggagccgttcatcatcgccaccaagaggcagctgagcgccatgcacccgatccacaagctcctggagccacatttcaaggacaacatgcagatcaacacgctggccaggagcatcctgctcagcgcaggcggcatcctggagaggaccatgttcccggggaagtacgccatggagatgtcctccgccatctactccgagtggaggttcaccgaacagtccttgcccaacgacctcgtcaagagggggatggcgtcgtcgtccaacaaggatcaccttcacctgcacgtggaggactacccgtacgcggtggacggcatggacgtgtggcgcgccatcgacggctgggtgcggagctactgcgcccacttctaccactccgacgccgcggtcgccgccgacgccgagctgcaggcgtggtggcacgacgtgcgcaccgtcggccacggcgaccggcagcgcgaccgggcgtgctggctggacctcgacaccgtggccaacctcgtggagtcgctgtccacgctcatctggatcgcctccgcgctgcacgccgccgtcaacttcggccagtacggctacgcggggttcatgcccaaccgtcccacccggtgccgccggttcgtgccgctgccgggctccccggagatggcgcagctggaggccgacccggacaggttcttcctcgacaccgtgcccgaccgcttcaccaccacgctcggcctcacgctcatcgaggtgctctccaaccacacctccgacgagctctacctgggccagcgcgccaccgcgtcgtggaccgacgacggcgaggtgctgcagctgctcgacaggttccgggacgacctccggcgggtggagaagcgggtcacggagaggaacaaggacctgcggctcaagaaccgcaagggacccgccaaggtgccctacacgctgctcttcccggacgtcggcaatgtcggcgccaaggagaaggggatcaccggcaaagggatacccaacagcgtctccatatga

SEQ ID NO: 4642 - protein, 857 aa, Sorghum bicolor
  misc_feature: Ceres ANNOT ID no. 6039460
  misc_feature (162)..(835): Pfam Id: Lipoxygenase Pfam Desc: Lipoxygenase
  misc_feature (42)..(150): Pfam Id: PLAT Pfam Desc: PLAT/LH2 domain
  misc_feature (1)..(857): NCBI GI: 84626301 NCBI Desc: lipoxygenase [zea mays]
  misc_feature (1)..(857): NCBI GI: 115463087 NCBI Desc: os05g0304600 [oryza sativa (japonica cultivar-group)]
  misc_feature (39)..(857): NCBI GI: 16904543 NCBI Desc: lipoxygenase [corylus avellana]
  misc_feature (39)..(857): NCBI GI: 765203 NCBI Desc: linoleate:oxygen oxidoreductase; lipoxygenase; lox [solanum tuberosum]
  misc_feature (39)..(857): NCBI GI: 585419 NCBI Desc: lipoxygenase a
  misc_feature (39)..(857): SWISSPROT Homolog: EC 1.13.11.12 Lipoxygenase A
MQMPFCWDKRSPAHAPADNHVAINGTVVVSCHLGLSSPGKTTTLRLFSTTQMDPNTGKGKLSPEAPLRSGKKTKAKQGAVKTTTMTYQVTFFVDADFGTPGAVVVKSGLRNDHFFLRHVQVHMPEAGRTIHFECNSWVYPFKKTNADRVFFINTSYLPDKTPEALRLLRDEELRSLRGSGRGELKDWERVYDYDLYNDLGNPDKEEHARPVLGGITSVYPYPRRCRTGRPLFKTDGATETRKHMINLDFYIPPDERFSPTKLAEVLTLAVQAVTHFVLPESKALFHGNINSFRSLEQLKGDLYRKPVVDGQVVMDKLKTSVPSHKTYKQVSKMVKETPVKFPIPQVIQNEPEAWRSDEEFAREMLAGLNPVVIKRLEVFPPVSRGGKQSSITAAHIERQGQLEGRTVHKALDEKRLYILDHHDYLMPYLRRINTQEQGVCVYASRTLLFLKDDGTLKPLVIELSLPSDGAGADGEISRVFLPASPGTTDGHLWWLAKAHVSVNDSGYHQLISHWLFTHATVEPFIIATKRQLSAMHPIHKLLEPHFKDNMQINTLARSILLSAGGILERTMFPGKYAMEMSSAIYSEWRFTEQSLPNDLVKRGMASSSNKDHLHLHVEDYPYAVDGMDVWRAIDGWVRSYCAHFYHSDAAVAADAELQAWWHDVRTVGHGDRQRDRACWLDLDTVANLVESLSTLIWIASALHAAVNFGQYGYAGFMPNRPTRCRRFVPLPGSPEMAQLEADPDRFFLDTVPDRFTTTLGLTLIEVLSNHTSDELYLGQRATASWTDDGEVLQLLDRFRDDLRRVEKRVTERNKDLRLKNRKGPAKVPYTLLFPDVGNVGAKEKGITGKGIPNSVSI

SEQ ID NO: 4643 - DNA, 1593 bp, Sorghum bicolor
  misc_feature: Ceres ANNOT ID no. 6039462
  misc_feature: Encodes the peptide sequence at SEQ ID NO 4644
  misc_feature: Up-regulated in shoot tissues in response to methyl jasmonate treatment
  misc_feature: Up-regulated in root tissues in response to methyl jasmonate treatment
  misc_feature: Up-regulated in shoot tissues in response to aminocyclopropane carboxylic treatment
  misc_feature: Up-regulated in shoot tissues in response to salicylic acid treatment
  misc_feature: Up-regulated in root tissues in response to salicylic acid treatment
atgccgatgccgatgccacgggcgcggacgcgatggtcggcgctggccgccagcgcgctaatccagtgctgcgcggggagctcctactgcttcggcgtctactccccggcgctcaaggcctcgcagcgctacgaccagtccgcgctcgacgccgtcgccttcttcaaggacgtcggcgccaacgtcggggtcctctcgggcctcctcgccgcgtgggcgcccgcgggggggcggaggcgcccctggctcgtcctcctcgtcggtgccctgctctgcgtcgcgggctacctccccatctggctcgccgtcgcgggggtcgcgcccgcgccgctcccgctcatgtgcctctacatgctgctcgccgcgcaggcgcagaccttcttcaacaccgctgatgttgtctccgccgtcgagaacttccccgaccgacgaggcactgtcatcggcatcatgaagggttttctaggcctaagtggggcaatacttgtccaaatttaccgcactatccacattgatcccagctctttcatactcatgctggcagttttgcccacagccgtcacgttggtgctcatgtattttgtggatgtccacaacccacatgaacggtacaacaagaaattcctagatgctttctccctcattgctgttactgttgccggatacttgatgattctcataatctgtggtcaaattttctcaataagctcagctgtgcagagcatttgtttcgtggtactcttgatactagtgatgtctccggtagccgtcgctttaaaggcccagacaccacatgaggaatcaatctcagaacaaaggactggactgctccgtgaagaggtcgcagaggattctgaaaatgctacctccagtaccgcacttgggggatctgaccaagacctgtctgcaggcaaagagaacctgaatgtattacaggccatgtgcaaactcaacttctggttgctcttcctagcaatggcttgcggaatgggatcaggtctggccacagtgaacaatatcagccagattggtggctcccttggctacacgaccaaggagaccagcacacttgtgtcactctggagcatttggaacttctcagggcggtttggtgcaggcttcatatctgaccatttccttcgcctgcgaggagttggcaggccattctttataggtgttacgctgctgatcatgagcgtcggtcatgccatcatctcctccggtctccctgcatcactctacattgggtcggtgctcatcggcatgtgctacggttgtcagtgggccctgatgccgagcataacatctgagatctttgggctgaaccattttgggaccatattcaacacggtggctgttgcaagccctgttgggtcttacatcctctcggtgcgcattgtgggctacatatacgatattgagtcgtcaccagatgagcactcctgtgtaggtaagcaatgctttgcgctctctttcatgatcatggctggggtctgtatgttcgggtctgctgttgcgtttgtgttgtttatcagaacaaggaagttctataggcgtgtcatatacgcgaggttgcaatctttcctagactag

SEQ ID NO: 4644 - protein, 530 aa, Sorghum bicolor
  misc_feature: Ceres ANNOT ID no. 6039462
  misc_feature (11)..(259): Pfam Id: Nodulin-like Pfam Desc: Nodulin-like
  misc_feature (9)..(525): NCBI GI: 5882744 NCBI Desc: strong similarity to gbaf031243 nodule-specific protein (nlj70) from lotus japonicus and is a member of the pf00083 sugar (and other) transporter family. est gbz37715 comes
  misc_feature (9)..(525): NCBI GI: 5882744 (continued) from this gene. [arabidopsis thaliana]
  misc_feature (5)..(524): NCBI GI: 110736938 NCBI Desc: nodulin-like protein [arabidopsis thaliana]
  misc_feature (5)..(524): NCBI GI: 42570361 NCBI Desc: nodulin-related [arabidopsis thaliana]
  misc_feature (5)..(525): NCBI GI: 30686019 NCBI Desc: nodulin-related [arabidopsis thaliana]
  misc_feature (9)..(520): NCBI GI: 8778273 NCBI Desc: f14d16.8 [arabidopsis thaliana]
  misc_feature: Up-regulated in shoot tissues in response to methyl jasmonate treatment
  misc_feature: Up-regulated in root tissues in response to methyl jasmonate treatment
  misc_feature: Up-regulated in shoot tissues in response to aminocyclopropane carboxylic treatment
  misc_feature: Up-regulated in shoot tissues in response to salicylic acid treatment
  misc_feature: Up-regulated in root tissues in response to salicylic acid treatment
  misc_feature: The sequence is a functional homolog of SEQ ID NO. 454 in the 11/188,298 US application
  misc_feature: The sequence is a functional homolog of SEQ ID NO. 331 in the 11/188,298 US application
MPMPMPRARTRWSALAASALIQCCAGSSYCFGVYSPALKASQRYDQSALDAVAFFKDVGANVGVLSGLLAAWAPAGGRRRPWLVLLVGALLCVAGYLPIWLAVAGVAPAPLPLMCLYMLLAAQAQTFFNTADVVSAVENFPDRRGTVIGIMKGFLGLSGAILVQIYRTIHIDPSSFILMLAVLPTAVTLVLMYFVDVHNPHERYNKKFLDAFSLIAVTVAGYLMILIICGQIFSISSAVQSICFVVLLILVMSPVAVALKAQTPHEESISEQRTGLLREEVAEDSENATSSTALGGSDQDLSAGKENLNVLQAMCKLNFWLLFLAMACGMGSGLATVNNISQIGGSLGYTTKETSTLVSLWSIWNFSGRFGAGFISDHFLRLRGVGRPFFIGVTLLIMSVGHAIISSGLPASLYIGSVLIGMCYGCQWALMPSITSEIFGLNHFGTIFNTVAVASPVGSYILSVRIVGYIYDIESSPDEHSCVGKQCFALSFMIMAGVCMFGSAVAFVLFIRTRKFYRRVIYARLQSFLD

SEQ ID NO: 4645 - DNA, 1518 bp, Sorghum bicolor
  misc_feature: Ceres ANNOT ID no. 6039464
  misc_feature: Encodes the peptide sequence at SEQ ID NO 4646
atggcggtggtggacaagtggacgggcctaggttcggctctggcgagcttcctgttcctgtggtccatggtgcagagacacgtccccgtcacgctcagccaccgcgtcgccacctgggccaacaagctcgcctcctacctcaacccctacctggagatcaccatctccgagtacggcgccgagcgcttccgccgcagcgacttgttcctcgccgccgaggcctacctctccgacgcgtgcgcgctgcgcgcccgcaagctcaaggccgagatcggcagggacagcagcaacctccaggtctcggtcggcgacaacgacgaggtcaccgacgacttccagggcgccacggtctggtggtacgtcgccaagaaggtgcccaggtccaacgtcatcaacctctacggcaaccaggacgagccccgcttctaccgggtcgtcttccaccgccgccaccgcgacctcgtcgtcgccaagtacctgccccacgtcctccgggaaggccgcgccgtcaccgtccgcaaccgccagcgccgcctcttcaccaacaatcccagcggcggcggccgtgggaggggcgacgtctggagccacgtcgcgttcgagcacccggccacgttcgacacgctcgccatggaccctgaggagaaggaggagatcctcgacgacctcgaggcgttccgggaggctaaggactactacaccaaggtcggcaaggcgtggaagcgagggtacctgctctatggaccccccggcaccggcaagtccaccatgatcgccgccatggccaacttcctcgactacgacgtctacgacctcgagctcacggcggtcaacaacaacaccgacctgcggaagctcttcatcgagaccaccggcaagtccatcatcgtcatcgaggacatcgactgctccgtcgacctcaccggcaagcgcaaggacgacaagaagcaggcagacggcggtgctgacaagcccaagctgccgatggagcctgaaaaggacgaaggcagcaaggtcaccctttcagggctgctcaacttcatcgacgggctctggtcggcgtgcggcggcgagcgcatcatcatcttcacaaccaaccacaaggacaagctggacccggcgctgatccggcgaggcaggatggatcggcacatcgagatgtcctactgccgtttccgggcgttcaaggtgctcgccaaaaactacctggacgtcgaggagcacgagctgttcggccagatagggcagctgcttgaggagacagacatgtcaccggcagatgtggcagagaacctgatgcccatgtccaagaagaagaagaagagggacgccaacgtgtgcctggagaatcttgtggaggctctgaaacaggccaaggaggatgcggccaaggccaaggagaaagcagaggcggcaaagaagaaggctcaagaggaagacgacgcaaagaaaggcaaaggacaagaccaaggcgataaaacgtcagaatccaagatgagcaacggacacatcaaatga

SEQ ID NO: 4646 - protein, 505 aa, Sorghum bicolor
  misc_feature: Ceres ANNOT ID no. 6039464
  misc_feature (243)..(442): Pfam Id: AAA Pfam Desc: ATPase family associated with various cellular activities(AAA)
  misc_feature (3)..(504): NCBI GI: 55276716 NCBI Desc: atpase 3 [hordeum vulgare subsp. vulgare]
  misc_feature (1)..(505): NCBI GI: 55276711 NCBI Desc: atpase 2 [hordeum vulgare subsp. vulgare]
  misc_feature (57)..(504): NCBI GI: 115488382 NCBI Desc: os12g0431100 [oryza sativa (japonica cultivar-group)]
  misc_feature (53)..(490): NCBI GI: 115489802 NCBI Desc: os12g0639400 [oryza sativa (japonica cultivar-group)]
  misc_feature (1)..(505): NCBI GI: 92868644 NCBI Desc: aaa atpase [medicago truncatula]
  misc_feature: The sequence is a functional homolog of SEQ ID NO. 462 in the 11/188,298 US application
MAVVDKWTGLGSALASFLFLWSMVQRHVPVTLSHRVATWANKLASYLNPYLEITISEYGAERFRRSDLFLAAEAYLSDACALRARKLKAEIGRDSSNLQVSVGDNDEVTDDFQGATVWWYVAKKVPRSNVINLYGNQDEPRFYRVVFHRRHRDLVVAKYLPHVLREGRAVTVRNRQRRLFTNNPSGGGRGRGDVWSHVAFEHPATFDTLAMDPEEKEEILDDLEAFREAKDYYTKVGKAWKRGYLLYGPPGTGKSTMIAAMANFLDYDVYDLELTAVNNNTDLRKLFIETTGKSIIVIEDIDCSVDLTGKRKDDKKQADGGADKPKLPMEPEKDEGSKVTLSGLLNFIDGLWSACGGERIIIFTTNHKDKLDPALIRRGRMDRHIEMSYCRFRAFKVLAKNYLDVEEHELFGQIGQLLEETDMSPADVAENLMPMSKKKKKRDANVCLENLVEALKQAKEDAAKAKEKAEAAKKKAQEEDDAKKGKGQDQGDKTSESKMSNGHIK

SEQ ID NO: 4647 - DNA, 666 bp, Sorghum bicolor
  misc_feature: Ceres ANNOT ID no. 6039467
  misc_feature: Encodes the peptide sequence at SEQ ID NO 4648
atggcgcagccaccggagagagctgctgccggcgccggggcgctcatctacgccatggtggcgcggggcacggtggcggtggcggagcacacgtcctacacgggcaacttccgggacatcgccgcgcagtgcttgctcaagctgccggcggggaacaaccgattcacctacacctgcgacggccacaccttcaacttcctcgtcagcgacggatacgtcagccgggcggcagattcctatggcctcctggagatgatcaaggaggacttcaacaagagatatgcagggggcaaagcagcaacagctacagccaacagtctcacccgagatttcgggccaaggcttagagaccagatgcagtactgtacggatcacccagaggaggtgagtaagctgtccaaagtgaaggctcagatggatcaagtgaaaagcatcatgatggaaaatattgacaaggtcattgatcgcggacaacaggtcgatgagcttgtcacaaggacagagcagctccacgatggggctgctgatttcaggcggggtggcgagcggttgcggcgcaagatgtggtatcagaacatgaagatgaagctcatcgtccttggcatcatcgtcgcgttgatcgtcatcataatcctctcaatttgccatggcggatgcggcaagtga

SEQ ID NO: 4648 - protein, 221 aa, Sorghum bicolor
  misc_feature: Ceres ANNOT ID no. 6039467
  misc_feature (128)..(216): Pfam Id: Synaptobrevin Pfam Desc: Synaptobrevin
  misc_feature (11)..(217): NCBI GI: 60543737 NCBI Desc: synaptobrevin 1 [oryza sativa (japonica cultivar-group)]
  misc_feature (11)..(217): NCBI GI: 92899155 NCBI Desc: longin [medicago truncatula]
  misc_feature (14)..(221): NCBI GI: 600710 NCBI Desc: formerly called hat24; synaptobrevin-related protein
  misc_feature (14)..(221): NCBI GI: 79324082 NCBI Desc: sar1 (synaptobrevin-related protein 1) [arabidopsis thaliana]
  misc_feature (11)..(217): NCBI GI: 7211989 NCBI Desc: strong similarity to the synaptobrevin homolog f25i18.14 gi2924792 from a. thaliana on bac gbac002334. [arabidopsis thaliana]
MAQPPERAAAGAGALIYAMVARGTVAVAEHTSYTGNFRDIAAQCLLKLPAGNNRFTYTCDGHTFNFLVSDGYVSRAADSYGLLEMIKEDFNKRYAGGKAATATANSLTRDFGPRLRDQMQYCTDHPEEVSKLSKVKAQMDQVKSIMMENIDKVIDRGQQVDELVTRTEQLHDGAADFRRGGERLRRKMWYQNMKMKLIVLGIIVALIVIIILSICHGGCGK

SEQ ID NO: 4649 - DNA, 243 bp, Sorghum bicolor
  misc_feature: Ceres ANNOT ID no. 6039478
  misc_feature: Encodes the peptide sequence at SEQ ID NO 4650
atggcggagacggcggacatggagcggatcttcaagcggttcgacaccaatggcgacggcaagatctcgctgtcggagctgacggacgcgctgcggcagctggggtccacctccgccgacgaggtgcagcgcatgatggccgagatcgacaccgacggcgacggctgcatcgacttcaacgagttcatcaccttctgcaacgccaacccggggctcatgaaggacgtcgccaaggtcttctga

SEQ ID NO: 4650 - protein, 80 aa, Sorghum bicolor
  misc_feature: Ceres ANNOT ID no. 6039478
  misc_feature (6)..(34): Pfam Id: efhand Pfam Desc: EF hand
  misc_feature (41)..(69): Pfam Id: efhand Pfam Desc: EF hand
  misc_feature (1)..(80): NCBI GI: 1871507 NCBI Desc: calcium-binding pollen allergen [cynodon dactylon]
  misc_feature (1)..(80): NCBI GI: 4098203 NCBI Desc: calcium binding protein [cynodon dactylon]
  misc_feature (6)..(80): NCBI GI: 3367732 NCBI Desc: p7 protein [phleum pratense]
  misc_feature (3)..(80): NCBI GI: 29465668 NCBI Desc: pollen allergen che a 3 [chenopodium album]
  misc_feature (1)..(80): NCBI GI: 59800144 NCBI Desc: polcalcin bra r 1 (calcium-binding pollen allergen bra r 1)
MAETADMERIFKRFDTNGDGKISLSELTDALRQLGSTSADEVQRMMAEIDTDGDGCIDFNEFITFCNANPGLMKDVAKVF

SEQ ID NO: 4651 - DNA, 621 bp, Sorghum bicolor
  misc_feature: Ceres ANNOT ID no. 6039484
  misc_feature: Encodes the peptide sequence at SEQ ID NO 4652
atggccgcgcagtccttcctcctcgcagccacggccacggccacgaccgccgcgctcttcgcggctccctattcctccgcacgccctttccactcggcccacttcgtcgccggcccggggggcgccgccgccgccagggcactcgtcgtcgccgacgcgtctaagaaggccgtagccgtcctcaagggcacgtccgaggtcgagggcgtcgtcacgctcacgcaggacgacgacggacctacaactgtgaacgtccgtatcactggacttactcctggacttcatggcttccacctccacgagtttggtgatactaccaatgggtgcatatcgacaggaccacattttaatccaaacaatctgacacacggtgcaccagaagacgaagtccgtcatgcgggtgacctgggaaacattgttgccaatgctgagggcgtagctgaggcaaccattgttgatacccagattccattgagtggcccaaattcagttgttgggagagcatttgtggttcatgagcttgaagatgatttggggaaaggtggccatgagctcagcctctctactggaaatgctggtggaagactggcatgtggtatgttctctttgctatatttatga

SEQ ID NO: 4652 - protein, 206 aa, Sorghum bicolor
  misc_feature: Ceres ANNOT ID no. 6039484
  misc_feature (54)..(202): Pfam Id: Sod_Cu Pfam Desc: Copper/zinc superoxide dismutase (SODC)
  misc_feature (1)..(203): NCBI GI: 12697818 NCBI Desc: copper/zinc superoxide dismutase [oryza sativa (japonica cultivar-group)]
  misc_feature (1)..(203): NCBI GI: 3915008 NCBI Desc: superoxide dismutase [cu-zn], chloroplast precursor
  misc_feature (1)..(206): NCBI GI: 14326463 NCBI Desc: copper/zinc superoxide dismutase precursor [dichanthelium lanuginosum]
  misc_feature (1)..(203): NCBI GI: 1572627 NCBI Desc: cu/zn superoxide dismutase [triticum aestivum]
  misc_feature (1)..(203): NCBI GI: 1568639 NCBI Desc: cu/zn superoxide dismutase [triticum aestivum]
  misc_feature (1)..(203): SWISSPROT Homolog: EC 1.15.1.1 Superoxide dismutase [Cu-Zn], chloroplast precursor
MAAQSFLLAATATATTAALFAAPYSSARPFHSAHFVAGPGGAAAARALVVADASKKAVAVLKGTSEVEGVVTLTQDDDGPTTVNVRITGLTPGLHGFHLHEFGDTTNGCISTGPHFNPNNLTHGAPEDEVRHAGDLGNIVANAEGVAEATIVDTQIPLSGPNSVVGRAFVVHELEDDLGKGGHELSLSTGNAGGRLACGMFSLLYL

SEQ ID NO: 4653 - DNA, 2013 bp, Sorghum bicolor
  misc_feature: Ceres ANNOT ID no. 6039489
  misc_feature: Encodes the peptide sequence at SEQ ID NO 4654
atgacccacccttcctcgtcgtcgtcctccgctcccccgcccccgccgctgccgccgcccggggcggcggcgggggcggccgaggccacctccctcgcgccgggcttccgcttccaccccaccgacgaggagctcgtctcctactacctcaagcgcaaggtcctcggccgcccgctcaaggtcgacgccatcgcagaggtcgacctctacaaggtcgagccctgggacctgcccgcccgctcccgcctccgctcccgcgactcccagtggtacttcttcagccgcctcgaccgcaagcacgccaaccgcgcccgcaccaaccgcgccacgtcgagtgggtactggaagaccacggggaaggacagggaggtgcgccatgggcccagggtcgtcgggatgaagaagacgctcgtcttccatgccggacgcgctcccaagggcgagcgcaccaactgggtcatgcacgagtaccgcctcgagggcgacgacgctgcggggataccgcaggactcatttgtggtgtgccggatcttccagaaagctggcccaggtcctcagaatggggcacagtatggagcgccctttgttgaggaggaatgggaggaggaagacgcagatgtcggtttgcttccagtggagggtgatgctgctgttgaccctgaggttccccgcgctcctgtggagatacctggtgccctggagagaggctatcttcagatgagtgatctcattcagggtttgggtgatcaaaatggaaatggtacacctagtttgccagtttctgatacttcaaataatagcaaccattctgaagatgtagatggaaattctggggacattttaagtgacccaaaccttggctctaattttcttcagtatgaacctggggagcaaaatagcttaatgcttaatggaagtatcatatcaaatgcaaatgctggagatttttttacgaattccagccccagtgatgggttcctagagctgaaggattttgcagatgctgcaaatgtggatttccctctgggcaatggatcaaccatctgtccttcagatggttgggcatggaaaacacccgactcagcagaagctgtaaatggagctaacaatgagattcctccagtccctgatgaccagactttccagccagatgagctggaacaactgctgcagtcaatacaacaagattcccatttcggctcaagtatcattgacccccggcattcttctatgacaaattcagttcttcctgaggatgattctttgatgttctatgatgcacccttcgattccaccatgtgtgatgatgggtttggacagaatggaattcttggctccgcagcaaccaatctatctggcattggcatggtggacgatggtatgcaatacttcgatgcaatggatgaaaatttatttaatgatattctgggctccatacagcagccagctggtaacagttcccacgcttttaatggcccagtccttacccaagaggtcaacaataccatgtatacatatagtccaactcaaaaggttttagaacctaattttgtagttggtgccccgtcatctgctaggttacctgaagctggtagtcagttaaattgtgttgttttaccagatggtcaggctaagagtagtgctatcggaaagggatttgtaaagattttggattcgatctccgctcccccagcttttgcaggagaattcccagctaaccaccgcaaatccttggctcatatttctggagcgcgccccaacacactccatgtttctgctgaagtgatccgcataggaagtttagctgttccttctggcgcagacaagtgggctctgcaaaaggatcaaggcatggagctgctcttctctgcagattttgagcctgatacccgtatacactgtggctgcaacaccattaccgcggtgctgcgtggtggcttctgccttttcttcgtttcggcaataatgctcttagtgagctacgaggtgggcatgtgcatctatggcaagtag

SEQ ID NO: 4654 - protein, 670 aa, Sorghum bicolor
  misc_feature: Ceres ANNOT ID no. 6039489
  misc_feature (32)..(160): Pfam Id: NAM Pfam Desc: No apical meristem (NAM) protein
  misc_feature (32)..(341): NCBI GI: 21105746 NCBI Desc: nam-like protein 9 [petunia x hybrida]
  misc_feature (25)..(203): NCBI GI: 6456751 NCBI Desc: nac2 [arabidopsis thaliana]
  misc_feature (18)..(211): NCBI GI: 18398893 NCBI Desc: no apical meristem (nam) family protein [arabidopsis thaliana]
  misc_feature (24)..(217): NCBI GI: 21105744 NCBI Desc: nam-like protein 8 [petunia x hybrida]
  misc_feature (19)..(271): NCBI GI: 42572353 NCBI Desc: no apical meristem (nam) family protein [arabidopsis thaliana]
  misc_feature: The sequence is a functional homolog of SEQ ID NO 162 in the 10/225,068US patent application
  misc_feature: The sequence is a functional homolog of SEQ ID NO 2414 in the 10/374,780US patent application
  misc_feature: The sequence is a functional homolog of SEQ ID NO 2628 in the 10/374,780US patent application
  misc_feature: The sequence is a functional homolog of SEQ ID NO 308 in the 10/225,066US patent application
  misc_feature: The sequence is a functional homolog of SEQ ID NO 428 in the 11/435,388US patent application
  misc_feature: The sequence is a functional homolog of SEQ ID NO 508 in the 10/412,699US patent application
  misc_feature: The sequence is a functional homolog of SEQ ID NO 728 in the 10/225,066US patent application
  misc_feature: The sequence is a functional homolog of SEQ ID NO 854 in the 11/435,388US patent application
  misc_feature: Useful for making plants with altered Lignin content
  misc_feature: Useful for making plants with altered alkaloid content
  misc_feature: Useful for making plants with modulated growth and phenotype characteristics
  misc_feature: GREAT-hit functional homolog of the protein sequence given in SEQ ID NO 13147
  misc_feature: Functional homolog of the protein sequence given in SEQ ID NO 13331
  misc_feature: The sequence is a functional homolog of SEQ ID NO 508 in the 20040045049 US patent application
  misc_feature: The sequence is a functional homolog of SEQ ID NO 308 in the 20050160493 US patent application
  misc_feature: The sequence is a functional homolog of SEQ ID NO 854 in the 20060272060 US patent application
  misc_feature: The sequence is a functional homolog of SEQ ID NO 854 in the 11/435,388 US patent application
  misc_feature: The sequence is a functional homolog of SEQ ID NO 2346 in the 10/374,780 US patent application
  misc_feature: The sequence is a functional homolog of SEQ ID NO 238 in the 10/225,068 US patent application
  misc_feature: The sequence is a functional homolog of SEQ ID NO 338 in the 10/412,699 US patent application
  misc_feature: The sequence is a functional homolog of SEQ ID NO 774 in the 11/479,226 US patent application
  misc_feature: Useful for making plants with altered carbohydrate content
  misc_feature: Functional homolog of the protein sequence given in SEQ ID NO 13622
  misc_feature: Useful for making plants with altered lignin content
  misc_feature: Functional homolog of the protein sequence given in SEQ ID NO 13250
  misc_feature: The sequence is a functional homolog of SEQ ID NO 1196 in the 10/412,699 US patent application
  misc_feature: The sequence is a functional homolog of SEQ ID NO 865 in the 10/374,780 US patent application
  misc_feature: The sequence is a functional homolog of SEQ ID NO 2012 in the 10/374,780 US patent application
  misc_feature: The sequence is a functional homolog of SEQ ID NO 312 in the 10/412,699 US patent application
  misc_feature: The sequence is a functional homolog of SEQ ID NO 731 in the 11/479,226 US patent application
  misc_feature: The sequence is a functional homolog of SEQ ID NO 102 in the 10/374,780 US patent application
  misc_feature: The sequence is a functional homolog of SEQ ID NO 886 in the 10/225,066 US patent application
  misc_feature: The sequence is a functional homolog of SEQ ID NO 1036 in the 10/225,066 US patent application
  misc_feature: The sequence is a functional homolog of SEQ ID NO 216 in the 10/666,642 US patent application
  misc_feature: The sequence is a functional homolog of SEQ ID NO 2608 in the 10/374,780 US patent application
  misc_feature: The sequence is a functional homolog of SEQ ID NO 658 in the 11/435,388 US patent application
  misc_feature: The sequence is a functional homolog of SEQ ID NO 880 in the 10/412,699 US patent application
  misc_feature: Useful for making plants with modulated water use efficiency
  misc_feature: The sequence is a functional homolog of SEQ ID NO 891 in the 10/374,780 US patent application
  misc_feature: The sequence is a functional homolog of SEQ ID NO 344 in the 10/666,642 US patent application
  misc_feature: Useful for making plants with modulated nitrogen use efficiency
  misc_feature: Functional homolog of the protein sequence given in SEQ ID NO 13624
  misc_feature: The sequence is a functional homolog of SEQ ID NO 26 in the 10/286,264 US patent application
  misc_feature: The sequence is a functional homolog of SEQ ID NO 336 in the 10/412,699 US patent application
  misc_feature: The sequence is a functional homolog of SEQ ID NO 770 in the 11/479,226 US patent application
  misc_feature: The sequence is a functional homolog of SEQ ID NO. 362 in the 11/188,298 US application
  misc_feature: The sequence is a functional homolog of SEQ ID NO. 466 in the 11/188,298 US application
  misc_feature: The sequence is a functional homolog of SEQ ID NO. 335 in the 11/188,298 US application
MTHPSSSSSSAPPPPPLPPPGAAAGAAEATSLAPGFRFHPTDEELVSYYLKRKVLGRPLKVDAIAEVDLYKVEPWDLPARSRLRSRDSQWYFFSRLDRKHANRARTNRATSSGYWKTTGKDREVRHGPRVVGMKKTLVFHAGRAPKGERTNWVMHEYRLEGDDAAGIPQDSFVVCRIFQKAGPGPQNGAQYGAPFVEEEWEEEDADVGLLPVEGDAAVDPEVPRAPVEIPGALERGYLQMSDLIQGLGDQNGNGTPSLPVSDTSNNSNHSEDVDGNSGDILSDPNLGSNFLQYEPGEQNSLMLNGSIISNANAGDFFTNSSPSDGFLELKDFADAANVDFPLGNGSTICPSDGWAWKTPDSAEAVNGANNEIPPVPDDQTFQPDELEQLLQSIQQDSHFGSSIIDPRHSSMTNSVLPEDDSLMFYDAPFDSTMCDDGFGQNGILGSAATNLSGIGMVDDGMQYFDAMDENLFNDILGSIQQPAGNSSHAFNGPVLTQEVNNTMYTYSPTQKVLEPNFVVGAPSSARLPEAGSQLNCVVLPDGQAKSSAIGKGFVKILDSISAPPAFAGEFPANHRKSLAHISGARPNTLHVSAEVIRIGSLAVPSGADKWALQKDQGMELLFSADFEPDTRIHCGCNTITAVLRGGFCLFFVSAIMLLVSYEVGMCIYGK

SEQ ID NO: 4655 - DNA, 648 bp, Sorghum bicolor
  misc_feature: Ceres ANNOT ID no. 6039514
  misc_feature: Encodes the peptide sequence at SEQ ID NO 4656
atgacaggccttggctcaccatgtggtgcgtgcaagttcctacggaggaagtgtgtgaaggggtgtgtcttcgctccatatttcagtcatgagcaaggggctgcacactttgctgctatacataaggtctttggggctagcaatgcctcaaagctcctaatgcatctcccgataagtgaccgctgcgaggctgcagtcactatgtcatatgaggcacaggctaggcttcaggatccaatatatggctgtgttgctcacatcttttctctgcaacaacaggtggtcagtctgcaagcagaactagagtctttcaaagctctagcaacacaaggatatggagatggatccttgccaccaaaccctcagaaagaaaactgtgaaagattagcaccttacattcaagatgggcagctcgtttttcacccaacaacggcaaacaattcttcagtaaagagtgagaggcagttatactttgcaaatgactgcttcacatcagcgtcaactcaacattctgaaggttatgagcaagatttatgcatgcctgactactacaacaatagcaatccttcttgcaccacgcaagggagtgggtatcatgatatggatgaccttcagtcagtagcctttgcctatctgcatgaagcatga

SEQ ID NO: 4656 - protein, 215 aa, Sorghum bicolor
  misc_feature: Ceres ANNOT ID no. 6039514
  misc_feature (1)..(111): NCBI GI: 126567721 NCBI Desc: rootless concerning crown and seminal lateral roots [zea mays]
  misc_feature (1)..(111): NCBI GI: 126567727 NCBI Desc: rootless concerning crown and seminal lateral roots [zea mays]
  misc_feature (1)..(213): NCBI GI: 126567723 NCBI Desc: rtcs-like protein [zea mays]
  misc_feature (2)..(119): NCBI GI: 48716501 NCBI Desc: lob domain protein-like [oryza sativa (japonica cultivar-group)]
  misc_feature (5)..(110): NCBI GI: 126567725 NCBI Desc: rtcn [zea mays]
  misc_feature: The plant produces a reduced number of seeds.
  misc_feature: Useful for biocontainment applications
  misc_feature: GREAT-hit functional homolog of the protein sequence given in SEQ ID NO 13545
  misc_feature: Useful for biocontainment applications
  misc_feature: Functional homolog of the protein sequence given in SEQ ID NO 13545
  misc_feature: Useful for making plants with modulated biomass
  misc_feature: Useful for making plants with modulated low light sensitivity
  misc_feature: Functional homolog of the protein sequence given in SEQ ID NO 13882
MTGLGSPCGACKFLRRKCVKGCVFAPYFSHEQGAAHFAAIHKVFGASNASKLLMHLPISDRCEAAVTMSYEAQARLQDPIYGCVAHIFSLQQQVVSLQAELESFKALATQGYGDGSLPPNPQKENCERLAPYIQDGQLVFHPTTANNSSVKSERQLYFANDCFTSASTQHSEGYEQDLCMPDYYNNSNPSCTTQGSGYHDMDDLQSVAFAYLHEA

SEQ ID NO: 4657 - DNA, 1671 bp, Sorghum bicolor
  misc_feature: Ceres ANNOT ID no. 6039554
  misc_feature: Encodes the peptide sequence at SEQ ID NO 4658
atgaattccagcagaagcctcctctcctcgcccctctttgctagctcgtctccaaacttcaggagcagtacctccgtctccgtctcctcctccccgtccccatcccgcaccacaggtatatttccgatgatacatgacaacaccggcagagcatccacggcgtgccactactcgccatcacttgtggctgaggagcagcttcacggttccaaagacaccttgaccttgaagggcgaaaaggctttgcttgagttgctgctaggcatggctctggaccagcacgtcgacggcggcaagctcacggctgaggatactgatttcgagacctatttaaaagaagcaacaagccgagtgctttaccagccagtattcactgaggatgattccacttcggagaactcttcagcatcaacagctaaaacacctgggagtttggatcttggcaagccgacgaaggaggtggaattgccagcacaagaatcaggcacttcagacacccagttggatgtaccactgcctcaccgcgtggacccaaaccattcgtacgagggactgctgagcaatgatcaagtgtttattagatccacccggttacttgagagaagatccaagaaacgcaacgccaacagggctttgagtaatgacgttccgtgcagtggtgtgaatgtgaattcaaagagaaaagagaagtcaaagaagtttggcagagttcttgatccagatgagccttttaggttgtttctacgggatcgagagacaacagagttcttgacagcaaaagaggagaaacagatgttcagtcaaatacagaatcttatgaagctagaggaggctcagcgtaaactgcaagctcaatgtggtcgtgagccaacagttgcagagtgggctcaagccgtaggaatgagctgcagggagttgcaatcctgtgtgcgcaccggaagacggtgccgagagaagatggcccgctccaactttcgccttgtgatacatgttgctaggaaatatgaaggacatggtcttgacattcaggacttggtgcaggatggatgctgtgggttgatgaaaacctttgagaagttcaacccgagcaagggatgcagattcccgacctatgcgtactggtggatccgtcaatcgatcaaaaagtccatcttcaagaattcaagactaatccgattgccggagagtgtgtttgcactcctgaggaaggtgggcaaagcaaggatggaatgcataatggatggggagcagccgacgaatgagaacgtcgcaaggcgcgccggcatcacaattgagaagcttgcgaaactgagagctaaaaccaggaaaccacggtccatgcaggatcgggtttggtcagacgacggtgtcacgtaccaggaggtcaccgaggaccccaacattgagccccctgaggtgagcgtggacaggctgatgatgcggcagcaggtgcgcagcttcctggcggggatgctgagcccccgggagaaggagatcatcgagcaccgcttcggcatccacgacgggcagcccaagacccttcatgtcatcggcgacatgtacgggctgtccaaggagaggatccgtcaggtgcagaacaaggccctggacaagctgaaaaacaccatctcggcacagggcttccacgtctactttgatttgctaacttga

SEQ ID NO: 4658 - protein, 556 aa, Sorghum bicolor
  misc_feature: Ceres ANNOT ID no. 6039554
  misc_feature (320)..(390): Pfam Id: Sigma70_r2 Pfam Desc: Sigma-70 region 2
  misc_feature (488)..(541): Pfam Id: Sigma70_r4 Pfam Desc: Sigma-70, region 4
  misc_feature (394)..(475): Pfam Id: Sigma70_r3 Pfam Desc: Sigma-70 region 3
  misc_feature (1)..(556): NCBI GI: 4336610 NCBI Desc: sigma factor sig6; zmsig6 [zea mays]
  misc_feature (2)..(556): NCBI GI: 40253689 NCBI Desc: sig6, plastid rna polymerase sigma factor [oryza sativa (japonica cultivar-group)]
  misc_feature (130)..(555): NCBI GI: 140068569 NCBI Desc: sigma factor, ecf [medicago truncatula]
  misc_feature (190)..(554): NCBI GI: 12697780 NCBI Desc: ppsig2 [physcomitrella patens]
  misc_feature (193)..(541): NCBI GI: 7363218 NCBI Desc: sigma factor 2 [sinapis alba]
MNSSRSLLSSPLFASSSPNFRSSTSVSVSSSPSPSRTTGIFPMIHDNTGRASTACHYSPSLVAEEQLHGSKDTLTLKGEKALLELLLGMALDQHVDGGKLTAEDTDFETYLKEATSRVLYQPVFTEDDSTSENSSASTAKTPGSLDLGKPTKEVELPAQESGTSDTQLDVPLPHRVDPNHSYEGLLSNDQVFIRSTRLLERRSKKRNANRALSNDVPCSGVNVNSKRKEKSKKFGRVLDPDEPFRLFLRDRETTEFLTAKEEKQMFSQIQNLMKLEEAQRKLQAQCGREPTVAEWAQAVGMSCRELQSCVRTGRRCREKMARSNFRLVIHVARKYEGHGLDIQDLVQDGCCGLMKTFEKFNPSKGCRFPTYAYWWIRQSIKKSIFKNSRLIRLPESVFALLRKVGKARMECIMDGEQPTNENVARRAGITIEKLAKLRAKTRKPRSMQDRVWSDDGVTYQEVTEDPNIEPPEVSVDRLMMRQQVRSFLAGMLSPREKEIIEHRFGIHDGQPKTLHVIGDMYGLSKERIRQVQNKALDKLKNTISAQGFHVYFDLLT

SEQ ID NO: 4659 - DNA, 1743 bp, Sorghum bicolor
  misc_feature: Ceres ANNOT ID no. 6039555
  misc_feature: Encodes the peptide sequence at SEQ ID NO 4660
atggccaccatccccaccacagattccggcctcctcctcggttcctccgctctcctccggaggactaggagggccgcctcgtccgccaggcttcccgccgccgcccgccgtcgcccgcagctcctcgtgcgcgcctccgccaaggagatcgccttcgaccagggctccagagcctcccttcaggccggcgtcgagaagctcgccgccgcggtcggcgtcaccctcggacccagaggaaggaatgttgtcctggatgagtttggaacccccaaagtggtcaatgatggagttaccattgctcgtgctattgagctcgcagatcccatggagaatgctggtgctgcattgattcgtgaagttgctagcaagacgaatgactcggctggtgacggaaccactaccgcctctgttctcgctagggaaatcataaaattgggtatgttgagcattacttcaggggcaaatccagtgtcagttaagaagggcattgataagactgttcagaaattggtggaggaacttgagaagaagtccaggcctgtcaagggtagcggggatattaaagctgttgctgccatatcagctggaaatgatgaatttgttgggactatgattgctgaagctattgacaaggttggccctgatggtgtcctctcaatcgagtcatcatcatcatttgagacgacagttgaagttgaagaagggatggagcttgacagaggatatatctcccctcagtttgtcaccaatcctgaaaaatctactgttgagtttgaaaatgctcggattcttgtcactgatcagaagatatcatcgataaaagaaatcattcctctgttggagcagacaacacagttaagagcaccacttcttataattgcagaggatgtaagtggcgaggcgctggcaacattagttgtaaacaagcttagaggaattctaaatgtggctgcaatcaaagctcctggctttggtgagaggcgtaaagctcttcttcaggacattgccattgttacaggtgctgaatatcaatccaaagatcttggtctactagttgagaatacaacagtagagcagcttggcatagctcggaaagttacaatctcaagttcctcgactaccattatagcagatgctgctagcaaagatgatatccaggccagaattgctcagctgaagagagagctttctcagacggactcggcttatgactctgagaagttggcagagagaattgcaaagctttctggtggagttgctgtgatcaaggttggagcctcaaccgaggcggagcttgaggaccgcaagctccgcatagaggacgcaaagaatgcaacttttgcagctatagaggaaggtattgttccaggaggtggtgcagcctatgttcatctctcaacatttgtaccggctatcaaggagacgttggatgatcctgaagagcggcttggtgccgatatcattcagaaggctttggtggcacctgcagcgttgatagcacataatgctggggtggaaggtgaggtgattgtggataaaatcagggaaagcgaatgggagtttggttataacgccatggcggacaagcacgagaacctggtggaggctggtgtgatcgaccctgcgaaagtgacaaggtgtgccctgcagaacgccgcctcggtggctggaatggtgctgactacccaggcaatcgttgtggagaagccccagaaggctcctgcagctgcagcggcaccctag

SEQ ID NO: 4660 - protein, 580 aa, Sorghum bicolor
  misc_feature: Ceres ANNOT ID no. 6039555
  misc_feature (67)..(570): Pfam Id: Cpn60_TCP1 Pfam Desc: TCP-1/cpn60 chaperonin family
  misc_feature (23)..(579): NCBI GI: 77554291 NCBI Desc: rubisco subunit binding-protein alpha subunit, chloroplast precursor(60 kda chaperonin alpha subunit) (cpn-60 alpha) [oryza sativa (japonica cultivar-group)]
  misc_feature (36)..(580): NCBI GI: 1710807 NCBI Desc: rubisco subunit binding-protein alpha subunit, chloroplast precursor (60 kda chaperonin alpha subunit) (cpn-60 alpha)
  misc_feature (43)..(577): NCBI GI: 1351030 NCBI Desc: rubisco subunit binding-protein alpha subunit, chloroplast precursor (60 kda chaperonin alpha subunit) (cpn-60 alpha)
  misc_feature (13)..(578): NCBI GI: 3790441 NCBI Desc: chaperonin 60 alpha subunit [canavalia lineata]
  misc_feature (43)..(577): NCBI GI: 99801 NCBI Desc: chaperonine 60k alpha chain - rape (fragment)
  misc_feature: Useful for making plants with modulated nitrogen use efficiency
  misc_feature: Functional homolog of the protein sequence given in SEQ ID NO 13023
  misc_feature: Useful for making plants with modulated nitrogen use efficiency
  misc_feature: Functional homolog of the protein sequence given in SEQ ID NO 13023
MATIPTTDSGLLLGSSALLRRTRRAASSARLPAAARRRPQLLVRASAKEIAFDQGSRASLQAGVEKLAAAVGVTLGPRGRNVVLDEFGTPKVVNDGVTIARAIELADPMENAGAALIREVASKTNDSAGDGTTTASVLAREIIKLGMLSITSGANPVSVKKGIDKTVQKLVEELEKKSRPVKGSGDIKAVAAISAGNDEFVGTMIAEAIDKVGPDGVLSIESSSSFETTVEVEEGMELDRGYISPQFVTNPEKSTVEFENARILVTDQKISSIKEIIPLLEQTTQLRAPLLIIAEDVSGEALATLVVNKLRGILNVAAIKAPGFGERRKALLQDIAIVTGAEYQSKDLGLLVENTTVEQLGIARKVTISSSSTTIIADAASKDDIQARIAQLKRELSQTDSAYDSEKLAERIAKLSGGVAVIKVGASTEAELEDRKLRIEDAKNATFAAIEEGIVPGGGAAYVHLSTFVPAIKETLDDPEERLGADIIQKALVAPAALIAHNAGVEGEVIVDKIRESEWEFGYNAMADKHENLVEAGVIDPAKVTRCALQNAASVAGMVLTTQAIVVEKPQKAPAAAAAP

SEQ ID NO: 4661 - DNA, 1047 bp, Sorghum bicolor
  misc_feature: Ceres ANNOT ID no. 6039556
  misc_feature: Encodes the peptide sequence at SEQ ID NO 4662
atggttttgttcgaactagacccggacatcacccgatggggtcttcaccatctcctccccgctccggctggctactctgctcatgatcgcacccaaaccacccctaccacaccttgtacagcctttgttcgccctcttcatcagcccaccggagacatgggtggctcaaactctgttgagatcaaggttgagcatgtcaatgcggttgacaacgacgaggtcatcgcgcaagcccttcaggaagaactgtcccatgtcgccctcgccgaagcatccggggcaaacagcacccctgacgatcaacaacactctgctgttctcacgcagcaatggcttcgcccacgtgccgtccatgtacaatcatcttctcaagaggcagggaccagggaggaacctttcagcacctgctcaagccctggagatgacaataatgtccaggacagccagccatgcttgatggagctcatggataacttttctgtccttgacggtgaagtgggcaaaaggttgaacaacatggttcctgttcgtcatgttcctaaagtaaatggagagattccttctgttgatgaagccatttcagatcatcaaagacttcttgacaggttggtgctgtacggtttggttgatctcaaggttaaaggagatggcaactgccagtttagagcgctgtcagatcaattttaccgaactcctgaacatcacagatttgttcgggaacaagtggtgaagcagcttgaatcgcatcctgagatttatgaaggatatgttcctatggattacagggaatatctcagaaaaatgtcaaagagcggagagtggggtgaccatgttacattgcaggctgctgcagatacgtatggtgtaaagatcttcatcctgacatcattcagagatacatgttacattgagattcttcctgttgttgagaaatccagaagagttatatgcttgagtttttgggctgaggtgcactacaactcgatatatccggaaggagagttgccggttttggagaacaaaaagaaaagctggtggcccttctag

SEQ ID NO: 4662 - protein, 348 aa, Sorghum bicolor
  misc_feature: Ceres ANNOT ID no. 6039556
  misc_feature (214)..(326): Pfam Id: OTU Pfam Desc: OTU-like cysteine protease
  misc_feature (67)..(348): NCBI GI: 140068577 NCBI Desc: calcium-binding ef-hand; ovarian tumour, otubain [medicago truncatula]
  misc_feature (91)..(348): NCBI GI: 48716492 NCBI Desc: otu-like cysteine protease-like [oryza sativa (japonica cultivar-group)]
  misc_feature (134)..(330): NCBI GI: 115458186 NCBI Desc: os04g0402300 [oryza sativa (japonica cultivar-group)]
  misc_feature (121)..(345): NCBI GI: 18403314 NCBI Desc: otu-like cysteine protease family protein [arabidopsis thaliana]
  misc_feature (122)..(345): NCBI GI: 52075842 NCBI Desc: otu-like cysteine protease-like [oryza sativa (japonica cultivar-group)]
MVLFELDPDITRWGLHHLLPAPAGYSAHDRTQTTPTTPCTAFVRPLHQPTGDMGGSNSVEIKVEHVNAVDNDEVIAQALQEELSHVALAEASGANSTPDDQQHSAVLTQQWLRPRAVHVQSSSQEAGTREEPFSTCSSPGDDNNVQDSQPCLMELMDNFSVLDGEVGKRLNNMVPVRHVPKVNGEIPSVDEAISDHQRLLDRLVLYGLVDLKVKGDGNCQFRALSDQFYRTPEHHRFVREQVVKQLESHPEIYEGYVPMDYREYLRKMSKSGEWGDHVTLQAAADTYGVKIFILTSFRDTCYIEILPVVEKSRRVICLSFWAEVHYNSIYPEGELPVLENKKKSWWPF

SEQ ID NO: 4663 - DNA, 2838 bp, Sorghum bicolor
  misc_feature: Ceres ANNOT ID no. 6039604
  misc_feature: Encodes the peptide sequence at SEQ ID NO 4664
atgccggcccctgtcgctgcctacccggccaagatggcatgctgtctccagctccaccttcttcgccgctcggcccctgctccactccctgctcgggtcctcctcctgctctccaccccgcgcctgcgcctgcgccccgtccgagcgtctcccggtcccggctcgtccccgcccaactccttcgctggctggtcctccgatagtgccgatgacggcgccgacaaatctactctagggttcggcccagcaggaggacttctaggacctggacttgctgcctttttcttcctcgccggccttacctttgctgccgtctccatcagaagcagtggcaaccacgcagctgcaaaaatgcaaaacttgcctgcagagactgctgccacggaatcttactctgattatcactcccacaaagaggatgatgctatcagtgtcagggaagaagatgcccaagcttccttaccaacggattgggaggaaaacaatgacagccttgatgaaacaaaaagtacagatgaattcctggcgcctcttctacagtcaaacgaggaggttcctggggtgcaagctgaacatgaagtggggcacccgttgcagaacactgaacctgttactaacggtaatcatcttgtcggtgaagaagtgcagcagtttgacaatctcattgcatccgatggtaatcaaaatccagcatcacctcctctgcccatctcatcagaatatgctcaggtttcttttgcaccatctagcacacttgatgctgcagacccctcggagggaattcctaacgtagaagaaacatcagatctcaaaatggctttgccagaaaacgagcatttggatgaaactttaacttcagatgcaatggtgctagattcagatggtgttgtgctcatccaagatatcgctgacagtgccgttgctgctgcatttcacccagaagacaaaggtgtcgagcagaacccacaaactcatgacaaagatgaattttctccatccggattgcctgattatatggaacatgtaagtgccgaagagatgcatccacttggatcaaatgagttatctatggctacagggactagtgagccaggagatggggaggaaactatagtagaagatctgtatgaaagagaaagtgaattagaaaaccaaaacaaaccattcaagtccacaccacctgaccaatatttttcttctcctggaattcctgccccatctatagtatccactgcttcacaggtgcccgtggggcagattgtggttccagcttctgttgacccaacccaggaaaatgctatagctgcactgcagattctaaaggtgatcgaacccagtgctcgagctggtgacttgtgtacccggcgcgagtatgctcgatggttggtagtcgcgagcaattgcctttcaaggaacactttctcgaaagtgtatccagcaatgtatattgataatgtcactgaacttgcatttgatgatgttacacctgaagatcctgatttccccttcatacaaggcctagcagaagctggattgatttctagcaagctttcaagatctgatatgaatatcccagaagatgttcatgacaatcatatcttgttttcccccgagagtcctttgtcacgtcaagaccttgtgagttggaaaatggttctggataggaggcaactgcctgaagttgacagaaattgtttgttcaaagtatctggctatatagacatcgataagataaacacagctgcctggccagctttggtcgctgacttaggtgctggagaccagagcattacagctctttccttcggtttcacaagacttttccaaccgaacaaacctgtgacgaagggacaagctgccctagcaatttcaactggtgattctggtgaagtggttctggaggaggttgctcgtattgaggcagagaaaatagctgaagcagctgtaaatgcacatggtgccttggttgctcaggttgagaaagatcttaatgcaaggtttgaaagggagcttaaggaggaaagagaaaaggtagagacccttgaaaaactagctgaagaagctaggatggagctggataggttgagggaagaaagagaggaagagaagaacattctgctcaggggcagagctgctgttgaatctgaaatggaagttctgttgaagttgaggagtgaagtagaggaacagctgcagaatgtactgagcaagaaggtggaggtctcctttgagaagagtaggattgaaaaactccaaaaggaaattgagaatgataacttggctgttgtgcaacttcaatatgagcttgaagtggagaggaaggcgctatctttggcaagggcttgggcagaggaggaagccaaaaaggcccgggagcatgcacgagcccttgaggatgcccggaaccaatgggagcgtcaaggaatcaaagttgttgttgaaggaggactccaggatgacgcttcagcaggagtcacatgggctaacgctggcaaagaacatccagttgatgaggttatcaaccgggcagaatctttgctggagaagctaaagtcaatgtcagctgagatgaaagtgcggtctcgtggtgcgctggagagggtgatgcaacacgtgaggtccttcattgcaagcctaaagcagcaagctgcagatgcaaggcagtggtgttccgagtttggggcttctgctgcttccaaggcactcatggtatcagcagaagtgcagggcagtgtatctgcgtttggtgcaacccttggagataagtcgaagagggtaatggaagagtgcaaggacggcctggaaaagttttcacacagattcaagacatcagactag

SEQ ID NO: 4664 - protein, 945 aa, Sorghum bicolor
  misc_feature: Ceres ANNOT ID no. 6039604
  misc_feature (410)..(780): NCBI GI: 115468208 NCBI Desc: os06g0499000 [oryza sativa (japonica cultivar-group)]
  misc_feature (450)..(630): NCBI GI: 75909391 NCBI Desc: s-layer region-like [anabaena variabilis atcc 29413]
  misc_feature (439)..(630): NCBI GI: 119511050 NCBI Desc: s-layer region-like protein [nodularia spumigena ccy9414]
  misc_feature (446)..(642): NCBI GI: 126658439 NCBI Desc: s-layer region-like protein [cyanothece sp. ccy0110]
  misc_feature (451)..(634): NCBI GI: 113474253 NCBI Desc: s-layer region-like [trichodesmium erythraeum ims101]
MPAPVAAYPAKMACCLQLHLLRRSAPAPLPARVLLLLSTPRLRLRPVRASPGPGSSPPNSFAGWSSDSADDGADKSTLGFGPAGGLLGPGLAAFFFLAGLTFAAVSIRSSGNHAAAKMQNLPAETAATESYSDYHSHKEDDAISVREEDAQASLPTDWEENNDSLDETKSTDEFLAPLLQSNEEVPGVQAEHEVGHPLQNTEPVTNGNHLVGEEVQQFDNLIASDGNQNPASPPLPISSEYAQVSFAPSSTLDAADPSEGIPNVEETSDLKMALPENEHLDETLTSDAMVLDSDGVVLIQDIADSAVAAAFHPEDKGVEQNPQTHDKDEFSPSGLPDYMEHVSAEEMHPLGSNELSMATGTSEPGDGEETIVEDLYERESELENQNKPFKSTPPDQYFSSPGIPAPSIVSTASQVPVGQIVVPASVDPTQENAIAALQILKVIEPSARAGDLCTRREYARWLVVASNCLSRNTFSKVYPAMYIDNVTELAFDDVTPEDPDFPFIQGLAEAGLISSKLSRSDMNIPEDVHDNHILFSPESPLSRQDLVSWKMVLDRRQLPEVDRNCLFKVSGYIDIDKINTAAWPALVADLGAGDQSITALSFGFTRLFQPNKPVTKGQAALAISTGDSGEVVLEEVARIEAEKIAEAAVNAHGALVAQVEKDLNARFERELKEEREKVETLEKLAEEARMELDRLREEREEEKNILLRGRAAVESEMEVLLKLRSEVEEQLQNVLSKKVEVSFEKSRIEKLQKEIENDNLAVVQLQYELEVERKALSLARAWAEEEAKKAREHARALEDARNQWERQGIKVVVEGGLQDDASAGVTWANAGKEHPVDEVINRAESLLEKLKSMSAEMKVRSRGALERVMQHVRSFIASLKQQAADARQWCSEFGASAASKALMVSAEVQGSVSAFGATLGDKSKRVMEECKDGLEKFSHRFKTSD

SEQ ID NO: 4665 - DNA, 1353 bp, Sorghum bicolor
  misc_feature: Ceres ANNOT ID no. 6039613
  misc_feature: Encodes the peptide sequence at SEQ ID NO 4666
atgaagaaatggggcaacagcgggcaagccgccgattccttctaccaggtccgccccgattgcagccaaaacgtccccaacaccaagttcaagatcaaggcggggaagacactgagcgttcggaaatggcatgctgccttcacgcgtgacggatgcctggatatcgcctctgttctcagccgcatacagagagggggtgtgcaccccgcaatcaggggagaggtttgggagttcttgctcggctgctttgaccctggcagcaccttcgatgagagggaccagattagggagcggagaaggatgcagtatgccagatggaaggaagaatgcaaagaaatggattctcatgttggcagtggtaaaattatcactgccccggttataactgaggatggattccctatcaaggatccattggtattactggaggctacttcagacacgcaaggtacttctaccaccaccaccaccaatggcagcagtggaaatggaattgatgttgataacaactccatgaaccttgtcttggataaacaaatcattggctggaagcttacattacatcaaataggccttgatgttctgcgcactgaccgcaccatggtattttacgagaacaaagataatctttcaaagttgtgggatattcttgctgtctatgcatggatcgacaaagaagttggttattgtcaagggatgagtgatttatgttcacccatgatagtgctactcaacgatgaagcagatgcattttggtgctttgagagattgatgcgtaggctgcgaggcaatttcagatgtacacagcagtcagttggggtggaaaaccagcttcagcatcttgcttctatcattcaggtgcttgatccaaagttgcatggccacctagaaacacttggcgggggtgactatctctttgcattccgcatgttcatggtattgttccggcgagaactatcatttggggattccttgtacctttgggagatgatgtgggctctagaatatgatcctgacatttgctccacttatgaagagactggggctgcagtccacaaaattgaaggatttaaaccaaaggtaaaatcaatacgtcagtttggcaagtacgagagggagaatatgaagaacagggcaaatggtggcgatggacctgtccctatttcggttttcctggttgctagtgtcctgaaagagaacagtccaaagcttctgcaagaggctcgagggattgatgacattattaggatattgaatgatgttaacgggaatctggacgcgaaaagggcttgtgttgttgcactgaagcttcataggaagtaccacaaaaagttgcaggaaaagaaatcctaa

SEQ ID NO: 4666 - protein, 450 aa, Sorghum bicolor
  misc_feature: Ceres ANNOT ID no. 6039613
  misc_feature (152)..(350): Pfam Id: TBC Pfam Desc: TBC domain
  misc_feature (1)..(449): NCBI GI: 50508504 NCBI Desc: gtpase activating protein-like [oryza sativa (japonica cultivar-group)]
  misc_feature (150)..(449): NCBI GI: 42569183 NCBI Desc: rabgap/tbc domain-containing protein [arabidopsis thaliana]
  misc_feature (151)..(448): NCBI GI: 42567218 NCBI Desc: rabgap/tbc domain-containing protein [arabidopsis thaliana]
  misc_feature (1)..(267): NCBI GI: 115486059 NCBI Desc: os11g0587500 [oryza sativa (japonica cultivar-group)]
  misc_feature (175)..(346): NCBI GI: 42566063 NCBI Desc: rabgap/tbc domain-containing protein [arabidopsis thaliana]
MKKWGNSGQAADSFYQVRPDCSQNVPNTKFKIKAGKTLSVRKWHAAFTRDGCLDIASVLSRIQRGGVHPAIRGEVWEFLLGCFDPGSTFDERDQIRERRRMQYARWKEECKEMDSHVGSGKIITAPVITEDGFPIKDPLVLLEATSDTQGTSTTTTTNGSSGNGIDVDNNSMNLVLDKQIIGWKLTLHQIGLDVLRTDRTMVFYENKDNLSKLWDILAVYAWIDKEVGYCQGMSDLCSPMIVLLNDEADAFWCFERLMRRLRGNFRCTQQSVGVENQLQHLASIIQVLDPKLHGHLETLGGGDYLFAFRMFMVLFRRELSFGDSLYLWEMMWALEYDPDICSTYEETGAAVHKIEGFKPKVKSIRQFGKYERENMKNRANGGDGPVPISVFLVASVLKENSPKLLQEARGIDDIIRILNDVNGNLDAKRACVVALKLHRKYHKKLQEKKS

SEQ ID NO: 4667 - DNA, 1110 bp, Sorghum bicolor
  misc_feature: Ceres ANNOT ID no. 6039685
  misc_feature: Encodes the peptide sequence at SEQ ID NO 4668
atggaatccgcgacggcgtccgtccgcagcgcgtcgctcgcgcgggcccggcccgcgctcgtctacgggggcggggcgcggcgcgtcgtgggcgctggccccgccgccgcgcgcgcccggcggagggcgcccctcgtcgtcgcagtcgccgcacaccaccagaaccacctcgagccgctcccgtcgcgcgcgcaggagggcggcgccgtggcggtggcgacgaccacccaggctgacgaggcggaggtccatgcgaacgacgctgcgccggcggcggctgctgaaactgaaacctcgtctccccaactggctcctggtaataagacggtgcgcgtcagatttgtgctgcaaaagcagtgcacgttcggacagagcgtctgcctcgtcggcgacgaccctgcgctcggcctctgggatccgttgaatgcgtttgctttggaatgggcggaggaaagccacgactggatcttagagaaagatttaccggccaacaagctggttgagttcaagttcttgctgcaagattcgacagggaagttgcattggcaggatgggccgaacagaagctttcggacaggtgaaaccgcaaacacgttggttgtgtttgaagattgggatgatgtgaagaatcagaaaatagcagaagaggagggaggggcgtctactgggattgagcaaactgttgtttcaaatgacagcaaaagcacaaaggatactgtttttgaagatgagctccaagcggatgataatcaagtcaaagaagatgaacccgtagttgccaaggaggataagaagccagcggttgacacagatgcttcttttcatgtagattgggtgaagacaaacgaagctagccctcgaaagtcggtgctgcatgaggaaatggaagttctagacgaacttcttggaaaagaaaacatggagaacagcagtatttcgagtactgatgagaatcatgctgaaaaaactggaggagatgatatcttgtctgaggatggtgttccggttgagaatgggttggccactgcttatgaacatgatttgctttggggttggaaggccctgcagcagctgatgatgagcctgggcttcaaaatagatacaacatga

SEQ ID NO: 4668 - protein, 369 aa, Sorghum bicolor
  misc_feature: Ceres ANNOT ID no. 6039685
  misc_feature (109)..(201): Pfam Id: CBM_20 Pfam Desc: Starch binding domain
  misc_feature (95)..(259): NCBI GI: 92871883 NCBI Desc: glycoside hydrolase, starch-binding [medicago truncatula]
  misc_feature (94)..(321): NCBI GI: 23505873 NCBI Desc: at5g01260/f7j8_240 [arabidopsis thaliana]
  misc_feature (20)..(205): NCBI GI: 145594536 NCBI Desc: alpha-amylase [salinispora tropica cnb-440]
  misc_feature (93)..(200): NCBI GI: 90074677 NCBI Desc: gammer-cyclomaltdextrin glucanotransferase [bacillus sp. g-825-6]
  misc_feature (107)..(205): NCBI GI: 54304042 NCBI Desc: cyclodextrin glycosyltransferase [anaerobranca gottschalkii]
MESATASVRSASLARARPALVYGGGARRVVGAGPAAARARRRAPLVVAVAAHHQNHLEPLPSRAQEGGAVAVATTTQADEAEVHANDAAPAAAAETETSSPQLAPGNKTVRVRFVLQKQCTFGQSVCLVGDDPALGLWDPLNAFALEWAEESHDWILEKDLPANKLVEFKFLLQDSTGKLHWQDGPNRSFRTGETANTLVVFEDWDDVKNQKIAEEEGGASTGIEQTVVSNDSKSTKDTVFEDELQADDNQVKEDEPVVAKEDKKPAVDTDASFHVDWVKTNEASPRKSVLHEEMEVLDELLGKENMENSSISSTDENHAEKTGGDDILSEDGVPVENGLATAYEHDLLWGWKALQQLMMSLGFKIDTT

SEQ ID NO: 4669 - DNA, 510 bp, Sorghum bicolor
  misc_feature: Ceres ANNOT ID no. 6039686
  misc_feature: Encodes the peptide sequence at SEQ ID NO 4670
atggcagccagcctgtggcgcgccgtgatggacagcgtcagcggctcctcctcctccccctcggcgctggacgcgcctccgggcggcggcgtcgagttctggcacggtgcggagcgcgcgggttggctaaacaagcaaggcgagtacatcaagacgtggaggcggcggtggttcgtgctcaagcaggggaggctcttctggttcaaggaccctgtggtgacgcgggcctcggtgccccgcggcgtcatccccgtcgcctcctgcctcacagtcaagggcgccgaggacgtgctcaaccgccagttcgccttcgagctctccacgcctgccgagaccatgtacttcatcgcggactccgagaaggagaaggaggagtggattaactccatcggtcgctccatcgtccagcactcccggtccgtcaccgacgcagaggtcgtcgactacgacagccgcccccagcccccgccgcagcctaaggctagcgaagagagtgaaccagcagcttaa

SEQ ID NO: 4670 - protein, 169 aa, Sorghum bicolor
  misc_feature: Ceres ANNOT ID no. 6039686
  misc_feature (37)..(135): Pfam Id: PH Pfam Desc: PH domain
  misc_feature (1)..(153): NCBI GI: 15290005 NCBI Desc: p0683f02.2 [oryza sativa (japonica cultivar-group)]
  misc_feature (3)..(152): NCBI GI: 21536721 NCBI Desc: atph1-like protein [arabidopsis thaliana]
  misc_feature (3)..(152): NCBI GI: 9759096 NCBI Desc: atph1-like protein [arabidopsis thaliana]
  misc_feature (21)..(153): NCBI GI: 115441137 NCBI Desc: os01g0856800 [oryza sativa (japonica cultivar-group)]
  misc_feature (30)..(152): NCBI GI: 5926716 NCBI Desc: atph1 [arabidopsis thaliana]
MAASLWRAVMDSVSGSSSSPSALDAPPGGGVEFWHGAERAGWLNKQGEYIKTWRRRWFVLKQGRLFWFKDPVVTRASVPRGVIPVASCLTVKGAEDVLNRQFAFELSTPAETMYFIADSEKEKEEWINSIGRSIVQHSRSVTDAEVVDYDSRPQPPPQPKASEESEPAA

SEQ ID NO: 4671 - DNA, 1494 bp, Sorghum bicolor
  misc_feature: Ceres ANNOT ID no. 6039690
  misc_feature: Encodes the peptide sequence at SEQ ID NO 4672
atggtgccgggcgagcaggcggaggacgccatcgtggcggcggacgtcggcaacggcaaggacgccggggaggtgcgcgccgccatgggcgtcgtcggcggcgacgacgctgagcagctgcagcagcagcacggcggcggcggcaagttcagcatgaagagcctgctctggcacggcggctccgtctgggacgcctggttcagctgcgcctccaaccaggtggcgcaggtgctgctgacgctgccgtactcgttctcgcagctgggcatggtctccggcgtgctgctgcaggtcttctacggcctcatgggcagctggaccgcctacctcatcagcgtcctctacgtcgagtaccgcgcccgcaaggagaaggaaggcgtcagcttcaagaaccacgtcatccagtggttcgaagttctcgacgggctgctgggcccgtactggaaggccgccgggctcgcgttcaactgcacgttcctgctcttcggcacggtcatccagctgatcgcctgcgcaagcaacatctactacatcaacgaccggctggacaagcggacgtggacgtacatcttcggcgcgtgctgcgccaccaccgtcttcatcccctccttccacaactaccgcgtctggtccttcctcggcctcggaatgaccacctacaccgcctggtacctcaccatcgccgccgccgtccacggccaggtcgacggcgtcacccactcgggcccgaacaagctcgtgccctacttcaccggcgccaccaacatcctctacactttcggtggccatgccatcactgtggagatcatgcacgcgatgtggaagcctcgcaggttcaagtacatctacctgctggcgacggtgtacgtgttcacgctgacgctgccgtcggcggcggccatgtactgggcgttcggcgaccagctgctgacgcactccaacgccttctcgctgctgccgaggacgccgtggcgcgacgcggcggtggtgctgatgctgatccaccagttcatcaccttcgggttcgcgtgcaccccgctcttcttcgtgtgggagaaggcggtgggcatgcacgagacgccgagcgtcttcctccgcgcgctggtccgcctccccatcgtcgtccccgtctggttcctcgccatcatcttccccttcttcgggcccatcaactccgccgtcggcgcgctcctcgtcagcttcaccgtctacatcatccccgccctcgcccacatgctcacgtaccgctccgcgtccgccagactgaatgcagcggagaagccgccgtcgtttctgccgagctggtcggggatgttcgtgctgaacgcgttcgtggtggcgtgggtgctggtggtcggcttcggcctcggcggctgggccagcgtgaccaacttcgtcaagcagatcgacacgttcgggctcttcgccaagtgctaccagtgcccgacgaagacgcacgccgggtcgccgttgccggcgccgccgcatcactga

SEQ ID NO: 4672 - protein, 497 aa, Sorghum bicolor
  misc_feature: Ceres ANNOT ID no. 6039690
  misc_feature (58)..(452): Pfam Id: Aa_trans Pfam Desc: Transmembrane amino acid transporter protein
  misc_feature (1)..(497): NCBI GI: 75254071 NCBI Desc: auxin transporter-like protein 2
  misc_feature (1)..(497): NCBI GI: 85540627 NCBI Desc: auxin transporter-like protein 1
  misc_feature (1)..(497): NCBI GI: 37651177 NCBI Desc: aux1-like auxin influx carrier protein [pisum sativum]
  misc_feature (1)..(497): NCBI GI: 126217792 NCBI Desc: auxin influx transport protein [casuarina glauca]
  misc_feature (33)..(496): NCBI GI: 21586468 NCBI Desc: auxin influx carrier protein [medicago truncatula]
MVPGEQAEDAIVAADVGNGKDAGEVRAAMGVVGGDDAEQLQQQHGGGGKFSMKSLLWHGGSVWDAWFSCASNQVAQVLLTLPYSFSQLGMVSGVLLQVFYGLMGSWTAYLISVLYVEYRARKEKEGVSFKNHVIQWFEVLDGLLGPYWKAAGLAFNCTFLLFGTVIQLIACASNIYYINDRLDKRTWTYIFGACCATTVFIPSFHNYRVWSFLGLGMTTYTAWYLTIAAAVHGQVDGVTHSGPNKLVPYFTGATNILYTFGGHAITVEIMHAMWKPRRFKYIYLLATVYVFTLTLPSAAAMYWAFGDQLLTHSNAFSLLPRTPWRDAAVVLMLIHQFITFGFACTPLFFVWEKAVGMHETPSVFLRALVRLPIVVPVWFLAIIFPFFGPINSAVGALLVSFTVYIIPALAHMLTYRSASARLNAAEKPPSFLPSWSGMFVLNAFVVAWVLVVGFGLGGWASVTNFVKQIDTFGLFAKCYQCPTKTHAGSPLPAPPHH

SEQ ID NO: 4673 - DNA, 978 bp, Sorghum bicolor
  misc_feature: Ceres ANNOT ID no. 6039704
  misc_feature: Encodes the peptide sequence at SEQ ID NO 4674
atgacggagctgtggatggaggtgctgccgccgccctacttcgcgggacaggcggcgggcggcgggtggttcctgccgccgccgccggaccggcgggccgggaccggggcgtggacggtggaggagaacaagatgttcgagcgcgcgctggcgcgggtcgactccgacgcgccggatcggtgggagcgggtcgcccagttgctgcctgggaggacggtggccgacgtcgtcgcccactacgatgacctcgagagcgatgtcggcttcatcgaggccggattcgtgcccttcccccgctacggcggcggcggcggtggcgcgtcgcaatccgctgggttcacgttcgactgggatgccggcgccggcgacgctggctttaagcgctcctgctacgtggttggcggcggcaagcgcgagcgcggtgggccggaccaggagcgcaagaagggcatcccctggacggaggaggagcacaagctgttcttgatgggtctgaagaagtacgggcgcggggactggcggaacatctcgcgcaacttcgtgactagccggacgccgacgcaggtggccagccacgcgcagaagtacttcatccgcctcaactccggcggcaaggacaagcgccgctccagcatccacgacatcaccaccgtcaacctccccgacgacgacaccgcaggcggcggcaacccctcggcctcgccgccctctgtgtctgtgctcacctccacctccaccacaccctcgtccaccaccaccggcggcggcccggtcatctccgagcagtttggcgtcctcgtcgacagcaagcccccgccgccgcaccaccaccaccaccaccacttcttgccgcactcctcctacggcaacgtgaagctcgagcccggcgtcaattcccatcacggtgctggcttcctggacgactctgttctgatgcagatgcagatgcactgcggccagctgcagcctctcggctga

SEQ ID NO: 4674 - protein, 325 aa, Sorghum bicolor
  misc_feature: Ceres ANNOT ID no. 6039704
  misc_feature (35)..(84): Pfam Id: Myb_DNA-binding Pfam Desc: Myb-like DNA-binding domain
  misc_feature (150)..(197): Pfam Id: Myb_DNA-binding Pfam Desc: Myb-like DNA-binding domain
  misc_feature (6)..(319): NCBI GI: 18874263 NCBI Desc: myb-like transcription factor divaricata [antirrhinum majus]
  misc_feature (1)..(271): NCBI GI: 115434468 NCBI Desc: os01g0142500 [oryza sativa (japonica cultivar-group)]
  misc_feature (1)..(270): NCBI GI: 146147359 NCBI Desc: myb_al protein [aeluropus littoralis]
  misc_feature (6)..(245): NCBI GI: 124494160 NCBI Desc: transcription factor div2 [bournea leiophylla]
  misc_feature (6)..(254): NCBI GI: 51557078 NCBI Desc: myb transcription factor [hevea brasiliensis]
  misc_feature: The sequence is a functional homolog of SEQ ID NO 1897 in the 11/479,226US patent application
  misc_feature: The sequence is a functional homolog of SEQ ID NO 1930 in the 10/412,699US patent application
  misc_feature: The sequence is a functional homolog of SEQ ID NO 22 in the 10/225,066US patent application
  misc_feature: The sequence is a functional homolog of SEQ ID NO 246 in the 10/714,887US patent application
  misc_feature: The sequence is a functional homolog of SEQ ID NO 246 in the 11/435,388US patent application
  misc_feature: The sequence is a functional homolog of SEQ ID NO 2870 in the 10/374,780US patent application
  misc_feature: The sequence is a functional homolog of SEQ ID NO 452 in the 10/374,780US patent application
  misc_feature: The sequence is a functional homolog of SEQ ID NO 88 in the 10/225,068US patent application
  misc_feature: The sequence is a functional homolog of SEQ ID NO 886 in the 11/435,388US patent application
  misc_feature: The sequence is a functional homolog of SEQ ID NO 984 in the 10/225,066US patent application
  misc_feature: Useful for making plants with altered alkaloid content
  misc_feature: Useful for making plants with modulated growth and phenotype characteristics
  misc_feature: Functional homolog of the protein sequence given in SEQ ID NO 13278
  misc_feature: The sequence is a functional homolog of SEQ ID NO 1930 in the 20040045049 US patent application
  misc_feature: The sequence is a functional homolog of SEQ ID NO 22 in the 20050160493 US patent application
  misc_feature: The sequence is a functional homolog of SEQ ID NO 1897 in the 20070022495 US patent application
  misc_feature: The sequence is a functional homolog of SEQ ID NO 120 in the 11/375,241 US patent application
  misc_feature: The sequence is a functional homolog of SEQ ID NO 2680 in the 10/374,780 US patent application
  misc_feature: The sequence is a functional homolog of SEQ ID NO 654 in the 10/225,066 US patent application
  misc_feature: The sequence is a functional homolog of SEQ ID NO 1897 in the 11/479,226 US patent application
  misc_feature: The sequence is a functional homolog of SEQ ID NO 22 in the 10/225,066 US patent application
  misc_feature: The sequence is a functional homolog of SEQ ID NO 2870 in the 10/374,780 US patent application
  misc_feature: The sequence is a functional homolog of SEQ ID NO 886 in the 11/435,388 US patent application
  misc_feature: The sequence is a functional homolog of SEQ ID NO 1000 in the 10/225,066 US patent application
  misc_feature: The sequence is a functional homolog of SEQ ID NO 1885 in the 11/479,226 US patent application
  misc_feature: The sequence is a functional homolog of SEQ ID NO 274 in the 10/714,887 US patent application
  misc_feature: The sequence is a functional homolog of SEQ ID NO 274 in the 11/435,388 US patent application
  misc_feature: The sequence is a functional homolog of SEQ ID NO 306 in the 10/374,780 US patent application
  misc_feature: The sequence is a functional homolog of SEQ ID NO 50 in the 10/286,264 US patent application
  misc_feature: The sequence is a functional homolog of SEQ ID NO 928 in the 10/412,699 US patent application
  misc_feature: The sequence is a functional homolog of SEQ ID NO 36 in the 10/286,264 US patent application
  misc_feature: The sequence is a functional homolog of SEQ ID NO 864 in the 10/412,699 US patent application
  misc_feature: Useful for making plants with modulated flowering time
  misc_feature: Functional homolog of the protein sequence given in SEQ ID NO 13566
  misc_feature: The sequence is a functional homolog of SEQ ID NO 976 in the 11/435,388 US patent application
  misc_feature: The sequence is a functional homolog of SEQ ID NO 2720 in the 10/374,780 US patent application
  misc_feature: The sequence is a functional homolog of SEQ ID NO 360 in the 10/225,066 US patent application
  misc_feature: The sequence is a functional homolog of SEQ ID NO 876 in the 11/435,388 US patent application
  misc_feature: Useful for making plants with modulated nitrogen use efficiency
  misc_feature: The sequence is a functional homolog of SEQ ID NO. 514 in the 11/188,298 US application
MTELWMEVLPPPYFAGQAAGGGWFLPPPPDRRAGTGAWTVEENKMFERALARVDSDAPDRWERVAQLLPGRTVADVVAHYDDLESDVGFIEAGFVPFPRYGGGGGGASQSAGFTFDWDAGAGDAGFKRSCYVVGGGKRERGGPDQERKKGIPWTEEEHKLFLMGLKKYGRGDWRNISRNFVTSRTPTQVASHAQKYFIRLNSGGKDKRRSSIHDITTVNLPDDDTAGGGNPSASPPSVSVLTSTSTTPSSTTTGGGPVISEQFGVLVDSKPPPPHHHHHHHFLPHSSYGNVKLEPGVNSHHGAGFLDDSVLMQMQMHCGQLQPLG

SEQ ID NO: 4675 - DNA, 1608 bp, Sorghum bicolor
  misc_feature: Ceres ANNOT ID no. 6039708
  misc_feature: Encodes the peptide sequence at SEQ ID NO 4676
atggcgtcggtcaggtcgtgcgtgtccgtgaagtccgccgtgagcccggtcaggtacagatccacgagggccagggcggccggtctgggggctccgggaaggctgcgcgtacggtccccgtccctggcgctcggcggcgacggtggctgcgccagcgccagcagcagcgggaggggtagcgtcgtcgtcagtggcggcggtctcggcgtgctcggcggcgatggaccgaggatcatccggcggggcggcgggcgggaggtcctcgccatgtgcagcgcgagcttcgacggggtccgtcccgccgccggcgccggcgctgccgtggccagcgccgtgcagcccgtgccggcggcgttccccgagcgcgtcaaggtggtggcgctggtggcggccatcatgctgctctgcaacgccgaccgggtcgtcatgtccgtcgccgtcgtgccgctcgccgcgcagtacgggtggtccagctccttcgtcggcatcgtccagtcgtcgtttttatggggatatgttttctcatccatggttggaggagctttggcagacaaatatggcgggaagaaggtgatggcaggtgctgctgcactctggtccttggctacaattctcactccttgggccgcctcccgctccaccatcatgttgcttgctgtacgtgcactctttggccttgcagaaggtgttgcatttccgacaatgagcaccttcttaccaaagtggttcccaacacatgagcgttccactgctgttggcatttccatgggtggattccatcttggaaatgtcataagcttcctagcaacaccgatcatcatgtcacacataggcctctcgggaacatttgccttcttcgcgtcgcttggttacgtgtggctctttgtatggatgttaaatgtagaaagtgatcctcttgacagccgtactataagcaaatctgaattggaattaattctagctggaagaactggatctaaagtccaaggcagtaaattcccatccctaagggaattgttctcaaggactgaattcttagctgtcactttggccaatgtggtcaacaactggggctattttgtcctattgtcgtggatgcctgtgtacttcaaaacggtttataacgtcaatctgaaacaagcagcatggttcagcgccataccttgggcagtcatggcgatgtccggttatgttgcaggagcctctgcagatttcctgatcaaatctggttactctattggactagttcggaaaattatgcagtccattggtttcatggggccttgtgtgtcattactatgtttaagatttgcccaaactccatcagttgctgcagttctcatgaccactgccctgagcttgagttctttttgccaagccggatacttttgcaatatacaggacattgctccaaaatatgctggatccttgcacgggttgacgaacggcatagggacggtggccgccatagttagcaccatcgggaccggctacttcgtccagtggctagggtccttccaggccttcctcaccctcacggcggcgctctacttcagcgccaccgtcttctacaacatctacgcaaccggcgacctgatttttgactga

SEQ ID NO: 4676 - protein, 535 aa, Sorghum bicolor
  misc_feature: Ceres ANNOT ID no. 6039708
  misc_feature (128)..(493): Pfam Id: MFS_1 Pfam Desc: Major Facilitator Superfamily
  misc_feature (126)..(533): Pfam Id: Sugar_tr Pfam Desc: Sugar (and other) transporter
  misc_feature (91)..(534): NCBI GI: 42569720 NCBI Desc: transporter-related [arabidopsis thaliana]
  misc_feature (92)..(535): NCBI GI: 20805189 NCBI Desc: p0529h11.31 [oryza sativa (japonica cultivar-group)]
  misc_feature (121)..(535): NCBI GI: 51536596 NCBI Desc: at3g46980 [arabidopsis thaliana]
  misc_feature (121)..(535): NCBI GI: 79314547 NCBI Desc: carbohydrate transporter/ sugar porter [arabidopsis thaliana]
  misc_feature (166)..(535): NCBI GI: 115441093 NCBI Desc: os01g0852200 [oryza sativa (japonica cultivar-group)]
MASVRSCVSVKSAVSPVRYRSTRARAAGLGAPGRLRVRSPSLALGGDGGCASASSSGRGSVVVSGGGLGVLGGDGPRIIRRGGGREVLAMCSASFDGVRPAAGAGAAVASAVQPVPAAFPERVKVVALVAAIMLLCNADRVVMSVAVVPLAAQYGWSSSFVGIVQSSFLWGYVFSSMVGGALADKYGGKKVMAGAAALWSLATILTPWAASRSTIMLLAVRALFGLAEGVAFPTMSTFLPKWFPTHERSTAVGISMGGFHLGNVISFLATPIIMSHIGLSGTFAFFASLGYVWLFVWMLNVESDPLDSRTISKSELELILAGRTGSKVQGSKFPSLRELFSRTEFLAVTLANVVNNWGYFVLLSWMPVYFKTVYNVNLKQAAWFSAIPWAVMAMSGYVAGASADFLIKSGYSIGLVRKIMQSIGFMGPCVSLLCLRFAQTPSVAAVLMTTALSLSSFCQAGYFCNIQDIAPKYAGSLHGLTNGIGTVAAIVSTIGTGYFVQWLGSFQAFLTLTAALYFSATVFYNIYATGDLIFD

SEQ ID NO: 4677 - DNA, 2310 bp, Sorghum bicolor
  misc_feature: Ceres ANNOT ID no. 6039716
  misc_feature: Encodes the peptide sequence at SEQ ID NO 4678
  misc_feature: Up-regulated in root tissues in response to methyl jasmonate treatment
  misc_feature: Up-regulated in shoot tissues in response to methyl jasmonate treatment
atggcttcaagggcaatcattagcagaaggaagtatttcttggatcatgttaacacacctgtcatttcatcgtccgccttctctaccttccaacatggaagactcagttttgaggttgagccaagaacagaacagcaatttcttgagcgtagttctggggattccaaatgtgagaaggagcaacacagtatgaatttgataaaaaaggatctactaggttttggttatgggtttcggcaacatccagcttatgtgatttctctttctcatggtggaattggaaagaatgaatacgggctgcctttgagcttgggagctagatctttgctgcagtcagtccgcagagcatcaactgcaactgcagggcagcctaagatggatacagatgatgaacagagtgaggaccagaagcagaataaaaagaaaaaggaggcatccccagaagaatgtgatcaggctgtggaaggcctaagcactgcaaaagctatggctaaagctaagcaggtacaagaatctctgaaggttggccaatcagtcatgcagaaattttgggcgagaattctgggtgtgggccctgctctccgtgctgttgcttcaatgagcagggctgattgggcagcaaagcttaagcattggaaggatgaattcatttctacactgcagcattactggttagggacaaaactactctgggcagatgttaggatctcatcaagattgctggttaaacttgctggtgggaagagtctttcaagaagagagaggcaacagctgacacgcacaacagcagatatcttcaggctggtcccgtttgctgtgttcatcattgttccattcatggaattcttactgccagtcttcctcaagttatttccaaacatgcttccatcaactttccaggacaaaatgaaagaagaggaggcattaaaaaggaaattgaaagcaagaatggagtatgcaaaatttttgcaagataccgcaaaagaaatggcaaaggaagtccagacatctcgtagcggagaaacgaaacagacagctgaagatctggacgagtttttgaataaggttaggagaggtgaacgtgtctctaatgacgaaatcttgaatttcgcaaagctattcaatgatgaacttactctagataacatgagcagaccacgtttggttaatatgtgcaaatatatgggtatccggccttttggtacagaccactacctgaggttcatgcttcgcaaaaaactgcaagacattaagaatgatgataagctgattcaagctgagggagttgaatctctctctgaagaagagctccggcaagcctgccgggagcgtggtcatctaggcctgctgtcaactgaagagatgcgacaacagctccgagactggttggacctctcacttaaccacgctgtgccatcttcacttctcatactttcaagagcctttactgtgtctgggagaatgaagcctgaggaggctgttgtagccacactatcttctctaccagatgaagttgtggatacagtcgggacagtattgccatctgaagattcggtttctgagaggaggagaaaattagaattccttgagatgcaggaagaacttatcaaggaggaagagaaaaagaaagagaaagaagaaaaggcaaaacaaaagaaagaagaggaggcaaagatgaaagaaccagacactgctgaagaagatttagctttgaaggaaatgactgatgctactgctagggaagaagaagaactgagaaaagcaaaagaacatgacaaggaaaagctctgcaatatcagccgtgcattggctgtgctcgcatctgcctcttctgttagcaaggagcgtcaagagttcctgagccttgtcaataaagagatagagctatataactccatgctcgaaaaagagggtactgaaggtgaagaagaagctaaaaaagcatatgtagctgctagggaagagccagaccatgatgctgaggtcgctgcagaagaaaaggtctcgtcagcgctgattgagaaggttgatgctatgcttcaagaattagaaaaggagattgatgatgtggatgcacaaattggaaaccgttggcaacttcttgatagggaccacgatggcaaggtgactcccgaggaggtggctgccgcggcagtctatctgaaggacaccatcgggaaggaaggcgtgcaagagctcatcagcaacctttcgaaggacaaagaaggaaagatcctcgtggaagatattgtgaggctagcatcgcaaacagaggaacacaacgatgacgaagaggaagcacgacagtag

SEQ ID NO: 4678 - protein, 769 aa, Sorghum bicolor
  misc_feature: Ceres ANNOT ID no. 6039716
  misc_feature (209)..(479): Pfam Id: LETM1 Pfam Desc: LETM1-like protein
  misc_feature (1)..(768): NCBI GI: 58198731 NCBI Desc: ca2+ binding protein cbp1 [triticum aestivum]
  misc_feature (1)..(769): NCBI GI: 116310694 NCBI Desc: h0306b06.8 [oryza sativa (indica cultivar-group)]
  misc_feature (49)..(766): NCBI GI: 42562974 NCBI Desc: calcium-binding ef hand family protein [arabidopsis thaliana]
  misc_feature (217)..(761): NCBI GI: 62510844 NCBI Desc: leucine zipper-ef-hand containing transmembrane protein 1, mitochondrial precursor
  misc_feature (217)..(761): NCBI GI: 123993861 NCBI Desc: leucine zipper-ef-hand containing transmembrane protein 1 [synthetic construct]
  misc_feature: Up-regulated in root tissues in response to methyl jasmonate treatment
  misc_feature: Up-regulated in shoot tissues in response to methyl jasmonate treatment
MASRAIISRRKYFLDHVNTPVISSSAFSTFQHGRLSFEVEPRTEQQFLERSSGDSKCEKEQHSMNLIKKDLLGFGYGFRQHPAYVISLSHGGIGKNEYGLPLSLGARSLLQSVRRASTATAGQPKMDTDDEQSEDQKQNKKKKEASPEECDQAVEGLSTAKAMAKAKQVQESLKVGQSVMQKFWARILGVGPALRAVASMSRADWAAKLKHWKDEFISTLQHYWLGTKLLWADVRISSRLLVKLAGGKSLSRRERQQLTRTTADIFRLVPFAVFIIVPFMEFLLPVFLKLFPNMLPSTFQDKMKEEEALKRKLKARMEYAKFLQDTAKEMAKEVQTSRSGETKQTAEDLDEFLNKVRRGERVSNDEILNFAKLFNDELTLDNMSRPRLVNMCKYMGIRPFGTDHYLRFMLRKKLQDIKNDDKLIQAEGVESLSEEELRQACRERGHLGLLSTEEMRQQLRDWLDLSLNHAVPSSLLILSRAFTVSGRMKPEEAVVATLSSLPDEVVDTVGTVLPSEDSVSERRRKLEFLEMQEELIKEEEKKKEKEEKAKQKKEEEAKMKEPDTAEEDLALKEMTDATAREEEELRKAKEHDKEKLCNISRALAVLASASSVSKERQEFLSLVNKEIELYNSMLEKEGTEGEEEAKKAYVAAREEPDHDAEVAAEEKVSSALIEKVDAMLQELEKEIDDVDAQIGNRWQLLDRDHDGKVTPEEVAAAAVYLKDTIGKEGVQELISNLSKDKEGKILVEDIVRLASQTEEHNDDEEEARQ

SEQ ID NO: 4679 - DNA, 726 bp, Sorghum bicolor
  misc_feature: Ceres ANNOT ID no. 6039740
  misc_feature: Encodes the peptide sequence at SEQ ID NO 4680
atgagctgcacgggggcggggcaggccggcggcgggtggctgctcgattacgggctggtggaggaggagatccagggctcggagttcatgtacatggtcgacgacccggccgtctccagcgtgatactggggttcgatgctcccaggaaggacgacggcggcgtccaggacaactccggcgccaagaagagatcccggccagagtccagcgcaccacctggcaccaaggcttgccgtgagaagctccggcgagacaggctcaacgaaaggttcaacgagctctgcgccatcttggagcccggcaagccaccaaaggctgacaaagttgccattctaagcgacgctgcccgtcttctgaaccagctgcgtaccgaggcccagaagcttaagcaatcaaatgaatcactccaggactccatcaagagtctcaaggctgagaagtctgagctgcgagatgagaagacgaggctcaaggccgagagggagaggctggagcagatgctcaagggcgtcagccacgccgcagtggcggctccagcgcccttcgtcccgcaccctgctgctgcagccgccgctccatctttccacccggcggcggcgtttgctcaggctggtaagttcgtgccgtaccccagctacccgccgccggctgcgttctggcagtggataccgccgacgtccctcgacacgaccaaggaccccgcacactggccgccggtcgcctag

SEQ ID NO: 4680 - protein, 241 aa, Sorghum bicolor
  misc_feature: Ceres ANNOT ID no. 6039740
  misc_feature (72)..(123): Pfam Id: HLH Pfam Desc: Helix-loop-helix DNA-binding domain
  misc_feature (100)..(241): NCBI GI: 115464245 NCBI Desc: os05g0455400 [oryza sativa (japonica cultivar-group)]
  misc_feature (46)..(241): NCBI GI: 92896368 NCBI Desc: prefoldin; helix-loop-helix dna-binding [medicago truncatula]
  misc_feature (5)..(241): NCBI GI: 38636768 NCBI Desc: helix-loop-helix-like protein [oryza sativa (japonica cultivar-group)]
  misc_feature (60)..(241): NCBI GI: 29367409 NCBI Desc: helix-loop-helix-like protein [oryza sativa (japonica cultivar-group)]
  misc_feature (55)..(241): NCBI GI: 92918531 NCBI Desc: helix-loop-helix dna-binding [medicago truncatula]
  misc_feature: The sequence is a functional homolog of SEQ ID NO 10 in the 10/666,642US patent application
  misc_feature: The sequence is a functional homolog of SEQ ID NO 1203 in the 11/479,226US patent application
  misc_feature: The sequence is a functional homolog of SEQ ID NO 2422 in the 10/374,780US patent application
  misc_feature: The sequence is a functional homolog of SEQ ID NO 54 in the 10/412,699US patent application
  misc_feature: The sequence is a functional homolog of SEQ ID NO 542 in the 10/412,699US patent application
  misc_feature: The sequence is a functional homolog of SEQ ID NO 814 in the 10/225,066US patent application
  misc_feature: Useful for making plants with modulated growth and phenotype characteristics
  misc_feature: The sequence is a functional homolog of SEQ ID NO 54 in the 20040045049 US patent application
  misc_feature: The sequence is a functional homolog of SEQ ID NO 542 in the 20040045049 US patent application
  misc_feature: The sequence is a functional homolog of SEQ ID NO 1203 in the 11/479,226 US patent application
  misc_feature: The sequence is a functional homolog of SEQ ID NO 2422 in the 10/374,780 US patent application
  misc_feature: The sequence is a functional homolog of SEQ ID NO 542 in the 10/412,699 US patent application
  misc_feature: The sequence is a functional homolog of SEQ ID NO 814 in the 10/225,066 US patent application
  misc_feature: Useful for making plants with altered lignin content
  misc_feature: Functional homolog of the protein sequence given in SEQ ID NO 12959
MSCTGAGQAGGGWLLDYGLVEEEIQGSEFMYMVDDPAVSSVILGFDAPRKDDGGVQDNSGAKKRSRPESSAPPGTKACREKLRRDRLNERFNELCAILEPGKPPKADKVAILSDAARLLNQLRTEAQKLKQSNESLQDSIKSLKAEKSELRDEKTRLKAERERLEQMLKGVSHAAVAAPAPFVPHPAAAAAAPSFHPAAAFAQAGKFVPYPSYPPPAAFWQWIPPTSLDTTKDPAHWPPVA

SEQ ID NO: 4681 - DNA, 858 bp, Sorghum bicolor
  misc_feature: Ceres ANNOT ID no. 6039745
  misc_feature: Encodes the peptide sequence at SEQ ID NO 4682
atgccttcggccgccgcggccgccgcggcgcctctccaccgcatcgcatgcgcgcgtcagcgcctccctcaaacctccctcttcttcctcccaccccgcgcgctccccaattccgggcgcctcaccgtcccggccccgctgcccgttcacgcgctgaggctgcctccgacggcgacgagggcggcaagccacgacgccgccacgggcgcgagatcgcccacatctggcggccagatgttggtgttcgtcccgccgcacccgctgataaagcattgggtctccgtgctgcgcaacgaacagacaccgtgcgccatcttcaagcttggtcggctgctcatatatgaagcatccagagattggttgcctacaatcacaggagagattgaaacacccgtagctgtagctagcgttgaatttattgatccaagagagcctgttctggttgttccgatactgagagctggtcttgcactagctgaacttgcttcatcagttctgccagcaaccaagacttatcaccttggcctccgtagagatgaagaaacacttcaaccttcaatatacctgaacaacctgccagacaaaattccagaggggactcgtgtactagttgttgacccaatgctggccactggtgggacaatggttgctgctattgacttattaatcgagcgcggagttaccagcaagcagattaaagttgtatctgctgttgcatcacctcctgcactgcaaaagctcaataacaagttccctgggctccatgtgtacacaggaataattgatccggaagtaaatgagaaaggttttatagttccaggactgggggatgctggcgacagaagctttgccacataa

SEQ ID NO: 4682 - protein, 285 aa, Sorghum bicolor
  misc_feature: Ceres ANNOT ID no. 6039745
  misc_feature (107)..(257): Pfam Id: Pribosyltran Pfam Desc: Phosphoribosyl transferase domain
  misc_feature (75)..(285): NCBI GI: 1848214 NCBI Desc: uracil phosphoribosyltransferase [nicotiana tabacum]
  misc_feature (60)..(285): NCBI GI: 21536984 NCBI Desc: uracil phosphoribosyltransferase-like protein [arabidopsis thaliana]
  misc_feature (78)..(285): NCBI GI: 16329360 NCBI Desc: uracil phosphoribosyltransferase [synechocystis sp. pcc 6803]
  misc_feature (78)..(285): NCBI GI: 81169405 NCBI Desc: uracil phosphoribosyltransferase [synechococcus elongatus pcc 7942]
  misc_feature (78)..(285): NCBI GI: 61216942 NCBI Desc: uracil phosphoribosyltransferase (ump pyrophosphorylase) (uprtase)
  misc_feature (75)..(285): SWISSPROT Homolog: EC 2.4.2.9 Uracil phosphoribosyltransferase
  misc_feature: The sequence is a functional homolog of SEQ ID NO. 524 in the 11/188,298 US application
MPSAAAAAAAPLHRIACARQRLPQTSLFFLPPRALPNSGRLTVPAPLPVHALRLPPTATRAASHDAATGARSPTSGGQMLVFVPPHPLIKHWVSVLRNEQTPCAIFKLGRLLIYEASRDWLPTITGEIETPVAVASVEFIDPREPVLVVPILRAGLALAELASSVLPATKTYHLGLRRDEETLQPSIYLNNLPDKIPEGTRVLVVDPMLATGGTMVAAIDLLIERGVTSKQIKVVSAVASPPALQKLNNKFPGLHVYTGIIDPEVNEKGFIVPGLGDAGDRSFAT

SEQ ID NO: 4683 - DNA, 810 bp, Sorghum bicolor
  misc_feature: Ceres ANNOT ID no. 6039746
  misc_feature: Encodes the peptide sequence at SEQ ID NO 4684
atggacgagggctacgccaacctccccaccagccacctcctcggctccgtccccgctgtgacacaggacgacaggaaacacgtcccccccgccgcccaagatgcagctgccacctctcggttgcaggagttcccgcctgctcctggtggtaatggaggagggtatcgtccaccaagtggccctgcagatggagatgtagaaaaccaagcagattggaaaggatacttcaatgttgcatcttatgctccatacttcaatgttgatactgatgttgtagttgacaggctcatcagttcaatttatccaatggatgggttttacaggaaaattgatgctaatcctgacatgtatgggcctttatggatcaccactactctggttttcatgctagctgcgtttggtaactatgccacttatctgatgcaaaataaaaaggatctggacatatggaactttgatgttggttatttcagttgggcagcatcagtcatgtatggttatgctatcattgtgcccgctctgttctttttcctgtttcagtattttggatcacgccaaagtcttgttcgattttggtgtatgtggggctattctctgtttgtcttcatacctgcatctgtacttttgcttattcctgtggaatttcttcgatgggtcatcatagctcttgctggtggtgcatcatcttggttcatcgctttaaatttgaaggaatgcactgaaggagctgatctgatggttctgatagctagtgcatcggtgctgcaagttgctctggcactgttcatcaaagttttcttttttgcctga

SEQ ID NO: 4684 - protein, 269 aa, Sorghum bicolor
  misc_feature: Ceres ANNOT ID no. 6039746
  misc_feature (85)..(250): Pfam Id: Yip1 Pfam Desc: Yip1 domain
  misc_feature (1)..(268): NCBI GI: 145330697 NCBI Desc: integral membrane yip1 family protein [arabidopsis thaliana]
  misc_feature (5)..(268): NCBI GI: 30690667 NCBI Desc: integral membrane yip1 family protein [arabidopsis thaliana]
  misc_feature (5)..(268): NCBI GI: 38604050 NCBI Desc: at5g27490 [arabidopsis thaliana]
  misc_feature (22)..(269): NCBI GI: 119496974 NCBI Desc: yip1 domain family [neosartorya fischeri nrrl 181]
  misc_feature (22)..(269): NCBI GI: 119397895 NCBI Desc: yip1 domain family [aspergillus clavatus nrrl 1]
MDEGYANLPTSHLLGSVPAVTQDDRKHVPPAAQDAAATSRLQEFPPAPGGNGGGYRPPSGPADGDVENQADWKGYFNVASYAPYFNVDTDVVVDRLISSIYPMDGFYRKIDANPDMYGPLWITTTLVFMLAAFGNYATYLMQNKKDLDIWNFDVGYFSWAASVMYGYAIIVPALFFFLFQYFGSRQSLVRFWCMWGYSLFVFIPASVLLLIPVEFLRWVIIALAGGASSWFIALNLKECTEGADLMVLIASASVLQVALALFIKVFFFA

SEQ ID NO: 4685 - DNA, 771 bp, Sorghum bicolor
  misc_feature: Ceres ANNOT ID no. 6039747
  misc_feature: Encodes the peptide sequence at SEQ ID NO 4686
atggccacctccgcggccctccgccgcgcgccctgggcggcggcggcgcgcggtctccttggcgccatgagtggctcgcgggtgcctcctccccgtcgcctcccgtaccgcgctgagcgctccgcagctctctcctccctctccgacccgcagccgggcgccgctgccgacgcccacctcctccgggtcataaactatgagatctcctgcgcccagcaagactgcaagaagcgcgactgggcgaaggaattaggggagtggttcccttttgagatccaggataaggagggtaccactaggataattctcaccaggagagatcagaaggagcaaattgaagtggaggtgttcttgccgagccctgccgagccagtggagcacaatggtgagcagaaggatggcaccaaagatgacaacagccaggctcatgctatcaatggtgctgcaaatcggtactatatcccgctgctggtgaaaattcacaaagggatggcttcgtggctggagatcagctgtagatcttaccctgatgaacttgccattgagagcttggcgtttggaccgacggatgagtctgttgattcatcaaatgttgaagctaagataagtaatcttcctgaggaacttcagcatgcattttatgcctacttgaaaagtagagccatttcgtcagatgttaccaacttcttgcatgcgtacatgataaacaaagagtgccatgagtatctcgcttggctgagaaaacttaaaggtttgataaaaagtaaatga

SEQ ID NO: 4686 - protein, 256 aa, Sorghum bicolor
  misc_feature: Ceres ANNOT ID no. 6039747
  misc_feature (64)..(253): Pfam Id: MAM33 Pfam Desc: Mitochondrial glycoprotein
  misc_feature (4)..(253): NCBI GI: 50725737 NCBI Desc: mitochondrial glycoprotein-like [oryza sativa (japonica cultivar-group)]
  misc_feature (55)..(256): NCBI GI: 20334884 NCBI Desc: at1g15870/f7h2_19 [arabidopsis thaliana]
  misc_feature (54)..(256): NCBI GI: 6503284 NCBI Desc: f23a5.7 [arabidopsis thaliana]
  misc_feature (36)..(249): NCBI GI: 89297453 NCBI Desc: mitochondrial glycoprotein [tetrahymena thermophila sb210]
  misc_feature (58)..(253): NCBI GI: 13605746 NCBI Desc: at4g31930/f10n7_260 [arabidopsis thaliana]
  misc_feature: Useful for making plants with modulated cold sensitivity
  misc_feature: Functional homolog of the protein sequence given in SEQ ID NO 13001
MATSAALRRAPWAAAARGLLGAMSGSRVPPPRRLPYRAERSAALSSLSDPQPGAAADAHLLRVINYEISCAQQDCKKRDWAKELGEWFPFEIQDKEGTTRIILTRRDQKEQIEVEVFLPSPAEPVEHNGEQKDGTKDDNSQAHAINGAANRYYIPLLVKIHKGMASWLEISCRSYPDELAIESLAFGPTDESVDSSNVEAKISNLPEELQHAFYAYLKSRAISSDVTNFLHAYMINKECHEYLAWLRKLKGLIKSK

SEQ ID NO: 4687 - DNA, 939 bp, Sorghum bicolor
  misc_feature: Ceres ANNOT ID no. 6039751
  misc_feature: Encodes the peptide sequence at SEQ ID NO 4688
atggctgaatcctttgttctcaataccggcgcgaggatcccatcggttgggcttggcgtatggcaaatacaacctgacgctgctgtcaacgccatctacgctgctgtcaaggctgggtatcggcatatcgattgtgctccagcatacagcaatgagaaggaggtgggtttggctttgaagaaattatttgaagatggtgtggttaagcgtgatgatttgtttatcacctctaagctatggtctgctaatcatgcacctgaagatgtgaaagagggatttgataccacacttcaagatttgcagcttgactacttagatttgtacctcatccatggtccaatccgtatcaaaaaaggaactagcattacgagccctgaaaattttatccctacagatatccctactacatgggcagcaatggagaagttatacgaatctggcaaagctcgtgcaatcggcgtgagtaatttttcttgtaagaagctggatgatttgtttgccgttgctcgagtgcctccagcagtgaaccaggttgagtgccatccggtttggcagcaagacaagctccggaagttatgccaatccaagggtgttcatctttctgcattttcgcctttaggctcacctggatctcctggaatcaatgggtcaagtgtcctcgagaactcgattgtggtctctgttgcagagaagttgcagaaaacacctgcccaggtcgctctacgctggggaattcaaatgggccatagtgtactaccaaaaagcgccaatgaatcaaggattaaggagaacattgacatatttgactggtctattccagaagatttgatggcgaagttctctgaaatcaaacaggtcaggctgctgagagctgagtttgcagttcaccctcaaggcggctacaatacattagaggatttttgggatggtgaaatataa

SEQ ID NO: 4688 - protein, 312 aa, Sorghum bicolor
  misc_feature: Ceres ANNOT ID no. 6039751
  misc_feature (7)..(285): Pfam Id: Aldo_ket_red Pfam Desc: Aldo/keto reductase family
  misc_feature (1)..(312): NCBI GI: 115441039 NCBI Desc: os01g0847700 [oryza sativa (japonica cultivar-group)]
  misc_feature (1)..(312): NCBI GI: 115464263 NCBI Desc: os05g0456300 [oryza sativa (japonica cultivar-group)]
  misc_feature (1)..(312): NCBI GI: 99033786 NCBI Desc: aldose reductase [zea mays]
  misc_feature (1)..(312): NCBI GI: 13160397 NCBI Desc: aldose reductase [digitalis purpurea]
  misc_feature (1)..(312): NCBI GI: 13160399 NCBI Desc: aldose reductase [digitalis purpurea]
MAESFVLNTGARIPSVGLGVWQIQPDAAVNAIYAAVKAGYRHIDCAPAYSNEKEVGLALKKLFEDGVVKRDDLFITSKLWSANHAPEDVKEGFDTTLQDLQLDYLDLYLIHGPIRIKKGTSITSPENFIPTDIPTTWAAMEKLYESGKARAIGVSNFSCKKLDDLFAVARVPPAVNQVECHPVWQQDKLRKLCQSKGVHLSAFSPLGSPGSPGINGSSVLENSIVVSVAEKLQKTPAQVALRWGIQMGHSVLPKSANESRIKENIDIFDWSIPEDLMAKFSEIKQVRLLRAEFAVHPQGGYNTLEDFWDGEI

SEQ ID NO: 4689 - DNA, 936 bp, Sorghum bicolor
  misc_feature: Ceres ANNOT ID no. 6039752
  misc_feature: Encodes the peptide sequence at SEQ ID NO 4690
atggccacccacttcgtcctcaacaccggcgcgaagatcccgtcggtcgggctcggcacctggcagtccgacaatggactcgtcggcgacgccgtctatgccgccgtgaaggcaggttacaggcacatcgactgtgctcaagcatacaacaacgagaaagaggtcgggtttggtctcaagaaagtgctggacgagggcatagtcaagcgtgaagatctcttcatcacctccaaactctggaacaccaaccatgcgccggaggacgtcccggttgcgctggacggcacactcaagaacctgcaaactgactacgtggatctttacctcatacattggccggtgagaatgaagaaagacgccgggttcggcccgcagagcgtggtcccgtcagatatccccgcgacgtgggcggcgatggagaagctgtacgacgccggcaaggcgcgcgccatcggcgtcagcaacttctcgagcaagaagctagcggacctgctcgccgtggcgcgcgtgcccccggccgtcgaccaggtggagtgccaccccgtgtggcagcagggcaagctccgcgccttctgcgtggccaacgggatccacctctccgcctactcgccgttggggtcgccgggaacgatgatggtgaaggcgggcgcggtgctggagcacccggtcgtcgtgtcggcggcggagaagctcgggaagacgccggcgcaggtggcgctgcgctggggcatccagatggggcacagcgtgctcccgaagagcaccgacgaggagaggatcagggcgaacttcgacgtctacgactggtccatcccggacgaattgttcgccaagttctcggagattgagcaggagaagctgattcgcgcgggcttttttgttgatcccgaaggcgtgttcaaatccatcgaagagttttgggatggcgagatctga

SEQ ID NO: 4690 - protein, 311 aa, Sorghum bicolor
  misc_feature: Ceres ANNOT ID no. 6039752
  misc_feature (7)..(284): Pfam Id: Aldo_ket_red Pfam Desc: Aldo/keto reductase family
  misc_feature (1)..(311): NCBI GI: 115464263 NCBI Desc: os05g0456300 [oryza sativa (japonica cultivar-group)]
  misc_feature (1)..(311): NCBI GI: 99033786 NCBI Desc: aldose reductase [zea mays]
  misc_feature (1)..(311): NCBI GI: 115441039 NCBI Desc: os01g0847700 [oryza sativa (japonica cultivar-group)]
  misc_feature (3)..(311): NCBI GI: 79324628 NCBI Desc: oxidoreductase [arabidopsis thaliana]
  misc_feature (5)..(311): NCBI GI: 13160397 NCBI Desc: aldose reductase [digitalis purpurea]
MATHFVLNTGAKIPSVGLGTWQSDNGLVGDAVYAAVKAGYRHIDCAQAYNNEKEVGFGLKKVLDEGIVKREDLFITSKLWNTNHAPEDVPVALDGTLKNLQTDYVDLYLIHWPVRMKKDAGFGPQSVVPSDIPATWAAMEKLYDAGKARAIGVSNFSSKKLADLLAVARVPPAVDQVECHPVWQQGKLRAFCVANGIHLSAYSPLGSPGTMMVKAGAVLEHPVVVSAAEKLGKTPAQVALRWGIQMGHSVLPKSTDEERIRANFDVYDWSIPDELFAKFSEIEQEKLIRAGFFVDPEGVFKSIEEFWDGEI

SEQ ID NO: 4691 - DNA, 345 bp, Sorghum bicolor
  misc_feature: Ceres ANNOT ID no. 6039754
  misc_feature: Encodes the peptide sequence at SEQ ID NO 4692
atggtgagagttagtgtcttgaacgatgctctcaagagcatgtataatgctgagaagcgtgggaagaggcaagtgatgatcagaaggtatatcggtgagtttgagtatgttgatgaccatcgtgctggaaagattgttgttgagttgaacggcaggctgaacaagtgtggagtaatcagtcctcgttttgatgttggtgtcaaggaaattgaagggtggactgctaggctccttccatctcgtcagtttggtttcattgttttgacgacctctgctggcatcatggatcatgaagaggccaggaggaagaatgttggtggcaaggtgctagggtttttctactag

SEQ ID NO: 4692 - protein, 114 aa, Sorghum bicolor
  misc_feature: Ceres ANNOT ID no. 6039754
  misc_feature (5)..(114): Pfam Id: Ribosomal_S8 Pfam Desc: Ribosomal protein S8
  misc_feature (1)..(114): NCBI GI: 6683481 NCBI Desc: wrp15a [citrullus lanatus]
  misc_feature (1)..(114): NCBI GI: 17863 NCBI Desc: r-protein bns15a [brassica napus]
  misc_feature (1)..(114): NCBI GI: 119720818 NCBI Desc: 40s ribosomal protein s15a [brassica rapa]
  misc_feature (1)..(114): NCBI GI: 13560779 NCBI Desc: cytoplasmic ribosomal protein s15a [daucus carota]
  misc_feature (1)..(114): NCBI GI: 2130985 NCBI Desc: r-protein bns15a [brassica napus]
MVRVSVLNDALKSMYNAEKRGKRQVMIRRYIGEFEYVDDHRAGKIVVELNGRLNKCGVISPRFDVGVKEIEGWTARLLPSRQFGFIVLTTSAGIMDHEEARRKNVGGKVLGFFY

SEQ ID NO: 4693 - DNA, 561 bp, Sorghum bicolor
  misc_feature: Ceres ANNOT ID no. 6039772
  misc_feature: Encodes the peptide sequence at SEQ ID NO 4694
atggcagaggtgatagatctaacgggagatggaggtgttcttaagacagtagtccggaaagcaaaagacgatgctatagcgccgtctgagagcctgcctttagttgatgttcattatgaaggtacacttgctgagactggtgaagtttttgataccacccatgaagacaactctattttctcatttgaaattggacaaggggctgtcatcaaggcatgggatatagccttaagaactatgaaggttggcgaggttgcaaaaattacatgcaagtcagaatatgcatacggagctgcaggctcaccaccagagatacctcctaatgcaacccttatttttgaggtggagctattagcttgcaggccgaggaaaggttcaagtgtggggagtgcatctgatgagaaagccagacttgaggaacttaagaagcaacgagagctagctgctgctaccaaagaagaagagaaaaagaagagggaggaagcaaaagccgctgcagcagcccgggtacaagcaaagcttgatgcgaagaaggggaagggaaaaggaaagggaaaatag

SEQ ID NO: 4694 - protein, 186 aa, Sorghum bicolor
  misc_feature: Ceres ANNOT ID no. 6039772
  misc_feature (15)..(118): Pfam Id: FKBP_C Pfam Desc: FKBP-type peptidyl-prolyl cis-trans isomerase
  misc_feature (1)..(186): NCBI GI: 76057837 NCBI Desc: peptidyl prolyl cis-trans isomerase [oryza sativa (indica cultivar-group)]
  misc_feature (1)..(186): NCBI GI: 115464287 NCBI Desc: os05g0458100 [oryza sativa (japonica cultivar-group)]
  misc_feature (1)..(186): NCBI GI: 92875677 NCBI Desc: peptidylprolyl isomerase, fkbp-type [medicago truncatula]
  misc_feature (1)..(156): NCBI GI: 30172151 NCBI Desc: peptidylprolyl cis-trans isomerase [oryza sativa (indica cultivar-group)]
  misc_feature (5)..(134): NCBI GI: 108873300 NCBI Desc: fk506-binding protein [aedes aegypti]
  misc_feature (3)..(117): SWISSPROT Homolog: EC 5.2.1.8 FK506-binding protein 4
  misc_feature: The plant is abnormally small.
  misc_feature: Useful for making plants with modulated biomass
  misc_feature: GREAT-hit functional homolog of the protein sequence given in SEQ ID NO 12926
  misc_feature: Useful for making plants with modulated biomass
  misc_feature: Functional homolog of the protein sequence given in SEQ ID NO 12926
MAEVIDLTGDGGVLKTVVRKAKDDAIAPSESLPLVDVHYEGTLAETGEVFDTTHEDNSIFSFEIGQGAVIKAWDIALRTMKVGEVAKITCKSEYAYGAAGSPPEIPPNATLIFEVELLACRPRKGSSVGSASDEKARLEELKKQRELAAATKEEEKKKREEAKAAAAARVQAKLDAKKGKGKGKGK

SEQ ID NO: 4695 - DNA, 2448 bp, Sorghum bicolor
  misc_feature: Ceres ANNOT ID no. 6039778
  misc_feature: Encodes the peptide sequence at SEQ ID NO 4696
atgacgctcgcctccctcgcccgcgccctcggccggtccgcgcgctcctcccggccgcgccagggtttccagctcgggggcctccggcagtcgccagcgccgccgctaccgccgcctgtccacggccgtgagagcggggcgacaggatttgtccgtagttacctgactgcggcatcgtcggcagctcttgggaagcccgcagcgggcaagactgtggactggagatacatcctcgccagcccacagttccgacgcctcttctcggacgagtccaagaagaactatgagaactactacccgaagggtaagaaggaggcgccgaaaggagatgggagtaacaagtctgaatcgaagcaggaatccaatacagatgaaggatggaatttccaggataatgctatgaaacacctgcagaatttccttgcacctctattaattcttggcctgatgctatcatccatgtcatctagcaccgcagaccagaaggagataagcttccaagagttcaagaacaagttactagaacctggtttagttgatcgcattgttgtttcaaataaatcagtagcgaaggtctacatcaggaattcacctcttccaaagagccaaggccaaaatagtgatacccatatttctaccactgatattccaggcaagcctgctcccagcagatgcaagtattacttcaacattggtagtgttgattcctttgaagagaagttagaggaagcccaggaagctttgggaatagattcacatgattttgtcccagtaacttatgttgctgaagtaaattggttccaagaagttatgaggtttgccccaacagcatttcttgttggtctgatatattttatgggaaaaaggatgcagagtggtttcaatattggaggtggtcctggcaaaggaagaggaggtattttcaacattggaaaagctacagtgacaaagatggacaagaactccaaaaataaggtgttttttaaggatgtagccggttgtgacgaagcaaaacaagaaataatggagtttgtgcatttccttaaaaatcccaagaagtatgaagatttgggagctaaaatacccaaaggtgctctacttgtaggccctcctgggacagggaagactttgcttgccaaagctaccgcaggagagtctggtgtgccatttttgtctatttctggttcagatttcatggaaatgtttgttggtgttggaccatccagggtacggaacttgttccaagaagctagacagtgtgctcccagtattgtattcattgacgaaatcgacgctattggtcgtgcaagaggacgtggaggtttttcaggttcaaatgatgaacgcgagagtactttgaaccagctgcttgtagagatggatggatttggaacaactgctggtgttgttgttcttgctgggacaaatagacctgacatcctggataaggcattattaaggccaggaagatttgatcgccagataacaattgacaagccagatataaagggtcgtgatcaaatattccgcatatatcttcaaaagcttaagctagacaacgaaccatcattttattcgcaaaggctagctgccttgacacctgggtttgcaggagctgacattgccaatgtttgtaatgaagctgctttaattgctgcgagaagtgagaaaactcagattaccatgcagcattttgagtctgcgattgataggattattggtggtttggagaagaaaaatagggtcattagcaaactggagcgccgtaccgttgcttaccatgaatctggacatgctgttgctggatggttcttggagcatgcagagcctcttctgaaagttacaattgttcctcgtggaacagctgctttaggctttgcacaatatgtcccaaatgaaaatcttttgatgacaaaagagcagctttttgatatgacatgcatgacattaggtggccgagctgcagaggaggttttgattggcaaaatctcaactggtgctcagaatgacttggagaaagttaccaaaatgacatatgcacaggtcgctgtgtatggttttagtgaaaaggttgggcttctatccttccctcagaaggatgatggttttgaaatgaccaagccttacagtaatcagacggcatccatcatcgatgatgaggtccgggactgggttggcaaggcctataagaaaacagttgaattgataacagagcataaggagcaagttgcgcaaatcgcagaattactgcttgagaaggaagtcttacaccaggacgatctaaccagggtactaggagaacgtccattcaaggcactggagccaaccaactacgacctctttaagcaaggtttccaggatgatgatgacaagagccaagcaacatcagagaacgctgagttgcctgatgattcatctcccccacttggtgaggttgtacccacgtag

SEQ ID NO: 4696 - protein, 815 aa, Sorghum bicolor
  misc_feature: Ceres ANNOT ID no. 6039778
  misc_feature (561)..(764): Pfam Id: Peptidase_M41 Pfam Desc: Peptidase family M41
  misc_feature (364)..(554): Pfam Id: AAA Pfam Desc: ATPase family associated with various cellular activities(AAA)
  misc_feature (162)..(338): Pfam Id: FtsH_ext Pfam Desc: FtsH Extracellular
  misc_feature (1)..(815): NCBI GI: 115464291 NCBI Desc: os05g0458400 [oryza sativa (japonica cultivar-group)]
  misc_feature (1)..(815): NCBI GI: 15021761 NCBI Desc: aaa-metalloprotease ftsh [pisum sativum]
  misc_feature (1)..(815): NCBI GI: 92873588 NCBI Desc: aaa atpase; bacterial luciferase-like; peptidase m41, ftsh extracellular [medicago truncatula]
  misc_feature (10)..(662): NCBI GI: 8778569 NCBI Desc: f22g5.10 [arabidopsis thaliana]
  misc_feature (305)..(803): NCBI GI: 92868752 NCBI Desc: aaa atpase; peptidase m41, ftsh extracellular [medicago truncatula]
  misc_feature: The sequence is a functional homolog of SEQ ID NO. 462 in the 11/188,298 US application
  misc_feature: The sequence is a functional homolog of SEQ ID NO. 471 in the 11/188,298 US application
MTLASLARALGRSARSSRPRQGFQLGGLRQSPAPPLPPPVHGRESGATGFVRSYLTAASSAALGKPAAGKTVDWRYILASPQFRRLFSDESKKNYENYYPKGKKEAPKGDGSNKSESKQESNTDEGWNFQDNAMKHLQNFLAPLLILGLMLSSMSSSTADQKEISFQEFKNKLLEPGLVDRIVVSNKSVAKVYIRNSPLPKSQGQNSDTHISTTDIPGKPAPSRCKYYFNIGSVDSFEEKLEEAQEALGIDSHDFVPVTYVAEVNWFQEVMRFAPTAFLVGLIYFMGKRMQSGFNIGGGPGKGRGGIFNIGKATVTKMDKNSKNKVFFKDVAGCDEAKQEIMEFVHFLKNPKKYEDLGAKIPKGALLVGPPGTGKTLLAKATAGESGVPFLSISGSDFMEMFVGVGPSRVRNLFQEARQCAPSIVFIDEIDAIGRARGRGGFSGSNDERESTLNQLLVEMDGFGTTAGVVVLAGTNRPDILDKALLRPGRFDRQITIDKPDIKGRDQIFRIYLQKLKLDNEPSFYSQRLAALTPGFAGADIANVCNEAALIAARSEKTQITMQHFESAIDRIIGGLEKKNRVISKLERRTVAYHESGHAVAGWFLEHAEPLLKVTIVPRGTAALGFAQYVPNENLLMTKEQLFDMTCMTLGGRAAEEVLIGKISTGAQNDLEKVTKMTYAQVAVYGFSEKVGLLSFPQKDDGFEMTKPYSNQTASIIDDEVRDWVGKAYKKTVELITEHKEQVAQIAELLLEKEVLHQDDLTRVLGERPFKALEPTNYDLFKQGFQDDDDKSQATSENAELPDDSSPPLGEVVPT

SEQ ID NO: 4697 - DNA, 729 bp, Sorghum bicolor
  misc_feature: Ceres ANNOT ID no. 6039789
  misc_feature: Encodes the peptide sequence at SEQ ID NO 4698
atggagtacgtaaaccctctcactggcttccgcgtcgacggccgacgccccaacgagatgcggcaactcaagggcgaggtcggcgtcgttgcgcgcgcagacgggtcggcgttgttcgagatgggcaacaccagagtcatcgctgccgtctacggccctcgagaggttcagaacaaaggtcagcaagtaaacagcaatgaagctttggttcgttgtgagtataggatggcagaatttagtacaggagatcggaggagaaaaccgaagggtgacaggcgatcaacagaaatttctcttgttattcgacagacaatggaggcaagcatattaacacatttaatgccacgctcacagattgatatatatgtccaagttcttcaagctgatggtggaacaaggtcagcttgcatcaatgctgcaacactagctcttgcagatgctgggattccaatgcgagacattgtcacatcttgtagtgctggctatctgtgttctactcctttgctcgatctgaattaccttgaagacagtgctgggggttccgatgtcactgttggcattcttgcaaagatggacaaagtgactttgcttcagatggatgcaaaattaccgatggatacatttgaaaatgtaatgggacttgcaatagaagggtgcaaagcaattgcaacttacattcgagaggtgctattggagaatacaaagaagcttgagtgtcagcgtggttaa

SEQ ID NO: 4698 - protein, 242 aa, Sorghum bicolor
  misc_feature: Ceres ANNOT ID no. 6039789
  misc_feature (19)..(150): Pfam Id: RNase_PH Pfam Desc: 3' exoribonuclease family, domain 1
  misc_feature (153)..(218): Pfam Id: RNase_PH_C Pfam Desc: 3' exoribonuclease family, domain 2
  misc_feature (9)..(236): NCBI GI: 122920908 NCBI Desc: chain b, structure of the human rna exosome composed of rrp41, rrp45, rrp46, rrp43, mtr3, rrp42, csl4, rrp4, and rrp40
  misc_feature (9)..(237): NCBI GI: 73919276 NCBI Desc: probable exosome complex exonuclease 1
  misc_feature (9)..(237): NCBI GI: 116117011 NCBI Desc: ensangp00000009222 [anopheles gambiae str. pest]
  misc_feature (9)..(238): NCBI GI: 116754659 NCBI Desc: exosome complex exonuclease 1 [methanosaeta thermophila pt]
  misc_feature (9)..(237): NCBI GI: 29337010 NCBI Desc: probable exosome complex exonuclease 1
MEYVNPLTGFRVDGRRPNEMRQLKGEVGVVARADGSALFEMGNTRVIAAVYGPREVQNKGQQVNSNEALVRCEYRMAEFSTGDRRRKPKGDRRSTEISLVIRQTMEASILTHLMPRSQIDIYVQVLQADGGTRSACINAATLALADAGIPMRDIVTSCSAGYLCSTPLLDLNYLEDSAGGSDVTVGILAKMDKVTLLQMDAKLPMDTFENVMGLAIEGCKAIATYIREVLLENTKKLECQRG

SEQ ID NO: 4699 - DNA, 1662 bp, Sorghum bicolor
  misc_feature: Ceres ANNOT ID no. 6039794
  misc_feature: Encodes the peptide sequence at SEQ ID NO 4700
atggccgaggaggcccaggctccgccgtccgccaccatggcgaaggaggcccagtcgccgccgtccgccgccgtagcggaggcgacggctacgccgcagctcgtgttattcaactccttgacgaagagggaggagcccttccagccccgggtggaggggaaggtagggatgtacgtctgtggcgtcactccatacgactttagccacatcggccacgcgcgtgcctacgtcgccttcgacgtcctctacaggtaccttaaattcttggggtatgaagttgaatatgtccgtaatttcacggatatcgatgacaagatcattaagcgtgcaaatgaacgcgatgaaacagttacaagtttgagtagccggtttatcaatgaatttcttcttgatatgactgagctccagtgcttgcctcctacctgcgagccacgggtaacagagcacattgagcatattatagagttgataacaaagataatggagaatgggaaagcctatgctatggaaggagatgtttacttttcagtcgatagcttccctgaatatctcagtttatctggaaggaaatttgatcaaaatcaggcaggtgcacgggttgcttttgatacgagaaagcgtaatcctgcagacttcgcactctggaaggctgcaaaggagggtgagcctttttgggatagcccttggggccgtggaagaccaggatggcatatcgaatgcagcgcaatgagtgctcactatttaggacatgtatttgatattcatggtggggggaaagatttgatttttcctcatcatgagaatgagcttgcccaaagccgagcggcttatcctgagagcgaggtcaagtgctggatgcacaatggcttcgttaacaaagatgataaaaaaatggcaaaatcagataataactttttcacgattagagatatcattgccctttaccatccaatggctttaagatttttcttgatgcgcacacattatagatcagatgtcaaccactctgatcaagcacttgagattgcatctgatcgtgtctactacatttatcagactctatatgactgtgaggaagtgctagctacatatcgtgaaaagggtattgctgtcccagtgccatctgaggagcaaaatctgattgataagcaccattcagaattcttgaaatatatgtcgaatgatcttaaaaccacagatgttctggatcgttgcttcgtggagctgctgaagaccataaacagcagtctgaatgatttgaagaaactgcagcaaaaaatagaacagcaaaagaagaaacagcaacagcagaagaagcagcaacagaagcaacagcagttgcaaaaacagccagaagattatattcaagcactgattgccttggaaacagaacttaaaaataaactgtctatacttggtctgatgccatcatcatctttggcagaggtactgaagcaactgaaggacaaagcattaaagcgagcagggctgactgaagaaaatttgcaagagcagattgagcagagaaatgtcgcaaggaagaataagcagtttgaggtatctgatggaatcaggaaaaaccttgctaccaagggcatcgccctaatggacgaaccttctggtacagtgtggagaccatgcgaaccagagcggtctgaataa

SEQ ID NO: 4700 - protein, 553 aa, Sorghum bicolor
  misc_feature: Ceres ANNOT ID no. 6039794
  misc_feature (46)..(345): Pfam Id: tRNA-synt_1e Pfam Desc: tRNA synthetases class I (C) catalytic domain
  misc_feature (69)..(354): Pfam Id: tRNA-synt_1g Pfam Desc: tRNA synthetases class I (M)
  misc_feature (105)..(550): NCBI GI: 115450673 NCBI Desc: os03g0143300 [oryza sativa (japonica cultivar-group)]
  misc_feature (33)..(502): NCBI GI: 42569504 NCBI Desc: trna synthetase class i (c) family protein [arabidopsis thaliana]
  misc_feature (34)..(429): NCBI GI: 109894916 NCBI Desc: cysteinyl-trna synthetase (cysteine--trna ligase) (cysrs)
  misc_feature (32)..(348): NCBI GI: 7572928 NCBI Desc: cysteine-trna ligase [arabidopsis thaliana]
  misc_feature (34)..(417): NCBI GI: 118746644 NCBI Desc: cysteinyl-trna synthetase [geobacter lovleyi sz]
  misc_feature (34)..(429): SWISSPROT Homolog: EC 6.1.1.16 Cysteinyl-tRNA synthetase
MAEEAQAPPSATMAKEAQSPPSAAVAEATATPQLVLFNSLTKREEPFQPRVEGKVGMYVCGVTPYDFSHIGHARAYVAFDVLYRYLKFLGYEVEYVRNFTDIDDKIIKRANERDETVTSLSSRFINEFLLDMTELQCLPPTCEPRVTEHIEHIIELITKIMENGKAYAMEGDVYFSVDSFPEYLSLSGRKFDQNQAGARVAFDTRKRNPADFALWKAAKEGEPFWDSPWGRGRPGWHIECSAMSAHYLGHVFDIHGGGKDLIFPHHENELAQSRAAYPESEVKCWMHNGFVNKDDKKMAKSDNNFFTIRDIIALYHPMALRFFLMRTHYRSDVNHSDQALEIASDRVYYIYQTLYDCEEVLATYREKGIAVPVPSEEQNLIDKHHSEFLKYMSNDLKTTDVLDRCFVELLKTINSSLNDLKKLQQKIEQQKKKQQQQKKQQQKQQQLQKQPEDYIQALIALETELKNKLSILGLMPSSSLAEVLKQLKDKALKRAGLTEENLQEQIEQRNVARKNKQFEVSDGIRKNLATKGIALMDEPSGTVWRPCEPERSE

SEQ ID NO: 4701 - DNA, 510 bp, Sorghum bicolor
  misc_feature: Ceres ANNOT ID no. 6039795
  misc_feature: Encodes the peptide sequence at SEQ ID NO 4702
atggcgagcaccactagccaggcgagcctcctactccagaagcagctcaaggatcttgcgaagaaccccgtggatgggttctcggcggggcttgtagacgatagcaacgtcttcgagtggcaggtcaccatcatcggcccgcctgacaccctatatgatggaggctacttcaatgcaataatgaccttcccccagaactatcccaacagcccgccatcagtaagatttacttctgagatgtggcatccgaacgtttatcctgatggacgtgtttgcatctctattcttcatccacctggcgaggatcccaatggttatgagcttgcaagcgaacggtggacaccagtgcatacggttgaaagtatagttttgagcatcatttcaatgctttctagcccgaacgacgagtctccagcgaatattgaagctgctaaggattggagagaaaagcgggatgagttcaagaaaaaggtaaggcaatgtgtccgcagatctcaggaaatgctctga

SEQ ID NO: 4702 - protein, 169 aa, Sorghum bicolor
  misc_feature: Ceres ANNOT ID no. 6039795
  misc_feature (11)..(162): Pfam Id: UQ_con Pfam Desc: Ubiquitin-conjugating enzyme
  misc_feature (1)..(169): NCBI GI: 2641619 NCBI Desc: ubiquitin-conjugating enzyme protein e2 [zea mays]
  misc_feature (1)..(168): NCBI GI: 2624417 NCBI Desc: ubiquitin carrier protein [zea mays]
  misc_feature (6)..(169): NCBI GI: 115187640 NCBI Desc: ubiquitin-conjugating enzyme [arachis hypogaea]
  misc_feature (6)..(168): NCBI GI: 9759251 NCBI Desc: ubiquitin-conjugating enzyme ubc7 [arabidopsis thaliana]
  misc_feature (6)..(168): NCBI GI: 20334880 NCBI Desc: at3g46460/f18l15_180 [arabidopsis thaliana]
  misc_feature (6)..(168): SWISSPROT Homolog: EC 6.3.2.19 Ubiquitin-conjugating enzyme E2 7
  misc_feature: The sequence is a functional homolog of SEQ ID NO. 431 in the 11/188,298 US application
MASTTSQASLLLQKQLKDLAKNPVDGFSAGLVDDSNVFEWQVTIIGPPDTLYDGGYFNAIMTFPQNYPNSPPSVRFTSEMWHPNVYPDGRVCISILHPPGEDPNGYELASERWTPVHTVESIVLSIISMLSSPNDESPANIEAAKDWREKRDEFKKKVRQCVRRSQEML

SEQ ID NO: 4703 - DNA, 660 bp, Sorghum bicolor
  misc_feature: Ceres ANNOT ID no. 6039798
  misc_feature: Encodes the peptide sequence at SEQ ID NO 4704
atggctcgtccttcgaagctctacctcgtcttctacaactccctccaagcgctcggatggttcctcgccctcctccgcctcctgccctccctcgtccctcccttccctgtccactccgcgtacgtggtcaccggcgacctcatctgtacccacccgcccacatgtgcgttccttgaaacggtccacgctgccataggattggtgccgaccgcgccatttcttgctttcttgcaatggggagggaggacccacttcatcctggctgttgtccggcaaattcccgaggttcagaggagtccatctgtgtacataacatttatagcttggagcatatctgaggtcatccgttactctcactatgctctgactaccttaaaagtttgtccaggatggctgacatatctcaggtacactgcttttatcccgctgtatccaatcggggttggaccaggagaaatgtggactatgtatcaagctctcccatttgtgaagaagaggaacctttactcaggtttcttcaagaagttctccatgagctaccattcatttctagtgggtgtgctggtgatctatccgttcctgtggctgaagctgtacctgcatgtgttcaaacaacgcaagtccaagctgggaaaggggagcaggaagaaacgagcctaa

SEQ ID NO: 4704 - protein, 219 aa, Sorghum bicolor
  misc_feature: Ceres ANNOT ID no. 6039798
  misc_feature (53)..(214): Pfam Id: PTPLA Pfam Desc: Protein tyrosine phosphatase-like protein, PTPLA
  misc_feature (1)..(219): NCBI GI: 115464319 NCBI Desc: os05g0460800 [oryza sativa (japonica cultivar-group)]
  misc_feature (135)..(219): NCBI GI: 140065412 NCBI Desc: protein tyrosine phosphatase-like protein, ptpla [medicago truncatula]
  misc_feature (8)..(211): NCBI GI: 41054101 NCBI Desc: similar to riken cdna 6330408j20 gene [danio rerio]
  misc_feature (8)..(218): NCBI GI: 55777164 NCBI Desc: protein tyrosine phosphatase-like (proline instead of catalytic arginine), member b [homo sapiens]
  misc_feature (8)..(218): NCBI GI: 6851256 NCBI Desc: protein tyrosine phosphatase-like protein ptplb [mus musculus]
MARPSKLYLVFYNSLQALGWFLALLRLLPSLVPPFPVHSAYVVTGDLICTHPPTCAFLETVHAAIGLVPTAPFLAFLQWGGRTHFILAVVRQIPEVQRSPSVYITFIAWSISEVIRYSHYALTTLKVCPGWLTYLRYTAFIPLYPIGVGPGEMWTMYQALPFVKKRNLYSGFFKKFSMSYHSFLVGVLVIYPFLWLKLYLHVFKQRKSKLGKGSRKKRA

SEQ ID NO: 4705 - DNA, 582 bp, Sorghum bicolor
  misc_feature: Ceres ANNOT ID no. 6039802
  misc_feature: Encodes the peptide sequence at SEQ ID NO 4706
atggcggcgccgccggcgagggcccgggccgactacgactaccttatcaagctgctcctcattggggatagcggtgttggcaagagttgccttctgttgcggttctctgatggttccttcactacaagctttattaccacaattggtattgactttaagatacgaacaatagaattggatggcaagcgtataaagctacagatttgggatacagcgggccaagaacgcttccggactattaccactgacatccgaaactggattcggaacattgaacaacatgcctctgataatgtcaacaaaatcttggttggcaacaaggccgatatggatgaaagcaagagggccgtacctactgcaaaaggacaagcacttgctgatgagtatgggatcaagttttttgaaacgagtgccaagacaaacctgaatgtggagcaagtgtttttctccatcgcacgtgacatcaagcagaggcttgcagagactgattcaaagccagaggacaaggcaatcaaaattaacaagccagaccagggttccgaggcaccagctgcccagcgatctgcctgctgcggctcataa

SEQ ID NO: 4706 - protein, 193 aa, Sorghum bicolor
  misc_feature: Ceres ANNOT ID no. 6039802
  misc_feature (17)..(157): Pfam Id: Ras Pfam Desc: Ras family
  misc_feature (17)..(109): Pfam Id: Miro Pfam Desc: Miro-like protein
  misc_feature (66)..(193): NCBI GI: 92897911 NCBI Desc: sigma-54 factor, interaction region; ras small gtpase, rab type [medicago truncatula]
  misc_feature (66)..(193): NCBI GI: 871510 NCBI Desc: small gtp-binding protein [pisum sativum]
  misc_feature (66)..(193): NCBI GI: 18447913 NCBI Desc: ras-related protein rab8-1 [nicotiana tabacum]
  misc_feature (66)..(193): NCBI GI: 18447919 NCBI Desc: ras-related protein rab8-4 [nicotiana tabacum]
  misc_feature (66)..(193): NCBI GI: 18447917 NCBI Desc: ras-related protein rab8-3 [nicotiana tabacum]
  misc_feature: Useful for making plants with altered Lignin content
  misc_feature: Useful for making plants with modulated oxidative stress sensitivity
  misc_feature: GREAT-hit functional homolog of the protein sequence given in SEQ ID NO 13074
  misc_feature: GREAT-hit functional homolog of the protein sequence given in SEQ ID NO 13211
  misc_feature: Useful for making plants with altered lignin content
  misc_feature: Functional homolog of the protein sequence given in SEQ ID NO 13211
  misc_feature: Useful for making plants with modulated oxidative stress sensitivity
  misc_feature: Functional homolog of the protein sequence given in SEQ ID NO 13074
  misc_feature: The sequence is a functional homolog of SEQ ID NO. 400 in the 11/188,298 US application
MAAPPARARADYDYLIKLLLIGDSGVGKSCLLLRFSDGSFTTSFITTIGIDFKIRTIELDGKRIKLQIWDTAGQERFRTITTDIRNWIRNIEQHASDNVNKILVGNKADMDESKRAVPTAKGQALADEYGIKFFETSAKTNLNVEQVFFSIARDIKQRLAETDSKPEDKAIKINKPDQGSEAPAAQRSACCGS

SEQ ID NO: 4707 - DNA, 1383 bp, Sorghum bicolor
  misc_feature: Ceres ANNOT ID no. 6039825
  misc_feature: Encodes the peptide sequence at SEQ ID NO 4708
atggccgcgccggcgggccgccttcttctgctcgtcttcgccgtcgcgggagccctggcgccccccgtggcggccgagatcaggaaggagtccttcagggaggacccgcgctcgtccatcatgttcgagaaattcggcttctccaagtctggccgggtccggatcatcgtctctggcgccgccgtctcctcccccgtcgcgcggccggacaacgcggagctcgggttcttcctcctctccgacgagtccctcctccacgccatcgacgaggcgcaggaggggcccacgcgggagaagcgcgccgcggcgaccaacggcggcggcgaggaccccgatgggagctccggcgccggcgccgggtgcgtgctcgacagcccctacgtgaagaagctcttcaccttcaaaaacatgaagggcggccactacaacaagtccttcccggtcacccgccccgacgagtacaccctcttcttcgccaactgcgccccggaggcgctcgtctccatgaccgtccgcaccgagatgtacaacgtcaacgccgacggctccaaggactacctccccgtcggccaggcgcccctgccggccatctacggcttcttcgccttctgctacgccgcgttcctggccgcctgggggtacctcaccctctcccgcgaccgcgtgtccgcgcaccagatccaccacctcatgtcgggcctcctcgtcgcgcgcctgctcttctgcctctccgccgccgaggaccagcactacatccgcgtcacggggacgccgcacggatgggatgtggccttctacctcttccagctcgtgaagggtgtcatcctcttcgcggtgatcgcgctggtcggcacggggtggtccttcttgaagccggtcctgcaggaccgggagaagaaggtgctcatggccgtgatcccgctccaggtcaccgccaacatcgccgccgctgtcattggggagacagggcccttcatggagagctgggtgacatggaatcagatcttgctcttcgtggatgtggcgtgctgttgcgcggtgctcttcccggtcgtctggtccatccggtcgctcagggagacgtccaagaccgacggcaaggcggcgcggaacctctccaagctcacactgttccggcagttctacgtcgtggtgattgggtacctctacttcactaggatcgtcgtgtatgcgctcaagacggttgccagctacaagtaccggtgggtgagcgttttggcagaggagatggccaccctggcgttctacctgttcatgttctacacattcaggccggccgagaagagccactacttctctctcgatgaagatgaagaagaggccgcagagatggtgctccgagaagaggaattcgagctatga

SEQ ID NO: 4708 - protein, 460 aa, Sorghum bicolor
  misc_feature: Ceres ANNOT ID no. 6039825
  misc_feature (148)..(437): Pfam Id: Lung_7-TM_R Pfam Desc: Lung seven transmembrane receptor
  misc_feature (3)..(459): NCBI GI: 115447341 NCBI Desc: os02g0618700 [oryza sativa (japonica cultivar-group)]
  misc_feature (84)..(447): NCBI GI: 119608330 NCBI Desc: g protein-coupled receptor 107, isoform cra_d [homo sapiens]
  misc_feature (84)..(367): NCBI GI: 10047325 NCBI Desc: kiaa1624 protein [homo sapiens]
  misc_feature (84)..(367): NCBI GI: 55665262 NCBI Desc: g protein-coupled receptor 107 [homo sapiens]
  misc_feature (84)..(367): NCBI GI: 119608328 NCBI Desc: g protein-coupled receptor 107, isoform cra_c [homo sapiens]
MAAPAGRLLLLVFAVAGALAPPVAAEIRKESFREDPRSSIMFEKFGFSKSGRVRIIVSGAAVSSPVARPDNAELGFFLLSDESLLHAIDEAQEGPTREKRAAATNGGGEDPDGSSGAGAGCVLDSPYVKKLFTFKNMKGGHYNKSFPVTRPDEYTLFFANCAPEALVSMTVRTEMYNVNADGSKDYLPVGQAPLPAIYGFFAFCYAAFLAAWGYLTLSRDRVSAHQIHHLMSGLLVARLLFCLSAAEDQHYIRVTGTPHGWDVAFYLFQLVKGVILFAVIALVGTGWSFLKPVLQDREKKVLMAVIPLQVTANIAAAVIGETGPFMESWVTWNQILLFVDVACCCAVLFPVVWSIRSLRETSKTDGKAARNLSKLTLFRQFYVVVIGYLYFTRIVVYALKTVASYKYRWVSVLAEEMATLAFYLFMFYTFRPAEKSHYFSLDEDEEEAAEMVLREEEFEL

SEQ ID NO: 4709 - DNA, 345 bp, Sorghum bicolor
  misc_feature: Ceres ANNOT ID no. 6039826
  misc_feature: Encodes the peptide sequence at SEQ ID NO 4710
atgagcaccatgaagttttgccgtgagtgcaacaacatcctgtaccccaaggaggagagagacaggcgcaccctattcttcgcatgtcgcaactgtgagcaccaggaggtctctgacaataactgcgtctatcggaacgaggtgcaccacactgctggggagcgaacgcaggtcttgcaggatgtagcttctgaccccactcttcccagaaccaagactgttcgctgtagtgcttgtgggcatggagaggctgttttcttccaggccacagcaagaggggaggaggggatgaccctgttctttgtgtgctgcagcccagattgtggtaatcggtggagggaatga

SEQ ID NO: 4710 - protein, 114 aa, Sorghum bicolor
  misc_feature: Ceres ANNOT ID no. 6039826
  misc_feature (4)..(58): Pfam Id: RNA_POL_M_15KD Pfam Desc: RNA polymerases M/15 Kd subunit
  misc_feature (1)..(114): NCBI GI: 87240462 NCBI Desc: dna-directed rna polymerase, subunit c11/m/9 [medicago truncatula]
  misc_feature (11)..(114): NCBI GI: 115489060 NCBI Desc: os12g0560400 [oryza sativa (japonica cultivar-group)]
  misc_feature (4)..(114): NCBI GI: 38541317 NCBI Desc: polr2i protein [mus musculus]
  misc_feature (4)..(114): NCBI GI: 5453930 NCBI Desc: dna directed rna polymerase ii polypeptide i [homo sapiens]
  misc_feature (4)..(114): NCBI GI: 46396569 NCBI Desc: dna-directed rna polymerase ii 14.5 kda polypeptide (rpb9) (rpb14.5)
  misc_feature (4)..(114): SWISSPROT Homolog: EC 2.7.7.6 DNA-directed RNA polymerase II subunit I
  misc_feature: Useful for making plants with altered Lignin content
  misc_feature: GREAT-hit functional homolog of the protein sequence given in SEQ ID NO 12917
  misc_feature: Useful for making plants with altered lignin content
  misc_feature: Functional homolog of the protein sequence given in SEQ ID NO 12917
MSTMKFCRECNNILYPKEERDRRTLFFACRNCEHQEVSDNNCVYRNEVHHTAGERTQVLQDVASDPTLPRTKTVRCSACGHGEAVFFQATARGEEGMTLFFVCCSPDCGNRWRE

SEQ ID NO: 4711 - DNA, 2100 bp, Sorghum bicolor
  misc_feature: Ceres ANNOT ID no. 6039846
  misc_feature: Encodes the peptide sequence at SEQ ID NO 4712
atgcgtctttcttcttctcttcaagatctgccaaccttcactagaattgatgctttggaaaggggctctagtgttggcagtgatctgagctcagggcgtgcaaaacctgtccgcatgcttcaaagagacggtgctgtggcaagcttttcaaaagaaagaacacccccatcatcaccaacaaatagaaagaaatgcatgagagcagccggatgtgctatttcactgatcttattggtgttctttgcatatggttcttggagatatttccatgtattcctctctgaaggaagctctgaatactatgtggttcttgattgtggcagcactggtacaagagtttatgtctatgaatggcatattaatcataatgacgcaaatgcatttcctattgttttgaaacctttagggaatgctcctaagaagaaatctggtaaattaacccgactatatcagcgaatggagacagaacctggattgagcaagcttgttcacaatgaatccggattgaagaaggcaatagagccccttcttcaaatggctgagaaactgatccctagacatgcacacaaacacactccactttttctatatgctacagctggtgtccgcaagctacctagtgcagattcagagtggctccttgataaggcctgggatattctgaacaattcatcatttttatgtagtagagacaaagtcaagatcattaatggcatggatgaagcttattatggatggatagctcttaaccaccacatgaatatgtttggcacctcatcatctaaaatgacatatggttcacttgatttaggtggatcatcattacaggttacatttgagaatgataaatcagtgcaggatgagacaagcattcgtctgagtattggttcagttgatcatcaccttagtgcttattctcttactggttatgggttaaatgatgcatttgataaatctgtagcacatctagtgaaaaggttgggaggagcagctagtaatggcaaggttcaagtcaaacatccctgtctacagactggatacaaagaaaattacacttgttcttactgccacccattaaaacaagatggaagtcccagtgttggcgagaagaacactggcaaagagaagcagggaatagctgttgaactggttggagcacctcagtggaatgaatgcagtgctcttgcaaaagtaacagtcaatctttctgaatggtccagtgcaagtccaggtcttgattgtaacattcatccttgtgctcttgcttctaactttccccaaccacatgggcagttttttgctatgtctggcttctttgtggtttttaaattttttaatttgactgctgatgcgtctctagttgatgttctaaaaagaggtcaggaattttgtgaaaaaccatggaaagttgcaaagagtagtgttcctccacagccttttgtagaacaatattgcttcagagctccttatattgcatcactactgagagagggattgcagattaaagatagtcaggtggtagtcggctctggcagtattacttggactctcggagttgctttgttggaggctggtcaggcattatcttcacgactagatattcaaggataccgaatactggaccgggagataaacccaaatattctcatagtattgtttcttatttcaattgtgttggtcatatgtgccatactgtgcgtcagcaattcaatgccaagatcattccgcaagtcttatctgccacttcataggcataattctggaggcagttctgttcttggtatgggattgcctttcaaacatttgtggaatcccattagttcaggtgatggaagaacaaagacaccactgagccctactgttgctgggtcagatcctcatccatttggtatgagccatggattaggaggcagcagtgttcagcttatggagtcctcgaggcaatccttgggtgcctatcacagctattctgttgggagcttaggtcagatgcagttttccagtggtgtgcgaggtcagactacacttcaaagccggaggtcgcaatcaagagaagatctcatttcttcacttgctgatattcatgttccaaaagtgtag

SEQ ID NO: 4712 - protein, 699 aa, Sorghum bicolor
  misc_feature: Ceres ANNOT ID no. 6039846
  misc_feature (91)..(535): Pfam Id: GDA1_CD39 Pfam Desc: GDA1/CD39 (nucleoside phosphatase) family
  misc_feature (54)..(634): NCBI GI: 92894069 NCBI Desc: nucleoside phosphatase gda1/cd39 [medicago truncatula]
  misc_feature (47)..(699): NCBI GI: 42566949 NCBI Desc: nucleoside phosphatase family protein / gda1/cd39 family protein [arabidopsis thaliana]
  misc_feature (1)..(609): NCBI GI: 144925033 NCBI Desc: nucleoside phosphatase gda1/cd39; alkaline phosphatase [medicago truncatula]
  misc_feature (243)..(609): NCBI GI: 140066972 NCBI Desc: ectonucleoside triphosphate diphosphohydrolase 1, related [medicago truncatula]
  misc_feature (150)..(347): NCBI GI: 7262666 NCBI Desc: strong similarity to ecto-apyrase from rattus norvegicus gbu81295 and is a member of the gda1/cd39 (nucleoside phosphatase) pf01150 family. this gene is cut off at the 5' end.
  misc_feature (150)..(347): NCBI GI: 7262666 (continued) [arabidopsis thaliana]
MRLSSSLQDLPTFTRIDALERGSSVGSDLSSGRAKPVRMLQRDGAVASFSKERTPPSSPTNRKKCMRAAGCAISLILLVFFAYGSWRYFHVFLSEGSSEYYVVLDCGSTGTRVYVYEWHINHNDANAFPIVLKPLGNAPKKKSGKLTRLYQRMETEPGLSKLVHNESGLKKAIEPLLQMAEKLIPRHAHKHTPLFLYATAGVRKLPSADSEWLLDKAWDILNNSSFLCSRDKVKIINGMDEAYYGWIALNHHMNMFGTSSSKMTYGSLDLGGSSLQVTFENDKSVQDETSIRLSIGSVDHHLSAYSLTGYGLNDAFDKSVAHLVKRLGGAASNGKVQVKHPCLQTGYKENYTCSYCHPLKQDGSPSVGEKNTGKEKQGIAVELVGAPQWNECSALAKVTVNLSEWSSASPGLDCNIHPCALASNFPQPHGQFFAMSGFFVVFKFFNLTADASLVDVLKRGQEFCEKPWKVAKSSVPPQPFVEQYCFRAPYIASLLREGLQIKDSQVVVGSGSITWTLGVALLEAGQALSSRLDIQGYRILDREINPNILIVLFLISIVLVICAILCVSNSMPRSFRKSYLPLHRHNSGGSSVLGMGLPFKHLWNPISSGDGRTKTPLSPTVAGSDPHPFGMSHGLGGSSVQLMESSRQSLGAYHSYSVGSLGQMQFSSGVRGQTTLQSRRSQSREDLISSLADIHVPKV

SEQ ID NO: 4713 - DNA, 990 bp, Sorghum bicolor
  misc_feature: Ceres ANNOT ID no. 6039857
  misc_feature: Encodes the peptide sequence at SEQ ID NO 4714
atgttccatccttcatcgtcgtcgccacccaactacagtgacctctccatgcatcatgcagtgagcttctcctctgctgtgcccacagctccgactgaaattcctcgcgggggtttcttccacggcaacggtggcttgctagcacttcccaatgttgctgcatcagcgccgcctccctacccctcttccctgccttcctactacatgcataggaacatcaactcgcatttcttccctcttcacctccagttgtctgaacaggtcagcagtaatgccaccttgtcttgctcgtctccttcagcttcggcatgccagttgcctcttccccatgttccttcttccccttcatcttccggtgaccttttggagttcagcactggagccatgcggcgtgtcttcagtacgggtgacctccaggtgatgaatgtcgcggcatctccaccaccgccaccactttcagtttcaggtgacccacacggccaagatgcaggggggcctttcactcagaaggttggccgttacagcgctgaagaacgcaaggagaagattgagcgttaccgtacgaagcgtaaccagaggaacttccacaagaagatcacttatgcctgcaggaagacgctggcggacagcaggcccagggtgcagggccgcttcgcgaggaatgccgagacagaggccgaggctgttgcaggccacgagagggaggcctcagacaacaacagctacgagcactgccactacggcgacctcaccaccaacagcagcagtagcagctgctgctacgacatccagtgcagggaaagtggcaaaaccacaacatttgacgacggcaagtggtggtgggagacgccggtggccgctccagctgcagccaatgggcatcatgggcaccgtcagtaccagcagcagcttcttgattttgacatcgacatggacatggacggagatgatctgtgggccagcctggctgacatgtgctctgggacctga

SEQ ID NO: 4714 - protein, 329 aa, Sorghum bicolor
  misc_feature: Ceres ANNOT ID no. 6039857
  misc_feature (179)..(223): Pfam Id: CCT Pfam Desc: CCT motif
  misc_feature (124)..(239): NCBI GI: 42561691 NCBI Desc: zinc finger constans-related [arabidopsis thaliana]
  misc_feature (110)..(229): NCBI GI: 87240457 NCBI Desc: cct [medicago truncatula]
  misc_feature (177)..(240): NCBI GI: 115483703 NCBI Desc: os11g0101200 [oryza sativa (japonica cultivar-group)]
  misc_feature (124)..(239): NCBI GI: 2341026 NCBI Desc: f19p19.3 [arabidopsis thaliana]
  misc_feature (170)..(233): NCBI GI: 115482424 NCBI Desc: os10g0466500 [oryza sativa (japonica cultivar-group)]
  misc_feature: The sequence is a functional homolog of SEQ ID NO. 370 in the 11/188,298 US application
MFHPSSSSPPNYSDLSMHHAVSFSSAVPTAPTEIPRGGFFHGNGGLLALPNVAASAPPPYPSSLPSYYMHRNINSHFFPLHLQLSEQVSSNATLSCSSPSASACQLPLPHVPSSPSSSGDLLEFSTGAMRRVFSTGDLQVMNVAASPPPPPLSVSGDPHGQDAGGPFTQKVGRYSAEERKEKIERYRTKRNQRNFHKKITYACRKTLADSRPRVQGRFARNAETEAEAVAGHEREASDNNSYEHCHYGDLTTNSSSSSCCYDIQCRESGKTTTFDDGKWWWETPVAAPAAANGHHGHRQYQQQLLDFDIDMDMDGDDLWASLADMCSGT

SEQ ID NO: 4715 - DNA, 2613 bp, Sorghum bicolor
  misc_feature: Ceres ANNOT ID no. 6039859
  misc_feature: Encodes the peptide sequence at SEQ ID NO 4716
atgctgcagcgcgcggccagcaacgcctactcctggtggtgggcgtcgcacatccgcaccacccagtctaagtggcttgaaacaaccgtcggcgagatggaggacagggtaaagtccatgctcaagctcattggggccgacggcgattcgttcggcaagaaagcagagctctacttcaaaagccggccagagctcatcaatcacgtggaggagatgttcagatcctatcaggcccttgccgacaggtttgaccggatatccagtgagctgcacaaggccaaccacaccattgccactgtgtttccagaccatgtgcagctatcaatgcaagagggggatggtgaggggttaccgaaggcaatcggtgggattgatctcagcaatttcaaattccctgcgctggaaggcttgtccatgggctcgcagaacgcgagcaggggcaccagtccggtccctaagagggggccccaagcacagcggagggtcacctccaacatgaccaaggagaaggcgcaggaggagatagacaagctgcagaaacaaatcctggcactacagactgagaaagagttcttgaagacctcgtacgacagctcactaggcaagtatctagacatcgagaaacaggtggccgagttgcaggatgaggtctgcaatttgcaagatgctttcagcactggtgtagccattgaagacaatgaagctcgggcattgatggctgcgcaagccattatgtcgtgtgaggatacgttggtgaacttgcaggaccagaaaaacagatcgactgaagaggcgaaggtggagctccgacgagccaatgaggcaattgaaaagctgaaaaccttcaagaatgaatgtgggctgcctcacgcgcaaatggatgggcatgatcatcatgaaatggaactggtccacgcactgcctttcgatgatgctgatgattctgctctgaatgagggcaggcttgacctccaggaaatatgtcaaagagtcaaagaaataattgaatcttaccctgagctatcagttgcagaattagcggataaggttgatcgacttgtagaaaaggtgatcaaccttgaacttgctactacttcacagaatgctcagattgatagaatgaagactgagatagatggccttcatgagcgcctgcatgctttggagcaagacaaggtggctttggttgttgattctagtaacttggctgacaggttgaagaaagttgaagacatgctgcaagaagtacaacatatttggaagtctgtgcaaaatggatccgagaacatttgtaaacaaatgactgaagccacacatgaacttactgaattcgtcgaaacattacatgctcctgagcaagaaatcagtgacttcgtggattcattgcgaggctccaaaggcgatgcttctctggaagatgactcaggactaacaagtctgtctgtgcaaaacgagccatccaaatctttgcatggcactacaagtgaaattgagaaacatgaagaaacctcagaaggccttgtagcccagaaacagctacttccaaaagaatccgaaggtgagagtaagattccattagaagattatgcatctgtacttcagagctacaaagatacagagcaaaagctttcagaaattgagaagagaaatcaagagtaccatcttgaggcaatgtcagaactgaaggaacttaagagtgccaatgcaacgaaagatgaggagatccactcgcttaggcgcatgctaagttctttgcagaaaaagatgaaagacaaagagattgctaagtcagaagaaacatccaagataagcaccagtcctactacagaggacaaagagattgctgagatagaggaatacattaagcaatggcaagttgatgactcgctagcttgttcggttgcagaggagaaatttagagtagaaattgacagggtgttgggggagaacttgaacttctggttgaggtttagcacatcatatcatcaaatacgaaatttccaaatatcctttgacatgttgaaaactgagatgcacagattgactgatgaacaggaagatggggacacttaccgctttgctggtagttatcaggtagcaaagttggaatcagcagtactggaaaagaaattcagggatctaaatacagatcttcaagtttggattgaaaagaacgtgctattgaaaggagaggtagagaacagattttcatcactatgcagcatacaagaagatatatcaaagatcacaactctggataaatgtgatgaagttcacttcaatccttttcaagctgcaaaattccaaggagaggtgcttaatatgaaacaagagaataacaaagttgctaaggagctagaagctgggctggaccatgtaagaggccttcaagtggaggttggaagggtgctcttgaagctcagagagaatctcgaggtatctatagcaagaagccaccgagcccaacaaaacttccggagcctgtcaacaaaagccggggttccccttagaacttttctgtttggctcaaagccaaagagaccatcactcttttcatgcatgagtcctggggtgcataagcaacacagtggttcaagggctgggcgtagatga

SEQ ID NO: 4716 - protein, 870 aa, Sorghum bicolor
  misc_feature: Ceres ANNOT ID no. 6039859
  misc_feature (11)..(84): Pfam Id: KIP1 Pfam Desc: KIP1-like protein
  misc_feature (143)..(773): NCBI GI: 115440897 NCBI Desc: os01g0835800 [oryza sativa (japonica cultivar-group)]
  misc_feature (1)..(826): NCBI GI: 20453212 NCBI Desc: at5g10500/f12b17_150 [arabidopsis thaliana]
  misc_feature (1)..(630): NCBI GI: 13936326 NCBI Desc: kinase interacting protein 1 [petunia integrifolia]
  misc_feature (1)..(485): NCBI GI: 42561868 NCBI Desc: kinase interacting family protein [arabidopsis thaliana]
  misc_feature (28)..(580): NCBI GI: 2160165 NCBI Desc: f21m12.11 gene product [arabidopsis thaliana]
  misc_feature: The sequence is a functional homolog of SEQ ID NO. 459 in the 11/188,298 US application
MLQRAASNAYSWWWASHIRTTQSKWLETTVGEMEDRVKSMLKLIGADGDSFGKKAELYFKSRPELINHVEEMFRSYQALADRFDRISSELHKANHTIATVFPDHVQLSMQEGDGEGLPKAIGGIDLSNFKFPALEGLSMGSQNASRGTSPVPKRGPQAQRRVTSNMTKEKAQEEIDKLQKQILALQTEKEFLKTSYDSSLGKYLDIEKQVAELQDEVCNLQDAFSTGVAIEDNEARALMAAQAIMSCEDTLVNLQDQKNRSTEEAKVELRRANEAIEKLKTFKNECGLPHAQMDGHDHHEMELVHALPFDDADDSALNEGRLDLQEICQRVKEIIESYPELSVAELADKVDRLVEKVINLELATTSQNAQIDRMKTEIDGLHERLHALEQDKVALVVDSSNLADRLKKVEDMLQEVQHIWKSVQNGSENICKQMTEATHELTEFVETLHAPEQEISDFVDSLRGSKGDASLEDDSGLTSLSVQNEPSKSLHGTTSEIEKHEETSEGLVAQKQLLPKESEGESKIPLEDYASVLQSYKDTEQKLSEIEKRNQEYHLEAMSELKELKSANATKDEEIHSLRRMLSSLQKKMKDKEIAKSEETSKISTSPTTEDKEIAEIEEYIKQWQVDDSLACSVAEEKFRVEIDRVLGENLNFWLRFSTSYHQIRNFQISFDMLKTEMHRLTDEQEDGDTYRFAGSYQVAKLESAVLEKKFRDLNTDLQVWIEKNVLLKGEVENRFSSLCSIQEDISKITTLDKCDEVHFNPFQAAKFQGEVLNMKQENNKVAKELEAGLDHVRGLQVEVGRVLLKLRENLEVSIARSHRAQQNFRSLSTKAGVPLRTFLFGSKPKRPSLFSCMSPGVHKQHSGSRAGRR

SEQ ID NO: 4717 - DNA, 450 bp, Sorghum bicolor
  misc_feature: Ceres ANNOT ID no. 6039861
  misc_feature: Encodes the peptide sequence at SEQ ID NO 4718
atggcgagggccctcgaccgctacacctccggcaaggatgtcgcctacagttgtggatactgtggctatgcattaaacttgagctcctccgcacggaacacagcgaacattggatccaagtatggcaagcacatcaggaaaggcgttgtctcattctttgcaatcgatgagagccgttttacacaaactgatgaggtgagctgcaccccgtacttccattcaagccattcatggggattcttcagaaatagaacacggttgctctgccggaagtgcagtggtcatattggtaatgcttatgaagatgaggatcccaccttgtgcgatgggtcagatgacctggacatgagctccaagggcagcagcacatcccctcggaagaaatatgttattaagatcaatgcactgcagccctcatcagatgactctggagctctcttctccccgtga

SEQ ID NO: 4718 - protein, 149 aa, Sorghum bicolor
  misc_feature: Ceres ANNOT ID no. 6039861
  misc_feature: Useful for making plants with altered sterol content
  misc_feature: Useful for making plants with modulated light quality response
  misc_feature: Useful for making plants with modulated seed size
  misc_feature: Useful for making plants with modulated nitrogen use efficiency
  misc_feature: GREAT-hit functional homolog of the protein sequence given in SEQ ID NO 13481
  misc_feature: GREAT-hit functional homolog of the protein sequence given in SEQ ID NO 13504
  misc_feature: GREAT-hit functional homolog of the protein sequence given in SEQ ID NO 13506
  misc_feature: Useful for making plants with modulated light quality response
  misc_feature: Useful for making plants with modulated light quality sensitivity
  misc_feature: Functional homolog of the protein sequence given in SEQ ID NO 13506
  misc_feature: The sequence is a functional homolog of SEQ ID NO. 421 in the 11/188,298 US application
MARALDRYTSGKDVAYSCGYCGYALNLSSSARNTANIGSKYGKHIRKGVVSFFAIDESRFTQTDEVSCTPYFHSSHSWGFFRNRTRLLCRKCSGHIGNAYEDEDPTLCDGSDDLDMSSKGSSTSPRKKYVIKINALQPSSDDSGALFSP

SEQ ID NO: 4719 - DNA, 888 bp, Sorghum bicolor
  misc_feature: Ceres ANNOT ID no. 6039863
  misc_feature: Encodes the peptide sequence at SEQ ID NO 4720
atgtcggcggcgacggaggtggcgccagtacagcagcggagccatgcggcggcggtgtggcgggcggtggcggggtggctcggcctgctcttccagatcctgctccggatcatccgcagcacgccctcctcctgggcgcagctgctctccttcgtgggcctgcgccacccgctcctcccagtcgcctcgtcgcctgaggtggccttcgtgcagctcccatccgaggcccctgctgacgtgtcgcctccgccgctccggcggctcacggtggtgcttgacttggatgagactttagtttgcgcgtatgagtcttcgagccttcctgctactgtgcgcacacaggctgttgaagcaggattgcattgctttgacatggagtgtgtatcgtctgaaaaggatcctgatggaaggcagaggataaatcatgtaactgtctttgagcgtcctggcttacatgaatttttgcagcgaactagcgaatttgctgatcttgttctctttacagctggtttggaaggctatgccaaacctctagttgacaggatagatgctcacaacagattcactcaccgtctgtatcggccttcaactgttactacagaatacagagagcacgtaaaagatctttcttgtttgtccaaagatttccagagaattgtccttgttgataacaacccatacagtttcttactgcaaccattgaatggaataccatgtattacattttcagctggacaacctgttgacgatcagcttatgggaacgatatttccgctcctcgagcacctcgctctgcaaaaagatgttaggcctgcattgtatgaaacgtttcacatgccagagtggttccaaagacaaggaatcccacaaactgaacaggcagtttag

SEQ ID NO: 4720 - protein, 295 aa, Sorghum bicolor
  misc_feature: Ceres ANNOT ID no. 6039863
  misc_feature (79)..(275): Pfam Id: NIF Pfam Desc: NLI interacting factor-like phosphatase
  misc_feature (4)..(295): NCBI GI: 56202314 NCBI Desc: nli interacting factor (nif) family protein-like [oryza sativa (japonica cultivar-group)]
  misc_feature (141)..(273): NCBI GI: 49903624 NCBI Desc: ctd (carboxy-terminal domain, rna polymerase ii, polypeptide a) small phosphatase 1 [xenopus tropicalis]
  misc_feature (141)..(273): NCBI GI: 17046469 NCBI Desc: os4 [xenopus laevis]
  misc_feature (141)..(278): NCBI GI: 115438721 NCBI Desc: os01g0629400 [oryza sativa (japonica cultivar-group)]
  misc_feature (85)..(279): NCBI GI: 20129109 NCBI Desc: cg1696-pa [drosophila melanogaster]
MSAATEVAPVQQRSHAAAVWRAVAGWLGLLFQILLRIIRSTPSSWAQLLSFVGLRHPLLPVASSPEVAFVQLPSEAPADVSPPPLRRLTVVLDLDETLVCAYESSSLPATVRTQAVEAGLHCFDMECVSSEKDPDGRQRINHVTVFERPGLHEFLQRTSEFADLVLFTAGLEGYAKPLVDRIDAHNRFTHRLYRPSTVTTEYREHVKDLSCLSKDFQRIVLVDNNPYSFLLQPLNGIPCITFSAGQPVDDQLMGTIFPLLEHLALQKDVRPALYETFHMPEWFQRQGIPQTEQAV

SEQ ID NO: 4721 - DNA, 1116 bp, Sorghum bicolor
  misc_feature: Ceres ANNOT ID no. 6039875
  misc_feature: Encodes the peptide sequence at SEQ ID NO 4722
atggcgcgagccctggcagccgcagcagccgccgtcgcgctcttcgtcgccgccttgctcctcctcgcttcgacgactctggccaccgcagcggcagcgccgacgacgacgagcggcatcccggccgtgttcgcgttcggggactcgacgctggacccggggaacaacaacgggctgcaggccacgctggtgcgcgcggaccacgcgccctacggctgcggcttcccgggggccgcggccacgggccggttctcggacggcaagctcatcaccgactacatcgtggagtcgctcggtgtcaagggcctcctcccggcgtaccgcgaccgcggcctcacgctcgcggaggcctccacgggggtcagcttcgcgtcgggcgggtccggcctcgacgacctgaccgcgcagaccgccatggtgtacacgttcggctcgcagatcggcgacttccaggacctgctcggcaagatcggcatgcccaaggccgccgagatcgccaacacgtcgctgtacgtggtctccgccggcaccaacgacgtcaccatgaactacttcatcttgccactccggaccgtcagcttccccaccatcgaccagtacagtgactacctcatcggcaggctccagggataccttcagagcctgtacaatctgggagcccggaacttcatggtgtccggcctgccgccggtggggtgcctgccggtgacgaggagtctcaatctggcgtcgggaggaggctgcgtcgccgaccagaacgcggccgcggagaggtacaacgcggcgctgcagcagatgctgaccaagctggaggccgcgtcccccggcgccacgcttgcgtacgtcgacgtgtacacgccattgatggacatggtcacgcagccccagaaatatggtgagcggcaacagattgacaagctgaggtacggtttcaccgagacgaggcagggctgctgcgggaacggtctgctggcgatgggggcgctgtgcaccagcgagctgccgcagtgccggtctccggcgcagttcatgttcttcgactccgtgcacccgacgcaggccacctacaaggcgctcgccgaccacatcgtccagtctcacatcacgaagagttag

SEQ ID NO: 4722 - protein, 371 aa, Sorghum bicolor
  misc_feature: Ceres ANNOT ID no. 6039875
  misc_feature (43)..(363): Pfam Id: Lipase_GDSL Pfam Desc: GDSL-like Lipase/Acylhydrolase
  misc_feature (14)..(363): NCBI GI: 145360286 NCBI Desc: carboxylic ester hydrolase [arabidopsis thaliana]
  misc_feature (16)..(361): NCBI GI: 6573287 NCBI Desc: rxf26 [arabidopsis thaliana]
  misc_feature (27)..(368): NCBI GI: 115478062 NCBI Desc: os09g0132200 [oryza sativa (japonica cultivar-group)]
  misc_feature (12)..(370): NCBI GI: 140061188 NCBI Desc: lipolytic enzyme, g-d-s-l [medicago truncatula]
  misc_feature (12)..(365): NCBI GI: 18390708 NCBI Desc: gdsl-motif lipase/hydrolase family protein [arabidopsis thaliana]
MARALAAAAAAVALFVAALLLLASTTLATAAAAPTTTSGIPAVFAFGDSTLDPGNNNGLQATLVRADHAPYGCGFPGAAATGRFSDGKLITDYIVESLGVKGLLPAYRDRGLTLAEASTGVSFASGGSGLDDLTAQTAMVYTFGSQIGDFQDLLGKIGMPKAAEIANTSLYVVSAGTNDVTMNYFILPLRTVSFPTIDQYSDYLIGRLQGYLQSLYNLGARNFMVSGLPPVGCLPVTRSLNLASGGGCVADQNAAAERYNAALQQMLTKLEAASPGATLAYVDVYTPLMDMVTQPQKYGERQQIDKLRYGFTETRQGCCGNGLLAMGALCTSELPQCRSPAQFMFFDSVHPTQATYKALADHIVQSHITKS

SEQ ID NO: 4723 - DNA, 1830 bp, Sorghum bicolor
  misc_feature: Ceres ANNOT ID no. 6039881
  misc_feature: Encodes the peptide sequence at SEQ ID NO 4724
  misc_feature: Up-regulated in root tissues in response to methyl jasmonate treatment
  misc_feature: Up-regulated in shoot tissues in response to methyl jasmonate treatment
atggagaccctcctggtcggcaaccccgccaacggcgtggcgaagccgatgtgcaacggcgtcggcgctctgcccgtggccaactcccacgccgtcatcggcgcggcgccgccggcgacgacggcggccccggcgggcgccactctcggccggcacctggcgcggcggctcgtgcagatcggcgcctccgacgtgttcgccgtccccggcgacttcaacctcaccctgctcgactacctcatcgccgagccggggctgagcctcgtcggctgctgcaacgagctcaacgccgggtacgccgccgacgggtacgcccgctcccgtggcgtcggcgcctgcgccgtcacgttcaccgtcggcgggctcagcgtgctcaacgccatcgccggcgcgtacagcgagaacctccccgtgatctgcatcgtgggcggtcccaactccaacgactacggcaccaaccgcatcctgcaccacaccatcggcctcccggacttctcccaggagctccgctgcttccagaccatcacctgctaccaggccgtcatcaacaacctggacgacgcgcacgagcagatcgacaccgccatcgcgacggcgctgagggagagcaagcccgtgtacatcagcgtcggctgcaacctggccggcctctcccacccgaccttcagccgggatccggtgcccctgttcatctcccccaggctgagcaacaaggcgaacctcgagtacgccgtggaggcggcggcggacttcctcaacaaggcggtgaagccggtgatggtgggcgggcccaagatccgggtggccaaggccagggaggcgttcgccggcgtcgcggacgccagcgggtaccctttcgccgtgatgccgtccgccaagggccttgtgccggagcaccacccgcggttcatcggcacctactggggcgccgtgagcaccacgttctgcgccgagatcgtggagtccgccgacgcgtacctcttcgccggccccatcttcaacgactacagctccgtcggctactccctgctgctcaagcgggagaaggccatcatcgtgcagcccgaccgcgtggtggtcggcaacggcccggcgttcgggtgcatcctcatgtccgagttcctccgcgggctcgccaagcgcctcaggcgcaacaccacggcgtacgacaactaccgccggatcttcgtccccgaccgcgagccgctcaacggcaagcccgacgagccgctcagggtcaacatcctcttcaagcacatcaagggcatgctgtccggcgagaccgccgtcgtcgccgagaccggcgactcgtggttcaactgccagaagctcaggctccccgagggctgcgggtacgagttccagatgcagtacggctcgatcgggtggtcggtcggcgcgacgctcgggtacgcccaggcggccaaggacaagcgtgtcatcgcgtgcatcggcgatggaagcttccaggtgacggcgcaagacgtgtcgacgatgctccggtgcgggcagaagagcatcatcttcctcatcaacaacggcgggtacaccatcgaggtggagatccacgacggcccgtacaacgtgatcaagaactgggactacacggggctcatcaacgccatccacaacggcgacggcaactgctggaccatgaaggttcggacggaggcggagctcaaggaggcgatcgccacggcgacgggcgccaagaaagactgcctctgcttcatcgaggtgatcgtgcacaaggacgacaccagcaaggagctcctcgagtggggctccagggtctccgccgccaacagcaggccgcccaacccccagtga

SEQ ID NO: 4724 - protein, 609 aa, Sorghum bicolor
  misc_feature: Ceres ANNOT ID no. 6039881
  misc_feature (47)..(223): Pfam Id: TPP_enzyme_N Pfam Desc: Thiamine pyrophosphate enzyme, N-terminal TPP binding domain
  misc_feature (245)..(378): Pfam Id: TPP_enzyme_M Pfam Desc: Thiamine pyrophosphate enzyme, central domain
  misc_feature (440)..(580): Pfam Id: TPP_enzyme_C Pfam Desc: Thiamine pyrophosphate enzyme, C-terminal TPP binding domain
  misc_feature (1)..(609): NCBI GI: 22395 NCBI Desc: pyruvate decarboxylase [zea mays]
  misc_feature (1)..(609): NCBI GI: 3970823 NCBI Desc: pyruvate decarboxylase [zea mays]
  misc_feature (1)..(609): NCBI GI: 115510971 NCBI Desc: pyruvate decarboxylase isozyme 1 (pdc)
  misc_feature (1)..(609): NCBI GI: 23495286 NCBI Desc: pyruvate decarboxylase [oryza sativa]
  misc_feature (1)..(609): NCBI GI: 1098559 NCBI Desc: pyruvate decarboxylase
  misc_feature (1)..(609): SWISSPROT Homolog: EC 4.1.1.1 Pyruvate decarboxylase isozyme 1
  misc_feature: Up-regulated in root tissues in response to methyl jasmonate treatment
  misc_feature: Up-regulated in shoot tissues in response to methyl jasmonate treatment
  misc_feature: The sequence is a functional homolog of SEQ ID NO. 538 in the 11/188,298 US application
METLLVGNPANGVAKPMCNGVGALPVANSHAVIGAAPPATTAAPAGATLGRHLARRLVQIGASDVFAVPGDFNLTLLDYLIAEPGLSLVGCCNELNAGYAADGYARSRGVGACAVTFTVGGLSVLNAIAGAYSENLPVICIVGGPNSNDYGTNRILHHTIGLPDFSQELRCFQTITCYQAVINNLDDAHEQIDTAIATALRESKPVYISVGCNLAGLSHPTFSRDPVPLFISPRLSNKANLEYAVEAAADFLNKAVKPVMVGGPKIRVAKAREAFAGVADASGYPFAVMPSAKGLVPEHHPRFIGTYWGAVSTTFCAEIVESADAYLFAGPIFNDYSSVGYSLLLKREKAIIVQPDRVVVGNGPAFGCILMSEFLRGLAKRLRRNTTAYDNYRRIFVPDREPLNGKPDEPLRVNILFKHIKGMLSGETAVVAETGDSWFNCQKLRLPEGCGYEFQMQYGSIGWSVGATLGYAQAAKDKRVIACIGDGSFQVTAQDVSTMLRCGQKSIIFLINNGGYTIEVEIHDGPYNVIKNWDYTGLINAIHNGDGNCWTMKVRTEAELKEAIATATGAKKDCLCFIEVIVHKDDTSKELLEWGSRVSAANSRPPNPQ

SEQ ID NO: 4725 - DNA, 1656 bp, Sorghum bicolor
  misc_feature: Ceres ANNOT ID no. 6039885
  misc_feature: Encodes the peptide sequence at SEQ ID NO 4726
atggccgccgatgacgcggcgcggagcagcagacggatggatctgaacctctacctcggcctcccccgcgccccgcgcgcccgccgccccgatctcggctccgacctcgcgctcggcaccccgatgctgtcttcgtcgtctccatcgtcctcggctgcctccgcggacgcgccgccgctggagacggatccgctgcacccgccctactcgccgacccgcgccgacctggtgcgcccgccgaccccggcgcacgagccctacaacccgttcgcgcccgaggcgcacccgccctacgtgcccccgccaccactgcctgttccaggggctttacctgtgctcgctgatgagcttgagtttggttttcccgacgcgcacctcggtgtggtcgagcgcttagaccggccatcgtcgtcgactgcatcctctcccttccgcccggatcgtgccgagcgctaccgccgcttcatgtccttgggcgggtctcgctacttccggccaagacggttccggtccgaccttccacctctcagctcagaggctcctagcctggagaatgatgctgcagcgcaaccacctgaacgtgaagagcctgtccatgataccgtggaggagaacaaggtggttaccgatggtgcagttgtgggtgtctcagaggacgatggaacagagcatggtaagagtgccgcaatgttcgagtgtaatatctgttttgaaatggctgaagaaccagtggttacctcctgcggccatctcttctgctggccttgtttatatcagtggttgcatgttcactccagccataaggagtgccctgtctgcaaaggagaggttactgaagggaacatcactcctatctatgggagagggaattcaggttcagatactgagaagaaggttgcagaggatggcaacgcatctggccccaagattccaccaaggccacatgggaatcggctagagagtttccggcaacagttccaccatttgcggcccatatctagaaggtttggtgacacacatgggcttttgtctacgtggaggcgcatttttgatcagcatttggtgaatagcatgagtagacttgaagcgcctcctgaaccatctgtctcggaaactgctcagcatgcaagccgtttgggccgaatgactactaggttgagagcgaggaggttgcaaagggaagcggaaaaccctacatccgttgtttcatctgcaccagatagtgggcagcctggaaacaatacatccgatctgccaaggcgctcttcaagcccatttcacgcagaagggatggatttattgcgacacattgccttcgctggtcttgaagactcagaaaggtttgcgactgctgtcagtgaacttaggcgaattgctaggccaagcccctatggggcatcaacttcatcaaacccaccaaatcctgagcctgttgatggaactcatattgcctcggcactggctgcagatcaagcttctaattcaagcaccatggctgtgattcaggaagatgcggcttttactgaaagtgctggagaacctagtaatgcagggtcttcaagatccctgagaagaagaagaggaagtgatgccttaggttctttggatgtggatggtggggacctacatcagaataagagaaggcggctgaactaa

SEQ ID NO: 4726 - protein, 551 aa, Sorghum bicolor
  misc_feature: Ceres ANNOT ID no. 6039885
  misc_feature (233)..(273): Pfam Id: zf-C3HC4 Pfam Desc: Zinc finger, C3HC4 type (RING finger)
  misc_feature (418)..(551): NCBI GI: 115440831 NCBI Desc: os01g0830200 [oryza sativa (japonica cultivar-group)]
  misc_feature (194)..(325): NCBI GI: 92899109 NCBI Desc: zinc finger, ring-type [medicago truncatula]
  misc_feature (220)..(328): NCBI GI: 115440149 NCBI Desc: os01g0766200 [oryza sativa (japonica cultivar-group)]
  misc_feature (176)..(325): NCBI GI: 108877619 NCBI Desc: rnf5 [aedes aegypti]
  misc_feature (225)..(320): NCBI GI: 62858735 NCBI Desc: rnf5 [xenopus tropicalis]
  misc_feature: The sequence is a functional homolog of SEQ ID NO 2412 in the 10/374,780US patent application
  misc_feature: The sequence is a functional homolog of SEQ ID NO 496 in the 10/412,699US patent application
  misc_feature: The sequence is a functional homolog of SEQ ID NO 76 in the 10/666,642US patent application
  misc_feature: The sequence is a functional homolog of SEQ ID NO 766 in the 10/666,642US patent application
  misc_feature: The sequence is a functional homolog of SEQ ID NO 767 in the 10/666,642US patent application
  misc_feature: The sequence is a functional homolog of SEQ ID NO 982 in the 10/225,066US patent application
  misc_feature: Useful for making plants with modulated growth and phenotype characteristics
  misc_feature: The sequence is a functional homolog of SEQ ID NO 496 in the 20040045049 US patent application
  misc_feature: The sequence is a functional homolog of SEQ ID NO 76 in the 20070033671 US patent application
  misc_feature: The sequence is a functional homolog of SEQ ID NO 766 in the 20070033671 US patent application
  misc_feature: The sequence is a functional homolog of SEQ ID NO 766 in the 10/666,642 US patent application
  misc_feature: The sequence is a functional homolog of SEQ ID NO 767 in the 10/666,642 US patent application
  misc_feature: The sequence is a functional homolog of SEQ ID NO. 309 in the 11/188,298 US application
MAADDAARSSRRMDLNLYLGLPRAPRARRPDLGSDLALGTPMLSSSSPSSSAASADAPPLETDPLHPPYSPTRADLVRPPTPAHEPYNPFAPEAHPPYVPPPPLPVPGALPVLADELEFGFPDAHLGVVERLDRPSSSTASSPFRPDRAERYRRFMSLGGSRYFRPRRFRSDLPPLSSEAPSLENDAAAQPPEREEPVHDTVEENKVVTDGAVVGVSEDDGTEHGKSAAMFECNICFEMAEEPVVTSCGHLFCWPCLYQWLHVHSSHKECPVCKGEVTEGNITPIYGRGNSGSDTEKKVAEDGNASGPKIPPRPHGNRLESFRQQFHHLRPISRRFGDTHGLLSTWRRIFDQHLVNSMSRLEAPPEPSVSETAQHASRLGRMTTRLRARRLQREAENPTSVVSSAPDSGQPGNNTSDLPRRSSSPFHAEGMDLLRHIAFAGLEDSERFATAVSELRRIARPSPYGASTSSNPPNPEPVDGTHIASALAADQASNSSTMAVIQEDAAFTESAGEPSNAGSSRSLRRRRGSDALGSLDVDGGDLHQNKRRRLN

SEQ ID NO: 4727 - DNA, 1593 bp, Sorghum bicolor
  misc_feature: Ceres ANNOT ID no. 6039886
  misc_feature: Encodes the peptide sequence at SEQ ID NO 4728
  misc_feature: Down-regulated in shoot tissues in response to salicylic acid treatment
atggcagccgccgccgattctgccgccggccaaaaccctaaggacgacgagcggcacgtgctcaccgctgactccgacgccaggttctcggaggaggagtacgaagaggatggggaggaggaatacgaggaggaggaggaggaggaggagctggacgggccggcggccgaggcggcggagcgggagcgggtgcagtccgtgttccggcggctgtcatccaaccccgtgggcatccgcgtccacgacgtgctcatcaagggaaacaccaagacgcgggacgagctcatcgaggcggaggtcgccgacctgctccgcgccgcacccaccgtgcaggatctgctccgcgccgccagtgtcgccaccgcgcggctgcacagtctcgacgtcttcgacaccgtcaagatcacgctcgacgcggggccgcccgagctgcccggcaccaccaacgtcgtcatcgaggtcgtcgaggcggccaaccccctcactggcaccgccggcgtctattcgaagcccgaggcaagatcttggtcgctggaagggtcacttaagttgaagaatttgtttggctatggtgacatctgggatgcatcagggtcctttggttgggaccaaacaacagaggttggtgttggagtctacctaccgaggttcaaatcaataccaacaccattgatggcccgggcatctttgtcatcacaagattggctgaagttttcatcatacaaggagcgcctacttggcctttcatttggtttgctgtcaacaaggaaccatgacttgtcatataaccttacatggcgtaccttaactgatccatcgcatgtctcatcaaaggccataaggaggcagttagggcataatcttctttctgcattgaagtacatatacaagattgataagagggattcacatcttaggccaacaaaaggatatgcgtttcagtcaacttctcaagttggtggtctatggaatagcaaaggattgagatattttcggcaggagtttgatgtgcgtggtgctgtgcctttgggattttataatgctgctctcaatgttggtgttggagcgggtgtcattttaccacttggagggggattcatgaattcgacttcaccagtgccagagaggttttatcttggaggcaattcttctccagtttgcagcttgggcggactgtcatctctgctgggtttcagattaaggggagttggcccaacagaggcacggaggcatgtccttgataaaccggagagtggctcgggtgaccctggaagggattacttgggaggtgatctggccgtgtctgcctttgctgacctttcttttgatctgcctctcaagatattcagagatgctggaattcatggccatgcattcctaactgccggaaaccttgcaaaattgtcggagggtgagtataagaacttcacggcttctgaatttcagcgcacattccggagctctgctggtgttggcattattttgcctaccaaacttttccgggtggaggtgaactattgtcacatcctaaagcaagctgagcatgacagttcgaagactggaatccagttcagcttctcctcgcccatgtag

SEQ ID NO: 4728 - protein, 530 aa, Sorghum bicolor
  misc_feature: Ceres ANNOT ID no. 6039886
  misc_feature (186)..(530): Pfam Id: Bac_surface_Ag Pfam Desc: Surface antigen
  misc_feature (1)..(529): NCBI GI: 115483753 NCBI Desc: os11g0106200 [oryza sativa (japonica cultivar-group)]
  misc_feature (174)..(529): NCBI GI: 144923817 NCBI Desc: bacterial surface antigen (d15) [medicago truncatula]
  misc_feature (79)..(405): NCBI GI: 38511778 NCBI Desc: cgi-51 protein [xenopus tropicalis]
  misc_feature (53)..(405): NCBI GI: 14043738 NCBI Desc: cgi-51 protein [homo sapiens]
  misc_feature (53)..(405): NCBI GI: 62896873 NCBI Desc: cgi-51 protein variant [homo sapiens]
  misc_feature: Down-regulated in shoot tissues in response to salicylic acid treatment
MAAAADSAAGQNPKDDERHVLTADSDARFSEEEYEEDGEEEYEEEEEEEELDGPAAEAAERERVQSVFRRLSSNPVGIRVHDVLIKGNTKTRDELIEAEVADLLRAAPTVQDLLRAASVATARLHSLDVFDTVKITLDAGPPELPGTTNVVIEVVEAANPLTGTAGVYSKPEARSWSLEGSLKLKNLFGYGDIWDASGSFGWDQTTEVGVGVYLPRFKSIPTPLMARASLSSQDWLKFSSYKERLLGLSFGLLSTRNHDLSYNLTWRTLTDPSHVSSKAIRRQLGHNLLSALKYIYKIDKRDSHLRPTKGYAFQSTSQVGGLWNSKGLRYFRQEFDVRGAVPLGFYNAALNVGVGAGVILPLGGGFMNSTSPVPERFYLGGNSSPVCSLGGLSSLLGFRLRGVGPTEARRHVLDKPESGSGDPGRDYLGGDLAVSAFADLSFDLPLKIFRDAGIHGHAFLTAGNLAKLSEGEYKNFTASEFQRTFRSSAGVGIILPTKLFRVEVNYCHILKQAEHDSSKTGIQFSFSSPM

SEQ ID NO: 4729 - DNA, 795 bp, Sorghum bicolor
  misc_feature: Ceres ANNOT ID no. 6039900
  misc_feature: Encodes the peptide sequence at SEQ ID NO 4730
atgtggccgtcgtgggtcaagacgcgcagctctgaccccgctgccgcctccacctccaccgccctcgtccccgccgccggcgcgtcgccgcgcctctccatccccaacccgtctctcaaggacctccggtccctgctcgcgccggactccgccgccgccgccctgccgtccgccgtctccccgtcgccgcgcgtcttccaccgcatccgcgtcgccgcctccgcgctccgcgtcctccgcacgctccagcactccccgtcctccccgcccgccgccggcaaggagctagcaccgggcggcgggcgggtggtgctgtacttcacctccctccgcgtggtccgcggcacctacgaggactgccgcgcggtgcgcgccatcctgcgcgggctccgcgccgccgtcgacgagcgcgacctctccatggacccgggctacctccccgagctcgccgcgctcctcccccacccgcacgcgcagcagcagcgccgccaccgcgtggcgctgccccaggtcttcgtcggcggccgctacctcggcggcgccgaggaggtccggcgcctccacgagtccggcgagctccgccgcatcgtcgcccccgcccccgccaaccccgcgttccccggcaactgcgcccgctgcggcggcgagcgctacgtgctgtgcggcgcctgcgacggcagccacaagcggtacagcctcaagggcggcggcgggttccgcgcctgcgccgagtgcaacgagaacgggctcgtccgctgccccgcctgctgctgcatccccgtccacgccgcctga

SEQ ID NO: 4730 - protein, 264 aa, Sorghum bicolor
  misc_feature: Ceres ANNOT ID no. 6039900
  misc_feature (104)..(178): Pfam Id: Glutaredoxin Pfam Desc: Glutaredoxin
  misc_feature (1)..(256): NCBI GI: 15624060 NCBI Desc: glutaredoxin-like [oryza sativa (japonica cultivar-group)]
  misc_feature (1)..(257): NCBI GI: 115463369 NCBI Desc: os05g0353600 [oryza sativa (japonica cultivar-group)]
  misc_feature (98)..(256): NCBI GI: 53370707 NCBI Desc: glutaredoxin domain containing protein [oryza sativa (japonica cultivar-group)]
  misc_feature (85)..(256): NCBI GI: 115448683 NCBI Desc: os02g0748800 [oryza sativa (japonica cultivar-group)]
  misc_feature (77)..(257): NCBI GI: 124359980 NCBI Desc: thioredoxin fold [medicago truncatula]
MWPSWVKTRSSDPAAASTSTALVPAAGASPRLSIPNPSLKDLRSLLAPDSAAAALPSAVSPSPRVFHRIRVAASALRVLRTLQHSPSSPPAAGKELAPGGGRVVLYFTSLRVVRGTYEDCRAVRAILRGLRAAVDERDLSMDPGYLPELAALLPHPHAQQQRRHRVALPQVFVGGRYLGGAEEVRRLHESGELRRIVAPAPANPAFPGNCARCGGERYVLCGACDGSHKRYSLKGGGGFRACAECNENGLVRCPACCCIPVHAA

SEQ ID NO: 4731 - DNA, 2004 bp, Sorghum bicolor
  misc_feature: Ceres ANNOT ID no. 6039903
  misc_feature: Encodes the peptide sequence at SEQ ID NO 4732
atggccgtcccttcctccgaccgcgcgaggcggccattcctcctctcgctctcgctcttcctcctcgtctccgccatcctcgtccttgccttcctcttcctcgacccctcacctggatcgctcgccttcctcccctcccgtctctccgcctcagccccttccctcgcacctcctcctcctcctcttccccaacagcaaagcccacctcactcggaaccagatggctcgagcgccaccggcaaagcggagaaggacactagtgcatcacaaccagccgtcacaaaagccgatgtcaacagtagcgcatctgaaccatccgccgaggaagccagcggctcgccgggagcaggcgacaacagcgacgccgccgggggaggcggggcggacgggaagacggatacaagcgtcgccccggtggagaagggtggggacgaggaggaggtgccgccggtgagcgtgaggtggcagacgtgcagcaggctcgggaggggcgtgtcgtcgacggactacatcccgtgcctcgacaacgtgcgggcgatcaaggcgctgcggtcgaggcggcacatggagcaccgggagcggcactgccccctggcgccccggcccagatgcctggtgcctctgcccgcagggtaccggacgcctgtgccgtggccgggcagccgtgacatgatttggtacaacaacgtccctcacccaaagctggtggagtataagaaagatcagaactgggttacaaggtctggcgattatctagtttttcctggaggtggaactcaattcaaagatggtgtgggaagatacattcagttcgttgaacagattatgccagacattcaatggggaaggcgcacaagaactgtcttggatgttggatgtggagttgccagctttggtggatacctgcttgacaggaatgtcattactatgtcatttgccccaaaagatgagcatgaggctcagatacagtttgcactggagcgtggaattccagcatttctagctgtaattggaacacaaaagcttccatttcctgataatacgttcgatgttgtacactgtggaaaaccactgttggagcttaatagagtactaaggcctggaggatatttcatttggtctgcaacccctgtctaccgtcaagagaaaagagaccaagatgactggaatgcaatggttactctgactaaatcaatctgctggagaacagtggtaaaatctcaagttgtcaatggaattggagttgttatatatcaaaagccggcatcgaattcttgctatgctgaaaggaagaccaatgaaccccctctgtgctccgagagagatggatcacgttttccttggtatgctcctcttgatagttgccttttcacaactaccattaccagtacagatgaaagatacagctggcctgttccatggcccgaaagacttgatgttagatatgcaagtgtacctgatgattctgcttctaacaaagagaagtttgaagctgatacaaagtattggaaacagctcgtttcagaagtatatttcagtgacttcccacttaattggtcaagcattcgtaatgtaatggacatgaatgctggttttggagggtttgcggcagcgctcattgatcgaccattatgggttatgaatgttgcaccaattgggcagccagataccttgccacttattttcaacagaggtttgattggggcatatcatgactggtgcgaatctttcaacacctaccctcgtacctatgatcttctccacatgagtaatctcattggaagtcttacaaataggtgtgacctcattgaagtggtggttgaaatcgacagaatactgagacctggaagatggtttgtgttgaaagacacattagagatgataaaaaagatgcgcccaatcctgaagtctctgcactatgaaactgtcatcgtgaaacagcaatttcttgttgctagaaagagtttctggcggcccggcaaaccatcttccacgtcagggtga

SEQ ID NO: 4732 - protein, 667 aa, Sorghum bicolor
  misc_feature: Ceres ANNOT ID no. 6039903
  misc_feature (289)..(373): Pfam Id: Methyltransf_11 Pfam Desc: Methyltransferase domain
  misc_feature (275)..(661): NCBI GI: 115464429 NCBI Desc: os05g0472200 [oryza sativa (japonica cultivar-group)]
  misc_feature (151)..(642): NCBI GI: 58652086 NCBI Desc: at5g06050 [arabidopsis thaliana]
  misc_feature (14)..(644): NCBI GI: 15408875 NCBI Desc: ankyrin-like protein [oryza sativa (japonica cultivar-group)]
  misc_feature (26)..(638): NCBI GI: 20334726 NCBI Desc: at1g77260/t14n5_19 [arabidopsis thaliana]
  misc_feature (37)..(479): NCBI GI: 38567836 NCBI Desc: osjnbb0020j19.14 [oryza sativa (japonica cultivar-group)]
  misc_feature: The sequence is a functional homolog of SEQ ID NO 198 in the 10/666,642US patent application
  misc_feature: Useful for making plants with modulated growth and phenotype characteristics
  misc_feature: The sequence is a functional homolog of SEQ ID NO 198 in the 20070033671 US patent application
  misc_feature: The sequence is a functional homolog of SEQ ID NO 198 in the 10/666,642 US patent application
  misc_feature: The sequence is a functional homolog of SEQ ID NO 508 in the 11/435,388 US patent application
  misc_feature: The sequence is a functional homolog of SEQ ID NO 562 in the 10/412,699 US patent application
  misc_feature: The sequence is a functional homolog of SEQ ID NO 626 in the 11/435,388 US patent application
  misc_feature: The sequence is a functional homolog of SEQ ID NO 484 in the 11/435,388 US patent application
MAVPSSDRARRPFLLSLSLFLLVSAILVLAFLFLDPSPGSLAFLPSRLSASAPSLAPPPPPLPQQQSPPHSEPDGSSATGKAEKDTSASQPAVTKADVNSSASEPSAEEASGSPGAGDNSDAAGGGGADGKTDTSVAPVEKGGDEEEVPPVSVRWQTCSRLGRGVSSTDYIPCLDNVRAIKALRSRRHMEHRERHCPLAPRPRCLVPLPAGYRTPVPWPGSRDMIWYNNVPHPKLVEYKKDQNWVTRSGDYLVFPGGGTQFKDGVGRYIQFVEQIMPDIQWGRRTRTVLDVGCGVASFGGYLLDRNVITMSFAPKDEHEAQIQFALERGIPAFLAVIGTQKLPFPDNTFDVVHCGKPLLELNRVLRPGGYFIWSATPVYRQEKRDQDDWNAMVTLTKSICWRTVVKSQVVNGIGVVIYQKPASNSCYAERKTNEPPLCSERDGSRFPWYAPLDSCLFTTTITSTDERYSWPVPWPERLDVRYASVPDDSASNKEKFEADTKYWKQLVSEVYFSDFPLNWSSIRNVMDMNAGFGGFAAALIDRPLWVMNVAPIGQPDTLPLIFNRGLIGAYHDWCESFNTYPRTYDLLHMSNLIGSLTNRCDLIEVVVEIDRILRPGRWFVLKDTLEMIKKMRPILKSLHYETVIVKQQFLVARKSFWRPGKPSSTSG

SEQ ID NO: 4733 - DNA, 1533 bp, Sorghum bicolor
  misc_feature: Ceres ANNOT ID no. 6039917
  misc_feature: Encodes the peptide sequence at SEQ ID NO 4734
atgatggcagcggagccctcgccgtcggttccctccaccgccgctgacgacctcgaaaccctcgccctcgactcatcctcgtcgtccgccgccgctaccgcctccgcctctaccgaccccctcctccggccacctacctccccgaccgccgcgagcgacgaccacttcgtcatcgacgacttcctcgacgaggacgacttctccaccacaccgtcgcccagcgtcgtccgcccgccgcgcgcagcgcgcggcgatgcggcgtctccagtgttcgccaaaatcaccgtatccgatcccaagaagcacgcggagcccagcggcgggggtgccgccggtgtgatcccggggtccggcagctacttttcttacctcatcaccacccgttttgctggcggcggcggggaggtccgcgtgcggcggcgcttccgcgacgtggtggccctcgcggaccgccttgccgcagcccaccgcggcctcttcgtcccggcccggcccgacaagagcgtcctcgaggggcaggtgatacagcgccacgacttcgtcagccagcggtgcgctgcgctccagcgctacctctgccgccttgccgcgcaccctattgttggtcagagccctgatctccgtacgttcctcacggagcctggtgccatccctgccttccaaggtgaggcgccgcggtactggacttccacggtgaatgctgctgctccgctggtgccaacgaaagctgggagggacttgtttgggatgtttaagggtctcaagcagacgttggtgaatgggctggttgcaacaaagcctccacctgtggagcaggagacagacacagagttcctggcacacaaggccaggttcgaggacttacagcagcagctcaccacaacatcgcagcaggcagaagcgcttgttaaagcccaagatgatcttagagaaactacaggtcacttgggaatgacattgattaagctggcaaaatttgaaagagagcaggcaacatgtaattccctaagaagacgggctggtgaaatccatagttttgcaaattctgttttgaagatgagcaggtcacagataaaattaaactctgaaattgtgaaacacctgggtagtatccatgaatacttggagatgatgatatcagttcatcatgcgtttacagatcgctctaatgctttacattacgtgcaaagcttgtcagcagatttgttttccttgcacaccagagcagggagacttgaatcttcatcagcaagagatatggggcatgagtggtcaacatatcagaaggtagaggggttgaaagaaacaataagatcagcggaagcagccaaaagtgatgcacttagagaatatgaaagcattaaggaaaacaacaagattgaaataaaaagatttgacaaggaaagacgccatgatctcatcgagatgctgaaaggttttgtggtaactcaggtgtcttattcagaccattttgctaatatgtggacaaaggtaacagaggaaacagaagtatatgcaaacaggagcaactga

SEQ ID NO: 4734 - protein, 510 aa, Sorghum bicolor
  misc_feature: Ceres ANNOT ID no. 6039917
  misc_feature (89)..(214): Pfam Id: PX Pfam Desc: PX domain
  misc_feature (254)..(501): Pfam Id: Vps5 Pfam Desc: Vps5 C terminal like
  misc_feature (1)..(510): NCBI GI: 115464451 NCBI Desc: os05g0474500 [oryza sativa (japonica cultivar-group)]
  misc_feature (1)..(510): NCBI GI: 115440797 NCBI Desc: os01g0827200 [oryza sativa (japonica cultivar-group)]
  misc_feature (8)..(510): NCBI GI: 30681754 NCBI Desc: phox (px) domain-containing protein [arabidopsis thaliana]
  misc_feature (82)..(218): NCBI GI: 32822856 NCBI Desc: snx2-prov protein [xenopus laevis]
  misc_feature (85)..(218): NCBI GI: 13905328 NCBI Desc: sorting nexin 2 [mus musculus]
MMAAEPSPSVPSTAADDLETLALDSSSSSAAATASASTDPLLRPPTSPTAASDDHFVIDDFLDEDDFSTTPSPSVVRPPRAARGDAASPVFAKITVSDPKKHAEPSGGGAAGVIPGSGSYFSYLITTRFAGGGGEVRVRRRFRDVVALADRLAAAHRGLFVPARPDKSVLEGQVIQRHDFVSQRCAALQRYLCRLAAHPIVGQSPDLRTFLTEPGAIPAFQGEAPRYWTSTVNAAAPLVPTKAGRDLFGMFKGLKQTLVNGLVATKPPPVEQETDTEFLAHKARFEDLQQQLTTTSQQAEALVKAQDDLRETTGHLGMTLIKLAKFEREQATCNSLRRRAGEIHSFANSVLKMSRSQIKLNSEIVKHLGSIHEYLEMMISVHHAFTDRSNALHYVQSLSADLFSLHTRAGRLESSSARDMGHEWSTYQKVEGLKETIRSAEAAKSDALREYESIKENNKIEIKRFDKERRHDLIEMLKGFVVTQVSYSDHFANMWTKVTEETEVYANRSN

SEQ ID NO: 4735 - DNA, 951 bp, Sorghum bicolor
  misc_feature: Ceres ANNOT ID no. 6039920
  misc_feature: Encodes the peptide sequence at SEQ ID NO 4736
atggcgagtgcacaggcaatggggcaaggagaacaagatcacttcgttctgaagagcggacacaccattccagctgttggtctaggcacttggagggctggctcagataccgctcactctgttcagacagccatcaccgaggctggatataggcatgtggatacagctgctcaatacggagtagaaaaagaggtcggtaaaggacttaaagctgcaatggagggtgggatcaataggaaagatttgtttgtaacgtcgaagttatggtgcacagagttggctcctgataaggttcggccagcacttcagaaaacactcaaggatttacagctggattacctggatctctaccttatccattggcccttcagactaaaagatggggcgcacatgcccccggaagctggggaagtgctggaattcgacatggaaagagtgtggagggaaatggaaagccttgtgaaagatgggctagttaaggatataggtgtttgcaattacacagttaccaagctcaaccgtctgatgcggtcagcaaatgttccaccagcaatggaaatgcaccctggttggaagaatgacaagatttttgaggcctgcaaaaagcatgggattcatgttacagcttactctccactgggttcttcagagaagaacctagcacacgaccccgttgtcgaaaaggtagccaacaaactgaacaagaccccagggcaggtgctcatcaagtgggccctccaaagagggacaagcgttattcccaaatcgaccaaggacgaaagaatcaaagagaacatccaggtgtttggatgggagatccctgaggaggacttcacggtcttgtgcagcatcaaagatgagaagcgcgtgctgaccggagaggagctcttcgtgaacaagacccacgggccgtacaagagcgcatctgaggtctgggaccacgaggactga

SEQ ID NO: 4736 - protein, 316 aa, Sorghum bicolor
  misc_feature: Ceres ANNOT ID no. 6039920
  misc_feature (17)..(286): Pfam Id: Aldo_ket_red Pfam Desc: Aldo/keto reductase family
  misc_feature (1)..(316): NCBI GI: 113595 NCBI Desc: aldose reductase (ar) (aldehyde reductase)
  misc_feature (1)..(316): NCBI GI: 18891 NCBI Desc: aldose reductase-related protein [hordeum vulgare subsp. vulgare]
  misc_feature (1)..(316): NCBI GI: 728592 NCBI Desc: aldose reductase [hordeum vulgare]
  misc_feature (2)..(316): NCBI GI: 110590880 NCBI Desc: chain a, holo aldose reductase from barley
  misc_feature (1)..(316): NCBI GI: 1155213 NCBI Desc: aldose reductase-related protein [avena fatua]
  misc_feature (1)..(316): SWISSPROT Homolog: EC 1.1.1.21 Aldose reductase
MASAQAMGQGEQDHFVLKSGHTIPAVGLGTWRAGSDTAHSVQTAITEAGYRHVDTAAQYGVEKEVGKGLKAAMEGGINRKDLFVTSKLWCTELAPDKVRPALQKTLKDLQLDYLDLYLIHWPFRLKDGAHMPPEAGEVLEFDMERVWREMESLVKDGLVKDIGVCNYTVTKLNRLMRSANVPPAMEMHPGWKNDKIFEACKKHGIHVTAYSPLGSSEKNLAHDPVVEKVANKLNKTPGQVLIKWALQRGTSVIPKSTKDERIKENIQVFGWEIPEEDFTVLCSIKDEKRVLTGEELFVNKTHGPYKSASEVWDHED

SEQ ID NO: 4737 - DNA, 1881 bp, Sorghum bicolor
  misc_feature: Ceres ANNOT ID no. 6039930
  misc_feature: Encodes the peptide sequence at SEQ ID NO 4738
atgtacccgctggtgacgggcacgccgccggcgcggctgccggcggcgtcgcgggtggacaaggccacgagccacctgctgcagggacccgactgggccgtcaacctcgaaatctgcgacaccctcaacgccgaccgctggcaaacaaaggatgtggtaaaagctgtgaagaagcgattgcagcataaggacccaaaagttcaattctttactttgacgttattggagacaatgatgaagaactgtggtgaatatgttcattttgaagttgttgatcatcatgttctacaggagatggttaaaattgtccagaagaggcatgatatgcaagtgagggataaggcattgttacttctggattcatggcaagaggcatttggtggacctggtggcaaatatccacagtactactggtcatacattgaactaaagagggcaggagtaatgttcccacgacgtcctgtagatgctcctccagtatttactcctcctgcaacacatcaggcgtatggttcacctagatatacttctggaagtctaaatgagagaatcacatctgatgctggaacattgagctttgagggtttgaataatattagaaatgcaacggaacttctgtgtgatatggtgaatgctttgaaccctgctgatcgcatggcagtaaaagatgaaatcattacagatcttgtaaatcaatgtcgttcaaatcaacaaaagctcatccaatttgtcagttccacaggggatgaggagctgctaaagcaaggactagaactaaatgatcgcttacagagtgtactgacaaaacatgatgctattgcttctggttctccattaccagttgaaacaccgagtagagaactacgcagagaggatccaaatcctgagccatctacaccaattacacatgatagcaaggctcaagttgaagaggatgaagatgatgagtttgctcagatagcacgaagaaaaaacaaatctgtgatatccagtgatgaggcatcatccagtgctggtgatcaggccctggtacctgttgatccagcactttctgaagtttcttcagttgcgagcaatgcaatagtgcctctcgacgcaacttctgttagtggaaccaggacgaaggagcaggatatgattgatcttctcagcctcactttgtacagtcctcctgaatcatctgcagattcttcaactcagaaccaaaatgggagtcagccgagcgtcacatcaaatggaccagaaacacagccgagctatcagcccgctgcagcgaatggggcaaattaccctgccaacaaccaggcttatccaacaaaccagggatatgttccttacaataactatgttgcaccatgggcccaaacgggaccggttgcacagcctggagcatatccaactcaaccccagcaatatgtgactcaaccccagcaatatgtgtctagctatccggcaccaccatgggctatgcctgcaagtgccaatgcaactaatcctttccagcctgcgacataccaaactccaaaccctcctgctgcttctgttgcccctgcagctacctatccaactacgtcaaagtcttatgccgctccatcaatgcaacttgttccatctccagcaccaaaacccctgcaaagttacaactcttctatttctcaaacatactctggtccgaacatggttacagatgctcggatgaacggaaatcagcggccaaaagaaactccagtggcagcagccagaccatattacatgccggacaatttgtttggagacctgatcgacgtgaagagttttggcgctggaagcaagatcaacaggtctaccagcatgccgagtccaaagggtggtggccagcctatgattggtagaaacaaatag

SEQ ID NO: 4738 - protein, 626 aa, Sorghum bicolor
  misc_feature: Ceres ANNOT ID no. 6039930
  misc_feature (13)..(147): Pfam Id: VHS Pfam Desc: VHS domain
  misc_feature (183)..(283): Pfam Id: GAT Pfam Desc: GAT domain
  misc_feature (15)..(510): NCBI GI: 92887452 NCBI Desc: epsin, n-terminal; gat; enth/vhs [medicago truncatula]
  misc_feature (6)..(489): NCBI GI: 42567576 NCBI Desc: vhs domain-containing protein / gat domain-containing protein [arabidopsis thaliana]
  misc_feature (17)..(505): NCBI GI: 82791812 NCBI Desc: vhs and gat domain protein [glycine max]
  misc_feature (15)..(345): NCBI GI: 140065047 NCBI Desc: gat; enth/vhs [medicago truncatula]
  misc_feature (320)..(559): NCBI GI: 46367662 NCBI Desc: vhs2 protein [oryza sativa (japonica cultivar-group)]
MYPLVTGTPPARLPAASRVDKATSHLLQGPDWAVNLEICDTLNADRWQTKDVVKAVKKRLQHKDPKVQFFTLTLLETMMKNCGEYVHFEVVDHHVLQEMVKIVQKRHDMQVRDKALLLLDSWQEAFGGPGGKYPQYYWSYIELKRAGVMFPRRPVDAPPVFTPPATHQAYGSPRYTSGSLNERITSDAGTLSFEGLNNIRNATELLCDMVNALNPADRMAVKDEIITDLVNQCRSNQQKLIQFVSSTGDEELLKQGLELNDRLQSVLTKHDAIASGSPLPVETPSRELRREDPNPEPSTPITHDSKAQVEEDEDDEFAQIARRKNKSVISSDEASSSAGDQALVPVDPALSEVSSVASNAIVPLDATSVSGTRTKEQDMIDLLSLTLYSPPESSADSSTQNQNGSQPSVTSNGPETQPSYQPAAANGANYPANNQAYPTNQGYVPYNNYVAPWAQTGPVAQPGAYPTQPQQYVTQPQQYVSSYPAPPWAMPASANATNPFQPATYQTPNPPAASVAPAATYPTTSKSYAAPSMQLVPSPAPKPLQSYNSSISQTYSGPNMVTDARMNGNQRPKETPVAAARPYYMPDNLFGDLIDVKSFGAGSKINRSTSMPSPKGGGQPMIGRNK

SEQ ID NO: 4739 - DNA, 2304 bp, Sorghum bicolor
  misc_feature: Ceres ANNOT ID no. 6039936
  misc_feature: Encodes the peptide sequence at SEQ ID NO 4740
atggacgtcaacgaggaggccatggcggcgcacaagcgcgccttcctcgacttcctcgaccaagacgttgggaagggggtttacatgcaggccgtccgcgacatggtccagaacaagcgccaccgcctcatcatcggcatggacgacctccgcaaccacaacctcgatctcgcccgcagggtgattcgaagccccggggagtatatgcagccggcgtcggacgcggtttcggaggtggcgaggaatctagatcccaagtttctgaaggaaggggagcgcgtgatggtgggcttctcggggccgttcgggttccacagggtcacgcctagggatctcatgtcctccttcatcggcaccatggtctgcgttgagggcatcgtcaccaaatgctcgttggtaaggccaaaagttgttaagagcgttcacttctgccctgtgactggggactttctatcgcgtgaatacagggacatcacttcttttgtaggcttgcctactggctctgtttatccaacaagggatgagaatggtaacttgttggtcaccgagtatggaatgtgtgaatacaaggatcaccagacattgtccatgcaagaagtgcctgaaaattctgcacctggacagctcccaagaactgtcgatgttattgtcgaagatgatcttgtagattgttgcaaacctggtgatcgtgtctcaattgtcggtgtatacaaggctctaccagggaaaagcaagggaagtgttagtggtgtgttcagaactgtccttatcgcaaataatgtgtcgcttcttaacaaagaggcaaatgcacctgtctatactcgggaagatctgaagcggatgaaagaaatatcaaggagaaatgacaccttcgacgtgctgggaaactcacttgctccatccatatatggtcatctatggataaagaaggcagtagtactactgatgcttggtggcgttgagaagaatctaaaaaatggaactcacttgagaggagatataaacatgatgatggtgggagatccttcagttgccaagtcccagctcctaagagctgtgatgaacattgcccctttggctatctcaacaactggcaggggttcatctggtgttggtttgactgctgctgtgacttctgatcaagagactggggaaagaaggcttgaagctggtgccatggttcttgctgatcgtggtgttgtctgcattgatgagtttgataaaatgaatgatcaagaccgagttgctattcatgaagtcatggaacagcaaactgtaaccattgcaaaggcaggaatacatgcctcgctaaatgcgagatgtagtgtaattgctgcagcaaatccaatatatggaacttatgatcgatcattgacgccaacaaagaatattgggcttcccgattcactgctttcccgttttgatttactttttattgttcttgatcaaatggatcctgagattgaccggcaaatttcagaacacgttgctcgaatgcatagatattgcactgatgatggaggagcaaggtctcttgataaggatggatgtgctgaagaagacgatggtgatgctatttttgttaagtatgataggatgctccatggtcaggatagaagaagaggaaagaaagctaagcaggataggctaactgtcaaatttgtgaagaaatatattcattatgcaaagaaccttattcaaccaaagctcactgacgaggcatctgatcatattgctacttcatatgctgagctcagggatggtagtgcaaatgcaaagtctggtggaggtacacttccaattacagcaaggacactggaaaccataatccgtctatccacagctcatgccaagatgaaactgagacatgaggttctgaaatccgatgttgaggctgcattgcaagttctaaattttgcaatataccacaaggaattgactgagatggaagagcgtgaacagagagaaatggagatgaaacagcaagctgatcatgatgcaggtgcaactggtggcactgaggatgggcatggaagctctggaaacgatccaatggatgtggatgtaggaaacacttcaaatgatcagaatgttcctgcagagagaattgaagcattcgaagcaattctgggtcagcatgtgttggcaagccatgtagatcaaatgtcaattgatgaaatcgagcagacggtgaatagggagtcaactgcaccttacaccagaagccaagtagagtttattttggagaggatgcaagatgcaaacaggataatgatacgagatggtgttgttcgaatcatataa

SEQ ID NO: 4740 - protein, 767 aa, Sorghum bicolor
  misc_feature: Ceres ANNOT ID no. 6039936
  misc_feature (277)..(642): Pfam Id: MCM Pfam Desc: MCM2/3/5 family
  misc_feature (335)..(476): Pfam Id: AAA_3 Pfam Desc: ATPase family associated with various cellular activities(AAA)
  misc_feature (324)..(486): Pfam Id: Mg_chelatase Pfam Desc: Magnesium chelatase, subunit ChlI
  misc_feature (1)..(767): NCBI GI: 5725518 NCBI Desc: replication origin activator 2 [zea mays]
  misc_feature (1)..(767): NCBI GI: 5725520 NCBI Desc: replication origin activator 3 [zea mays]
  misc_feature (1)..(767): NCBI GI: 114049619 NCBI Desc: roa protein [zea mays]
  misc_feature (1)..(767): NCBI GI: 115464471 NCBI Desc: os05g0476200 [oryza sativa (japonica cultivar-group)]
  misc_feature (169)..(767): NCBI GI: 2497820 NCBI Desc: dna replication licensing factor mcm3 homolog (replication origin activator) (roa protein)
MDVNEEAMAAHKRAFLDFLDQDVGKGVYMQAVRDMVQNKRHRLIIGMDDLRNHNLDLARRVIRSPGEYMQPASDAVSEVARNLDPKFLKEGERVMVGFSGPFGFHRVTPRDLMSSFIGTMVCVEGIVTKCSLVRPKVVKSVHFCPVTGDFLSREYRDITSFVGLPTGSVYPTRDENGNLLVTEYGMCEYKDHQTLSMQEVPENSAPGQLPRTVDVIVEDDLVDCCKPGDRVSIVGVYKALPGKSKGSVSGVFRTVLIANNVSLLNKEANAPVYTREDLKRMKEISRRNDTFDVLGNSLAPSIYGHLWIKKAVVLLMLGGVEKNLKNGTHLRGDINMMMVGDPSVAKSQLLRAVMNIAPLAISTTGRGSSGVGLTAAVTSDQETGERRLEAGAMVLADRGVVCIDEFDKMNDQDRVAIHEVMEQQTVTIAKAGIHASLNARCSVIAAANPIYGTYDRSLTPTKNIGLPDSLLSRFDLLFIVLDQMDPEIDRQISEHVARMHRYCTDDGGARSLDKDGCAEEDDGDAIFVKYDRMLHGQDRRRGKKAKQDRLTVKFVKKYIHYAKNLIQPKLTDEASDHIATSYAELRDGSANAKSGGGTLPITARTLETIIRLSTAHAKMKLRHEVLKSDVEAALQVLNFAIYHKELTEMEEREQREMEMKQQADHDAGATGGTEDGHGSSGNDPMDVDVGNTSNDQNVPAERIEAFEAILGQHVLASHVDQMSIDEIEQTVNRESTAPYTRSQVEFILERMQDANRIMIRDGVVRII

SEQ ID NO: 4741 - DNA, 1527 bp, Sorghum bicolor
  misc_feature: Ceres ANNOT ID no. 6039971
  misc_feature: Encodes the peptide sequence at SEQ ID NO 4742
atgtcgaccagcaagggcggcgcagccaagggcggcggagggaagaagaaggaggtgaagaaggagacgaagcttgggatggcctataagaaggacgacaacttcggggagtggtactctgaggttgttgttaacagcgaaatgatcgagtactatgacatctctggttgttatatattgaggccatgggcgatggaaatctgggagctactgaaagaattctttgatgcagaaattaaaaagctgaagctcaaaccatattatttccctttgtttgttactgagaatgttctgcagaaggaaaaggaccacattgagggctttgcaccagaggtagcttgggttactaagtcagggaaatctgaactggaagcacctattgcaatacgccccacaagtgagactgtcatgtatccatacttctccaaatggataagaagccaccgagacttacccttgaggtgtaatcagtggtgtaatgttgttagatgggagtttagcaatcctactcctttcataaggagccgtgaatttctgtggcaagaggggcatactgcttttgcgactaaagaagaggcagatgaagaggttctccaaatattggaactgtacagaaggatatatgaagaatttctagcagttccagtgtccaaagggaggaaaagcgagatggaaaaatttgcaggtggactttataccaccagtgttgaggccttcattccaaacactggtcgtggcatacaaggcgcaacctcacattgtcttggtcaaaacttcgccaagatgtttgatattacttttgagaatgagaagggtgttagggaaatggtttggcaaaactcttgggcctacacaacccgctcgattggagtgatggtgatgacacatggtgatgacaaaggcttagtattaccaccaaaggtggcaccaatccaggtaatcgtgattccagtgccttataaggatgctgacacaactgccataaagggagcctgcgaatcagctgtttacacactcaatcaatctgggtttcgagcggatctggacacccgtgaaaattactctccaggttggaagtattctcactgggaaatgaaaggtgttccattgagaattgagattggtccaaaagatcttgcaaacaaacaggtgcgcattgtacgtcgggacaatggtgcaaaggttgacattcctgtgaccaatttggttgaagaggttaaagtgttactggatgggattcaaaaaaatctgttcaaaacagcccaagaaaagagagatgcctgtgttcaagtcatcaacacttgggatgatttcacgactgctctgaataacaaaaggttgatcttggctgcatggtgtgatgaggaggaagttgagaaagatgtgaaagctcggacaaaaggggaactcggagctgcaaaaacattgtgtactccatttgagcagccagaacttccagaaggtaccctgtgctttgcatctggaaagccagcgaagaagtggtcgttctggggccgcagctactga

SEQ ID NO: 4742 - protein, 508 aa, Sorghum bicolor
  misc_feature: Ceres ANNOT ID no. 6039971
  misc_feature (435)..(508): Pfam Id: ProRS-C_1 Pfam Desc: Prolyl-tRNA synthetase, C-terminal
  misc_feature (312)..(409): Pfam Id: HGTP_anticodon Pfam Desc: Anticodon binding domain
  misc_feature (67)..(243): Pfam Id: tRNA-synt_2b Pfam Desc: tRNA synthetase class II core domain (G, H, P, S and T)
  misc_feature (1)..(508): NCBI GI: 77554943 NCBI Desc: prolyl-trna synthetase [oryza sativa (japonica cultivar-group)]
  misc_feature (1)..(508): NCBI GI: 115488440 NCBI Desc: os12g0443700 [oryza sativa (japonica cultivar-group)]
  misc_feature (1)..(300): NCBI GI: 77554944 NCBI Desc: prolyl-trna synthetase [oryza sativa (japonica cultivar-group)]
  misc_feature (5)..(508): NCBI GI: 22136084 NCBI Desc: multifunctional aminoacyl-trna ligase-like protein [arabidopsis thaliana]
  misc_feature (23)..(508): NCBI GI: 92873428 NCBI Desc: trna synthetase, class ii (g, h, p and s) [medicago truncatula]
MSTSKGGAAKGGGGKKKEVKKETKLGMAYKKDDNFGEWYSEVVVNSEMIEYYDISGCYILRPWAMEIWELLKEFFDAEIKKLKLKPYYFPLFVTENVLQKEKDHIEGFAPEVAWVTKSGKSELEAPIAIRPTSETVMYPYFSKWIRSHRDLPLRCNQWCNVVRWEFSNPTPFIRSREFLWQEGHTAFATKEEADEEVLQILELYRRIYEEFLAVPVSKGRKSEMEKFAGGLYTTSVEAFIPNTGRGIQGATSHCLGQNFAKMFDITFENEKGVREMVWQNSWAYTTRSIGVMVMTHGDDKGLVLPPKVAPIQVIVIPVPYKDADTTAIKGACESAVYTLNQSGFRADLDTRENYSPGWKYSHWEMKGVPLRIEIGPKDLANKQVRIVRRDNGAKVDIPVTNLVEEVKVLLDGIQKNLFKTAQEKRDACVQVINTWDDFTTALNNKRLILAAWCDEEEVEKDVKARTKGELGAAKTLCTPFEQPELPEGTLCFASGKPAKKWSFWGRSY

SEQ ID NO: 4743 - DNA, 843 bp, Sorghum bicolor
  misc_feature: Ceres ANNOT ID no. 6039979
  misc_feature: Encodes the peptide sequence at SEQ ID NO 4744
atggcggcgaaagcgagcagcgcagccgcagccgcctccggcgcggcctacgaggagcagcgcaggaagagggtcctcgagaacctcaagcacctggaggatttgggtataaaggagatgtccaagagcctgctccaggcggcgcgcctgcagaaacagaacaaggccggcgtgcgcgcgagccccaaggcgaggaagaagttcgacgccaccgaggtgcggcgttcttcgagggccaagaccacggtttcctacaaggacgattttgctgaactagatacttttctgcgtggcataaggcgcggtggtggtaggaatacagagcatggaagagaatacacaggaagaatttcttcttatcaacagcaacaacgtgctttcagaaaagctgagaaacttcaagacagtctagaccctaataacccatcttttgttaagaccatggttcgatcacatgtgtccagctgcttttggcttggtcttcctacaagcttctgcaaagataatctgccttccaaagagtttaggatggtgttggaggatgaagagggtgttgaatttgatgctgtctatattggaaaccgaacaggtctaagtggtggatggaggggatttgcaatgcaccacaacctggaggaaggggattcattggtctttgaattggctgagcatgacagatttaagatttatataataaaagctattgatgatgatgtgaaagaggctgagcctgatgacaagaatgccagtgggggtaccaaggaagagcctgaccaggaagaatcacctgttgctgagcctccaaaaggtgccaaaaggagaaaactccgaggacgccggtag

SEQ ID NO: 4744 - protein, 280 aa, Sorghum bicolor
  misc_feature: Ceres ANNOT ID no. 6039979
  misc_feature (143)..(237): Pfam Id: B3 Pfam Desc: B3 DNA binding domain
  misc_feature (12)..(234): NCBI GI: 51091016 NCBI Desc: transcriptional factor b3-like [oryza sativa (japonica cultivar-group)]
  misc_feature (52)..(233): NCBI GI: 30694114 NCBI Desc: transcriptional factor b3 family protein [arabidopsis thaliana]
  misc_feature (126)..(269): NCBI GI: 115435514 NCBI Desc: os01g0234100 [oryza sativa (japonica cultivar-group)]
  misc_feature (164)..(229): NCBI GI: 92884626 NCBI Desc: transcriptional factor b3 [medicago truncatula]
  misc_feature (45)..(239): NCBI GI: 20160548 NCBI Desc: p0022f10.13 [oryza sativa (japonica cultivar-group)]
  misc_feature: The sequence is a functional homolog of SEQ ID NO. 467 in the 11/188,298 US application
MAAKASSAAAAASGAAYEEQRRKRVLENLKHLEDLGIKEMSKSLLQAARLQKQNKAGVRASPKARKKFDATEVRRSSRAKTTVSYKDDFAELDTFLRGIRRGGGRNTEHGREYTGRISSYQQQQRAFRKAEKLQDSLDPNNPSFVKTMVRSHVSSCFWLGLPTSFCKDNLPSKEFRMVLEDEEGVEFDAVYIGNRTGLSGGWRGFAMHHNLEEGDSLVFELAEHDRFKIYIIKAIDDDVKEAEPDDKNASGGTKEEPDQEESPVAEPPKGAKRRKLRGRR

SEQ ID NO: 4745 - DNA, 858 bp, Sorghum bicolor
  misc_feature: Ceres ANNOT ID no. 6039982
  misc_feature: Encodes the peptide sequence at SEQ ID NO 4746
atggacggcctgcacggtacggacgcctgcttctcccccgcgagggccatctcgccgcaggtgaggcccccggccggcccgccggacgtaggcagtcagtacctggcggagctgctgcaggagcaccagaagctggggcccttcatgcaggtgctcccaatctgcagcaggctgctgaatcaagaaataatgcgggtgtcgaatatccggcgccaacatggtgctgctggggactttgacaggtttccacccgcaagccccaaccagatgcatccgtcaccccccatgccaaacttttgtggaaacggttttagtccttggaatgggatgcaatcagagagagtaggtgttccacaaggagctatgggttggcaaggacccccacaaagccctggttcttacattgtcaagaagattttgcggttggaagtaccgacagaaacataccctaatttcaattttatcggccgtcttcttggaccaagaggaaactctttaaagaggattgaagcctctacaggctgtcgtgttttcatcagagggaagggctcaattaaagattctggcaaggaggaacaactcaagggaagaactggctatgaacacttgagcgaacccctccatatcttgattgaagctgagttacccgctaatgtgattgatgcaagacttgcaaaggcccaggagatcctcgaagagttgttgaaaccagtggatgaatcacaagactactacaagagacagcaactccgagaacttgcaatgttgaattcgccactccgagaggagagtccacatccaggtggtgctcctcctagtcccttcagtaatggcggcatgaaaagagtgaaacaatga

SEQ ID NO: 4746 - protein, 285 aa, Sorghum bicolor
  misc_feature: Ceres ANNOT ID no. 6039982
  misc_feature (1)..(285): NCBI GI: 115464523 NCBI Desc: os05g0481500 [oryza sativa (japonica cultivar-group)]
  misc_feature (3)..(284): NCBI GI: 24060154 NCBI Desc: kh domain-like protein [oryza sativa (japonica cultivar-group)]
  misc_feature (12)..(238): NCBI GI: 92867398 NCBI Desc: facilitated glucose transporter; kh, type 1 [medicago truncatula]
  misc_feature (18)..(284): NCBI GI: 19310523 NCBI Desc: at1g09660/f21m12_5 [arabidopsis thaliana]
  misc_feature (12)..(284): NCBI GI: 92893883 NCBI Desc: kh [medicago truncatula]
MDGLHGTDACFSPARAISPQVRPPAGPPDVGSQYLAELLQEHQKLGPFMQVLPICSRLLNQEIMRVSNIRRQHGAAGDFDRFPPASPNQMHPSPPMPNFCGNGFSPWNGMQSERVGVPQGAMGWQGPPQSPGSYIVKKILRLEVPTETYPNFNFIGRLLGPRGNSLKRIEASTGCRVFIRGKGSIKDSGKEEQLKGRTGYEHLSEPLHILIEAELPANVIDARLAKAQEILEELLKPVDESQDYYKRQQLRELAMLNSPLREESPHPGGAPPSPFSNGGMKRVKQ

SEQ ID NO: 4747 - DNA, 1482 bp, Sorghum bicolor
  misc_feature: Ceres ANNOT ID no. 6039997
  misc_feature: Encodes the peptide sequence at SEQ ID NO 4748
atgcaagattctctaagcttgatgcagtttcatgatccgtacctctacagcggcagcgctgggagcgccaacctgccactgtcacaccctttctcgcctcatcatcaccaaggttttgtcgataattgcactggcaaggacgtggcagagttcgtcgacccggcgacgacgacggcggcggaggtaagcagcgacgagcaggaattggcagtaagcaaggaggtctccgagggaggaggtggtggcgcggtggtggtggaggtggaggagcgaaacgacgccacgacggccaggggcggcgagttggaggctcacggcgtccggatgatcgcgctgctcatggagagcgcggtggccgtgtcggtgggcaacctcgcggacgccaacagcatgctcctggagctggcgcagatggcgtccccgtacgcgtcgtcctgcggggagcgtctcgtggcctacttcaccaaggccctggcggcgcggctgatgagctcgtgggtcggcatctgcgctccgctggcgccgccgtgcgccgccgtccacgccgcgttcagggccttctacaacgtctcgccgttcgcgaggttcgcctacctggcgtgcaaccaggccatcctggaggcgttccacggcaagcgcctggtccacattgtggacctcgacgtggttccgggcggcgcgctgcagtggctctcgctcctgcccgcgctggcggcgcggccgggcggcccgccggtgctccgcgtcaccgggttcggcatgtcgcggtcggcgcttcacgacacgggcaaccagctcgccgggctcgcgagcaagctgaacatgccgttcgagttctacgccatcgcgaagcggcccggggacgtcgtcgtcggcgccgcggtggcggacatgcccagcaggagaccaggggaggccctcgccgtgcactggctgcggcacgctctgtacgacgcggctggggacgacggcgccacgatgcagctggtgcagtggctggagcccaaggtgctgacgctggtggagcaagagcgagcaggagcggcgcccggagacgtcggtggcggcggcggcgaccacggccacttcctggaccgattcgtctccgcgctgcaccactactcggcgctgttcgactcgctgggcgcgtcgcggccgagcgagttggacgcgagcaggcacctggtggagcaaggcgtgctcggcagagagatcggcaacgtgctggcggtcggcggcccgtcgcggagcgggcggggcaagttcggctgctggcaggaggagctcgcccggcacgggttcctacgagccggcggtgtggggcgcgcgcagctggtggccggcgcgtgcccggcgggactaggctacacggtggcggacgaccaccacggcacggtgcggctggggtggaagggcaccccgctgtatgcggtctccacgtgggcatggtgcccctcgcctcacggacaggcacaccgttaa

SEQ ID NO: 4748 - protein, 493 aa, Sorghum bicolor
  misc_feature: Ceres ANNOT ID no. 6039997
  misc_feature (84)..(394): Pfam Id: GRAS Pfam Desc: GRAS family transcription factor
  misc_feature (37)..(481): NCBI GI: 115472849 NCBI Desc: os07g0567700 [oryza sativa (japonica cultivar-group)]
  misc_feature (83)..(481): NCBI GI: 10178637 NCBI Desc: scarecrow [zea mays]
  misc_feature (103)..(481): NCBI GI: 124360295 NCBI Desc: flagellar basal body rod protein; gras transcription factor [medicago truncatula]
  misc_feature (104)..(462): NCBI GI: 119935906 NCBI Desc: at5g41920 [arabidopsis thaliana]
  misc_feature (103)..(481): NCBI GI: 13365610 NCBI Desc: scarecrow [pisum sativum]
  misc_feature: The sequence is a functional homolog of SEQ ID NO 1327 in the 10/374,780US patent application
  misc_feature: The sequence is a functional homolog of SEQ ID NO 431 in the 11/479,226US patent application
  misc_feature: Useful for making plants with modulated growth and phenotype characteristics
  misc_feature: The sequence is a functional homolog of SEQ ID NO 1327 in the 20060162006 US patent application
  misc_feature: The sequence is a functional homolog of SEQ ID NO 431 in the 20070022495 US patent application
MQDSLSLMQFHDPYLYSGSAGSANLPLSHPFSPHHHQGFVDNCTGKDVAEFVDPATTTAAEVSSDEQELAVSKEVSEGGGGGAVVVEVEERNDATTARGGELEAHGVRMIALLMESAVAVSVGNLADANSMLLELAQMASPYASSCGERLVAYFTKALAARLMSSWVGICAPLAPPCAAVHAAFRAFYNVSPFARFAYLACNQAILEAFHGKRLVHIVDLDVVPGGALQWLSLLPALAARPGGPPVLRVTGFGMSRSALHDTGNQLAGLASKLNMPFEFYAIAKRPGDVVVGAAVADMPSRRPGEALAVHWLRHALYDAAGDDGATMQLVQWLEPKVLTLVEQERAGAAPGDVGGGGGDHGHFLDRFVSALHHYSALFDSLGASRPSELDASRHLVEQGVLGREIGNVLAVGGPSRSGRGKFGCWQEELARHGFLRAGGVGRAQLVAGACPAGLGYTVADDHHGTVRLGWKGTPLYAVSTWAWCPSPHGQAHR

SEQ ID NO: 4749 - DNA, 1914 bp, Sorghum bicolor
  misc_feature: Ceres ANNOT ID no. 6040004
  misc_feature: Encodes the peptide sequence at SEQ ID NO 4750
atgtcaggaccgctgaatcattgctgttcaagctattctaccttttgcatcctttcaaacattagtggggccacctcaaaccttagagattcaacaggaaggccatttacatcatccttttccggtcaatctggatcacttccgggttttcatcactcaggctcacacaacattcatggaaatcttaatcttgcaaatatctctggatcattagcaccaagaaataattcaatgacgggcattccatctccaggggttcaacaacccggtggtggtatttccagtggccggttcccttcaaataatcttcaagcttccatgtctcagattcctcatgggcattctgggatcagcaacagaggaggtatgaatgttgggggaaatcctggatttagtagtagcatgaatgctattggtggttcaatacaaggtttatcctcaaacttggctaatgtgggtaaccgcaattctgctcctgggttggcagcttctccagtcttagggaatttaggtccacgaataacaaatgctgggaatattatgggtgggagcaatattgggagaagtataagctctggaggactgtctatgcctagtattgcatctcgcatgaatttaagtggcaactctggaagtggggctatcaacattcaaggatccaaccgtatgggtagtatgcttcaacaagcatccccacagtttatgaacttgcttggaagttcttacccaacacctggagggtcactatctcagaatcaagtacagtcaggaaacaactctttaggatcttctggaatgctatatgatggaagctcaggtgacaatgctccatttgatattaatgacttccctcagttaactggacggcctaattcggctggaggtggtcaaggacaatatggatcactgagaaagcatggagtaagtgtcaatgccattgtgcaacaaaatcaggaattcagcattcagaatgaagattttccagctttaccaggaaataaaggtagttcctcagattatcctatggatatccatcacaaggaccaccttcatgagaatgtaaatattatgcaagcacaacattatcctatggctcgaccatctggctttaacttgggaagcagctatccaccccgtcaacatcagcagagtgctaattcagttcaaaatgctgggctggaaactattggactaagaccatcaaattctccaagtccatcgactaatgcgggggtttatgagcaattcatgcagaagtaccatcaaccacagactcaaaattcacttaggttgcaggcatcttcaggtcctcaacagtacaaggatcagagccaaaaatccgttcagggaacacaggctgcgccagatccatatagcttacttggattgttgagtttaataagaatgaaagagcctggacctacagctcttgctttggggattgatttgacatcgttggggttgaatttgaactcccaagataatctttacaagacatttggctctccgtggtcaaatgagccagctataggagaacctgattatcagatccccgcttgtttctttgcagagccaccaccagcactgcaaccattacattttcagaagtttcaccccttgacactattctacatcttttacagcatgcctaaggatgtcgctcagttatatgctgctaatgaactatacaataaagggtggttttaccacaaagactaccgtgtgtggctcacaagagctcctaattctgcacctctcgtgaaaactccacttcatgaacgagggtcctacatttgttttgatccaagcatctgggatactgtccataaggacaactttgttctccattacgaagcagtggagaagagacctgtccttccttctgctggccaaaatattaggcgagaattataa

SEQ ID NO: 4750 - protein, 637 aa, Sorghum bicolor
  misc_feature: Ceres ANNOT ID no. 6040004
  misc_feature (482)..(621): Pfam Id: NOT2_3_5 Pfam Desc: NOT2 / NOT3 / NOT5 family
  misc_feature (19)..(626): NCBI GI: 145359458 NCBI Desc: vip2 (vire2 interacting protein2); transcription regulator [arabidopsis thaliana]
  misc_feature (227)..(634): NCBI GI: 115455179 NCBI Desc: os03g0736000 [oryza sativa (japonica cultivar-group)]
  misc_feature (67)..(626): NCBI GI: 12006939 NCBI Desc: vip2 protein [arabidopsis thaliana]
  misc_feature (19)..(425): NCBI GI: 92897645 NCBI Desc: not2/not3/not5 [medicago truncatula]
  misc_feature (96)..(610): NCBI GI: 8439898 NCBI Desc: f24b9.20 [arabidopsis thaliana]
MSGPLNHCCSSYSTFCILSNISGATSNLRDSTGRPFTSSFSGQSGSLPGFHHSGSHNIHGNLNLANISGSLAPRNNSMTGIPSPGVQQPGGGISSGRFPSNNLQASMSQIPHGHSGISNRGGMNVGGNPGFSSSMNAIGGSIQGLSSNLANVGNRNSAPGLAASPVLGNLGPRITNAGNIMGGSNIGRSISSGGLSMPSIASRMNLSGNSGSGAINIQGSNRMGSMLQQASPQFMNLLGSSYPTPGGSLSQNQVQSGNNSLGSSGMLYDGSSGDNAPFDINDFPQLTGRPNSAGGGQGQYGSLRKHGVSVNAIVQQNQEFSIQNEDFPALPGNKGSSSDYPMDIHHKDHLHENVNIMQAQHYPMARPSGFNLGSSYPPRQHQQSANSVQNAGLETIGLRPSNSPSPSTNAGVYEQFMQKYHQPQTQNSLRLQASSGPQQYKDQSQKSVQGTQAAPDPYSLLGLLSLIRMKEPGPTALALGIDLTSLGLNLNSQDNLYKTFGSPWSNEPAIGEPDYQIPACFFAEPPPALQPLHFQKFHPLTLFYIFYSMPKDVAQLYAANELYNKGWFYHKDYRVWLTRAPNSAPLVKTPLHERGSYICFDPSIWDTVHKDNFVLHYEAVEKRPVLPSAGQNIRREL

SEQ ID NO: 4751 - DNA, 1182 bp, Sorghum bicolor
  misc_feature: Ceres ANNOT ID no. 6040011
  misc_feature: Encodes the peptide sequence at SEQ ID NO 4752
atggagcagcatctgtttttgcgtggaggaaatgcccaaggagattctgggctggttctctcaactgacgctaaaccaaggctgaaatggacacctgagttacatcagcgatttgtagatgcagtcaatcaattaggtggagcagagaaagctactccaaaaacagtcatgaggctcatgggaattccaggactcaccttgtaccatttgaaaagccatctccagaaatacaggcttagcaagaacctccaagctcaagcaaatgtcagtacatcaaagaatgccataggatgtacatccgttgctgataggattcctggaacaagcgcagctacaatgagcagtacaaatgtcgttccacaggcagagaagactattcaaattggtgaagcacttcagatgcaaattgaggttcagaggcagctaaatgaacaacttgaggtgcaaaggcatctacaactacgaattgaagcccaagggaaatacctgcaggcagttttggagcaggcacaagagacacttggaaaacagaatttgggtcctgcaaacctggaagatgcaaaaataaaaatatcagagttagtttcacaagtatcaactgaatgcttcagtaatgcgattacagatgtaaaaggaagttcaagtgtgcatagattagagcccagacaaatccagtttgttgaaagttcaacaaatagttatttgtctgtggctgaaggattcatcaaggagcacagactacagcaccatggagtactaaaagcatatgatgatagttcattattttgcagaaaaagatctcatgaacatgagacccagtttgcccttaacagaagcctaagtgagcgtaggatggctcatttgcagaatgaggaaggatacagtaaagcagagtttgggtatgaaagtgacacagaaatggcacatgagtatgctgaacctcaaaagaatggtggaggtagcaccaccagttcggcgtcaggaagcaaagtagatgcagagaagctatatctggaagaacaaaactgcgcaagacaggcagttgaataccccagagaaagcaagctagtagattttgagcatccgtgctctgggaagaaacttgatctgaacacccacaatgtcgatgacactgatcaagcttacagacattttgacttgaatggcttcagctggagctga

SEQ ID NO: 4752 - protein, 393 aa, Sorghum bicolor
  misc_feature: Ceres ANNOT ID no. 6040011
  misc_feature (27)..(78): Pfam Id: Myb_DNA-binding Pfam Desc: Myb-like DNA-binding domain
  misc_feature (2)..(260): NCBI GI: 6223653 NCBI Desc: transfactor-like [arabidopsis thaliana]
  misc_feature (2)..(260): NCBI GI: 42572243 NCBI Desc: myb family transcription factor [arabidopsis thaliana]
  misc_feature (2)..(393): NCBI GI: 9758906 NCBI Desc: transfactor-like protein [arabidopsis thaliana]
  misc_feature (2)..(393): NCBI GI: 14596181 NCBI Desc: transfactor-like protein [arabidopsis thaliana]
  misc_feature (2)..(393): NCBI GI: 28059694 NCBI Desc: transfactor-like protein [arabidopsis thaliana]
  misc_feature: The sequence is a functional homolog of SEQ ID NO 1233 in the 10/666,642US patent application
  misc_feature: The sequence is a functional homolog of SEQ ID NO 1338 in the 10/374,780US patent application
  misc_feature: The sequence is a functional homolog of SEQ ID NO 1339 in the 10/374,780US patent application
  misc_feature: The sequence is a functional homolog of SEQ ID NO 1857 in the 10/374,780US patent application
  misc_feature: The sequence is a functional homolog of SEQ ID NO 1990 in the 11/479,226US patent application
  misc_feature: The sequence is a functional homolog of SEQ ID NO 1992 in the 11/479,226US patent application
  misc_feature: The sequence is a functional homolog of SEQ ID NO 1999 in the 11/479,226US patent application
  misc_feature: The sequence is a functional homolog of SEQ ID NO 2000 in the 11/479,226US patent application
  misc_feature: The sequence is a functional homolog of SEQ ID NO 935 in the 10/666,642US patent application
  misc_feature: Useful for making plants with modulated growth and phenotype characteristics
  misc_feature: The sequence is a functional homolog of SEQ ID NO 1338 in the 20060162006 US patent application
  misc_feature: The sequence is a functional homolog of SEQ ID NO 1339 in the 20060162006 US patent application
  misc_feature: The sequence is a functional homolog of SEQ ID NO 1857 in the 20060162006 US patent application
  misc_feature: The sequence is a functional homolog of SEQ ID NO 1990 in the 20070022495 US patent application
  misc_feature: The sequence is a functional homolog of SEQ ID NO 1992 in the 20070022495 US patent application
  misc_feature: The sequence is a functional homolog of SEQ ID NO 1999 in the 20070022495 US patent application
  misc_feature: The sequence is a functional homolog of SEQ ID NO 2000 in the 20070022495 US patent application
  misc_feature: The sequence is a functional homolog of SEQ ID NO 1233 in the 20070033671 US patent application
  misc_feature: The sequence is a functional homolog of SEQ ID NO 935 in the 20070033671 US patent application
  misc_feature: Useful for making plants with modulated flowering time
  misc_feature: Functional homolog of the protein sequence given in SEQ ID NO 13579
  misc_feature: The sequence is a functional homolog of SEQ ID NO 1062 in the 10/225,066 US patent application
  misc_feature: The sequence is a functional homolog of SEQ ID NO 2788 in the 10/374,780 US patent application
  misc_feature: The sequence is a functional homolog of SEQ ID NO 1589 in the 11/479,226 US patent application
  misc_feature: The sequence is a functional homolog of SEQ ID NO 762 in the 10/412,699 US patent application
  misc_feature: The sequence is a functional homolog of SEQ ID NO 190 in the 10/225,066 US patent application
  misc_feature: The sequence is a functional homolog of SEQ ID NO 2866 in the 10/374,780 US patent application
  misc_feature: Useful for making plants with altered lignin content
  misc_feature: Useful for making plants with altered terpenoid content
  misc_feature: Functional homolog of the protein sequence given in SEQ ID NO 12902
  misc_feature: The sequence is a functional homolog of SEQ ID NO 1995 in the 11/479,226 US patent application
  misc_feature: The sequence is a functional homolog of SEQ ID NO 1996 in the 11/479,226 US patent application
  misc_feature: The sequence is a functional homolog of SEQ ID NO 1997 in the 11/479,226 US patent application
  misc_feature: The sequence is a functional homolog of SEQ ID NO 1998 in the 11/479,226 US patent application
  misc_feature: The sequence is a functional homolog of SEQ ID NO 2001 in the 11/479,226 US patent application
  misc_feature: The sequence is a functional homolog of SEQ ID NO 2000 in the 11/479,226 US patent application
  misc_feature: The sequence is a functional homolog of SEQ ID NO 1999 in the 11/479,226 US patent application
MEQHLFLRGGNAQGDSGLVLSTDAKPRLKWTPELHQRFVDAVNQLGGAEKATPKTVMRLMGIPGLTLYHLKSHLQKYRLSKNLQAQANVSTSKNAIGCTSVADRIPGTSAATMSSTNVVPQAEKTIQIGEALQMQIEVQRQLNEQLEVQRHLQLRIEAQGKYLQAVLEQAQETLGKQNLGPANLEDAKIKISELVSQVSTECFSNAITDVKGSSSVHRLEPRQIQFVESSTNSYLSVAEGFIKEHRLQHHGVLKAYDDSSLFCRKRSHEHETQFALNRSLSERRMAHLQNEEGYSKAEFGYESDTEMAHEYAEPQKNGGGSTTSSASGSKVDAEKLYLEEQNCARQAVEYPRESKLVDFEHPCSGKKLDLNTHNVDDTDQAYRHFDLNGFSWS

SEQ ID NO: 4753 - DNA, 840 bp, Sorghum bicolor
  misc_feature: Ceres ANNOT ID no. 6040014
  misc_feature: Encodes the peptide sequence at SEQ ID NO 4754
  misc_feature: Up-regulated in shoot tissues in response to methyl jasmonate treatment
  misc_feature: Up-regulated in root tissues in response to methyl jasmonate treatment
atggagttcctgcacgggcagaggctggagaccacggtggccatcgcggtggccgtcgtcgccgtcgccgcgggggccgcctacctcttcctccgcagcaggaagaccaggggctgcctggaccccgagaacttcaaggagtttaaacttgttgagaagaggcaactgagtcataatgttgccaagttcaagtttgcactcccgacacctacttctgcattgggtcttccaatcggacaacatataagctgcagaggacaggatgctgctggtgaggaagtgatcaagccttatactccaactactctggactctgatcttggatcctttgagcttgttataaagatgtatccccaaggaagaatgtctcatcatttccgtgagatgaaagttggtgattatatgtctgtgaagggacctaagggtcgtttcaagtacctacctggacaagtgagagcatttggaatgatagctggaggatcaggcattactccaatgttccaagtcacaagggcaattcttgagaacccaaaagacaatacgaaagtacacttaatctatgcaaatgtcacatatgatgatattcttctgaaggaagaacttgacagtatggccaaaaactatcccgatcgcttcaagatctactatgtcttgaatcagcctcccgaagtctgggacggtggtgtcgggttcgtctcaaaggaaatgatccaaactcattgtccagtgcccgctgccgacattcaggtattgcgatgtggccctcctcccatgaacaaagccatggctgcacacctggacgatctcggttacacgaaggagatgcagttccagttctaa

SEQ ID NO: 4754 - protein, 279 aa, Sorghum bicolor
  misc_feature: Ceres ANNOT ID no. 6040014
  misc_feature (47)..(146): Pfam Id: FAD_binding_6 Pfam Desc: Oxidoreductase FAD-binding domain
  misc_feature (155)..(264): Pfam Id: NAD_binding_1 Pfam Desc: Oxidoreductase NAD-binding domain
  misc_feature (1)..(279): NCBI GI: 17221690 NCBI Desc: cytochrome b5 reductase isoform ii [zea mays]
  misc_feature (1)..(279): NCBI GI: 4336205 NCBI Desc: cytochrome b5 reductase [zea mays]
  misc_feature (1)..(279): NCBI GI: 55979115 NCBI Desc: nadh:cytochrome b5 reductase [vernicia fordii]
  misc_feature (2)..(279): NCBI GI: 21553853 NCBI Desc: nadh-cytochrome b5 reductase [arabidopsis thaliana]
  misc_feature (1)..(279): NCBI GI: 55979113 NCBI Desc: nadh:cytochrome b5 reductase [vernicia fordii]
  misc_feature: Up-regulated in shoot tissues in response to methyl jasmonate treatment
  misc_feature: Up-regulated in root tissues in response to methyl jasmonate treatment
MEFLHGQRLETTVAIAVAVVAVAAGAAYLFLRSRKTRGCLDPENFKEFKLVEKRQLSHNVAKFKFALPTPTSALGLPIGQHISCRGQDAAGEEVIKPYTPTTLDSDLGSFELVIKMYPQGRMSHHFREMKVGDYMSVKGPKGRFKYLPGQVRAFGMIAGGSGITPMFQVTRAILENPKDNTKVHLIYANVTYDDILLKEELDSMAKNYPDRFKIYYVLNQPPEVWDGGVGFVSKEMIQTHCPVPAADIQVLRCGPPPMNKAMAAHLDDLGYTKEMQFQF

SEQ ID NO: 4755 - DNA, 1629 bp, Sorghum bicolor
  misc_feature: Ceres ANNOT ID no. 6040016
  misc_feature: Encodes the peptide sequence at SEQ ID NO 4756
atgtctttttcagatgacggaaagatgaagggctgtcagccaaacctttttcggacaaaggataagaaagtcgccaagaggacagaccgtgcaggctgctccacatctaagagtggatcaagcaactcaaagtcaccatcttcatcccccttccggaaactttcagaagttaggagcatacgtctcagccattttctaagtcactcttcaaatgctacaaaatatgaacatgttaggatatttgtctccacatggaacgttggaggaaaagcgcctaccgccgagttgaaactggatgactttcttcctgctgatgaccattcagatatttatgttttaggttttcaggaaattgtgcctctcaatgctggtaatgtccttgtgatagaagataacgaaccagctgcaagatggcttgctcttataaaccgtgcactaaatcaaccagttgacactgatgctgatatatttcagcacaaaccatcgccctccctggattcaacctcatcccagtcaacaccaggccttgatggttcgttctccaaccgttcaagaacagccagtggttctgtaatcttccaaaagtccttgaaatccatcaggaaatcttacatgccatcccagagaaaactgctcaaattctgcaattgcccagtggaaatggccaagaaatcctacaaagatgcttgctttcgatgcccacggccacaagcatatgccaatgaaatggattcttcagaagaggatgaattggatgacaaattgaatgatatttttggccttaatgatgatgatgttacttcgtctgcttctgcctccagggaccagctaaagtataacctcatatcttgcaaacaaatggttggtatttttgtcacagtctgggcaaagaaagaactagtgcagcatataggacatgtgagaacatcctgtgttggtcgcggaataatgggatatcttggaaacaagggatgtatatcagtaagcatgacattgtaccagacaagcttttgtttcatctgcagccatttggcttcaggtgaaaaggaaggcgatgaattgaggcggaatttagatgtgttagagattctaaggctcacacaatttcgaaggatttgcagaagagctgggcgaagaatccctgagaaaattctcgaccatgagcgggtgatatggttaggagacctgaactaccgaatttccttgagctatgaagataccaaaaaacttctgactgaaaataactgggatgccctttttgaaaaggatcagctcaatattcagcgtgcgtctggaagtgtgttcaaggggtggagtgaagagaagatatattttgctcccacatacaagtactcttgcaactcagattcttatgctggagagactgccacatcaaagaaaaagaggagaaccccagcctggtgtgatagaatactatggcatggagatggtattgcacagttatcgtacttccggggggagtctcaattctctgaccatcgtcctgtttgtggaacatttattgttgatgctgaaaggctagatggcaaatcaaagaggcgctcatcaaacactaacattagaatcggtgctgaagagctgttaccgacaagcaacaagcataactaa

SEQ ID NO: 4756 - protein, 542 aa, Sorghum bicolor
  misc_feature: Ceres ANNOT ID no. 6040016
  misc_feature (80)..(507): Pfam Id: Exo_endo_phos Pfam Desc: Endonuclease/Exonuclease/phosphatase family
  misc_feature (164)..(521): NCBI GI: 145334295 NCBI Desc: endonuclease/exonuclease/phosphatase family protein [arabidopsis thaliana]
  misc_feature (164)..(521): NCBI GI: 30680735 NCBI Desc: endonuclease/exonuclease/phosphatase family protein [arabidopsis thaliana]
  misc_feature (52)..(536): NCBI GI: 53793645 NCBI Desc: at5g65090 [arabidopsis thaliana]
  misc_feature (52)..(536): NCBI GI: 10178171 NCBI Desc: inositol-1, 4, 5-trisphosphate 5-phosphatase-like protein [arabidopsis thaliana]
  misc_feature (153)..(538): NCBI GI: 15220522 NCBI Desc: endonuclease/exonuclease/phosphatase family protein [arabidopsis thaliana]
MSFSDDGKMKGCQPNLFRTKDKKVAKRTDRAGCSTSKSGSSNSKSPSSSPFRKLSEVRSIRLSHFLSHSSNATKYEHVRIFVSTWNVGGKAPTAELKLDDFLPADDHSDIYVLGFQEIVPLNAGNVLVIEDNEPAARWLALINRALNQPVDTDADIFQHKPSPSLDSTSSQSTPGLDGSFSNRSRTASGSVIFQKSLKSIRKSYMPSQRKLLKFCNCPVEMAKKSYKDACFRCPRPQAYANEMDSSEEDELDDKLNDIFGLNDDDVTSSASASRDQLKYNLISCKQMVGIFVTVWAKKELVQHIGHVRTSCVGRGIMGYLGNKGCISVSMTLYQTSFCFICSHLASGEKEGDELRRNLDVLEILRLTQFRRICRRAGRRIPEKILDHERVIWLGDLNYRISLSYEDTKKLLTENNWDALFEKDQLNIQRASGSVFKGWSEEKIYFAPTYKYSCNSDSYAGETATSKKKRRTPAWCDRILWHGDGIAQLSYFRGESQFSDHRPVCGTFIVDAERLDGKSKRRSSNTNIRIGAEELLPTSNKHN

SEQ ID NO: 4757 - DNA, 927 bp, Sorghum bicolor
  misc_feature: Ceres ANNOT ID no. 6040017
  misc_feature: Encodes the peptide sequence at SEQ ID NO 4758
atgaagagttctccatgggcgggggcccgccgtcctgccgtcgtgcagctcctcctcttcctcgcccacctcgtcggccgcggcggcgctgccgggggaggcagcaagggcagctcggtgtacccggcggccgtcgtctacccgcatcactcccgccagatctcctggaaacccagggtgttcctgtaccagcacttcctcagcgacgacgaggccaaccacctcatctccctcgcgagagcagagctcaagaggtcggcggtcgctgataatatgtccggcaagagcacacttagcgacgtccgcaccagctccggcacctttctcaggaagggccaggatccaattgttgagggtatagaggacaaaattgctgcatggacattccttccaaaagagaatggtgaagatatccaagtcctaagatataaacatggggagaagtatgaaccgcactatgattacttcactgacaatgttaacactattcgtggtggtcatcgctatgctactgttcttttgtacttaactgatgtagcagaaggaggggaaacagttttccccttggctgaggaggtcgatgatgctaaagatgcaaccttctcagaatgtgctcagaaaggcattgcagtgaaaccacgaaaaggagatgccctccttttcttcaaccttaagccagatggcaccaccgatccagtgagcctccatggtggttgtgcagtcataaggggcgagaaatggtcagctacgaagtggatccgtgtggcctcgttcgataaggtccattacccacaaggcaactgcaccgacgagaacgagagctgctcgaaatgggcggccctaggggagtgcataaagaacccagagtacatggtgggaaccacagcattgcccggttactgtcgaaggagctgcaatgtgtgctag

SEQ ID NO: 4758 - protein, 308 aa, Sorghum bicolor
  misc_feature: Ceres ANNOT ID no. 6040017
  misc_feature (134)..(255): Pfam Id: 2OG-FeII_Oxy Pfam Desc: 2OG-Fe(II) oxygenase superfamily
  misc_feature (268)..(308): Pfam Id: ShK Pfam Desc: ShK domain-like
  misc_feature (35)..(308): NCBI GI: 21593296 NCBI Desc: prolyl 4-hydroxylase alpha subunit-like protein [arabidopsis thaliana]
  misc_feature (42)..(308): NCBI GI: 21618073 NCBI Desc: prolyl 4-hydroxylase alpha subunit-like protein [arabidopsis thaliana]
  misc_feature (42)..(308): NCBI GI: 18397528 NCBI Desc: oxidoreductase, 2og-fe(ii) oxygenase family protein [arabidopsis thaliana]
  misc_feature (32)..(308): NCBI GI: 114796723 NCBI Desc: prolyl 4-hydroxylase [dianthus caryophyllus]
  misc_feature (13)..(308): NCBI GI: 34393269 NCBI Desc: prolyl 4-hydroxylase alpha-1 subunit precursor-like protein [oryza sativa (japonica cultivar-group)]
  misc_feature: The sequence is a functional homolog of SEQ ID NO. 333 in the 11/188,298 US application
MKSSPWAGARRPAVVQLLLFLAHLVGRGGAAGGGSKGSSVYPAAVVYPHHSRQISWKPRVFLYQHFLSDDEANHLISLARAELKRSAVADNMSGKSTLSDVRTSSGTFLRKGQDPIVEGIEDKIAAWTFLPKENGEDIQVLRYKHGEKYEPHYDYFTDNVNTIRGGHRYATVLLYLTDVAEGGETVFPLAEEVDDAKDATFSECAQKGIAVKPRKGDALLFFNLKPDGTTDPVSLHGGCAVIRGEKWSATKWIRVASFDKVHYPQGNCTDENESCSKWAALGECIKNPEYMVGTTALPGYCRRSCNVC

SEQ ID NO: 4759 - DNA, 603 bp, Sorghum bicolor
  misc_feature: Ceres ANNOT ID no. 6040027
  misc_feature: Encodes the peptide sequence at SEQ ID NO 4760
atggctcgaaccaagcaccaggccgtgaggaagctgccgcagaagcccaagaagaagctccagttcgagcgcgcaggtggggcgagtacgtcggcgaccccggtgagtgcgtgcgtgcgtgcgggaattggttttagccctccttttgcggtttcgccttttgttgggctggtctcacttgcttgcaatctgtttgatggaatgcaggagaggaggaatgctgggaccgggggaggagccgcggctcgcgttgcacgggggcgtgtggagaagaagcatcgctggcgggcagggactgtagcgctgcgggagatcaggaagtaccagaagtccactgagccgctcatcccctttgcgcccttcgtcaaagagttaactgcattcataacagactggaggatagggcgctacacccctgaagccctccttgcgctgcaagaggcagcagaattccacttgatagaactgtttgaagtggcgaatctgtgtgccatccatgccaagcgcgtaacagtcagtaagttatcactgaatgaactccttttcctctgtactattacgcctaatggagatttggatatgataaatctagatgttatttaa

SEQ ID NO: 4760 - protein, 200 aa, Sorghum bicolor
  misc_feature: Ceres ANNOT ID no. 6040027
  misc_feature (111)..(184): Pfam Id: Histone Pfam Desc: Core histone H2A/H2B/H3/H4
  misc_feature (72)..(172): NCBI GI: 21668094 NCBI Desc: centromeric histone h3-like protein [zea mays]
  misc_feature (71)..(172): NCBI GI: 50511368 NCBI Desc: histone h3 [oryza sativa (japonica cultivar-group)]
  misc_feature (71)..(174): NCBI GI: 134152529 NCBI Desc: centromeric histone h3-like protein-1 [eruca sativa]
  misc_feature (67)..(172): NCBI GI: 122074 NCBI Desc: histone h3.2
  misc_feature (84)..(172): NCBI GI: 1814238 NCBI Desc: developmental-specific histone h3 [euplotes crassus]
MARTKHQAVRKLPQKPKKKLQFERAGGASTSATPVSACVRAGIGFSPPFAVSPFVGLVSLACNLFDGMQERRNAGTGGGAAARVARGRVEKKHRWRAGTVALREIRKYQKSTEPLIPFAPFVKELTAFITDWRIGRYTPEALLALQEAAEFHLIELFEVANLCAIHAKRVTVSKLSLNELLFLCTITPNGDLDMINLDVI

SEQ ID NO: 4761 - DNA, 1065 bp, Sorghum bicolor
  misc_feature: Ceres ANNOT ID no. 6040033
  misc_feature: Encodes the peptide sequence at SEQ ID NO 4762
atgcatcccaaggctcgaatccacgccgacccggtgcgcgaggtcgaccacttcgactgcctgccggattcgctcgtcctgctgatcctgaacaaggtcgaggacgtgcgatcgctcggccggtgctacgccgtgtccaagcgcctctgtgggcttgttccccttgtccatgatgtgtatgtcaagattgaccgcgtcgtggcggtcgacggcgacgccgaggacactctcaacctgtcctcgcccaagcctcggaacatcttctcgcacttcctcaagctgatgctcctcacaatcatcaagccgttccacagcatgcgcaaccctaacggtactgggagaccattgttcccgcagctctcgcagcactcgccagcacaggtgctcaggaacttcacgcacgtcaggaatcttcggattgagctcccctctggggatgtgggtactgaggagggagttctgctgaaatggcgggcagagtatgggagcacacttcagaattgtgtgatcctcgggggtacccgggttgaccgcaagcctgttggtggagagcatgagccatctttggaggataatgggagcatgccagagtctttctataccaatggtgggctgaaacttcgtgttgtctggacaatcagctctctaattgcggcatcaacgaggcactatcttctccgctcaatcatcaatgaccatcccacacttcggagcttggtactaacagatgccgatggccaaggcacattgtgcatgggggcagagcagctgaaggagttcagagagaaccagttgtctgcctcagcgtgttctaacaggactcaggtcccagcctgcaacatgaagctcaagtatgctccatatcttgagctgcctggtggtatggcgttgcaaggcgctactttggtggctatcaaaccctcacctgagggaagcaatggaggccatcctaaccgtaaggaagccgacgggtttgtgtttggagcatttgatgggccatttaaggctgctgtgaaggcactgatgaagagacgtacttaccttctggagatgaatggcttctag

SEQ ID NO: 4762 - protein, 354 aa, Sorghum bicolor
  misc_feature: Ceres ANNOT ID no. 6040033
  misc_feature (4)..(352): NCBI GI: 20161462 NCBI Desc: p0432b10.4 [oryza sativa (japonica cultivar-group)]
  misc_feature (109)..(354): NCBI GI: 14209573 NCBI Desc: f-box family protein-like [oryza sativa (japonica cultivar-group)]
  misc_feature: The plant is abnormally small.
  misc_feature: Useful for making plants with modulated biomass
  misc_feature: Useful for making plants with modulated heat sensitivity
  misc_feature: Useful for making plants with modulated low light sensitivity
  misc_feature: Useful for making plants with modulated seed size
  misc_feature: Useful for making plants with modulated nitrogen use efficiency
  misc_feature: Functional homolog of the protein sequence given in SEQ ID NO 13481
  misc_feature: Functional homolog of the protein sequence given in SEQ ID NO 13501
  misc_feature: Functional homolog of the protein sequence given in SEQ ID NO 13503
  misc_feature: Useful for making plants with modulated low light sensitivity
  misc_feature: Useful for making plants with modulated nitrogen use efficiency
  misc_feature: Functional homolog of the protein sequence given in SEQ ID NO 13503
MHPKARIHADPVREVDHFDCLPDSLVLLILNKVEDVRSLGRCYAVSKRLCGLVPLVHDVYVKIDRVVAVDGDAEDTLNLSSPKPRNIFSHFLKLMLLTIIKPFHSMRNPNGTGRPLFPQLSQHSPAQVLRNFTHVRNLRIELPSGDVGTEEGVLLKWRAEYGSTLQNCVILGGTRVDRKPVGGEHEPSLEDNGSMPESFYTNGGLKLRVVWTISSLIAASTRHYLLRSIINDHPTLRSLVLTDADGQGTLCMGAEQLKEFRENQLSASACSNRTQVPACNMKLKYAPYLELPGGMALQGATLVAIKPSPEGSNGGHPNRKEADGFVFGAFDGPFKAAVKALMKRRTYLLEMNGF

SEQ ID NO: 4763 - DNA, 2025 bp, Sorghum bicolor
  misc_feature: Ceres ANNOT ID no. 6040037
  misc_feature: Encodes the peptide sequence at SEQ ID NO 4764
atgtacagggcctcgaatttcgtacctgatcctaatcaggtgctcctggatgccaagccattaaggtctttagctccaatgttccctgcccccatgggagtcaatgttaatcaatcaagtacaccaccattggtctgtgtcactccagttggtcaatttccagcagggtttggtgcagggaaccttcccgcctttggatcgttcactactttcagtgccactgcaaatggtgtttcttacacaggcaccagtgctaatggggccattgatgccactcctatctctgcatacaagacaaggacaggcatatcacttggtgatgatgagctttactcgggtaaccaaactttggtaaccaagcgtaagagaggccgtcctcttggttctggtcgtaatggcccaaatggtaaggtaaagcgccctaagcccacatacaagaattttgttgctggcaaagagcttgcctttctgtcatcttcatccgatcccagggagattgtggaatctgttcacatggcctttgaggcactccggcgaagacatctgcagatggatgaaacacaggacgctagcagacgtgctgacctgaaggctggtgccatcatgatggccagtaacatcagggcgaatacgggcaagagagtaggaactgtccctggagttgaaataggggatattttctatttcaggatggagctgtgtgtccttggattgcatgcacctagtatgggaggcattgattacatgactactaaatttggaaatgatgaggaatctgtagccatatgtatcgtctctgcaggaggttatgagaatgaggatgatgacacagatgtgctggtgtacagtggtcaagggggaaatagtaggaatactgaggagaggcatgaccagaagcttgagaggggtaacctagctcttgagaggagtttgcataggaagaatgtgataagggttgtacgtggcttcaaggatccattttgcctaactgggaaaatttacatatatgatggcctctacaagattcatgagtcctggaaggagaaaacaaggtctggtatcaattgcttcaaatacaagctgctgcgggaacctggacagcgtgatggagctgcattatggaagatgactcagagatggatagataatcctgctaccagaggcagggttctactagctgatctgtcatctaaggctgaagctttgccagtttgtgttgtcaatgacgtagaccatgagaaaggacctggagaattcacctatactaatcaggtcaaatactcgaggcctctcagttctatgaaaaagttgcagggctgtggatgccagagtgtttgcctgcctggtgatgccagttgtgcttgtggacagcataatggaggtgatttaccctacagttcattaggattgttgtcatgccgcaaaccgattatctatgaatgtggtgaatcttgcaactgttctataaattgccggaacaaagtgacccaaaaagggtccaggctacattttgaggtcttcaggactaccaatcgaggctggggtcttcgctgctgggaacctgttcgtgctggttcatttatatgtgagtatgctggtgaggtcattgatgagctcagagttaatttgaatgattgcgaagatgattacatttttcaaactgtatgccctggtgagaaaactttaaaatggaattgtggacctgaaatgataggtgaagaaagcacatatgtatcgtctgatgaatttgagccactgcctatcaagataagtgcaaaaaacatgggaaatgtctctcgtttcatgaaccacagttgctcacccaatgtcttctggcaaccagttcaatatgatcatggagatgatggacacccacatataatgttctttgcgctgaaacatattccaccaatgacagaactgacttatgactatggtgttgctggagctgaatctagtggtccaggttctcgtagaacgaagaactgcatgtgtggatcacaaaactgccggggattattttga

SEQ ID NO: 4764 - protein, 674 aa, Sorghum bicolor
  misc_feature: Ceres ANNOT ID no. 6040037
  misc_feature (211)..(367): Pfam Id: YDG_SRA Pfam Desc: YDG/SRA domain
  misc_feature (496)..(652): Pfam Id: SET Pfam Desc: SET domain
  misc_feature (394)..(494): Pfam Id: Pre-SET Pfam Desc: Pre-SET motif
  misc_feature (1)..(674): NCBI GI: 20977606 NCBI Desc: set domain protein 105 [zea mays]
  misc_feature (43)..(674): NCBI GI: 71743838 NCBI Desc: set domain protein sdg111 [zea mays]
  misc_feature (107)..(674): NCBI GI: 24021800 NCBI Desc: set domain protein 113 [zea mays]
  misc_feature (107)..(674): NCBI GI: 48927668 NCBI Desc: set domain protein [triticum aestivum]
  misc_feature (243)..(674): NCBI GI: 48927670 NCBI Desc: set domain protein [triticum aestivum]
MYRASNFVPDPNQVLLDAKPLRSLAPMFPAPMGVNVNQSSTPPLVCVTPVGQFPAGFGAGNLPAFGSFTTFSATANGVSYTGTSANGAIDATPISAYKTRTGISLGDDELYSGNQTLVTKRKRGRPLGSGRNGPNGKVKRPKPTYKNFVAGKELAFLSSSSDPREIVESVHMAFEALRRRHLQMDETQDASRRADLKAGAIMMASNIRANTGKRVGTVPGVEIGDIFYFRMELCVLGLHAPSMGGIDYMTTKFGNDEESVAICIVSAGGYENEDDDTDVLVYSGQGGNSRNTEERHDQKLERGNLALERSLHRKNVIRVVRGFKDPFCLTGKIYIYDGLYKIHESWKEKTRSGINCFKYKLLREPGQRDGAALWKMTQRWIDNPATRGRVLLADLSSKAEALPVCVVNDVDHEKGPGEFTYTNQVKYSRPLSSMKKLQGCGCQSVCLPGDASCACGQHNGGDLPYSSLGLLSCRKPIIYECGESCNCSINCRNKVTQKGSRLHFEVFRTTNRGWGLRCWEPVRAGSFICEYAGEVIDELRVNLNDCEDDYIFQTVCPGEKTLKWNCGPEMIGEESTYVSSDEFEPLPIKISAKNMGNVSRFMNHSCSPNVFWQPVQYDHGDDGHPHIMFFALKHIPPMTELTYDYGVAGAESSGPGSRRTKNCMCGSQNCRGLF

SEQ ID NO: 4765 - DNA, 483 bp, Sorghum bicolor
  misc_feature: Ceres ANNOT ID no. 6040039
  misc_feature: Encodes the peptide sequence at SEQ ID NO 4766
atggcggagaagctgacgccggcgcaggtcgacgagtgcaaggagatcttcgacctgttcgacgccgacgaggacggcaagtcaccatcccatcccatccatcgtcggatcgccgcaggcgacctcgtgacggcgctgcggtccctgggccagaacgtggacgaggcggaggcgcggcgcttcctggaggacgcgggcgccggcgccggcgccaccatcgacctcgcggcgttcctggccttggcggcgcgcaagatgggcgcgaggcagtcggaggagcgcctcgcggagtgcttcgacgtgttcgacgacgcccgcaccgggtccatccccgcggagcagctgcggcaggtgatggtgagccacggcgaccggctcacggagcaggaggccgacgcgatgctccgcgaggccgacccgcaaggcgagggccgcgtcgagtacaagcaatacgtcaaggtgctgctcagggacaagaagtga

SEQ ID NO: 4766 - protein, 160 aa, Sorghum bicolor
  misc_feature: Ceres ANNOT ID no. 6040039
  misc_feature (1)..(160): NCBI GI: 115492 NCBI Desc: calmodulin-related protein
  misc_feature (1)..(156): NCBI GI: 50299509 NCBI Desc: calmodulin cam-205 [daucus carota]
  misc_feature (1)..(156): NCBI GI: 50299505 NCBI Desc: calmodulin cam-203 [daucus carota]
  misc_feature (1)..(156): NCBI GI: 4959593 NCBI Desc: calmodulin mutant syncam5 [synthetic construct]
  misc_feature (1)..(156): NCBI GI: 115524 NCBI Desc: calmodulin 1 (cam 1)
MAEKLTPAQVDECKEIFDLFDADEDGKSPSHPIHRRIAAGDLVTALRSLGQNVDEAEARRFLEDAGAGAGATIDLAAFLALAARKMGARQSEERLAECFDVFDDARTGSIPAEQLRQVMVSHGDRLTEQEADAMLREADPQGEGRVEYKQYVKVLLRDKK

SEQ ID NO: 4767 - DNA, 798 bp, Sorghum bicolor
  misc_feature: Ceres ANNOT ID no. 6040047
  misc_feature: Encodes the peptide sequence at SEQ ID NO 4768
atgatgtaccatgctaagaatttttctgtgccctttgcacagcagagggctcagaataatgaacatgcaagtaatattggaggtattggtggacccaacgtaagcaaccctgctaatcctgtaggaagtgggaaacaacgcttacgatggacatcagatcttcataatcgctttgtggatgccattgcacagcttggtggaccagatagagctacacctaaaggggttctcactgtgatgggtgtaccagggatcacgatttatcatgtgaagagccatttgcagaagtatcgccttgcaaagtatataccggaatctcctgctgaaggttccaaggacgaaaagaaagattcgagtgattccctctcgaacacggattctgcaccaggattgcaaatcaacgaggcactaaagatgcaaatggaggttcaaaagcggctacatgagcaactcgaggttcaaagacaactgcaactaagaattgaagcacaagggagatacctgcagatgataattgaggagcaacaaaagcttggtggatcaattaaagcttctgaggatcagaagctttcagattcacctccaagcttagatgactacccagagagcatgcagccttctcccaagaaaccaaggatagatgcattatcaccggattcagagcgagatagaacacaacccgaatttgaatcccatttgatgggtccgtgggatcaagaaatctgtgcgaaaaacatatgcggcgttgcattcccagtggaggagttcaaagcagaccctggtatgagcaagtcttaa

SEQ ID NO: 4768 - protein, 265 aa, Sorghum bicolor
  misc_feature: Ceres ANNOT ID no. 6040047
  misc_feature (47)..(98): Pfam Id: Myb_DNA-binding Pfam Desc: Myb-like DNA-binding domain
  misc_feature (1)..(265): NCBI GI: 51572282 NCBI Desc: myb transcription factor [triticum aestivum]
  misc_feature (21)..(228): NCBI GI: 124359545 NCBI Desc: peptidase m22, glycoprotease; homeodomain-related [medicago truncatula]
  misc_feature (30)..(264): NCBI GI: 23197610 NCBI Desc: transfactor-like protein [arabidopsis thaliana]
  misc_feature (31)..(225): NCBI GI: 77403669 NCBI Desc: myb-cc type transfactor [solanum tuberosum]
  misc_feature (15)..(192): NCBI GI: 32488658 NCBI Desc: osjnba0087o24.8 [oryza sativa (japonica cultivar-group)]
  misc_feature: The sequence is a functional homolog of SEQ ID NO 1338 in the 10/374,780US patent application
  misc_feature: The sequence is a functional homolog of SEQ ID NO 1339 in the 10/374,780US patent application
  misc_feature: The sequence is a functional homolog of SEQ ID NO 1857 in the 10/374,780US patent application
  misc_feature: The sequence is a functional homolog of SEQ ID NO 1992 in the 11/479,226US patent application
  misc_feature: The sequence is a functional homolog of SEQ ID NO 2000 in the 11/479,226US patent application
  misc_feature: The sequence is a functional homolog of SEQ ID NO 933 in the 10/666,642US patent application
  misc_feature: Useful for making plants with altered Lignin content
  misc_feature: Useful for making plants with altered terpenoid content
  misc_feature: Useful for making plants with modulated growth and phenotype characteristics
  misc_feature: Functional homolog of the protein sequence given in SEQ ID NO 12902
  misc_feature: The sequence is a functional homolog of SEQ ID NO 1338 in the 20060162006 US patent application
  misc_feature: The sequence is a functional homolog of SEQ ID NO 1339 in the 20060162006 US patent application
  misc_feature: The sequence is a functional homolog of SEQ ID NO 1857 in the 20060162006 US patent application
  misc_feature: The sequence is a functional homolog of SEQ ID NO 1992 in the 20070022495 US patent application
  misc_feature: The sequence is a functional homolog of SEQ ID NO 2000 in the 20070022495 US patent application
  misc_feature: The sequence is a functional homolog of SEQ ID NO 933 in the 20070033671 US patent application
  misc_feature: The sequence is a functional homolog of SEQ ID NO 1995 in the 11/479,226 US patent application
  misc_feature: The sequence is a functional homolog of SEQ ID NO 1996 in the 11/479,226 US patent application
  misc_feature: The sequence is a functional homolog of SEQ ID NO 1997 in the 11/479,226 US patent application
  misc_feature: The sequence is a functional homolog of SEQ ID NO 1998 in the 11/479,226 US patent application
  misc_feature: The sequence is a functional homolog of SEQ ID NO 2001 in the 11/479,226 US patent application
  misc_feature: The sequence is a functional homolog of SEQ ID NO 2000 in the 11/479,226 US patent application
MMYHAKNFSVPFAQQRAQNNEHASNIGGIGGPNVSNPANPVGSGKQRLRWTSDLHNRFVDAIAQLGGPDRATPKGVLTVMGVPGITIYHVKSHLQKYRLAKYIPESPAEGSKDEKKDSSDSLSNTDSAPGLQINEALKMQMEVQKRLHEQLEVQRQLQLRIEAQGRYLQMIIEEQQKLGGSIKASEDQKLSDSPPSLDDYPESMQPSPKKPRIDALSPDSERDRTQPEFESHLMGPWDQEICAKNICGVAFPVEEFKADPGMSKS

SEQ ID NO: 4769 - DNA, 999 bp, Sorghum bicolor
  misc_feature: Ceres ANNOT ID no. 6040053
  misc_feature: Encodes the peptide sequence at SEQ ID NO 4770
atggcttatgcgagcccggggactgatacgtcaacagatctagatactgacgagaagaatcaaatgttggaactagggcagcttgtatcccttacagcttctgattctggcaacaaatcaaaagataagctaggtcaaaaggcactccgccgtctggcacaaaaccgtgaagctgctaggaaaagccgtctaagaaagaaggcatatgtcgagcaacttgagaacagcaggctgaaacttagtcaattggagcaggagctccagcgtgctcgccaacagggcatttttattcctactccaggagaccagcctaattcaactactgaaaatggtgctttggcatttgacatggactatgctcgatggcaagatgatcacaataagcagataaatgaactgagggctgcactcaatgcacatgccagtgacgatgatcttcggcatatgatcgacagcatcatggcatattacagcgaagctttcaggctcaagagagtagcagccaaggcagatgctttccacgtgctgtcaggaatgtggaagacccctgtcgagaggtgttttatgtggtttggtggacttcgaccgtcagagattctaaagttacttgcaagtcatctggaaccccttactgaacagcagcttgcaagtatatacagcctgcaacagtcctcggaacaagctgaagaggacctttcacagggggtgagagcactgcaacagtctgtcgcagaaacccttgcatcaggatccctgtgtcctgctggttcttctggtaacgctgcagattgctcggggcagatggcagtggcagttgggaagcttgggactctagaaagcttcctgcaggaggctgacgatctgcgaaggcggattcttgaacagatgcagcacatactgaccacccgccaatctgcacgagcactgcttgcaatcagtgactacctttcccggctacgcgctctgagttctctctggattgcacgaccacgggaatga

SEQ ID NO: 4770 - protein, 332 aa, Sorghum bicolor
  misc_feature: Ceres ANNOT ID no. 6040053
  misc_feature (43)..(95): Pfam Id: bZIP_1 Pfam Desc: bZIP transcription factor
  misc_feature (1)..(332): NCBI GI: 17025924 NCBI Desc: bzip transcription factor [oryza sativa]
  misc_feature (5)..(332): NCBI GI: 297018 NCBI Desc: ocs-element binding factor 3.2 [zea mays]
  misc_feature (1)..(332): NCBI GI: 47499874 NCBI Desc: bzip transcription factor [oryza sativa (japonica cultivar-group)]
  misc_feature (1)..(332): NCBI GI: 34921538 NCBI Desc: transcription factor hbp-1b(c1)
  misc_feature (5)..(332): NCBI GI: 297020 NCBI Desc: ocs-element binding factor 3.1 [zea mays]
  misc_feature: The sequence is a functional homolog of SEQ ID NO 1496 in the 10/374,780US patent application
  misc_feature: The sequence is a functional homolog of SEQ ID NO 156 in the 10/412,699US patent application
  misc_feature: The sequence is a functional homolog of SEQ ID NO 1566 in the 10/412,699US patent application
  misc_feature: The sequence is a functional homolog of SEQ ID NO 164 in the 10/412,699US patent application
  misc_feature: The sequence is a functional homolog of SEQ ID NO 1754 in the 10/412,699US patent application
  misc_feature: The sequence is a functional homolog of SEQ ID NO 178 in the 10/412,699US patent application
  misc_feature: The sequence is a functional homolog of SEQ ID NO 1788 in the 10/412,699US patent application
  misc_feature: The sequence is a functional homolog of SEQ ID NO 1792 in the 10/412,699US patent application
  misc_feature: The sequence is a functional homolog of SEQ ID NO 1794 in the 10/412,699US patent application
  misc_feature: The sequence is a functional homolog of SEQ ID NO 1978 in the 10/374,780US patent application
  misc_feature: The sequence is a functional homolog of SEQ ID NO 2026 in the 10/374,780US patent application
  misc_feature: The sequence is a functional homolog of SEQ ID NO 2030 in the 10/374,780US patent application
  misc_feature: The sequence is a functional homolog of SEQ ID NO 2032 in the 10/374,780US patent application
  misc_feature: The sequence is a functional homolog of SEQ ID NO 206 in the 10/225,068US patent application
  misc_feature: The sequence is a functional homolog of SEQ ID NO 353 in the 11/479,226US patent application
  misc_feature: The sequence is a functional homolog of SEQ ID NO 354 in the 10/412,699US patent application
  misc_feature: The sequence is a functional homolog of SEQ ID NO 356 in the 10/412,699US patent application
  misc_feature: The sequence is a functional homolog of SEQ ID NO 369 in the 11/479,226US patent application
  misc_feature: The sequence is a functional homolog of SEQ ID NO 380 in the 10/412,699US patent application
  misc_feature: The sequence is a functional homolog of SEQ ID NO 389 in the 11/479,226US patent application
  misc_feature: The sequence is a functional homolog of SEQ ID NO 40 in the 10/374,780US patent application
  misc_feature: The sequence is a functional homolog of SEQ ID NO 534 in the 10/225,066US patent application
  misc_feature: The sequence is a functional homolog of SEQ ID NO 776 in the 10/225,066US patent application
  misc_feature: The sequence is a functional homolog of SEQ ID NO 823 in the 11/479,226US patent application
  misc_feature: The sequence is a functional homolog of SEQ ID NO 831 in the 11/479,226US patent application
  misc_feature: The sequence is a functional homolog of SEQ ID NO 930 in the 11/435,388US patent application
  misc_feature: The sequence is a functional homolog of SEQ ID NO 934 in the 11/435,388US patent application
  misc_feature: The sequence is a functional homolog of SEQ ID NO 936 in the 11/435,388US patent application
  misc_feature: Useful for making plants with modulated growth and phenotype characteristics
  misc_feature: The sequence is a functional homolog of SEQ ID NO 156 in the 20040045049 US patent application
  misc_feature: The sequence is a functional homolog of SEQ ID NO 1566 in the 20040045049 US patent application
  misc_feature: The sequence is a functional homolog of SEQ ID NO 178 in the 20040045049 US patent application
  misc_feature: The sequence is a functional homolog of SEQ ID NO 1788 in the 20040045049 US patent application
  misc_feature: The sequence is a functional homolog of SEQ ID NO 1792 in the 20040045049 US patent application
  misc_feature: The sequence is a functional homolog of SEQ ID NO 1794 in the 20040045049 US patent application
  misc_feature: The sequence is a functional homolog of SEQ ID NO 1496 in the 10/374,780 US patent application
  misc_feature: The sequence is a functional homolog of SEQ ID NO 1566 in the 10/412,699 US patent application
  misc_feature: The sequence is a functional homolog of SEQ ID NO 1792 in the 10/412,699 US patent application
  misc_feature: The sequence is a functional homolog of SEQ ID NO 2030 in the 10/374,780 US patent application
  misc_feature: The sequence is a functional homolog of SEQ ID NO 206 in the 10/225,068 US patent application
  misc_feature: The sequence is a functional homolog of SEQ ID NO 356 in the 10/412,699 US patent application
  misc_feature: The sequence is a functional homolog of SEQ ID NO 831 in the 11/479,226 US patent application
  misc_feature: The sequence is a functional homolog of SEQ ID NO 934 in the 11/435,388 US patent application
  misc_feature: The sequence is a functional homolog of SEQ ID NO 1788 in the 10/412,699 US patent application
  misc_feature: The sequence is a functional homolog of SEQ ID NO 2026 in the 10/374,780 US patent application
  misc_feature: The sequence is a functional homolog of SEQ ID NO 354 in the 10/412,699 US patent application
  misc_feature: The sequence is a functional homolog of SEQ ID NO 823 in the 11/479,226 US patent application
  misc_feature: The sequence is a functional homolog of SEQ ID NO 930 in the 11/435,388 US patent application
  misc_feature: The sequence is a functional homolog of SEQ ID NO 1794 in the 10/412,699 US patent application
  misc_feature: The sequence is a functional homolog of SEQ ID NO 2032 in the 10/374,780 US patent application
  misc_feature: The sequence is a functional homolog of SEQ ID NO 380 in the 10/412,699 US patent application
  misc_feature: The sequence is a functional homolog of SEQ ID NO 534 in the 10/225,066 US patent application
  misc_feature: The sequence is a functional homolog of SEQ ID NO 936 in the 11/435,388 US patent application
  misc_feature: The sequence is a functional homolog of SEQ ID NO 1878 in the 10/412,699 US patent application
  misc_feature: The sequence is a functional homolog of SEQ ID NO 2138 in the 10/374,780 US patent application
  misc_feature: The sequence is a functional homolog of SEQ ID NO 372 in the 10/225,066 US patent application
  misc_feature: The sequence is a functional homolog of SEQ ID NO 878 in the 11/435,388 US patent application
  misc_feature: The sequence is a functional homolog of SEQ ID NO 1494 in the 10/374,780 US patent application
  misc_feature: The sequence is a functional homolog of SEQ ID NO 1564 in the 10/412,699 US patent application
  misc_feature: The sequence is a functional homolog of SEQ ID NO 1492 in the 10/374,780 US patent application
  misc_feature: The sequence is a functional homolog of SEQ ID NO 1562 in the 10/412,699 US patent application
  misc_feature: The sequence is a functional homolog of SEQ ID NO 242 in the 10/374,780 US patent application
  misc_feature: The sequence is a functional homolog of SEQ ID NO 764 in the 10/412,699 US patent application
  misc_feature: The sequence is a functional homolog of SEQ ID NO 826 in the 10/225,066 US patent application
  misc_feature: The sequence is a functional homolog of SEQ ID NO 950 in the 11/435,388 US patent application
  misc_feature: The sequence is a functional homolog of SEQ ID NO 96 in the 11/375,241 US patent application
  misc_feature: Useful for making plants with modulated biomass
  misc_feature: Functional homolog of the protein sequence given in SEQ ID NO 13416
  misc_feature: The sequence is a functional homolog of SEQ ID NO 1495 in the 10/374,780 US patent application
  misc_feature: The sequence is a functional homolog of SEQ ID NO 1565 in the 10/412,699 US patent application
MAYASPGTDTSTDLDTDEKNQMLELGQLVSLTASDSGNKSKDKLGQKALRRLAQNREAARKSRLRKKAYVEQLENSRLKLSQLEQELQRARQQGIFIPTPGDQPNSTTENGALAFDMDYARWQDDHNKQINELRAALNAHASDDDLRHMIDSIMAYYSEAFRLKRVAAKADAFHVLSGMWKTPVERCFMWFGGLRPSEILKLLASHLEPLTEQQLASIYSLQQSSEQAEEDLSQGVRALQQSVAETLASGSLCPAGSSGNAADCSGQMAVAVGKLGTLESFLQEADDLRRRILEQMQHILTTRQSARALLAISDYLSRLRALSSLWIARPRE

SEQ ID NO: 4771 - DNA, 885 bp, Sorghum bicolor
  misc_feature: Ceres ANNOT ID no. 6040074
  misc_feature: Encodes the peptide sequence at SEQ ID NO 4772
atgaggaagaagctggacacgcgcttccccgctcctcggattaagaagatcatgcaagcagatgaagatgtgggcaagattgctttagctgtacctgttctagtgtccaaagcattggagctatttctgcaagatttatgtgataggacatatgatattacaattcgaaagggggtcaagactgtgggttcttcccatttgaaacagtgcatacaaacgtacaacgtctatgacttcttgactgaagtagtcagtaaagttccagacattggtccttctgatgttattgctgatgataagcttggcaaaaggaggaaagctgaagaagatggaagtgaggaggaattaaagaggacaagaaatgagacagaaagctatacaagcaatggcagaggccgtgggaggggccgtgggagaggccgccgtggacgtggagcttggcgggaggttgtcacaactcatgaacaatttgcagagaaccaatctagcaagctagccagcctaaaggtggaggtagcagatgaggtctcgaatgcaactgaagcaaaagaggctactacaccagtgagcaatgccagggcttccataaggaacattgacttgaatttggatccaactgatgacgaggatgatgttacagtgccaccccaagcccagctgtcagctccagcaactagctccgccgcagccactgcaggacctggaccatctgctgcaggacctggaccatctgttccacggtcaaaggaaggagcaaaactcaaggattttcttggcgcttggggactgcctgacatgagcaatatggagatggaccctgtccagtttgctttgtcaacaaaccatagagtggaggaggatgaggattatgacaatgaagactaa

SEQ ID NO: 4772 - protein, 294 aa, Sorghum bicolor
  misc_feature: Ceres ANNOT ID no. 6040074
  misc_feature (7)..(71): Pfam Id: CBFD_NFYB_HMF Pfam Desc: Histone-like transcription factor (CBF/NF-Y) and archaealhistone
  misc_feature (1)..(293): NCBI GI: 92872430 NCBI Desc: histone-fold/tfiid-taf/nf-y [medicago truncatula]
  misc_feature (1)..(293): NCBI GI: 82749762 NCBI Desc: at3g12480-like protein [boechera stricta]
  misc_feature (1)..(166): NCBI GI: 18481624 NCBI Desc: repressor protein [oryza sativa]
  misc_feature (1)..(166): NCBI GI: 18481626 NCBI Desc: repressor protein [zea mays]
  misc_feature (18)..(166): NCBI GI: 77551403 NCBI Desc: repressor protein [oryza sativa (japonica cultivar-group)]
  misc_feature: The sequence is a functional homolog of SEQ ID NO 1107 in the 10/374,780US patent application
  misc_feature: The sequence is a functional homolog of SEQ ID NO 1108 in the 10/374,780US patent application
  misc_feature: The sequence is a functional homolog of SEQ ID NO 1109 in the 10/374,780US patent application
  misc_feature: The sequence is a functional homolog of SEQ ID NO 118 in the 10/412,699US patent application
  misc_feature: The sequence is a functional homolog of SEQ ID NO 1188 in the 10/412,699US patent application
  misc_feature: The sequence is a functional homolog of SEQ ID NO 1189 in the 10/412,699US patent application
  misc_feature: The sequence is a functional homolog of SEQ ID NO 1190 in the 10/412,699US patent application
  misc_feature: The sequence is a functional homolog of SEQ ID NO 188 in the 10/225,068US patent application
  misc_feature: The sequence is a functional homolog of SEQ ID NO 2256 in the 10/374,780US patent application
  misc_feature: The sequence is a functional homolog of SEQ ID NO 284 in the 11/479,226US patent application
  misc_feature: The sequence is a functional homolog of SEQ ID NO 772 in the 10/225,066US patent application
  misc_feature: The sequence is a functional homolog of SEQ ID NO 835 in the 10/374,780US patent application
  misc_feature: The sequence is a functional homolog of SEQ ID NO 836 in the 10/374,780US patent application
  misc_feature: The sequence is a functional homolog of SEQ ID NO 837 in the 10/374,780US patent application
  misc_feature: The sequence is a functional homolog of SEQ ID NO 910 in the 11/435,388US patent application
  misc_feature: Useful for making plants with modulated growth and phenotype characteristics
  misc_feature: The sequence is a functional homolog of SEQ ID NO 118 in the 20040045049 US patent application
  misc_feature: The sequence is a functional homolog of SEQ ID NO 1188 in the 20040045049 US patent application
  misc_feature: The sequence is a functional homolog of SEQ ID NO 1189 in the 20040045049 US patent application
  misc_feature: The sequence is a functional homolog of SEQ ID NO 1190 in the 20040045049 US patent application
  misc_feature: The sequence is a functional homolog of SEQ ID NO 1107 in the 20060162006 US patent application
  misc_feature: The sequence is a functional homolog of SEQ ID NO 1108 in the 20060162006 US patent application
  misc_feature: The sequence is a functional homolog of SEQ ID NO 1109 in the 20060162006 US patent application
MRKKLDTRFPAPRIKKIMQADEDVGKIALAVPVLVSKALELFLQDLCDRTYDITIRKGVKTVGSSHLKQCIQTYNVYDFLTEVVSKVPDIGPSDVIADDKLGKRRKAEEDGSEEELKRTRNETESYTSNGRGRGRGRGRGRRGRGAWREVVTTHEQFAENQSSKLASLKVEVADEVSNATEAKEATTPVSNARASIRNIDLNLDPTDDEDDVTVPPQAQLSAPATSSAAATAGPGPSAAGPGPSVPRSKEGAKLKDFLGAWGLPDMSNMEMDPVQFALSTNHRVEEDEDYDNED

SEQ ID NO: 4773 - DNA, 654 bp, Sorghum bicolor
  misc_feature: Ceres ANNOT ID no. 6040082
  misc_feature: Encodes the peptide sequence at SEQ ID NO 4774
atggacgacggagctgacctcccctgccaattgctcttctcccacccggagatgcctgacagcttcgacgagttcttcagcagcgccacgacgacgacctgcacccacacgcacagctgcaaccctcccggcccctcggccgccatgcacacccacacgtgcctgcacacgcacacccaggtcctcggcagcggcggggaggacgacgacgacgccagggaggaggaggactcggccaagccgcggaaacctctcgggaacagggaagccgtgcgcaagtaccgggagaagaagaaggcgcacgccgccttcctcgaagaggaggtcaagaagctccgtgcagccaatcagcagctcctgaggcggctgcagggccatgcagctctggaggcggaggtggcgaggctcaggagcctcctgctcgatgtccggggcaagatcgacgcagaggtcggcgtgttcccgtttcagaggccgtgcagtgtgggctctgtggcgtgtgctgatccagctctgtgcttcaatggcaactcggaggtaggaggctgctgggaggagagctcaagaccagcagttgcggatgtttcagaaggtttgcgtaattccatggatgttgttgcaagcttcgtgagttctgatcctctcgctgaatga

SEQ ID NO: 4774 - protein, 217 aa, Sorghum bicolor
  misc_feature: Ceres ANNOT ID no. 6040082
  misc_feature (75)..(132): Pfam Id: bZIP_2 Pfam Desc: Basic region leucine zipper
  misc_feature (75)..(141): Pfam Id: bZIP_1 Pfam Desc: bZIP transcription factor
  misc_feature (1)..(158): NCBI GI: 113367246 NCBI Desc: bzip transcription factor bzip121 [glycine max]
  misc_feature (1)..(159): NCBI GI: 113367214 NCBI Desc: bzip transcription factor bzip122 [glycine max]
  misc_feature (18)..(183): NCBI GI: 54291039 NCBI Desc: transcription factor-like [oryza sativa (japonica cultivar-group)]
  misc_feature (31)..(214): NCBI GI: 30693563 NCBI Desc: bzip family transcription factor [arabidopsis thaliana]
  misc_feature (123)..(159): NCBI GI: 145652373 NCBI Desc: transcription factor bzip120 [glycine max]
  misc_feature: The sequence is a functional homolog of SEQ ID NO 1343 in the 10/374,780US patent application
  misc_feature: The sequence is a functional homolog of SEQ ID NO 1463 in the 11/479,226US patent application
  misc_feature: The sequence is a functional homolog of SEQ ID NO 1707 in the 11/479,226US patent application
  misc_feature: The sequence is a functional homolog of SEQ ID NO 52 in the 10/286,264US patent application
  misc_feature: The sequence is a functional homolog of SEQ ID NO 694 in the 10/412,699US patent application
  misc_feature: Useful for making plants with modulated growth and phenotype characteristics
  misc_feature: The sequence is a functional homolog of SEQ ID NO 52 in the 20030093837 US patent application
  misc_feature: The sequence is a functional homolog of SEQ ID NO 1343 in the 20060162006 US patent application
  misc_feature: The sequence is a functional homolog of SEQ ID NO 1707 in the 20070022495 US patent application
MDDGADLPCQLLFSHPEMPDSFDEFFSSATTTTCTHTHSCNPPGPSAAMHTHTCLHTHTQVLGSGGEDDDDAREEEDSAKPRKPLGNREAVRKYREKKKAHAAFLEEEVKKLRAANQQLLRRLQGHAALEAEVARLRSLLLDVRGKIDAEVGVFPFQRPCSVGSVACADPALCFNGNSEVGGCWEESSRPAVADVSEGLRNSMDVVASFVSSDPLAE

SEQ ID NO: 4775 - DNA, 3078 bp, Sorghum bicolor
  misc_feature: Ceres ANNOT ID no. 6040086
  misc_feature: Encodes the peptide sequence at SEQ ID NO 4776
atggagtcgagctcgagcaggagctggagcatcgacagctacctcaacgagcacttcgacatccccgccaagaacccgcccagcgaggcccgcctccggtggcgccgcgccgtcggcctcgtcgtccgcaaccgtcgccgccgcttccgcatgttctccggcctccacgccctcgacgacgcccagcgccgcaagatcctggtacgtataagacgataccacctatctcctgagcttatcgaagcaggattttgtatcagtccagatgaactggcagcaattactggaattcgtgaagattatacaatcttcaagactcatggtggaattagtggtatatctaggaaaatcaaagcatcattggaagatggcatcaaggaaactgaaatagcaaccaggcagaaactgtatggcagtaataagcatgctgagaagcctcctagaagcttctggatgtttgtctgggatgcattgcatgacctgacgttgattattctaattgtttgtgctgttgtttctctagtagttggccttgccactgaggggtggccgaagggcatctatgacggccttgggataataaccagcattttattggtggtgctggttacagcatccagtgattacaaacagtcacggaaattcatggagctggactgtgagaaaaagaagatatatgcccttgtcactagagataggaaaaccaaaagggtactgattcatgatttggttgtgggtgacatcttgcatctttcaataggtgatgtggttcctgcagatggcctgttcatctctggctactgcttagtcatagatgaatctagtttatcaggtgaaagtgaaccagttcatgtttttgaagaaaagcctttcattcatgctggaagtaaagtggtagatgggactgccaagatgcttgtaactgctgttggtatgcgtactgaatggggcaaaatcatggatactctgaatgatgatggcgtggatgaaacccctttacaagttaagcttaatggtgtggcaacaatcattggacagatcgggttggtgtttgctatcctcacatttttggtacttctagtgaggttccttgttgacaaggggaaggacgttgggttgttaaattggtcagcaaatgatgcactgacaatagtgaactactttgctattgcagtgacaatcattgttgtcgcagtccctgagggtctaccactggctgtcactcttagccttgcgtttgccatgcaaaagttgatgaatgataaagcactagtgaggcatctcgctgcatgtgaaaccatgggttcagctagttgtatttgcactgataagactggaactttgacgaccaaccacatgatcgttgacaaggtttggatcggtgatgtatccaagtctgtcaatggtgatacaaatatgaatgagctgaaggctgctactgccgaaagtgctgtggacatacttattcaaggaatatttgtgaacactggttctgagatcgtgaagggagacgatggcaaaaaaactatcttaggcacaccaactgaagcagcattattggagtttggcttgatcttgcaaggagacctgtatggtgagtacaataagttggcaagagtcaaagtagagccttttaactctgttaagaaaaagatgtctgtgctagtacagttacctaatggaggcctccggtccttctgtaaaggtgcatcggaacttattttagggcagtgtgatactttcctcaatagtgaaggaaatttagcaccactgtcagaaatgcaaaagcaaaatgtcttaaatataataaactcatttgcttctgaggcattaagaacgctttgtattgcatttaaggatctgagtgaaattcctgatgaccagacaataccagaggatggttacacactaatagcactttttggcataaaggatccagtccgtcccggtgtaagggatgcagtaatgacctgcatggctgctggaatcaaagtaaaaatggtgactggagacaacatcaatactgctaaagccattgccaaggaatgtggaatattgaccgaggatggaatagcaatcgaaggaagagagcttcacgataagagcgcagatgaattgaaggagatcctgcctaaaattcaggtaatggcccggtccttgccgatggacaaatataaattggtgacaagcctaaaaagtatgtatcaagaggtcgtggcagttactggtgatggaacaaacgatgctccagcattgcgtgagtcagacataggtctggccatgggcattgccggcactgaggttgcgaaagaaaatgccgatgttataataatggatgataatttcagtaccattgtaaatgttgctagatggggtcgtgcggtttacttgaacattcagaagtttgtgcagttccagcttacagttaatatagtggctctgatagtgaatttcatctcagcgtgtatcataggtactgcaccacttactgccgttcagttgctatgggtgaacatgatcatggatacattaggagccttggccttagcgacagagccacctaatgatgaaatgatgaagagaccacctgtgagacgggggcatggtttcatcactcaggtcatgtggagaaatattcttgggcaggctttataccagctccttgtacttggtactctcatgtttgttggtaagaggatccttaatatcgaaggcccaaatgctgatataacgatcaataccctcatattcaactcttttgtgttttgccaggttttcaacgagataaatagcagggaaatggaaaagatcaacgtgttcagagggatactgaaaaattggatctttatcagtatattgacagcaaccgtcgtattccaagtaattatagtggagtttcttggaacctttgcaaacaccataccgctgagttggaagctgtggttgctcagtattattcttggctcggtcagtatggtcatctctgttatcgtcaagtgcattcccgtcgaatctagaaaaacaaatattaagccccatggctatgagttgattcctgaagccccagaaacagtatag

SEQ ID NO: 4776 - protein, 1025 aa, Sorghum bicolor
  misc_feature: Ceres ANNOT ID no. 6040086
  misc_feature (192)..(433): Pfam Id: E1-E2_ATPase Pfam Desc: E1-E2 ATPase
  misc_feature (437)..(765): Pfam Id: Hydrolase Pfam Desc: haloacid dehalogenase-like hydrolase
  misc_feature (861)..(1005): Pfam Id: Cation_ATPase_C Pfam Desc: Cation transporting ATPase, C-terminus
  misc_feature (99)..(178): Pfam Id: Cation_ATPase_N Pfam Desc: Cation transporter/ATPase, N-terminus
  misc_feature (7)..(1023): NCBI GI: 75322378 NCBI Desc: probable calcium-transporting atpase 6, plasma membrane-type (ca(2+)-atpase isoform 6)
  misc_feature (11)..(1025): NCBI GI: 110832729 NCBI Desc: probable calcium-transporting atpase 5, plasma membrane-type (ca(2+)-atpase isoform 5)
  misc_feature (31)..(1025): NCBI GI: 110832728 NCBI Desc: probable calcium-transporting atpase 4, plasma membrane-type (ca(2+)-atpase isoform 4)
  misc_feature (73)..(1023): NCBI GI: 18483249 NCBI Desc: type iib calcium atpase [medicago truncatula]
  misc_feature (24)..(1025): NCBI GI: 16508162 NCBI Desc: type iib calcium atpase [medicago truncatula]
  misc_feature (53)..(1024): SWISSPROT Homolog: EC 3.6.3.8 Calcium-transporting ATPase 4, plasma membrane-type
MESSSSRSWSIDSYLNEHFDIPAKNPPSEARLRWRRAVGLVVRNRRRRFRMFSGLHALDDAQRRKILVRIRRYHLSPELIEAGFCISPDELAAITGIREDYTIFKTHGGISGISRKIKASLEDGIKETEIATRQKLYGSNKHAEKPPRSFWMFVWDALHDLTLIILIVCAVVSLVVGLATEGWPKGIYDGLGIITSILLVVLVTASSDYKQSRKFMELDCEKKKIYALVTRDRKTKRVLIHDLVVGDILHLSIGDVVPADGLFISGYCLVIDESSLSGESEPVHVFEEKPFIHAGSKVVDGTAKMLVTAVGMRTEWGKIMDTLNDDGVDETPLQVKLNGVATIIGQIGLVFAILTFLVLLVRFLVDKGKDVGLLNWSANDALTIVNYFAIAVTIIVVAVPEGLPLAVTLSLAFAMQKLMNDKALVRHLAACETMGSASCICTDKTGTLTTNHMIVDKVWIGDVSKSVNGDTNMNELKAATAESAVDILIQGIFVNTGSEIVKGDDGKKTILGTPTEAALLEFGLILQGDLYGEYNKLARVKVEPFNSVKKKMSVLVQLPNGGLRSFCKGASELILGQCDTFLNSEGNLAPLSEMQKQNVLNIINSFASEALRTLCIAFKDLSEIPDDQTIPEDGYTLIALFGIKDPVRPGVRDAVMTCMAAGIKVKMVTGDNINTAKAIAKECGILTEDGIAIEGRELHDKSADELKEILPKIQVMARSLPMDKYKLVTSLKSMYQEVVAVTGDGTNDAPALRESDIGLAMGIAGTEVAKENADVIIMDDNFSTIVNVARWGRAVYLNIQKFVQFQLTVNIVALIVNFISACIIGTAPLTAVQLLWVNMIMDTLGALALATEPPNDEMMKRPPVRRGHGFITQVMWRNILGQALYQLLVLGTLMFVGKRILNIEGPNADITINTLIFNSFVFCQVFNEINSREMEKINVFRGILKNWIFISILTATVVFQVIIVEFLGTFANTIPLSWKLWLLSIILGSVSMVISVIVKCIPVESRKTNIKPHGYELIPEAPETV

SEQ ID NO: 4777 - DNA, 1452 bp, Sorghum bicolor
  misc_feature: Ceres ANNOT ID no. 6040096
  misc_feature: Encodes the peptide sequence at SEQ ID NO 4778
atggcgtccgcggccgccgcgccaacctccctctccctcgcggcccgcgcggccaccagggcagccaccgccgccgctgccgccgccgccccgctgcgcaggggaggcctcgccgcggcgtgccagccggcgcggtcgctggcgttcgcggcgggcgacgcgcggctcgcggtccacgtcgcgtcgcggtgccggcaggcgtcctccgcgcgcggcacgcgggccatggccaccatggccaagaagagcgtcggggacctcacggaggccgacctcgaggggaagcgcgtcttcgtgcgcgccgacctcaacgtgccgctcgacgagaaccagaacatcaccgacgacacccgcatccgggccgccgtacccaccatccagtacctcatcagcaagggcgccaaggtcatcctctcaagccacttgggtcgccctaagggttttacacccaagtttagcttaggtcccattgtaggacggttgtctgagcttcttggcattcaggtgcaaaaggccgaggatgttattggccctgaagttgagaagctggtggacgccttgcccattggtggggttttgctcctggagaacgtaagattctacaaggaagaggagaagaatgacccagagtttgcacagaagcttgcctccctagcagatctttatgtcaatgatgcatttggaacagcccacagggcacatgcatcgactgagggagttaccaagtttctgaagccttctgttgcagggttccttttgcagaaggaacttgactaccttgtcggagctgtctcaagccctaaacgcccatttgctgccatcgtgggtggttcaaaggtgtcatccaagattggggttattgaatccctgttggaaaagtgtgatatccttctcttgggtggtggtatgatcttcacattttacaaggcacaaggtctctctgttggtgcttcattggttgaggaagacaaacttgatcttgcaacatctctccttgcaaaggctaaggaaaagggtgtctcccttttgttgccaaccgatgttgtcattgctgataagtttgcccctgatgctaacagccagattgttccagcatctgcaattcctgatggttggatggggctggatattggcccagatgctgttacttcattcaacgcagccctggatacatgccagacggtcatctggaacgggcccatgggtgttttcgaatttgacaagtttgctgtaggaactgaggctgtggcaaagaagttggcagaacttagcgccaagggtgtcacaactatcattggaggtggagactctgttgccgctgttgagaaggtgggagttgctgacgttatgagccacatttccacgggaggtggtgccagcttggaattgttggaaggaaaggagcttccaggagttgttgcattggatgaagccatccctgtggctgtatga

SEQ ID NO: 4778 - protein, 483 aa, Sorghum bicolor
  misc_feature: Ceres ANNOT ID no. 6040096
  misc_feature (80)..(475): Pfam Id: PGK Pfam Desc: Phosphoglycerate kinase
  misc_feature (1)..(483): NCBI GI: 3738261 NCBI Desc: chloroplast phosphoglycerate kinase [populus nigra]
  misc_feature (1)..(483): NCBI GI: 92872325 NCBI Desc: phosphoglycerate kinase [medicago truncatula]
  misc_feature (1)..(483): NCBI GI: 1161600 NCBI Desc: phosphoglycerate kinase [nicotiana tabacum]
  misc_feature (1)..(483): NCBI GI: 12644295 NCBI Desc: phosphoglycerate kinase, chloroplast precursor
  misc_feature (1)..(483): NCBI GI: 3328122 NCBI Desc: phosphoglycerate kinase precursor [solanum tuberosum]
  misc_feature (1)..(479): SWISSPROT Homolog: EC 2.7.2.3 Phosphoglycerate kinase, chloroplast precursor
MASAAAAPTSLSLAARAATRAATAAAAAAAPLRRGGLAAACQPARSLAFAAGDARLAVHVASRCRQASSARGTRAMATMAKKSVGDLTEADLEGKRVFVRADLNVPLDENQNITDDTRIRAAVPTIQYLISKGAKVILSSHLGRPKGFTPKFSLGPIVGRLSELLGIQVQKAEDVIGPEVEKLVDALPIGGVLLLENVRFYKEEEKNDPEFAQKLASLADLYVNDAFGTAHRAHASTEGVTKFLKPSVAGFLLQKELDYLVGAVSSPKRPFAAIVGGSKVSSKIGVIESLLEKCDILLLGGGMIFTFYKAQGLSVGASLVEEDKLDLATSLLAKAKEKGVSLLLPTDVVIADKFAPDANSQIVPASAIPDGWMGLDIGPDAVTSFNAALDTCQTVIWNGPMGVFEFDKFAVGTEAVAKKLAELSAKGVTTIIGGGDSVAAVEKVGVADVMSHISTGGGASLELLEGKELPGVVALDEAIPVAV

SEQ ID NO: 4779 - DNA, 1245 bp, Sorghum bicolor
  misc_feature: Ceres ANNOT ID no. 6040099
  misc_feature: Encodes the peptide sequence at SEQ ID NO 4780
atgggggcgaagcgggcggtgctggtgggcatcaactacccgggcaccaaagcggagctcaaggggtgccacaacgacgtcgctcgcatgcgccggtgcctcgtcgaccgcttcggcttcgacgagtccggcatccgcgtcctcatcgatgacggctccgcgctgaagcccacgggggccaacatccggcgggaactcgcgcgcctcgtcggggacgcgcggcccggggacctgctcttcttccactacagcgggcacggcacacggctgcccgccgagaccgggcaggacgacgacaccggatacgacgagtgcatcgtgccctgcgacatgaaccttatcacagaccaagatttcacggagcttgtgcaaaaaatccccagtggctgtctctttaccatagtttctgattcgtgccacagtggtggactacttgacaagacgaaggaacagattggccacagcaccaagctgaaccagacccagcgccgggaacttgaagaacggcctgcttctgacactagcttccgggaattcctcaaagatactgttcgggacgtgtttgagtctaaaggaattcacctgccccaccgtagccatagccaccggcaaggtcacggtgacgacgatgatgctgaagagtcacgctacatcaacacagccgatgcccatgtcaaaaaccggtcgctacctctctcgacattgatcgagatgctcaaggagaagactgggaaggatgacgttgatgtaggctcaatccggctaacactatttaacctctttggagacgacgccagtccgaagataaagaagttcatgaaggtcatgctgaacaagttacagcagggacagcatggtggcattgtgggcttcatgggcgccctggcacaggaattcctgaaagccaagcttgatggcaaggaagaagagctcgacccagccatgaaacaaaatgtgcacagcgaccaagaggtgtatgccgggacgacggcgagggtgccaagcaacggtgtcctgatcagtgggtgccagaccgaccagacgtctgcggacgcgaccacaccgaagggtgtgtcctacggtgcgctcagcaatgccatccaggccatcctctcggagcgcgggaaggtaacaaacaaggagctcgtgctgaaagcgcgcaagatgctgtcgaaacagggctacacccaacagcctgggctctactgcagcgatgagaatgcgagtgtggctttcatatgctga

SEQ ID NO: 4780 - protein, 414 aa, Sorghum bicolor
  misc_feature: Ceres ANNOT ID no. 6040099
  misc_feature (4)..(412): Pfam Id: Peptidase_C14 Pfam Desc: Caspase domain
  misc_feature (3)..(414): NCBI GI: 4235430 NCBI Desc: latex-abundant protein [hevea brasiliensis]
  misc_feature (9)..(414): NCBI GI: 23343885 NCBI Desc: metacaspase 1 [lycopersicon esculentum]
  misc_feature (4)..(414): NCBI GI: 40644374 NCBI Desc: metacaspase type ii [picea abies]
  misc_feature (4)..(414): NCBI GI: 33304380 NCBI Desc: metacaspase 7 [arabidopsis thaliana]
  misc_feature (3)..(414): NCBI GI: 32482818 NCBI Desc: metacaspase 4 [arabidopsis thaliana]
MGAKRAVLVGINYPGTKAELKGCHNDVARMRRCLVDRFGFDESGIRVLIDDGSALKPTGANIRRELARLVGDARPGDLLFFHYSGHGTRLPAETGQDDDTGYDECIVPCDMNLITDQDFTELVQKIPSGCLFTIVSDSCHSGGLLDKTKEQIGHSTKLNQTQRRELEERPASDTSFREFLKDTVRDVFESKGIHLPHRSHSHRQGHGDDDDAEESRYINTADAHVKNRSLPLSTLIEMLKEKTGKDDVDVGSIRLTLFNLFGDDASPKIKKFMKVMLNKLQQGQHGGIVGFMGALAQEFLKAKLDGKEEELDPAMKQNVHSDQEVYAGTTARVPSNGVLISGCQTDQTSADATTPKGVSYGALSNAIQAILSERGKVTNKELVLKARKMLSKQGYTQQPGLYCSDENASVAFIC

SEQ ID NO: 4781 - DNA, 774 bp, Sorghum bicolor
  misc_feature: Ceres ANNOT ID no. 6040105
  misc_feature: Encodes the peptide sequence at SEQ ID NO 4782
atggcgccgagaacgtcagagaaaacgatgacaccggcggcggcggctgccgccacggggctcgcgcttagcgtcagcggcggagccggagccagcggcccgcacttcagaggcgtcaggaagcggccgtggggccggtacgccgcggagatccgcgacccggccaagaagagccgcgtgtggctcggcacgttcgacacggccgaggaggctgcgcgggcctacgacgccgccgcgcgcgactaccgcggcccaaaggccaagaccaacttccctttcccttcgtcgtgcatgccactcgccgccggcgccggcgccggcagcttgcctgcggcgaaggccgtcaccggtggcggcggcagccggagcagcaacagcagcaccgtcgagtctttcagcagcggcagcgacgtgcaggcggcgcccatgcaggccatgccgctcccaccgtctctggagctcgacctgttccaccgcgcggcggctgcgggcacgggcacgggcggcgccgccgtacggttccctttcaacagctaccccgtgacgcacccgtactatttcttcgggcaggccgctgctgccgcggcggcagggtgccacatgctcaagctggcaccgacggtgaccgtggcggccgtggcgcagagcgactccgactcctcgtcggtcgtggatctgtcgccatcgccgccggccgccgtgtcgacgcagaaggccgccgccgcgttcgatcttgacctgaactgcccaccgccggcggagatggaggcctag

SEQ ID NO: 4782 - protein, 257 aa, Sorghum bicolor
  misc_feature: Ceres ANNOT ID no. 6040105
  misc_feature (34)..(85): Pfam Id: AP2 Pfam Desc: AP2 domain
  misc_feature (114)..(255): NCBI GI: 47087871 NCBI Desc: ethylene-responsive element binding factor [oryza sativa]
  misc_feature (114)..(255): NCBI GI: 115464685 NCBI Desc: os05g0497300 [oryza sativa (japonica cultivar-group)]
  misc_feature (1)..(246): NCBI GI: 9309342 NCBI Desc: ethylene responsive element binding factor3 [oryza sativa]
  misc_feature (1)..(246): NCBI GI: 56567583 NCBI Desc: bth-induced erf transcriptional factor 2 [oryza sativa (indica cultivar-group)]
  misc_feature (24)..(255): NCBI GI: 4099921 NCBI Desc: erebp-3 homolog [stylosanthes hamata]
  misc_feature: The sequence is a functional homolog of SEQ ID NO 10 in the 10/412,699US patent application
  misc_feature: The sequence is a functional homolog of SEQ ID NO 100 in the 10/412,699US patent application
  misc_feature: The sequence is a functional homolog of SEQ ID NO 1000 in the 10/412,699US patent application
  misc_feature: The sequence is a functional homolog of SEQ ID NO 124 in the 11/479,226US patent application
  misc_feature: The sequence is a functional homolog of SEQ ID NO 1435 in the 11/479,226US patent application
  misc_feature: The sequence is a functional homolog of SEQ ID NO 243 in the 11/479,226US patent application
  misc_feature: The sequence is a functional homolog of SEQ ID NO 2504 in the 10/374,780US patent application
  misc_feature: The sequence is a functional homolog of SEQ ID NO 314 in the 10/666,642US patent application
  misc_feature: The sequence is a functional homolog of SEQ ID NO 501 in the 10/374,780US patent application
  misc_feature: The sequence is a functional homolog of SEQ ID NO 618 in the 10/225,066US patent application
  misc_feature: The sequence is a functional homolog of SEQ ID NO 674 in the 10/412,699US patent application
  misc_feature: Useful for making plants with altered alkaloid content
  misc_feature: Useful for making plants with modulated growth and phenotype characteristics
  misc_feature: GREAT-hit functional homolog of the protein sequence given in SEQ ID NO 13008
  misc_feature: The sequence is a functional homolog of SEQ ID NO 10 in the 20040045049 US patent application
  misc_feature: The sequence is a functional homolog of SEQ ID NO 100 in the 20040045049 US patent application
  misc_feature: The sequence is a functional homolog of SEQ ID NO 1000 in the 20040045049 US patent application
  misc_feature: The sequence is a functional homolog of SEQ ID NO 674 in the 20040045049 US patent application
  misc_feature: The sequence is a functional homolog of SEQ ID NO 314 in the 20070033671 US patent application
  misc_feature: Useful for making plants with altered lignin content
  misc_feature: Functional homolog of the protein sequence given in SEQ ID NO 13219
MAPRTSEKTMTPAAAAAATGLALSVSGGAGASGPHFRGVRKRPWGRYAAEIRDPAKKSRVWLGTFDTAEEAARAYDAAARDYRGPKAKTNFPFPSSCMPLAAGAGAGSLPAAKAVTGGGGSRSSNSSTVESFSSGSDVQAAPMQAMPLPPSLELDLFHRAAAAGTGTGGAAVRFPFNSYPVTHPYYFFGQAAAAAAAGCHMLKLAPTVTVAAVAQSDSDSSSVVDLSPSPPAAVSTQKAAAAFDLDLNCPPPAEMEA

SEQ ID NO: 4783 - DNA, 579 bp, Sorghum bicolor
  misc_feature: Ceres ANNOT ID no. 6040138
  misc_feature: Encodes the peptide sequence at SEQ ID NO 4784
atggctaagatcgctgccgtcgccgccacggcggcgctgtgcctcgcggccctggtggccgtggccgtcggccaaggcgtggtcgagcggcagaggctcaaggacctgcagtgctggcaagaggtccaggagaacccgctcggcgcgtgccggcaggtgctcgaccggcagctcaccggcggcatgcgctacggcatcggcccgttccggtggggcaccgggctccggatgcggtgctgccagcagctccaggacgtgagccgcgagtgccgctgcgccgccatccggagcatggtcaggggctacgaggagaccatgccgccgctggagaaaggctggtgggggcagcagccgcagccgggctacgactacccctgcagccaggcaggagagggatacggctacggtgagagtggccagcagcagatgtacccaccgtgtcgtcccggcaccgggcaaaaaatcgcccgcgtgaagcttacaaaggccaggcagtacgccgcagggatgccgatgatgtgccggctgtcggagccccaggagtgcagcgtcttctccggcggcgaccagtactactag

SEQ ID NO: 4784 - protein, 192 aa, Sorghum bicolor
  misc_feature: Ceres ANNOT ID no. 6040138
  misc_feature (50)..(182): Pfam Id: Tryp_alpha_amyl Pfam Desc: Protease inhibitor/seed storage/LTP family
  misc_feature (1)..(191): NCBI GI: 16305142 NCBI Desc: alpha globulin [zea mays]
  misc_feature (11)..(191): NCBI GI: 115505553 NCBI Desc: 19 kda globulin precursor (alpha-globulin)
  misc_feature (11)..(191): NCBI GI: 20159 NCBI Desc: 19 kda globulin precursor [oryza sativa (japonica cultivar-group)]
  misc_feature (15)..(191): NCBI GI: 169805 NCBI Desc: [oryza sativa dna fragment with a miscellaneous signal and an open reading frame.], gene product
  misc_feature (12)..(142): NCBI GI: 110341795 NCBI Desc: globulin 1 [triticum aestivum]
MAKIAAVAATAALCLAALVAVAVGQGVVERQRLKDLQCWQEVQENPLGACRQVLDRQLTGGMRYGIGPFRWGTGLRMRCCQQLQDVSRECRCAAIRSMVRGYEETMPPLEKGWWGQQPQPGYDYPCSQAGEGYGYGESGQQQMYPPCRPGTGQKIARVKLTKARQYAAGMPMMCRLSEPQECSVFSGGDQYY

SEQ ID NO: 4785 - DNA, 774 bp, Sorghum bicolor
  misc_feature: Ceres ANNOT ID no. 6040155
  misc_feature: Encodes the peptide sequence at SEQ ID NO 4786
atgaggaggacgacccaatctatggccgcctccgccgcgcgctcgccgccggcgattgaccggcacgcggtgcggctgatcacgcgcgtctccgtagcactggccgccatcgccacgctctcactcttacacctcttgcgccacgcatccatccactgcttccccgcgtccaacccacttgcgctcaccatctcgctcgcccccttcccccgcacctcctgcgacgccgcctcgcgccgggtggtcccgcccgaccgccgcctcgctaagctccgcgcctccccgcgctggagacgccgagccgtttccctggccacgtccgccttcccaccgctccgcggcctcggcctcctcgcggcttcttcccgcgtcctctgcctcgccgcgggcgccggccacgccgtcgacgcgctccgcgcggtggggaccagggatgccacagggatcgacctcgtcgacttcccgccgctcgtccgccgcgcggatccccaccacctccccttctccgacggcgccttcgacctcgtgttctcggatgacccctcggcgatctccggcgcgctcttcgcggcccgcctcgcgagcgaggctgagcgcgccgtccgtcgcggtggcggcattgcgctcgcgttcgaccgggagatcgagaccgcagccgtcgccgcactattcaagaaatcgcgcgtcgtggatgtgaaggatgtcaccttggatggctcccaggttaggctgctgatcatgcagagtaatggcactacttcagatccatattga

SEQ ID NO: 4786 - protein, 257 aa, Sorghum bicolor
  misc_feature: Ceres ANNOT ID no. 6040155
  misc_feature (11)..(248): NCBI GI: 115464733 NCBI Desc: os05g0500700 [oryza sativa (japonica cultivar-group)]
  misc_feature (19)..(254): NCBI GI: 124301140 NCBI Desc: at2g16030 [arabidopsis thaliana]
  misc_feature (87)..(239): NCBI GI: 9743354 NCBI Desc: f21j9.14 [arabidopsis thaliana]
MRRTTQSMAASAARSPPAIDRHAVRLITRVSVALAAIATLSLLHLLRHASIHCFPASNPLALTISLAPFPRTSCDAASRRVVPPDRRLAKLRASPRWRRRAVSLATSAFPPLRGLGLLAASSRVLCLAAGAGHAVDALRAVGTRDATGIDLVDFPPLVRRADPHHLPFSDGAFDLVFSDDPSAISGALFAARLASEAERAVRRGGGIALAFDREIETAAVAALFKKSRVVDVKDVTLDGSQVRLLIMQSNGTTSDPY

SEQ ID NO: 4787 - DNA, 2133 bp, Sorghum bicolor
  misc_feature: Ceres ANNOT ID no. 6040172
  misc_feature: Encodes the peptide sequence at SEQ ID NO 4788
atgtcaagcgacctctccgcacgctcgtcggcgctttcctcctccaccgcgtcgccttccgacgactcgcggcggaaggagcaaggacggcatgcgacgaccaacggcagcggcagcggtagcagcagcgggcgccgggggagccactggcggagccagcgcgtgcagtggctcggcggcgccggcgcggcgtgggcggtggacccgcgcgcgaggtgggtccgggactggaaccgcgcctacctcctggcgtgcgcggcggggctgatggtggacccgctcttcctgtacgccgtgtctctgagcggcccgctcatgtgcctcttcgtcgacggctggctcgccgccgccgtcaccgcgctgcgctgcgccgtggacgccatgcacgtgtggaacgtcgccacgcagctccgcctccgcgtcgcgcgcgccggcgccggcgccggcgcgacgccgggtagtaagcgcgtggccagcggcgcgggcgacgaggagcagcagcagcagcagggcgccgaggacgacgacgaggaggccgccgccgaggccgcgcgcaagctccccgaagagtccaggaaagggatgctgcttgacttcttcgtcatccttcccgtgatgcaggtggtggtgtgggtagcggcgccggcgatgatccgcgcggggttgacgacgccggtgatgacggtgatgctggtggcgttcctgctcgagtacctgcccaagatctaccacgcggcgcgcctgctccggcggacgcagcgccagtccggctacatcttcggcaccatctggtggggcatcgcgctcaacctcatggcctacttcgtcgccgcccatgctgtgggggcgtgctggtacctgctcggcgtgcagcgggccagcaagtgtctgaaagagcagtgcctccaggcggcggcggccggcgggtgcgcgcgcagcagcgcggtggcctgcgcggcgccgctgtactacggcggctccccttccacctccggtgtcatcggcagcggcgacaggctcgcctggtcccggaacgcgcaggcccggggcacgtgcctgtccagcggcggcggcggcggcgacaactaccagtacggcgcgtactcgtggacggtgatgctggtggcgaacccgagccgcgtggagcggatgctgctcccgatcttctggggcctcatgacgctcagcacgttcggcaacctggagagcacgacggagtgggtggagatcgtgttcaacatcgtcaccatcacgggcgggctcgtcctcgtcaccatgctcatcggcaacatcaaggtgttcctgaacgcgaccacgtccaagaagcaggccatgcacacgcggctccgcagcgtggagtggtggatgaagcgcaagaacctgccccggagcttccgcgcccgtgtgcgccagttcgagcgccagcggtgggccgccacccgcggcgtcgacgagtgccagatcgtgcgcgacctccccgagggactccgccgggacatcaagtaccacctctgcctcgacctcgtccgccaggtccccttcttccagcacatggacgacctcgtcctcgagaacatctgcgacagggtcaaatccctcatcttccccaagggagaaaccatcgtgagggagggagacgtggtgcagcggatgctgttcatcgtgaggggccacctgcagtgcagccaggtgctgcggaacggggcgacgagcagctgcacgctggggccaggcaacttcagcggcgacgagctgctgtcgtggtgcctgcggcggccgttcctggagcggctcccgacgtcgtcggcaacgctggtgacgctggagagcacggaggtgttcggactggacgccgccgacgtcaagtacgtgacgcagcacttccgctacaccttcaccaacgacaaggtgcgccgcagcgcgcgctactactcgccggggtggcgcacctgggcggccgtcgccgtgcagctggcatggcggaggtacaagcaccgcaagacgctctcgtcgctgtccttcatccgcccgcggcgaccgctgtcccgctgctcgtcgctcggggaggagaagctccgcctctacaccgccatcctcacctcgcccaagcccaaccaggacgacgacttctag

SEQ ID NO: 4788 - protein, 710 aa, Sorghum bicolor
  misc_feature: Ceres ANNOT ID no. 6040172
  misc_feature (532)..(630): Pfam Id: cNMP_binding Pfam Desc: Cyclic nucleotide-binding domain
  misc_feature (37)..(710): NCBI GI: 66933062 NCBI Desc: cyclic nucleotide-gated ion channel 4 [hordeum vulgare subsp. vulgare]
  misc_feature (208)..(710): NCBI GI: 66933078 NCBI Desc: cyclic nucleotide-gated ion channel 4 [hordeum vulgare subsp. vulgare]
  misc_feature (188)..(708): NCBI GI: 9759498 NCBI Desc: cyclic nucleotide and calmodulin-regulated ion channel [arabidopsis thaliana]
  misc_feature (193)..(707): NCBI GI: 92876983 NCBI Desc: iq calmodulin-binding region; cyclic nucleotide-binding [medicago truncatula]
  misc_feature (175)..(705): NCBI GI: 115455461 NCBI Desc: os03g0758300 [oryza sativa (japonica cultivar-group)]
  misc_feature: The sequence is a functional homolog of SEQ ID NO. 503 in the 11/188,298 US application
MSSDLSARSSALSSSTASPSDDSRRKEQGRHATTNGSGSGSSSGRRGSHWRSQRVQWLGGAGAAWAVDPRARWVRDWNRAYLLACAAGLMVDPLFLYAVSLSGPLMCLFVDGWLAAAVTALRCAVDAMHVWNVATQLRLRVARAGAGAGATPGSKRVASGAGDEEQQQQQGAEDDDEEAAAEAARKLPEESRKGMLLDFFVILPVMQVVVWVAAPAMIRAGLTTPVMTVMLVAFLLEYLPKIYHAARLLRRTQRQSGYIFGTIWWGIALNLMAYFVAAHAVGACWYLLGVQRASKCLKEQCLQAAAAGGCARSSAVACAAPLYYGGSPSTSGVIGSGDRLAWSRNAQARGTCLSSGGGGGDNYQYGAYSWTVMLVANPSRVERMLLPIFWGLMTLSTFGNLESTTEWVEIVFNIVTITGGLVLVTMLIGNIKVFLNATTSKKQAMHTRLRSVEWWMKRKNLPRSFRARVRQFERQRWAATRGVDECQIVRDLPEGLRRDIKYHLCLDLVRQVPFFQHMDDLVLENICDRVKSLIFPKGETIVREGDVVQRMLFIVRGHLQCSQVLRNGATSSCTLGPGNFSGDELLSWCLRRPFLERLPTSSATLVTLESTEVFGLDAADVKYVTQHFRYTFTNDKVRRSARYYSPGWRTWAAVAVQLAWRRYKHRKTLSSLSFIRPRRPLSRCSSLGEEKLRLYTAILTSPKPNQDDDF

SEQ ID NO: 4789 - DNA, 1221 bp, Sorghum bicolor
  misc_feature: Ceres ANNOT ID no. 6040173
  misc_feature: Encodes the peptide sequence at SEQ ID NO 4790
atggagtgttccaattcaactagttcccaagggcatcatgtaaatggaaagcggaatcaagtgcaaaccattgatcctcctggtcctactcctaccattgttgaaatgggaccaaggcactgcccattgactttcgtgagaagatcccgtggagtattgtgtttggtgatcatgatattaacagcatttctgatgatggtttacctgtcccctgtaactactttccttgtgcggttgttcagcgtgcattacagcagaaagtctacatgcttcctgtttgggatgtggttagccatgtggccttttttgtttgagaagattaacaagaccaggtttattttctctggtgaaagtgtgccagcaaatgagcgagtgctgttatttgctaaccacaggactgaggttgactggatgtacttgtgggattttgcattgaggaaaggccgcttgcagtgcatcaagtatatccttaagaaaagcttgatgaagttacctgttttcaactgggcatttcacattattgagtttattccggtagagaggaagtgggagattgatgaagcaataatccgaagcaggctttccgaattgaagaacccaaaggatcccctttggttagcggttttcccagaaggcactgactatactgagaagaagtgtgtcaaaagtcaagaatatgcagcagagcatggtttgcctgttctgaagaacgtactccttcccaagacaaagggtttcaattgctgtttgcaagtgctgcggagtaccatagatgctgtttatgacatcacaatcgcttacaaacatcgaccgccgacttttctggacaacgtttatggcattggtccttccgaagtccacatccacatcaacagtatccaagtttccgacataccaacatctgaagacgaagtagctgactggttgatagagcgattcaggctgaaggacgagctgctgtccaagttctccacgctaggccacttccccaacgaaggaactgaaggggatctgtcaacaaccaagtgccttgcaaattttgtggcggtagttactgtcaccggctttctcatgtacctaaccctgttttcgtccgtatggttcaaagttttcgtagcgtttagctgttctttccttacgctcgctacctgctactctatacatctgccccagatgatagattcaggttcctctgagagtatccatgcgaaggaagcttga

SEQ ID NO: 4790 - protein, 406 aa, Sorghum bicolor
  misc_feature: Ceres ANNOT ID no. 6040173
  misc_feature (111)..(269): Pfam Id: Acyltransferase Pfam Desc: Acyltransferase
  misc_feature (4)..(405): NCBI GI: 115440337 NCBI Desc: os01g0782500 [oryza sativa (japonica cultivar-group)]
  misc_feature (76)..(398): NCBI GI: 145332637 NCBI Desc: lpat5 [arabidopsis thaliana]
  misc_feature (42)..(347): NCBI GI: 5882722 NCBI Desc: contains similarity to gbz95637 acyl-coa:1-acylglycerol-3-phosphate acyltransferase from brassica napus. [arabidopsis thaliana]
  misc_feature (52)..(406): NCBI GI: 4583544 NCBI Desc: acyl-coa:1-acylglycerol-3-phosphate acyltransferase [brassica napus]
  misc_feature (52)..(406): NCBI GI: 73620927 NCBI Desc: 1-acyl-sn-glycerol-3-phosphate acyltransferase 2 (lysophosphatidyl acyltransferase 2)
MECSNSTSSQGHHVNGKRNQVQTIDPPGPTPTIVEMGPRHCPLTFVRRSRGVLCLVIMILTAFLMMVYLSPVTTFLVRLFSVHYSRKSTCFLFGMWLAMWPFLFEKINKTRFIFSGESVPANERVLLFANHRTEVDWMYLWDFALRKGRLQCIKYILKKSLMKLPVFNWAFHIIEFIPVERKWEIDEAIIRSRLSELKNPKDPLWLAVFPEGTDYTEKKCVKSQEYAAEHGLPVLKNVLLPKTKGFNCCLQVLRSTIDAVYDITIAYKHRPPTFLDNVYGIGPSEVHIHINSIQVSDIPTSEDEVADWLIERFRLKDELLSKFSTLGHFPNEGTEGDLSTTKCLANFVAVVTVTGFLMYLTLFSSVWFKVFVAFSCSFLTLATCYSIHLPQMIDSGSSESIHAKEA

SEQ ID NO: 4791 - DNA, 2076 bp, Sorghum bicolor
  misc_feature: Ceres ANNOT ID no. 6040175
  misc_feature: Encodes the peptide sequence at SEQ ID NO 4792
atggcgcgacatcctaagccgcccgcgcccccgtccccgcccccgccgccgtgcccgccctcggactcggaccccggcgtcggcttcgaccccatcgaggagtggctcgtggacttcgacccggccatgtcgggcgagctagcggccaagggtctcggcgccgctgagcaagcggcggcggttccgcatacgctggtggagacggcggcgggaaagagcttcgagctcgagtttggtgtgatggacgagaaggtcgaggtggtgagcagcagcggattggacgagctgcttgctccggatcagcttctggtgtcggggattggcgatttggctgtgcgagaggatattccagagggagcggttgctatggagatggctgccgcaccgcccgcacctgctgatgctgagatgaataccacggtgtgcgtggaagtggaatcggaaggtggcaaggaagggcaggaggcaccgcccgcacctgctggtgccgagatgatgaataccacggtgtccgtggaagtgcaaccggaaggtggcaaggaaaggcaggagagcagcgatgaagagtcagagtcagagagcagtgaggatgacgatgatggctcatcgagtgaggcttccttgagcagcgaagaggagaaagagcatggggttaacaaggatgaggaatcgagtgaagcctcaagcagcgaagaggaagaactggaagttaagaggcatggtggtaaggctggtaacctggagagcctccttgaggaaggggagttgatgatagggagcgatgcggaggagcaaaagggaggcatcaagtccaaatatgaagcagaggtccttccaccagtcccaaaaattgaaatacagttagaaccacatcatcagactcttccagtagggactatttcagctataatgggtgagagagtaattgttgaaggttcagtccaacacaaccccctgaatgagggttcaattctctggataacagaaagtaggacgccacttggtatagttgatgagttgtttggacccgttaagaacccatactaccttgtgcggtacaactctgaggaagaggtacctgctgggatcagtgcaggaaccaatgtctcttttgtagcggactttgcagatcacatcctgaatatgaaggagctctatgcaaaaggctatgatgaatctgatcctgtaggcaatgaagaagaagaagatttacctgatttctctgatgatgaaaaggaggctgagtacaaacggtcattacgtcaagcaaaaaggcggactgatagacagcatgagcctatgaagacttctggtgataggaagagatcacagtctagaggtagtgggatccggaagcccatgccgccaaggaacctggatacatcagcaccaggtcaccagccacggcctcattttcgccgctcagatatggctcgtgcaggtgctgaaaatacagcacattcattgggtcctcaaaatgcacctatgattgctccaaccatgctgcctgctggcacaatgaaccctgctatgccatcacctgttcctcttgcaaatcagatgggtggctgcttcatgaatccagcacagcagcagttcttaccgcaacaacctaatatggtttggcctggtggatttccacagcctcctcatccgaacatgggggtagatggagccgcactcgctgccaacatcatgcagaacctcatagcaggacagtttcagaacccgaacttcggtggcttcccaaaccaaacgccgatgccctttcctcagttcatgccccaaactggaacgcctgcaaatccaatgccattcggtggcagaccaccagtgaactctccatttggtccagtgcctatggggcaaggcaactttggtcagcctccaaattcacaaggatttacaaacctggcggcgccaccccgtggagacggggaacaagattcacccccgcagttcagttctaggcagtttcatcaagggagcccgtcctttggccggggaaggacgcagcagcgcggtggccggcattcctctggcagaggtggcagaggcggccggcatcgcagatag

SEQ ID NO: 4792 - protein, 691 aa, Sorghum bicolor
  misc_feature: Ceres ANNOT ID no. 6040175
  misc_feature (262)..(426): Pfam Id: NAF1 Pfam Desc: NAF1 domain
  misc_feature (163)..(551): NCBI GI: 94732468 NCBI Desc: novel protein containing a naf1 domain [danio rerio]
  misc_feature (161)..(552): NCBI GI: 44981057 NCBI Desc: abr138cp [eremothecium gossypii]
  misc_feature (161)..(552): NCBI GI: 45185368 NCBI Desc: abr138cp [eremothecium gossypii]
  misc_feature (8)..(551): NCBI GI: 54645228 NCBI Desc: ga10257-pa [drosophila pseudoobscura]
  misc_feature (184)..(359): NCBI GI: 42733819 NCBI Desc: similar to dictyostelium discoideum (slime mold). prespore-specific protein (fragment)
MARHPKPPAPPSPPPPPCPPSDSDPGVGFDPIEEWLVDFDPAMSGELAAKGLGAAEQAAAVPHTLVETAAGKSFELEFGVMDEKVEVVSSSGLDELLAPDQLLVSGIGDLAVREDIPEGAVAMEMAAAPPAPADAEMNTTVCVEVESEGGKEGQEAPPAPAGAEMMNTTVSVEVQPEGGKERQESSDEESESESSEDDDDGSSSEASLSSEEEKEHGVNKDEESSEASSSEEEELEVKRHGGKAGNLESLLEEGELMIGSDAEEQKGGIKSKYEAEVLPPVPKIEIQLEPHHQTLPVGTISAIMGERVIVEGSVQHNPLNEGSILWITESRTPLGIVDELFGPVKNPYYLVRYNSEEEVPAGISAGTNVSFVADFADHILNMKELYAKGYDESDPVGNEEEEDLPDFSDDEKEAEYKRSLRQAKRRTDRQHEPMKTSGDRKRSQSRGSGIRKPMPPRNLDTSAPGHQPRPHFRRSDMARAGAENTAHSLGPQNAPMIAPTMLPAGTMNPAMPSPVPLANQMGGCFMNPAQQQFLPQQPNMVWPGGFPQPPHPNMGVDGAALAANIMQNLIAGQFQNPNFGGFPNQTPMPFPQFMPQTGTPANPMPFGGRPPVNSPFGPVPMGQGNFGQPPNSQGFTNLAAPPRGDGEQDSPPQFSSRQFHQGSPSFGRGRTQQRGGRHSSGRGGRGGRHRR

SEQ ID NO: 4793 - DNA, 849 bp, Sorghum bicolor
  misc_feature: Ceres ANNOT ID no. 6040176
  misc_feature: Encodes the peptide sequence at SEQ ID NO 4794
atggcggggaagcacgggcgcaacggctacgacgacgacaacgtcaaccccttcgcgggaggaagtgttccacctgccaccaattctcgtctctcacctctatcacatgaaccggctgatttctacaatgtggacattcctctcgactcatcaaaggatctgaagaaaaaggagaaagaactccaggctatggaggctgagctaaacaaaagagaacgggaattgaaaaggaaggaagaggcagcatcccgagctggcattgtgatagaagagaaaaattggcctcccttttttcccctcatccaccacgacatttccaatgagatacctatccatctacaaaggatgcagtaccttgcattctcgtcattcttgggattggtagcgtgtctcttttggaatatcatagcaactacaacagcatggattaaaggggaaggtgttatgatctggctgcttgccattatctacttcatatctggtgcacctggggcttatgtgttatggtatcgacctctttataatgcaatgagaactgagagcgctttgaagtttgggtggttttttctattttacatgattcatataatcttctgtgtgtgggcagctgtggctcctccattccctttcaaaggaaaatctttggctgggattttacctgcaattgatgtcataagcaagaatgctattgtggggatattttactttgttggatttggcttgttctgccttgaatcacttctgagcatcggtgtcattcagcaagtatacatgtatttccgtggaagtggaaaagctgcagagatgaaacgtgaggcagcacgtagtgctctaagttcagccttctga

SEQ ID NO: 4794 - protein, 282 aa, Sorghum bicolor
  misc_feature: Ceres ANNOT ID no. 6040176
  misc_feature (90)..(264): Pfam Id: SCAMP Pfam Desc: SCAMP family
  misc_feature (1)..(282): NCBI GI: 7109232 NCBI Desc: secretory carrier membrane protein [oryza sativa]
  misc_feature (1)..(281): NCBI GI: 15220305 NCBI Desc: secretory carrier membrane protein (scamp) family protein [arabidopsis thaliana]
  misc_feature (1)..(281): NCBI GI: 3941289 NCBI Desc: similarity to scamp37 [pisum sativum]
  misc_feature (5)..(263): NCBI GI: 115460268 NCBI Desc: os04g0595800 [oryza sativa (japonica cultivar-group)]
  misc_feature (74)..(254): NCBI GI: 32492338 NCBI Desc: osjnba0006a01.24 [oryza sativa (japonica cultivar-group)]
  misc_feature: The plant produces a reduced number of seeds.
  misc_feature: Useful for biocontainment applications
  misc_feature: Functional homolog of the protein sequence given in SEQ ID NO 13043
  misc_feature: Useful for biocontainment applications
  misc_feature: Functional homolog of the protein sequence given in SEQ ID NO 13043
MAGKHGRNGYDDDNVNPFAGGSVPPATNSRLSPLSHEPADFYNVDIPLDSSKDLKKKEKELQAMEAELNKRERELKRKEEAASRAGIVIEEKNWPPFFPLIHHDISNEIPIHLQRMQYLAFSSFLGLVACLFWNIIATTTAWIKGEGVMIWLLAIIYFISGAPGAYVLWYRPLYNAMRTESALKFGWFFLFYMIHIIFCVWAAVAPPFPFKGKSLAGILPAIDVISKNAIVGIFYFVGFGLFCLESLLSIGVIQQVYMYFRGSGKAAEMKREAARSALSSAF

SEQ ID NO: 4795 - DNA, 1914 bp, Sorghum bicolor
  misc_feature: Ceres ANNOT ID no. 6040179
  misc_feature: Encodes the peptide sequence at SEQ ID NO 4796
  misc_feature: Up-regulated in root tissues in response to salicylic acid treatment
  misc_feature: Up-regulated in shoot tissues in response to salicylic acid treatment
atgtcggcggcgatcagaggagccgagttccccggcttccggggcgcggcggcgcagctccccaggtcgcggatgctcgggaggccgatccgggtggcgccacccgccgcggcccagccaggcggcggcggcgcgtccgcgggcagcatacgcgccgtctccgcgcctgcgaagaaggatgcttctgaagttaagcgaagcaaggttgagataataaaggaaaagagcaattttctcaggtaccctttgaacgaggagttggtctcagaggccccaaatatcaacgagagtgctgttcagctgatcaagtttcatgggagctaccagcaaactgatcgggatgtccgtgggcagaagaattactcatttatgctccggacaaagaatccttgtggaaaagttccaaaccaactttatttggctatggatacactagctgatgagtttggaatcggaacactccgcctgacgaccaggcagacattccaattgcacggagttcttaagaagaacttgaagactgttctcagcactgtcataaagaatatgggctcaacattgggcgcttgtggtgatctcaacaggaatgtacttgcacctgcagcaccttatgtcaaaaaggatatcctttttgctcaacaaacagcagagaacattgccacacttcttacaccacagtctggggcttattatgacctgtgggtggatggagaaaagataatgtcagctgaagagcctcctgaggtgacaaaagcccgcaatgacaactcacatggaacaaacttccctgactctcctgagccaatttatggcacccaatatctgccgaggaagttcaaggtcgcagttaccgcggctggtgataactctgttgatattctgaccaatgacataggtgtcgttgttgtttcagatgatgcaggagaacctattggttttaacatctatgttggtggtggcatgggaagaacacaccgagtggaaactacattccctcggctggctgatccgttgggttatgttccgaaagaagatatattatatgctataaaggccatcgtcgtcacacagagggaaaatggaagaagggatgatcgcaagtatagtaggatgaagtatttgattgaccgttggggaatcgacaagtttcgggctgaagttgaaaaatattacgggaagaagttcgaaagtttccgaccattgccagagtggcagtttaacagctaccttggctggcaagaacagggtgatgggaaattattctatggagtgcatgttgataacggtcgtgttggtgggcaagcaaagaaaactctacgagagataatcgagaagtataatttggatgttagtattaccccaaaccaaaatcttattttatgtgggattgatcaggcatggagagaacccattactacagctcttgcccaagctggcctgctggaaccacaggatgttgaccccctgaatttaacttccatggcatgccccgccttgccactatgccctttggcacaaacagaagctgaacgggggatcttacccattcttaaacggattaggacagttttcaacaaggttggtatcaaggattcagagtctgtggttgtgaggataactggctgccctaatggatgtgctagaccatatatggcagagcttggttttgttggtgatggcccaaaaagttaccagatctggctgggtggaacaccaaaccagagtacgctagcagaatcatttatggataaagtgaagcttgatgacattgagaaggttttagaacctctgttttcctattggaatagcacgcgccaggaaggtgaatcttttggaagcttcacaaaccgaacgggattcgacaaattgaaagatgtggtgaacaagtgggcagagtcaccatcagccgcatga

SEQ ID NO: 4796 - protein, 637 aa, Sorghum bicolor
  misc_feature: Ceres ANNOT ID no. 6040179
  misc_feature (214)..(395): Pfam Id: NIR_SIR Pfam Desc: Nitrite and sulphite reductase 4Fe-4S domain
  misc_feature (114)..(182): Pfam Id: NIR_SIR_ferr Pfam Desc: Nitrite/Sulfite reductase ferredoxin-like half domain
  misc_feature (410)..(478): Pfam Id: NIR_SIR_ferr Pfam Desc: Nitrite/Sulfite reductase ferredoxin-like half domain
  misc_feature (1)..(637): NCBI GI: 2653558 NCBI Desc: ferredoxin-sulfite reductase precursor [zea mays]
  misc_feature (63)..(635): NCBI GI: 81052037 NCBI Desc: sulfite reductase, ferredoxin dependent [allium cepa]
  misc_feature (50)..(637): NCBI GI: 3738234 NCBI Desc: sulfite reductase [nicotiana tabacum]
  misc_feature (17)..(630): NCBI GI: 7406463 NCBI Desc: sulphite reductase [arabidopsis thaliana]
  misc_feature (17)..(630): NCBI GI: 804953 NCBI Desc: sulfite reductase [arabidopsis thaliana]
  misc_feature (61)..(625): SWISSPROT Homolog: EC 1.8.7.1 Sulfite reductase [ferredoxin]
  misc_feature: Up-regulated in root tissues in response to salicylic acid treatment
  misc_feature: Up-regulated in shoot tissues in response to salicylic acid treatment
MSAAIRGAEFPGFRGAAAQLPRSRMLGRPIRVAPPAAAQPGGGGASAGSIRAVSAPAKKDASEVKRSKVEIIKEKSNFLRYPLNEELVSEAPNINESAVQLIKFHGSYQQTDRDVRGQKNYSFMLRTKNPCGKVPNQLYLAMDTLADEFGIGTLRLTTRQTFQLHGVLKKNLKTVLSTVIKNMGSTLGACGDLNRNVLAPAAPYVKKDILFAQQTAENIATLLTPQSGAYYDLWVDGEKIMSAEEPPEVTKARNDNSHGTNFPDSPEPIYGTQYLPRKFKVAVTAAGDNSVDILTNDIGVVVVSDDAGEPIGFNIYVGGGMGRTHRVETTFPRLADPLGYVPKEDILYAIKAIVVTQRENGRRDDRKYSRMKYLIDRWGIDKFRAEVEKYYGKKFESFRPLPEWQFNSYLGWQEQGDGKLFYGVHVDNGRVGGQAKKTLREIIEKYNLDVSITPNQNLILCGIDQAWREPITTALAQAGLLEPQDVDPLNLTSMACPALPLCPLAQTEAERGILPILKRIRTVFNKVGIKDSESVVVRITGCPNGCARPYMAELGFVGDGPKSYQIWLGGTPNQSTLAESFMDKVKLDDIEKVLEPLFSYWNSTRQEGESFGSFTNRTGFDKLKDVVNKWAESPSAA

SEQ ID NO: 4797 - DNA, 189 bp, Sorghum bicolor
  misc_feature: Ceres ANNOT ID no. 6040180
  misc_feature: Encodes the peptide sequence at SEQ ID NO 4798
atggcggccactctgaagctcaggatcctcaccgtggccgcggcggccgccgtcatcgcctcgtccctggtcggcacggcctcagcggctgaggggccggcgcccgctccgacgtccggcgcgtccatggccgcgccggctcttgccgctgcgtccttcaccgcacttgtcttcggctacctcttctaa

SEQ ID NO: 4798 - protein, 62 aa, Sorghum bicolor
  misc_feature: Ceres ANNOT ID no. 6040180
  misc_feature (1)..(62): NCBI GI: 115440295 NCBI Desc: os01g0778300 [oryza sativa (japonica cultivar-group)]
  misc_feature (3)..(55): NCBI GI: 115472945 NCBI Desc: os07g0573900 [oryza sativa (japonica cultivar-group)]
  misc_feature: Useful for making plants with altered Lignin content
  misc_feature: Useful for making plants with altered cell wall content and/or composition
  misc_feature: Functional homolog of the protein sequence given in SEQ ID NO 13337
  misc_feature: Functional homolog of the protein sequence encoded by LOCUS at3g13520
  misc_feature: Functional homolog of the protein sequence encoded by LOCUS at4g26320
  misc_feature: Functional homolog of the protein sequence encoded by LOCUS at5g56540
MAATLKLRILTVAAAAAVIASSLVGTASAAEGPAPAPTSGASMAAPALAAASFTALVFGYLF

SEQ ID NO: 4799 - DNA, 897 bp, Sorghum bicolor
  misc_feature: Ceres ANNOT ID no. 6040189
  misc_feature: Encodes the peptide sequence at SEQ ID NO 4800
atggcttcttcaaagaggagaggcggtggtggtgttgccggcggggacaagaaggatctattccatgttgtccacaaggtgcccgccggcgacagcccgtacgtcgtagccaagcacctccagcttgtggagaagcaaccggatatggcaattgtgtggttctggaaggcaatcaactcaggggacagggtcgacagtgccctgaaggacatggccgtggtgatgaagcagcaggatcgttctgaggaggcaatcgaggccatcagatccttcaggcacctttgctccaagcaggctcaagaatccctcgacaacctcctcattgatctctacaagaaatgcgggaaagttgaggaacagattgagcttctgaaacagaagctgaagatgatatacctcggtgaggccttcaacgggaaggcgacaaagaaagcacgatcccatggcaagaagtttcaggtctcaatccaacaagagacgtctcgcattctgggcaatcttggctgggcttacatgcagcagaacaactttgaagccgccgaattggtgtaccgtaaggctcaaactattgaacctgatgccaacagggcgtgcaaccttgggttgtgcctaattaagcagggtaggcacgaggaggcacgacaagcactcgaggatgttcgactacgtagaatctatggatcagaagatgaaaaggtggttgcccgtgctgagcagcttctccgcgaactaaacccattgaagtgtgtttcatcgccgtttgaagttggcctcagtgtccatgaagagatcatgggtaaactagatcttatgatgaatgagtggacgccgttcaggtcaaggaggctgcctgtgtttgaggagatagcaactttccgggaccaaatggcttgttga

SEQ ID NO: 4800 - protein, 298 aa, Sorghum bicolor
  misc_feature: Ceres ANNOT ID no. 6040189
  misc_feature (161)..(194): Pfam Id: TPR_1 Pfam Desc: Tetratricopeptide repeat
  misc_feature (161)..(194): Pfam Id: TPR_2 Pfam Desc: Tetratricopeptide repeat
  misc_feature (14)..(298): NCBI GI: 7211988 NCBI Desc: strong similarity to the beta-9 tubulin gene (178 gene product) gbaf060248. [arabidopsis thaliana]
  misc_feature (31)..(246): NCBI GI: 102139799 NCBI Desc: male sterility protein-related [musa acuminata]
  misc_feature (13)..(259): NCBI GI: 3859112 NCBI Desc: male sterility ms5 [arabidopsis thaliana]
  misc_feature (13)..(259): NCBI GI: 4028970 NCBI Desc: pollenless3 [arabidopsis thaliana]
  misc_feature (26)..(253): NCBI GI: 10176888 NCBI Desc: male sterility ms5; pollenless3 [arabidopsis thaliana]
  misc_feature: Useful for making plants with altered terpenoid content
  misc_feature: GREAT-hit functional homolog of the protein sequence given in SEQ ID NO 13067
  misc_feature: Useful for making plants with altered terpenoid content
  misc_feature: Functional homolog of the protein sequence given in SEQ ID NO 13067
  misc_feature: Useful for biocontainment applications
  misc_feature: Functional homolog of the protein sequence given in SEQ ID NO 13883
MASSKRRGGGGVAGGDKKDLFHVVHKVPAGDSPYVVAKHLQLVEKQPDMAIVWFWKAINSGDRVDSALKDMAVVMKQQDRSEEAIEAIRSFRHLCSKQAQESLDNLLIDLYKKCGKVEEQIELLKQKLKMIYLGEAFNGKATKKARSHGKKFQVSIQQETSRILGNLGWAYMQQNNFEAAELVYRKAQTIEPDANRACNLGLCLIKQGRHEEARQALEDVRLRRIYGSEDEKVVARAEQLLRELNPLKCVSSPFEVGLSVHEEIMGKLDLMMNEWTPFRSRRLPVFEEIATFRDQMAC

SEQ ID NO: 4801 - DNA, 933 bp, Sorghum bicolor
  misc_feature: Ceres ANNOT ID no. 6040192
  misc_feature: Encodes the peptide sequence at SEQ ID NO 4802
atggtggcggcgatcagggtgcccaagacccaacgcgctaggcgggagctcctcaagcatgcgcccaagcttgttgagaccagcaagaagacactgatcctccatggtaccaagactagtgctgtgttgaactctgtgctgtcagatatttaccacctaaagcgtgataatgctgtgaaatataccaagaagaatgataacattaggccttttgaaagtggtggagaatcttctctggaatttttctccctcaagacagactgtagccttatagtgtatggttctcattcaaagaagaggcccaacaatctgattttgggaagaacgtatgaccaccacatatatgaccttgttgaagtaggagttgagaactacaagtcgatggaatcttatgtttatgataagaagctagcaccgaaacttggatcgaagcctttctttgctttcataggggaacactttgagagtgctgaagagctgaaacatttgaaagaagtgctgcttgatctattcaaaggagaggttgtagagaatctaaaccttgctggtgtggatcggatctatgtgtgcactgcaatatctcctactactgtctacataatgcactgtgctctccgcctaaaaaggtcaggtacatctattcctaggatggagctggtcgaagttggaccttcaatggatctggttgtaaggaggcacagacttccagttgaaagcttaaagaaagaagctatgaagactgctgaacatgctaagaagatgaaaaatgtcactaaggatccagtgaagggcaagctgggcaaggtctacatgccagaccagcaggttggaaagttgaccttatcaaacgacgtaaagggtctaaagagggagcgccgcgaagccaagaaaaacaacgaggactcgaagaagcaaaaggtcaaccctgagtaa

SEQ ID NO: 4802 - protein, 310 aa, Sorghum bicolor
  misc_feature: Ceres ANNOT ID no. 6040192
  misc_feature (32)..(233): Pfam Id: Brix Pfam Desc: Brix domain
  misc_feature (1)..(310): NCBI GI: 18202717 NCBI Desc: brix domain containing protein 1 homolog
  misc_feature (128)..(310): NCBI GI: 115464777 NCBI Desc: os05g0506900 [oryza sativa (japonica cultivar-group)]
  misc_feature (8)..(305): NCBI GI: 119568688 NCBI Desc: brix domain containing 1, isoform cra_c [homo sapiens]
  misc_feature (8)..(307): NCBI GI: 19263817 NCBI Desc: brix domain containing 1 [mus musculus]
  misc_feature (8)..(308): NCBI GI: 28461332 NCBI Desc: bxdc1-prov protein [xenopus laevis]
  misc_feature: Useful for making plants with modulated biomass
  misc_feature: Functional homolog of the protein sequence given in SEQ ID NO 13885
MVAAIRVPKTQRARRELLKHAPKLVETSKKTLILHGTKTSAVLNSVLSDIYHLKRDNAVKYTKKNDNIRPFESGGESSLEFFSLKTDCSLIVYGSHSKKRPNNLILGRTYDHHIYDLVEVGVENYKSMESYVYDKKLAPKLGSKPFFAFIGEHFESAEELKHLKEVLLDLFKGEVVENLNLAGVDRIYVCTAISPTTVYIMHCALRLKRSGTSIPRMELVEVGPSMDLVVRRHRLPVESLKKEAMKTAEHAKKMKNVTKDPVKGKLGKVYMPDQQVGKLTLSNDVKGLKRERREAKKNNEDSKKQKVNPE

SEQ ID NO: 4803 - DNA, 1263 bp, Sorghum bicolor
  misc_feature: Ceres ANNOT ID no. 6040194
  misc_feature: Encodes the peptide sequence at SEQ ID NO 4804
  misc_feature: Down-regulated in root tissues in response to methyl jasmonate treatment
  misc_feature: Up-regulated in root tissues in response to aminocyclopropane carboxylic treatment
atgggccgcctccgcgacgggcgagccttcctccaccgcgcgctggtcctctcgtcgctgctgctcctcgcctcgggcgaaatcttcttcgaggagcggttcgatgatggttgggatagccgttgggtgaaatctgattggaagaagagccaaggacaaaccggaaccttcagacacacagcaggaacctattctggagatcctgacgataaaggtatacaaacaactggggatgccaaacattttgctatatcggcaaaattcccagaatttagtaacaaggaccggacattggtgatccagtactctctaaagattgagcaagacattgaatgtggtggtgcttacatcaaacttatgtctggttatctcaaccagaagaagtttggcggcgacactccttacagcttcatgtttgggcctgatatatgtggggatcagaaaaagaagcttcatctcatactttcataccaagggcaaaactaccctatcaagaaagatctaaaatgcgaagcagacaagttgacacatttttacacatttattctaagacctgatgccacttatagcatccttattgataaccgggagagagaatttggaagcatgtacactgactgggatatccttcctcctcgtaagatcaaagatgttaatgcgaaaaagccaaaagactgggatgacagggaatatattgaagatcctgatcaagttaagccagagggatatgattcaattcctaaacagatacctaatccaaaggacaaaaagcctgagtcatgggatgatgacgaagacggtacatggaagcccagaatgatacctaatccagaatacaagggaccatggaagcggaagaaaattaagaatcctaactacaaaggaaaatggaagaccccgtggattgacaatccagagtttgaggatgacccagacctatatgttttgaaacctttgcagtatgtggggattgaagtctggcaggtcaaagctggttcggtttttgacaacattttgatttgcgatgatccagactatgcaagacatgttgtagatgaaacttttgctgcaaataaggaggctgaaaaagaggcctttgaaggagctgaaaggaagaggaaggctagagaagaagaggaagcacggcgagcacgggaggaaggggagagacgaaggcgggagagggatagggaccgtggcagggaccgttacagggatagatataagcgccatagacactacgactaccatgacgagctatag

SEQ ID NO: 4804 - protein, 420 aa, Sorghum bicolor
  misc_feature: Ceres ANNOT ID no. 6040194
  misc_feature (28)..(340): Pfam Id: Calreticulin Pfam Desc: Calreticulin family
  misc_feature (60)..(420): NCBI GI: 115464783 NCBI Desc: os05g0507300 [oryza sativa (japonica cultivar-group)]
  misc_feature (13)..(420): NCBI GI: 92867898 NCBI Desc: concanavalin a-like lectin/glucanase [medicago truncatula]
  misc_feature (1)..(420): NCBI GI: 2052383 NCBI Desc: calreticulin
  misc_feature (3)..(379): NCBI GI: 33517365 NCBI Desc: calreticulin 3 [brassica rapa subsp. pekinensis]
  misc_feature (13)..(402): NCBI GI: 117165712 NCBI Desc: calreticulin-1 [glycine max]
  misc_feature: Down-regulated in root tissues in response to methyl jasmonate treatment
  misc_feature: Up-regulated in root tissues in response to aminocyclopropane carboxylic treatment
MGRLRDGRAFLHRALVLSSLLLLASGEIFFEERFDDGWDSRWVKSDWKKSQGQTGTFRHTAGTYSGDPDDKGIQTTGDAKHFAISAKFPEFSNKDRTLVIQYSLKIEQDIECGGAYIKLMSGYLNQKKFGGDTPYSFMFGPDICGDQKKKLHLILSYQGQNYPIKKDLKCEADKLTHFYTFILRPDATYSILIDNREREFGSMYTDWDILPPRKIKDVNAKKPKDWDDREYIEDPDQVKPEGYDSIPKQIPNPKDKKPESWDDDEDGTWKPRMIPNPEYKGPWKRKKIKNPNYKGKWKTPWIDNPEFEDDPDLYVLKPLQYVGIEVWQVKAGSVFDNILICDDPDYARHVVDETFAANKEAEKEAFEGAERKRKAREEEEARRAREEGERRRRERDRDRGRDRYRDRYKRHRHYDYHDEL

SEQ ID NO: 4805 - DNA, 1389 bp, Sorghum bicolor
  misc_feature: Ceres ANNOT ID no. 6040196
  misc_feature: Encodes the peptide sequence at SEQ ID NO 4806
atgccctccgtcctccaccttctcttgctgctgctcgccgcctcggccgcggcggcagccaccgctggcgctggcgctggcgctggcaccagcggggacccgcgggcgtacgaggcgctgttcgacgcgtggtgcgcggagcacgggaaggcctacgccacgcccgaggagcgcgcggcgcggctggccgtgttcgcggacaacgcggccttcgtcgccgcgcataacgcccgcgtcaacgccgctggtggcggcggcgcgcccccgtcctacacgctcgcgctcaacgccttcgcggacctgacacacgaggagttccgggccgcgcggctcggccgcatcgcggcgggggcggcggcgctccggagccccgccgcgcccgtgtaccggggcctcgacggcggtctgggcgcggtgcccgatgcgctggactggagggagaatggggccgtcaccaaggtcaaggaccaaggcagctgcggagcttgctggagtttttccgctacaggtgctatggaaggaataaacaaaatcaagacaggctctctggtcagtctttctgaacaggaactaattgactgtgacagatcttataatagtggctgtggtggtggcctcatggattatgcttataagtttgtggttaaaaatggtggaattgacacagaggaggactacccctatcgtgaagcagatgggacatgtaacaagaacaagctgaaaaagcgaattgtgacaattgatggttactctgatgtaccttccaacaaagaagatttgttacttcaggctgttgcccagcaaccagttagtgtaggaatatgtggcagcgctagagcatttcaactatactcccagggtatctttgatggtccatgtccaacatctcttgatcatgctgtgctaattgtgggttatggctctgaaggtggcaaggattactggattgtgaaaaactcttggggtgaaagttggggaatgaagggctatatgcatatgcatcgaaacactggtgattccaagggtgtctgcggtataaacatgatggcatcatttcctaccaaatcaagccccaatcctcctccttcaccaggcccaggtccaaccaagtgcagtctgcttacatactgtcctgaaggatccacctgttgttgctcgtggcgtatcttgggcttttgtctttcctggagctgttgtgaactggacaatgcagtttgctgcaaggataacaaatcctgctgccctcatgactatcctgtctgcgatacagatcgcgggctgtgtctcaaggccagcggcaactcttctgctatagaaggaatcaggaggaaacggactttctctaaagctccctcgtggactggcttagtggaattgatggaccattga

SEQ ID NO: 4806 - protein, 462 aa, Sorghum bicolor
  misc_feature: Ceres ANNOT ID no. 6040196
  misc_feature (139)..(354): Pfam Id: Peptidase_C1 Pfam Desc: Papain family cysteine protease
  misc_feature (41)..(106): Pfam Id: Inhibitor_I29 Pfam Desc: Cathepsin propeptide inhibitor domain (I29)
  misc_feature (382)..(430): Pfam Id: Granulin Pfam Desc: Granulin
  misc_feature (40)..(446): NCBI GI: 14600257 NCBI Desc: papain-like cysteine peptidase xbcp3 [arabidopsis thaliana]
  misc_feature (40)..(446): NCBI GI: 18391078 NCBI Desc: cysteine protease, papain-like (xbcp3) [arabidopsis thaliana]
  misc_feature (40)..(430): NCBI GI: 2160175 NCBI Desc: strong similarity to dianthus cysteine proteinase (gbu17135). [arabidopsis thaliana]
  misc_feature (7)..(385): NCBI GI: 34223513 NCBI Desc: oil palm polygalacturonase allergen pest472 [elaeis guineensis]
  misc_feature (8)..(453): NCBI GI: 6682829 NCBI Desc: cysteine protease component of protease-inhibitor complex [zea mays]
MPSVLHLLLLLLAASAAAAATAGAGAGAGTSGDPRAYEALFDAWCAEHGKAYATPEERAARLAVFADNAAFVAAHNARVNAAGGGGAPPSYTLALNAFADLTHEEFRAARLGRIAAGAAALRSPAAPVYRGLDGGLGAVPDALDWRENGAVTKVKDQGSCGACWSFSATGAMEGINKIKTGSLVSLSEQELIDCDRSYNSGCGGGLMDYAYKFVVKNGGIDTEEDYPYREADGTCNKNKLKKRIVTIDGYSDVPSNKEDLLLQAVAQQPVSVGICGSARAFQLYSQGIFDGPCPTSLDHAVLIVGYGSEGGKDYWIVKNSWGESWGMKGYMHMHRNTGDSKGVCGINMMASFPTKSSPNPPPSPGPGPTKCSLLTYCPEGSTCCCSWRILGFCLSWSCCELDNAVCCKDNKSCCPHDYPVCDTDRGLCLKASGNSSAIEGIRRKRTFSKAPSWTGLVELMDH

SEQ ID NO: 4807 - DNA, 1785 bp, Sorghum bicolor
  misc_feature: Ceres ANNOT ID no. 6040198
  misc_feature: Encodes the peptide sequence at SEQ ID NO 4808
atgagcatcaaaagcattaatggaaagagtcccatagtggttggaccttggggagggacaggaggatacccttgggatgacggtgtgtactcaacaatacgccagatcgtgattggccatggtgcagctattgactcaataaggattgagtatgatctgaaaggaaggtcagtttggtcagaaacacgtggaggtactgatggaggttctgaaaccgataaggtgaaactagattttccagatgaagtccttgtgtctgtaagtgggcactatggatctgtttgtgggacaccggtcatcataagatcattgacatttcagagcaacagttcgacgtatggacctttcggcaccgaagatgggacacctttctcacttccagtgagcagcggcaagatcattggatttcatgggcggtctgggtcatatctcaactcaataggtttctacctgaagcaagtgcattttccaaatccgatgaattctccagcttcacctatgagcctcccaagctcacaaagtagaaatggctatggtttcagtggtgatactggacctgacatggttctcgccgtgcgagatagaggcgatagctatgctgtttatgctagcaatcagcccaagcagcaatatacaaacccatcacctgactacaatgatggagcgctctggaacaagatggtttctttccccagttattatggagatacaggagctgcagccatgagcagccctcaaacttatggtccctggggtggaagtggtggcaccatatttgatgacggtgtatacactggtgtgtggcagatcaatttaacacgtgcagtgggaatttcttctattaaggttctgtatgatcgaaatgggcaggcagtatggggtaacaagcatggattcagtggaggtgttatacctgacaagataatatttgatttcccgtcagaggtgttgactcatataaccgggttctatgattcagcaataatcatgggcccaaccgtggtcagatctctaacgtttcacacgaacaagcggacatatggaccatatggggatgagtatggcacatacttctccacaagttttacaaatggaaggatagtaggatttcatggcagggaggggtggtacatcgatggaattggagttcatgttcaggaaggcaaattggcatcacagcgatttgttagcagaccaaagaccgcgactagcccatcggtacagtacaacatgcttgctcaagcgccgagcaatacatatacagacaatgaggttgcttatggcatggtgaaagaaccggttcctatgggaccaggaccatggggtggggagggaggccgggcgtgggacgacggagtttacactggcgtgaagcaaatctacatcatgagaggagcattcatcgggtcgatacagatcgagtatgacaggagtggccactccatctggtcttcaaggcatgggaacagcggccacataacccacagggtcaagctggacttcccgcacgaggtgctgacgtgcgtgtacggctactacaacactaacagggaggacgggccccgggtcctgaggtcgctgacgttcatcaccaacaggggcaagtacgggcctttcggcgacgagttcggatcctacttctcgtcggcgacgacggaggggaaggtggtggggttccacggccggagcgggcagcacctggacgccatcggcgtgcacatgcagcactggctcggggacaggaggcctgcccccaagtacgtgttgtccaagtacctattctga

SEQ ID NO: 4808 - protein, 594 aa, Sorghum bicolor
  misc_feature: Ceres ANNOT ID no. 6040198
  misc_feature (22)..(153): Pfam Id: Jacalin Pfam Desc: Jacalin-like lectin domain
  misc_feature (256)..(387): Pfam Id: Jacalin Pfam Desc: Jacalin-like lectin domain
  misc_feature (446)..(576): Pfam Id: Jacalin Pfam Desc: Jacalin-like lectin domain
  misc_feature (2)..(352): NCBI GI: 115440261 NCBI Desc: os01g0775500 [oryza sativa (japonica cultivar-group)]
  misc_feature (433)..(577): NCBI GI: 62199784 NCBI Desc: agglutinin [castanea crenata]
  misc_feature (433)..(577): NCBI GI: 85376265 NCBI Desc: agglutinin isoform [castanea crenata]
  misc_feature (12)..(150): NCBI GI: 107597846 NCBI Desc: lectin [cycas revoluta]
  misc_feature (252)..(385): NCBI GI: 1883006 NCBI Desc: jasmonate inducible protein [brassica napus]
MSIKSINGKSPIVVGPWGGTGGYPWDDGVYSTIRQIVIGHGAAIDSIRIEYDLKGRSVWSETRGGTDGGSETDKVKLDFPDEVLVSVSGHYGSVCGTPVIIRSLTFQSNSSTYGPFGTEDGTPFSLPVSSGKIIGFHGRSGSYLNSIGFYLKQVHFPNPMNSPASPMSLPSSQSRNGYGFSGDTGPDMVLAVRDRGDSYAVYASNQPKQQYTNPSPDYNDGALWNKMVSFPSYYGDTGAAAMSSPQTYGPWGGSGGTIFDDGVYTGVWQINLTRAVGISSIKVLYDRNGQAVWGNKHGFSGGVIPDKIIFDFPSEVLTHITGFYDSAIIMGPTVVRSLTFHTNKRTYGPYGDEYGTYFSTSFTNGRIVGFHGREGWYIDGIGVHVQEGKLASQRFVSRPKTATSPSVQYNMLAQAPSNTYTDNEVAYGMVKEPVPMGPGPWGGEGGRAWDDGVYTGVKQIYIMRGAFIGSIQIEYDRSGHSIWSSRHGNSGHITHRVKLDFPHEVLTCVYGYYNTNREDGPRVLRSLTFITNRGKYGPFGDEFGSYFSSATTEGKVVGFHGRSGQHLDAIGVHMQHWLGDRRPAPKYVLSKYLF

SEQ ID NO: 4809 - DNA, 381 bp, Sorghum bicolor
  misc_feature: Ceres ANNOT ID no. 6040200
  misc_feature: Encodes the peptide sequence at SEQ ID NO 4810
atggcgactacggaggcggcggcggcgacaccggtggcgccggcagaggggtcggtgatcgcgatccacagcctcgacgagtggagcatccagatcgaggaggccaacagcgccaagaagctggtggtgattgacttcactgctacttggtgtccaccatgccgcatgatagctccagtttttgctgaactggccaagaagcacccaaatgttgttttcctgaaagttgatgttgatgaaatgaagaccattgctgagcaattcagtgttgaggccatgccaacattcctgttcatgagggagggcgacgtcaaggacagggttgtcggcgcagcaaaggaagagctagcaaataagcttcaactgcagatggcccagtag

SEQ ID NO: 4810 - protein, 126 aa, Sorghum bicolor
  misc_feature: Ceres ANNOT ID no. 6040200
  misc_feature (19)..(123): Pfam Id: Thioredoxin Pfam Desc: Thioredoxin
  misc_feature (1)..(125): NCBI GI: 66841002 NCBI Desc: thioredoxin h1 protein [zea mays]
  misc_feature (7)..(125): NCBI GI: 12082335 NCBI Desc: thioredoxin h [oryza sativa (japonica cultivar-group)]
  misc_feature (1)..(126): NCBI GI: 8980491 NCBI Desc: thioredoxin h [triticum aestivum]
  misc_feature (2)..(125): NCBI GI: 16517113 NCBI Desc: thioredoxin h [triticum aestivum]
  misc_feature (2)..(125): NCBI GI: 2995380 NCBI Desc: thioredoxin h [triticum turgidum subsp. durum]
MATTEAAAATPVAPAEGSVIAIHSLDEWSIQIEEANSAKKLVVIDFTATWCPPCRMIAPVFAELAKKHPNVVFLKVDVDEMKTIAEQFSVEAMPTFLFMREGDVKDRVVGAAKEELANKLQLQMAQ

SEQ ID NO: 4811 - DNA, 1149 bp, Sorghum bicolor
  misc_feature: Ceres ANNOT ID no. 6040211
  misc_feature: Encodes the peptide sequence at SEQ ID NO 4812
atggcgcgctcgacctcactgtccgaggcggaggcggggatatcctgcttcgcctcctccctttccggattccgcggcgtcctcaagcaccgatatgccgacttcatcgtccacgaggttgctcgcgacggcgctctcgtccagctcacctcgttcgatctccccaccgagtgcgttgatgtgaatgaggaggataaggcggcgccgtccgctgaagcggaccactcccaggccctcgagtcgttccgttcgctctgcggcgatgccgactgcaacgcattgaagggtctcctggagagggtgtcggctggtggtgacagtgatgtctcgcctgtcattctctcccctgatgctgacaaggctcaccgatcggaggtgcataacttctttaagaagaccttcaagttcctggtcacagacacggtggaacacagtgatggggtccagaggtgcatcagggtgcgtttggggtcaggagcaggtggtggaagaggtggtggcggccgtgggagaggaaggaaacggaagaacatgggtagttctgattggagagatgacacgccatttgatagtagagggtcgagtaattggtcagataatgttgggaagttcctgaggtttcacctgtacaaagagaacaaggacacccaagaagcattaggagtaataggaaaaatgctaggacttcagccacgttcatttgggtttgcagggacaaaggataagcgtgctgttactacacagcaggtaactgttttcaaggtgcaagccagtagattggctgctcttaataatcgtctgtttgggattaaagttggaaacttctgttacgtgaaggagggacttgttcttggacaactcacaggaaatcgatttacaattactctgaggggtgttactgcagaatctgaagacatgataaaaaatgcagtagatggcttaggaaaaaatggatttatcaactactatggtttgcagcgttttggtagtggttcagtaccaacacatcttgttggggctgctttgcttagaggagagtggaaggctgctgtaaacttgattcttgatccaagggaaggagatatcctacaaatattttatatgtgtccaattaggagtttttattcagttctgccagcttttgtttaa

SEQ ID NO: 4812 - protein, 382 aa, Sorghum bicolor
  misc_feature: Ceres ANNOT ID no. 6040211
  misc_feature (168)..(381): Pfam Id: TruD Pfam Desc: tRNA pseudouridine synthase D (TruD)
  misc_feature (2)..(161): NCBI GI: 115440235 NCBI Desc: os01g0773000 [oryza sativa (japonica cultivar-group)]
  misc_feature (187)..(360): NCBI GI: 15620853 NCBI Desc: kiaa1897 protein [homo sapiens]
  misc_feature (196)..(360): NCBI GI: 50511165 NCBI Desc: mkiaa1897 protein [mus musculus]
  misc_feature (196)..(360): NCBI GI: 62859873 NCBI Desc: loc549638 [xenopus tropicalis]
  misc_feature (174)..(363): NCBI GI: 44981577 NCBI Desc: acr136cp [eremothecium gossypii]
MARSTSLSEAEAGISCFASSLSGFRGVLKHRYADFIVHEVARDGALVQLTSFDLPTECVDVNEEDKAAPSAEADHSQALESFRSLCGDADCNALKGLLERVSAGGDSDVSPVILSPDADKAHRSEVHNFFKKTFKFLVTDTVEHSDGVQRCIRVRLGSGAGGGRGGGGRGRGRKRKNMGSSDWRDDTPFDSRGSSNWSDNVGKFLRFHLYKENKDTQEALGVIGKMLGLQPRSFGFAGTKDKRAVTTQQVTVFKVQASRLAALNNRLFGIKVGNFCYVKEGLVLGQLTGNRFTITLRGVTAESEDMIKNAVDGLGKNGFINYYGLQRFGSGSVPTHLVGAALLRGEWKAAVNLILDPREGDILQIFYMCPIRSFYSVLPAFV

SEQ ID NO: 4813 - DNA, 1449 bp, Sorghum bicolor
  misc_feature: Ceres ANNOT ID no. 6040215
  misc_feature: Encodes the peptide sequence at SEQ ID NO 4814
atggtgctcgcggagctgggcgggagcatcgcccgcgcgctgtcgcggatgagcaacgccaccgtggtggacgagaaggtgctcgccgactgcctcaacgagatctgccgcgcgctcctgcaggccgacgtccgcttcgagacggtccgcgacgtcaaggccaacatcaagcgcgtcgtcaacctcgacgcgctcgccgccggcaccaacaagcgccgcatcatacagcaggccgttgtcgatgagatacgcaggatgctggatcccggtaagccgtccttcacccccagcaaggggaagcctaatctggtcatgttcgtcggcttgcagggttctgggaaaaccactacctgcaccaagtatgcagattatcatcggcgtaagggatttaatcctgcactggtttgtgctgatacattccgagctggtgcttttgatcagttgaaacagaatgcaacaaaagccaagataccattctacggaagctacaccgaatcagatcctgtgaaaattgctgttgagggcgtggacatgttcaggaaagaaaagtgtgatctcattattgttgatacaagtggacgccacaagcaggaagctgccctcttcgaagaaatgcgccaagtttcagaagctacaaaaccagacctggtgatattcgttatggatggtagtattggtcaagctgcatttgatcaggcgcaagcgtttaaacagagtgcttcggttggtgctgtgattgttacaaaaatggatggtcatgcgaaaggcgggggtgcacttagtgcggttgcagctacaaaaagccctgtgatatttatcggaactggagaacatattctagactttgaggttttcgaagtgaatccatttgttagccgtctgttgggtatgggtgacttgtctggcttggtgaacaagatccacgaagttattatgcctaataatcagccaccgaatattattggccctcagttggttgaaggaaccttcacactcaggcttctgtatgagatgttccagactctccagagtatgggtcctcttggacaggtcgtctctatgatacctggatttagcgctcagtttattgaaaaaggaaatgagaaggaaggtcaagcaaagattaagcggtacatgacgatgatggactccatgactgatgcagagcttgacgggacaaacccaaagttgatgaaccagtcacgaatcaaccggatcgctcggggatccggcaggctcgtggaggaagtggtccacatgctggaggagtacaagcgaattgccaaaatgtggaagaaactgccgctgccaaccaacaacaggagattaaatacaaaccgcgacataaggcccatagccaatgccattcctccgaatatgttgaatcagcttggtggcttcgttgggctgcagaatatgatgaaacaaatgggcgctcaaagtagatga

SEQ ID NO: 4814 - protein, 482 aa, Sorghum bicolor
  misc_feature: Ceres ANNOT ID no. 6040215
  misc_feature (100)..(296): Pfam Id: SRP54 Pfam Desc: SRP54-type protein, GTPase domain
  misc_feature (329)..(431): Pfam Id: SRP_SPB Pfam Desc: Signal peptide binding domain
  misc_feature (2)..(88): Pfam Id: SRP54_N Pfam Desc: SRP54-type protein, helical bundle domain
  misc_feature (1)..(480): NCBI GI: 1020002 NCBI Desc: signal recognition particle 54 kda subunit [hordeum vulgare]
  misc_feature (1)..(480): NCBI GI: 1020000 NCBI Desc: signal recognition particle 54 kda subunit [hordeum vulgare]
  misc_feature (1)..(479): NCBI GI: 556902 NCBI Desc: 54-kd signal recognition particle (srp) specific protein [lycopersicon esculentum]
  misc_feature (1)..(479): NCBI GI: 92867758 NCBI Desc: gtp-binding signal recognition particle srp54, g-domain [medicago truncatula]
  misc_feature (1)..(479): NCBI GI: 556900 NCBI Desc: 54-kd signal recognition particle (srp) specific protein [lycopersicon esculentum]
MVLAELGGSIARALSRMSNATVVDEKVLADCLNEICRALLQADVRFETVRDVKANIKRVVNLDALAAGTNKRRIIQQAVVDEIRRMLDPGKPSFTPSKGKPNLVMFVGLQGSGKTTTCTKYADYHRRKGFNPALVCADTFRAGAFDQLKQNATKAKIPFYGSYTESDPVKIAVEGVDMFRKEKCDLIIVDTSGRHKQEAALFEEMRQVSEATKPDLVIFVMDGSIGQAAFDQAQAFKQSASVGAVIVTKMDGHAKGGGALSAVAATKSPVIFIGTGEHILDFEVFEVNPFVSRLLGMGDLSGLVNKIHEVIMPNNQPPNIIGPQLVEGTFTLRLLYEMFQTLQSMGPLGQVVSMIPGFSAQFIEKGNEKEGQAKIKRYMTMMDSMTDAELDGTNPKLMNQSRINRIARGSGRLVEEVVHMLEEYKRIAKMWKKLPLPTNNRRLNTNRDIRPIANAIPPNMLNQLGGFVGLQNMMKQMGAQSR

SEQ ID NO: 4815 - DNA, 318 bp, Sorghum bicolor
  misc_feature: Ceres ANNOT ID no. 6040218
  misc_feature: Encodes the peptide sequence at SEQ ID NO 4816
atggatattgaatcggtaaggtgtgcttgctgtagcctcaaagaggactgcacccaggaatacatagacaatgtcaagggcaactttggagggaaatggctctgtggcttatgctcagaggctgtaagggatgaactcagtaaacacaggagcagccaggatggaattgaagaggccgtcaaggctcatatggaattctgcaggatgccgctgtcaagcccagctgtccgggtagctgatggcatgaaggagatgcttaggaggaggtcaggggacaagaggaggccagcaacaccatcaaaggcacacccagcatag

SEQ ID NO: 4816 - protein, 105 aa, Sorghum bicolor
  misc_feature: Ceres ANNOT ID no. 6040218
  misc_feature (1)..(101): NCBI GI: 7715593 NCBI Desc: f20b17.20 [arabidopsis thaliana]
  misc_feature (1)..(95): NCBI GI: 144923428 NCBI Desc: 4fe-4s ferredoxin, iron-sulfur binding [medicago truncatula]
  misc_feature (2)..(89): NCBI GI: 4587551 NCBI Desc: f15i1.18 [arabidopsis thaliana]
MDIESVRCACCSLKEDCTQEYIDNVKGNFGGKWLCGLCSEAVRDELSKHRSSQDGIEEAVKAHMEFCRMPLSSPAVRVADGMKEMLRRRSGDKRRPATPSKAHPA

SEQ ID NO: 4817 - DNA, 1086 bp, Sorghum bicolor
  misc_feature: Ceres ANNOT ID no. 6040228
  misc_feature: Encodes the peptide sequence at SEQ ID NO 4818
atgggagctcagcagagcgtcaacgcagggaaagccaaggtggatatgcaagtcgacctcacccatatgctgtgcgaggcgctgctgctgccgcccctaagaagctctggtgtcactttatcgcaaatcgttggaaggatctctctcaaacacccaaacctctttgggagaagtgagaagttggatgtgatattggataaaggaatcaatgactccaatgttgttgttgcctatagacgcccaaggcctgagtggttatcacagcaatcatttgtaattcagcactcaatgacaccagaagttgccgtccatggattcccggctgataacttcacacgatcagggagcagagggataaaccttagtcgattatcatttggtttggagcttaatgaaccagccacatcaaactggacgtcgggaactagtgttaaatttgagcatatccgtcctattaataatcagggccactccattgccagagaccatgacggctttcctctgacatgcagtggtaacctccatgacaacatgatcatcttgaagcaagaatctggttatgcagatgtcaatgacaatagcttcttaaaagttaacttccaaatggaacaaggattgccacttgtaccaaagtcactgaccttcaatagagttaaatgtgcagtttcaaaaggcattaagttgggtccgacatttttggttactagtttgacaggcggatccattgtgggggacatggcaccatatcaagcttttgccataggcggacttggtagtgtccgaggctatggtgagggtgctgttggttcaggaagactatgtctaattgctaactgtgaatatacagttcccttggtgaagcatctggagggttctattttcatggactgtggcagtgacttaggatctgcccgtcatgttcctggtaatccagctctgcggcaagggaaaccaggatttggtattggatttggatatggacttcacttcaacactaacttaggtcagatccgtgtcgactatgctatgaatgcatttaatcgcaagaccatctactttggaatcaacagtagtggtggctcttag

SEQ ID NO: 4818 - protein, 361 aa, Sorghum bicolor
  misc_feature: Ceres ANNOT ID no. 6040228
  misc_feature (53)..(359): Pfam Id: Bac_surface_Ag Pfam Desc: Surface antigen
  misc_feature (1)..(361): NCBI GI: 56121918 NCBI Desc: at3g44160 [arabidopsis thaliana]
  misc_feature (1)..(357): NCBI GI: 140040345 NCBI Desc: bacterial surface antigen (d15) [medicago truncatula]
  misc_feature (2)..(355): NCBI GI: 23124456 NCBI Desc: cog4775: outer membrane protein/protective antigen oma87 [nostoc punctiforme pcc 73102]
  misc_feature (47)..(355): NCBI GI: 86608254 NCBI Desc: membrane protein, omp85 family [cyanobacteria bacterium yellowstone b-prime]
  misc_feature (230)..(355): NCBI GI: 56750623 NCBI Desc: chloroplastic outer envelope membrane protein homolog [synechococcus elongatus pcc 6301]
MGAQQSVNAGKAKVDMQVDLTHMLCEALLLPPLRSSGVTLSQIVGRISLKHPNLFGRSEKLDVILDKGINDSNVVVAYRRPRPEWLSQQSFVIQHSMTPEVAVHGFPADNFTRSGSRGINLSRLSFGLELNEPATSNWTSGTSVKFEHIRPINNQGHSIARDHDGFPLTCSGNLHDNMIILKQESGYADVNDNSFLKVNFQMEQGLPLVPKSLTFNRVKCAVSKGIKLGPTFLVTSLTGGSIVGDMAPYQAFAIGGLGSVRGYGEGAVGSGRLCLIANCEYTVPLVKHLEGSIFMDCGSDLGSARHVPGNPALRQGKPGFGIGFGYGLHFNTNLGQIRVDYAMNAFNRKTIYFGINSSGGS

SEQ ID NO: 4819 - DNA, 2022 bp, Sorghum bicolor
  misc_feature: Ceres ANNOT ID no. 6040229
  misc_feature: Encodes the peptide sequence at SEQ ID NO 4820
  misc_feature: Down-regulated in shoot tissues in response to salicylic acid treatment
atggccccgaccgcggagccgtcttcgccgccgccgcagcggcgcccccgcacgggcccacccccggggctgaagaacctcggcaacacctgctacctcaacagcgtcctccagtgcctcgcgtccacgccgcccctcgccacgttctgcctcgcctctcgccactccatcctgtgcaagaaggtgttcccgaacagggacaaggagtgcgcgttctgcgtgcttgagctgcagatcgcccggctgcttcgggcggatgcaggggcactcgattccccagcaaaggttatccgctgcatgcccctattcgccgagcacttcaggtgggggcgccaggaggacgcgcacgagttcctccgctatgttgtggatgcctgtcacactgctggcctccgcattcgcaagcggctacctgcagcaggtgccagtggtaactgtggtgaggatggccgggcacaggcggcgtgtctggttatgagggagacatttggcggggcattgttgagtcaagtgaagtgccttgtgtgcaagggagagtctaacaagactgatgagataatggacatcagtctcgatctgcctgggagcagttctgttgctgatgcccttgcccgcttctttcagccggagatattggagggcgcaaacaaatatagctgtgaaagatgtaaaaagctcacctcagcacggaagcaaatgtttatgctgagggcacctaaggtgcttgtcatacaactcaagaggtttgaggggataaatggtggaaagatcaacaggaatatagaattcaaggagatacttggtctttctgattgcatgtacaataaaaataaaaaccaggatccgcaaccagtatataatctttttggttgtatcgtccactcagggctctccccagagtctggtcactactatgcctatgttaaggattctattggtcaatggttttgttgtaacgattctcatgtctccctatcaagctctcagaatgttttgtctgagaaggtctatatcctattttatatactgaattcaaaaactcaaaagcctagtacaaatggttactcttctactgcagttaaacctttcagcaccaatggaattggcatatcaagcacctcatctagtgagacctcgaagatacctttggtaaaacagaatggcatatgttctaccaaagataatgtactgatgcccttgaagaatggaaaaactgcatcaggtccacttatcaagccgattcactttaagaatagcgcagcagaaaaggttatgtcaaatggcaaagtaaacctcacttcaaaaattaatccagaggtcaatgaaactgctaaatcatcagaatcaaatgggtacaagactggacagtttgcgggacccattaaaaataatgctgataatactatttcttgtggagagagaggccaacagtcagaaagaatactgcaggatgcaaatggaaatggccagccaagaacactgcaggatgcaaatggaaatgaccagccaggtcatcattcccagtatcttggtgggaccagtaacggcaatgctatgcccgctcaacaagagaccagtaatggcaatgccacgccctctcaacaagagaccagtaatggaaatgccatgcccactcaacaagagaccagtaatggcaatgccacgcctgctcaacaggagatcagtaatggcaaggcctcacatgctgaacaatattctgaccagtcatctcatgcaaactcttcaggaaacaaacgccaatttgaagaagataagctcgctaagtcagctaattctgagcttcggctgtctgtatggatggatgatgtctacaattttatgcgctcgcaaaagaggcgtcggattcaaagttcagacatttctcaagattttgatacaatgagaaagcagctagcatcagatgctagaatatttaggtcaaaagttccggagtcactgatagacaatctcatcaaacgtctgagatcatactttgagggcaaatattcaccaaatgcctag

SEQ ID NO: 4820 - protein, 673 aa, Sorghum bicolor
  misc_feature: Ceres ANNOT ID no. 6040229
  misc_feature (19)..(341): Pfam Id: UCH Pfam Desc: Ubiquitin carboxyl-terminal hydrolase
  misc_feature (1)..(496): NCBI GI: 115464817 NCBI Desc: os05g0510300 [oryza sativa (japonica cultivar-group)]
  misc_feature (13)..(670): NCBI GI: 60543331 NCBI Desc: at3g14400 [arabidopsis thaliana]
  misc_feature (13)..(670): NCBI GI: 18086363 NCBI Desc: at3g14400/mln21_18 [arabidopsis thaliana]
  misc_feature (70)..(648): NCBI GI: 124056592 NCBI Desc: ubiquitin carboxyl-terminal hydrolase 36 (ubiquitin thioesterase 36) (ubiquitin-specific-processing protease 36) (deubiquitinating enzyme 36)
  misc_feature (70)..(648): NCBI GI: 47940448 NCBI Desc: usp36 protein [homo sapiens]
  misc_feature: Down-regulated in shoot tissues in response to salicylic acid treatment
MAPTAEPSSPPPQRRPRTGPPPGLKNLGNTCYLNSVLQCLASTPPLATFCLASRHSILCKKVFPNRDKECAFCVLELQIARLLRADAGALDSPAKVIRCMPLFAEHFRWGRQEDAHEFLRYVVDACHTAGLRIRKRLPAAGASGNCGEDGRAQAACLVMRETFGGALLSQVKCLVCKGESNKTDEIMDISLDLPGSSSVADALARFFQPEILEGANKYSCERCKKLTSARKQMFMLRAPKVLVIQLKRFEGINGGKINRNIEFKEILGLSDCMYNKNKNQDPQPVYNLFGCIVHSGLSPESGHYYAYVKDSIGQWFCCNDSHVSLSSSQNVLSEKVYILFYILNSKTQKPSTNGYSSTAVKPFSTNGIGISSTSSSETSKIPLVKQNGICSTKDNVLMPLKNGKTASGPLIKPIHFKNSAAEKVMSNGKVNLTSKINPEVNETAKSSESNGYKTGQFAGPIKNNADNTISCGERGQQSERILQDANGNGQPRTLQDANGNDQPGHHSQYLGGTSNGNAMPAQQETSNGNATPSQQETSNGNAMPTQQETSNGNATPAQQEISNGKASHAEQYSDQSSHANSSGNKRQFEEDKLAKSANSELRLSVWMDDVYNFMRSQKRRRIQSSDISQDFDTMRKQLASDARIFRSKVPESLIDNLIKRLRSYFEGKYSPNA

SEQ ID NO: 4821 - DNA, 780 bp, Sorghum bicolor
  misc_feature: Ceres ANNOT ID no. 6040237
  misc_feature: Encodes the peptide sequence at SEQ ID NO 4822
atgccgctgccgccgctgctgcaccctccactgtcgctgcgccttcaccttctcctccgctcccaatccctaacccctctcctcaggcgaggatccagctgcgatgcgccgcccctttgcgggaccaggaggtacatctccgttcgcgcctccgttgcacagctcggggtggaggaggcggtggtgggcttcgtcgccggtaagaggaaggccaccgaggtagcccacgcggtgtggagaaatattgttcaaaaaggggatacggtggttgatgccacatgcgggaatggcaatgacacgctcgctctgcttaagatggtggctgatgaaacagcgcaaggacgtgtttatgggatggacattcaagattccgcaatagagagtacttcctcttttctgaaaatgtccgtggatgatgaccatcagcgaggactagtaaaactatttcctatatgtcatagtagaatggaagaaattgttcccaaagatgctcctgtcaggcttgttgctttcaacttgggataccttccaggaggagataaaactgtaatcacagtgcctaggacaactgagctagcattgcaagctgccagcaaacttctcagttctgggggactcataagtgttcttgtctacattgggcatccaggtggaagggatgaactcgatgttgttgaatcatttgcatcaagccttcctgtggacacctgggcgacctgcaaacttcaaatgctcaataggccaattgctccagtactcatacttctgaacaagaaatga

SEQ ID NO: 4822 - protein, 259 aa, Sorghum bicolor
  misc_feature: Ceres ANNOT ID no. 6040237
  misc_feature (115)..(259): Pfam Id: rRNA_methylase Pfam Desc: Putative rRNA methylase
  misc_feature (3)..(259): NCBI GI: 115464835 NCBI Desc: os05g0511700 [oryza sativa (japonica cultivar-group)]
  misc_feature (103)..(259): NCBI GI: 4966367 NCBI Desc: similar to gi2293301 ytqb from bacillus subtilis sequence gbaf008220. [arabidopsis thaliana]
  misc_feature (75)..(259): NCBI GI: 16411098 NCBI Desc: lmo1662 [listeria monocytogenes]
  misc_feature (73)..(259): NCBI GI: 15836518 NCBI Desc: rrna methylase [chlamydophila pneumoniae j138]
  misc_feature (71)..(259): NCBI GI: 116102563 NCBI Desc: sam-dependent methyltransferase [pediococcus pentosaceus atcc 25745]
MPLPPLLHPPLSLRLHLLLRSQSLTPLLRRGSSCDAPPLCGTRRYISVRASVAQLGVEEAVVGFVAGKRKATEVAHAVWRNIVQKGDTVVDATCGNGNDTLALLKMVADETAQGRVYGMDIQDSAIESTSSFLKMSVDDDHQRGLVKLFPICHSRMEEIVPKDAPVRLVAFNLGYLPGGDKTVITVPRTTELALQAASKLLSSGGLISVLVYIGHPGGRDELDVVESFASSLPVDTWATCKLQMLNRPIAPVLILLNKK

SEQ ID NO: 4823 - DNA, 1461 bp, Sorghum bicolor
  misc_feature: Ceres ANNOT ID no. 6040245
  misc_feature: Encodes the peptide sequence at SEQ ID NO 4824
atgggtgagcggcggtacaccgagcaggaggaggccctcgagatcaagtccctccgccgcatcatcgccgcctacgccaactatcaagatgctgcagaaagggatgtcaagagatatgagcggtcattcaaaatgcttcctcccgcgcacaaggaacttcttttccaccttggtctgaagtaccaaagactgagatggtgtatatccatgaatgcatcttttatcatgaacatgcttgaggcatttgaacctccttttgacatgagtcagtatgtagatgctgatccatcgaacttgcatgaccatagtcatatgggttgcactcattccagcgagaggggtgattgctctataatttctatctccagaagcaatttgtcattggatgagcagcatgatagtcccaaagaagataccaagacacatgaatcttcaagagaaactgataataagaagggtggggaagatctcatggcaggctgctcccagcctgttggcaacatggggatgtctcaaggtgcaggcattgcatgtaatggtgataaagatatgagtggagcagcttattgcctggataaagatgtctctgcatcttctgtaacaccgcggcactgcacagcttcattgttcaagttgaatgttcctccaattgatgttgacaaggtaagatgcatagtaagaaatatcgtgagagattggggcgaggagggtcaaaaggaacgtgatgagtgctataagcccattctcgaggagcttaatcgtctttttcctaaccggagtgatcagaggcctccttcatgtcttgtccctggtgctgggcttgggagattggctcttgagatatcttctctgggttttgtaagccaagggaatgaattctcatactacatgctgatctgttcaaatttcatcttgaaccacactcaagaggctaatgaatggaccatatatccttggatacacagcaactgcaattctctttcagacaacgatcaacttcgtcctgtttcatttcctgatattcatccctcaagtgcaggtatcacagagggattttcaatgtgtgctggggactttgtagaggtctacagtgaggaaagccaagaatctgcatgggatgctgttgtaacttgcttcttccttgacacggcacacaatattgttgaatatatcgagatcatatcaaaagttctgaaggatggtggggtctggattaacttgggtccccttctatatcactttgctgattcatatgggccagatgatgatatgtctatcgaattaagtttggaagatgtgaaaaaagttgcttaccattatggatttacaatggaggtggagaaaatgatagaaactacttacacttcaaacatgaaagcaatgatgcagaatcggtaccatgcagcattctggacaatgaggaaggatgcatctcggtcaaaagcttgtaagccccgttga

SEQ ID NO: 4824 - protein, 486 aa, Sorghum bicolor
  misc_feature: Ceres ANNOT ID no. 6040245
  misc_feature (208)..(477): Pfam Id: N2227 Pfam Desc: N2227-like protein
  misc_feature (218)..(475): NCBI GI: 22748889 NCBI Desc: chromosome 9 open reading frame 41 [homo sapiens]
  misc_feature (218)..(475): NCBI GI: 119582971 NCBI Desc: chromosome 9 open reading frame 41, isoform cra_c [homo sapiens]
  misc_feature (218)..(474): NCBI GI: 119582969 NCBI Desc: chromosome 9 open reading frame 41, isoform cra_a [homo sapiens]
  misc_feature (188)..(475): NCBI GI: 116132390 NCBI Desc: ensangp00000007572 [anopheles gambiae str. pest]
  misc_feature (213)..(475): NCBI GI: 18543255 NCBI Desc: cg11596-pa, isoform a [drosophila melanogaster]
MGERRYTEQEEALEIKSLRRIIAAYANYQDAAERDVKRYERSFKMLPPAHKELLFHLGLKYQRLRWCISMNASFIMNMLEAFEPPFDMSQYVDADPSNLHDHSHMGCTHSSERGDCSIISISRSNLSLDEQHDSPKEDTKTHESSRETDNKKGGEDLMAGCSQPVGNMGMSQGAGIACNGDKDMSGAAYCLDKDVSASSVTPRHCTASLFKLNVPPIDVDKVRCIVRNIVRDWGEEGQKERDECYKPILEELNRLFPNRSDQRPPSCLVPGAGLGRLALEISSLGFVSQGNEFSYYMLICSNFILNHTQEANEWTIYPWIHSNCNSLSDNDQLRPVSFPDIHPSSAGITEGFSMCAGDFVEVYSEESQESAWDAVVTCFFLDTAHNIVEYIEIISKVLKDGGVWINLGPLLYHFADSYGPDDDMSIELSLEDVKKVAYHYGFTMEVEKMIETTYTSNMKAMMQNRYHAAFWTMRKDASRSKACKPR

SEQ ID NO: 4825 - DNA, 1473 bp, Sorghum bicolor
  misc_feature: Ceres ANNOT ID no. 6040246
  misc_feature: Encodes the peptide sequence at SEQ ID NO 4826
atgcatccttacattcagatacacaccattgttctctgcatcatcatatccagcttcttcatcagctgcaatgcagaagataccagaccaccccagacccagagcagcctggttcttggccttagccatatcagatctctgtataccccatccatggcacttgtgaactccacaagctatgacttcttggacatcatagagccagtgacagcatacacagacggctacctgctgtccctgaaccttggcactcccccacaggtgttccaagtgtacttggacacagggagtgacctcacctgggtcccctgtggcagcagcagcagctaccagtgcctggattgtgggtcctccgtgaagccgactccgacgttcctgccgtcagaatccacgtcgaacacgagggacctctgcgggagccgcttctgcgtcgacgtccacagctccgacaacaggttcgacccgtgcgcggcggcggggtgcgccatcccggccttcacgggcggccagtgccccagaccttgccctccgttctcctacacctacggcggcggagcactggtcctcggctccctctccagggactccgtgacgctccatggaagcacacacggcagcggcgccggcgccggccctctccccgtggccttccctggcttcggcttcggctgcgtgggcagctccatcagggagccgctcggcatcgccgggttcggcaggggcgccctgtccctgccgtcccagctcgggttcctcggcaagggcttctcccactgcttcctcggcttccggttcgcgaggaaccccaacttcaccagcccgctggtgatgggcgacctcgcgctgtcgtcggcgtcgacggacggcggcttcgtcttcaccccgatgctgacgagcgccacgtacccgaacttctactacgtcggcctggagggtgtcgtcctcggagacgacgacggcggctccgccatggccgcacctcccagcctgagcggcatcgacgcgcagggcaacggcggggtgctggtggacaccgggacgacgtacacgcagctgccggacccgttctacgcgtcggtgctggcgtcgctcatctccgccgcgccgccgtacgagaggtcccgcgacctggaggcgaggacggggttcgacctctgcttcaaggtcccctgcgcgcgcgccccgtgcgcggacgacgagctgccgccgatcaccctccacctcgccggcggcgccaggctggcgctgcccaagctgagcagctactaccccgtgaccgccatcagggactccgtggtcgtcaagtgcctgctgttccagaggatggaaatggaagacgacggcgatggcacgagcggcggcgggccggcggcggtgctgggcagcttccagatgcagaacgtggaggtcgtgtacgatctcgcggcggggcgtgtcgggttccgtccgagggactgcgcgcttcacgcctag

SEQ ID NO: 4826 - protein, 490 aa, Sorghum bicolor
  misc_feature: Ceres ANNOT ID no. 6040246
  misc_feature (75)..(484): Pfam Id: Asp Pfam Desc: Eukaryotic aspartyl protease
  misc_feature (6)..(490): NCBI GI: 9758987 NCBI Desc: chloroplast nucleoid dna-binding protein-like [arabidopsis thaliana]
  misc_feature (11)..(487): NCBI GI: 92872092 NCBI Desc: peptidase aspartic, active site [medicago truncatula]
  misc_feature (68)..(487): NCBI GI: 18377815 NCBI Desc: at4g16560/dl4305c [arabidopsis thaliana]
  misc_feature (68)..(453): NCBI GI: 38605896 NCBI Desc: osjnbb0020o11.8 [oryza sativa (japonica cultivar-group)]
  misc_feature (68)..(453): NCBI GI: 115459640 NCBI Desc: os04g0535200 [oryza sativa (japonica cultivar-group)]
MHPYIQIHTIVLCIIISSFFISCNAEDTRPPQTQSSLVLGLSHIRSLYTPSMALVNSTSYDFLDIIEPVTAYTDGYLLSLNLGTPPQVFQVYLDTGSDLTWVPCGSSSSYQCLDCGSSVKPTPTFLPSESTSNTRDLCGSRFCVDVHSSDNRFDPCAAAGCAIPAFTGGQCPRPCPPFSYTYGGGALVLGSLSRDSVTLHGSTHGSGAGAGPLPVAFPGFGFGCVGSSIREPLGIAGFGRGALSLPSQLGFLGKGFSHCFLGFRFARNPNFTSPLVMGDLALSSASTDGGFVFTPMLTSATYPNFYYVGLEGVVLGDDDGGSAMAAPPSLSGIDAQGNGGVLVDTGTTYTQLPDPFYASVLASLISAAPPYERSRDLEARTGFDLCFKVPCARAPCADDELPPITLHLAGGARLALPKLSSYYPVTAIRDSVVVKCLLFQRMEMEDDGDGTSGGGPAAVLGSFQMQNVEVVYDLAAGRVGFRPRDCALHA

SEQ ID NO: 4827 - DNA, 507 bp, Sorghum bicolor
  misc_feature: Ceres ANNOT ID no. 6040248
  misc_feature: Encodes the peptide sequence at SEQ ID NO 4828
atggctgccttgccattggccaccgctgaagtatgcgatgctaatcctcatctgattatgaacggcgagctccgtgctctccagcccatcttccaaatctacggaaggcgccaggtttttgccggccctattgtcacactgaaggtctatgaggacaatgtcctgatccgcgagttccttgaggagaaaggccacgggagggtccttgtggttgacggtggtgggagcatgcgctgtgccattcttggtggcaaccccgtccagcaggcacagaacaatgggtgggctggtattctggtcaatggctgcatcagggatgtcgatgagatcaatggctgcgacattggtgtacgagctctgaactcgcaccctatgaaggcaaacaagaaggggatgggggagaagcatgtccctgtcaacattgctggaaccaggatttacgatggcgagtggctctacgccgatacggatggcattcttgtctcgaggacggaactgactgtgtag

SEQ ID NO: 4828 - protein, 168 aa, Sorghum bicolor
  misc_feature: Ceres ANNOT ID no. 6040248
  misc_feature (4)..(161): Pfam Id: Methyltransf_6 Pfam Desc: Demethylmenaquinone methyltransferase
  misc_feature (1)..(168): NCBI GI: 46805895 NCBI Desc: s-adenosylmethionine:2-demethylmenaquinone methyltransferase-like [oryza sativa (japonica cultivar-group)]
  misc_feature (6)..(168): NCBI GI: 92889308 NCBI Desc: dimethylmenaquinone methyltransferase [medicago truncatula]
  misc_feature (1)..(148): NCBI GI: 115439647 NCBI Desc: os01g0722800 [oryza sativa (japonica cultivar-group)]
  misc_feature (1)..(168): NCBI GI: 46805897 NCBI Desc: s-adenosylmethionine:2-demethylmenaquinone methyltransferase-like [oryza sativa (japonica cultivar-group)]
  misc_feature (6)..(168): NCBI GI: 21537415 NCBI Desc: s-adenosylmethionine:2-demethylmenaquinone methyltransferase-like protein [arabidopsis thaliana]
MAALPLATAEVCDANPHLIMNGELRALQPIFQIYGRRQVFAGPIVTLKVYEDNVLIREFLEEKGHGRVLVVDGGGSMRCAILGGNPVQQAQNNGWAGILVNGCIRDVDEINGCDIGVRALNSHPMKANKKGMGEKHVPVNIAGTRIYDGEWLYADTDGILVSRTELTV

SEQ ID NO: 4829 - DNA, 1314 bp, Sorghum bicolor
  misc_feature: Ceres ANNOT ID no. 6040250
  misc_feature: Encodes the peptide sequence at SEQ ID NO 4830
atgagccaccggagacgatctcgcgctgccggctcgccgcctggcgacgccggtccggcccctacgccggagaagtcggggcggattcagccgagggcggtgttggggtcggaccggagggtgctggcgctcgcgctggcgttccgcgcagccaacgcgctgctcgtgcgcacctacttcaaccccgacgagcactggcagtgcctcgaggtcgcccaccgcgtcgccttcgggtatggtcaccttacatgggagtggaagcgggggctgcgaagttacctccacccgttgatctttgctgcgctctacaagatcctggcgctactccacctagacactccatgggttatgttattttcccagttggttaactggttcatgtttttctgtatcacgcggactctatcaaacagcttggagactgttttgactgtggctggactctattactggtttactgcaatagagtcttccaaggcaacctcaatcgtttcaaagcagcatgctgtctgtgaacaaagtgcctcatcaagaaaagtggctcttctgatagcagccttgtcctgtgccattcgaccaacaagtgctgtaacatggctatatgttggtcttttggattttattcagatgaaatcaaaatgtcgttttgtccttcttgatgtcattccaataggggccattgtccttgcagtaacaacactccttgattggtggatgtttggttcccgtgttatagtaccacttaattttttgaaattcaacctcttctcttcgggaggagactactatggaacacatgtcttccactggtactttacacagggttttccatccatgatttggacattcttaccatttgcaatgtacggtattgtaaagtctcgggaatggagactttcaggtctaattgcttgggtattaggggtttacagcatacttggacacaaagaattcagatttgttcttccggtgctacctttagcattgatgttctcaggttactgcttagctgccatgtcacaactcaaggccaaaaatcagcatgggaaaagaagcctttcaaggttgcaactttctgttattcttcttgtcataaccaatgttcccatgtccttatatatgtccttattccatcaaaggggaacagaagatgttatgtattatttgtcaaaagaagcccatgatggaagagtgaagagtgtcctctttctcatgccttgtcactcaacaccttactactcaaccttacattacgatctacctatgcgctttttggactgcactcctaggtggttattttctttgttcttttga

SEQ ID NO: 4830 - protein, 437 aa, Sorghum bicolor
  misc_feature: Ceres ANNOT ID no. 6040250
  misc_feature (40)..(417): Pfam Id: Glyco_transf_22 Pfam Desc: Alg9-like mannosyltransferase family
  misc_feature (81)..(429): NCBI GI: 52077509 NCBI Desc: dolichyl-phosphate-mannose-glycolipid alpha-mannosyltransferase-like [oryza sativa (japonica cultivar-group)]
  misc_feature (1)..(429): NCBI GI: 9755753 NCBI Desc: dolichyl-phosphate-mannose--glycolipid alpha-mannosyltransferase-like protein [arabidopsis thaliana]
  misc_feature (115)..(429): NCBI GI: 119597886 NCBI Desc: phosphatidylinositol glycan, class b [homo sapiens]
  misc_feature (115)..(429): NCBI GI: 17389331 NCBI Desc: phosphatidylinositol glycan, class b [homo sapiens]
  misc_feature (115)..(429): NCBI GI: 62898221 NCBI Desc: phosphatidylinositol glycan, class b variant [homo sapiens]
MSHRRRSRAAGSPPGDAGPAPTPEKSGRIQPRAVLGSDRRVLALALAFRAANALLVRTYFNPDEHWQCLEVAHRVAFGYGHLTWEWKRGLRSYLHPLIFAALYKILALLHLDTPWVMLFSQLVNWFMFFCITRTLSNSLETVLTVAGLYYWFTAIESSKATSIVSKQHAVCEQSASSRKVALLIAALSCAIRPTSAVTWLYVGLLDFIQMKSKCRFVLLDVIPIGAIVLAVTTLLDWWMFGSRVIVPLNFLKFNLFSSGGDYYGTHVFHWYFTQGFPSMIWTFLPFAMYGIVKSREWRLSGLIAWVLGVYSILGHKEFRFVLPVLPLALMFSGYCLAAMSQLKAKNQHGKRSLSRLQLSVILLVITNVPMSLYMSLFHQRGTEDVMYYLSKEAHDGRVKSVLFLMPCHSTPYYSTLHYDLPMRFLDCTPRWLFSLFF

SEQ ID NO: 4831 - DNA, 1317 bp, Sorghum bicolor
  misc_feature: Ceres ANNOT ID no. 6040254
  misc_feature: Encodes the peptide sequence at SEQ ID NO 4832
atggcagcagcagccgtcgcctccagttccacgccgcggccgctccgcttggcgcagcgcggggcgctcgcaccccaccacgtcagcgccccgccgccccgctcccgcaggccgcggctcgccgtctgtgcctcggccggcgtggagacggagaccaccagcgggtccgggcggttctacttcaacttcaccgggttccccttcccgctcggcccgttcctcaaccgccgcaccatccgcaccgaggccgtgaagggcagcatatggctgttcgagcaggagcaggcgctgggattcagcagcgtctccaccaacacccgcatgaccgtcatcaagctcaagtccggtgggctctgggtgcacgcgcccatcgcgcccaccaaggagtgcatccagctgctcaaggagctggacgcgccggtggagcacatcgtgctgccgaccttcgcgtacgagcacaaaatcttcgtcgggcccttctccaggaagttccccaaggctcagatatgggtggcgcccaggcagtggagctggccaatcaacctgccgctcgagttcttcgggatcttccgggccaagccgctcaaagatgaggatgacgccacgccctgggccgtcgaaatcgagcagaaggtgctcagctctccggaagttgggattgggccgtatgtggaggtggcgttctaccataagtcttcacggacactactggtgaccgatgctgtcatctttgttcctcaacagccaccggagtgtatcagcaaagaatctctgttggcatctgcgaagaatggactggcagtgaaactattaagcaaagggaaggaggttcctgacgaaccagttgttgacaataagctaaaccggcagaaagggtgggagagaatggtgcttcaaatactatttcttggtccgtcaaatctgcttgagccaaatgcaagttttgctcaaatgtcgcaaaaattgattgtctcaccaattgtcaagacactcgttttcagcaaagttccagagaaggtgagggactgggttgacaggattgctgcggactggcgattccgacggataatcccttgccacttcgcagccccaatcaacgcgagtcggtcagactttctggccgcctttgccttcctcgacgagttcctccccgagcgcgctgccagggcgcccggtctctcactgctcttcgcctccttcatggggaaggcagccagctacttccctccggacgacatgaagacgctctcgtccctagacgagttcttggtctctgttggcgctgtcaagaaaaccgtctctggacggaagaggtga

SEQ ID NO: 4832 - protein, 438 aa, Sorghum bicolor
  misc_feature: Ceres ANNOT ID no. 6040254
  misc_feature (62)..(312): NCBI GI: 33240507 NCBI Desc: uncharacterized protein [prochlorococcus marinus subsp. marinus str. ccmp1375]
  misc_feature (108)..(250): NCBI GI: 2394396 NCBI Desc: orfr [methylobacterium extorquens]
  misc_feature (83)..(242): NCBI GI: 78695508 NCBI Desc: similar to short-chain dehydrogenases of various substrate specificities [bradyrhizobium sp. btai1]
  misc_feature: The plant flowers significantly late compared to wild-type.
  misc_feature: Useful for making plants with modulated flowering time
  misc_feature: GREAT-hit functional homolog of the protein sequence given in SEQ ID NO 13135
  misc_feature: Useful for making plants with modulated flowering time
  misc_feature: Functional homolog of the protein sequence given in SEQ ID NO 13135
MAAAAVASSSTPRPLRLAQRGALAPHHVSAPPPRSRRPRLAVCASAGVETETTSGSGRFYFNFTGFPFPLGPFLNRRTIRTEAVKGSIWLFEQEQALGFSSVSTNTRMTVIKLKSGGLWVHAPIAPTKECIQLLKELDAPVEHIVLPTFAYEHKIFVGPFSRKFPKAQIWVAPRQWSWPINLPLEFFGIFRAKPLKDEDDATPWAVEIEQKVLSSPEVGIGPYVEVAFYHKSSRTLLVTDAVIFVPQQPPECISKESLLASAKNGLAVKLLSKGKEVPDEPVVDNKLNRQKGWERMVLQILFLGPSNLLEPNASFAQMSQKLIVSPIVKTLVFSKVPEKVRDWVDRIAADWRFRRIIPCHFAAPINASRSDFLAAFAFLDEFLPERAARAPGLSLLFASFMGKAASYFPPDDMKTLSSLDEFLVSVGAVKKTVSGRKR

SEQ ID NO: 4833 - DNA, 1158 bp, Sorghum bicolor
  misc_feature: Ceres ANNOT ID no. 6040263
  misc_feature: Encodes the peptide sequence at SEQ ID NO 4834
atgtcgcgtctcctcctccgccaccttctcccaggggtgcagagcggcgccagccaccccttcgccgccgccgcctcttcccgttctgcgtcgtcccgggccgcctcctcccgctcctcatacacttcccggttcgcccctcccgcctaccacgcctccgccacggccgcggcagcccaatcggagggttcggcggcggcggccgccgagtccacacccgcagcgggcgcccagccctcaccgacgccgccccccgcggcgcgcgggcggtggggcctgctcaagttcggcgccttggcggcagtcgccggggccatcggcggcgtcggatacgccagctgcgcctattcgctgaatgaagtggcggagaagacgagagagttcaggaagaacccagcaccgctcatccctgaggatgcctccacgctcgagaagtataaggctatggtgtactcgacggctatgaaagttcctgtttccgctatagagctgtacttggatattaggagcacaattgaagaccatgtcaggggatttactgaacccacatcagacaaactgctaccagatctacttcctcaagatcagcatgtcttcaccctagttcttgatctgaatgaaactcttgtctactctgattggcagcgtgagagaggatggagaacttttaagaggccaggagttgatgcttttctggaacatatgtcaaaattatatgaagttgttgtgtattctgatcagccacctatgtatgttgaacctgtgtttgagaggctgaactcaaggggtaccatttcacacaggttatcaagacctgcaactaagtacgtggatggaaaacattatcgggatttgtcaaagttgaacagaaaccctgctcaagttatctatctcagtgcccatgctcttgaatcttgcttgcagcatgacaattgtgttcaaatcaagccttttaaacttgaagataaatatgatacccaactgttggatctcattccatttctcgagtatgttgccatggctagaccttctgacattaggacagtgttagcatcttatcaaggtcatgatgttgctgctgagtttattgagcgttcaaaggaacaccagcggcgtatgcaggaacagagcaaacttgggcgcttatggcgacgatga

SEQ ID NO: 4834 - protein, 385 aa, Sorghum bicolor
  misc_feature: Ceres ANNOT ID no. 6040263
  misc_feature (190)..(352): Pfam Id: NIF Pfam Desc: NLI interacting factor-like phosphatase
  misc_feature (24)..(371): NCBI GI: 115464851 NCBI Desc: os05g0513200 [oryza sativa (japonica cultivar-group)]
  misc_feature (33)..(371): NCBI GI: 8778307 NCBI Desc: f14j16.15 [arabidopsis thaliana]
  misc_feature (46)..(283): NCBI GI: 20804683 NCBI Desc: p0512c01.26 [oryza sativa (japonica cultivar-group)]
  misc_feature (172)..(378): NCBI GI: 145345073 NCBI Desc: mpt family transporter: inner membrane translocase (import) tim50 [ostreococcus lucimarinus cce9901]
  misc_feature (165)..(378): NCBI GI: 83305920 NCBI Desc: import inner membrane translocase subunit tim50, mitochondrial precursor
MSRLLLRHLLPGVQSGASHPFAAAASSRSASSRAASSRSSYTSRFAPPAYHASATAAAAQSEGSAAAAAESTPAAGAQPSPTPPPAARGRWGLLKFGALAAVAGAIGGVGYASCAYSLNEVAEKTREFRKNPAPLIPEDASTLEKYKAMVYSTAMKVPVSAIELYLDIRSTIEDHVRGFTEPTSDKLLPDLLPQDQHVFTLVLDLNETLVYSDWQRERGWRTFKRPGVDAFLEHMSKLYEVVVYSDQPPMYVEPVFERLNSRGTISHRLSRPATKYVDGKHYRDLSKLNRNPAQVIYLSAHALESCLQHDNCVQIKPFKLEDKYDTQLLDLIPFLEYVAMARPSDIRTVLASYQGHDVAAEFIERSKEHQRRMQEQSKLGRLWRR

SEQ ID NO: 4835 - DNA, 1119 bp, Sorghum bicolor
  misc_feature: Ceres ANNOT ID no. 6040270
  misc_feature: Encodes the peptide sequence at SEQ ID NO 4836
atgatctcctggcggcgcagcgcgtcatggctgtcgtcggcgtcccgctcctcgcttggcgctgccgtcggcggggaggcgaaggtcacgccggaggtggatccggcggcagcccaggagatggaggaggacgaggaggccgacgaggagcggtggtcgcgcctgctgccggagctgctcacggagatcatgcggcgcgtggacgccggcgccgagcgctggccgccgcgccgcgacgtggtggtctgcgcctgcgtgtgccggcggtggcgcgacgccgcggtctcggtcgtgcgcccgccgctcgagtgcgggaggatcaccttcccgtcctcgctcaagcagcctggaccaagggatgcaccgatgcactgttttatccggagggacaaaaagaactcgaccttttctctctatctcagcttaacacaggctctaacggataaagggaagtttcttttggctgctcgaaggttcagacaaggagcacatacagaatatatcatctcttacgactatgatgatctgcacccaagaagcagttcatatgttggaaagttgagatctgacttcttggggacaaagtttatcatctatgatagccaggcaccatatgatggtgctaaaccttcgcggagccgatccactcggcgctttgcaagcaagcagataagcccacaggtttcaggtggcaattttgaagttggacaagtgacctataagttcaacttcatgaaatcaagagggccaaggcgaatgcagtgcaatatccagtgccctgtaagtcagggcactatgtcagatccatccaaggagaaaacaccctcgtcaagttccttagatctaaagaacaaagctccaagatggcacgaccatcttcagtgttggtgcttaaatttccatggccgggtgactgtcgcctccgtgaagaacttccagcttgtggccacagccggctctggtggtccatggggcgttggagacgaggaaacggtgatcctgcagtttgggaagatcgaggatgatgcgtttacaatggactaccggcagcctctgtctgctttccaggcgttcgccatctgcctcaccagctttggcacgaagctggcttgtgaataa

SEQ ID NO: 4836 - protein, 372 aa, Sorghum bicolor
  misc_feature: Ceres ANNOT ID no. 6040270
  misc_feature (116)..(366): Pfam Id: Tub Pfam Desc: Tub family
  misc_feature (50)..(105): Pfam Id: F-box Pfam Desc: F-box domain
  misc_feature (43)..(372): NCBI GI: 56202013 NCBI Desc: chain a, c-terminal domain of mouse brain tubby protein-like [oryza sativa (japonica cultivar-group)]
  misc_feature (28)..(372): NCBI GI: 87241115 NCBI Desc: tubby; di-trans-poly-cis-decaprenylcistransferase; cyclin-like f-box [medicago truncatula]
  misc_feature (188)..(372): NCBI GI: 7769867 NCBI Desc: f12m16.22 [arabidopsis thaliana]
  misc_feature (45)..(372): NCBI GI: 87241116 NCBI Desc: tubby; cyclin-like f-box [medicago truncatula]
  misc_feature (47)..(255): NCBI GI: 90399022 NCBI Desc: h0701f11.8 [oryza sativa (indica cultivar-group)]
MISWRRSASWLSSASRSSLGAAVGGEAKVTPEVDPAAAQEMEEDEEADEERWSRLLPELLTEIMRRVDAGAERWPPRRDVVVCACVCRRWRDAAVSVVRPPLECGRITFPSSLKQPGPRDAPMHCFIRRDKKNSTFSLYLSLTQALTDKGKFLLAARRFRQGAHTEYIISYDYDDLHPRSSSYVGKLRSDFLGTKFIIYDSQAPYDGAKPSRSRSTRRFASKQISPQVSGGNFEVGQVTYKFNFMKSRGPRRMQCNIQCPVSQGTMSDPSKEKTPSSSSLDLKNKAPRWHDHLQCWCLNFHGRVTVASVKNFQLVATAGSGGPWGVGDEETVILQFGKIEDDAFTMDYRQPLSAFQAFAICLTSFGTKLACE

SEQ ID NO: 4837 - DNA, 2721 bp, Sorghum bicolor
  misc_feature: Ceres ANNOT ID no. 6040319
  misc_feature: Encodes the peptide sequence at SEQ ID NO 4838
atgatgtccaggtcgtacaccaacctcctcgacctcgccgcaggaaacttcgcggcgcttggcccgtcgggcggcgggaggcggcggctcgggtcgttcggggcgaagcggatgccccgggtcatgacggtgcccgggacgctgtccgacctcgacgacgacgacgacgagcaggcggccaccagcagcgtcgcctccgacgtgccctcgtccgccgtcggggagcgcctcatcgtcgtggccaaccagctccccgtcgtcgcgcgccgccgccccgacggtggccgcggctgggtcttctcctgggacgaggactcgctcctcctccggctccgcgacggcgtccccgacgagatggaggtcttcttcgtcggctcgctccgcgccgacgtgccgcccggggagcaggaggaggtctcgcagtcgctcatcgacggcttccggtgcgcccccgtgttcctggcgcccgaactcaacgagcggttctaccatcacttctgcaagcgctacctctggccactgttccactacatgctgccctttgcctccccgctgccaccgacggcggaggcggccgcatccggggacggtggccggtttgaccgcagcgcctgggaggcctatgtgctcgcgaacaagcacttctacgagaaggtggttgaggtcatcaaccctgaggatgactacgtctgggtccacgattaccatctcatggcgctgcccaccttcctccgccgacgcttcaatcgcctccggatcggcttcttcctccacagcccgtttccctcatcggagatctaccgcaccctccctgtccgggaggaggttctacggacgttgctcaattgtgatctcatcggcttccacacctttgattatgccaggcacttcctctcttgctgcagtaggatgcttggtctagagtaccagtcaaagcgcggatacattggattggagtactttggccgcactgttgggatcaagatcatgcccatgggaatccatatgggccaactgcaatcggtgctgcgattacctgagaaggaggacaaggttgctgagctgcggcagcgattccaggggaaagctgtgttgctgggggtagatgatacagatatctttaaagggatcaatttgaagcttcttgcatttgagaatatgctgaggatgcatcccaagtggcaggggagagctgtgttggtgcagatagccaaccctcctcgtgggaagggtaaggagatggaggccatccaggctgagatccgggagagctgtgacaggattaatagggagtttggccagactgggtatagccctgtcgtcttcattgaccgcaatgtgtcaagtgcggagaggcttgcatattacacaatagccgagtgtgtggtagtgacggctgtgagggatggaatgaacttgacgccttacgagtacattgtctgccggcaggggatacccggctcagagtctgctccagaggtgagtggaccaaagaagagcatgctggttgtgtcggagttcattgggtgctcgccttcattgagtggtgcaattcgtgttaacccatggaatgttgaaacaactgctgaggcattgaatgaggccatctcaatgtcggaacaagaaaagcagctgaggcatggaaaacattaccgctatgtcagcacccatgatgttgcatattggtcgaagagctttgtccaggatctggagagggcctgcaaggatcacttcaggaagccttgctggggtataggactagggtttggatttagggtggtggcgctagacccacatttcacaaagcttaatttggatacaatcatcatgtcttacgagagagcaaagagtagggtcatattacttgattatgatggtacattggtaccacagacttcaatcgataagaaaccaagttcagaaatattgagaatcatcaataccctatgtttggataacaataacactgttttcattgtcagtgggagaagtagggatagcttgggatcactgtttgcattgtgcccaaagctaggaatcgcagcagaacacggttacttcttaaggtggacgagagatgaagggtggcaatcaagcagccatacctcagactttggatggatgcaaatggcagagccagtgatgaatctttatacagaatcaactgatggatcctatattgagaccaaagaaactgctttggtatggcatcatcaggatgctgacccaggctttgggtcttcccaggcgaaggagatgctggatcacctggaaagtgtactagcaaatgaaccagtcgcagttaagagtggtcagttcattgtcgaagtgaaacctcagggagttagcaaagggcttgtagctgagaagatactcacattgatgaaggagaaagggcggcaagcggattttgtattatgcatcggtgatgacaggtcagatgaggacatgtttgaaaatatcgctgatgtcatgaagagaaacaatgttgctccaaagacaccgctatttgcatgtacagtggggcagaaaccgagcaaagccaggttctaccttgatgatacatttgaagtagtcaatatgctgagcttgctagcagatgcttcggaacctgaccctgtaatagagttggaggaggatgacttggctacatctgtctctgccatagatatcagcgatgaaccaccacagcttggtaatagaagggatgaaggatcttag

SEQ ID NO: 4838 - protein, 906 aa, Sorghum bicolor
  misc_feature: Ceres ANNOT ID no. 6040319
  misc_feature (75)..(572): Pfam Id: Glyco_transf_20 Pfam Desc: Glycosyltransferase family 20
  misc_feature (621)..(856): Pfam Id: Trehalose_PPase Pfam Desc: Trehalose-phosphatase
  misc_feature (23)..(880): NCBI GI: 140048870 NCBI Desc: glycosyl transferase, family 20; trehalose-phosphatase [medicago truncatula]
  misc_feature (32)..(888): NCBI GI: 60265773 NCBI Desc: trehalose-6-phosphate synthase [ginkgo biloba]
  misc_feature (63)..(879): NCBI GI: 8927678 NCBI Desc: contains similarity to a trehalose-6-phosphate synthase mrna from arabidopsis thaliana gby08568 and contains a trehalose-6-phosphate synthase pf00982 domain. ests gbt76758,
  misc_feature (63)..(879): NCBI GI: 8927678 (continued) gbt21695, gbr30506, gbt42298, gbt42288 come from this gene
  misc_feature (38)..(873): NCBI GI: 55792824 NCBI Desc: trehalose 6-phosphate synthase [gossypium hirsutum]
  misc_feature (38)..(873): NCBI GI: 55792822 NCBI Desc: trehalose 6-phosphate synthase [gossypium hirsutum]
  misc_feature: Useful for making plants with altered carbohydrate content
  misc_feature: Functional homolog of the protein sequence given in SEQ ID NO 13884
MMSRSYTNLLDLAAGNFAALGPSGGGRRRLGSFGAKRMPRVMTVPGTLSDLDDDDDEQAATSSVASDVPSSAVGERLIVVANQLPVVARRRPDGGRGWVFSWDEDSLLLRLRDGVPDEMEVFFVGSLRADVPPGEQEEVSQSLIDGFRCAPVFLAPELNERFYHHFCKRYLWPLFHYMLPFASPLPPTAEAAASGDGGRFDRSAWEAYVLANKHFYEKVVEVINPEDDYVWVHDYHLMALPTFLRRRFNRLRIGFFLHSPFPSSEIYRTLPVREEVLRTLLNCDLIGFHTFDYARHFLSCCSRMLGLEYQSKRGYIGLEYFGRTVGIKIMPMGIHMGQLQSVLRLPEKEDKVAELRQRFQGKAVLLGVDDTDIFKGINLKLLAFENMLRMHPKWQGRAVLVQIANPPRGKGKEMEAIQAEIRESCDRINREFGQTGYSPVVFIDRNVSSAERLAYYTIAECVVVTAVRDGMNLTPYEYIVCRQGIPGSESAPEVSGPKKSMLVVSEFIGCSPSLSGAIRVNPWNVETTAEALNEAISMSEQEKQLRHGKHYRYVSTHDVAYWSKSFVQDLERACKDHFRKPCWGIGLGFGFRVVALDPHFTKLNLDTIIMSYERAKSRVILLDYDGTLVPQTSIDKKPSSEILRIINTLCLDNNNTVFIVSGRSRDSLGSLFALCPKLGIAAEHGYFLRWTRDEGWQSSSHTSDFGWMQMAEPVMNLYTESTDGSYIETKETALVWHHQDADPGFGSSQAKEMLDHLESVLANEPVAVKSGQFIVEVKPQGVSKGLVAEKILTLMKEKGRQADFVLCIGDDRSDEDMFENIADVMKRNNVAPKTPLFACTVGQKPSKARFYLDDTFEVVNMLSLLADASEPDPVIELEEDDLATSVSAIDISDEPPQLGNRRDEGS

SEQ ID NO: 4839 - DNA, 1029 bp, Sorghum bicolor
  misc_feature: Ceres ANNOT ID no. 6040325
  misc_feature: Encodes the peptide sequence at SEQ ID NO 4840
  misc_feature: Up-regulated in root tissues in response to methyl jasmonate treatment
  misc_feature: Up-regulated in shoot tissues in response to methyl jasmonate treatment
  misc_feature: Up-regulated in shoot tissues in response to salicylic acid treatment
atggactcgcgctgcccccacctactcctgctcctcctggcggcgctcctccccccgccgtcgtcgggggcggcggcggcggcggcgggggtcatccggctgccgacgggagggagagcgggggccgtggcctgcgcgccgccggaccccgccctgtacgaccgtcccgtcatcggcatcgtctcgcacccgggggacggcgcgggcggcaggatcagcaacaccaccgcgacctcctacatcggcgcctcctacgtcaagttcgtcgaggccgccggcgcgcgcgtcatcccgctcgtctacaacgagcccgaggagcgcctcctcgagaaactgagtttgttgaatggagtgctgttcactggtggatcagagaagcaaggtgtatattttgagacgataaaaaaagtgtttcagtatgttttggacaagaatgacgcaggtgaaccatttcctttgtttgcccaatgtcttggctttgagctaataagcatgattgtcagcaaggacaataatatcttggagacgtttgacgcccagaatcaagcatccactcttcagtttcccagctatgctttggagggctcagtgtttcaaaggtttgaccctgccctcataaaaaaagtcagcaccagctgtcttgtcatgcaaaatcatagatatggtatatcaccaaggcgatatcgagagaatgatgcactatcaagtttcttcaaaatcttgactacatcacctgatgaaaacggcaaggtctatgtctcaactgtacaagcctataattatccaatcacttccacgcaatggcatcctgagaaagccatttttgagtggaggaaaccaatgattccacacagcgaagatgcagtacaggttactcaacattttgccaatcattttatcagccaagcacgcaagtctccaaacaggcctcctgccgacaaagtgctggataacttaatttacaactacagcccgacatttagtggaaaaaaatctttgctgctacagaacagggtgagtagtggttag

SEQ ID NO: 4840 - protein, 342 aa, Sorghum bicolor
  misc_feature: Ceres ANNOT ID no. 6040325
  misc_feature (56)..(271): Pfam Id: Peptidase_C26 Pfam Desc: Peptidase C26
  misc_feature (39)..(329): NCBI GI: 3169656 NCBI Desc: gamma-glutamyl hydrolase [arabidopsis thaliana]
  misc_feature (42)..(329): NCBI GI: 1679658 NCBI Desc: gamma glutamyl hydrolase [glycine max]
  misc_feature (54)..(336): NCBI GI: 47086967 NCBI Desc: zgc:76958 [danio rerio]
  misc_feature (54)..(336): NCBI GI: 49257854 NCBI Desc: mgc84044 protein [xenopus laevis]
  misc_feature (54)..(336): NCBI GI: 5712219 NCBI Desc: gamma-glutamyl hydrolase [mus musculus]
  misc_feature (27)..(329): SWISSPROT Homolog: EC 3.4.19.9 Gamma-glutamyl hydrolase precursor
  misc_feature: Up-regulated in root tissues in response to methyl jasmonate treatment
  misc_feature: Up-regulated in shoot tissues in response to methyl jasmonate treatment
  misc_feature: Up-regulated in shoot tissues in response to salicylic acid treatment
MDSRCPHLLLLLLAALLPPPSSGAAAAAAGVIRLPTGGRAGAVACAPPDPALYDRPVIGIVSHPGDGAGGRISNTTATSYIGASYVKFVEAAGARVIPLVYNEPEERLLEKLSLLNGVLFTGGSEKQGVYFETIKKVFQYVLDKNDAGEPFPLFAQCLGFELISMIVSKDNNILETFDAQNQASTLQFPSYALEGSVFQRFDPALIKKVSTSCLVMQNHRYGISPRRYRENDALSSFFKILTTSPDENGKVYVSTVQAYNYPITSTQWHPEKAIFEWRKPMIPHSEDAVQVTQHFANHFISQARKSPNRPPADKVLDNLIYNYSPTFSGKKSLLLQNRVSSG

SEQ ID NO: 4841 - DNA, 528 bp, Sorghum bicolor
  misc_feature: Ceres ANNOT ID no. 6040333
  misc_feature: Encodes the peptide sequence at SEQ ID NO 4842
atgtcagcaaccaatcctttggtcacggctcatgtcatacaggatgtgttggatccctttacaccaaccattccactaagaatagcatacaacaataagctacttctggcaagtgctgagctaaagccatctgcggttgtaagtaaaccacgagtcgatgtcggtggcaatgacatgagggctttctacaccctggtactgattgacccggatgctccaagtccaagccatccatcactaagggagtacttgcactggatggtgacagatattcctgaaacaactagtgtcaactttggccaagagctagtattttatgagcgaccggacccaagatctggcatccacaggctggtatttgtgctgttccgtcaacttggcagggggacagtttttgcaccagaaatgcgccacaacttcaactgcagaagctttgcacggcaatatcacctcagtgttgccactgctacatatttcaactgtcaaagggaaggtggatcgggcggaagaaggtttcgggaagagtag

SEQ ID NO: 4842 - protein, 175 aa, Sorghum bicolor
  misc_feature: Ceres ANNOT ID no. 6040333
  misc_feature (18)..(162): Pfam Id: PBP Pfam Desc: Phosphatidylethanolamine-binding protein
  misc_feature (1)..(175): NCBI GI: 89514801 NCBI Desc: ft-like protein 3 [hordeum vulgare subsp. vulgare]
  misc_feature (5)..(171): NCBI GI: 115503902 NCBI Desc: ft-like protein [vitis vinifera]
  misc_feature (5)..(171): NCBI GI: 125616878 NCBI Desc: flowering locus t-like protein [vitis labrusca x vitis vinifera]
  misc_feature (5)..(171): NCBI GI: 125616876 NCBI Desc: flowering locus t-like protein [vitis labrusca x vitis vinifera]
  misc_feature (6)..(171): NCBI GI: 38256990 NCBI Desc: flowering locus t [populus nigra]
  misc_feature: Useful for making plants with modulated flowering time
  misc_feature: Functional homolog of the protein sequence given in SEQ ID NO 13388
  misc_feature: Functional homolog of the protein sequence given in SEQ ID NO 13391
  misc_feature: The sequence is a functional homolog of SEQ ID NO 2 in US patent 7196246
  misc_feature: Useful for making plants with modulated flowering time
  misc_feature: Functional homolog of the protein sequence given in SEQ ID NO 13388
  misc_feature: The sequence is a functional homolog of SEQ ID NO 2 in US patent 7208653
MSATNPLVTAHVIQDVLDPFTPTIPLRIAYNNKLLLASAELKPSAVVSKPRVDVGGNDMRAFYTLVLIDPDAPSPSHPSLREYLHWMVTDIPETTSVNFGQELVFYERPDPRSGIHRLVFVLFRQLGRGTVFAPEMRHNFNCRSFARQYHLSVATATYFNCQREGGSGGRRFREE

SEQ ID NO: 4843 - DNA, 1143 bp, Sorghum bicolor
  misc_feature: Ceres ANNOT ID no. 6040358
  misc_feature: Encodes the peptide sequence at SEQ ID NO 4844
atgtccgtgctcccgtgcggccgtggcgccgcgtgcttcctgttgctgctactaggcgtcctctcgtgcctccacacagccgcctcgcggcccgtgccgggtgcagggcaccaccaccggcctccggacgccgtctcgtggcgctcgttcgagcacctgcatggcgcgcggcggggcagccgcgtcgccggcctcgccgacctgaagaggtacctggcgaggttcgggtacatgcaggcgccccggccggcgcacgagcacgacgacgtgttcgacgaccacatggaggccgccgtgaggcggtaccagtccagcctcagcctgcccgtcaccggccggctcgactcctcgacgctcggccggatcatgaccaagcgctgcggcgtggccgacggcgccggcatgtccgtgaccgcgtccctctcggcggaggtggcggctggcactggcagccggttcacgttcctcgccgaccaggaccagccgtggtggacgcggccgcacccgctggtcctgacgtacgcagtctcgccgacggccaccgtcggctacctgccggccgaagccgtgcgcgccgcgttccggagcgcgttcgcgcggtgggcgagggtgatccccgtggatttcgtcgagaccgactactacgacggcggcgagcccgacatcatggtggggttctacgagggcgaccacggggacggctcgccgttcgacgggcggtacggccaggtagcccacgcgtacacctcggacgacgacgggcacatccacttcgacgcggcggagcactggtcagtggacgtgggcagtgacaccgacacgcggggggactcggccatggacctggagtccgtggcgacgcacgagatcgggcacatcctcgggctaggccactcgtcgtcgccggaggcgatcatgtacccctacatcgccgccatgcaaaggaaggtggagctcagcgcggacgacatcgacggcgtcctgcggctgtacgggtcgaacccacggtttaggcacgagcaagagcaccctgcgccgccgcggagcgtgccctctgtgtcgccaggaaggagcagctggcatgctggttcagttagcttagtttgtacagtcttggtcatgctagtgacacttgtaaaatag

SEQ ID NO: 4844 - protein, 380 aa, Sorghum bicolor
  misc_feature: Ceres ANNOT ID no. 6040358
  misc_feature (163)..(332): Pfam Id: Peptidase_M10 Pfam Desc: Matrixin
  misc_feature (61)..(126): Pfam Id: PG_binding_1 Pfam Desc: Putative peptidoglycan binding domain
  misc_feature (47)..(350): NCBI GI: 92890172 NCBI Desc: h+-transporting two-sector atpase, delta (oscp) subunit; peptidase, metallopeptidases [medicago truncatula]
  misc_feature (32)..(337): NCBI GI: 92897358 NCBI Desc: peptidase m10a and m12b, matrixin and adamalysin; peptidase, metallopeptidases [medicago truncatula]
  misc_feature (89)..(338): NCBI GI: 21553383 NCBI Desc: proteinase like protein [arabidopsis thaliana]
  misc_feature (47)..(372): NCBI GI: 2829864 NCBI Desc: similar to zinc metalloproteinases [arabidopsis thaliana]
  misc_feature (47)..(372): NCBI GI: 53749140 NCBI Desc: at1g24140 [arabidopsis thaliana]
MSVLPCGRGAACFLLLLLGVLSCLHTAASRPVPGAGHHHRPPDAVSWRSFEHLHGARRGSRVAGLADLKRYLARFGYMQAPRPAHEHDDVFDDHMEAAVRRYQSSLSLPVTGRLDSSTLGRIMTKRCGVADGAGMSVTASLSAEVAAGTGSRFTFLADQDQPWWTRPHPLVLTYAVSPTATVGYLPAEAVRAAFRSAFARWARVIPVDFVETDYYDGGEPDIMVGFYEGDHGDGSPFDGRYGQVAHAYTSDDDGHIHFDAAEHWSVDVGSDTDTRGDSAMDLESVATHEIGHILGLGHSSSPEAIMYPYIAAMQRKVELSADDIDGVLRLYGSNPRFRHEQEHPAPPRSVPSVSPGRSSWHAGSVSLVCTVLVMLVTLVK

SEQ ID NO: 4845 - DNA, 2652 bp, Sorghum bicolor
  misc_feature: Ceres ANNOT ID no. 6040359
  misc_feature: Encodes the peptide sequence at SEQ ID NO 4846
atgaattaccgcttccagaacctcctcggcgcgccgtaccgcggcggcgacgccgtcttcgcgggcgactcgcccgttctcctctccgccgtcggcaaccgcgtggcctccaccgacctcggcgcctcctcgtccctcaccctcccgttcgagtcctcatccagcgtcacccgcctcgccacttccccctcgggcgacttcctcctcgcggccgatgacaacggccgcgcgctctatgccaacctccgccgccgcgccgtcctccaccgcgtctccttcaagggcgcaccgtcagctatccgcttcagccccgacggtcagctcatcgccgtggccgtcgggaaggtcgtgcagatctggcgctcgccggggtttcgcagggagttcttccccttccacctcctccgcaccttcccgggcttcgccgctggcgtgacagcattcgattggtccccggactcagcgttcctcctcgcgtcctgcaaggacctgacagctcggctcttgcccgtcaagaagggactaggaagcaaaccctttctcttccttggccatcgcgcggctgtcgtgggtgccttctttgccacagataagaagacagggagagtcaagggggtttatacagtctccaaggatggagctatctttacatggaatttggtggaaggaaatgaggaaaatgatacctcacctccgccatcaccagggacgccagagcaggggtcagaacagaatgatgtcatggaactggatggtgggagcaggaaaaggaaggtttcgggagaattggaggaaccagtcactaagctgcatttggcaaagtgggagctgcaggaaaagcatttcttcatgcagtcaccggctaagttaacagcatgtgattaccaccgggagctcgacatggtggtggttggattctctagtggagtatttgggctgtaccagatgccagactttgtgtgcctccacttgctgtcagtatcaagagagaagatcaccactgctattttcaacagtttggggaattggcttgtctttggatgcgccaaacttggacagcttctggtgtgggagtggcggtcggagagctacattttgaaacagcagggacactactttgatgtgaattgcatcgcatactcaccagactctcagttattggccactggtgctgatgataacaaagtcaaggtctggacagtttcatctgggttctgtttcataacattttcggagcatacaaatgctgttactgcagttcattttatggccaataaccattctcttctaagtgcctcccttgacgggactattcgagcatgggatttgttccgctatcgcaacttcagaacatttaccaccccttcacctaggcagtttgtttctttaactgcagaccagagtggagaagtaatatgtgctggaacacttgattcatttgagatatttgtttggtcaatgaaaactggtcgattgttggatgtactcagtggccatgaaggaccagtgcatggtctaatgttttcgccaatcaatgctattctggcttcatcatcatgggacaaaactgttcgcctttgggatgtctttgagagcaagggtgcagtggaaacttttcagcactcacatgatgttcttactttagcttatcgacctgatggaaggcagatagcatgcagtactttagatggcctaatcaatttctgggatccatctgatggtttgttgatgtataccattgagggccgcagggatattgctgggggtcgccttatgactgacaggagatctgcagctaatacaagtatagggaagtacttcacaacgttgtgctattctgctgatggaagttctattttagctggaggaaacaccaaatatatttgcatgtatgatgttggagaacaggtgctgttgcgtagattccagatcactcgcaatctctcattggatggagttcttgattttctgaactcaaagaagatgacagatgctggcgcactagatctcattgacgatgaagacagtgatgttgaagaaggaattgatcgacaggctagaggaaacttagggcttggtttacctggatcaatggcaaatcgtggaagacccatagctcggacaaaatgtgttaagtttgctccaactggaagatcatttgctgcagcaaccactgatggtgttttattgtactcagttgatgaatcatttatttttgatccgacagaccttgacattgatgttacgcctgagaaagtagaggaagctcttgcagaaaaccaacagcagagagcccttatacttagccttcggttgaatgaggactccttgattaagaagtgcatattcgcagttgatccatctgatgtaagagcaatttgttcggcaattccttacaagtatctccaaagattgattgatgctttcgctggtcttttggaaagttgtccgcatctggaatttatcctcctgtggtctcaggagctatgtaaggttcatggccactatattcaacagaactccagaactttgcttccttctctgaaatcattgcagaagtctataacaagactacatcaggatttggcagacacttgctcttctaatgagtacttgttgaaatatctgtgcactgctggtacaaagaattag

SEQ ID NO: 4846 - protein, 883 aa, Sorghum bicolor
  misc_feature: Ceres ANNOT ID no. 6040359
  misc_feature (768)..(883): Pfam Id: PWP2 Pfam Desc: Periodic tryptophan protein 2 WD repeat associated domain
  misc_feature (362)..(400): Pfam Id: WD40 Pfam Desc: WD domain, G-beta repeat
  misc_feature (404)..(442): Pfam Id: WD40 Pfam Desc: WD domain, G-beta repeat
  misc_feature (490)..(528): Pfam Id: WD40 Pfam Desc: WD domain, G-beta repeat
  misc_feature (1)..(879): NCBI GI: 124360858 NCBI Desc: periodic tryptophan protein-associated region; wd40-like [medicago truncatula]
  misc_feature (173)..(878): NCBI GI: 5103844 NCBI Desc: strong similarity to gbx95263 periodic tryptophan protein 2 gene (pwp2) from homo sapiens and contains 6 wd40, g-beta repeat domains. [arabidopsis thaliana]
  misc_feature (207)..(878): NCBI GI: 42571491 NCBI Desc: transducin family protein / wd-40 repeat family protein [arabidopsis thaliana]
  misc_feature (208)..(876): NCBI GI: 115437836 NCBI Desc: periodic tryptophan protein 2 [aspergillus terreus nih2624]
  misc_feature (259)..(876): NCBI GI: 12311748 NCBI Desc: spbc713.04c [schizosaccharomyces pombe]
  misc_feature: The sequence is a functional homolog of SEQ ID NO. 502 in the 11/188,298 US application
  misc_feature: The sequence is a functional homolog of SEQ ID NO. 485 in the 11/188,298 US application
MNYRFQNLLGAPYRGGDAVFAGDSPVLLSAVGNRVASTDLGASSSLTLPFESSSSVTRLATSPSGDFLLAADDNGRALYANLRRRAVLHRVSFKGAPSAIRFSPDGQLIAVAVGKVVQIWRSPGFRREFFPFHLLRTFPGFAAGVTAFDWSPDSAFLLASCKDLTARLLPVKKGLGSKPFLFLGHRAAVVGAFFATDKKTGRVKGVYTVSKDGAIFTWNLVEGNEENDTSPPPSPGTPEQGSEQNDVMELDGGSRKRKVSGELEEPVTKLHLAKWELQEKHFFMQSPAKLTACDYHRELDMVVVGFSSGVFGLYQMPDFVCLHLLSVSREKITTAIFNSLGNWLVFGCAKLGQLLVWEWRSESYILKQQGHYFDVNCIAYSPDSQLLATGADDNKVKVWTVSSGFCFITFSEHTNAVTAVHFMANNHSLLSASLDGTIRAWDLFRYRNFRTFTTPSPRQFVSLTADQSGEVICAGTLDSFEIFVWSMKTGRLLDVLSGHEGPVHGLMFSPINAILASSSWDKTVRLWDVFESKGAVETFQHSHDVLTLAYRPDGRQIACSTLDGLINFWDPSDGLLMYTIEGRRDIAGGRLMTDRRSAANTSIGKYFTTLCYSADGSSILAGGNTKYICMYDVGEQVLLRRFQITRNLSLDGVLDFLNSKKMTDAGALDLIDDEDSDVEEGIDRQARGNLGLGLPGSMANRGRPIARTKCVKFAPTGRSFAAATTDGVLLYSVDESFIFDPTDLDIDVTPEKVEEALAENQQQRALILSLRLNEDSLIKKCIFAVDPSDVRAICSAIPYKYLQRLIDAFAGLLESCPHLEFILLWSQELCKVHGHYIQQNSRTLLPSLKSLQKSITRLHQDLADTCSSNEYLLKYLCTAGTKN

SEQ ID NO: 4847 - DNA, 2349 bp, Sorghum bicolor
  misc_feature: Ceres ANNOT ID no. 6040365
  misc_feature: Encodes the peptide sequence at SEQ ID NO 4848
atggcggagcccgaggcctcccccgcggcggccggcggcggtgggcggctccgcaacgcgttcgggggtgtgctctgcgccttcacgctcctcctcatcggcgtcgtcgcgttctcgatccgcctcttctccgtaatcaagtacgagagcgtgatccatgagttcgacccctacttcaacttccgcgtcactcagtatctgtcgaagaatggaatttacgagttctggaactggtttgatgataggacatggtacccccttggccgtgtgattggtggcactgtgtatcctggtttgacattgactgctggaactatttggtggttgctgaattctcttaacatcccattgtctgtggagacagtttgtgtgttcacagctccaattttctcagcaaatgcatcatgggctacttacctgttaacaaaggaagcgaagggtactggagctggattaatggcagcagccattttagcaatggtcccctcatacatctcaagatctgttgcaggcagctatgataatgaagctgtagcaatatttgccttgatatttacattttatctatatgtaaagacgctgaacacgggatcactcttttatgcaacactcaatgctctctcatatttctacatggtctgctcttggggaggctacacattcattatcaatcttatcccaatgcatgtcctcttgtgcattgtaactggtcgttattcttcgcggctctacattgcatatgctccccttgttatacttggaacgcttctggcagcattagtacctgtggttggttttaatgcagtaatgacctctgagcactttgcatcatttctggtgttcataattcttcacgtggttgctcttgtgtattatatcaaagggcttttgactcctaggctgttcaaagttgctatgactcttgtcatatctgttggcttagctgtttgtttcgcagtagtagccatacttgtcgccttggtggcatctagtccaacaaaaggctggagcggccgcagtttgagtctacttgatccaacttatgcaagcaagtacatccccatcattgctagtgtcagtgaacaccaacctcctacctggccctcttattttatggacattaatgtgttggccttcctgattcctgctgggattatttcatgcttcttgcctctgtctgacgcaagctccttcatggtcttgtatttagtcactgcagtgtatttttctggagttatggtacggcttatgcttgtccttgctcctgctgcgtgtattttatctgggattgctctatctgaagttttcagtgtcctcacacgatccattaaatttcagctgtcaaaattttttgatgacagccctacttcttcaggtgatagtagccctgagagttctacaaattcaacaaaaaatgaaaatagaaatgaaaaatctgaaacggctccaaaggaaaaaccgtcaaagaagaaccggaagaaggagaaagaagtagcagagagtgtttctgtgaagcctaaaaaggaaaagaggcttttggttctgccttttgaattatctgttatgggtattttgctgctgatcgtgttaggtggtttctatgtggtccattgtgtatgggcggcagctgaagcgtactcggcgccttcaattgtgttgacatctcgttcacgggatggattgcatgtttttgatgatttccgtgaagcttatgcatggctgagccataacacagatgttgatgacaaggttgcttcctggtgggactatggttaccaaacaactgcaatggccaacagaactgtgattgtagacaataacacctggaacaacactcatatagcaacagttggtacagcaatgtcgtccccagaaaaagcagcttgggaaatcttcaattctttagatgtcaaatatgtgcttgttgtctttggaggacttgttggataccctagcgatgatatcaataagttcctttggatggtacgcataggaggtggtgtgttccctcacatcaaggaaccagattatcttagggatggtcaataccgtgttgatgctcaagccaccccaactatgctgaattgcctcatgtacaagctttgttattacaggtttgtggagaccgatggaaaaggttttgatagagtaagaggatatgaaataggaaagaagcatttcaagctaacacattttgaggaggtattcacaacccaccattggatggtccgtatatataaactgaaaccccagaagaacagggttcgaggcaagttgaagaagttgaaggctagtgccaaaactagttccacacttgcggcagggcaaaagaagaacccgtggcaatag

SEQ ID NO: 4848 - protein, 782 aa, Sorghum bicolor
  misc_feature: Ceres ANNOT ID no. 6040365
  misc_feature (24)..(711): Pfam Id: STT3 Pfam Desc: Oligosaccharyl transferase STT3 subunit
  misc_feature (17)..(781): NCBI GI: 16974315 NCBI Desc: at5g19690/t29j13_110 [arabidopsis thaliana]
  misc_feature (9)..(781): NCBI GI: 92868553 NCBI Desc: oligosaccharyl transferase, stt3 subunit [medicago truncatula]
  misc_feature (30)..(462): NCBI GI: 90399055 NCBI Desc: h0103c06.8 [oryza sativa (indica cultivar-group)]
  misc_feature (30)..(462): NCBI GI: 38344929 NCBI Desc: osjnba0018m05.20 [oryza sativa (japonica cultivar-group)]
  misc_feature (30)..(482): NCBI GI: 108880169 NCBI Desc: oligosaccharyl transferase [aedes aegypti]
  misc_feature (30)..(473): SWISSPROT Homolog: EC 2.4.1.119 Dolichyl-diphosphooligosaccharide--protein glycosyltransferase subunitSTT3A
  misc_feature: Useful for making plants with altered carbohydrate content
  misc_feature: Functional homolog of the protein sequence given in SEQ ID NO 13886
MAEPEASPAAAGGGGRLRNAFGGVLCAFTLLLIGVVAFSIRLFSVIKYESVIHEFDPYFNFRVTQYLSKNGIYEFWNWFDDRTWYPLGRVIGGTVYPGLTLTAGTIWWLLNSLNIPLSVETVCVFTAPIFSANASWATYLLTKEAKGTGAGLMAAAILAMVPSYISRSVAGSYDNEAVAIFALIFTFYLYVKTLNTGSLFYATLNALSYFYMVCSWGGYTFIINLIPMHVLLCIVTGRYSSRLYIAYAPLVILGTLLAALVPVVGFNAVMTSEHFASFLVFIILHVVALVYYIKGLLTPRLFKVAMTLVISVGLAVCFAVVAILVALVASSPTKGWSGRSLSLLDPTYASKYIPIIASVSEHQPPTWPSYFMDINVLAFLIPAGIISCFLPLSDASSFMVLYLVTAVYFSGVMVRLMLVLAPAACILSGIALSEVFSVLTRSIKFQLSKFFDDSPTSSGDSSPESSTNSTKNENRNEKSETAPKEKPSKKNRKKEKEVAESVSVKPKKEKRLLVLPFELSVMGILLLIVLGGFYVVHCVWAAAEAYSAPSIVLTSRSRDGLHVFDDFREAYAWLSHNTDVDDKVASWWDYGYQTTAMANRTVIVDNNTWNNTHIATVGTAMSSPEKAAWEIFNSLDVKYVLVVFGGLVGYPSDDINKFLWMVRIGGGVFPHIKEPDYLRDGQYRVDAQATPTMLNCLMYKLCYYRFVETDGKGFDRVRGYEIGKKHFKLTHFEEVFTTHHWMVRIYKLKPQKNRVRGKLKKLKASAKTSSTLAAGQKKNPWQ

SEQ ID NO: 4849 - DNA, 465 bp, Sorghum bicolor
  misc_feature: Ceres ANNOT ID no. 6040377
  misc_feature: Encodes the peptide sequence at SEQ ID NO 4850
atggagtattctaatttgcaacagcaggcatcatccttgaaaaagagcctctttgatcagggatacttggatgagcaattttgtcagattgaggacttgcaggatgaagcaagccctaattttacagaagaagttgtttccttgttcttcaagaactcaacgaggctaatggcaattattgagcaagctatggagaagaaccctagagatttcagtagatgggatgtaaacatgcagcaattaaaaggaagctgttgtagtattggtgcttctaggatgaagaacgagtgcacctcattcaggaatagctgtggagacgagaatgctgaaggttgtatgaggtccttccagaacttgaagagggagcatggagtcctcaggcagaagctggaatcctacttccagctgctgcgacaagccggtcatgctgtgagtgtgactgcaaccaggcctagaggcatgtaa

SEQ ID NO: 4850 - protein, 154 aa, Sorghum bicolor
  misc_feature: Ceres ANNOT ID no. 6040377
  misc_feature (17)..(151): NCBI GI: 115439883 NCBI Desc: os01g0743800 [oryza sativa (japonica cultivar-group)]
  misc_feature (6)..(135): NCBI GI: 9279718 NCBI Desc: histidine-containing phosphotransfer protein-like [arabidopsis thaliana]
  misc_feature (21)..(142): NCBI GI: 115462463 NCBI Desc: os05g0186100 [oryza sativa (japonica cultivar-group)]
  misc_feature (1)..(144): NCBI GI: 13774348 NCBI Desc: histidine-containing phosphotransfer protein [catharanthus roseus]
  misc_feature (6)..(136): NCBI GI: 140071469 NCBI Desc: hpt [medicago truncatula]
  misc_feature: The sequence is a functional homolog of SEQ ID NO. 465 in the 11/188,298 US application
MEYSNLQQQASSLKKSLFDQGYLDEQFCQIEDLQDEASPNFTEEVVSLFFKNSTRLMAIIEQAMEKNPRDFSRWDVNMQQLKGSCCSIGASRMKNECTSFRNSCGDENAEGCMRSFQNLKREHGVLRQKLESYFQLLRQAGHAVSVTATRPRGM

SEQ ID NO: 4851 - DNA, 1692 bp, Sorghum bicolor
  misc_feature: Ceres ANNOT ID no. 6040378
  misc_feature: Encodes the peptide sequence at SEQ ID NO 4852
  misc_feature: Up-regulated in shoot tissues in response to salicylic acid treatment
atggcggactgggaggggatcccggcgcgggagcggcggcagatggaggagatcctgcagctcgacatggaggagctcaacgtggaggtcgtcgacgacaacgacgaggaagaggaggaagacgagggtgacggcaacgaggaggacgacgtcgtcgatgccttcctcagagataacaatggagatggagtggctagcacctctggacctttcacattcaataggtctctagcctcattgcacacataccttggcgaggttgatgatactcggggtagagttactctcttagatggtggcacagtcctcaacttaccaatgttttatcttcaaggtgttgttctatttcctggagctaccctgcctctcagagtaattgaggatagattagtagtaactatcgacaaagctttgaggctggtcgatgctccatgcacaattggtgtggttctcatgcgccgactcccaaatcgtcgacattatgctactgcttctgttggaacaaccgcagagatacgtcaacttggaaggttggaggatggttcattaaatgttgttgcccgtgggcagcaacgatttcgtcttaggaggcattggattgatgttgatcgggtggtgtggggtgaggtacaaattattgaagaagatactcccttgagaactcctagagatgcatttgctcagctagctgcatgtaatagcttcaatctgcacgcttcgtcatcagtcatcagtttggatatgtctcatatgaaacaaggccatatagattcagaactagagtgcgatactccatcaccaaacagtaatataagcaacccttcatcaatggatacaaggctgtgccatctaggttcacagtcaagtgactcgatgaaatcatcctcagatgaagacggagatttgatgcacacacagttttggaggcggaagcaacattctgtgagggaaagtggtgcatcaagtcattcagacaacaagaccaacatgagcaatgagaacaatctttgcttgacgcctctccaatcattgccgatagcaaaaacaagagatgctaagcggcggcgacactatcatgcttactctaagcaggcttctcaggcaccattatcattttggcctcggtgggtatatgaaatgtatgattcatataaacttgctcgcagcgctgcagagttatggagacagataattgcaaacccaagcatggacgatcacataagaaagccagatattttgtcatttcacatcggaagcaaacttccagtctcagaatctgtgagacaaaaacttctggagattgatggaatttcatatcgcctacagaaagaaattcagcttctcaaggcctttaatcatattaaatgcagaaattgccagtctcgtatagcaaaacgtagtgacatggtggtgatgtctactgatggggttcttggtgcttatgtcaaccctcatggttgtgtccatgagacgattacagtcagcaatgcaactgggctagcactcattggcaatccttctacagttcacagctggtttcctggatactcatggacgattgcagcatgcatggcctgcgagtcccacataggctggcgattcaaagccaccaagaagaatctgcgacccaggtcattttgggggatccgcagctcacaaattgcagatgacacagtagatcagagcgactga

SEQ ID NO: 4852 - protein, 563 aa, Sorghum bicolor
  misc_feature: Ceres ANNOT ID no. 6040378
  misc_feature (104)..(450): Pfam Id: LON Pfam Desc: ATP-dependent protease La (LON) domain
  misc_feature (3)..(557): NCBI GI: 59958328 NCBI Desc: at2g25740 [arabidopsis thaliana]
  misc_feature (3)..(557): NCBI GI: 18377847 NCBI Desc: at2g5740/f3n11.19 [arabidopsis thaliana]
  misc_feature (1)..(468): NCBI GI: 57899976 NCBI Desc: atp-dependent protease la (lon) domain-containing protein-like [oryza sativa (japonica cultivar-group)]
  misc_feature (348)..(563): NCBI GI: 51591891 NCBI Desc: zgc:92404 [danio rerio]
  misc_feature (335)..(563): NCBI GI: 28461384 NCBI Desc: crbn protein [mus musculus]
  misc_feature: Up-regulated in shoot tissues in response to salicylic acid treatment
MADWEGIPARERRQMEEILQLDMEELNVEVVDDNDEEEEEDEGDGNEEDDVVDAFLRDNNGDGVASTSGPFTFNRSLASLHTYLGEVDDTRGRVTLLDGGTVLNLPMFYLQGVVLFPGATLPLRVIEDRLVVTIDKALRLVDAPCTIGVVLMRRLPNRRHYATASVGTTAEIRQLGRLEDGSLNVVARGQQRFRLRRHWIDVDRVVWGEVQIIEEDTPLRTPRDAFAQLAACNSFNLHASSSVISLDMSHMKQGHIDSELECDTPSPNSNISNPSSMDTRLCHLGSQSSDSMKSSSDEDGDLMHTQFWRRKQHSVRESGASSHSDNKTNMSNENNLCLTPLQSLPIAKTRDAKRRRHYHAYSKQASQAPLSFWPRWVYEMYDSYKLARSAAELWRQIIANPSMDDHIRKPDILSFHIGSKLPVSESVRQKLLEIDGISYRLQKEIQLLKAFNHIKCRNCQSRIAKRSDMVVMSTDGVLGAYVNPHGCVHETITVSNATGLALIGNPSTVHSWFPGYSWTIAACMACESHIGWRFKATKKNLRPRSFWGIRSSQIADDTVDQSD

SEQ ID NO: 4853 - DNA, 1524 bp, Sorghum bicolor
  misc_feature: Ceres ANNOT ID no. 6040384
  misc_feature: Encodes the peptide sequence at SEQ ID NO 4854
atggggaaggccgtggtggttggcacggcggtggtggcgtgcgcggcggtcggggtggccttggcgctggcgcaccgcaggcggaagcgggatgccgagctcctgggatccgcggaggccgagaggaagaggcgcgcggccgccgtgatcgaggacgtggagagcagcctcgccacgcccacggcgctgctgcggagcatcgcggacgccatggtcaccgagatggagcgcggcctgcgcggggacatccactcgcagctcaagatgctcattagctacgtcgacaacctccccactggagatgaacatgggctgttttatgcactggatcttggaggcaccaacttccgtgtgctgcgagtccaactaggaggaagggagaaacgtgttgtcaaacaacagtatgaggaggtttccattccaccgcatttgatggttgggacttccatggaactatttgatttcattgctgctgcattggctaaatttgttgatactgaaggtgaagatttccacctcccagagggtagactgagagaacttggtttcaccttttccttcccggtgaaccaaacatcaatatcatcaggaacactcatcaagtggacaaagggcttttccatcaacggcacggttggtgaagatgttgtttctgagttgagcagagccatggagagacaggggctagatatgaaagttacggcgttggtcaatgatacagttggcacattggctggtgggagatatatggataacgatgtagttgcagccgtaatattgggtactggtacaaatgcagcatatgtggagcatgcaaatgcaattcctaaatggactgggttactgcctaaatctggaaacatggtaattaatacagaatgggggagcttcaaatccgacaagcttcctctttcagaatacgacaaagccatggactttgaaagtttgaaccctggagagcagatatacgaaaaaatgatttctggcatgtatctgggagagattgtgcgaagaattttactgaagttggcacatgacgcttctctatttggggatgttgttccatctaagctggagcagccatttatattgaggacaccagatatgtcagccatgcatcatgactcctcgcatgacctcaaaactcttggagctaaactgaaggatatagttggggtcgcagatacttccctggaagtaagatacattactcgccacatctgtgaccttgttgcagagcggggagcacgcttggcagctgcaggtatatatagcatcctgaagaagataggccgggacaaagtaccaagtagtggcggtaaaatgccaaggactgtagttgccttggatggtgggctctatgaacattacaagaagttcagcagttgcgtagaagcaactcttacagacttgctcggcgaagaggcctcttcctccgtggttgccaagctggccaatgatggctctggcattggagctgctcttcttgcagcctcacactcccagtatggggagagtcactag

SEQ ID NO: 4854 - protein, 507 aa, Sorghum bicolor
  misc_feature: Ceres ANNOT ID no. 6040384
  misc_feature (258)..(502): Pfam Id: Hexokinase_2 Pfam Desc: Hexokinase
  misc_feature (44)..(251): Pfam Id: Hexokinase_1 Pfam Desc: Hexokinase
  misc_feature (1)..(503): NCBI GI: 21954124 NCBI Desc: hexokinase [zea mays]
  misc_feature (1)..(505): NCBI GI: 13991925 NCBI Desc: hexokinase i [oryza sativa]
  misc_feature (1)..(503): NCBI GI: 75157445 NCBI Desc: hexokinase-6 (hexokinase-2)
  misc_feature (1)..(506): NCBI GI: 110808552 NCBI Desc: hexokinase-2 (hexokinase-3)
  misc_feature (1)..(505): NCBI GI: 11066213 NCBI Desc: hexokinase [citrus sinensis]
  misc_feature (1)..(505): SWISSPROT Homolog: EC 2.7.1.1 Hexokinase-5
  misc_feature: The sequence is a functional homolog of SEQ ID NO. 321 in the 11/188,298 US application
MGKAVVVGTAVVACAAVGVALALAHRRRKRDAELLGSAEAERKRRAAAVIEDVESSLATPTALLRSIADAMVTEMERGLRGDIHSQLKMLISYVDNLPTGDEHGLFYALDLGGTNFRVLRVQLGGREKRVVKQQYEEVSIPPHLMVGTSMELFDFIAAALAKFVDTEGEDFHLPEGRLRELGFTFSFPVNQTSISSGTLIKWTKGFSINGTVGEDVVSELSRAMERQGLDMKVTALVNDTVGTLAGGRYMDNDVVAAVILGTGTNAAYVEHANAIPKWTGLLPKSGNMVINTEWGSFKSDKLPLSEYDKAMDFESLNPGEQIYEKMISGMYLGEIVRRILLKLAHDASLFGDVVPSKLEQPFILRTPDMSAMHHDSSHDLKTLGAKLKDIVGVADTSLEVRYITRHICDLVAERGARLAAAGIYSILKKIGRDKVPSSGGKMPRTVVALDGGLYEHYKKFSSCVEATLTDLLGEEASSSVVAKLANDGSGIGAALLAASHSQYGESH

SEQ ID NO: 4855 - DNA, 1119 bp, Sorghum bicolor
  misc_feature: Ceres ANNOT ID no. 6040395
  misc_feature: Encodes the peptide sequence at SEQ ID NO 4856
atgaggattcgggagctccgggatgggctggaggtggaggacgacgagcgggagcaggagggatcgtggggtggcggcggcgacggggaggtggtcgcggttgtgcgactgcgggcgaagcgcgcgctcgtcggcgccggcgcgagggtcctgttctatccgacgcttctctacaacgtgctccgcaacatgttcgacggcgagttccgctggtgggatcgcgtcgacaagtatgttttgctaggtgctgttccgttctctagcgatgttccgcgcctgaagcaacttggagtaagaggagttgttacactcaatgaaccctatgaaactctggttccaacatccctatatcaggctcatggaatcaatcatctcgaaattcccacaagagactacctgtttgccccatccctggagcatatttgtcgtgcagtggattttatccattgtaatgaagtgcaaggtggtagcacctatgtccactgtaaggctggaaggggacgaagcaccactatagttttgtgttttttgatcaagtacagaaatatgacaccagaagcagctttggatcatgcgaggtctgtgaggcctagagtgcttttagcgccagctcagtggcaggctgttaaaatgttcagcaagctcaacgggagatgcctttccatacagagctcgaacccaacctgctcagtactatcttatgaggaatccagtgaactgttgagcacgcagagcagcagatgcctttcgattcagagctcgactgaagactcaatagcatctgatgaagaatccagtgaagcatcctttgtagaccctgaagttgatggctacgccgccactgagtttgacagcgagcattttattttacctcgttgtcgaagtatgctgtccagaccaacaagccccactggctgtagcgatgcagtcttcgtaaccgaagaagatctagagggctatgagacctacgccgatgacgggaaggacgttgttgaagtgcaagtagtggttcgccgcaagcccatcatgagcaaactttcctgcttccttgggtccttgaagcttaccggcaactgcgagccaccacctggccgtttgactgaggttcgagcctgctag

SEQ ID NO: 4856 - protein, 372 aa, Sorghum bicolor
  misc_feature: Ceres ANNOT ID no. 6040395
  misc_feature (74)..(215): Pfam Id: DSPc Pfam Desc: Dual specificity phosphatase, catalytic domain
  misc_feature (1)..(372): NCBI GI: 74318858 NCBI Desc: dual-specificity protein-like phosphatase 4 [zea mays]
  misc_feature (1)..(372): NCBI GI: 115464977 NCBI Desc: os05g0524200 [oryza sativa (japonica cultivar-group)]
  misc_feature (17)..(235): NCBI GI: 102139981 NCBI Desc: dual specificity protein phosphatase family protein [musa acuminata]
  misc_feature (1)..(212): NCBI GI: 144924691 NCBI Desc: tyrosine specific protein phosphatase and dual specificity protein phosphatase [medicago truncatula]
  misc_feature (17)..(215): NCBI GI: 74318850 NCBI Desc: dual-specificity protein-like phosphatase 1 [zea mays]
MRIRELRDGLEVEDDEREQEGSWGGGGDGEVVAVVRLRAKRALVGAGARVLFYPTLLYNVLRNMFDGEFRWWDRVDKYVLLGAVPFSSDVPRLKQLGVRGVVTLNEPYETLVPTSLYQAHGINHLEIPTRDYLFAPSLEHICRAVDFIHCNEVQGGSTYVHCKAGRGRSTTIVLCFLIKYRNMTPEAALDHARSVRPRVLLAPAQWQAVKMFSKLNGRCLSIQSSNPTCSVLSYEESSELLSTQSSRCLSIQSSTEDSIASDEESSEASFVDPEVDGYAATEFDSEHFILPRCRSMLSRPTSPTGCSDAVFVTEEDLEGYETYADDGKDVVEVQVVVRRKPIMSKLSCFLGSLKLTGNCEPPPGRLTEVRAC

SEQ ID NO: 4857 - DNA, 1635 bp, Sorghum bicolor
  misc_feature: Ceres ANNOT ID no. 6040397
  misc_feature: Encodes the peptide sequence at SEQ ID NO 4858
atggtgatggacttggacgagccgcttgatgcggcggccgccgagaagggcgaggcggcgctgcggcgactgaccgaggccgacccggcgctcttcctctccccctcagtggacctcgccgccgccgcccgagcggcctcacagtacatctattcctctctggcgccactctcccttgctcagccgccgccgctccctaccctcctcgcggaccccgccttcgacgccgagcagatttggtcccagatagagctgctcgcccgcccgctccttcctcacctgcgccgccagctccgccgtctcgagcagcaacctccctcgcaacagcctcctgtggagacgcttgctgttgccgagggtgagcagttggaggaggatggagaaagtagcgaatcagaggagttgaagaatgaggaggaggagttggaggggacagaggacgaggaggagttggaggggacagaggatgaggaggaaatgggcgacgacgaggaggaagaagcggagctggatggtagaggagggaatggggtggaggataagttcctgaagatagatgagttgacggagttcctggagaagggtgaggaagaggagtatggtagtggtgccaagcggagagagaagaaggcggcgaaaaactggatggttgagagtgatggtgaggatgacgatgaggatgaagacgaggaccaattggatttagaagattttgaggatgatgaggaggaggatgaagcaggcggtggagatattcggtataaagatttttttgagaagggacataacaagcaagttaagaacagagatggttccacaaagaaagttcaattcaaggatgatgatgcacatgaatctgaacttgatgacagtgagaatgatgatggaaatgttcaacaagagcaaggtctctcaactcacgaaaaggagcgtctgaagatgcgtgctaaaatagagcaaatggagaaagctagccttgaacccagcacatggaccatgcagggagaggttactgcttctaagaggcccaaaaacagcgccctagaagtggaccttgattttgagcacaatgtaagacctgcccctgtaatcaccgaggaagtgacagcttcccttgaagaaatgataaagaaaagaatcacagagagtctttttgatgatgtcgagaaacctactatgttgccatctaaagctccaaaggagcacaaggaactggatgaaactaagagcaagaagggtcttgctgaactctatgaggatgattatgcacaaaaggcaggcattgcacctgcccctctttctatttcagatgaactaaagaaagaggcaaatactttatttaagcggatatgtttgaaattggatgcgctatcacatttccactttgctccaaagccagtcattgaggatatgtctatacaagcaaatgttcctgctttagccatggaagagattgcacctgtagctgtttctgatgcggcaatgcttgcccctgaagagatctttgaaggaaaaggtgatgttaaggaagagggggaacttacacaggctgagcgcaagagaagaagagctaacaagaaaaggagatatgcagcatcccataaggagaggccagccaagttgcagaaagattga

SEQ ID NO: 4858 - protein, 544 aa, Sorghum bicolor
  misc_feature: Ceres ANNOT ID no. 6040397
  misc_feature (20)..(544): Pfam Id: Mpp10 Pfam Desc: Mpp10 protein
  misc_feature (175)..(369): NCBI GI: 32400814 NCBI Desc: dna topoisomerase ii inhibitor [triticum aestivum]
  misc_feature (118)..(543): NCBI GI: 108883177 NCBI Desc: u3 small nucleolar ribonucleoprotein protein mpp10 [aedes aegypti]
  misc_feature (122)..(541): NCBI GI: 2230873 NCBI Desc: m phase phosphoprotein 10 [homo sapiens]
  misc_feature (122)..(541): NCBI GI: 116497055 NCBI Desc: m-phase phosphoprotein 10 (u3 small nucleolar ribonucleoprotein) [homo sapiens]
  misc_feature (122)..(541): NCBI GI: 119620182 NCBI Desc: m-phase phosphoprotein 10 (u3 small nucleolar ribonucleoprotein), isoform cra_a [homo sapiens]
  misc_feature: Useful for making plants with modulated heat sensitivity
  misc_feature: Functional homolog of the protein sequence given in SEQ ID NO 13183
MVMDLDEPLDAAAAEKGEAALRRLTEADPALFLSPSVDLAAAARAASQYIYSSLAPLSLAQPPPLPTLLADPAFDAEQIWSQIELLARPLLPHLRRQLRRLEQQPPSQQPPVETLAVAEGEQLEEDGESSESEELKNEEEELEGTEDEEELEGTEDEEEMGDDEEEEAELDGRGGNGVEDKFLKIDELTEFLEKGEEEEYGSGAKRREKKAAKNWMVESDGEDDDEDEDEDQLDLEDFEDDEEEDEAGGGDIRYKDFFEKGHNKQVKNRDGSTKKVQFKDDDAHESELDDSENDDGNVQQEQGLSTHEKERLKMRAKIEQMEKASLEPSTWTMQGEVTASKRPKNSALEVDLDFEHNVRPAPVITEEVTASLEEMIKKRITESLFDDVEKPTMLPSKAPKEHKELDETKSKKGLAELYEDDYAQKAGIAPAPLSISDELKKEANTLFKRICLKLDALSHFHFAPKPVIEDMSIQANVPALAMEEIAPVAVSDAAMLAPEEIFEGKGDVKEEGELTQAERKRRRANKKRRYAASHKERPAKLQKD

SEQ ID NO: 4859 - DNA, 1722 bp, Sorghum bicolor
  misc_feature: Ceres ANNOT ID no. 6040398
  misc_feature: Encodes the peptide sequence at SEQ ID NO 4860
atggcgtcgcacatcatcctgccgccggacgacgccgacgagaaccacaaccaccaggccgaggaggaggagcgggaggagctggggcgcgacgaagacgccgacgacgaggagcacgggcacgggcaccccccggcgctgccacccaaggcggcgctgccgttctcggccacgtgcgtgcggatctcccgcgactcgtacccgaacctccgcgcgctccgcaacgcctcctctgtcagcctcgccgacgccgcctacgtcaagatctccgagggcgactacgggtacgtcctcgacgacgtcccgcacttcaccgactacctccccgacatcccgacttaccctaatccactacaagatcatccagcctattcaactgtcaagcagtattttgtcaatgaagatgacactgtacctcaaaaggttgttgttcagaagaacagtcggcgtggtgttcacttccgtcgtgctgggcctcgtcagaggatttattttggcaccgatgaagtgaaggcctgcattgtaacttgtggaggcctgtgccctgggcttaacactgttatcagggaactggtgtgtggcttgtcacacatgtacaatgtcagcagcatttttggaatacagaatggatacaagggtttctattctagcaactaccttcccctgacaccaaagagcgtcaatgacatccacaaaaggggtggtacagttctaggaacatcacgaggtggccatgatacaaaaaagattgttgataacattcaagatcgtggaatcaatcaggtgtatatcatcggaggagatggaactcagaagggagcatatgagatcttcaaggaaatccggaaacgtggcctcaaagtttctgtcgctggagttccaaagacaatagataatgacattgcgatcatcgacaagtcctttggttttgatacggctgtggaagaggcccagcgcgccattgattcagctcacgtggaagcttgcagtgctgagaatggaataggtttagtaaaactgatgggtcgttatagtgggttcattgcgatgtacgctactcttgctagtcgagatgtggactgctgtttgattccagagtctccattttatctggacggagagggtggattgcttcaatatgtagaaaagaggctgaaagagaacaagcacatggttattgttgttgctgagggagcagggcaggatcttattgcgaaaagcatagccacatcagatcaacaagatgcatctggaaataagctgcttcttgatattggtctgtggctgactcacaagataaaggactacttcaaaagcaaaaagatggagatgacgattaaatacatagatcctacatacatgatccgtgctattccaagcaatgcatcagacaatgtctactgcacacttctagctcacagtgctatccatggcgcaatggcggggtatagcttcactgttggaatggtcaacggaagacatacctatatacctttctatcgggtgacatccacaaggaacaaggttaaagtcactgacaggatgtgggcaaggcttctgtcgtccaccaaccagccaagtttcctgagtcagaaggatatcgatgaagcgagtgaggcggataggctggcaaacaggccaccactgccaacgggtgccagctctcgcgtggcgaggtctttcgatcaatcttcgtcgtgttcttcaaatggagagatctag

SEQ ID NO: 4860 - protein, 573 aa, Sorghum bicolor
  misc_feature: Ceres ANNOT ID no. 6040398
  misc_feature (171)..(424): Pfam Id: PFK Pfam Desc: Phosphofructokinase
  misc_feature (88)..(555): NCBI GI: 92877935 NCBI Desc: phosphofructokinase [medicago truncatula]
  misc_feature (79)..(539): NCBI GI: 19699124 NCBI Desc: at4g26270/t25k17_80 [arabidopsis thaliana]
  misc_feature (88)..(541): NCBI GI: 92893972 NCBI Desc: phosphofructokinase [medicago truncatula]
  misc_feature (88)..(553): NCBI GI: 10176767 NCBI Desc: pyrophosphate-dependent phosphofructo-1-kinase-like protein [arabidopsis thaliana]
  misc_feature (76)..(533): NCBI GI: 53749196 NCBI Desc: at4g29220 [arabidopsis thaliana]
MASHIILPPDDADENHNHQAEEEEREELGRDEDADDEEHGHGHPPALPPKAALPFSATCVRISRDSYPNLRALRNASSVSLADAAYVKISEGDYGYVLDDVPHFTDYLPDIPTYPNPLQDHPAYSTVKQYFVNEDDTVPQKVVVQKNSRRGVHFRRAGPRQRIYFGTDEVKACIVTCGGLCPGLNTVIRELVCGLSHMYNVSSIFGIQNGYKGFYSSNYLPLTPKSVNDIHKRGGTVLGTSRGGHDTKKIVDNIQDRGINQVYIIGGDGTQKGAYEIFKEIRKRGLKVSVAGVPKTIDNDIAIIDKSFGFDTAVEEAQRAIDSAHVEACSAENGIGLVKLMGRYSGFIAMYATLASRDVDCCLIPESPFYLDGEGGLLQYVEKRLKENKHMVIVVAEGAGQDLIAKSIATSDQQDASGNKLLLDIGLWLTHKIKDYFKSKKMEMTIKYIDPTYMIRAIPSNASDNVYCTLLAHSAIHGAMAGYSFTVGMVNGRHTYIPFYRVTSTRNKVKVTDRMWARLLSSTNQPSFLSQKDIDEASEADRLANRPPLPTGASSRVARSFDQSSSCSSNGEI

SEQ ID NO: 4861 - DNA, 888 bp, Sorghum bicolor
  misc_feature: Ceres ANNOT ID no. 6040406
  misc_feature: Encodes the peptide sequence at SEQ ID NO 4862
atgccgttgaggcggcgacagccgcggcggccggagacgggtgcggcggagaggtacagggagatgcggatcggggctgcgctgtcgcggccctgggactatcccacggcctgcggcgagcttgcagcgctcctgcgcctcggatacgcggacctccctaaggcagcccaggcgctcgttgcctccgatgtgctgctagcgtttcgcctccttcccgatgtgcagacaggatatgcagtaagcactgctaatgttcttctccaagcggtagaagttgccctaccaaagcaaaagaaggcgcaggctgtttcagagttcaagcactctattattgcacataaaaggcgttcaagagtccaacaaaattcaggttcaccagacataccacaagatatacttgttcatatcttcagtttcctggacatgcattctttggtagcagcaggtcttgtctgctggtcttggaattcagcggcaaatgacaacaaactgtggaagatgaattactcgattttctttggcctcagccatttgagttgcaacaacatccctgtatctggtgtgcactacagcatgaattcagtgtcagattatccaagctttagctggaaggagtccttccacaaatgtgcgtcgtggaaatttgcatcaaatagagcattttgtgcacattgcagatcagttatttggctgagcaacctcacatgtgcttctccacaccattgccctaagaatagacaagatgaagtaaaattacggcctctgttacctgatacagttgctaaatacatattgcacgttgaagatctagcagcttcatcatctgaaagtgatgacacggatgactccgattacgagaattggcacccaagattttgggtgttatag

SEQ ID NO: 4862 - protein, 295 aa, Sorghum bicolor
  misc_feature: Ceres ANNOT ID no. 6040406
  misc_feature (123)..(170): Pfam Id: F-box Pfam Desc: F-box domain
  misc_feature (1)..(152): NCBI GI: 115465003 NCBI Desc: os05g0526300 [oryza sativa (japonica cultivar-group)]
  misc_feature (74)..(174): NCBI GI: 144924245 NCBI Desc: cyclin-like f-box [medicago truncatula]
  misc_feature (1)..(49): NCBI GI: 115435286 NCBI Desc: os01g0216700 [oryza sativa (japonica cultivar-group)]
MPLRRRQPRRPETGAAERYREMRIGAALSRPWDYPTACGELAALLRLGYADLPKAAQALVASDVLLAFRLLPDVQTGYAVSTANVLLQAVEVALPKQKKAQAVSEFKHSIIAHKRRSRVQQNSGSPDIPQDILVHIFSFLDMHSLVAAGLVCWSWNSAANDNKLWKMNYSIFFGLSHLSCNNIPVSGVHYSMNSVSDYPSFSWKESFHKCASWKFASNRAFCAHCRSVIWLSNLTCASPHHCPKNRQDEVKLRPLLPDTVAKYILHVEDLAASSSESDDTDDSDYENWHPRFWVL

SEQ ID NO: 4863 - DNA, 645 bp, Sorghum bicolor
  misc_feature: Ceres ANNOT ID no. 6040409
  misc_feature: Encodes the peptide sequence at SEQ ID NO 4864
atgtccctccttgactcgctcgcctcgctcggtctcgggtacgcaatcgccatcgcgctcggcttcctcgtcctcctcgcctcggtgctcctcgcctcctacttctgcctccgccgcggcggcgccggcgacttgttcggccccggagtcggcgttggcgtcggctccgcccgccacgccgcctcctccgcgtccagctccggccacatctccatcaccgtgccccgcgtcgtgttcgtggcggaggactacgactcgccgggctcctcctcccgcggcgccgccgccgcggcgtcccccgtcgggctcgacccctccgtcatcgcgtcgtacccgagggtgcccttctccaaggccggggcgggcgcgggcgcggacgccgaggtcgcctgctccatctgcctctgcgagtacagggagggcgagatgctgcgggtgatgcccgagtgcaggcacaggttccacctcacgtgcctcgacgcgtggctgcgccggagcgcgtcctgccccgtctgccgttcctcgcccatccccacccccgtcgccaccccgctctccacaccactctcggagcttgttccgctgtcgcagtatgctgccgaccgtcgccggagcaggtttgggtggttaatcggtgatgcttag

SEQ ID NO: 4864 - protein, 214 aa, Sorghum bicolor
  misc_feature: Ceres ANNOT ID no. 6040409
  misc_feature (131)..(172): Pfam Id: zf-C3HC4 Pfam Desc: Zinc finger, C3HC4 type (RING finger)
  misc_feature (2)..(206): NCBI GI: 115439793 NCBI Desc: os01g0736600 [oryza sativa (japonica cultivar-group)]
  misc_feature (101)..(206): NCBI GI: 87162786 NCBI Desc: zinc finger, ring-type; ringv [medicago truncatula]
  misc_feature (102)..(196): NCBI GI: 92876930 NCBI Desc: zinc finger, ring-type; ringv [medicago truncatula]
  misc_feature (40)..(194): NCBI GI: 22831074 NCBI Desc: c3hc4-type ring zinc finger protein-like [oryza sativa (japonica cultivar-group)]
  misc_feature (102)..(197): NCBI GI: 62642311 NCBI Desc: zinc finger family protein [picea abies]
  misc_feature: The sequence is a functional homolog of SEQ ID NO 384 in the 10/666,642US patent application
  misc_feature: Useful for making plants with modulated growth and phenotype characteristics
  misc_feature: The sequence is a functional homolog of SEQ ID NO 384 in the 20070033671 US patent application
  misc_feature: The sequence is a functional homolog of SEQ ID NO 384 in the 10/666,642 US patent application
  misc_feature: The sequence is a functional homolog of SEQ ID NO. 329 in the 11/188,298 US application
  misc_feature: The sequence is a functional homolog of SEQ ID NO. 271 in the 11/188,298 US application
MSLLDSLASLGLGYAIAIALGFLVLLASVLLASYFCLRRGGAGDLFGPGVGVGVGSARHAASSASSSGHISITVPRVVFVAEDYDSPGSSSRGAAAAASPVGLDPSVIASYPRVPFSKAGAGAGADAEVACSICLCEYREGEMLRVMPECRHRFHLTCLDAWLRRSASCPVCRSSPIPTPVATPLSTPLSELVPLSQYAADRRRSRFGWLIGDA

SEQ ID NO: 4865 - DNA, 2874 bp, Sorghum bicolor
  misc_feature: Ceres ANNOT ID no. 6040422
  misc_feature: Encodes the peptide sequence at SEQ ID NO 4866
  misc_feature: Down-regulated in shoot tissues in response to salicylic acid treatment
atgcgaggaggaggaggaggagggccgggcgtcggcacgccggggcgcccgcgatgggggtccggcgccacgacgccgcggtcgctgagcacgggctcctcgccgcgcggctccgaccggagctccgacgacggggaggagctggtcgaggtcacgctggacctcctcgaggacgacaacattgtgctgcggagcgtcgagccggcagcggcgggctccgccgcggtggcggctccgccgcgccgccacccggacccgaccccgtcgtcgtccggggcgccgtcgcggtcgcgctcgcccgcgatgcgccggacctcctcgcaccgcctgctgcagttctcgcaggagctcaaggctaccgccaaccgcgccaagcagttctcgcaggacctcaccaagcgcttcacgcgcacacagagccgcgccaacctcgcggacccgccgccggccaccgccaccgccgcggcgccgtcctcgggcatcgacgccgcgctcgaggcccgcgcacagcgccgccgccgcgcgcagctcgaccgcaccaagtccggcgcgcagcgcgcgatccgcggactccgattcatcagcggcggcaacaaggctagcaacgcctggatcgaggtccaggctaacttcgaccgcctcgcgcgcgacggctacctctcccgcgccgactttcccaaatgcatagggatgacggagtcgcaggagttcgcgatggagctcttcgacacgctgagccgccgccggcagatgcaggtggataagatcaacaaggatgagctgcgcgagatctggcagcagatcaccgacaacagcttcgactcgcgcctccagatcttcttcgacatggtggataagaacgcagatggccatatcacggaggccgaggtgaaagagatcattatgctgagtgcttctgctaataaattgtcgaggcttaaggagcaagctgaggagtatgcagccttgatcatggaggaacttgatcctgaagggcttggctacattgagctttggcaattggagacactgctactgcaaaaggatacctatgtgaactacagccaggccttgagttacacaagccaggcactaagccagaaccttgctggtctgaggaaaagaagtccaatccgaaaaattagcagcacggtgaactactatctggaggacaactggaaacgtctctgggtgcttgcagtgtggattggaataatggctgggttgttcatttggaagttcattcagtaccgtaaccgttatgtctttgatgtgatgggctactgtgtcacaactgcgaaaggtgctgcagagactctcaaactgaacatggcgcttattctcttgcctgtatgccgcaacactatcacctggctgcggaatactaaagctgcacgagcattgccgttcgatgacaacataaacttccataagactattgcagcagcaattgtggttggtgttgttcttcatgcagggaaccaccttgtatgtgattttccacggctcattggttcatcagagatgaagtatgctccgctgcgcaaatactttggggaaaataaaccaacatatctagctctggtaaaaggagtggagggcataacaggggtaatcatggttgtgtgcatgcttatcgcttttactctagcaacaaggtggttccgccgtagcctggtgaagcttccaaggccatttgacaaactaactggcttcaatgcattctggtactcccatcatctgttcatcattgtgtacatagcacttgttattcatggagagtgtctataccttatccatgactggtacaaaaagacgacatggatgtaccttgctgttcctgttggtctgtatgtaggggaaaggactctgaggtttttcagatcaggcagttattctgttcggttattgaaggtggctatatatcctggtaatgttttgacattgcagatgtctaaacctcctgcattccgttacaagagcggacagtatatgtttgttcaatgccctgcagtttcaccttttgaatggcatcctttctcaattacttcagcacctggggatgactatttaagcattcatgttcgacaacttggtgactggacacgggagctcaagcgggtattctcagcagcttgtgagccaccggtgggtgggaaaagtggccttcttcgagcagacgagacaactaagaaagcgttaccaaaacttttgattgatggaccatatggttctcctgcacaagactacagcaagtatgatgttctactacttgtcggattaggaattggtgccacaccttttattagcatactgaaagacctgctcaataacatcatcaaaatggaagaagaggaagaagcttcaagtgatctttacccaccaattggtcgcagcaaggcacatgttgatcttgacacccttatgaggattacctcaaaaccaaagagggtactgaagacaacaaatgcttacttttattgggtgacacgtgaacaagggtcttttgattggtttaaaggggtcatgaatgaaattgctgaactagatcagaggaatatcattgagatgcacaactatctcacaagtgtttacgaggaaggggatgcccggtcagcactcattacaatgctacaagctctcaaccatgccaagaatggtgttgatatagtttctggaactaaagtgcggacacattttgcaagaccaaattttaagaaggtcctatctaagatagctaccaaacatccatatgctaagataggagtgttctattgtggggctccagttctggcacaggaactaagcaaactctgttatgaattcaatggcaagtctacaacaaaattcgaattccacaaggaacatttctga

SEQ ID NO: 4866 - protein, 957 aa, Sorghum bicolor
  misc_feature: Ceres ANNOT ID no. 6040422
  misc_feature (753)..(940): Pfam Id: NAD_binding_6 Pfam Desc: Ferric reductase NAD binding domain
  misc_feature (176)..(275): Pfam Id: NADPH_Ox Pfam Desc: Respiratory burst NADPH oxidase
  misc_feature (631)..(747): Pfam Id: FAD_binding_8 Pfam Desc: FAD-binding domain
  misc_feature (434)..(590): Pfam Id: Ferric_reduct Pfam Desc: Ferric reductase like transmembrane component
  misc_feature (276)..(304): Pfam Id: efhand Pfam Desc: EF hand
  misc_feature (5)..(957): NCBI GI: 116805085 NCBI Desc: respiratory burst oxidase-like protein c [zea mays]
  misc_feature (1)..(957): NCBI GI: 125859103 NCBI Desc: respiratory burst oxidase homologue a [hordeum vulgare subsp. vulgare]
  misc_feature (10)..(957): NCBI GI: 114432120 NCBI Desc: respiratory burst oxidase protein b [zea mays]
  misc_feature (215)..(957): NCBI GI: 2654870 NCBI Desc: rbohaosp [oryza sativa]
  misc_feature (215)..(957): NCBI GI: 115439771 NCBI Desc: os01g0734200 [oryza sativa (japonica cultivar-group)]
  misc_feature: Down-regulated in shoot tissues in response to salicylic acid treatment
MRGGGGGGPGVGTPGRPRWGSGATTPRSLSTGSSPRGSDRSSDDGEELVEVTLDLLEDDNIVLRSVEPAAAGSAAVAAPPRRHPDPTPSSSGAPSRSRSPAMRRTSSHRLLQFSQELKATANRAKQFSQDLTKRFTRTQSRANLADPPPATATAAAPSSGIDAALEARAQRRRRAQLDRTKSGAQRAIRGLRFISGGNKASNAWIEVQANFDRLARDGYLSRADFPKCIGMTESQEFAMELFDTLSRRRQMQVDKINKDELREIWQQITDNSFDSRLQIFFDMVDKNADGHITEAEVKEIIMLSASANKLSRLKEQAEEYAALIMEELDPEGLGYIELWQLETLLLQKDTYVNYSQALSYTSQALSQNLAGLRKRSPIRKISSTVNYYLEDNWKRLWVLAVWIGIMAGLFIWKFIQYRNRYVFDVMGYCVTTAKGAAETLKLNMALILLPVCRNTITWLRNTKAARALPFDDNINFHKTIAAAIVVGVVLHAGNHLVCDFPRLIGSSEMKYAPLRKYFGENKPTYLALVKGVEGITGVIMVVCMLIAFTLATRWFRRSLVKLPRPFDKLTGFNAFWYSHHLFIIVYIALVIHGECLYLIHDWYKKTTWMYLAVPVGLYVGERTLRFFRSGSYSVRLLKVAIYPGNVLTLQMSKPPAFRYKSGQYMFVQCPAVSPFEWHPFSITSAPGDDYLSIHVRQLGDWTRELKRVFSAACEPPVGGKSGLLRADETTKKALPKLLIDGPYGSPAQDYSKYDVLLLVGLGIGATPFISILKDLLNNIIKMEEEEEASSDLYPPIGRSKAHVDLDTLMRITSKPKRVLKTTNAYFYWVTREQGSFDWFKGVMNEIAELDQRNIIEMHNYLTSVYEEGDARSALITMLQALNHAKNGVDIVSGTKVRTHFARPNFKKVLSKIATKHPYAKIGVFYCGAPVLAQELSKLCYEFNGKSTTKFEFHKEHF

SEQ ID NO: 4867 - DNA, 648 bp, Sorghum bicolor
  misc_feature: Ceres ANNOT ID no. 6040429
  misc_feature: Encodes the peptide sequence at SEQ ID NO 4868
atgaacgccttccggttcctcggggacatgacccacctcttctcggtcctcgtcctcctcctcaagatctacgccaccaagtcctgctcaggggtgtcgaggaagacgcaggagctgtacatgttggtgttcgtcgcgaggtacctggacctcttcacggactacgtctcgctctacaactcggtgatgaaggtggtgttcatcaccagctcggcggcgatcgtgtggtgcatgcgccgccacccgcaggtgcggaggacgtacgacaaggagcaggataccttccgccatgcggtgctcgtcgccgcatcattcctgctcgcgctgatgttccacgagcgattcaccttccgcgagatatgctgggcattttcaatctatctcgaggcagtggccattctcccacagttagtgttgctccagagaagcagaaatgtggataacttaactggacaatatgttttcttccttggggcctaccgtgcattttacattctaaactggatttaccgttatttcacggagggtcatcacagcagatggatcccttggcttgctggtttggtgcagacagctctgtatgcagatttcttttactattatttcttaagttggaagaacaatgttaagctcgagttgcctgcatga

SEQ ID NO: 4868 - protein, 215 aa, Sorghum bicolor
  misc_feature: Ceres ANNOT ID no. 6040429
  misc_feature (1)..(205): Pfam Id: ER_lumen_recept Pfam Desc: ER lumen protein retaining receptor
  misc_feature (1)..(215): NCBI GI: 92867121 NCBI Desc: er lumen protein retaining receptor [medicago truncatula]
  misc_feature (1)..(215): NCBI GI: 32189301 NCBI Desc: at1g29330 [arabidopsis thaliana]
  misc_feature (1)..(215): NCBI GI: 77550860 NCBI Desc: er lumen protein retaining receptor [oryza sativa (japonica cultivar-group)]
  misc_feature (1)..(215): NCBI GI: 6685428 NCBI Desc: er lumen protein retaining receptor (hdel receptor) (pgp169-12)
  misc_feature (1)..(215): NCBI GI: 9293986 NCBI Desc: er lumen protein-retaining receptor-like protein [arabidopsis thaliana]
MNAFRFLGDMTHLFSVLVLLLKIYATKSCSGVSRKTQELYMLVFVARYLDLFTDYVSLYNSVMKVVFITSSAAIVWCMRRHPQVRRTYDKEQDTFRHAVLVAASFLLALMFHERFTFREICWAFSIYLEAVAILPQLVLLQRSRNVDNLTGQYVFFLGAYRAFYILNWIYRYFTEGHHSRWIPWLAGLVQTALYADFFYYYFLSWKNNVKLELPA

SEQ ID NO: 4869 - DNA, 375 bp, Sorghum bicolor
  misc_feature: Ceres ANNOT ID no. 6040458
  misc_feature: Encodes the peptide sequence at SEQ ID NO 4870
atggcgctggcgtcgaggctggcgcagctgcaggccaaggcgtgcgaggccacgcggttcgtggcgcggcacgggtgcgagtaccagcggtccctcgcggagaagaacaagaagtacgtcgtggagccgcccaccatcgagaagtgccaggagctctcaaatcagctcttctacacccgcctcgccagccttcctggtcgctacgaagcattctggaaagagcttgatcaagtgaagcagctgtggaagaacaggaacgatctgaaagtcgagcacgccggtgtcgcagcactcttcggcatcgagctgtacgcgtggttctgcgcaggcgagatcgttgggagaggatttactttgacagggtatcatgtctga

SEQ ID NO: 4870 - protein, 124 aa, Sorghum bicolor
  misc_feature: Ceres ANNOT ID no. 6040458
  misc_feature (10)..(124): Pfam Id: ATP-synt_G Pfam Desc: Mitochondrial ATP synthase g subunit
  misc_feature (3)..(124): NCBI GI: 102139975 NCBI Desc: mitochondrial atp synthase g subunit family protein [musa acuminata]
  misc_feature (3)..(123): NCBI GI: 21553484 NCBI Desc: copia-like retroelement pol polyprotein [arabidopsis thaliana]
MALASRLAQLQAKACEATRFVARHGCEYQRSLAEKNKKYVVEPPTIEKCQELSNQLFYTRLASLPGRYEAFWKELDQVKQLWKNRNDLKVEHAGVAALFGIELYAWFCAGEIVGRGFTLTGYHV

SEQ ID NO: 4871 - DNA, 639 bp, Sorghum bicolor
  misc_feature: Ceres ANNOT ID no. 6040463
  misc_feature: Encodes the peptide sequence at SEQ ID NO 4872
atgggctgcgcgtcgtccaagcagttcggcaggagcgcgtcgtcggcgcacgaggatcccgccgtgctggcgtcccagacctcattcacggtgaacgaggtggaggcgctgtacgagctgtacaagaagctgagcttctccatcgtcaaagacgggctcatccacaaggaggagtttcagttcgccttgttcaggaacagcaagagagcgaacctcttcgcggacagggtcttcgatctgttcgatctcaaacggaacggagtcatcgatttcgaggaattcgtgcggtcgctcagtgtgttccaccctaacgcagatacatcggagaagacagcgttcgcgttcaagctgtatgatctaagagggacaggttacatcgaaaaagaagagctcagagagatggtcttggcactgcttgacgagtctgatctctgcctttcagatagcaccgttgagacgattgtcgataatacattcagtcaagcggactcgaatggggacggcaggatagatcctgaagaatgggaagaattcgtgaagaagaacccggcaacattaagaaacatgtctctcccctatttgcaggacattaccatgtcatttccgagcttcataatgcattcagaagccagtgactga

SEQ ID NO: 4872 - protein, 212 aa, Sorghum bicolor
  misc_feature: Ceres ANNOT ID no. 6040463
  misc_feature (73)..(101): Pfam Id: efhand Pfam Desc: EF hand
  misc_feature (154)..(182): Pfam Id: efhand Pfam Desc: EF hand
  misc_feature (1)..(212): NCBI GI: 79835718 NCBI Desc: calcium sensing protein [brassica juncea]
  misc_feature (1)..(212): NCBI GI: 79835606 NCBI Desc: calcium sensing protein [oryza sativa (indica cultivar-group)]
  misc_feature (1)..(212): NCBI GI: 113579699 NCBI Desc: os05g0534400 [oryza sativa (japonica cultivar-group)]
  misc_feature (1)..(212): NCBI GI: 76577799 NCBI Desc: calcineurin b-like protein 7 [oryza sativa (japonica cultivar-group)]
  misc_feature (1)..(212): NCBI GI: 76577801 NCBI Desc: calcineurin b-like protein 8 [oryza sativa (japonica cultivar-group)]
  misc_feature: Useful for making plants with modulated salt sensitivity
  misc_feature: Functional homolog of the protein sequence given in SEQ ID NO 13664
  misc_feature: Useful for making plants with modulated drought sensitivity
  misc_feature: Functional homolog of the protein sequence given in SEQ ID NO 13665
  misc_feature: Useful for making plants with modulated water use efficiency
  misc_feature: Functional homolog of the protein sequence given in SEQ ID NO 13666
  misc_feature: The sequence is a functional homolog of SEQ ID NO 2 in US patent 7250555
MGCASSKQFGRSASSAHEDPAVLASQTSFTVNEVEALYELYKKLSFSIVKDGLIHKEEFQFALFRNSKRANLFADRVFDLFDLKRNGVIDFEEFVRSLSVFHPNADTSEKTAFAFKLYDLRGTGYIEKEELREMVLALLDESDLCLSDSTVETIVDNTFSQADSNGDGRIDPEEWEEFVKKNPATLRNMSLPYLQDITMSFPSFIMHSEASD

SEQ ID NO: 4873 - DNA, 2637 bp, Sorghum bicolor
  misc_feature: Ceres ANNOT ID no. 6040470
  misc_feature: Encodes the peptide sequence at SEQ ID NO 4874
atgttaaggtctctctctttcctcctactccactcatcgctccactccaggcagagcccatctagactcctctcttctgccgcctcctcccgtggtaccctaggcggccgcgcgcatggaaccgtctctgccgtactggagatcgtcggccccatcgagcttctgttcccggccttcgaggcgcgcctctatgtgcgcctcgtgcggcgctgcgcgcgcggcgcgctcgccgcgggcgccgccgctgcccacgcgcacatcgtcaaacgaggatttgcgtgcgacatgctcgtatccaacgtcctgctggattcttacgccaaaggaggctctcttgcggccggacgccagctgttcgacgaaatgccacacagggacgtcgtgtcctggtgtaccgtcatttccgcgcacgttagccgcgggatcttcgtcgaggccatcggattatttaaggacttattgtcctctgatcaggtgaagccaaatcagtttgtcatctcatccgtactgaacgcctgtgccaggttgggtgtcatggagcttgggctcatggtgcatgcattggtggtcaagtgtggcttgggtgtcgataggtttgtagaagttggattagtggacatgtatgcgaaatgtggcaacacgggtgatgcttttaggctgttcaatgagattccgatgaagggctctgttgcttggaatgcaatgatttatggttttgtcgagaatggttgtttagtggaggctgctgagcttttccgggatatgcataaaattggcatgtcaatggatgtggtgaccttgagggtagtagctggtgttgctgctgttcttggatcatttgatctttctaggaacattcatgtttatgctcttaaagtgggcttgggagtagactgttttgttgtgtctgaactcatcaagtcagccgggatggtaggtgaaactcagtatattggaaagcttgttgctgcagttagaaagcgtgacggatctttgtattctttggctatttcaagctatcactcaaatggttgtcaggatgaagcagtgaaacttgcagaaaggtttctttcttcaggtctcagcttaagggaaggagacatggttacagtggtaggcatatgtcaaatagaagaggaggttcgacaaatgcatgcttttactctgaaaaccggaggcttctgttatactaacgtatgcaatgcccttatgtcagtatattctgaacttggatcactgatgtgtgcggaatcaatcttcaaaactatgcaatcaccagatgttgtatcatggtctggagtgatggcaggttgtgtcaagaacctccaatttgaaagagcgtgcagttactttaggcagttaagcaacactggagcaccgctagatcagcattgtgttgttactgtcataaatgcatgtactggtcttcaggacttggataagggaaggcagatacactcgtttgctcttaaacttgggctactgcttgctgatttcatcagtgcatccctagtaaacatgtatgcaaagtgccattgcattgagggtgctgctgagttattcacccatgcattgtttccacggaatttagttgtaactaatgccatgctctctggatattgctggaatttcctgccagataaagctctgctgctattttgcagggaatatcagtttggtctgtgtcctgatcgattcactttctcaactattcttggtgcatgttctgatataagagcaaagcaggctggcgagcagatccatggctaccttgtaaagattggttctgaaaatctggatgtcattgttggaaatgctatcatagacctttatgtcaagtgtggatgcatttctagtgcctgtagattctttcatagcatgaagagtaggaacatcaattcatatgccatgttaatgttgggttatattcagaacagatgcagtgatgaagctcttcatcttttctctaagatgcagcacagtggactgcgtgcaaaccgtgtcacctttgcaagaatcttacggggatgtcgcgatctttgtgctattgatttaggaagacaactgcatgcttccatcataaagatgggtctgctttctgatgtatatgtcacaaatgcacttgtgggaatgtacaaagcaactgacattcagactgaatcaagaagaaactctgaagaaacgttgacaggaaatgtttcagaacaggataccacagatagtttcagttcagaacaaagctatgtgagcagcactcttgaagaacttggactgttcacattggatgaagagaatgaccatgtaacttctgccaatgcgtggaagatctacactggtgctgcttctcaattctatggaactccacttcccattcatgtggttggacatgaatttggaatcaataacaacaatgggaataagctttcgctaaattacaaggattccagctacaagggaaatataaatggatctgttaagttatataacttgttgcaagaggacagcaccaaatctgatcactttgtcgtcattatttttgttgatagtaggaatttaaagatgagggatgcaagatttgttaatgtggaaccgctgaaacgatatggtgatctcccagcacttgggtttcctccttga

SEQ ID NO: 4874 - protein, 878 aa, Sorghum bicolor
  misc_feature: Ceres ANNOT ID no. 6040470
  misc_feature (230)..(264): Pfam Id: PPR Pfam Desc: PPR repeat
  misc_feature (633)..(667): Pfam Id: PPR Pfam Desc: PPR repeat
  misc_feature (60)..(722): NCBI GI: 78183583 NCBI Desc: ppr1106-17 [physcomitrella patens]
  misc_feature (40)..(690): NCBI GI: 54695180 NCBI Desc: ppr986-12 [physcomitrella patens]
  misc_feature (80)..(698): NCBI GI: 32482936 NCBI Desc: osjnbb0072m01.1 [oryza sativa (japonica cultivar-group)]
  misc_feature (80)..(698): NCBI GI: 116310835 NCBI Desc: osigba0140j09.3 [oryza sativa (indica cultivar-group)]
  misc_feature (82)..(677): NCBI GI: 38423978 NCBI Desc: ppr-repeat protein-like [oryza sativa (japonica cultivar-group)]
MLRSLSFLLLHSSLHSRQSPSRLLSSAASSRGTLGGRAHGTVSAVLEIVGPIELLFPAFEARLYVRLVRRCARGALAAGAAAAHAHIVKRGFACDMLVSNVLLDSYAKGGSLAAGRQLFDEMPHRDVVSWCTVISAHVSRGIFVEAIGLFKDLLSSDQVKPNQFVISSVLNACARLGVMELGLMVHALVVKCGLGVDRFVEVGLVDMYAKCGNTGDAFRLFNEIPMKGSVAWNAMIYGFVENGCLVEAAELFRDMHKIGMSMDVVTLRVVAGVAAVLGSFDLSRNIHVYALKVGLGVDCFVVSELIKSAGMVGETQYIGKLVAAVRKRDGSLYSLAISSYHSNGCQDEAVKLAERFLSSGLSLREGDMVTVVGICQIEEEVRQMHAFTLKTGGFCYTNVCNALMSVYSELGSLMCAESIFKTMQSPDVVSWSGVMAGCVKNLQFERACSYFRQLSNTGAPLDQHCVVTVINACTGLQDLDKGRQIHSFALKLGLLLADFISASLVNMYAKCHCIEGAAELFTHALFPRNLVVTNAMLSGYCWNFLPDKALLLFCREYQFGLCPDRFTFSTILGACSDIRAKQAGEQIHGYLVKIGSENLDVIVGNAIIDLYVKCGCISSACRFFHSMKSRNINSYAMLMLGYIQNRCSDEALHLFSKMQHSGLRANRVTFARILRGCRDLCAIDLGRQLHASIIKMGLLSDVYVTNALVGMYKATDIQTESRRNSEETLTGNVSEQDTTDSFSSEQSYVSSTLEELGLFTLDEENDHVTSANAWKIYTGAASQFYGTPLPIHVVGHEFGINNNNGNKLSLNYKDSSYKGNINGSVKLYNLLQEDSTKSDHFVVIIFVDSRNLKMRDARFVNVEPLKRYGDLPALGFPP

SEQ ID NO: 4875 - DNA, 1557 bp, Sorghum bicolor
  misc_feature: Ceres ANNOT ID no. 6040476
  misc_feature: Encodes the peptide sequence at SEQ ID NO 4876
atggccaacagcgagtatgagtacgtgaagagggagttcgagtttgatcgctgcctctcgccctctaactggatcgttgtccgcatcgacggctgccacttccacaggttctccaagattcacgcctttgagaaaccgaacgatgagaacgctctaagattaatgaatgcttgtgccactgctgtgcttgagaaattccctgacatagtctttgcttatggtgttagtgatgagtacagtttcatttttagagaggaaacagagttctatcaccggcgagaaagcaaaattctctctttatgtgtttcctacttcacttctgtgtacgtaatgaagtggaaagacttctttcctaacaaagagctgaaggagccaccatattttgatgctcgagctgtatgttacccaaatttgaagactattcgtgattatttggcttggagacaagtggactgtcatataaataatcagtacaatacctgcttctggatgttggtgaagtctggaaaaagtgaacaagaggctcagctagctttgaagggaacatttgcaaaggacaagaatgagctgcttgctcaacaattccaaataaactatgatgatgaaccgcctatgttccgcaaaggatctagtgtttaccgagaaaaggtagaaacaactgtgaagattgatgactatggggaacccataaaaagaccaagattgcaagttacagtggcgcatgttgatatcatagggcctgagttttgggaaaaccatcaacacattcttcgagaaggaaaaattctgcattggtttgtaaagaaatctgtcatcaatcacatcttttcgccttgtaattggatcgttgttcgcatcaatggttgccaatttgatcaattctcaacaattcattcatttgacaagccaaatgatgagactgcactaaggctgatgaatgaatctgcatctttgatgatggagcaataccctgacatcgtctttgcctatggttttagcaatgagtatagttttgtgttccatgagaagagtgagctatatcagagacaggaaagcctaatcctttcatcgtgttcttcatatttcacttctctttacatgatgaaatggaaagagttctccccccacaaagaattaatgcagacaccacgctttgaggcagaagctctatgttatccaaaactgaagatcgtatgtgaatacttgtcatggaggcaagcagagtgtcatgctggcaaccaatacaatacatgcttttggatgctagtgaattctggaaaaagcgaaaaagaagctcatgagatattgaagggaacattgtctaaagataaaaatgagttgctttttcagcaattccaaatgaactacaacaatgaacttgctatattccgaaagggttcatgtatttatcggcaaaaggtggaagaacttgcaggagctgaagacggtgacaacgacacaacaagagagcggtggcatgtgaaagtggaccatgttgacctaggacccgggttctggcgaaagcacccttggataatgactagttgcagtcggtag

SEQ ID NO: 4876 - protein, 518 aa, Sorghum bicolor
  misc_feature: Ceres ANNOT ID no. 6040476
  misc_feature (1)..(255): Pfam Id: Thg1 Pfam Desc: tRNAHis guanylyltransferase
  misc_feature (269)..(511): Pfam Id: Thg1 Pfam Desc: tRNAHis guanylyltransferase
  misc_feature (1)..(257): NCBI GI: 54645689 NCBI Desc: ga17959-pa [drosophila pseudoobscura]
  misc_feature (1)..(259): NCBI GI: 62897799 NCBI Desc: interphase cyctoplasmic foci protein 45 variant [homo sapiens]
  misc_feature (1)..(257): NCBI GI: 19921364 NCBI Desc: cg4103-pa [drosophila melanogaster]
  misc_feature (1)..(259): NCBI GI: 33989068 NCBI Desc: icf45 protein [homo sapiens]
  misc_feature (1)..(250): NCBI GI: 4539600 NCBI Desc: spcc63.07 [schizosaccharomyces pombe]
MANSEYEYVKREFEFDRCLSPSNWIVVRIDGCHFHRFSKIHAFEKPNDENALRLMNACATAVLEKFPDIVFAYGVSDEYSFIFREETEFYHRRESKILSLCVSYFTSVYVMKWKDFFPNKELKEPPYFDARAVCYPNLKTIRDYLAWRQVDCHINNQYNTCFWMLVKSGKSEQEAQLALKGTFAKDKNELLAQQFQINYDDEPPMFRKGSSVYREKVETTVKIDDYGEPIKRPRLQVTVAHVDIIGPEFWENHQHILREGKILHWFVKKSVINHIFSPCNWIVVRINGCQFDQFSTIHSFDKPNDETALRLMNESASLMMEQYPDIVFAYGFSNEYSFVFHEKSELYQRQESLILSSCSSYFTSLYMMKWKEFSPHKELMQTPRFEAEALCYPKLKIVCEYLSWRQAECHAGNQYNTCFWMLVNSGKSEKEAHEILKGTLSKDKNELLFQQFQMNYNNELAIFRKGSCIYRQKVEELAGAEDGDNDTTRERWHVKVDHVDLGPGFWRKHPWIMTSCSR

SEQ ID NO: 4877 - DNA, 1650 bp, Sorghum bicolor
  misc_feature: Ceres ANNOT ID no. 6040494
  misc_feature: Encodes the peptide sequence at SEQ ID NO 4878
  misc_feature: Up-regulated in root tissues in response to methyl jasmonate treatment
  misc_feature: Up-regulated in shoot tissues in response to methyl jasmonate treatment
  misc_feature: Up-regulated in shoot tissues in response to salicylic acid treatment
atgagccgcctactctcccggcggcaaattgacgccgtccgtcgatccgcacccctcgcgtgcgtgtccaggtggctgcacacgccgtcatttgcgacggtgtctccgcacgaggtttcaggttccagccccgcagaagtgcagaattttgtgcagggaagctggacagcatctgctaactggaactggatagttgatcccttgaacggtgaccaattcatcaaagttgctgaggttcagggaacagaaataaagccatttgtggagagtttatctaaatgcccaaagcatggacttcacaatccacttaaagctccagagaggtacctcatgtatggagatatatctgcaaaagctgcacatatgctgggccaacctgcagtctcagatttctttgctaaacttatccagagggtatctccaaagagctaccaacaagctcttgcagaagttcaagtttctcaaaagtttttggaaaacttttgtggagatcaggtacgttttctggcaaggtcatttgctgtacctggcaaccatcttggacaaagaagtaatggctaccgttggccatatggcccagttgcaattatcacaccattcaattttccattggagattcccttactgcaagtaatgggagcactatacatgggaaataaaccagtactcaaggttgacagcaaggttagcattgtgatggaacaaatgattaggttgcttcatgattgtggattgccagcggaggatatggatttcataaattctgatggtgtcacaatgaacaagcttctgttagaggctaatccgaaaatgacccttttcactgggagctcacgggtagcagagaaattggctgctgatttgaaaggccgagtcaaattggaggatgctggttttgattggaaaattcttggtccagatgttcaagaggttgattatgttgcatgggtttgcgatcaggatgcttatgcttgtagcggtcagaaatgctctgctcagtctgttctattcatgcacaagaattggtcttctagtggccttcttgagaaaatgaagaaactttctgaaagaaggaagcttgaagatttaacaattggtccagtccttacagttactacagaagccatgatagagcacatgaacaaccttctcaaaatacaaggatcgaaggttctgtttggtggtgaaccgttggcgaatcactcaattcccaaaatttatggcgccatgaagcctactgctgtatttgtccccctagaagaaattctaaaaagtgggaacttcgagcttgtgacaaaggagatatttggtccattccaggtagttacagaatactctgaggatcagcttgaattggtcttagaagcctgtgaaaggatgaacgcgcatctgacggctgcagtagtctcaaacgacccgctattcctgcaggatgtacttgggagatctgttaatgggacaacgtacgccgggattcgagcgaggaccactggtgctccacagaaccactggtttggtccggctggcgatccacgaggtgcagggatcggaactccggaggccatcaaacttgtctggtcctgccacagggagatcatatatgacgtcggccccgtgcccaagagctgggcgcttccttccgcgacttga

SEQ ID NO: 4878 - protein, 549 aa, Sorghum bicolor
  misc_feature: Ceres ANNOT ID no. 6040494
  misc_feature (55)..(516): Pfam Id: Aldedh Pfam Desc: Aldehyde dehydrogenase family
  misc_feature (1)..(549): NCBI GI: 73913050 NCBI Desc: delta-1-pyrroline-5-carboxylate dehydrogenase [triticum turgidum]
  misc_feature (2)..(549): NCBI GI: 15383744 NCBI Desc: delta-1-pyrroline-5-carboxylate dehydrogenase precursor [arabidopsis thaliana]
  misc_feature (23)..(549): NCBI GI: 92877332 NCBI Desc: aldehyde dehydrogenase; carbamoyl-phosphate synthase l chain, atp-binding [medicago truncatula]
  misc_feature (4)..(549): NCBI GI: 927428 NCBI Desc: fis1 [linum usitatissimum]
  misc_feature (2)..(549): NCBI GI: 10178084 NCBI Desc: dehydrogenase [arabidopsis thaliana]
  misc_feature (2)..(549): SWISSPROT Homolog: EC 1.5.1.12 Delta-1-pyrroline-5-carboxylate dehydrogenase 12A1, mitochondrial precursor
  misc_feature: Up-regulated in root tissues in response to methyl jasmonate treatment
  misc_feature: Up-regulated in shoot tissues in response to methyl jasmonate treatment
  misc_feature: Up-regulated in shoot tissues in response to salicylic acid treatment
  misc_feature: The sequence is a functional homolog of SEQ ID NO. 477 in the 11/188,298 US application
  misc_feature: The sequence is a functional homolog of SEQ ID NO. 537 in the 11/188,298 US application
  misc_feature: The sequence is a functional homolog of SEQ ID NO. 442 in the 11/188,298 US application
  misc_feature: The sequence is a functional homolog of SEQ ID NO. 304 in the 11/188,298 US application
  misc_feature: The sequence is a functional homolog of SEQ ID NO. 428 in the 11/188,298 US application
  misc_feature: The sequence is a functional homolog of SEQ ID NO. 435 in the 11/188,298 US application
  misc_feature: The sequence is a functional homolog of SEQ ID NO. 475 in the 11/188,298 US application
  misc_feature: The sequence is a functional homolog of SEQ ID NO. 437 in the 11/188,298 US application
MSRLLSRRQIDAVRRSAPLACVSRWLHTPSFATVSPHEVSGSSPAEVQNFVQGSWTASANWNWIVDPLNGDQFIKVAEVQGTEIKPFVESLSKCPKHGLHNPLKAPERYLMYGDISAKAAHMLGQPAVSDFFAKLIQRVSPKSYQQALAEVQVSQKFLENFCGDQVRFLARSFAVPGNHLGQRSNGYRWPYGPVAIITPFNFPLEIPLLQVMGALYMGNKPVLKVDSKVSIVMEQMIRLLHDCGLPAEDMDFINSDGVTMNKLLLEANPKMTLFTGSSRVAEKLAADLKGRVKLEDAGFDWKILGPDVQEVDYVAWVCDQDAYACSGQKCSAQSVLFMHKNWSSSGLLEKMKKLSERRKLEDLTIGPVLTVTTEAMIEHMNNLLKIQGSKVLFGGEPLANHSIPKIYGAMKPTAVFVPLEEILKSGNFELVTKEIFGPFQVVTEYSEDQLELVLEACERMNAHLTAAVVSNDPLFLQDVLGRSVNGTTYAGIRARTTGAPQNHWFGPAGDPRGAGIGTPEAIKLVWSCHREIIYDVGPVPKSWALPSAT

SEQ ID NO: 4879 - DNA, 807 bp, Sorghum bicolor
  misc_feature: Ceres ANNOT ID no. 6040506
  misc_feature: Encodes the peptide sequence at SEQ ID NO 4880
atgtggcttacagttatctgtgaacaaagaattctaattccaaacgagcacggggagaagcttgttggtttattacatcaaacaagttcaaagaaacttgtgatcctttgtcatggattccgagccacaaaggatgacagcatcttggttgaccttgctgatgccatcacaaaggaaggaattagtgcttttcggtttgatttttctggaaatgggggaagtgatggtgaattccagtatggaagctacagaaaagaggcagctgatctgcgctctgtagtattacatttttcagaacagaaatacgacatagttgctcttattgggcatagtaaaggaggaaatgctgtgcttctatatgcttccaagtaccatgatgtccctatcattgtgaacatttctggccgctttgcattagagcgaggtatcgaggggcgccttgggaagaatttcatgatgagaataaacaaagatggatacatcgatgtgaagaatagaaaaggggagctggagtaccgggtggcgagagcgagtctggaagaccggctgagcactgatacccttttctccagccgtgccataagcaaagactgcagggttctcacgatccacggcgccaaagacgagatcgtcccggcggaggacgcactgcagttcgcggcgaacatccgcaaccacgagctgcgcatcatcgcggaggccaaccaccgttacaccgggcacgaggaggagctggtctcgctggtgctgggcttcctcaggtcccatctccaccagggcacgtcgcgcttgcgtccgaaactgtag

SEQ ID NO: 4880 - protein, 268 aa, Sorghum bicolor
  misc_feature: Ceres ANNOT ID no. 6040506
  misc_feature (82)..(259): Pfam Id: BAAT_C Pfam Desc: BAAT / Acyl-CoA thioester hydrolase C terminal
  misc_feature (4)..(268): NCBI GI: 115465147 NCBI Desc: os05g0539500 [oryza sativa (japonica cultivar-group)]
  misc_feature (8)..(256): NCBI GI: 18461257 NCBI Desc: esterase/lipase/thioesterase family protein-like [oryza sativa (japonica cultivar-group)]
  misc_feature (8)..(255): NCBI GI: 115437876 NCBI Desc: os01g0579900 [oryza sativa (japonica cultivar-group)]
  misc_feature (9)..(262): NCBI GI: 124359246 NCBI Desc: esterase/lipase/thioesterase [medicago truncatula]
  misc_feature (9)..(261): NCBI GI: 140051860 NCBI Desc: esterase/lipase/thioesterase [medicago truncatula]
MWLTVICEQRILIPNEHGEKLVGLLHQTSSKKLVILCHGFRATKDDSILVDLADAITKEGISAFRFDFSGNGGSDGEFQYGSYRKEAADLRSVVLHFSEQKYDIVALIGHSKGGNAVLLYASKYHDVPIIVNISGRFALERGIEGRLGKNFMMRINKDGYIDVKNRKGELEYRVARASLEDRLSTDTLFSSRAISKDCRVLTIHGAKDEIVPAEDALQFAANIRNHELRIIAEANHRYTGHEEELVSLVLGFLRSHLHQGTSRLRPKL

SEQ ID NO: 4881 - DNA, 1746 bp, Sorghum bicolor
  misc_feature: Ceres ANNOT ID no. 6040515
  misc_feature: Encodes the peptide sequence at SEQ ID NO 4882
atgtaccgggcggcggcggcggccatctcgaggtcctcctcagtgctgcggaggcagctcccgcggggcgcgggcggggagccgccgcgtctgttggcgcgggggtatgcgtccacggcgaaggaggtgtccttcggcgttggcgcccgcgccgccatgctgcagggcgtcaacgacctcgccgacgccgttaaggtcaccatgggtcccaaggggcgcactgtgatcatcgaggggtcctataaaggtcccaaggtcacgaaggatggggtcactgttgccaagagcgtggagttcgaggatagcgcgaagaatgttggggcgaatctggtgaagcaagttgctgatgctacgaacaaggctgcaggggatggtaccacttgtgcaactgtgcttacacaggcaattcttacggaaggatgcaaggccgtggcagccggtgtcaatgttatggacttgcggaatggtataaacaaggccataaatgctaccactgctcacctcaaaagtaaagcgtggaagattaattctccagaagaaatcaaccaggtagcaaccatttctgcaaatggtgaaaaagaaattggagatctgatatcaaaagctatggaaaaagttggaaaggacggagtcattactattgttgatggcaaaacattggacaatgagcttgaagcagtacagggaatgaagctgtccagaggatacatatctcattactttgtgactgatcagaagactcagaaatgtgagatggagaaccctctgattcttatccatgacaagaaaatctcaaacatggattctctccttccagcattggaaatttctatcaagaaccgcaagcctcttctcattgttgctgaggatgttgatggagatgctctgtcaatgcttgtactgaacaagcatcgtgctggactcaaggtatgtgctgtcaaagctcctggatttggtgaaaatagaaggcacaatctggatgacatggctgtgatgactggaggagaggttattagcgaggaacgcggtcttgatcttggcaaagttcaattacaaatgcttggcactgctaaaaaggtaactgtatctcttgatgatactatcatcctagatggtggaggtgacaaacagcagatagaggagaggtgccaacagcttagagaatcaattgacacaagcactgctgtatttgacaaagaaaaggcccaagagcgtttatcaaagttatctggaggtgttgctgtactcaagattggtggagctagtgaagctgaagttggtgagaaaaaagatagggtaacagatgctctaaatgctgcgagagctgctgtggaggagggcatcgtgccaggtggtggagttgcccttctttatgccaccaaggagctcgacaaaattagcacatcaaacgaggatgaaaagattggagttcaaattatcaagaattctttgaaggctcccttgatgaccatagctgcaaatgctggcattgatggagctatagtcatagggaagctgattgaacaagaggacctcagtttgggctatgatgcagctaaaggggagtatgttgacatgatcaaggctggcatcatcgatcctgtgaaggtgatccgcactgcacttcaagatgctgcaagtgtttccctgctgatgacaaccacggaggctgctgtttctgagctcccggcaacgaaggccagaatagccagccgaatgccgcagatgagtggaatggatttttga

SEQ ID NO: 4882 - protein, 581 aa, Sorghum bicolor
  misc_feature: Ceres ANNOT ID no. 6040515
  misc_feature (60)..(563): Pfam Id: Cpn60_TCP1 Pfam Desc: TCP-1/cpn60 chaperonin family
  misc_feature (1)..(418): NCBI GI: 92870485 NCBI Desc: groel-like chaperone, atpase [medicago truncatula]
  misc_feature (1)..(581): NCBI GI: 22758324 NCBI Desc: mitochondrial chaperonin-60 [oryza sativa (japonica cultivar-group)]
  misc_feature (1)..(581): NCBI GI: 92882357 NCBI Desc: groel-like chaperone, atpase [medicago truncatula]
  misc_feature (33)..(581): NCBI GI: 478786 NCBI Desc: chaperonin 60 - cucurbit
  misc_feature (33)..(581): NCBI GI: 12546 NCBI Desc: chaperonin 60 [cucurbita cv. kurokawa amakuri]
MYRAAAAAISRSSSVLRRQLPRGAGGEPPRLLARGYASTAKEVSFGVGARAAMLQGVNDLADAVKVTMGPKGRTVIIEGSYKGPKVTKDGVTVAKSVEFEDSAKNVGANLVKQVADATNKAAGDGTTCATVLTQAILTEGCKAVAAGVNVMDLRNGINKAINATTAHLKSKAWKINSPEEINQVATISANGEKEIGDLISKAMEKVGKDGVITIVDGKTLDNELEAVQGMKLSRGYISHYFVTDQKTQKCEMENPLILIHDKKISNMDSLLPALEISIKNRKPLLIVAEDVDGDALSMLVLNKHRAGLKVCAVKAPGFGENRRHNLDDMAVMTGGEVISEERGLDLGKVQLQMLGTAKKVTVSLDDTIILDGGGDKQQIEERCQQLRESIDTSTAVFDKEKAQERLSKLSGGVAVLKIGGASEAEVGEKKDRVTDALNAARAAVEEGIVPGGGVALLYATKELDKISTSNEDEKIGVQIIKNSLKAPLMTIAANAGIDGAIVIGKLIEQEDLSLGYDAAKGEYVDMIKAGIIDPVKVIRTALQDAASVSLLMTTTEAAVSELPATKARIASRMPQMSGMDF

SEQ ID NO: 4883 - DNA, 1566 bp, Sorghum bicolor
  misc_feature: Ceres ANNOT ID no. 6040517
  misc_feature: Encodes the peptide sequence at SEQ ID NO 4884
atggcgtgtgctgcttacagtatcagaggccctctcaagctcgctgcaaggcaccgcttggatgtgttgactagtaacaactcgtgcaatggcttcaagtcttcagtgtcataccccgtcgctcagaggtggagcagcaactgctcatccatcacaatgcggcatgtcgcctcccatcatcacttgattgttaaggcttcagcaatgttgcactcaaaagcttcagcaactgatgcagccacggcttccgatgagaggataactgtactggtcattggtggtggaggcagggagcatgctctttgtcatgccttgaaccattccccatcatgtgctgcagttctatgtgcccctggtaatgctggtattgctcagtccggggatgcaacatgtatttcagatttggacatctccagtagtgatgatgttatctcattctgccgcaataggggtgtgggaatggttgtagtgggtcctgaagcccctcttgtcgccggtcttgcaaatgatcttgtcaaagttgggataccaacctttggacctacatcagaggctgcagcattagaaggatcgaaggacttcatgaagaagctgtgtgataagtacgatatccctacagctaagtatcgcacattcacggatgctgtggaagctaaaaaatatgtaaaaaatgaaggagcccctattgttgtcaaagctgatggtctggcagctggaaagggtgtggttgttgcaatgactttggatgaggcgttggaagccatagactctatgttggttgaaggctcattcggttctgctggttcacgggttatcattgaagaatttcttgagggtgaagaagcctctttctttgcattggtagacggcgaaaatgctttgcctcttgaatcagcacaggatcacaaaagagttggtgatggtgatgttggcccaaataccggtggtatgggtgcatactcccctgctccaatagtaacagatgagctcaaacgcattgtaatggaaagtataattatccctactgttaaaggcatggcagccgaaggttgcaagtttgttggtgtattatacgctgggcttatgatcgagaagaaatctggactgcctaagcttattgagtacaatgtaagatttggtgacccagaatgccaggttctgatgatgcgattagaatctgatttggcacaagttctgttatccgcttgccagggagagttaggcaatgtttcactaacctggtcacctgaaatggcaatggttgttgtgatggcaagccagggataccccggctcttataagaaggggaccgtaataaaaaacgtggacaaggctgagcaggtgtctccagctgtcaagatattccatgctgggacagcactagatggagatggcaatcttgtcgccgttggagggcgagttcttggtgtcactgccaaaggcaaggacatcgaagaagcaagggcaagagcatatgatgcggtagacgctgtccagtggccagaagggttcttcaggcgggacattggttggagagcactgaagcagaagcaagtggctaactag

SEQ ID NO: 4884 - protein, 521 aa, Sorghum bicolor
  misc_feature: Ceres ANNOT ID no. 6040517
  misc_feature (190)..(384): Pfam Id: GARS_A Pfam Desc: Phosphoribosylglycinamide synthetase, ATP-grasp (A) domain
  misc_feature (87)..(189): Pfam Id: GARS_N Pfam Desc: Phosphoribosylglycinamide synthetase, N domain
  misc_feature (418)..(514): Pfam Id: GARS_C Pfam Desc: Phosphoribosylglycinamide synthetase, C domain
  misc_feature (1)..(519): NCBI GI: 77553855 NCBI Desc: phosphoribosylamine--glycine ligase [oryza sativa (japonica cultivar-group)]
  misc_feature (45)..(518): NCBI GI: 37992755 NCBI Desc: glycinamide ribonucleotide synthetase [nicotiana tabacum]
  misc_feature (50)..(521): NCBI GI: 92894066 NCBI Desc: phosphoribosylglycinamide synthetase [medicago truncatula]
  misc_feature (84)..(504): NCBI GI: 1071918 NCBI Desc: phosphoribosylamine-glycine ligase (ec 6.3.4.13) - arabidopsis thaliana (fragment)
  misc_feature (87)..(518): NCBI GI: 85717178 NCBI Desc: phosphoribosylamine--glycine ligase [nitrobacter sp. nb-311a]
  misc_feature (72)..(520): SWISSPROT Homolog: EC 6.3.4.13 Phosphoribosylamine--glycine ligase, chloroplast precursor
MACAAYSIRGPLKLAARHRLDVLTSNNSCNGFKSSVSYPVAQRWSSNCSSITMRHVASHHHLIVKASAMLHSKASATDAATASDERITVLVIGGGGREHALCHALNHSPSCAAVLCAPGNAGIAQSGDATCISDLDISSSDDVISFCRNRGVGMVVVGPEAPLVAGLANDLVKVGIPTFGPTSEAAALEGSKDFMKKLCDKYDIPTAKYRTFTDAVEAKKYVKNEGAPIVVKADGLAAGKGVVVAMTLDEALEAIDSMLVEGSFGSAGSRVIIEEFLEGEEASFFALVDGENALPLESAQDHKRVGDGDVGPNTGGMGAYSPAPIVTDELKRIVMESIIIPTVKGMAAEGCKFVGVLYAGLMIEKKSGLPKLIEYNVRFGDPECQVLMMRLESDLAQVLLSACQGELGNVSLTWSPEMAMVVVMASQGYPGSYKKGTVIKNVDKAEQVSPAVKIFHAGTALDGDGNLVAVGGRVLGVTAKGKDIEEARARAYDAVDAVQWPEGFFRRDIGWRALKQKQVAN

SEQ ID NO: 4885 - DNA, 1206 bp, Sorghum bicolor
  misc_feature: Ceres ANNOT ID no. 6040522
  misc_feature: Encodes the peptide sequence at SEQ ID NO 4886
atggaggacttcggcggctggagtatgcagtatgcagcagatccatgcctgccaagccgcccgagcgacgacgacggcctcctcggtgcctttctaggcggcggcttcgacctccgttctgaccatggcggtctcagcgacctgccctcgtcgcaccaggtccagaacctcatgccctgccacggcggcgcgagtctttccgtttccgacggattcatgggcctggacacggcggatatgctcgcgagcgtcaccggcgcactggacgacggcctccttgacacgttcgcttacggttcggacgtcgtcgccgccgccgccgaggagcccgcgcagcccaccgcgtcgagcaacgccttctcctccggatacagcagcaccacgggcggcaattacggcaacatctcctccggcgagtccaacacgtgcagcggcggcggcggaggccatgacacggaggttgcgtctccctgcgccctgtcgcggtcgtcggcgctgcctcaggcaacggccgcgctcgcctcgaagcgaaagctggggggcaagtaccctgcggtagccgcgaccacatcaacggaggcgcaggtcgctgccccgtggcgtggcgcaaagcgcgactcggcgacgtcgtcgtcgtcgaccagcatcacgttcgccgccgggcatggtgaccaccatgcggcaggaggatcgtcatcgtcggccggcggcgggtacgagtacgagccggactcggaggcgctagcgcaggtgaaggagatgatctaccgcgcggcggcgatgcggccggtgcaccagctcgtgtgcggggccggcaccgagccggcgccgtcgtcccagagcaagccgcggcgcaagaacgtgcggatctcgagtgacccgcagacggtggcggcgcggctgcggcgggagagggtgagcgagcgcctgcgcgtgctgcagcggctcgtgccgggaggtagccggatggacacggcgtccatgctcgacgaggcggccagctacctcaagttcctcaagacgcaggtcaaggcgctggagagggcgaaccctagcaatggtggctaccacaacagcagcttgctgccgcagagttacacggggacggggagcctcggtgtcggtggtggtggcaccggtgttgccaatggaagagatggcgccattgatggctacgtaaattccaacaggaacatgcacttgtag

SEQ ID NO: 4886 - protein, 401 aa, Sorghum bicolor
  misc_feature: Ceres ANNOT ID no. 6040522
  misc_feature (293)..(340): Pfam Id: HLH Pfam Desc: Helix-loop-helix DNA-binding domain
  misc_feature (145)..(361): NCBI GI: 52076301 NCBI Desc: bhlh transcription-like [oryza sativa (japonica cultivar-group)]
  misc_feature (212)..(366): NCBI GI: 51536285 NCBI Desc: basic helix-loop-helix (bhlh)-like protein [oryza sativa (japonica cultivar-group)]
  misc_feature (207)..(370): NCBI GI: 83853819 NCBI Desc: bhelix-loop-helix transcription factor [glycine max]
  misc_feature (199)..(353): NCBI GI: 83853832 NCBI Desc: bhelix-loop-helix transcription factor [glycine max]
  misc_feature (240)..(353): NCBI GI: 140071559 NCBI Desc: helix-loop-helix dna-binding [medicago truncatula]
  misc_feature: The sequence is a functional homolog of SEQ ID NO 134 in the 10/225,066US patent application
  misc_feature: The sequence is a functional homolog of SEQ ID NO 16 in the 10/412,699US patent application
  misc_feature: The sequence is a functional homolog of SEQ ID NO 1658 in the 10/374,780US patent application
  misc_feature: The sequence is a functional homolog of SEQ ID NO 1679 in the 10/412,699US patent application
  misc_feature: The sequence is a functional homolog of SEQ ID NO 1937 in the 10/374,780US patent application
  misc_feature: The sequence is a functional homolog of SEQ ID NO 1938 in the 10/374,780US patent application
  misc_feature: The sequence is a functional homolog of SEQ ID NO 1939 in the 10/374,780US patent application
  misc_feature: The sequence is a functional homolog of SEQ ID NO 448 in the 10/374,780US patent application
  misc_feature: Useful for biocontainment applications
  misc_feature: Useful for making plants with modulated growth and phenotype characteristics
  misc_feature: The sequence is a functional homolog of SEQ ID NO 16 in the 20040045049 US patent application
  misc_feature: The sequence is a functional homolog of SEQ ID NO 1679 in the 20040045049 US patent application
  misc_feature: The sequence is a functional homolog of SEQ ID NO 134 in the 20050160493 US patent application
  misc_feature: The sequence is a functional homolog of SEQ ID NO 1937 in the 20060162006 US patent application
  misc_feature: The sequence is a functional homolog of SEQ ID NO 1938 in the 20060162006 US patent application
  misc_feature: The sequence is a functional homolog of SEQ ID NO 1939 in the 20060162006 US patent application
  misc_feature: Functional homolog of the protein sequence given in SEQ ID NO 13582
MEDFGGWSMQYAADPCLPSRPSDDDGLLGAFLGGGFDLRSDHGGLSDLPSSHQVQNLMPCHGGASLSVSDGFMGLDTADMLASVTGALDDGLLDTFAYGSDVVAAAAEEPAQPTASSNAFSSGYSSTTGGNYGNISSGESNTCSGGGGGHDTEVASPCALSRSSALPQATAALASKRKLGGKYPAVAATTSTEAQVAAPWRGAKRDSATSSSSTSITFAAGHGDHHAAGGSSSSAGGGYEYEPDSEALAQVKEMIYRAAAMRPVHQLVCGAGTEPAPSSQSKPRRKNVRISSDPQTVAARLRRERVSERLRVLQRLVPGGSRMDTASMLDEAASYLKFLKTQVKALERANPSNGGYHNSSLLPQSYTGTGSLGVGGGGTGVANGRDGAIDGYVNSNRNMHL

SEQ ID NO: 4887 - DNA, 1251 bp, Sorghum bicolor
  misc_feature: Ceres ANNOT ID no. 6040529
  misc_feature: Encodes the peptide sequence at SEQ ID NO 4888
atgccttactgcgaggtgggcagttacgccgacggcgacaagtgggagggcgtccgcctcttctaccgccgctacggccgcggcgcgaccaaggtgctcctcatcatcggattggcggggacgcacgactcgtggggcccgcagataaaggggctgaccgggtcgctggagcccgccgacgacgaggccgtgcggccggacgaggaggccggtgtcggcgcggccggagcggcggaggcggcccccgcggaagcggacgaggccgccggcggcggcgatggcatcgaggtctgctgtttcgacaaccgaggcgtcggccgcagctccgtgctccccaacaaatcctactactcgacggcaatcatggcgacggatgccttggccttgatggatcatttggggtggaagaaagctcacgtctttggccactccatgggtgccatgattgcttgcaagctagcggcaatggcacctcacaggctatgttcgctggcattgcttaatgttactggaggtggctttcaatgcttcccgaagctagatgggcagatgctatctcttgcattccgtttcttaagggcaaaaactccagaggaaagagctcttgtggacttggaaacacattatacgaaggaataccttgaggagactgttgggtcagttactagaagaatggtcctctatcaagaatatgtgaagggcatatcatctacagggatgcaatctaattgtggttttgaagggcaagtcaatgcatgctggactcacaatatgactactaaggaactagatacaatacgatctgctggttttctagtttcagttattcatggaaggtatgatattattgcacaattgtgccatgcaaaacgtctagcagaaaggcttcttcctgttgcaagaatggtagaacttcatggtgcacatctagtgagccatgaaagaccagatgaggtgaacaatgcacttatggatttgataaaggccaccaaatctgcgatgaaacctgaagagtggtcagcccagcctgagaacatatcggaaaccggggcactcatttctgcgagacccattaccgtcacgatgcaaacagatgaaggtgcaaatgctgccgtagcaatctataacttgcttggcaagctgcaactaagctttctttatctcataggggtgatagtcatggggtttgagcacatgaggaacattgtaaaggtaatgaagccagtaagggttgcagcagttgagtcataa

SEQ ID NO: 4888 - protein, 416 aa, Sorghum bicolor
  misc_feature: Ceres ANNOT ID no. 6040529
  misc_feature (95)..(325): Pfam Id: Abhydrolase_1 Pfam Desc: alpha/beta hydrolase fold
  misc_feature (82)..(411): NCBI GI: 79330737 NCBI Desc: catalytic/ hydrolase [arabidopsis thaliana]
  misc_feature (82)..(319): NCBI GI: 42568501 NCBI Desc: hydrolase, alpha/beta fold family protein [arabidopsis thaliana]
  misc_feature (122)..(413): NCBI GI: 48716201 NCBI Desc: hydrolase, alpha/beta fold family protein-like [oryza sativa (japonica cultivar-group)]
  misc_feature (279)..(319): NCBI GI: 16323216 NCBI Desc: at5g53050/mnb8_11 [arabidopsis thaliana]
  misc_feature (93)..(320): NCBI GI: 28828984 NCBI Desc: similar to arabidopsis thaliana (mouse-ear cress). genomic dna, chromosome 5, p1 clone:mnb8 (ec 3.3.2.3) (epoxide hydrolase) [dictyostelium discoideum]
MPYCEVGSYADGDKWEGVRLFYRRYGRGATKVLLIIGLAGTHDSWGPQIKGLTGSLEPADDEAVRPDEEAGVGAAGAAEAAPAEADEAAGGGDGIEVCCFDNRGVGRSSVLPNKSYYSTAIMATDALALMDHLGWKKAHVFGHSMGAMIACKLAAMAPHRLCSLALLNVTGGGFQCFPKLDGQMLSLAFRFLRAKTPEERALVDLETHYTKEYLEETVGSVTRRMVLYQEYVKGISSTGMQSNCGFEGQVNACWTHNMTTKELDTIRSAGFLVSVIHGRYDIIAQLCHAKRLAERLLPVARMVELHGAHLVSHERPDEVNNALMDLIKATKSAMKPEEWSAQPENISETGALISARPITVTMQTDEGANAAVAIYNLLGKLQLSFLYLIGVIVMGFEHMRNIVKVMKPVRVAAVES

SEQ ID NO: 4889 - DNA, 612 bp, Sorghum bicolor
  misc_feature: Ceres ANNOT ID no. 6040532
  misc_feature: Encodes the peptide sequence at SEQ ID NO 4890
  misc_feature: Down-regulated in shoot tissues in response to aminocyclopropane carboxylic treatment
  misc_feature: Down-regulated in root tissues in response to aminocyclopropane carboxylic treatment
atggcttcccaccaggacaaggctagctaccaggccggcgagaccaaggctcgcaccgaggagaagactgggcaggcgatgggggcgaccaaggacacggcgcagcacgccaaggagaccaccaagcagaaggcgtccgactccgacaccggcagctaccttggccagaagaccgaggaggccaagcacaaggccggccagaccacggagtccaccaagcagaaggccggccagaccacggaggccgccaagcagaaggccgccgagaccacggaggcgaccaagcagaaggccggcgagacgacggaggcgaccaagcagaagaccgccgagacgacggaggccaccaagcagaaggccgccgaggccatggaagccaccaagcagaaggccgccgaggccgggcagtacgccaaggagaccgtcgtctccggcaaggacaagtccgccggcgtcatccagcaggccaccgagcaggtgaagagcgcggcggccggcgccaaggacgcggtgatgaacacgctggggatgggcggggacaacaacagcaagcagagcgacacaaacaccgacagcagcaaggactcctccaccatcaccagagatcactag

SEQ ID NO: 4890 - protein, 203 aa, Sorghum bicolor
  misc_feature: Ceres ANNOT ID no. 6040532
  misc_feature (58)..(101): Pfam Id: LEA_4 Pfam Desc: Late embryogenesis abundant protein
  misc_feature (1)..(203): NCBI GI: 2654379 NCBI Desc: group 3 lea protein mgl3 [zea mays]
  misc_feature (1)..(203): NCBI GI: 126081 NCBI Desc: aba-inducible protein phv a1
  misc_feature (1)..(203): NCBI GI: 25989707 NCBI Desc: lea3 protein [triticum aestivum]
  misc_feature (11)..(203): NCBI GI: 25989705 NCBI Desc: lea1 protein [triticum aestivum]
  misc_feature (11)..(203): NCBI GI: 21637 NCBI Desc: group 3 late embryogenesis abundant protein (lea) [triticum aestivum]
  misc_feature: Down-regulated in shoot tissues in response to aminocyclopropane carboxylic treatment
  misc_feature: Down-regulated in root tissues in response to aminocyclopropane carboxylic treatment
MASHQDKASYQAGETKARTEEKTGQAMGATKDTAQHAKETTKQKASDSDTGSYLGQKTEEAKHKAGQTTESTKQKAGQTTEAAKQKAAETTEATKQKAGETTEATKQKTAETTEATKQKAAEAMEATKQKAAEAGQYAKETVVSGKDKSAGVIQQATEQVKSAAAGAKDAVMNTLGMGGDNNSKQSDTNTDSSKDSSTITRDH

SEQ ID NO: 4891 - DNA, 1602 bp, Sorghum bicolor
  misc_feature: Ceres ANNOT ID no. 6040535
  misc_feature: Encodes the peptide sequence at SEQ ID NO 4892
atgcggatgcctccatgtagccgcaaccgcaggcccggggcaccaggtaagcgcgccaccgccgctttccgcccaattcaccgccgccgactaagctttcccatttctgggaaaggttggtgcgggcggcgcgggttgcgcgcttcctgcagtgacgaccgcctcagcgccctcaccgacgacctactgctcctcatcttgcgccgccttgacacccgcacggcgctagccaccgcgaccctctcgaagcgctggagttgcctgccccgctgtctcgatgccctcgatttcagggtcactgacatactcccggcgcgctactaccagtggatcagtatccacggtaaagccgctaattatgcttatggtttcggcgtcgatctcaaggtgcttcgcgacaacattaagcggtatgagcgccgtgctatgcgtgctatgacctcatccatcaacaactttctcgacgcagatgatgatcaggacagaggcagtctaggcctccggagactgcggcttgatttctttcctggtcattgttcaagtggcatcaaccgattgatagctaaggctgctgattcgtggggggtcgaagatctggaggttttagttaagaatacattccagcaacattttgcccacagttttcctcaccatggtctctgctacaatccacacaactcccgactaagaagtttgaagctggcagcctgttacattccgccattgaagggcttccatgcgctcaccagcctggtcttgcaagatttaccggactccactccaaccgcagcctatgaagctattttcaccttgtgcccgcagctacaagcactgcacctcaagtcctgcatgctgaaccaaggtgttgtggccgtacacgcccccaaatcactgatcaagcaacttatcatggagcattgctggtttgggctgatcaagttgtacactctgccaatgctcgagagcatggctgttctacaaactaatgtgagttacgagcttagctccttcccatacctcacacacttgaatatcgcctttcaccgtggtgtagcaaaaacccgctgtgttcgtgttggaaatcattatgatctcaatcagtatcttggaggaaccccaggaataagtgaccttattttacgcttcactggatatcatagatggttcaaaccttggagccctacattgttgttccctaaactcaggaggcttctgattgctgatgtgccttcatcctgggatgcggcaccatgcctcgagtgccttcacatccatattaccccttgggaggaggagcctcatgatgacatttcgtgggaaccctctgagttctgccataatcagctaaaggagttggtgataattggttttcagggaacggagagacagatttactttgttaactttgttattaaagtatcaacgtcattgcagcttgtttccttgtacaaaaatggacatgttcaggacagggggcgctgggactgggacatggtgacacagcaataccgatgggttaatgaggagaaggttaaaatactgaaccagattgctgatagtgctccttgcgctgctacacccgttcaagtggttctggagtag

SEQ ID NO: 4892 - protein, 533 aa, Sorghum bicolor
  misc_feature: Ceres ANNOT ID no. 6040535
  misc_feature (44)..(532): NCBI GI: 115455907 NCBI Desc: os03g0796100 [oryza sativa (japonica cultivar-group)]
  misc_feature (52)..(502): NCBI GI: 21743052 NCBI Desc: osjnba0083d01.2 [oryza sativa (japonica cultivar-group)]
  misc_feature (42)..(500): NCBI GI: 32526680 NCBI Desc: plant disease resistance polyprotein -like protein [oryza sativa (japonica cultivar-group)]
  misc_feature (70)..(441): NCBI GI: 38346115 NCBI Desc: osjnbb0006n15.10 [oryza sativa (japonica cultivar-group)]
  misc_feature (128)..(533): NCBI GI: 115450823 NCBI Desc: os03g0156800 [oryza sativa (japonica cultivar-group)]
MRMPPCSRNRRPGAPGKRATAAFRPIHRRRLSFPISGKGWCGRRGLRASCSDDRLSALTDDLLLLILRRLDTRTALATATLSKRWSCLPRCLDALDFRVTDILPARYYQWISIHGKAANYAYGFGVDLKVLRDNIKRYERRAMRAMTSSINNFLDADDDQDRGSLGLRRLRLDFFPGHCSSGINRLIAKAADSWGVEDLEVLVKNTFQQHFAHSFPHHGLCYNPHNSRLRSLKLAACYIPPLKGFHALTSLVLQDLPDSTPTAAYEAIFTLCPQLQALHLKSCMLNQGVVAVHAPKSLIKQLIMEHCWFGLIKLYTLPMLESMAVLQTNVSYELSSFPYLTHLNIAFHRGVAKTRCVRVGNHYDLNQYLGGTPGISDLILRFTGYHRWFKPWSPTLLFPKLRRLLIADVPSSWDAAPCLECLHIHITPWEEEPHDDISWEPSEFCHNQLKELVIIGFQGTERQIYFVNFVIKVSTSLQLVSLYKNGHVQDRGRWDWDMVTQQYRWVNEEKVKILNQIADSAPCAATPVQVVLE

SEQ ID NO: 4893 - DNA, 1227 bp, Sorghum bicolor
  misc_feature: Ceres ANNOT ID no. 6040538
  misc_feature: Encodes the peptide sequence at SEQ ID NO 4894
atggccgtgcgcttgccgctcgcgctcgcggcagtggcggcggtcctgctgcttctcctgtgccgcggcggcggagccgaggcgcgtgtcctcctcacgctcgacgacttcggcggggtcggcgacggcattgccaacgacacccaggctctgttggacgcgtggaccgccgcgtgcacctccagcgaggaggccgtcctcgccgtgccggccggcaaggcgtaccggatctggcccgtgcagctctccgggccctgcaagaagaagctcaagctgctgatttccggcgcgatcgtggcgccgtcgagccccgacgagtgggcggggcgggacccgatgaagtggctctacatctacggcgtcgacgggctgtccgtcagcggcggcggcaccatcgacggcatggggcagcagtggtgggccagcacctgcaagcgcaagaagacccagccgtgctactcggggcctcgtccaaaggcggtgcacttcgaggagtgccgcggggtgagcgtgcagggcgtgacgctgcagaacgcgcagcagttccagctgacgttcacgcgctgctcctgcgtgaaggccagcttcctgcgggtgatcgcgccggcggacagccccaacaccgacggcatccacctcaacgacacctcccacgtccacatcacggacaacctcatctccacaggggatgattgcgtctccatggtcggcaattgctctgacgtccatgtgaaagacatctcatgtgggcctggccatggtatcagcatcgggagcctgggaaagaaccggaccacggacatggtggagaacgtgagggtcgacacctgcttgctcaccaacacgaccaacggcgtacggatcaagagctggcagggaggcatggggttcgcgcgtgacctgcggttcgagaacatcctgatgaagaacgtctcgaaccccatcatcgtcgaccagtactactgcgaccagcccacgccctgcgccaaccagacgcaggcggtggaggtgcgcaaggtggagttcgccaacatccggggcacgtcggcgacggcgcaggcgatcagcatcgcgtgcagcgacaccgtgccgtgccgggagctggagctggcgaacgtcaacctgacgctggcggagggcggcggccgggccaccgcgctctgctaccgggcgtccgggaagagcgttggcaccgtggtcccgccgtcctgcctcgccaagtcctga

SEQ ID NO: 4894 - protein, 408 aa, Sorghum bicolor
  misc_feature: Ceres ANNOT ID no. 6040538
  misc_feature (59)..(404): Pfam Id: Glyco_hydro_28 Pfam Desc: Glycosyl hydrolases family 28
  misc_feature (28)..(408): NCBI GI: 87162606 NCBI Desc: glycoside hydrolase, family 28 [medicago truncatula]
  misc_feature (23)..(408): NCBI GI: 122894108 NCBI Desc: polygalacturonase [citrus sinensis]
  misc_feature (31)..(404): NCBI GI: 7381227 NCBI Desc: polygalacturonase [lycopersicon esculentum]
  misc_feature (31)..(406): NCBI GI: 5902387 NCBI Desc: similar to polygalacturonases [arabidopsis thaliana]
  misc_feature (31)..(405): NCBI GI: 145336060 NCBI Desc: polygalacturonase [arabidopsis thaliana]
  misc_feature: Useful for making plants with altered cell wall content and/or composition
  misc_feature: GREAT-hit functional homolog of the protein sequence encoded by LOCUS at1g80170
  misc_feature: Useful for making plants with altered carbohydrate content
  misc_feature: Functional homolog of the protein sequence given in SEQ ID NO 13888
  misc_feature: Useful for making plants with altered cell wall content and/or composition
  misc_feature: Functional homolog of the protein sequence given in SEQ ID NO 13889
  misc_feature: The sequence is a functional homolog of SEQ ID NO. 450 in the 11/188,298 US application
MAVRLPLALAAVAAVLLLLLCRGGGAEARVLLTLDDFGGVGDGIANDTQALLDAWTAACTSSEEAVLAVPAGKAYRIWPVQLSGPCKKKLKLLISGAIVAPSSPDEWAGRDPMKWLYIYGVDGLSVSGGGTIDGMGQQWWASTCKRKKTQPCYSGPRPKAVHFEECRGVSVQGVTLQNAQQFQLTFTRCSCVKASFLRVIAPADSPNTDGIHLNDTSHVHITDNLISTGDDCVSMVGNCSDVHVKDISCGPGHGISIGSLGKNRTTDMVENVRVDTCLLTNTTNGVRIKSWQGGMGFARDLRFENILMKNVSNPIIVDQYYCDQPTPCANQTQAVEVRKVEFANIRGTSATAQAISIACSDTVPCRELELANVNLTLAEGGGRATALCYRASGKSVGTVVPPSCLAKS

SEQ ID NO: 4895 - DNA, 1050 bp, Sorghum bicolor
  misc_feature: Ceres ANNOT ID no. 6040545
  misc_feature: Encodes the peptide sequence at SEQ ID NO 4896
atggcggcggacgggaacggcgcggccgctgccggcggggacaccagggcggtcttcgcgcagatctacaagacgctcaaggaggagctgctcaccgaccccgccttcgagttcactgaggagtcgcaccagtggatcgaccgcatggttgactacactgtactcggaggcaagtgtaaccgtgggctctctgtggttgatagctacaagctgctgaagggtgctgatactctgagcgaggaggaaatgttccttgcttgcacccttggctggtgcattgaatggcttcaagctttctttcttgtgcttgatgatatcatggatgagtcccacactcgtcgtggccagccttgctggttcagggtgcctcaggttggcttcattgctgtgaatgacgggattatccttcgcaaccatatctcacggatccttaggcgccactttaagggcaagccttactatgctgatctccttgacttgttcaatgaggttgagttcaagacagcttcaggtcagctgctggaccttatcacaacccatgagggagaaaaagatctgacaaagtacaacataacagttcacggtcgtattgttcaatacaagacagcctactattcattttatctgccggttgcatgtgccctgctgctctctggcgagaatttggacaagtatggtgatgtagagaacatccttgttgaaatgggaacatactttcaagtccaggatgactatctggattgttatggtgatcctgaatttattggcaagattggaactgacattgaagattacaagtgctcatggctagttgtgcaagcccttgagcgtgctgatgagagccaaaagcgcattctatttgaaaattatggcaagaaagatccagcttgtgtggcaaaagtgaagaacctctacaaagaacttaacctagaggagtacgagagtgagagctacaagaagctgattgcagacattgaagcccagccaagcatcgcggttcagaacgtgctgaagtccttcttgcacaagatctacaagaggcagaagtag

SEQ ID NO: 4896 - protein, 349 aa, Sorghum bicolor
  misc_feature: Ceres ANNOT ID no. 6040545
  misc_feature (45)..(316): Pfam Id: polyprenyl_synt Pfam Desc: Polyprenyl synthetase
  misc_feature (1)..(349): NCBI GI: 33340602 NCBI Desc: geranylgeranyl-diphosphate synthase [zea mays]
  misc_feature (14)..(349): NCBI GI: 33340604 NCBI Desc: truncated geranylgeranyl-diphosphate synthase [zea mays]
  misc_feature (1)..(349): NCBI GI: 18958450 NCBI Desc: farnesyl pyrophosphare synthase [musa acuminata]
  misc_feature (14)..(349): NCBI GI: 1346028 NCBI Desc: farnesyl pyrophosphate synthetase 1 (fpp synthetase 1) (fps 1) (farnesyl diphosphate synthetase 1) [includes: dimethylallyltranstransferase ; geranyltranstransferase ]
  misc_feature (14)..(349): NCBI GI: 1346029 NCBI Desc: farnesyl pyrophosphate synthetase 2 (fpp synthetase 2) (fps 2) (farnesyl diphosphate synthetase 2) [includes: dimethylallyltranstransferase ; geranyltranstransferase ]
  misc_feature: Useful for making plants with modulated salt sensitivity
  misc_feature: GREAT-hit functional homolog of the protein sequence given in SEQ ID NO 13288
  misc_feature: Useful for making plants with modulated salt sensitivity
  misc_feature: Functional homolog of the protein sequence given in SEQ ID NO 13288
MAADGNGAAAAGGDTRAVFAQIYKTLKEELLTDPAFEFTEESHQWIDRMVDYTVLGGKCNRGLSVVDSYKLLKGADTLSEEEMFLACTLGWCIEWLQAFFLVLDDIMDESHTRRGQPCWFRVPQVGFIAVNDGIILRNHISRILRRHFKGKPYYADLLDLFNEVEFKTASGQLLDLITTHEGEKDLTKYNITVHGRIVQYKTAYYSFYLPVACALLLSGENLDKYGDVENILVEMGTYFQVQDDYLDCYGDPEFIGKIGTDIEDYKCSWLVVQALERADESQKRILFENYGKKDPACVAKVKNLYKELNLEEYESESYKKLIADIEAQPSIAVQNVLKSFLHKIYKRQK

SEQ ID NO: 4897 - DNA, 1017 bp, Sorghum bicolor
  misc_feature: Ceres ANNOT ID no. 6040549
  misc_feature: Encodes the peptide sequence at SEQ ID NO 4898
atggtgaaggacagcgcctactacgatgtcctcggggtcagcgtcgacgcgtcccccgccgagatcaagaaggcttattacatcaaggcgaagctggtgcatccggacaagaatcccgggaaccctgacgcggcactcaagttccaggaacttggagaggcctatcaagttctaagtgatccggggaaaaaggaggcttatgataagtacggaaaggagggtattccccaggataacatggtggatcctgctgctgtctttgggatgctttttggaagtgactattttgaagactacgttggtcagcttgctctagcatctatagcttcagtggagattgacgaaatctcaaacagtcaagaggcaagagcaaaggttcaagaaaagatgaaagagttacaaagagaaagagaagggaagcttactcagagccttaaggaccgacttcaaccatatgtagatgggagaaaagatgaatttgtgagttacgcaagtgcagaagctaggcgtttatccgaagcagcatttggtgaggctatgcttcacactatcgggtatatttatgtgcggcaagcagcaagagaactcgggaaaagtagaatctatatgggtgtaccgtttatagctgagtgggttagagacaaaggacaccacattaaatcacaggttaatgctgcttcaggtgctatctctctaatacaacttcaagaagggatgaaaaagatggagggaagtgagaacagtgaagagcaacttatgaagagttttgaggagaaaaaagatgccatgcttagctcactttggaaaattaatgtggttgatattgagtcaacactttcacgtgtctgccaagctgttctgaaagataacactgtctccaaagatgtcctgaagttgcgagccaaagcgttgaaaaagcttggaacgatattccaaggcgcaaagtctatgtaccatcgtgaaaacagcctgcgcgttgaaacggccacaaatcaacaagctactccatcacagtga

SEQ ID NO: 4898 - protein, 338 aa, Sorghum bicolor
  misc_feature: Ceres ANNOT ID no. 6040549
  misc_feature (6)..(68): Pfam Id: DnaJ Pfam Desc: DnaJ domain
  misc_feature (1)..(334): NCBI GI: 140071236 NCBI Desc: heat shock protein dnaj [medicago truncatula]
  misc_feature (1)..(330): NCBI GI: 20147307 NCBI Desc: at4g39150/t22f8_50 [arabidopsis thaliana]
  misc_feature (1)..(315): NCBI GI: 115479909 NCBI Desc: os09g0493800 [oryza sativa (japonica cultivar-group)]
  misc_feature (1)..(315): NCBI GI: 42407725 NCBI Desc: dnaj protein family-like [oryza sativa (japonica cultivar-group)]
  misc_feature (1)..(327): NCBI GI: 57340266 NCBI Desc: dnaj-like protein [brassica juncea]
MVKDSAYYDVLGVSVDASPAEIKKAYYIKAKLVHPDKNPGNPDAALKFQELGEAYQVLSDPGKKEAYDKYGKEGIPQDNMVDPAAVFGMLFGSDYFEDYVGQLALASIASVEIDEISNSQEARAKVQEKMKELQREREGKLTQSLKDRLQPYVDGRKDEFVSYASAEARRLSEAAFGEAMLHTIGYIYVRQAARELGKSRIYMGVPFIAEWVRDKGHHIKSQVNAASGAISLIQLQEGMKKMEGSENSEEQLMKSFEEKKDAMLSSLWKINVVDIESTLSRVCQAVLKDNTVSKDVLKLRAKALKKLGTIFQGAKSMYHRENSLRVETATNQQATPSQ

SEQ ID NO: 4899 - DNA, 1851 bp, Sorghum bicolor
  misc_feature: Ceres ANNOT ID no. 6040551
  misc_feature: Encodes the peptide sequence at SEQ ID NO 4900
atgtcaggccccctcgaccgatttgctaggccatgttttgaagggtttgtgcataacgatgaaaggaaagagagcagatctgatgcagacaactcagaaggagataagaagactaaaatcggatctttcaagaaaaaagcaatcaatgcagggaacaaattcaggcattccctgagaaggagaagcaaaaagaaagaaaggggggagtccatcaaggacataagggacgttaaagagcttcaagatgttgagacatttcgacaatgcttaattgatgaggatttgctgccacaacagcatgatgattatcacatgatgttaaggttcctaaaagcaaggaaatttgaagttgagaaagctaagaatatgtggtcagacatgcttaaatggaggaaggaattcggggtcgacaaaatagaggaatttgactacaccgagttagatgaagttacgaagtattacccacaattttatcatggggtagataaagagggaagacctgtctacatagagttaataggaaaagttgatgcaagcaagctattacaagtgacaactctagatcggtatgtgaaataccatgtcaaggagtttgagaggtgtttccagatgagatttccagcttgctccattgctgcaaaaaagcacatagattcatcgactactattttggacgtgcaaggcgtgggtttcaagaacttctcgaaatctgccagggaattaatcacacgattacagaagattgacagtgataactacccagagacactgtgccggatgtatataattaatgctggccaaggcttcaagatgctatggagcacaataaaatcattccttgatccaaaaactgtttccaagattcatgttcttgggaataagtaccaacataagttgctcgaaataattgacgagtgtgaattgccagaatttttcggtggcaaatgcaactgtattgaaggttgccaaagatctgacaaaggtccttggaaggatcccaacataataaagagagtcctcaatggtgaggccaactatggcaggcaaattgtgaccatatccagcactgatggaaagataatcagttatgctaggccagggcacccaactagaaaaggcagtgatgcgtctgccgagtctgggtctgaagtggaagacgtagtatctcctactgcatcaaggaacctgattacacatcctattttgacccctgttcacgaggagtcaaaattgtcggcacatggatctgcatttgttgctcatgcttctattgaagaaagcattcctgttgtggacaaggttgttgatgatggatggggtagtcccaaaggtagtctacaagcttcttcaggttcattgtcctcgagaaattcacatggcgcatttgaaggactccgcattcaaattatcacatggttgacattcttgatcatgaccctttttgccatgctttgttctgtcccaagcaagatggctagaaggatctctaaccaacctagtaggcatgatgactatcgtgttgaatatcctcaagaacaggagtacaaggaggaatttcgacctccatctcctgccccatcctatacagaaaaggatgtactttcatcgatgctaagacgactaggtgagctggaggacaaggtgcaggtgcttgaaacaaagccgtctgagatgccatttgaaaaggaagaattgctcaatgcagccgtccgccgcgtggatgcattggaagctgagttgatttccacaaagaaggccctttatgatgctttgatgcgacaggatgagctactcgcatacattgacaggcagcagctgatcaaatttcgtaaaaagaagttctgcttctaa

SEQ ID NO: 4900 - protein, 616 aa, Sorghum bicolor
  misc_feature: Ceres ANNOT ID no. 6040551
  misc_feature (155)..(339): Pfam Id: CRAL_TRIO Pfam Desc: CRAL/TRIO domain
  misc_feature (69)..(139): Pfam Id: CRAL_TRIO_N Pfam Desc: CRAL/TRIO, N-terminus
  misc_feature (1)..(616): NCBI GI: 14486705 NCBI Desc: phosphatidylinositol transfer-like protein iii [lotus japonicus]
  misc_feature (1)..(616): NCBI GI: 92870325 NCBI Desc: cellular retinaldehyde-binding/triple function, n-terminal [medicago truncatula]
  misc_feature (1)..(616): NCBI GI: 140039258 NCBI Desc: cellular retinaldehyde-binding/triple function, n-terminal [medicago truncatula]
  misc_feature (1)..(588): NCBI GI: 22137166 NCBI Desc: at4g39170/t22f8_70 [arabidopsis thaliana]
  misc_feature (1)..(616): NCBI GI: 4914429 NCBI Desc: sec14-like protein [arabidopsis thaliana]
MSGPLDRFARPCFEGFVHNDERKESRSDADNSEGDKKTKIGSFKKKAINAGNKFRHSLRRRSKKKERGESIKDIRDVKELQDVETFRQCLIDEDLLPQQHDDYHMMLRFLKARKFEVEKAKNMWSDMLKWRKEFGVDKIEEFDYTELDEVTKYYPQFYHGVDKEGRPVYIELIGKVDASKLLQVTTLDRYVKYHVKEFERCFQMRFPACSIAAKKHIDSSTTILDVQGVGFKNFSKSARELITRLQKIDSDNYPETLCRMYIINAGQGFKMLWSTIKSFLDPKTVSKIHVLGNKYQHKLLEIIDECELPEFFGGKCNCIEGCQRSDKGPWKDPNIIKRVLNGEANYGRQIVTISSTDGKIISYARPGHPTRKGSDASAESGSEVEDVVSPTASRNLITHPILTPVHEESKLSAHGSAFVAHASIEESIPVVDKVVDDGWGSPKGSLQASSGSLSSRNSHGAFEGLRIQIITWLTFLIMTLFAMLCSVPSKMARRISNQPSRHDDYRVEYPQEQEYKEEFRPPSPAPSYTEKDVLSSMLRRLGELEDKVQVLETKPSEMPFEKEELLNAAVRRVDALEAELISTKKALYDALMRQDELLAYIDRQQLIKFRKKKFCF

SEQ ID NO: 4901 - DNA, 387 bp, Sorghum bicolor
  misc_feature: Ceres ANNOT ID no. 6040563
  misc_feature: Encodes the peptide sequence at SEQ ID NO 4902
atggctgacccagagttggaagctatcaggcagaggaggatgcaagaactaatggcacagcgtggtggggcaaatcagcagaatgcgggccaacaaaaagctcaggaagatgcgaaacaggaagctgaggaacgccgacagatgatgcttgctcagatattatcttctgaagccagagaaaggctctcccgcatagctttggtcaaacctgacaaagcaagaggggtggaggatgttttgctgagagctgcccaaactggtggaatatctgaaaaggtgtctgaagaaaggcttatctcccttctagagcaaattaacacccagacaaacaagcaaaccaaagttacgattcagaggcggcgaagtgtccttgacgacgatgattag

SEQ ID NO: 4902 - protein, 128 aa, Sorghum bicolor
  misc_feature: Ceres ANNOT ID no. 6040563
  misc_feature (9)..(119): Pfam Id: dsDNA_bind Pfam Desc: Double-stranded DNA-binding domain
  misc_feature (1)..(128): NCBI GI: 48375149 NCBI Desc: cell death-related protein [oryza sativa (japonica cultivar-group)]
  misc_feature (1)..(128): NCBI GI: 32966259 NCBI Desc: apoptosis-related protein [oryza sativa (indica cultivar-group)]
  misc_feature (1)..(127): NCBI GI: 30690937 NCBI Desc: double-stranded dna-binding family protein [arabidopsis thaliana]
  misc_feature (1)..(128): NCBI GI: 41055911 NCBI Desc: similar to programmed cell death 5 [danio rerio]
  misc_feature (1)..(61): NCBI GI: 54145463 NCBI Desc: truncated programmed cell death 5-a variant [oryza sativa (indica cultivar-group)]
  misc_feature: The sequence is a functional homolog of SEQ ID NO. 376 in the 11/188,298 US application
MADPELEAIRQRRMQELMAQRGGANQQNAGQQKAQEDAKQEAEERRQMMLAQILSSEARERLSRIALVKPDKARGVEDVLLRAAQTGGISEKVSEERLISLLEQINTQTNKQTKVTIQRRRSVLDDDD

SEQ ID NO: 4903 - DNA, 1533 bp, Sorghum bicolor
  misc_feature: Ceres ANNOT ID no. 6040574
  misc_feature: Encodes the peptide sequence at SEQ ID NO 4904
atgaacaccgtcggcgtccctgtggtagccgtggcgaatggcgtccccgtggtggacgttgcggatgggatcggtgaggtggagcgcaaggtgcagaagagctactgggaggagcactccaaggacctcaccgtcgagtccatgatgctcgactcccgcgccgccgacctcgacaaggaggagcgacccgagatcctgtctttgcttccctcttacaaagggaaatcagttctagaacttggtgctggaataggacgctttactggagatctggcaaaagaagctgggcatgttctagcactagattttattgaaagtgtgattaagaagaatcaaagcataaatgggcatcacaagaacataaccttcaagtgtgctgatgtaacatctcccgaattgaagattgaagataactctgttgatctgatattttcaaactggctattaatgtacctttcagatgaggaggttgaaaagcttgtggggaaaatggtaaaatggttaaaggtcggaggccatattttctttagagaatcatgttttcaccaatctggagattccaaaaggaaggtgaacccaacacattatcgagaaccaaggttttatactaaggtatttaaagaaggccattcatttgatcaagatggaggttcttttgaactttctctagtgacttgtaaatgtattggggcttatgtcaaaaataagaagaatcaaaaccagatatgttggttattggaaaaggtaaaatcaacagaagacagagattttcaaaggttcctggacaacgtgcaatacaaaacaagtggaatcttacgttatgagcgtgtctttggtgaaggttatgtgagcactggtggaatcgagactacaaaggaatttgtgggcatgctggatcttaaacctggcaagaaagtacttgatgttggatgtggaattggaggcggcgacttttacatggctgaaaactatgatgtccatgtgcttggaattgatctttcggttaacatggtttcatttgcaattgaacgtgccattggacgcaagtgctctgttgaatttgaagttgctgattgcaccacaaaggattacccagaagatagttttgacgtcatctacagccgtgacactatccttcacatacaagacaagcctgctctgttcagaagcttcttcaaatggctaaaacccggtggcaaagtcctaatcagtgactactgtaagaatcctggaaaaccatcagaagaatttgctgcatacattaagcagagaggttatgacctccacgatgtgaaggcttatggacagatgctcaaggatgctggttttcatgatgtcattgcagaagatcgcactgagcagttcctgaatgttctacggagggagctaggtgaagttgaaaagaacaaagaggctttcctggcagacttcacccaggaggactacgacgacattgtgaacggctggaacgcgaagctgaaacggagctctgccggtgagcagaggtggggcctgttcattgcgaccaagtga

SEQ ID NO: 4904 - protein, 510 aa, Sorghum bicolor
  misc_feature: Ceres ANNOT ID no. 6040574
  misc_feature (78)..(176): Pfam Id: Methyltransf_11 Pfam Desc: Methyltransferase domain
  misc_feature (307)..(403): Pfam Id: Methyltransf_11 Pfam Desc: Methyltransferase domain
  misc_feature (78)..(174): Pfam Id: Methyltransf_12 Pfam Desc: Methyltransferase domain
  misc_feature (307)..(401): Pfam Id: Methyltransf_12 Pfam Desc: Methyltransferase domain
  misc_feature (249)..(479): Pfam Id: CMAS Pfam Desc: Cyclopropane-fatty-acyl-phospholipid synthase
  misc_feature (275)..(454): Pfam Id: Ubie_methyltran Pfam Desc: ubiE/COQ5 methyltransferase family
  misc_feature (18)..(510): NCBI GI: 17887465 NCBI Desc: phosphoethanolamine methyltransferase [triticum aestivum]
  misc_feature (22)..(510): NCBI GI: 115439355 NCBI Desc: os01g0695100 [oryza sativa (japonica cultivar-group)]
  misc_feature (22)..(510): NCBI GI: 45272584 NCBI Desc: phosphoethanolamine n-methyltransferase [oryza sativa]
  misc_feature (26)..(510): NCBI GI: 32478660 NCBI Desc: phosphoethanolamine n-methyltransferase [brassica napus]
  misc_feature (26)..(510): NCBI GI: 20147131 NCBI Desc: at3g18000/meb5_22 [arabidopsis thaliana]
  misc_feature (26)..(510): SWISSPROT Homolog: EC 2.1.1.103 Phosphoethanolamine N-methyltransferase 1
  misc_feature: The sequence is a functional homolog of SEQ ID NO 40 in US patent 7151202
MNTVGVPVVAVANGVPVVDVADGIGEVERKVQKSYWEEHSKDLTVESMMLDSRAADLDKEERPEILSLLPSYKGKSVLELGAGIGRFTGDLAKEAGHVLALDFIESVIKKNQSINGHHKNITFKCADVTSPELKIEDNSVDLIFSNWLLMYLSDEEVEKLVGKMVKWLKVGGHIFFRESCFHQSGDSKRKVNPTHYREPRFYTKVFKEGHSFDQDGGSFELSLVTCKCIGAYVKNKKNQNQICWLLEKVKSTEDRDFQRFLDNVQYKTSGILRYERVFGEGYVSTGGIETTKEFVGMLDLKPGKKVLDVGCGIGGGDFYMAENYDVHVLGIDLSVNMVSFAIERAIGRKCSVEFEVADCTTKDYPEDSFDVIYSRDTILHIQDKPALFRSFFKWLKPGGKVLISDYCKNPGKPSEEFAAYIKQRGYDLHDVKAYGQMLKDAGFHDVIAEDRTEQFLNVLRRELGEVEKNKEAFLADFTQEDYDDIVNGWNAKLKRSSAGEQRWGLFIATK

SEQ ID NO: 4905 - DNA, 1695 bp, Sorghum bicolor
  misc_feature: Ceres ANNOT ID no. 6040578
  misc_feature: Encodes the peptide sequence at SEQ ID NO 4906
atggcgtcgatgcagagctggcgcaaggcctacggcgccatcaaggacaccaccaccgttagcctcgccaatctcaactcggacttcaaggatctggatgtggcgatcgtgaaggctactaaccacgtggagtgcccgcccaaggagcgacacctgcgcaaggttgttgcggccacgtccatcgccaggcctcgggcggatgtcgcctactgcatccacgcgcttgcccgccgtcttgccaagacccgcaactggattgttgctctgaaaacacttgtagtaatccatagacttcttcgcgagggcgatcctacatttcgagaagagcttcttaactttacacaaaggggacggattctgcaactttcaaactttaaggatgactccagtccaattgcttgggattgttctgcctgggtgcgcacatatggtttgtttttggaggaaaggttggaatgcttcagagttctgaaatatgatgtcgaagctgagcgtttgtccaaacaaggtcaaggtcctgaaaagggtcacagtagaacaagagagttggattcacaggatctgttagagcagctgccagcattgcagcagttactataccgtcttgttggatgtcggcctgaaggagctgcaaatagtaactacttggtgcaatacgctctagctttggtgctaaaagaaagctttaaaatttattgtgcaataaatgacggaattatcaaccttgttgataagttctttgagatgccaagacatgaagcacttaaagctcttgaaatctacagaagagctggccaacaggctgggagtctgtctgatttctacgagaattgccggggtttagaactagctaggaattttcagtttcccactctgagggagccaccacaaacatttcttgcaactatggaggagtatgtgaaggaggctccacgcatggtcccagttcgggaacccctggaacttcctgagaggcttcttcttacatacaaacctgaagaatcagaggaaattcctgagcctgctcctgttgaagaggagaaggcaccagttgaagaacctgttccggtaccaccagttactgaagttgtttcatctcctcccaagactgaggtggccgatactggtgacttactgggcttagacgatccaaatcctgctgtatcagctatagaagaaagcaatgcacttgccttggctattgttccaacagatggtgcttcaacaactagtaacactgcatttcaagataaggggtttgatgctacaggatgggaacttgcccttgttaccgcaccgagcaacacaacttcatcttcttctgttggtcaattgggtggtggattcgacaagctcattttggacagcctttatgatgacggggcctacaggcagaggcaacagcaacagctgtatggttcagcagcacctaatccattcatgacaaatgatcctttcgccatgtcaaaccaagttgctcccccaccatcagttcaaatggctgccatgtctcagcagcatccgcagatcccaacgatgatgcaaccaaatccctttggaccacctatgcagccacagatgagcatgggtcctgcaacaaacaatccctttctggattctggcttcggggcattcccagtagcgaacaatggccatcaacaacacaacccatttggcagtgcccaacttctgtag

SEQ ID NO: 4906 - protein, 564 aa, Sorghum bicolor
  misc_feature: Ceres ANNOT ID no. 6040578
  misc_feature (29)..(310): Pfam Id: ANTH Pfam Desc: ANTH domain
  misc_feature (29)..(157): Pfam Id: ENTH Pfam Desc: ENTH domain
  misc_feature (1)..(564): NCBI GI: 56785152 NCBI Desc: clathrin assembly protein ap180 short form-like [oryza sativa (japonica cultivar-group)]
  misc_feature (1)..(559): NCBI GI: 92877485 NCBI Desc: carbamoyl-phosphate synthase l chain, atp-binding; anth [medicago truncatula]
  misc_feature (4)..(509): NCBI GI: 50251206 NCBI Desc: synaptosomal-associated protein 91-like [oryza sativa (japonica cultivar-group)]
  misc_feature (6)..(559): NCBI GI: 52077380 NCBI Desc: phosphoprotein-like [oryza sativa (japonica cultivar-group)]
  misc_feature (1)..(148): NCBI GI: 8778222 NCBI Desc: f10b6.32 [arabidopsis thaliana]
  misc_feature: The sequence is a functional homolog of SEQ ID NO. 322 in the 11/188,298 US application
MASMQSWRKAYGAIKDTTTVSLANLNSDFKDLDVAIVKATNHVECPPKERHLRKVVAATSIARPRADVAYCIHALARRLAKTRNWIVALKTLVVIHRLLREGDPTFREELLNFTQRGRILQLSNFKDDSSPIAWDCSAWVRTYGLFLEERLECFRVLKYDVEAERLSKQGQGPEKGHSRTRELDSQDLLEQLPALQQLLYRLVGCRPEGAANSNYLVQYALALVLKESFKIYCAINDGIINLVDKFFEMPRHEALKALEIYRRAGQQAGSLSDFYENCRGLELARNFQFPTLREPPQTFLATMEEYVKEAPRMVPVREPLELPERLLLTYKPEESEEIPEPAPVEEEKAPVEEPVPVPPVTEVVSSPPKTEVADTGDLLGLDDPNPAVSAIEESNALALAIVPTDGASTTSNTAFQDKGFDATGWELALVTAPSNTTSSSSVGQLGGGFDKLILDSLYDDGAYRQRQQQQLYGSAAPNPFMTNDPFAMSNQVAPPPSVQMAAMSQQHPQIPTMMQPNPFGPPMQPQMSMGPATNNPFLDSGFGAFPVANNGHQQHNPFGSAQLL

SEQ ID NO: 4907 - DNA, 1689 bp, Sorghum bicolor
  misc_feature: Ceres ANNOT ID no. 6040579
  misc_feature: Encodes the peptide sequence at SEQ ID NO 4908
  misc_feature: Down-regulated in shoot tissues in response to salicylic acid treatment
  misc_feature: Up-regulated in root tissues in response to salicylic acid treatment
atggccgctagtggcctcggcctctccacctcgttcctccccggccacgacaccctcctccggcgccggcgccggcggccggcgagcccctccaccgcgtcgttccggccggtgacggcggagctcggcggcgtcgcggcggggctgggccggcagctggtggaggcggtgggcgtggggctcccctgcaccgtcatgcagtgcggcgacgtcatctaccgcagcacgctcccccagaacgatgggctcaccatcacggcccccggcgtcgcgctcgcgctcgccgccgtgtcgtacctctgggccacgcccggcgtcgcgccggggttcttcgacatgttcgtcctcgccttcgccgagcgcctcttccgccctaccttccgcaaggatgacttcgtgctcgggaagaagcttggggagggcgcattcggggtcgtgtataaggcgtcactggcgaaccccgaagcggctaagaagcaaggggatgtggtcgtgaagaaggcaacagagtatggagcagtggagatttggatgaatgaacgtgtcaggagggcatgtgccagtagttgtgcggattttctttatggctttcgcgagaccaaaacaaagggtaagggagctgaagaatactggattatttggcgttttgaaggcgaggatacactttatgatctcatgcaaagcaaggaattcccttacaatgtggagacaaaaattcttggcaatgtccaggacttgccaaaaggtatagcgagagagaataagatcattcaaacggtgatgagacaactcttgtttgctcttgatggacttcattcgacagggattgttcacagagatataaaacctcaaaatgtgatattttcagagggatcacgaaccttcaaaattattgatcttggagcagcagctgacttacgggtaggaattaactatattcctaaagagttccttttggatccaaggtatgctgcaccagagcaatatattatgagcacgcaaaccccatctgctccttctgttccagttgcaacaactttgtctccagtcctgtggcagctgaatcttcctgacagattcgacatatatagcttggggctcatattcttgcagatggcattcccttcactacgaactgacagcagcctcatacaatttaatcgccaactgaagagatgcgactatgacttacaagcctggaggaatctggtggagccacgagcgactgctgagcttcggaggggctttgacatcatggatctagacaatggtatcggatgggaactcctcacgtcgatggtccggtacaaagcacggcaaaggaccagtgctgagggtgcattggcacacccatactttaaccgtgaggggctccttggcctctctgtcatgcaaaacgcacgactgcaactgttccgggcaacccagaaggactacagtgaagccgctcggtgggttatcggcctcatggcaaggtcaggaactgaagaagtgggaggctttacagaagcacagcttcaagagcttagggaaataaaaccgaagaaaggcaacgcccagcggaacgtgcttgcctccgtgctgcgcctgcagaagaagatcgtgaaaacgatcaacgagagcatggacgagctcgccagccagcgcaaaagcatctggtggagccggtggatacccagggaggagtag

SEQ ID NO: 4908 - protein, 562 aa, Sorghum bicolor
  misc_feature: Ceres ANNOT ID no. 6040579
  misc_feature (132)..(453): Pfam Id: Pkinase Pfam Desc: Protein kinase domain
  misc_feature (132)..(369): Pfam Id: Pkinase_Tyr Pfam Desc: Protein tyrosine kinase
  misc_feature (1)..(562): NCBI GI: 115465267 NCBI Desc: os05g0549100 [oryza sativa (japonica cultivar-group)]
  misc_feature (21)..(511): NCBI GI: 145351534 NCBI Desc: lhcii kinase [ostreococcus lucimarinus cce9901]
  misc_feature (90)..(562): NCBI GI: 62901028 NCBI Desc: serine/threonine-protein kinase stt7, chloroplast precursor
  misc_feature (159)..(473): NCBI GI: 140067192 NCBI Desc: protein kinase [medicago truncatula]
  misc_feature (159)..(453): NCBI GI: 29468988 NCBI Desc: protein kinase [chlamydomonas reinhardtii]
  misc_feature (57)..(562): SWISSPROT Homolog: EC 2.7.11.1 Serine/threonine-protein kinase SNT7, chloroplast precursor
  misc_feature: Down-regulated in shoot tissues in response to salicylic acid treatment
  misc_feature: Up-regulated in root tissues in response to salicylic acid treatment
  misc_feature: The sequence is a functional homolog of SEQ ID NO. 311 in the 11/188,298 US application
  misc_feature: The sequence is a functional homolog of SEQ ID NO. 498 in the 11/188,298 US application
  misc_feature: The sequence is a functional homolog of SEQ ID NO. 310 in the 11/188,298 US application
  misc_feature: The sequence is a functional homolog of SEQ ID NO. 358 in the 11/188,298 US application
  misc_feature: The sequence is a functional homolog of SEQ ID NO. 399 in the 11/188,298 US application
  misc_feature: The sequence is a functional homolog of SEQ ID NO. 464 in the 11/188,298 US application
  misc_feature: The sequence is a functional homolog of SEQ ID NO. 441 in the 11/188,298 US application
  misc_feature: The sequence is a functional homolog of SEQ ID NO. 312 in the 11/188,298 US application
MAASGLGLSTSFLPGHDTLLRRRRRRPASPSTASFRPVTAELGGVAAGLGRQLVEAVGVGLPCTVMQCGDVIYRSTLPQNDGLTITAPGVALALAAVSYLWATPGVAPGFFDMFVLAFAERLFRPTFRKDDFVLGKKLGEGAFGVVYKASLANPEAAKKQGDVVVKKATEYGAVEIWMNERVRRACASSCADFLYGFRETKTKGKGAEEYWIIWRFEGEDTLYDLMQSKEFPYNVETKILGNVQDLPKGIARENKIIQTVMRQLLFALDGLHSTGIVHRDIKPQNVIFSEGSRTFKIIDLGAAADLRVGINYIPKEFLLDPRYAAPEQYIMSTQTPSAPSVPVATTLSPVLWQLNLPDRFDIYSLGLIFLQMAFPSLRTDSSLIQFNRQLKRCDYDLQAWRNLVEPRATAELRRGFDIMDLDNGIGWELLTSMVRYKARQRTSAEGALAHPYFNREGLLGLSVMQNARLQLFRATQKDYSEAARWVIGLMARSGTEEVGGFTEAQLQELREIKPKKGNAQRNVLASVLRLQKKIVKTINESMDELASQRKSIWWSRWIPREE

SEQ ID NO: 4909 - DNA, 1248 bp, Sorghum bicolor
  misc_feature: Ceres ANNOT ID no. 6040589
  misc_feature: Encodes the peptide sequence at SEQ ID NO 4910
atggggacggggagcgtgcgggcgctggccctggcgctcgccgtgtttctcgcctgctccggcatcgccgtcgtcacggcgcaggagaccgagcggatcgaaggaagcgctggtgatgtgttggaagataaccctgttgggagactcaaggtctatgtctatgatctccccagcaaatacaacaagaagctgctgaagaaggatcctaggtgcctgaaccacatgtttgccgctgagatcttcatgcaccggttcctgttgtcaagcgctgtccgaacttttaatcctgaggaagcagattggttctacacacccgtatacacaacttgcgatctgacccctaagggtcttcccttgcctttcaagtctcctcgaatgatgcgtagcgcaatccagctgattgctacaaattggccttactggaatagatcagagggcgctgatcatttctttgtcacgccccatgactttggtgcttgctttcattatcaggaagagaaagcaatcggacggggaatccttcccttgcttcagcgtgctacgctggttcagacctttggacagaagaaccatgtctgcctgaaggatgggtccatcaccatcccgccatatgcgcctcctcagaaaatgcagactcaccttatccctgccgacacccctcgatccatctttgtgtacttccgaggtctgttctatgacactggcaatgatcctgagggcggttactatgcaagaggtgctcgtgcgtcagtctgggagaacttcaagaacaacccgctctttgacatctcgaccgatcacccaccaacatactatgaagacatgcagcgctcagtgttctgcctctgcccattgggctgggcaccatggagtcccaggctagtggaagccgtggtctttggctgcatcccagtgatcatcgcagatgacattgtccttccctttgcggacgccatcccatgggaggagatcggcgtttttgttgctgaggaggatgtcccgcagctggacagcatcctgacatccattcccacagatgttgtactgaggaagcaacggctccttgcgaacccatcgatgaagcaggccatgttgttcccccagcctgctcagccaggagatgcattccaccagattcttaatggtctcgcgcgcaagctccctcacggcagcaatgttttcctgaagcccggcgagagggtcctgaactggaccgctggaccaccaggcgacctgaagccttggtag

SEQ ID NO: 4910 - protein, 415 aa, Sorghum bicolor
  misc_feature: Ceres ANNOT ID no. 6040589
  misc_feature (51)..(355): Pfam Id: Exostosin Pfam Desc: Exostosin family
  misc_feature (9)..(415): NCBI GI: 17978869 NCBI Desc: at5g61840/mac9_140 [arabidopsis thaliana]
  misc_feature (12)..(415): NCBI GI: 15223522 NCBI Desc: exostosin family protein [arabidopsis thaliana]
  misc_feature (30)..(415): NCBI GI: 60657598 NCBI Desc: secondary cell wall-related glycosyltransferase family 47 [populus tremula x populus tremuloides]
  misc_feature (75)..(415): NCBI GI: 23821292 NCBI Desc: pectin-glucuronyltransferase [nicotiana plumbaginifolia]
  misc_feature (75)..(389): NCBI GI: 39725600 NCBI Desc: npgut1 homolog [nicotiana tabacum]
  misc_feature: Useful for making plants with altered cell wall content and/or composition
  misc_feature: GREAT-hit functional homolog of the protein sequence encoded by LOCUS at1g27440
  misc_feature: GREAT-hit functional homolog of the protein sequence encoded by LOCUS at5g61840
  misc_feature: Useful for making plants with altered carbohydrate content
  misc_feature: Functional homolog of the protein sequence given in SEQ ID NO 13639
  misc_feature: Useful for making plants with altered cell wall content and/or composition
  misc_feature: Functional homolog of the protein sequence given in SEQ ID NO 13864
MGTGSVRALALALAVFLACSGIAVVTAQETERIEGSAGDVLEDNPVGRLKVYVYDLPSKYNKKLLKKDPRCLNHMFAAEIFMHRFLLSSAVRTFNPEEADWFYTPVYTTCDLTPKGLPLPFKSPRMMRSAIQLIATNWPYWNRSEGADHFFVTPHDFGACFHYQEEKAIGRGILPLLQRATLVQTFGQKNHVCLKDGSITIPPYAPPQKMQTHLIPADTPRSIFVYFRGLFYDTGNDPEGGYYARGARASVWENFKNNPLFDISTDHPPTYYEDMQRSVFCLCPLGWAPWSPRLVEAVVFGCIPVIIADDIVLPFADAIPWEEIGVFVAEEDVPQLDSILTSIPTDVVLRKQRLLANPSMKQAMLFPQPAQPGDAFHQILNGLARKLPHGSNVFLKPGERVLNWTAGPPGDLKPW

SEQ ID NO: 4911 - DNA, 1218 bp, Sorghum bicolor
  misc_feature: Ceres ANNOT ID no. 6040590
  misc_feature: Encodes the peptide sequence at SEQ ID NO 4912
atggggagggggagcgcgatggcgcaagcccttgcgctcgtcgccttgctcctcgcctgctccgacgtcgccgtcgtcgcggcgcaggagactgagaggatccaagggagtgctggtgatgtgcttgaagatgatcctgtcggaaggctcaaggtatatgtctatgagctgccccccaagtacaacaagaatatactggcaaaggattcgagatgcctcagccacatgtttgctacagagatattcatgcatcgcttcctcttgacgagcgcggtccggactctaaatccggacgaagctgattggttctatactccagtatacacaacgtgcgaccttacaccatggggtcatcccttgactacaaagtctccacgaatgatgagaagtgcgattcagacggagggagcagaccatttctttgtcacaccacatgactttggagcatgcttctatttccaggaagagacggccatccagcgaggtgtccttccggtgctgcgccgtgctacactggtccagacttttgggcagaagcatcatgtgtgcctgaaggaaggctccatcaccatcccgccgtatgctcctcctcataagatcagaactcacattgttccaccagagacccctcgttcaatctttgtctacttccgtggtctgttctatgacaccgcaaatgatcccgagggtggttactatgcaaggggtgcccgtgcgtcagtatgggagaacttcaagaacaatgctctgttcgacatctccacagaacacccgccaacctactatgaggacatgcagcgtgccatcttctgcctgtgcccactggggtgggcgccatggagtccccgtctagtggaggccgtggtgtttggctgcatccccgtgatcatcgcggacgacatcgtgctcccctttgcggacgcgatcccatgggaggagatcgccgtgttcgtggccgaggacgacgtcctgaagctggacaccatcctgacgtccatacccatggaggagatcctccgcaaacagcggctgctggcgaacccgtcgatgaagcaggcgatgctgttcccgcagcccgcggagccccgggacgcgttccaccaggtgctcaacgggctggcgcggaagctcccccacggcaagggcgtgttcctcaagcccgggcagaaggtgctcaactggaccgaggggacccgggaagacctcaagccgtggtag

SEQ ID NO: 4912 - protein, 405 aa, Sorghum bicolor
  misc_feature: Ceres ANNOT ID no. 6040590
  misc_feature (52)..(345): Pfam Id: Exostosin Pfam Desc: Exostosin family
  misc_feature (11)..(405): NCBI GI: 15223522 NCBI Desc: exostosin family protein [arabidopsis thaliana]
  misc_feature (28)..(405): NCBI GI: 17978869 NCBI Desc: at5g61840/mac9_140 [arabidopsis thaliana]
  misc_feature (12)..(405): NCBI GI: 60657598 NCBI Desc: secondary cell wall-related glycosyltransferase family 47 [populus tremula x populus tremuloides]
  misc_feature (76)..(405): NCBI GI: 23821292 NCBI Desc: pectin-glucuronyltransferase [nicotiana plumbaginifolia]
  misc_feature (76)..(381): NCBI GI: 39725600 NCBI Desc: npgut1 homolog [nicotiana tabacum]
  misc_feature: Useful for making plants with altered cell wall content and/or composition
  misc_feature: Functional homolog of the protein sequence encoded by LOCUS at1g27440
  misc_feature: GREAT-hit functional homolog of the protein sequence encoded by LOCUS at5g61840
  misc_feature: Useful for making plants with altered carbohydrate content
  misc_feature: Functional homolog of the protein sequence given in SEQ ID NO 13639
  misc_feature: Useful for making plants with altered cell wall content and/or composition
  misc_feature: Functional homolog of the protein sequence given in SEQ ID NO 13640
MGRGSAMAQALALVALLLACSDVAVVAAQETERIQGSAGDVLEDDPVGRLKVYVYELPPKYNKNILAKDSRCLSHMFATEIFMHRFLLTSAVRTLNPDEADWFYTPVYTTCDLTPWGHPLTTKSPRMMRSAIQTEGADHFFVTPHDFGACFYFQEETAIQRGVLPVLRRATLVQTFGQKHHVCLKEGSITIPPYAPPHKIRTHIVPPETPRSIFVYFRGLFYDTANDPEGGYYARGARASVWENFKNNALFDISTEHPPTYYEDMQRAIFCLCPLGWAPWSPRLVEAVVFGCIPVIIADDIVLPFADAIPWEEIAVFVAEDDVLKLDTILTSIPMEEILRKQRLLANPSMKQAMLFPQPAEPRDAFHQVLNGLARKLPHGKGVFLKPGQKVLNWTEGTREDLKPW

SEQ ID NO: 4913 - DNA, 954 bp, Sorghum bicolor
  misc_feature: Ceres ANNOT ID no. 6040604
  misc_feature: Encodes the peptide sequence at SEQ ID NO 4914
atgccgccgccggcggccatccgcctggggcctccgcacccgtacctgaagacgcacgggggcaaggtcgcgaggctgcacgggttcgactgggccgtgctgctgctcctcgtcgccgccgacgtcgggctcaacctcatcgagccgttccaccgcttcgtcggcgaggacatgctcaccgacctccggtatccgttgaagagcaacaccgtgcccgtctgggccgtgccgatatacgcggtgatcggcccgatcgtcgtcttcgtcggggtgtacctgaagaggaggaacgtgtacgacatgcaccacgccattctagggcttctgttctccgtgctcatcaccggcgtcctcaccgacgcgatcaaggacggcgtcggccggccgcgccccaacttcttctggcgatgcttccctgacggagtgccgaagtacgacaacttcactagaggagtcctatgcgacggcgtcgccagtgtgatcaaagaagggcacaagagcttcccaagtggccattcttcgtggtcctttgctgggctaggcttcctgtcgtggtacctggcgggcaaggtcaaggtgttcgaccggcgcggccacgtggccaagctctgcgtcgtcgtcctgccgctgctgctggcggcgatggtggcggtgtcgcgggtggacgactactggcaccactggcaggacgtgtttgccggtgggattcttgggttggtggtggcgtccttctgctacctgcagtttttcccaccgccatctggtgaacaaggattttggccccatgcgtactttgagcacattcataaccctgaatgcgagggccaagcgcactcaacaacaaactcgaaccaccaccgatccttgtccaccagagagcctgttgcagtggagatgagcaccacgagccaagaagcattagattccatggaagaaggacgcagagatcagtga

SEQ ID NO: 4914 - protein, 317 aa, Sorghum bicolor
  misc_feature: Ceres ANNOT ID no. 6040604
  misc_feature (104)..(254): Pfam Id: PAP2 Pfam Desc: PAP2 superfamily
  misc_feature (1)..(317): NCBI GI: 56784972 NCBI Desc: phosphatidic acid phosphatase beta-like [oryza sativa (japonica cultivar-group)]
  misc_feature (1)..(317): NCBI GI: 126165538 NCBI Desc: acid phosphatase acp2 [oryza sativa (japonica cultivar-group)]
  misc_feature (4)..(281): NCBI GI: 56202159 NCBI Desc: phosphatidic acid phosphatase beta-like [oryza sativa (japonica cultivar-group)]
  misc_feature (7)..(285): NCBI GI: 9621903 NCBI Desc: phosphatidic acid phosphatase alpha [vigna unguiculata]
  misc_feature (7)..(297): NCBI GI: 10673973 NCBI Desc: phosphatidic acid phosphatase beta [vigna unguiculata]
MPPPAAIRLGPPHPYLKTHGGKVARLHGFDWAVLLLLVAADVGLNLIEPFHRFVGEDMLTDLRYPLKSNTVPVWAVPIYAVIGPIVVFVGVYLKRRNVYDMHHAILGLLFSVLITGVLTDAIKDGVGRPRPNFFWRCFPDGVPKYDNFTRGVLCDGVASVIKEGHKSFPSGHSSWSFAGLGFLSWYLAGKVKVFDRRGHVAKLCVVVLPLLLAAMVAVSRVDDYWHHWQDVFAGGILGLVVASFCYLQFFPPPSGEQGFWPHAYFEHIHNPECEGQAHSTTNSNHHRSLSTREPVAVEMSTTSQEALDSMEEGRRDQ

SEQ ID NO: 4915 - DNA, 681 bp, Sorghum bicolor
  misc_feature: Ceres ANNOT ID no. 6040606
  misc_feature: Encodes the peptide sequence at SEQ ID NO 4916
atgtctcaagccaaggttcctcatgttcagaccgattcttcttccgacgacgatggaccaacgacaaagctagtttttcataggcgcaaatcagttgataagctactcggtggccggaaagtttctgacgtcctgctatggaggaacagaaacttgtcggcagggatccttgcgggggcaacattggtctggttcctgttcgacgtggtggagtacaacgtagtaacgctcctttgccacattgcactgcttgggatgcttctgctcttcatttggtcgaccgctgcgcctctctttgacaggccgcctccacagatcccagaggtgatcgtttctgaacaagcgttcagagaagttgcacagaacatccactacaaactggctcactttgtgtcaatcctgtatgacgttgcatgtgagaaggatctcaagaagttcctcatggtgattgggtctctttggatactggcgatacttggagatacttgcagcttcaccacactgttatacgttggatttttgtgtgctctgacattaccggcactatatgaaagatacgaaacagaagtggaccatcttgtggccaagggccatgaagacctcaagaaattctacaagaaggttgactccaatgtgctcaacaagataccgagaggccctgtcaagacaaaagttctctaa

SEQ ID NO: 4916 - protein, 226 aa, Sorghum bicolor
  misc_feature: Ceres ANNOT ID no. 6040606
  misc_feature (41)..(224): Pfam Id: Reticulon Pfam Desc: Reticulon
  misc_feature (11)..(224): NCBI GI: 9279659 NCBI Desc: seed maturation protein-like [arabidopsis thaliana]
  misc_feature (25)..(224): NCBI GI: 20160502 NCBI Desc: osjnbb0021a09.5 [oryza sativa (japonica cultivar-group)]
  misc_feature (31)..(224): NCBI GI: 78714222 NCBI Desc: reticulon [hordeum vulgare]
  misc_feature (49)..(224): NCBI GI: 115435410 NCBI Desc: os01g0226300 [oryza sativa (japonica cultivar-group)]
  misc_feature (25)..(219): NCBI GI: 30681227 NCBI Desc: reticulon family protein [arabidopsis thaliana]
MSQAKVPHVQTDSSSDDDGPTTKLVFHRRKSVDKLLGGRKVSDVLLWRNRNLSAGILAGATLVWFLFDVVEYNVVTLLCHIALLGMLLLFIWSTAAPLFDRPPPQIPEVIVSEQAFREVAQNIHYKLAHFVSILYDVACEKDLKKFLMVIGSLWILAILGDTCSFTTLLYVGFLCALTLPALYERYETEVDHLVAKGHEDLKKFYKKVDSNVLNKIPRGPVKTKVL

SEQ ID NO: 4917 - DNA, 294 bp, Sorghum bicolor
  misc_feature: Ceres ANNOT ID no. 6040607
  misc_feature: Encodes the peptide sequence at SEQ ID NO 4918
atggcgacgaagcctgcgcaggtgctggtggcggtggtggtcctgctgctgctgtgcgccgccacgccgcggggcgccgacgcggcgacggcttgcgacgccacgcagctgaccccgtgcgcgggcgccatcatcggcagctcgccgcccaccgccgcgtgctgcagcaggctcaaggagcagcagccgtgcctgtgcacgtacgcgcgcgaccccaacctgcagcgctacgtcaactcgcccaacggcaagaaggccatggccgcgtgcaaggtgcccgtgccgtcgtgctaa

SEQ ID NO: 4918 - protein, 97 aa, Sorghum bicolor
  misc_feature: Ceres ANNOT ID no. 6040607
  misc_feature (32)..(97): Pfam Id: Tryp_alpha_amyl Pfam Desc: Protease inhibitor/seed storage/LTP family
  misc_feature (6)..(97): NCBI GI: 1848225 NCBI Desc: nonspecific lipid transfer protein [hordeum vulgare]
  misc_feature (10)..(97): NCBI GI: 9279661 NCBI Desc: lipid transfer protein [arabidopsis thaliana]
  misc_feature (9)..(94): NCBI GI: 45925909 NCBI Desc: probable lipid transfer protein family protein [tamarix androssowii]
  misc_feature (10)..(97): NCBI GI: 498036 NCBI Desc: lipid transfer protein
  misc_feature (8)..(97): NCBI GI: 110832071 NCBI Desc: nonspecific lipid-transfer protein 2 precursor (nsltp2) (7 kda lipid transfer protein)
  misc_feature: Useful for making plants with modulated biomass
  misc_feature: Functional homolog of the protein sequence given in SEQ ID NO 13146
  misc_feature: The sequence is a functional homolog of SEQ ID NO. 364 in the 11/188,298 US application
MATKPAQVLVAVVVLLLLCAATPRGADAATACDATQLTPCAGAIIGSSPPTAACCSRLKEQQPCLCTYARDPNLQRYVNSPNGKKAMAACKVPVPSC

SEQ ID NO: 4919 - DNA, 1077 bp, Sorghum bicolor
  misc_feature: Ceres ANNOT ID no. 6040612
  misc_feature: Encodes the peptide sequence at SEQ ID NO 4920
atgtcagcaagtgctttgaaagatctcaatgtttctcaatcagcaaacctggagaatggaaaagacaattctgtgaaatcctgcattagcaagcctgtgttaaatggcaacagttgtgccaaaaaggaagaaagttctctgtctgcttgccctgatgcagtgacgaatggaaatgtggctggaaatgcagacgtggagtacattgattctgagaatttagtagatctaccagatgttgatgcagctctaagtaccttagttaaaaggttggattcaaaggactgggttatgacatgtgaagctctcaacaatgttcggcagttggcaatgtatcacaaggaaagattgcaggagctgctggagcctctagttccgcttatcgtgaaatctgtgaagaatccaagaagcgctgtatgcaaaacagcactaatgacttgtgctgacatctttaaggcctatggagacctaatggttgactccatcgatccactgttaatgcagttgtttctaaaggcttcacaagataagcgatttgtctgtgaagctgctgaggcagctcttatatcaatgacaagttggatctcccctttactactgttaccaagaatgcagccctacctcaagaataggaatccacggattcgagcaaaagcatcagtgtgtttcagcaagagtgtgccttgcctagatgtgcagggaatcagagaatatggaatggataagctcatccagattgcagcaacccaacttagtgaccagcttcccgaatcaagggaggctgctcgcaacctggcactggaactacaagtaatctatgagaagtctcaggcctcaacctctgatgaaaatgagagcgaaccttctgtttcacaagatgctgaatcatgggaggctttctgtcagtccaagctttctgccttgagcgcccaagccatcctccgtgtgacctctactactccaaaagagggtgttgcctctaccacaaaaactacaaaagagggtgttgcctctactacaaatactacaaaagagggtgtcacctccgccccaaaagaaggtttggctgtggattgctag

SEQ ID NO: 4920 - protein, 358 aa, Sorghum bicolor
  misc_feature: Ceres ANNOT ID no. 6040612
  misc_feature (121)..(335): NCBI GI: 115477505 NCBI Desc: os08g0534200 [oryza sativa (japonica cultivar-group)]
  misc_feature (66)..(196): NCBI GI: 40807213 NCBI Desc: kiaa0423 protein [homo sapiens]
  misc_feature (66)..(264): NCBI GI: 115502237 NCBI Desc: protein kiaa0423
  misc_feature (66)..(264): NCBI GI: 50510481 NCBI Desc: mkiaa0423 protein [mus musculus]
  misc_feature (66)..(196): NCBI GI: 115502236 NCBI Desc: protein kiaa0423
MSASALKDLNVSQSANLENGKDNSVKSCISKPVLNGNSCAKKEESSLSACPDAVTNGNVAGNADVEYIDSENLVDLPDVDAALSTLVKRLDSKDWVMTCEALNNVRQLAMYHKERLQELLEPLVPLIVKSVKNPRSAVCKTALMTCADIFKAYGDLMVDSIDPLLMQLFLKASQDKRFVCEAAEAALISMTSWISPLLLLPRMQPYLKNRNPRIRAKASVCFSKSVPCLDVQGIREYGMDKLIQIAATQLSDQLPESREAARNLALELQVIYEKSQASTSDENESEPSVSQDAESWEAFCQSKLSALSAQAILRVTSTTPKEGVASTTKTTKEGVASTTNTTKEGVTSAPKEGLAVDC

SEQ ID NO: 4921 - DNA, 810 bp, Sorghum bicolor
  misc_feature: Ceres ANNOT ID no. 6040613
  misc_feature: Encodes the peptide sequence at SEQ ID NO 4922
atggcggccacggcagatccgcgggcgaagcctccggcagcggcgccgcaccacctcgccgagccgtgggcgcatcaggccgcctcaccagccgccgcccaccgcagcatgcccgtcgtagcctcggcctcggccgcggccggctgtggcgcccgcgatcgccgccggtcgtcgtcgtccaaccgccgggcccaggccgtcggggacgacacgtcgtacgacggtgggatcgaggcgctccgtgccaagctcatgggccacctgcgcgacgccgcggaccggctccgcgtgccccagcccagcaggagcaccatcgcctcgctgcctcctgctcctcgccctctggcgctgcccaaggctaccgctaccgcgagcccgccgccgccgccagggacggactccgagaccgagccagagctcagggcgccgccaccgcctccgcctcctcccgcacctactgcgcccgcgcaagcggacgctaccgctgccggcgcgaccgcgaggccgtggaacctgcgggagcgcacgcgtcgccgccccgccgccttcaggtcgtgggccgcgtccccgtccccgccgcctcctccgccgtcgtcgtcgtcgtcgcggaggcggcgcaagcgcgccccgttctccgtgtccctgacggcggaggagatcgaggaggacatctacgcgctgaccggcgcccggccgcggcggcggccccggaagcggccgcgcgccgtgcagcggcatgtcgattcgctgttcccggggctgtggctgaccgagatcacccccgacgcgtaccgagtgccggacgagtag

SEQ ID NO: 4922 - protein, 269 aa, Sorghum bicolor
  misc_feature: Ceres ANNOT ID no. 6040613
  misc_feature (151)..(252): NCBI GI: 115434350 NCBI Desc: os01g0132500 [oryza sativa (japonica cultivar-group)]
  misc_feature (133)..(269): NCBI GI: 115465299 NCBI Desc: os05g0551600 [oryza sativa (japonica cultivar-group)]
  misc_feature (83)..(198): NCBI GI: 91806886 NCBI Desc: proline-rich extensin-like family protein [arabidopsis thaliana]
  misc_feature (98)..(202): NCBI GI: 115473145 NCBI Desc: os07g0596300 [oryza sativa (japonica cultivar-group)]
  misc_feature (100)..(204): NCBI GI: 115475690 NCBI Desc: os08g0280200 [oryza sativa (japonica cultivar-group)]
MAATADPRAKPPAAAPHHLAEPWAHQAASPAAAHRSMPVVASASAAAGCGARDRRRSSSSNRRAQAVGDDTSYDGGIEALRAKLMGHLRDAADRLRVPQPSRSTIASLPPAPRPLALPKATATASPPPPPGTDSETEPELRAPPPPPPPPAPTAPAQADATAAGATARPWNLRERTRRRPAAFRSWAASPSPPPPPPSSSSSRRRRKRAPFSVSLTAEEIEEDIYALTGARPRRRPRKRPRAVQRHVDSLFPGLWLTEITPDAYRVPDE

SEQ ID NO: 4923 - DNA, 1125 bp, Sorghum bicolor
  misc_feature: Ceres ANNOT ID no. 6040623
  misc_feature: Encodes the peptide sequence at SEQ ID NO 4924
atgtcgtcgtcgctgtacaagcagatgggcctttccggagccggctccccgctcaccggccgccacgtcgccctcctcatcctcggcgccggcttcctcgcgctcaccgtcttcgtcgtgcaccccaacgagtttgaaatccaatccttcttcgcaggcggcggcagcagcagcagctgcgaccgccgccccggcacggacacagctgctgccgcagccaccagtccccacggtgccaccaccaccaccaccacggagaaggagctcgccgcagcacgggcgccggcgccggctccggacgacgacgacgacgacgtgcgcgtcctcatcggcatccagacgctgccgagcaagcgcgcgcggcggcacctgctgcgggacgtctactcgctgcaggcgcaggagcacccgtcggtggcccgcggcgtggacgtccggttcgtgttctgcaacgtgacgtcccccgacgacgcggtgctcgtggcgctggaggccatccgctacggcgacatcatggtgctggactgcgcggagaacatggacaacggcaagacgtacaccttcttctccaccgtggcgcgcgcgttcagcggcagcgaccggcggcggcggccgaggaggaggtacgagtacgactacgtgatgaaggccgacgacgacacgtacctgcgtctgccggcgctggtggcgtcgctgcgcggcgcggcgagggaggacgcctactacgggctgcagatgccgtgcgacacggagaacttctacccgttcccgcccttcatgtccgggatggggtacgcgctgtcgtgggacctggtgcagtgggtggcgtcgtcggacctggcacggcgcgagcaggacgggcccgaggacatgtggacggggcggtggctcaacctcgccggcaaggccaagaaccggtacgacaacgcgcccaggatgtacaactacaagggagcctcgccggacagctgcttccggcacggattcgtcccggacaccatcgccgtgcacatgctcaaggacgacgcgaggtgggccgagacgctcgcctacttcaacgccaccgccagcctcccgcgctccggcggcctataccacctgccggtgccggcggccagcccctga

SEQ ID NO: 4924 - protein, 374 aa, Sorghum bicolor
  misc_feature: Ceres ANNOT ID no. 6040623
  misc_feature (105)..(358): NCBI GI: 115479301 NCBI Desc: os09g0433500 [oryza sativa (japonica cultivar-group)]
  misc_feature (108)..(297): NCBI GI: 89269053 NCBI Desc: udp-gal:betagal beta 1,3-galactosyltransferase polypeptide 6 [xenopus tropicalis]
  misc_feature (208)..(340): NCBI GI: 74625883 NCBI Desc: beta-1,3-galactosyltransferase pvg3 (pyruvylated gal-beta-1,3-epitope synthesis protein 3) (pvgal synthesis protein 3)
  misc_feature (53)..(297): NCBI GI: 30685292 NCBI Desc: galactosyltransferase family protein [arabidopsis thaliana]
  misc_feature: The sequence is a functional homolog of SEQ ID NO. 346 in the 11/188,298 US application
MSSSLYKQMGLSGAGSPLTGRHVALLILGAGFLALTVFVVHPNEFEIQSFFAGGGSSSSCDRRPGTDTAAAAATSPHGATTTTTTEKELAAARAPAPAPDDDDDDVRVLIGIQTLPSKRARRHLLRDVYSLQAQEHPSVARGVDVRFVFCNVTSPDDAVLVALEAIRYGDIMVLDCAENMDNGKTYTFFSTVARAFSGSDRRRRPRRRYEYDYVMKADDDTYLRLPALVASLRGAAREDAYYGLQMPCDTENFYPFPPFMSGMGYALSWDLVQWVASSDLARREQDGPEDMWTGRWLNLAGKAKNRYDNAPRMYNYKGASPDSCFRHGFVPDTIAVHMLKDDARWAETLAYFNATASLPRSGGLYHLPVPAASP

SEQ ID NO: 4925 - DNA, 720 bp, Sorghum bicolor
  misc_feature: Ceres ANNOT ID no. 6040627
  misc_feature: Encodes the peptide sequence at SEQ ID NO 4926
atggcaggccggttgctgacggagtccagtcttcagtccgccattggggaggcctctgccgtgccctccaccgcatcgactgcgtgcgatgtgcctgtccaagatggcaggcaagcgagcggtactgtcttggtagaatgcagaatctgccaggaggatgacgacgaggcctgcatggaggctccttgctcctgcaagggaagcttgaagtacgcccatcgcaaatgcattcagagatggtgtgatgagaagggagacaccatatgtgagatatgcttgaagcaatttgtaccaaattacactgcctcttcaaagctgtttcaacgaggaagaaacacgattttcttcagtgctcctggctacattcaagcacggccagatcattctgctacatcaacaagctatgggtatgatcaaactccagctcctaccggcgtattatgttgtcgcataatcgctataactctgatggttctcctggtcttccgcgacgctctctcggttttcctggatgaccaagatgcctacaccgttgcaatggtcactctgctgatgcttagaaccacggcgatcgtcattccggtctacatcatattggtggcggttactgagctgcttcatcgacgcaggcaacggcaggttgtgcacgaccagatgacttcagagcatgaaggaggggagagtacgcagccgcagcagcatgtcattagcattcagtag

SEQ ID NO: 4926 - protein, 239 aa, Sorghum bicolor
  misc_feature: Ceres ANNOT ID no. 6040627
  misc_feature (47)..(92): Pfam Id: zf-C3HC4 Pfam Desc: Zinc finger, C3HC4 type (RING finger)
  misc_feature (1)..(237): NCBI GI: 115434232 NCBI Desc: os01g0121200 [oryza sativa (japonica cultivar-group)]
  misc_feature (1)..(239): NCBI GI: 79316317 NCBI Desc: protein binding / ubiquitin-protein ligase/ zinc ion binding [arabidopsis thaliana]
  misc_feature (46)..(239): NCBI GI: 52077476 NCBI Desc: zinc finger protein-like [oryza sativa (japonica cultivar-group)]
  misc_feature (46)..(239): NCBI GI: 115436152 NCBI Desc: os01g0303600 [oryza sativa (japonica cultivar-group)]
  misc_feature (7)..(214): NCBI GI: 42408883 NCBI Desc: zinc finger protein-like [oryza sativa (japonica cultivar-group)]
MAGRLLTESSLQSAIGEASAVPSTASTACDVPVQDGRQASGTVLVECRICQEDDDEACMEAPCSCKGSLKYAHRKCIQRWCDEKGDTICEICLKQFVPNYTASSKLFQRGRNTIFFSAPGYIQARPDHSATSTSYGYDQTPAPTGVLCCRIIAITLMVLLVFRDALSVFLDDQDAYTVAMVTLLMLRTTAIVIPVYIILVAVTELLHRRRQRQVVHDQMTSEHEGGESTQPQQHVISIQ

SEQ ID NO: 4927 - DNA, 1560 bp, Sorghum bicolor
  misc_feature: Ceres ANNOT ID no. 6040628
  misc_feature: Encodes the peptide sequence at SEQ ID NO 4928
atggccgccgcgacggcggcggcgcggcgggtcctcttagccctcgccgtcctcgccgcctgcctcggcgcggcgccgcgcggggcggacgcgctccgctcgctcggcgtcgggggcgacaaggcggccgacggggacacggccgtcgacctcgacgcctccaacttcaccgccttcctccaggcgtcgccggagtcgttcgcggtcgtcgagttcttcgcgcactggtgtcctgcttgcagaaactacaagcctcactatgagaaggttgcaaaaattttcaatggcccagatgctgcacacccagggactattgtgatggcacgggtggattgtgcatcaaaggtgaacgtggagctttgcaataaattctctgttgaccattatccttacctagtatggggtccaccaacaaaatttaatttggctcagtggaaaccaaagcaagagaatagtgaattagaattaattgatgatgcaagaacagcagatcggttacttaaatggataaataagaagatgggaagctcatttaatttagacgacaaaaagtacgagaatgaaagtatgctccccaaaaatgcttcagatcctgaacagattgttcgagcaatttatgatgttgaggaagctacagctcatgcattgcagataattttggagcataagatgatcaaaccagacactcgtgactcacttattaggtttttacaaattttggtggctcatcatccatcaaagaggtgtcgaagaggatctgctgagctacttattgactttgatgatcactggcatacaaacctctcaagtttgcaagacagttctacattgttgaaaagtgcaggagagaaaatatgtggaaatggggtgccacgtggatactggattttctgccgaggaagtaaaaaggaaacgagaggatttagctgtggtctatgggttttgctgcattcactaactgtccgaatcggagatggagagagccaaacaacatttacatcaatttgtgatttcatccacaatttcttcatctgtgaggaatgccgcacgcacttctatgaaatgtgttcaagtgtatcagtccccttcaaatctgcccgtgaccttgctctctggctatggaccgcgcataacaaagttaatgagagattgatgaaagaagaaaaggatttagacaatgctgatccttcatttcctaagatcgtctggcctccaaagcagctctgtccattgtgctacctttcttctagtaagactgctgatggagccatgcaggttgagtggaatgaagatgaagtattcaatttcttggttaactactatgggaagatgcttgtatcatcctacagggagacctccatggaatctcttcttcaagtaaccaagcaagtaggctcaatttctgacgattcttccgcatccagtgccgcaacagtaccaattggagctgccctgggtatcgcccttgctagctgtacatttggggcactagcatgcttctggaggacccagcagaagaacagaaagtactaccatttacgttctttaaagaaaatttga

SEQ ID NO: 4928 - protein, 519 aa, Sorghum bicolor
  misc_feature: Ceres ANNOT ID no. 6040628
  misc_feature (312)..(403): Pfam Id: Evr1_Alr Pfam Desc: Erv1 / Alr family
  misc_feature (47)..(173): Pfam Id: Thioredoxin Pfam Desc: Thioredoxin
  misc_feature (1)..(509): NCBI GI: 58201594 NCBI Desc: thiol oxidoreductase [zea mays]
  misc_feature (44)..(509): NCBI GI: 144923826 NCBI Desc: thioredoxin domain 2; erv1/alr; thioredoxin fold [medicago truncatula]
  misc_feature (11)..(518): NCBI GI: 6899648 NCBI Desc: contains thioredoxin domain pf00085. ests gbt42351, gbaa042405 come from this gene. [arabidopsis thaliana]
  misc_feature (11)..(509): NCBI GI: 30684124 NCBI Desc: thioredoxin family protein [arabidopsis thaliana]
  misc_feature (190)..(509): NCBI GI: 115465313 NCBI Desc: os05g0552500 [oryza sativa (japonica cultivar-group)]
MAAATAAARRVLLALAVLAACLGAAPRGADALRSLGVGGDKAADGDTAVDLDASNFTAFLQASPESFAVVEFFAHWCPACRNYKPHYEKVAKIFNGPDAAHPGTIVMARVDCASKVNVELCNKFSVDHYPYLVWGPPTKFNLAQWKPKQENSELELIDDARTADRLLKWINKKMGSSFNLDDKKYENESMLPKNASDPEQIVRAIYDVEEATAHALQIILEHKMIKPDTRDSLIRFLQILVAHHPSKRCRRGSAELLIDFDDHWHTNLSSLQDSSTLLKSAGEKICGNGVPRGYWIFCRGSKKETRGFSCGLWVLLHSLTVRIGDGESQTTFTSICDFIHNFFICEECRTHFYEMCSSVSVPFKSARDLALWLWTAHNKVNERLMKEEKDLDNADPSFPKIVWPPKQLCPLCYLSSSKTADGAMQVEWNEDEVFNFLVNYYGKMLVSSYRETSMESLLQVTKQVGSISDDSSASSAATVPIGAALGIALASCTFGALACFWRTQQKNRKYYHLRSLKKI

SEQ ID NO: 4929 - DNA, 582 bp, Sorghum bicolor
  misc_feature: Ceres ANNOT ID no. 6040637
  misc_feature: Encodes the peptide sequence at SEQ ID NO 4930
atgagcgcggtgaacatcaccaacgtggcggtgctggacaaccccaccgccttcctcaaccccttccagttcgagatctcctacgagtgcctcgtgcccctcgacgacgatctggagtggaagcttatatatgttggatcagctgaagatgaaaactacgaccaacagcttgagagcgtgcttgttggccctgtcaatgttgggacctaccgtttcgtcctccaggctgacccaccggatccctcaaagatccgtgaggaagacataattggtgtgactgtgctgctactgacgtgctcttacatgggccaggagttcatgagagtaggttactacgtgaacaatgattatgatgatgagcaattgagggaagagcctccagcaaaggtgctaattgaccgggtgcagagaaatatcttggctgacaagccccgagtcaccaagttccctatcaacttccatcctgaacccagtactggcacgggacagcagcagcaggaaccccaggcagcctcgccagaaaaccacacaggcaatggccatggcaatggcgatggaagcaagcctgaagctgaccaatga

SEQ ID NO: 4930 - protein, 193 aa, Sorghum bicolor
  misc_feature: Ceres ANNOT ID no. 6040637
  misc_feature (1)..(155): Pfam Id: Anti-silence Pfam Desc: Anti-silencing protein, ASF1-like
  misc_feature (1)..(175): NCBI GI: 75180361 NCBI Desc: anti-silencing factor 1-like protein b (anti-silencing function 1b protein) (silencing group a protein 1)
  misc_feature (12)..(173): NCBI GI: 6069498 NCBI Desc: s-locus protein 7 [brassica rapa]
  misc_feature (37)..(193): NCBI GI: 115439231 NCBI Desc: os01g0685200 [oryza sativa (japonica cultivar-group)]
  misc_feature (73)..(193): NCBI GI: 56784987 NCBI Desc: anti-silencing function 1a-like [oryza sativa (japonica cultivar-group)]
  misc_feature (1)..(167): NCBI GI: 54641715 NCBI Desc: ga21747-pa [drosophila pseudoobscura]
MSAVNITNVAVLDNPTAFLNPFQFEISYECLVPLDDDLEWKLIYVGSAEDENYDQQLESVLVGPVNVGTYRFVLQADPPDPSKIREEDIIGVTVLLLTCSYMGQEFMRVGYYVNNDYDDEQLREEPPAKVLIDRVQRNILADKPRVTKFPINFHPEPSTGTGQQQQEPQAASPENHTGNGHGNGDGSKPEADQ

SEQ ID NO: 4931 - DNA, 1263 bp, Sorghum bicolor
  misc_feature: Ceres ANNOT ID no. 6040643
  misc_feature: Encodes the peptide sequence at SEQ ID NO 4932
atggaggcgaagcagcggccgcggcacggcgaggagaggaggccgccggcgacggacaacagcggcggcggcggcggcgaggagtacgacccatggacggcgtggctctacaagccgcacactatctcggtgctcctcgtcggcgcctgggcaagtggagcacttgatcctgaaggtgctgctgctcacagtagcgtgacatcaatcaagaggggtgtctgggctatgattgcagtcttccttgcctactgcacgcttcaggcaccttcaacgatacttattaggccccatcctgctgtctggcgcctggtacatggactggctgtcgtttacctcgttgctcttaccttccttcttttccagaatcgtgacgatgctcgccaattcatgaaacaccttcaccctgatcttggagttgaattgccggagagatcttatggagccgattgccgtttgtatgttccagaaaaccctaaaaacaagttcataaatatttatgagacattgtttgatgaatttgtcgttgcccatatccttgggtggtggggtaaagctgtaatgatacggaatcaacttctcctttgggtcttgtcaattggctttgagctaatggagctaacgttcagacatatgttgccaaactttaatgagtgctggtgggatagcattatcttggatatcttgatctgcaattggtttggtatttgggcaggaatgcacacagtccgttactttgatggcaaaacgtatgaatgggttggactgagccgccaacgaagcatcatgggtaaggtgaaaagatcgttgagccagttcacccctgctcaatgggacaaggatcagtggcatcctttcatggggccactgcggttcatccaagtgctgttcctctgcgttgtcttcatgaccgtggagcttaacacattcttccttaagttttgcctttggatccctccaaggaatcccttggtcgtctacagattgatcctctggtggctgattgccatcccaaccatccgcgagtacaactcctacttacaagacagcaaaccggtgaagaaggttggagccttttgttggctctctctggctatatgcatagtggagctgcttatctgcatgaagtttgggcatggattgtttcatgacccaatgccaacctggctgatcatcttttggagctcggttgggattgcacttgtgattttcttgctttcatggtcatggaggagtcaccaaagattcaggagaaagcggctgtga

SEQ ID NO: 4932 - protein, 420 aa, Sorghum bicolor
  misc_feature: Ceres ANNOT ID no. 6040643
  misc_feature (96)..(379): Pfam Id: PSS Pfam Desc: Phosphatidyl serine synthase
  misc_feature (11)..(419): NCBI GI: 42562073 NCBI Desc: phosphatidyl serine synthase family protein [arabidopsis thaliana]
  misc_feature (11)..(379): NCBI GI: 5103809 NCBI Desc: similar to gbaf099053 phosphatidylserine synthase-2 from mus musculus. est gbn96271 comes from this gene. [arabidopsis thaliana]
  misc_feature (11)..(379): NCBI GI: 145323902 NCBI Desc: phosphatidyl serine synthase family protein [arabidopsis thaliana]
  misc_feature (167)..(420): NCBI GI: 115434202 NCBI Desc: os01g0118300 [oryza sativa (japonica cultivar-group)]
  misc_feature (211)..(419): NCBI GI: 22136302 NCBI Desc: similar to phosphatidylserine synthase-2 [arabidopsis thaliana]
MEAKQRPRHGEERRPPATDNSGGGGGEEYDPWTAWLYKPHTISVLLVGAWASGALDPEGAAAHSSVTSIKRGVWAMIAVFLAYCTLQAPSTILIRPHPAVWRLVHGLAVVYLVALTFLLFQNRDDARQFMKHLHPDLGVELPERSYGADCRLYVPENPKNKFINIYETLFDEFVVAHILGWWGKAVMIRNQLLLWVLSIGFELMELTFRHMLPNFNECWWDSIILDILICNWFGIWAGMHTVRYFDGKTYEWVGLSRQRSIMGKVKRSLSQFTPAQWDKDQWHPFMGPLRFIQVLFLCVVFMTVELNTFFLKFCLWIPPRNPLVVYRLILWWLIAIPTIREYNSYLQDSKPVKKVGAFCWLSLAICIVELLICMKFGHGLFHDPMPTWLIIFWSSVGIALVIFLLSWSWRSHQRFRRKRL

SEQ ID NO: 4933 - DNA, 543 bp, Sorghum bicolor
  misc_feature: Ceres ANNOT ID no. 6040648
  misc_feature: Encodes the peptide sequence at SEQ ID NO 4934
atggcggccacgagctccgcctgcggggcgctcgcatccctccccttcgccgcctccacctccgcttctccccgcgtctcgggcagcggccaccggggtccacggcgcttcagggccggcaccgtcagatgttccagcgcgtcgcccaacgtgtcccagggcgcgccggcgccggcgctgcccaagccgcaaatcgagctcgagttcgtcgggccgaagcccggcgccgacggctccttcccggtggaccgggcggaggcggccagcggcgagaagctcctccgtgacatcatgaacgagaacaagatcgagctctacgctgcatacggtaaagtgatgaactgcggtggcggcggaagctgcggcacttgcatcgtcgagataattgatggaaaggagctcctgaatgaaaggacgaacaccgagaatcggtacctgaagaagaaaccagactcatggaggctagcttgtcagactattgtaggcaacaaagagaactccggcaaggttgtggtacaacggctgccccagtggaagaaatga

SEQ ID NO: 4934 - protein, 180 aa, Sorghum bicolor
  misc_feature: Ceres ANNOT ID no. 6040648
  misc_feature (80)..(163): Pfam Id: Fer2 Pfam Desc: 2Fe-2S iron-sulfur cluster binding domain
  misc_feature (1)..(180): NCBI GI: 115465347 NCBI Desc: os05g0555300 [oryza sativa (japonica cultivar-group)]
  misc_feature (25)..(169): NCBI GI: 42573135 NCBI Desc: ferredoxin-related [arabidopsis thaliana]
  misc_feature (55)..(127): NCBI GI: 140059769 NCBI Desc: ferredoxin [medicago truncatula]
  misc_feature (25)..(148): NCBI GI: 79326134 NCBI Desc: electron carrier [arabidopsis thaliana]
  misc_feature (25)..(127): NCBI GI: 42573133 NCBI Desc: ferredoxin-related [arabidopsis thaliana]
MAATSSACGALASLPFAASTSASPRVSGSGHRGPRRFRAGTVRCSSASPNVSQGAPAPALPKPQIELEFVGPKPGADGSFPVDRAEAASGEKLLRDIMNENKIELYAAYGKVMNCGGGGSCGTCIVEIIDGKELLNERTNTENRYLKKKPDSWRLACQTIVGNKENSGKVVVQRLPQWKK

SEQ ID NO: 4935 - DNA, 1830 bp, Sorghum bicolor
  misc_feature: Ceres ANNOT ID no. 6040657
  misc_feature: Encodes the peptide sequence at SEQ ID NO 4936
  misc_feature: Down-regulated in root tissues in response to methyl jasmonate treatment
atggataacttgatcaccctcgtcaacaagctgcagagggcatgcacggctctcggagaccacggagaggagagcgccctcccgacgctctgggattcgctgccggccatcgccgtcgttggaggacagagctctggtaaatcctctgtgttggagagcgtggttgggaaggatttcctaccgaggggttcaggcattgtaacccggcggccgctggtgctgcagctccacagaattgatggcgacagggaatatgctgagtttatgcaccttccgagaaagagatttacagattttgctgctgtgaggaaggagatagctgatgaaactgacagagaaacaggacgttcaaagcaaatatcgactgtccctatccatttaagcatattttctccacatgttgtgaatcttactcttattgatcttcctgggcttactaaagtagcagttgagggccaaccggaaagtattgttcaggacattgaaaacatggttcgctcatatattgaaaagccaaattgtatcattctggctgtttccccagccaatcaggaccttgctacttctgatgcaatcaagatttcacgggaagttgatcccaaaggtgaaaggacctttggtgtgcttacaaaaattgatctgatggacaagggtaccgatgctgttgatatactggaaggaagagcttaccgtctccaaacaccgtgggttggtgttgttaatcgatcccaacaagatatcaacaagaatgtggacatgattgctgctaggcgtagagagcgagagtattttgcaactacaccagaatataagcacatggcttctaggatgggatctgaatatttaggaaagatgctttcaaagcatctggaacaagtgatcaaatcaaggatcccagggctccaatctcttataacaaagacaattgcagagctggaaactgaacttaatcgacttggaaaacccattgctaatgatgctggggggaagctgtacacaatcatggaaatatgtcgtatgtttgacagtatctacaaagagcatctggatggagtgcgtcctggtggagagaaagtttaccatgtcttcgacaatcaatttcctgttgctattaaacgattgcaatttgataaacaactctctatggaaaatgtgaggaagcttataacagaagctgatggataccagcctcacttgatagctccagaacaaggatatcgacgccttatagaatcttgtcttattagtatcagaggtcctgctgaggcagctgttgatgcggtccatgcaattctgaaggaccttgtccgcaaggctatcaatgaaacacatgagctgaagcagtttcccacccttcgtgtggaagtaggcaatgcggcttttgagtcattggatagaatgagggatgaaagcaagaaaaatacattaaagctagttgacatggaatgcagctacttgacagtagatttcttcaggaagcttcctcaggatgttgagaagggtggaaatccaagccactctatttttgatagatataatgactcttatcttagacgaattggacaaactgttctgtcatatgttaatatggtgtgttcgaccttgaggaactccatcccaaaatctatcgtttattgccaagtgcgagaggccaagcgctcgctgctcgatcacttcttcactgaactgggagcaagagagatgaagcaactttccaaacttctcgatgaagacccagcagtcatggaacggagaacaaaccttgcaaagaggctggagctgtaccggagtgcccaatcagaaatcgatgcagttgcgtggtccaaatag

SEQ ID NO: 4936 - protein, 609 aa, Sorghum bicolor
  misc_feature: Ceres ANNOT ID no. 6040657
  misc_feature (221)..(507): Pfam Id: Dynamin_M Pfam Desc: Dynamin central region
  misc_feature (37)..(212): Pfam Id: Dynamin_N Pfam Desc: Dynamin family
  misc_feature (512)..(605): Pfam Id: GED Pfam Desc: Dynamin GTPase effector domain
  misc_feature (35)..(213): Pfam Id: MMR_HSR1 Pfam Desc: GTPase of unknown function
  misc_feature (1)..(609): NCBI GI: 115465357 NCBI Desc: os05g0556100 [oryza sativa (japonica cultivar-group)]
  misc_feature (1)..(609): NCBI GI: 90995393 NCBI Desc: phragmoplastin [camellia sinensis]
  misc_feature (1)..(609): NCBI GI: 1218004 NCBI Desc: sdl5a
  misc_feature (1)..(609): NCBI GI: 1217994 NCBI Desc: sdl
  misc_feature (1)..(609): NCBI GI: 5931765 NCBI Desc: phragmoplastin [nicotiana tabacum]
  misc_feature: Down-regulated in root tissues in response to methyl jasmonate treatment
MDNLITLVNKLQRACTALGDHGEESALPTLWDSLPAIAVVGGQSSGKSSVLESVVGKDFLPRGSGIVTRRPLVLQLHRIDGDREYAEFMHLPRKRFTDFAAVRKEIADETDRETGRSKQISTVPIHLSIFSPHVVNLTLIDLPGLTKVAVEGQPESIVQDIENMVRSYIEKPNCIILAVSPANQDLATSDAIKISREVDPKGERTFGVLTKIDLMDKGTDAVDILEGRAYRLQTPWVGVVNRSQQDINKNVDMIAARRREREYFATTPEYKHMASRMGSEYLGKMLSKHLEQVIKSRIPGLQSLITKTIAELETELNRLGKPIANDAGGKLYTIMEICRMFDSIYKEHLDGVRPGGEKVYHVFDNQFPVAIKRLQFDKQLSMENVRKLITEADGYQPHLIAPEQGYRRLIESCLISIRGPAEAAVDAVHAILKDLVRKAINETHELKQFPTLRVEVGNAAFESLDRMRDESKKNTLKLVDMECSYLTVDFFRKLPQDVEKGGNPSHSIFDRYNDSYLRRIGQTVLSYVNMVCSTLRNSIPKSIVYCQVREAKRSLLDHFFTELGAREMKQLSKLLDEDPAVMERRTNLAKRLELYRSAQSEIDAVAWSK

SEQ ID NO: 4937 - DNA, 1818 bp, Sorghum bicolor
  misc_feature: Ceres ANNOT ID no. 6040674
  misc_feature: Encodes the peptide sequence at SEQ ID NO 4938
atgacgacgacgcgaggctccaggggggcgcgcatgaccgcgcaggacgcggcggaggcggccgtgggcgcggtcgggtgcggctacgacgtcacaggggacctccgcctgggccgcgcaaagcccggtggccggctggtggacctcgacgccgccgggaccgggacatccccgcgggacctggcgttcccgggcggcgccgtcgtggcgggcgtgccggccggtgtcgtcgccgacaagggcgagcgcgcgcggttccgctccgacgtgctccccttcgcgcagatggcggagcaggtgaaccggtcgctgtcgctggcgggcagcaagatcccctcgggcgccttcaacgccatgttcgactaccgcgggtgctggcaccgcgacgccgccgccacgcgcagcctctgcttcgacgcccgcctcgtcgagctctacagcgtcgaggccgtgcgcgcgcacctcgccctcagggaggacgtcaagcgggacctgccggcctcctgggatccccccgcgctcgccgagttcatcgacaagtacgggacccacgtcatcgtcggggtgaagatgggagggaaggacgtggtgtgcgtgaagcagctcaagggctctgacctcacgcagagcgacgtgcaggcccggctcaagaagctcgccgacgacaggctctcgtcctcgtcacaggaggattccacgggtaaatttggccccggatcagccgcctggcagtccttcagatcacccgttgtgtctcaaaaggatgacatggtgtgcattcacatcaggaggggcggcgtcgacagcgggcagtgccacagcaagtggctctccaccatcaccggcttcccggacgtgatctccatgtcgttcgtgcccataacgagcctgctcaccggcgtccggggcagcggcttcctcaaccacgccgtgaacctctacctcagatacaagccgcccatagaagagctccagcagtttctcgagttccaggtgcctcgactctgggctccagagttcggtgagctcccgctgtgtctccagcggaggaagaacagcctgccgtctctccagttcaccctcatgggccctaaacttcacgtcaacactgccaaggtcgattccagcaaccgcccggtgaccggcatccggctgttcctggaaggcaagaagaacgaccggctgggcgtccacctgcagcacctctcggcgacgcccggcgcggtcacggtgctcggcgaggccgcgtcggcggaggacgcggcggtgaacgagcgcgactacatcgagcccgtccggtcgccgctgctctcgcacatctgcacggcgcccgtgcagtacaacggcgcgcggatcgacgactgcgccgccatcgtcaccagcgcgtggctcgaggtgcgggacgcctgctgcctcaagaaggtgctcttcctgcgcctcggcttctccggcgtcgccgccatgaagatccgccgctccgagtgggacgggcctttcgtcgtgccgcggaagtccgggtcgctgtcggcgcggctcagcgccgcgctgtccggtggcctggcgccggtgccggtgccgcaggcggaggagaaggtggaggtgaactccgccattttccccaagggaccgccggtgccgctcccggttcagaagatggccaggcacattgacaccaccgaggtgagcaggggccccgacgacctgccgggctactgggtggtcaccggcgctaagctgtgcatggagggcggcaaggttgcgctcaaggtcaagtactcgttgctcatcgcagtgcaagaggacactgacggacactga

SEQ ID NO: 4938 - protein, 605 aa, Sorghum bicolor
  misc_feature: Ceres ANNOT ID no. 6040674
  misc_feature (133)..(316): Pfam Id: MACPF Pfam Desc: MAC/Perforin domain
  misc_feature (14)..(603): NCBI GI: 92870237 NCBI Desc: membrane attack complex component/perforin/complement c9 [medicago truncatula]
  misc_feature (17)..(603): NCBI GI: 92875831 NCBI Desc: membrane attack complex component/perforin/complement c9 [medicago truncatula]
  misc_feature (38)..(595): NCBI GI: 92895124 NCBI Desc: membrane attack complex component/perforin/complement c9 [medicago truncatula]
  misc_feature (318)..(595): NCBI GI: 8778214 NCBI Desc: f10b6.18 [arabidopsis thaliana]
  misc_feature (11)..(600): NCBI GI: 92875832 NCBI Desc: membrane attack complex component/perforin/complement c9 [medicago truncatula]
MTTTRGSRGARMTAQDAAEAAVGAVGCGYDVTGDLRLGRAKPGGRLVDLDAAGTGTSPRDLAFPGGAVVAGVPAGVVADKGERARFRSDVLPFAQMAEQVNRSLSLAGSKIPSGAFNAMFDYRGCWHRDAAATRSLCFDARLVELYSVEAVRAHLALREDVKRDLPASWDPPALAEFIDKYGTHVIVGVKMGGKDVVCVKQLKGSDLTQSDVQARLKKLADDRLSSSSQEDSTGKFGPGSAAWQSFRSPVVSQKDDMVCIHIRRGGVDSGQCHSKWLSTITGFPDVISMSFVPITSLLTGVRGSGFLNHAVNLYLRYKPPIEELQQFLEFQVPRLWAPEFGELPLCLQRRKNSLPSLQFTLMGPKLHVNTAKVDSSNRPVTGIRLFLEGKKNDRLGVHLQHLSATPGAVTVLGEAASAEDAAVNERDYIEPVRSPLLSHICTAPVQYNGARIDDCAAIVTSAWLEVRDACCLKKVLFLRLGFSGVAAMKIRRSEWDGPFVVPRKSGSLSARLSAALSGGLAPVPVPQAEEKVEVNSAIFPKGPPVPLPVQKMARHIDTTEVSRGPDDLPGYWVVTGAKLCMEGGKVALKVKYSLLIAVQEDTDGH

SEQ ID NO: 4939 - DNA, 1524 bp, Sorghum bicolor
  misc_feature: Ceres ANNOT ID no. 6040677
  misc_feature: Encodes the peptide sequence at SEQ ID NO 4940
atgaagacccgcgcctccaagagttacctctgcgcgggcagttcttcgttcgatgaccccgacgtggtcgaggtgtctccggccgcggctgcgggatggacccctagccaccacaagaggaagcggagccaggttgtacctcaagaagtaattgaaattgatgatgatgatcctgatggagtcataattattgctgataaagcaccagtggacaagaataagcaaactgctgtatgcccttgccctatgaattggccaaagtatggcaagagtggttggtttccggacatacctggcccaagcacatatgcttcaaaacatactgattcctgggttgatcacaaagtgtttcaagatgaggcagtttacaactattctgatgagtacccctatgagggatttgaagaagactatgcttatgatgaagatgagtttgaggatgatggttatgatgctccacttattgaaagtgaatttaaatttggtttgtctgccaagtttgataaccttgatgttccacctggtctggaggcttctttatcatggacgcagaagactgctattgagattgcaaataagaccaaacccactaaggctgtagatgataaaatcgaagaaaaatacaaggccttcaaacgatttgatactgttgatgatcacagtgatcattattattcaaagccagaaaagagaagggttcaggtggtaaaaaagccatcaaaagactgggtgaaacgtattcagcatgagtggaaagttctagagaaagatttgccagatactatatttgtgagggcatatgaggatagaatggacctgcttagagctgtcattatgggaccagctggtactccttaccatgacggtctcttcttctttgacatttacttccctcctcagtatccaaatgtaccgccgatggtgaattaccgtgctggtggtttgcggcttaatccaaacttgtatgcttgtgggaaggtgtgccttagcctcctaaacacctggactggcagtggatgtgagaagtggaatccagccaattcaactatgctgcaggtcctggtctctattcaagctttggttttgaatgcaaaaccttatttcaatgagcctggctatgctatgcatgctaacacagttcatggggagaagaaatccctgacatataatgaagatacgttcctgctatcctgcaggacgatgttgtactctcttcgaaatccaccaaagaattttgaggattttgttgctggccatttccgcaagtatgggcgcaacatccttgtagcttgcagagcctacctggatggtgcccaggttggatgcctttctggtgatggagtgcaggacgttgatgaaggtgacaagagctgctcggtgaggttcaagcagtcactgaagagacttaatgaggaacttctgatggagttcactgcgaagggtgcggactgcgacaagttcctcaccgagaaggcaagatctggagcttccacatccgcagcggataccacactgaggctgtaa

SEQ ID NO: 4940 - protein, 507 aa, Sorghum bicolor
  misc_feature: Ceres ANNOT ID no. 6040677
  misc_feature (246)..(395): Pfam Id: UQ_con Pfam Desc: Ubiquitin-conjugating enzyme
  misc_feature (1)..(507): NCBI GI: 55783585 NCBI Desc: ubiquitin-conjugating enzyme e2 [zea mays]
  misc_feature (160)..(507): NCBI GI: 50726452 NCBI Desc: ubiquitin-conjugating enzyme-like protein [oryza sativa (japonica cultivar-group)]
  misc_feature (202)..(494): NCBI GI: 92881363 NCBI Desc: ubiquitin-conjugating enzyme, e2 [medicago truncatula]
  misc_feature (132)..(455): NCBI GI: 115462765 NCBI Desc: os05g0232500 [oryza sativa (japonica cultivar-group)]
  misc_feature (132)..(459): NCBI GI: 56783934 NCBI Desc: ubiquitin-conjugating enzyme -like [oryza sativa (japonica cultivar-group)]
MKTRASKSYLCAGSSSFDDPDVVEVSPAAAAGWTPSHHKRKRSQVVPQEVIEIDDDDPDGVIIIADKAPVDKNKQTAVCPCPMNWPKYGKSGWFPDIPGPSTYASKHTDSWVDHKVFQDEAVYNYSDEYPYEGFEEDYAYDEDEFEDDGYDAPLIESEFKFGLSAKFDNLDVPPGLEASLSWTQKTAIEIANKTKPTKAVDDKIEEKYKAFKRFDTVDDHSDHYYSKPEKRRVQVVKKPSKDWVKRIQHEWKVLEKDLPDTIFVRAYEDRMDLLRAVIMGPAGTPYHDGLFFFDIYFPPQYPNVPPMVNYRAGGLRLNPNLYACGKVCLSLLNTWTGSGCEKWNPANSTMLQVLVSIQALVLNAKPYFNEPGYAMHANTVHGEKKSLTYNEDTFLLSCRTMLYSLRNPPKNFEDFVAGHFRKYGRNILVACRAYLDGAQVGCLSGDGVQDVDEGDKSCSVRFKQSLKRLNEELLMEFTAKGADCDKFLTEKARSGASTSAADTTLRL

SEQ ID NO: 4941 - DNA, 249 bp, Sorghum bicolor
  misc_feature: Ceres ANNOT ID no. 6040686
  misc_feature: Encodes the peptide sequence at SEQ ID NO 4942
atggaactgggtgataaggtagtcggttttctactgactctgacaagcttatccatatttacatactatacattctgggtcatcattttgccattcgttgacagcgaccactttgtgcacaagtacttcctgcctcaagagtatgcaattttgataccagtgcttgccggcgtagttctcctttcgttcttgagcgtctttgtgggtcttgtgatgctcaagtcaaagaagaagaagaagaccacttga

SEQ ID NO: 4942 - protein, 82 aa, Sorghum bicolor
  misc_feature: Ceres ANNOT ID no. 6040686
  misc_feature (1)..(80): Pfam Id: DPM2 Pfam Desc: Dolichol phosphate-mannose biosynthesis regulatory protein(DPM2)
  misc_feature (5)..(80): NCBI GI: 5031504 NCBI Desc: dpm2 protein [cricetulus griseus]
  misc_feature (5)..(80): NCBI GI: 119608135 NCBI Desc: hcg18554, isoform cra_a [homo sapiens]
  misc_feature (5)..(80): NCBI GI: 9506551 NCBI Desc: dolichol-phosphate mannosyltransferase 2 [rattus norvegicus]
  misc_feature (5)..(80): NCBI GI: 4503365 NCBI Desc: dolichyl-phosphate mannosyltransferase polypeptide 2, regulatory subunit isoform 1 [homo sapiens]
  misc_feature (5)..(80): NCBI GI: 60832160 NCBI Desc: dolichyl-phosphate mannosyltransferase polypeptide 2 regulatory subunit [synthetic construct]
MELGDKVVGFLLTLTSLSIFTYYTFWVIILPFVDSDHFVHKYFLPQEYAILIPVLAGVVLLSFLSVFVGLVMLKSKKKKKTT

SEQ ID NO: 4943 - DNA, 687 bp, Sorghum bicolor
  misc_feature: Ceres ANNOT ID no. 6040687
  misc_feature: Encodes the peptide sequence at SEQ ID NO 4944
atggagtacgtgaaccccctcaccggcttccgcgtcgacggccgccgccccaacgaggtgatgtcggcgctgttcgagatgggcaacaccagagtcatcgctgctgtctacggcccccgagaggttcagaacaaaggtcagcaagtaaacagcaacgaggctttggttcgttgtgagtataggatggcagaatttagtacaggagatcggaggagaaaaccaaagggtgacaggcgatcaacagaaatttctcttgttattcgacagacaatggaggcaagcatattaacacatttaatgccacactcacagattgatatatatgtccaagttcttcaagctgatggtggaacaaggtcagcttgcatcaatgcggcaacactagctcttgcagatgctgggattccaatgcgagacattgtcacatcttgtagtgctggctatctgtgttctactcctttgctcgatctgaattacctcgaagacagtgctgggggttccgatgtcaccgttggcattcttgcaaagatggacaaagtgactttgcttcagatggacgcaaaattaccgatggatacatttgaaaatgtaatgggacttgcaatagaaggatgcaaagcaattgcatcttacatccgagaggtgctattggagaatacaaagaaacttgagtgtcagcgtggttaa

SEQ ID NO: 4944 - protein, 228 aa, Sorghum bicolor
  misc_feature: Ceres ANNOT ID no. 6040687
  misc_feature (9)..(136): Pfam Id: RNase_PH Pfam Desc: 3' exoribonuclease family, domain 1
  misc_feature (139)..(204): Pfam Id: RNase_PH_C Pfam Desc: 3' exoribonuclease family, domain 2
  misc_feature (9)..(222): NCBI GI: 122920908 NCBI Desc: chain b, structure of the human rna exosome composed of rrp41, rrp45, rrp46, rrp43, mtr3, rrp42, csl4, rrp4, and rrp40
  misc_feature (9)..(223): NCBI GI: 116117011 NCBI Desc: ensangp00000009222 [anopheles gambiae str. pest]
  misc_feature (22)..(223): NCBI GI: 73919276 NCBI Desc: probable exosome complex exonuclease 1
  misc_feature (22)..(222): NCBI GI: 52549121 NCBI Desc: ribonuclease ph [uncultured archaeon gzfos24d9]
  misc_feature (22)..(223): NCBI GI: 29336822 NCBI Desc: probable exosome complex exonuclease 1
MEYVNPLTGFRVDGRRPNEVMSALFEMGNTRVIAAVYGPREVQNKGQQVNSNEALVRCEYRMAEFSTGDRRRKPKGDRRSTEISLVIRQTMEASILTHLMPHSQIDIYVQVLQADGGTRSACINAATLALADAGIPMRDIVTSCSAGYLCSTPLLDLNYLEDSAGGSDVTVGILAKMDKVTLLQMDAKLPMDTFENVMGLAIEGCKAIASYIREVLLENTKKLECQRG

SEQ ID NO: 4945 - DNA, 840 bp, Sorghum bicolor
  misc_feature: Ceres ANNOT ID no. 6040692
  misc_feature: Encodes the peptide sequence at SEQ ID NO 4946
atgccgccgccgctcgaggcgcgcgacttcctcggcgccggcgccacctcgtcgtgctgctcgtcgtcctgctcctccggcggcgatgggacggtgccgcacctcgcgctgcggctcgggctcccggggtccgactcccccggccgaggcgcgcaggcggagcacgcccacgtggacgccgcgctcaccctcggccccgcccccgcccccgcgccgcccaggggaggcgccaagcgcgggttcgccgactccctcgaccggtccgcgaagcgggacggtgctgcggcggatgacgacgctgctgggggcgtaactggggaggataagggggtagctgcggccgctgccggagctccgccggctgccaaggcacaagttgttggatggccacctgttaggagctaccgaaagaatacactagctgcaagtgccacaaagacaaaggtggaagatgaaggtaggagtgaggcgggatgctgttatgttaaggtcagcatggatggagccccatacctaaggaaggtagacctcaagacctattcaagctatgagaatctctcgcttggtctggagaaaatgttcagctgcttcatcactggtcaaaacagttcttgcaagacatcaagaagggataggtttactgatggttctagggctgatgcccttcaggaccaagaatatgtccttacttacgaagataaagatgctgactggatgcttgttggtgatctgccctgggacttgttcaccacaatttgtcggaaactaagaatcatgagaggctctgatgctgctggcatggctccaagatcactggaacagatagctcggaacaaataa

SEQ ID NO: 4946 - protein, 279 aa, Sorghum bicolor
  misc_feature: Ceres ANNOT ID no. 6040692
  misc_feature (37)..(271): Pfam Id: AUX_IAA Pfam Desc: AUX/IAA family
  misc_feature (1)..(279): NCBI GI: 75254487 NCBI Desc: auxin-responsive protein iaa19 (indoleacetic acid-induced protein 19)
  misc_feature (1)..(279): NCBI GI: 88911340 NCBI Desc: auxin-responsive protein iaa5 (indoleacetic acid-induced protein 5)
  misc_feature (1)..(279): NCBI GI: 75252766 NCBI Desc: auxin-responsive protein iaa21 (indoleacetic acid-induced protein 21)
  misc_feature (76)..(278): NCBI GI: 25989504 NCBI Desc: aux/iaa protein [solanum tuberosum]
  misc_feature (114)..(278): NCBI GI: 81074526 NCBI Desc: aux/iaa protein-like [solanum tuberosum]
  misc_feature: The sequence is a functional homolog of SEQ ID NO 1149 in the 10/412,699US patent application
  misc_feature: The sequence is a functional homolog of SEQ ID NO 682 in the 11/479,226US patent application
  misc_feature: The sequence is a functional homolog of SEQ ID NO 736 in the 10/374,780US patent application
  misc_feature: The sequence is a functional homolog of SEQ ID NO 737 in the 10/374,780US patent application
  misc_feature: The sequence is a functional homolog of SEQ ID NO 738 in the 10/374,780US patent application
  misc_feature: The sequence is a functional homolog of SEQ ID NO 739 in the 10/374,780US patent application
  misc_feature: The sequence is a functional homolog of SEQ ID NO 742 in the 10/374,780US patent application
  misc_feature: Useful for making plants with modulated growth and phenotype characteristics
  misc_feature: The sequence is a functional homolog of SEQ ID NO 1149 in the 20040045049 US patent application
  misc_feature: The sequence is a functional homolog of SEQ ID NO 736 in the 20060162006 US patent application
  misc_feature: The sequence is a functional homolog of SEQ ID NO 737 in the 20060162006 US patent application
  misc_feature: The sequence is a functional homolog of SEQ ID NO 738 in the 20060162006 US patent application
  misc_feature: The sequence is a functional homolog of SEQ ID NO 739 in the 20060162006 US patent application
  misc_feature: The sequence is a functional homolog of SEQ ID NO 682 in the 20070022495 US patent application
  misc_feature: The sequence is a functional homolog of SEQ ID NO 890 in the 10/412,699 US patent application
  misc_feature: The sequence is a functional homolog of SEQ ID NO 2002 in the 10/374,780 US patent application
  misc_feature: The sequence is a functional homolog of SEQ ID NO 644 in the 11/479,226 US patent application
  misc_feature: Useful for making plants with altered terpenoid content
  misc_feature: Functional homolog of the protein sequence given in SEQ ID NO 13610
  misc_feature: Useful for making plants with altered alkaloid content
  misc_feature: Functional homolog of the protein sequence given in SEQ ID NO 13611
  misc_feature: The sequence is a functional homolog of SEQ ID NO 652 in the 11/479,226 US patent application
MPPPLEARDFLGAGATSSCCSSSCSSGGDGTVPHLALRLGLPGSDSPGRGAQAEHAHVDAALTLGPAPAPAPPRGGAKRGFADSLDRSAKRDGAAADDDAAGGVTGEDKGVAAAAAGAPPAAKAQVVGWPPVRSYRKNTLAASATKTKVEDEGRSEAGCCYVKVSMDGAPYLRKVDLKTYSSYENLSLGLEKMFSCFITGQNSSCKTSRRDRFTDGSRADALQDQEYVLTYEDKDADWMLVGDLPWDLFTTICRKLRIMRGSDAAGMAPRSLEQIARNK

SEQ ID NO: 4947 - DNA, 1356 bp, Sorghum bicolor
  misc_feature: Ceres ANNOT ID no. 6040694
  misc_feature: Encodes the peptide sequence at SEQ ID NO 4948
atggtgtccagtcgaaggaacagcggggttatcctacgggaagggtcggttagggactggtctgagttcaacgatccctcgccgtctccaaaactgctgtattcgcaatcctatgtcgcaatgagggggttgctggcctcgttgatctccttggattttttcctgctgtcaagcaagctaaaatctgcttgtgcggctatgacttcccagaggcatagtcgatcacaggagagatcaaaatcaaaggggttgagctgcaggagagttgcagtccatctgttgttctttttcatggttggcattttcattgggttcatgcctttgttctctgttgatgtttacaagaaaatagtatctgaaaacgagaggcttccgttccacgagggtgtgattgaaacggaaacgatgggtactaaagttaaggagttggagacagttgtagtagagaaagaggtcgaactgattgacgagcctcaggttcaagagagccctccagttcctgcaatgttggatgatgaggcagattttgctgaatcgtcacctgctttacctggtattgaagaatctgacattgtcgcgaagaagctgctgataatcgtgacaatcacttctgttcggccacagcaggcatattatttgaatcggctagcccatgttttgaaagctgtacatgcacctcttctatggttagtggtggaatggcctgaacagtcctatgaaacagcagaaattctgaggtcttctggggttatgtacaggcatcttgtatgtagaaagaataccacgagtgtacggaagattgctgtctgtcaaaggaataatgcaatctatcatatcaaaaggcatcaccttgatggtataatgcattttgctgacgaagagcggtcatactcagctgatgtatttgaagaaatgcagaagatcaggcgctttggctcatggcctgtagcaatccatgttggaacaaagtatagggcagttttggaaggtcctatttgcaaaggtaaccgagtcatgggatggcacacagtccagacggctcaaaagaagagtttgactcgtcgattcccaattggtttctctgcatttgctttcaacagtacaatgttatgggaccctcaaagatggaaccgcccaccaatggattctgttatagtccactcaggtggaagaggtggtttgcaggagtcacgatttatagaaaagcttgttaaaaatgagcgccaaatagagggtcttccagacaattgcaatagggctatggtctggaatttcaacctggaacctcctctactgaactaccccagaggctgggcaatttataagaacctggaagctgacatgcctgtaatatag

SEQ ID NO: 4948 - protein, 451 aa, Sorghum bicolor
  misc_feature: Ceres ANNOT ID no. 6040694
  misc_feature (216)..(429): Pfam Id: Glyco_transf_43 Pfam Desc: Glycosyltransferase family 43
  misc_feature (1)..(435): NCBI GI: 66347206 NCBI Desc: glycosyltransferase [saccharum officinarum]
  misc_feature (1)..(450): NCBI GI: 63087728 NCBI Desc: glycosyltransferase [saccharum officinarum]
  misc_feature (126)..(450): NCBI GI: 32879545 NCBI Desc: beta3-glucuronyltransferase [zea mays]
  misc_feature (74)..(447): NCBI GI: 31979311 NCBI Desc: 3-beta-glucuronosyltransferase [hordeum vulgare]
  misc_feature (91)..(445): NCBI GI: 32968189 NCBI Desc: beta3-glucuronyltransferase [triticum aestivum]
  misc_feature: Useful for making plants with altered carbohydrate content
  misc_feature: Functional homolog of the protein sequence given in SEQ ID NO 13890
MVSSRRNSGVILREGSVRDWSEFNDPSPSPKLLYSQSYVAMRGLLASLISLDFFLLSSKLKSACAAMTSQRHSRSQERSKSKGLSCRRVAVHLLFFFMVGIFIGFMPLFSVDVYKKIVSENERLPFHEGVIETETMGTKVKELETVVVEKEVELIDEPQVQESPPVPAMLDDEADFAESSPALPGIEESDIVAKKLLIIVTITSVRPQQAYYLNRLAHVLKAVHAPLLWLVVEWPEQSYETAEILRSSGVMYRHLVCRKNTTSVRKIAVCQRNNAIYHIKRHHLDGIMHFADEERSYSADVFEEMQKIRRFGSWPVAIHVGTKYRAVLEGPICKGNRVMGWHTVQTAQKKSLTRRFPIGFSAFAFNSTMLWDPQRWNRPPMDSVIVHSGGRGGLQESRFIEKLVKNERQIEGLPDNCNRAMVWNFNLEPPLLNYPRGWAIYKNLEADMPVI

SEQ ID NO: 4949 - DNA, 960 bp, Sorghum bicolor
  misc_feature: Ceres ANNOT ID no. 6040695
  misc_feature: Encodes the peptide sequence at SEQ ID NO 4950
atggcgatcaagcggaccaaggcggagaagaagatcgcgtacgataagaagctgtgcgccctgctggatgagtacaccaaggtgctcgtcgccctcgccgacaatgtcggatccaagcagctccaggacatccgccggggcctcaggggcgactccatcgtgctcatggggaagaacacgctcatcaggcgatgcatcaaggtctacgccgagaagacggggaacaatgccttcgacccgctcatggacctcctcgtcggcaacgtcggcctcatcttcaccaagggcgacctcaaggaggtgcgcgaggaggtcgccaagtacaaggttggggctcctgctcgtgttgggcttgtagctcctgttgatgtcgttgtttcccctggcaacactgggctggatccctctcagacctctttcttccaggtgcttaacatccccaccaagattaacaagggtactgtggaaatcatcacccccgtggagctgatcaagaagggtgacaaggtgggctcatccgagtctgccctgctcgccaagttgggtatccgccccttctcatacggtcttcagatcgtcaatgtctatgaggatgggtcagtcttcagccccgaggtgcttgacctgactgaggaggacctggttgagaagttctccgctggtgtctccatggttgcctctctgtccctggtggtctcgtacccgacccttgctgctgcgcctcacatgttcatcaacgggtacaagaatgtgcttgctgttgctgtggagacagactactcgtacccgcacgctgacgagatcaaggagtacctgaaggatccaagcaagttcgctgttgctgccccggttgctgctgctgactctggtgcttcagctgctcccaaggaagaagagaaggcgcctgagtccgacgaggagtcggatggggaaatgggcttcagcctttttgacgactag

SEQ ID NO: 4950 - protein, 319 aa, Sorghum bicolor
  misc_feature: Ceres ANNOT ID no. 6040695
  misc_feature (6)..(110): Pfam Id: Ribosomal_L10 Pfam Desc: Ribosomal protein L10
  misc_feature (234)..(317): Pfam Id: Ribosomal_60s Pfam Desc: 60s Acidic ribosomal protein
  misc_feature (1)..(319): NCBI GI: 1550814 NCBI Desc: 60s acidic ribosomal protein p0 [zea mays]
  misc_feature (1)..(318): NCBI GI: 29467534 NCBI Desc: 60s acidic ribosomal protein p0 [oryza sativa (japonica cultivar-group)]
  misc_feature (1)..(318): NCBI GI: 730580 NCBI Desc: 60s acidic ribosomal protein p0
  misc_feature (1)..(318): NCBI GI: 1196897 NCBI Desc: acidic ribosomal protein p0 [glycine max]
  misc_feature (1)..(318): NCBI GI: 82623393 NCBI Desc: p0 ribosomal protein-like [solanum tuberosum]
  misc_feature (3)..(318): SWISSPROT Homolog: EC 4.2.99.18 60S acidic ribosomal protein P0 (DNA-(apurinic or apyrimidinic site)lyase)
MAIKRTKAEKKIAYDKKLCALLDEYTKVLVALADNVGSKQLQDIRRGLRGDSIVLMGKNTLIRRCIKVYAEKTGNNAFDPLMDLLVGNVGLIFTKGDLKEVREEVAKYKVGAPARVGLVAPVDVVVSPGNTGLDPSQTSFFQVLNIPTKINKGTVEIITPVELIKKGDKVGSSESALLAKLGIRPFSYGLQIVNVYEDGSVFSPEVLDLTEEDLVEKFSAGVSMVASLSLVVSYPTLAAAPHMFINGYKNVLAVAVETDYSYPHADEIKEYLKDPSKFAVAAPVAAADSGASAAPKEEEKAPESDEESDGEMGFSLFDD

SEQ ID NO: 4951 - DNA, 1056 bp, Sorghum bicolor
  misc_feature: Ceres ANNOT ID no. 6040706
  misc_feature: Encodes the peptide sequence at SEQ ID NO 4952
atggcggctccgcttgtgccccgggaagaggggttgaggcaggaaggtgcggtggagcaggaggaagaggacaggtgggcgtgcctgctgccggagctgctcgccgaggtgctgcggcgcctggaggcgtccggcggggagcggtggccggcgcggaaggacgtggtgtcgtgcgcctgcgtctgcaggcggtggcgcgacgtcgccgccacggtcgtccgcccgctgcctgagtccgggaagatcaccttcctggcctcgctgaagcagccagggccaaaagattttccaatccaatgcttcatcaaacgaaacaagaagaattctttgttttatctctaccttggattgacaaacaatccgatgatgcctgccacagacaaaggaaagtttctcatggctgctaaaaggtttaggcggggtgctcccacagagtatattatttcccttgatgctgatgatatttcacaaggaaacaaggcatatgtgggaaaattgaggtctgattttttgggaacaaacttcaaaatatatgacagccagcccccctacgatggtgcaaaggcgtcaagcactcgatctattcggcgttttggaagcaggcgaatcagcccccaagtatcgtcaggcaactttgatgtcggacaggtttcttacaaatacaacctgctcaaatccagagggcctaggaggatgctttgcaccatggagtgcccctctgttcaagagacctgggagaactccctcaaggtgatgtctttcaggcaaacaggtagcactatccttagaaacaacgccccaaggtggcatgagcacttgcagtgctggtgcttgaacttccatggacgggtgacagttgcatctgtcaagaatttccagctggtggctacaaccgacacaagccatcctgatagcgtcgatgatgcggaaattgttctgcagttcggtaaggttggtgacgacatcttcaccatggattatcgccagccactctcggcatttcaggcgttcgccatctgccttagcagctttgggacaaagctagcttgtgagtga

SEQ ID NO: 4952 - protein, 351 aa, Sorghum bicolor
  misc_feature: Ceres ANNOT ID no. 6040706
  misc_feature (91)..(345): Pfam Id: Tub Pfam Desc: Tub family
  misc_feature (24)..(80): Pfam Id: F-box Pfam Desc: F-box domain
  misc_feature (14)..(351): NCBI GI: 56202013 NCBI Desc: chain a, c-terminal domain of mouse brain tubby protein-like [oryza sativa (japonica cultivar-group)]
  misc_feature (13)..(351): NCBI GI: 87241115 NCBI Desc: tubby; di-trans-poly-cis-decaprenylcistransferase; cyclin-like f-box [medicago truncatula]
  misc_feature (156)..(351): NCBI GI: 7769867 NCBI Desc: f12m16.22 [arabidopsis thaliana]
  misc_feature (19)..(351): NCBI GI: 87241116 NCBI Desc: tubby; cyclin-like f-box [medicago truncatula]
  misc_feature (22)..(236): NCBI GI: 90399022 NCBI Desc: h0701f11.8 [oryza sativa (indica cultivar-group)]
MAAPLVPREEGLRQEGAVEQEEEDRWACLLPELLAEVLRRLEASGGERWPARKDVVSCACVCRRWRDVAATVVRPLPESGKITFLASLKQPGPKDFPIQCFIKRNKKNSLFYLYLGLTNNPMMPATDKGKFLMAAKRFRRGAPTEYIISLDADDISQGNKAYVGKLRSDFLGTNFKIYDSQPPYDGAKASSTRSIRRFGSRRISPQVSSGNFDVGQVSYKYNLLKSRGPRRMLCTMECPSVQETWENSLKVMSFRQTGSTILRNNAPRWHEHLQCWCLNFHGRVTVASVKNFQLVATTDTSHPDSVDDAEIVLQFGKVGDDIFTMDYRQPLSAFQAFAICLSSFGTKLACE

SEQ ID NO: 4953 - DNA, 891 bp, Sorghum bicolor
  misc_feature: Ceres ANNOT ID no. 6040715
  misc_feature: Encodes the peptide sequence at SEQ ID NO 4954
atgccgatctgctcgccgtcgtccgactcctcctcgtcgtcgggctcgggttcccgcgcgtgggtactccacgggctagtgctcggcgcggcggccgcggccgctgccgcggcgtacctgtaccggcgaccgagcgggttccgcagccgcgccgtggggatcatacccgcgcgcttcgcctccacgcgcttcgagggcaagccgctcgttcacatcctcggcaagcccatgatacagagaacatgggaaagagtgatgctagcttcttctttggaccatgttgttgtggcaacggatgatgagagaattgcagaatgctgtcgaggatttggagctgatgttataatgacatcagaatcttgcaaaaatggatctgaacgctgttgtgaggcactaaagaagcttgaaaaacgttatgacattgtcgtcaatattcaaggagatgagcctcttattgaaccggagataatagatggtgtagttatggcactgcagcgagctcctgatgcagtcttcagcactgctgttacttcactgaagccagaagatgcattcgatacaaatagagtgaagtgtgtcgtggataatcagggctacgctatatacttttcaagagggctgattccattcaataaatcagggaacgtcaatccaaaatacctgtatcttcttcatcttggaatctcgggttttgattcaaagtttttgaagatctatccagaacttccaccaacaccgttacaaatggaagaggacctagagcaactgaaagtacttgaaaacagctataggatgaaggtgatcaaagtggaccacgatgcccatggtgtagatgctcctgaggatgttgagaaaatcgaagcactgatgcgagcgagaaacattcagtag

SEQ ID NO: 4954 - protein, 296 aa, Sorghum bicolor
  misc_feature: Ceres ANNOT ID no. 6040715
  misc_feature (52)..(267): Pfam Id: CTP_transf_3 Pfam Desc: Cytidylyltransferase
  misc_feature (1)..(296): NCBI GI: 7688435 NCBI Desc: cmp-kdo synthetase [zea mays]
  misc_feature (55)..(290): NCBI GI: 7688437 NCBI Desc: cmp-kdo synthetase [zea mays]
  misc_feature (52)..(294): NCBI GI: 46446459 NCBI Desc: probable 3-deoxy-manno-octulosonate cytidylyltransferase (cmp-kdo synthetase) [parachlamydia sp. uwe25]
  misc_feature (49)..(287): NCBI GI: 14194887 NCBI Desc: 3-deoxy-manno-octulosonate cytidylyltransferase (cmp-kdo synthetase) (cmp-2-keto-3-deoxyoctulosonic acid synthetase) (cks)
  misc_feature (49)..(287): NCBI GI: 15835072 NCBI Desc: 3-deoxy-manno-octulosonate cytidylyltransferase [chlamydia muridarum]
MPICSPSSDSSSSSGSGSRAWVLHGLVLGAAAAAAAAAYLYRRPSGFRSRAVGIIPARFASTRFEGKPLVHILGKPMIQRTWERVMLASSLDHVVVATDDERIAECCRGFGADVIMTSESCKNGSERCCEALKKLEKRYDIVVNIQGDEPLIEPEIIDGVVMALQRAPDAVFSTAVTSLKPEDAFDTNRVKCVVDNQGYAIYFSRGLIPFNKSGNVNPKYLYLLHLGISGFDSKFLKIYPELPPTPLQMEEDLEQLKVLENSYRMKVIKVDHDAHGVDAPEDVEKIEALMRARNIQ

SEQ ID NO: 4955 - DNA, 720 bp, Sorghum bicolor
  misc_feature: Ceres ANNOT ID no. 6040721
  misc_feature: Encodes the peptide sequence at SEQ ID NO 4956
atggcgtcggcggcggggacgacgacacagaggcgcgtcggcgacgacgtggagtctcagcgggagcagggcgacgatggtagtagccgccgcgagcaagagcaagagcagcgacggcctctgctggacgaagaacggcggcgctccttggccgcggacgacggcggcgggatgagcccggtccagcgtgccatcagccagacgtaccagagcacggcgcacctagcgaagctgctgccgacgggcacggtgctggcgttccagctgctgtccccggtggtgacggcggagggccactgcgcgcgcgccaaccgcgccatggccgccgcgctcctggcgctctgcgcgctctcctgcttcgtgctcagcttcaccgacagcttccgtgacgccgccacgggcgccgtccgctacggcttcgccacctcgcgggggttatgggtcatcgacggcggcgcgccgctggacgacccgcgcgccgcggcggcgtaccggatccggttcctcgacctagtgcacgccgtggtgtccgtcatgatcttcgccgccgtcgcgctgctcgaccagaacgtcgtcacctgcttctaccccgtgccgtcggaggacgccaggcaggtgctcaccgtgctacccatcgccatcggcgtcgtcgggagcatgctgttcgtcaccttccccaccacccgccacggcatcgggttcccgctatctcagcactga

SEQ ID NO: 4956 - protein, 239 aa, Sorghum bicolor
  misc_feature: Ceres ANNOT ID no. 6040721
  misc_feature (72)..(235): NCBI GI: 115441457 NCBI Desc: os01g0882400 [oryza sativa (japonica cultivar-group)]
  misc_feature (55)..(233): NCBI GI: 72384432 NCBI Desc: 52o08_3 [brassica rapa subsp. pekinensis]
  misc_feature (55)..(234): NCBI GI: 15528693 NCBI Desc: p0560b06.26 [oryza sativa (japonica cultivar-group)]
  misc_feature (55)..(234): NCBI GI: 115436576 NCBI Desc: os01g0368700 [oryza sativa (japonica cultivar-group)]
  misc_feature (178)..(237): NCBI GI: 115465445 NCBI Desc: os05g0562800 [oryza sativa (japonica cultivar-group)]
  misc_feature: The plant flowers significantly late compared to wild-type.
  misc_feature: The plant is abnormally small.
  misc_feature: The plant produces a reduced number of seeds.
  misc_feature: Useful for biocontainment applications
  misc_feature: Useful for making plants with modulated biomass
  misc_feature: Useful for making plants with modulated flowering time
  misc_feature: Functional homolog of the protein sequence given in SEQ ID NO 13254
  misc_feature: Useful for biocontainment applications
  misc_feature: Useful for making plants with modulated biomass
  misc_feature: Useful for making plants with modulated flowering time
  misc_feature: Functional homolog of the protein sequence given in SEQ ID NO 13254
MASAAGTTTQRRVGDDVESQREQGDDGSSRREQEQEQRRPLLDEERRRSLAADDGGGMSPVQRAISQTYQSTAHLAKLLPTGTVLAFQLLSPVVTAEGHCARANRAMAAALLALCALSCFVLSFTDSFRDAATGAVRYGFATSRGLWVIDGGAPLDDPRAAAAYRIRFLDLVHAVVSVMIFAAVALLDQNVVTCFYPVPSEDARQVLTVLPIAIGVVGSMLFVTFPTTRHGIGFPLSQH

SEQ ID NO: 4957 - DNA, 501 bp, Sorghum bicolor
  misc_feature: Ceres ANNOT ID no. 6040730
  misc_feature: Encodes the peptide sequence at SEQ ID NO 4958
atgaggttggagaagtgctggttctgctcctccaccatctaccccggccatggaatccagttcgtccgcaacgacgccaagatcttccgcttttgccggtcaaagtgtcataaaaattttaagatgaagagaaatcctcgtaaggttaagtggacaaaagcatacaggcaattgcatggcaaggacatgacaaaggatgctacctttgagtttgagaggaagaggaacaggcctgagcgctatgaccgcaatttgacggagcaaactctgaaggccatcccacttattacaaagattaggcatgaccgcctggagaagcacatttcaaacagacataaacctggtaaacgcaaggagatggagaaagattctaaggagctggatcaggacatcggcttgcttccgaagaagcttattagcaatgagctcgcagtcgagaaaccaaagatcaaggtcaaagttgttcagcagcagacagaagataatgctatggaagagtag

SEQ ID NO: 4958 - protein, 166 aa, Sorghum bicolor
  misc_feature: Ceres ANNOT ID no. 6040730
  misc_feature (1)..(71): Pfam Id: Ribosomal_L24e Pfam Desc: Ribosomal protein L24e
  misc_feature (1)..(166): NCBI GI: 56201782 NCBI Desc: 60s ribosomal protein l30-like protein [oryza sativa (japonica cultivar-group)]
  misc_feature (1)..(154): NCBI GI: 145343588 NCBI Desc: ribosome biogenesis protein rlp24, probable [ostreococcus lucimarinus cce9901]
  misc_feature (1)..(166): NCBI GI: 16740902 NCBI Desc: ribosomal protein l24-like [homo sapiens]
  misc_feature (1)..(166): NCBI GI: 10047102 NCBI Desc: ribosomal protein l24-like [homo sapiens]
  misc_feature (1)..(157): NCBI GI: 89304138 NCBI Desc: ribosomal protein l24e containing protein [tetrahymena thermophila sb210]
MRLEKCWFCSSTIYPGHGIQFVRNDAKIFRFCRSKCHKNFKMKRNPRKVKWTKAYRQLHGKDMTKDATFEFERKRNRPERYDRNLTEQTLKAIPLITKIRHDRLEKHISNRHKPGKRKEMEKDSKELDQDIGLLPKKLISNELAVEKPKIKVKVVQQQTEDNAMEE

SEQ ID NO: 4959 - DNA, 738 bp, Sorghum bicolor
  misc_feature: Ceres ANNOT ID no. 6040731
  misc_feature: Encodes the peptide sequence at SEQ ID NO 4960
atggcggcgttggcgttggcgttcctagcgctgacggcggtgccggcggtgctgtgccaggcgccggggccggcggcgcccaagggcccgccgaacgtgacggcgatcctggagaaaggcggtcagtacaccaccttcatccggctgatgaagtcgacgcagcaggacacgcagctcaacagccagctgaacaactcgttcgggagcgggtacacggtgttcgcgcccaccgacaacgccttcgccagcctgaagccggggacgctgaacaagctgtcgcagcaggagcaggtgtcgctggtgcagttccacgtcctgccgcagttctactccctcgactccttcgagaccgccagcaaccccgtccgcacgcaggcgtcgggatccgatggcccctacacgctcaacatcaccgccgacagcaacagccaggtgaacgtgtccacgggcgtcgtcgccacccgcctcggcaccgcgctgcgcgccacgcagccgctcgccgtctactccgtcgacaccgtgctgctgcccaacgacctgttcggcgtcaagcccccctcggcggcgccgcccgcacccgccaagaagaagccggccaaggggggatccgtcgccgaggcgccctccgccggcgactcggccgacgcgccgccctccggcgcggccgccgcgcgtgccggatggagctcgctggccgctctgctcctcggtgccgcggcctgctccaccctgttgtga

SEQ ID NO: 4960 - protein, 245 aa, Sorghum bicolor
  misc_feature: Ceres ANNOT ID no. 6040731
  misc_feature (42)..(177): Pfam Id: Fasciclin Pfam Desc: Fasciclin domain
  misc_feature (3)..(245): NCBI GI: 115349910 NCBI Desc: fasciclin-like protein fla13 [triticum aestivum]
  misc_feature (3)..(235): NCBI GI: 56202243 NCBI Desc: arabinogalactan protein-like [oryza sativa (japonica cultivar-group)]
  misc_feature (3)..(237): NCBI GI: 115349908 NCBI Desc: fasciclin-like protein fla12 [triticum aestivum]
  misc_feature (1)..(235): NCBI GI: 115349912 NCBI Desc: fasciclin-like protein fla14 [triticum aestivum]
  misc_feature (8)..(244): NCBI GI: 21553523 NCBI Desc: arabinogalactan protein-like [arabidopsis thaliana]
  misc_feature: Useful for making plants with altered cell wall content and/or composition
  misc_feature: Functional homolog of the protein sequence encoded by LOCUS at1g03870
  misc_feature: Functional homolog of the protein sequence encoded by LOCUS at2g20520
  misc_feature: GREAT-hit functional homolog of the protein sequence encoded by LOCUS at5g44130
  misc_feature: Useful for making plants with altered carbohydrate content
  misc_feature: Functional homolog of the protein sequence given in SEQ ID NO 13891
  misc_feature: Useful for making plants with altered cell wall content and/or composition
  misc_feature: Functional homolog of the protein sequence given in SEQ ID NO 13892
MAALALAFLALTAVPAVLCQAPGPAAPKGPPNVTAILEKGGQYTTFIRLMKSTQQDTQLNSQLNNSFGSGYTVFAPTDNAFASLKPGTLNKLSQQEQVSLVQFHVLPQFYSLDSFETASNPVRTQASGSDGPYTLNITADSNSQVNVSTGVVATRLGTALRATQPLAVYSVDTVLLPNDLFGVKPPSAAPPAPAKKKPAKGGSVAEAPSAGDSADAPPSGAAAARAGWSSLAALLLGAAACSTLL

SEQ ID NO: 4961 - DNA, 1527 bp, Sorghum bicolor
  misc_feature: Ceres ANNOT ID no. 6040739
  misc_feature: Encodes the peptide sequence at SEQ ID NO 4962
atgtcacatagaaatatgctctggacacatcagtccgttaatcctgaatgggagcaaggacatgtccaagttcaaccaggaagttcctattatgcaggcacaagtgattcatccaacctgggcatgcaagttgctgttggaattccaggaaatacagctaatgttggtatatgtgatctgcggaatcatgagcgcccgcatgttcataattcatacccacatgccagtgttacatcgagatttgtcttcccaactactatgtacaaccctagcatgtcagcagcagctgtcaacatatatattcctcagactcaaagctttggactgggcaatgtgctatcaccatctttacataatcatgtttccacaggaactattgatgaaagtagcagcagtgtcaattttggtgatagtgctattggattcatgaaaaggaaaaatgcagtagttgctggaaatcatcattttcttcatggatttgctggctcaagttcatctgttcatgcgcctcagaatcctgtgcgcggaccatggaatgcttcatctcaatcaaattgtttacccggttatgctgcttcaaacctaccagaataccacaatagcaatgggtggccattcttagaagaatcttctgcagatgcttcaaattgtttcagttctgtggctgctcgcccagagttggtacctcatggtaactatttatatccatctcacataagccagtgcaatacatgggttccacaggctgcaagtcatggagtgccacagtggggatatagtaatgccatggtcaatcctccaggaaccgcagacatgccgaatggaaatattcaggattaccaaactggtcattcttctattcatgggccactacctcttttctgccagaatcctttgcatagtatgcaagcacaagcacctcaaatacaagtaccccatcaacagttcgtcggtaacaatgtggtgcatggtttaaatccttctgccgttggccatcctttagatccaagaattctggctctcccatttaatgctgagcacacttttgggcatccaatgcatccacctctgataaaccaagctaacaatgggtctttaagaattctgccatatcagaacgctacagtgatggatcattcaaggatttatgaagcaggacatgttattgatgaacatagagatatgcgtttagatgtggataacatgacttatgaggagcttgtagcattgcaagagcagataggtgatgtcaatactggtttgacagaaagctatatccaagaaaacttgaggtccactttttatgttccaggagcagctagcatccctgatcagttttctgagctttctttggagaatgatgcgtgcataatatgccaggaggagtatgaagctaaagaacttataggaacccttggatgcggtcacaagtaccatgtgaattgcataaagcaatggttgatgataaaaaatttgtgccccatatgcaagacaacagctttgtcatcagatagaaggaatggatga

SEQ ID NO: 4962 - protein, 508 aa, Sorghum bicolor
  misc_feature: Ceres ANNOT ID no. 6040739
  misc_feature (456)..(496): Pfam Id: zf-C3HC4 Pfam Desc: Zinc finger, C3HC4 type (RING finger)
  misc_feature (1)..(508): NCBI GI: 56202173 NCBI Desc: ring-finger protein-like [oryza sativa (japonica cultivar-group)]
  misc_feature (67)..(506): NCBI GI: 79319806 NCBI Desc: protein binding / ubiquitin-protein ligase/ zinc ion binding [arabidopsis thaliana]
  misc_feature (70)..(506): NCBI GI: 23506055 NCBI Desc: at3g15070/k15m2_22 [arabidopsis thaliana]
  misc_feature (390)..(503): NCBI GI: 140064802 NCBI Desc: site-specific dna-methyltransferase (cytosine-n4-specific); zinc finger, ring-type [medicago truncatula]
  misc_feature (160)..(506): NCBI GI: 558543 NCBI Desc: c-terminal zinc-finger [glycine max]
  misc_feature: The sequence is a functional homolog of SEQ ID NO 406 in the 10/666,642US patent application
  misc_feature: Useful for making plants with modulated growth and phenotype characteristics
  misc_feature: The sequence is a functional homolog of SEQ ID NO 406 in the 20070033671 US patent application
  misc_feature: The sequence is a functional homolog of SEQ ID NO. 271 in the 11/188,298 US application
  misc_feature: The sequence is a functional homolog of SEQ ID NO. 329 in the 11/188,298 US application
  misc_feature: The sequence is a functional homolog of SEQ ID NO. 424 in the 11/188,298 US application
MSHRNMLWTHQSVNPEWEQGHVQVQPGSSYYAGTSDSSNLGMQVAVGIPGNTANVGICDLRNHERPHVHNSYPHASVTSRFVFPTTMYNPSMSAAAVNIYIPQTQSFGLGNVLSPSLHNHVSTGTIDESSSSVNFGDSAIGFMKRKNAVVAGNHHFLHGFAGSSSSVHAPQNPVRGPWNASSQSNCLPGYAASNLPEYHNSNGWPFLEESSADASNCFSSVAARPELVPHGNYLYPSHISQCNTWVPQAASHGVPQWGYSNAMVNPPGTADMPNGNIQDYQTGHSSIHGPLPLFCQNPLHSMQAQAPQIQVPHQQFVGNNVVHGLNPSAVGHPLDPRILALPFNAEHTFGHPMHPPLINQANNGSLRILPYQNATVMDHSRIYEAGHVIDEHRDMRLDVDNMTYEELVALQEQIGDVNTGLTESYIQENLRSTFYVPGAASIPDQFSELSLENDACIICQEEYEAKELIGTLGCGHKYHVNCIKQWLMIKNLCPICKTTALSSDRRNG

SEQ ID NO: 4963 - DNA, 3183 bp, Sorghum bicolor
  misc_feature: Ceres ANNOT ID no. 6040743
  misc_feature: Encodes the peptide sequence at SEQ ID NO 4964
atggcggggaacgactggatcaacagctacctggaggccatcctggacgcgggcggggccgcgggagaaatctcagcagccgcaggcagcgggggcggtggcgacgggacggccggggagaagcgggataagtcgtcgctgatgctccgggagcgcggccggttcagccccgcgcgatacttcgtcgaggaggtcatctccggcttcgacgagaccgacctctacaagacctgggtccgcacgtcggctatgaggagtccccaggagcggaacacgcggctggagaacatgtcgtggaggatctggaacctcgtcaggaagaagaagcagatagaaggagaggaagcctctcgcttgtctaaacgacgcatggaacttgagaaagctcgtcaatatgctgctactgatttgtctgaagacctatctgaaggcgaaaaaggagaaacaaataatgaaccatctattcatgatgagagcatgaggacgcggatgccaaggattggttcaactgatgctattgagacatgggcaaaccagcacaaagataaaaagttgtacatagtattgataagcattcatggtcttatacgcggggagaatatggagctggggcgcgattcagatacaggtggtcaggtgaaatatgttgtagaacttgctagggctttaggttcaacaccaggagtatacagagtggatctactaacaaggcaaatttctgcacctgatgttgattggagttatggggaacctactgagatgctcagtccaataagttcagagaactttgggcatgagctaggcgaaagcagtggtgcctatatggtccggataccatttggaccaagagacaaatatatccctaaagagcatctatggcctcacatccaggaatttgttgatggcgcacttgtccatatcatgcagatgtccaaggttcttggagaacaaattggtagtgggcaaccagtatggccagttgttatacatggacactatgctgatgctggtgattctgctgctttactgtctggggcactcaatgtacccatggtattcactggtcattctcttggcagagacaagttggagcagattttgaagcaagggcgtcaaaccagggatgaaataaatgcaacctataagataatgcgtcgaattgaggctgaggaactttgccttgatgcatctgaaatcataattacaagcaccaggcaagaaatagaacaacaatggggattatatgatggttttgatctaactatggctcggaaactcagagcaagaataaaacgtggtgtgagctgctttggtcgttacatgccccgtatgattgcaatacctcctggcatggagtttagtcatatagcaccacatgatgttgatcaggacagtgaggaaggaaatgaagatggctcaggttcaccggatccacctatttgggctgatataatgcggttcttctcaaacccccgtaagcccatgattcttgctcttgctcgtccggacccgaagaagaatatcactactctagtcaaagcatttggtgaacatcgtgaactgagaaatttagcaaatcttacactgatcatgggcaatcgtgatgtcattgatgaaatgtcaagcacaaatgcagctgttttgacttcagtactcaagttaattgataaatacgatctatatggacaagtggcataccccaagcaccacaagcaatttgaagttcctgatatttatcgtttagctgcaagaacaaaaggagtttttatcaattgtgcattcattgaaccatttggactcaccttgattgaggctgctgcttatggtctacccatggttgccacccgaaatggtgggcctgtggacatacatcgggttcttgataatggaattcttgttgacccccacaatcaaaatgaaataggtgaggcactttataagcttgtgtcagataagcaattgtggacacgatgtcgccagaatggtctgaaaaacatccatcaattttcgtggcctgaacattgcaagaactatttggcacgtgtagtcactctcaagcctagacatccccgctggcaaaagaatgatgttgcaactgaaatatctgaagcagactcacctgaggactctctgagggatatccatgacatatcacttaacttgaagctttccttggacagtgaaaaatcaggcagcaaagaagggaattcaaatactgtgagaaggcatttggaggatgcagtgcaaaagttgtcaggtgttagtgacatcaaaaaggatgggccaggtgagaatggtaagtggccatcattgcgtaggaggaagcacatcattgtaattgctgtagactctgtgcaagatgcagactttgttcaggttattaaaagtatttttgaggcttcaagcaatgagagatcaaatggctctgttggttttgtattgtcaacggctagagcaatatcagagatacatgctttgcttatatctggagggatagaagctagtgactttgacgccttcatatgcaacagtggcagtgatctttgttatccatcttcaaactctgaggacatgcttagccctgctgagctcccattcatgattgatcttgattatcactcccaaattgaatatcgctggggaggagaaggtttaaggaagacactaattcgttgggcgtctgagaaaaataatgaaagtggacaaaaaatacttgttgaggatgaagaatgctcatccacttactgcatttcatttaaagtgtccaatactgcagctgcacctcctgtgaaggagattaggaggacaatgagaattcaagcactgcgctgccatgttttgtacagccatgatggtagcaagctgaacgtaattcctgttttggcttctcgctcacaggctttaaggtatttgtatatcagatggggggtagagctgtcaaacatcactgtggttgtcggtgaatgtggtgacacagattatgaaggactacttggaggcgtgcacaaaactatcatactcaaaggctcgttcaatactgctccaaaccaagtccatgctaacagaagctattcattccaagatgttgtatcccttgagaaacaaggaattgcttcaattgagggatatggtccagacaatctaaaatcagctctaaggcaatttggtatatcgaaagactaa

SEQ ID NO: 4964 - protein, 1060 aa, Sorghum bicolor
  misc_feature: Ceres ANNOT ID no. 6040743
  misc_feature (482)..(665): Pfam Id: Glycos_transf_1 Pfam Desc: Glycosyl transferases group 1
  misc_feature (774)..(1026): Pfam Id: S6PP Pfam Desc: Sucrose-6F-phosphate phosphohydrolase
  misc_feature (1)..(1060): NCBI GI: 38305300 NCBI Desc: sucrose-phosphate synthase [bambusa oldhamii]
  misc_feature (1)..(1060): NCBI GI: 89000527 NCBI Desc: sucrose phosphate synthase [lolium perenne]
  misc_feature (74)..(1056): NCBI GI: 33341083 NCBI Desc: sucrose-phosphate synthase 2 [triticum aestivum]
  misc_feature (1)..(1059): NCBI GI: 3915023 NCBI Desc: sucrose-phosphate synthase 1 (udp-glucose-fructose-phosphate glucosyltransferase 1)
  misc_feature (44)..(1052): NCBI GI: 19223854 NCBI Desc: sucrose phosphate synthase [actinidia chinensis]
  misc_feature (1)..(1059): SWISSPROT Homolog: EC 2.4.1.14 Sucrose-phosphate synthase 1
  misc_feature: Useful for making plants with altered cell wall content and/or composition
  misc_feature: Functional homolog of the protein sequence encoded by LOCUS at5g11110
  misc_feature: GREAT-hit functional homolog of the protein sequence encoded by LOCUS at5g20280
  misc_feature: Useful for making plants with altered cell wall content and/or composition
  misc_feature: Useful for making plants with modulated biomass
  misc_feature: Useful for making plants with modulated carbohydrate content
  misc_feature: Functional homolog of the protein sequence given in SEQ ID NO 13827
  misc_feature: Useful for making plants with altered carbohydrate content
  misc_feature: Functional homolog of the protein sequence given in SEQ ID NO 13828
MAGNDWINSYLEAILDAGGAAGEISAAAGSGGGGDGTAGEKRDKSSLMLRERGRFSPARYFVEEVISGFDETDLYKTWVRTSAMRSPQERNTRLENMSWRIWNLVRKKKQIEGEEASRLSKRRMELEKARQYAATDLSEDLSEGEKGETNNEPSIHDESMRTRMPRIGSTDAIETWANQHKDKKLYIVLISIHGLIRGENMELGRDSDTGGQVKYVVELARALGSTPGVYRVDLLTRQISAPDVDWSYGEPTEMLSPISSENFGHELGESSGAYMVRIPFGPRDKYIPKEHLWPHIQEFVDGALVHIMQMSKVLGEQIGSGQPVWPVVIHGHYADAGDSAALLSGALNVPMVFTGHSLGRDKLEQILKQGRQTRDEINATYKIMRRIEAEELCLDASEIIITSTRQEIEQQWGLYDGFDLTMARKLRARIKRGVSCFGRYMPRMIAIPPGMEFSHIAPHDVDQDSEEGNEDGSGSPDPPIWADIMRFFSNPRKPMILALARPDPKKNITTLVKAFGEHRELRNLANLTLIMGNRDVIDEMSSTNAAVLTSVLKLIDKYDLYGQVAYPKHHKQFEVPDIYRLAARTKGVFINCAFIEPFGLTLIEAAAYGLPMVATRNGGPVDIHRVLDNGILVDPHNQNEIGEALYKLVSDKQLWTRCRQNGLKNIHQFSWPEHCKNYLARVVTLKPRHPRWQKNDVATEISEADSPEDSLRDIHDISLNLKLSLDSEKSGSKEGNSNTVRRHLEDAVQKLSGVSDIKKDGPGENGKWPSLRRRKHIIVIAVDSVQDADFVQVIKSIFEASSNERSNGSVGFVLSTARAISEIHALLISGGIEASDFDAFICNSGSDLCYPSSNSEDMLSPAELPFMIDLDYHSQIEYRWGGEGLRKTLIRWASEKNNESGQKILVEDEECSSTYCISFKVSNTAAAPPVKEIRRTMRIQALRCHVLYSHDGSKLNVIPVLASRSQALRYLYIRWGVELSNITVVVGECGDTDYEGLLGGVHKTIILKGSFNTAPNQVHANRSYSFQDVVSLEKQGIASIEGYGPDNLKSALRQFGISKD

SEQ ID NO: 4965 - DNA, 525 bp, Sorghum bicolor
  misc_feature: Ceres ANNOT ID no. 6040744
  misc_feature: Encodes the peptide sequence at SEQ ID NO 4966
atgggagggaggcacgaggcggaggcggacggcggaaaggccgggggctactcctcctccggcctcccgccgtcggaggcgccgcacctgcagggccagccgtcgcaggagtacgggtacggcacgttccagggccctcggcaacctcccgtcgggttcccgcagcctgctccgcctcccgggttcggcggcggcggctatcacaaccagcagaagccgtacgcgcccgcggagccctactacgctcaggggtaccaggccgtgccaggctatggtcctgttgctgaaggaagacctgtgagaatgaggcgtctcccatgttgtggcctcggcttaggctggtgtctgttcattactgggtttttccttgctgccattccatggtacattggagcttttattctgatatgtgtgcgggtacatgaccaacgagagaaaccaggatacgttgcttgcacaattgctgctgttgttgctgccgttgccatcctcctgggggtaactaaaggaactcatgtgtggtga

SEQ ID NO: 4966 - protein, 174 aa, Sorghum bicolor
  misc_feature: Ceres ANNOT ID no. 6040744
  misc_feature (37)..(155): NCBI GI: 145324074 NCBI Desc: rpl18aa (60s ribosomal protein l18a-1); structural constituent of ribosome [arabidopsis thaliana]
  misc_feature (24)..(155): NCBI GI: 115468006 NCBI Desc: os06g0359400 [oryza sativa (japonica cultivar-group)]
  misc_feature (2)..(99): NCBI GI: 57116345 NCBI Desc: prion protein [lateolabrax japonicus]
  misc_feature (16)..(117): NCBI GI: 45736092 NCBI Desc: proline-rich protein family-like [oryza sativa (japonica cultivar-group)]
  misc_feature (18)..(91): NCBI GI: 68234792 NCBI Desc: tm2 [frankia sp. ean1pec]
  misc_feature: Useful for making plants with modulated drought sensitivity
  misc_feature: Useful for making plants with modulated nitrogen use efficiency
  misc_feature: Functional homolog of the protein sequence given in SEQ ID NO 13495
  misc_feature: Functional homolog of the protein sequence given in SEQ ID NO 13497
MGGRHEAEADGGKAGGYSSSGLPPSEAPHLQGQPSQEYGYGTFQGPRQPPVGFPQPAPPPGFGGGGYHNQQKPYAPAEPYYAQGYQAVPGYGPVAEGRPVRMRRLPCCGLGLGWCLFITGFFLAAIPWYIGAFILICVRVHDQREKPGYVACTIAAVVAAVAILLGVTKGTHVW

SEQ ID NO: 4967 - DNA, 537 bp, Sorghum bicolor
  misc_feature: Ceres ANNOT ID no. 6040745
  misc_feature: Encodes the peptide sequence at SEQ ID NO 4968
atggtcgcccacaggttccatcagtaccaggtggtgggtcgcgcgctgccgaccccgaccgatgagcaccccaagatctaccggatgaagctctgggccaccaacgaggttcgcgccaagtcaaagttctggtacttccttaggaagctcaagaaggtgaagaagagcaatggccagatgctcgctatcaacgagatctttgagcgcaacccaaccactatcaagaactatggcatctggctgcgttaccagagcaggaccggttaccacaacatgtacaaggagtaccgtgacaccaccctgaacggtgccgtggagcagatgtacaacgagatggcctcccgccaccgtgtgaggtccccctgcatccagatcatcaagacggccacggtgcacttcaagctgtgcaagagggacaacaccaagcagttccacaactctaagatcaagttcccgctcgtgtaccgcaaggtgaggccacccacaaggaagctcaagaccaccttcaaggcgtccaggcccaacctgttcatgtga

SEQ ID NO: 4968 - protein, 178 aa, Sorghum bicolor
  misc_feature: Ceres ANNOT ID no. 6040745
  misc_feature (5)..(178): Pfam Id: Ribosomal_L18ae Pfam Desc: Ribosomal L18ae protein family
  misc_feature (1)..(178): NCBI GI: 21362867 NCBI Desc: 60s ribosomal protein l18a
  misc_feature (45)..(178): NCBI GI: 20161578 NCBI Desc: ribosomal protein l18a-like [oryza sativa (japonica cultivar-group)]
  misc_feature (1)..(178): NCBI GI: 13430184 NCBI Desc: ribosomal protein l18a [castanea sativa]
  misc_feature (1)..(178): NCBI GI: 92891579 NCBI Desc: ribosomal l18ae protein [medicago truncatula]
  misc_feature (1)..(178): NCBI GI: 20453309 NCBI Desc: at3g14600/mie1_10 [arabidopsis thaliana]
MVAHRFHQYQVVGRALPTPTDEHPKIYRMKLWATNEVRAKSKFWYFLRKLKKVKKSNGQMLAINEIFERNPTTIKNYGIWLRYQSRTGYHNMYKEYRDTTLNGAVEQMYNEMASRHRVRSPCIQIIKTATVHFKLCKRDNTKQFHNSKIKFPLVYRKVRPPTRKLKTTFKASRPNLFM

SEQ ID NO: 4969 - DNA, 849 bp, Sorghum bicolor
  misc_feature: Ceres ANNOT ID no. 6040749
  misc_feature: Encodes the peptide sequence at SEQ ID NO 4970
atggcgtctcacgatcaccaccactcccacgagcacgagcacgagcacgggcacgaccaccaccattcccacggggacggcggtggccatggatcggggggatcgtgggtaggggaggacggccgcgtgtggcactcccacgacggcctcgcgccccactcccacgagcccatctactcccccggcgacttcaccaagcgcgcgccgccgctcgcctcgcgcaacttcgctgaccgcgccttcaccgtcggcattggcggtcccgtcggcaccgggaaaactgccctgatgttagcattatgcagattcctacgcgacaagtatagtcttgcagctgtcacaaatgatatattcacaaaagaagatggagaattcttaatcaaacatggagctctccctgaagagcgcatacgtgcagtagaaactggaggttgccctcatgcggctatccgtgaagatatcagcataaatcttggtcctctggaggagctatcgaacttgtacaaagctgatttgctactctgtgaatctgggggagataacttggcagctaacttcagcagagaattagcagactacataatctacattattgatgtctctggtggggacaagataccaagaaaaggtggccctggtataacacaggctgatcttttggtaataaacaagacagacctagcacctgctgtaggagctgatctggctgtaatggaacgagatgcgcttcgcatgcgggaaggagggccttttgtgtttgcgcaggtgaaacatggagtgggcgtcgaggagattgtgaatcagattttgcaggcgtgggaaattgtgactggtaataagcggcgatga

SEQ ID NO: 4970 - protein, 282 aa, Sorghum bicolor
  misc_feature: Ceres ANNOT ID no. 6040749
  misc_feature (81)..(253): Pfam Id: cobW Pfam Desc: CobW/HypB/UreG, nucleotide-binding domain
  misc_feature (1)..(282): NCBI GI: 13161912 NCBI Desc: urease accessory protein g [solanum tuberosum]
  misc_feature (1)..(282): NCBI GI: 13161906 NCBI Desc: urease accessory protein g [solanum tuberosum]
  misc_feature (1)..(282): NCBI GI: 13161910 NCBI Desc: urease accessory protein g [solanum tuberosum]
  misc_feature (1)..(282): NCBI GI: 13161908 NCBI Desc: urease accessory protein g [solanum tuberosum]
  misc_feature (1)..(282): NCBI GI: 79324312 NCBI Desc: ureg; metal ion binding / nickel ion binding / nucleotide binding [arabidopsis thaliana]
MASHDHHHSHEHEHEHGHDHHHSHGDGGGHGSGGSWVGEDGRVWHSHDGLAPHSHEPIYSPGDFTKRAPPLASRNFADRAFTVGIGGPVGTGKTALMLALCRFLRDKYSLAAVTNDIFTKEDGEFLIKHGALPEERIRAVETGGCPHAAIREDISINLGPLEELSNLYKADLLLCESGGDNLAANFSRELADYIIYIIDVSGGDKIPRKGGPGITQADLLVINKTDLAPAVGADLAVMERDALRMREGGPFVFAQVKHGVGVEEIVNQILQAWEIVTGNKRR

SEQ ID NO: 4971 - DNA, 1203 bp, Sorghum bicolor
  misc_feature: Ceres ANNOT ID no. 6040754
  misc_feature: Encodes the peptide sequence at SEQ ID NO 4972
atgtcgggcgcgaggcatgagcaccacctgtccggtgacttccagttccacgacgagctggcgtcgctgttcgcgcatcagcggcccgacgcggcgccgatggcgcagccgtggttcatggactacctgcacgcgaccgcggcggcggcgtcgccgctggactgcgacgccttcgtgggggacttcatcgacgtgccggcggtggccgcggacgaggtagtcaagagggagctcgtgatggtggatactgcggctgccggcagcggcggcgggacgccgacgccgacgacggcgccgctcactcccaacagcatgtcgatgtcgtccacgtccagcgaggcttgcggcgccggggccggagcgggcgaggaatcggcggctggtaagtgcaagaaggaggacggcgaggaggaggggctcgagagcaaggacgacggatcggcggcgggcaagggagacggtggggaaggagaggagaagaacaagaaaggggcggccaacaagggcaagggcaagggcgagaagcggccccggcagccgcggttcgcgttcatgaccaagagcgaggtcgaccacctcgaggacggctacaggtggcgcaagtacggccagaaagctgtcaagaacagcccatttccgaggagctactaccggtgcacgacgcagaagtgcccggtgaagaagcgggtggagcggtcgtaccaggacgcggcggtggtgatcaccacgtacgagggcaagcacacgcaccccatccccgccacgctgcgcgggagctcgcacctcctcgccgccgcgcaccaccacccgatgggcggcctccaccacgtgcacccgcacttccggatggcgccgccgccgccgccgccgccgtcgtcgtcgcagcagcagcagcagggccaccatcaccaccacggcgccgccgccatgcagcagctggccgtcagcggcggcgccgccggagtgcagcaggtgaatgctgccgccgccatggcgagccacgcggcgctgccagacgatggtgaccagcacggcttggctgccatcgcaggtgcggctggtactacgacggcggcaactactgccgccagtgctccgctccggatgcagcacttcatggcgcaagactatgctgggctcctgcaggacatgtttccatccttcgttcacagcgacgatgatggccaccatcaccaccattga

SEQ ID NO: 4972 - protein, 400 aa, Sorghum bicolor
  misc_feature: Ceres ANNOT ID no. 6040754
  misc_feature (193)..(252): Pfam Id: WRKY Pfam Desc: WRKY DNA -binding domain
  misc_feature (10)..(390): NCBI GI: 33519198 NCBI Desc: wrky14 [oryza sativa (japonica cultivar-group)]
  misc_feature (10)..(390): NCBI GI: 115439035 NCBI Desc: os01g0665500 [oryza sativa (japonica cultivar-group)]
  misc_feature (101)..(309): NCBI GI: 15991740 NCBI Desc: wrky transcription factor 71 [arabidopsis thaliana]
  misc_feature (82)..(264): NCBI GI: 102139757 NCBI Desc: dna-binding wrky domain-containing protein [musa acuminata]
  misc_feature (149)..(257): NCBI GI: 117582134 NCBI Desc: wrky transcription factor [populus tremula x populus alba]
  misc_feature: The sequence is a functional homolog of SEQ ID NO 204 in the 10/714,887US patent application
  misc_feature: The sequence is a functional homolog of SEQ ID NO 204 in the 11/435,388US patent application
  misc_feature: The sequence is a functional homolog of SEQ ID NO 450 in the 10/666,642US patent application
  misc_feature: The sequence is a functional homolog of SEQ ID NO 86 in the 10/412,699US patent application
  misc_feature: Useful for making plants with modulated growth and phenotype characteristics
  misc_feature: The sequence is a functional homolog of SEQ ID NO 86 in the 20040045049 US patent application
  misc_feature: The sequence is a functional homolog of SEQ ID NO 204 in the 20060015972 US patent application
  misc_feature: The sequence is a functional homolog of SEQ ID NO 450 in the 20070033671 US patent application
  misc_feature: The sequence is a functional homolog of SEQ ID NO 86 in the 10/412,699 US patent application
  misc_feature: The sequence is a functional homolog of SEQ ID NO 114 in the 11/375,241 US patent application
  misc_feature: The sequence is a functional homolog of SEQ ID NO 146 in the 10/286,264 US patent application
  misc_feature: The sequence is a functional homolog of SEQ ID NO 2500 in the 10/374,780 US patent application
  misc_feature: The sequence is a functional homolog of SEQ ID NO 672 in the 10/412,699 US patent application
MSGARHEHHLSGDFQFHDELASLFAHQRPDAAPMAQPWFMDYLHATAAAASPLDCDAFVGDFIDVPAVAADEVVKRELVMVDTAAAGSGGGTPTPTTAPLTPNSMSMSSTSSEACGAGAGAGEESAAGKCKKEDGEEEGLESKDDGSAAGKGDGGEGEEKNKKGAANKGKGKGEKRPRQPRFAFMTKSEVDHLEDGYRWRKYGQKAVKNSPFPRSYYRCTTQKCPVKKRVERSYQDAAVVITTYEGKHTHPIPATLRGSSHLLAAAHHHPMGGLHHVHPHFRMAPPPPPPPSSSQQQQQGHHHHHGAAAMQQLAVSGGAAGVQQVNAAAAMASHAALPDDGDQHGLAAIAGAAGTTTAATTAASAPLRMQHFMAQDYAGLLQDMFPSFVHSDDDGHHHHH

SEQ ID NO: 4973 - DNA, 1992 bp, Sorghum bicolor
  misc_feature: Ceres ANNOT ID no. 6040756
  misc_feature: Encodes the peptide sequence at SEQ ID NO 4974
atggcgcctcccgcctctgcatcggcgcggccgctatccctccccctcaccgtccctctctcccgctaccggtcccacgtgctccccgcgacctgctctcgcctcctcccccggcgccgcgtcgcgctcgcgccggcccggcctggcgccgcggtcctatccagtctcagtgacgcgcgggaggaggagggtgaagaggaagaggaaggggatttctatgaggaggatgagcaacaggaatacgacgatgaggaggaacaggggtacgacggggagaacgaggagctggtcgaggtggggtacgtgtccggcgcgcacggggtgcgcggcgacgtcctcgtcacgccacgcaccgactttccggagctccgcctcgccacgccggggacgagatggctgagggctcgtgctgctgggaagcagcaggtcagggaattcgagcttgttcggggaagggcccacacggggaagaagagctggatcgtcagttttgatggcatcgataacctggatgaggctaggcaaatagttggttcggctgtacttgtcaaagctggagataggccagaaattgaggacgatgaattctattcacttgaccttgttggaatgagagttattgtcaaggatacaggcaaggtcgtaggaacagttggtcagattttcaattttggagggggagatcttctacaggtgatgattggctctgctgagggtactgctgtcgatccagattcagaaaatcaagattcaatttcatcacgtgagcatgtgtggattccatttgctgaagatattgtacctgatgttgatatggcgagcagagaaatgtggattacacctccgaaggggttacttgagctcaattctcgttctgataagagatcaaaaaaagaaaggcgtgcgatggagtggaaggacaggaagaggcttcaacgtcgtgtaattgcaggaaagaaggtgctctccgaaatggaccaagtccatgttctggaaggtttggtatcagggaacaaggtccaaaaggcatcacttgcagagcagattgggagcattgactttcaattgttccgacatgcagtgcattgtgttagcaagcagattgagagctcttcaaagattttgctcgctaactcttcactgtcaagaaaaaaagtgatcaaaataccatacaagactctcatcaaccttgaggacaaagctgaacatgcattcagtagtgaattcaaaaacggtcttgagattcttctgaagtccaaagcagccattgtacttgttagaaatggctctgactctgatgctgagtttctgggtttgctcaattcttttagtgagttaatgaaggttgtagaaaatcaagtttctcccccttttattatcgtttcaccagctggtcatgtggagtcagttcggaactgcctggtagagaatgactattttggtttggacactgaaaaggtgtgggtgctggaagagctggagcttccagttgttagtatatcctccgagggaaacaggaaaaaggttctgatgaagtctccctgggagataataaaaaggccagcaggatctgggggtatcttcagcttactggcatcaaacaagattttggaaaccctcaatgaaatgggtgtacagtatacacagatctgcagctcatccaacaaaccactcatcgggcatcctatgctctttggggctgtcgcttcccgcggggctgatgttggcatccagctctccaagactagtgaaacggaaaacgatttcgatgtgatcctttctatcgatcagctgaacaagatgtgccgagatgtcactcaggtcaggttctccgctcgctccgaagagaacgtgcacgtcgagcatgtcgacgggcagtgggtcgctgtccagccggaggtggctaattcccatcgtctgcacgccgaggttacgagtgtcttaaactcttgcgctcctgataaactgtgtgtcatggagattgttgagtaa

SEQ ID NO: 4974 - protein, 663 aa, Sorghum bicolor
  misc_feature: Ceres ANNOT ID no. 6040756
  misc_feature (98)..(187): Pfam Id: RimM Pfam Desc: RimM N-terminal domain
  misc_feature (193)..(286): Pfam Id: PRC Pfam Desc: PRC-barrel domain
  misc_feature (92)..(502): NCBI GI: 140055703 NCBI Desc: photosynthetic reaction centre, h-chain, cytoplasmic [medicago truncatula]
  misc_feature (95)..(287): NCBI GI: 119486516 NCBI Desc: 16s rrna-processing protein [lyngbya sp. pcc 8106]
  misc_feature (94)..(232): NCBI GI: 78183760 NCBI Desc: 16s rrna processing protein rimm [synechococcus sp. cc9902]
  misc_feature (75)..(290): NCBI GI: 75907314 NCBI Desc: 16s rrna processing protein rimm [anabaena variabilis atcc 29413]
  misc_feature (94)..(232): NCBI GI: 116071641 NCBI Desc: 16s rrna-processing protein [synechococcus sp. bl107]
MAPPASASARPLSLPLTVPLSRYRSHVLPATCSRLLPRRRVALAPARPGAAVLSSLSDAREEEGEEEEEGDFYEEDEQQEYDDEEEQGYDGENEELVEVGYVSGAHGVRGDVLVTPRTDFPELRLATPGTRWLRARAAGKQQVREFELVRGRAHTGKKSWIVSFDGIDNLDEARQIVGSAVLVKAGDRPEIEDDEFYSLDLVGMRVIVKDTGKVVGTVGQIFNFGGGDLLQVMIGSAEGTAVDPDSENQDSISSREHVWIPFAEDIVPDVDMASREMWITPPKGLLELNSRSDKRSKKERRAMEWKDRKRLQRRVIAGKKVLSEMDQVHVLEGLVSGNKVQKASLAEQIGSIDFQLFRHAVHCVSKQIESSSKILLANSSLSRKKVIKIPYKTLINLEDKAEHAFSSEFKNGLEILLKSKAAIVLVRNGSDSDAEFLGLLNSFSELMKVVENQVSPPFIIVSPAGHVESVRNCLVENDYFGLDTEKVWVLEELELPVVSISSEGNRKKVLMKSPWEIIKRPAGSGGIFSLLASNKILETLNEMGVQYTQICSSSNKPLIGHPMLFGAVASRGADVGIQLSKTSETENDFDVILSIDQLNKMCRDVTQVRFSARSEENVHVEHVDGQWVAVQPEVANSHRLHAEVTSVLNSCAPDKLCVMEIVE

SEQ ID NO: 4975 - DNA, 681 bp, Sorghum bicolor
  misc_feature: Ceres ANNOT ID no. 6040762
  misc_feature: Encodes the peptide sequence at SEQ ID NO 4976
atgtccatctcgatgcgcctcgcgatcccggctcccgccgccgcgccgccgcggctgagggtgcgagcggcggcggcggcggcggcaggggacgggggctgtctccccgtcgcgcgcgccgccgtgcggacggagacggccgcgctcaggggatgtgcgtcgctgccactgaagccgctgggcgccggccagccgtgccggcacaggggggccgccgccgtgtgtcactcgtcggcgtacctcagcgcgcagaccatgcagtggatctccgccggagccagcgcagtgctattacttgctaaaggcactgccatccacaaatctttccttgtgccattttttgctcttcaagcaccttgcagcataatctcatggatcaagggtgactatggccagtggactgcttttcttgctctgttggtgcgtctattcttcttcattccaggtgaactggagcttccactgtcaacaatgctgcttgtgagcgttgctccataccaattgatgaatctgaggggaactcaaggtggtgcagtattgtcattggccatagctgtgtatctcgccttccagcacttcactagggtgggaggtctaggcaaagcctttgagcagggatcgattattgcgaccttggccatcatctgcatcacgattgttcccttgatgctgctattctga

SEQ ID NO: 4976 - protein, 226 aa, Sorghum bicolor
  misc_feature: Ceres ANNOT ID no. 6040762
  misc_feature (35)..(219): Pfam Id: WCOR413 Pfam Desc: Cold acclimation protein WCOR413
  misc_feature (1)..(226): NCBI GI: 51854280 NCBI Desc: cold acclimation protein cor413-tm1 [oryza sativa (japonica cultivar-group)]
  misc_feature (1)..(226): NCBI GI: 27902677 NCBI Desc: cold acclimation protein cor413-tm1 [oryza sativa (japonica cultivar-group)]
  misc_feature (1)..(226): NCBI GI: 27902669 NCBI Desc: cold acclimation protein cor413-tm1 [triticum aestivum]
  misc_feature (1)..(226): NCBI GI: 18449100 NCBI Desc: cold acclimation wcor413-like protein gamma form [hordeum vulgare subsp. vulgare]
  misc_feature (1)..(151): NCBI GI: 27902675 NCBI Desc: truncated cold acclimation protein cor413-tm1 [zea mays]
MSISMRLAIPAPAAAPPRLRVRAAAAAAAGDGGCLPVARAAVRTETAALRGCASLPLKPLGAGQPCRHRGAAAVCHSSAYLSAQTMQWISAGASAVLLLAKGTAIHKSFLVPFFALQAPCSIISWIKGDYGQWTAFLALLVRLFFFIPGELELPLSTMLLVSVAPYQLMNLRGTQGGAVLSLAIAVYLAFQHFTRVGGLGKAFEQGSIIATLAIICITIVPLMLLF

SEQ ID NO: 4977 - DNA, 1287 bp, Sorghum bicolor
  misc_feature: Ceres ANNOT ID no. 6040767
  misc_feature: Encodes the peptide sequence at SEQ ID NO 4978
atggcgccgccgccacaaccaaagcagctggtgctcgccgcgtcatctgcggacgcgggcgtggccgcctgggacctccgcaccggcgcggaggacatccgcttccgcccctgcgcctcccgccctcggtcgctcgcctcggtcgccgaccgcttcctcgcctccgctcaggctcttccagctggcggcaactccgggaccatccacttctactactgggacaagccgcaagtggccgtcaagagctttcctgctgagccgatccgagcacttatcgccgatcaggaggggagctacctcatcggcggtggcagcaatggcaatatgttcctttgggaggtgtctagtggagagcttctccgcacatggcatgcgcactatcgtgctgttaggtgccttgcgctgtatgactatttgcttgtctcagggtcagaggatgggagtatcaaagtttgggatctcatcacggtgcttgatgagcagtcaaggctggaggcccagacaccatacatgtatagtttcagtcagcatgcactgcctgtaactgatattgcttgttttcttggagcaattgctgtatcttcttcagaggatcgaacatgcaaaatttggagtttatctgagggtaggatgctaagaagcatttcatttcctactagcattggttctgtagcactagacccaagaagtcatattttctatgctggtggtagagatggaaagatatatgttactgctatgggtgttgatctcagttttcatggtagtgatgagtcatctattttgggcacattggatgaccacagcaaggcagtaacaagcttagcatcaagcacagatggacttctacttgtctctggatttgaggatggtaatgttcgggtctgggatactagatgtcagcaggtgacccgaaaattcaaacactcccaaggtccagtaaccaatgttctgatagtaacgccacaacgagtaaatctgccaccactacaaccattacgcaaagtttgctcagcaaatggggaggctgaatggcgggcagtagttcttcctcggcctgaaaatgatgttccaattcctggaaataaaacctccatctttatggagcgctacttggatgagcttcagaagcatggtggttcttccaggttatttgatttcgagctgaatgctcagaatggcactccaaaccaacagggaacagaatggagagatagatacttggagttgcaggatctctttgtacatgaggtcctccatcagatgccatcctcgaggaacccatga

SEQ ID NO: 4978 - protein, 428 aa, Sorghum bicolor
  misc_feature: Ceres ANNOT ID no. 6040767
  misc_feature (117)..(153): Pfam Id: WD40 Pfam Desc: WD domain, G-beta repeat
  misc_feature (259)..(297): Pfam Id: WD40 Pfam Desc: WD domain, G-beta repeat
  misc_feature (1)..(427): NCBI GI: 115471673 NCBI Desc: os07g0408100 [oryza sativa (japonica cultivar-group)]
  misc_feature (1)..(276): NCBI GI: 50510214 NCBI Desc: transducin / wd-40 repeat protein family -like protein [oryza sativa (japonica cultivar-group)]
  misc_feature (10)..(366): NCBI GI: 87241484 NCBI Desc: wd40-like [medicago truncatula]
  misc_feature (20)..(323): NCBI GI: 140046046 NCBI Desc: wd40-like [medicago truncatula]
  misc_feature (7)..(320): NCBI GI: 82524836 NCBI Desc: loc496904 [xenopus tropicalis]
MAPPPQPKQLVLAASSADAGVAAWDLRTGAEDIRFRPCASRPRSLASVADRFLASAQALPAGGNSGTIHFYYWDKPQVAVKSFPAEPIRALIADQEGSYLIGGGSNGNMFLWEVSSGELLRTWHAHYRAVRCLALYDYLLVSGSEDGSIKVWDLITVLDEQSRLEAQTPYMYSFSQHALPVTDIACFLGAIAVSSSEDRTCKIWSLSEGRMLRSISFPTSIGSVALDPRSHIFYAGGRDGKIYVTAMGVDLSFHGSDESSILGTLDDHSKAVTSLASSTDGLLLVSGFEDGNVRVWDTRCQQVTRKFKHSQGPVTNVLIVTPQRVNLPPLQPLRKVCSANGEAEWRAVVLPRPENDVPIPGNKTSIFMERYLDELQKHGGSSRLFDFELNAQNGTPNQQGTEWRDRYLELQDLFVHEVLHQMPSSRNP

SEQ ID NO: 4979 - DNA, 2460 bp, Sorghum bicolor
  misc_feature: Ceres ANNOT ID no. 6040769
  misc_feature: Encodes the peptide sequence at SEQ ID NO 4980
  misc_feature: Down-regulated in shoot tissues in response to aminocyclopropane carboxylic treatment
atgggcaaggcgaaggggaagcagcgtcaggacaagttctaccacctcgccaaggagcaagggtaccggagtcgcgcggcgttcaagctgctccagctcgacgcgcggttccgcttcctcccgacggctcgctcggtgctcgacctctgtgccgcgccaggagggtgggtccaggtggccgtcaaccatgcccccgtgggagccttcgtcgtcggcgtcgacctcgtccccatccgccccatccgtggtgcccactcgctcaccgaggatatcaccaccaccaagtgccgcgccgcggtgcggaggcttatggactccaacggcgtctccgccttcgacgtcgtgctccacgacgggtcgcccaacgtcggtggtgcctgggcgcaggaggccacatcgcagtcggctctcgtcattgacgcactgcgccttgctaccatgttcctcgctcccaagggcgccttcatcacgaaggtttttaggtctcaagattacaacgctattatgtactgtcttaaacagttctttgagaaggttgaggcgactaaaccttcggcaagtcggtctacatctgctgaaatttatatcatctgccagaaatacaaggctcctgcaaagattcaaccagaacttctagatataaagcacttgttcagtgttgttccagaacagaccaaatctagggatgttatggatggtaggaaaaagagacaccgtgatgggtatgaagaagggaatacgacattgcggaaagtcggtttggcatcagactttgtatggtctgatgcccaggcgccactggagtttttgggctcttacaatgcaatttcatttgataatccagaatccctgcccataaaaaatcatgagcttacaacagatgatataaaaaatttctgtgaggacttacttctgttggataaaaatagtttcaagcatatcttgaaatggcgaattcgcttacgaaaatcactgtcagcgtcttcacaagtcaccccaaaggtcaatgatgctgtggagaacacaaaggtcacagatgatgatgtgcttctacaagaaatggaagaattgaccagtgtcatcgatagaaataaaaaaagagagaaaaagcgtttgtcaaagcgtcgagcgaaggataaagcacgcaaggccacaggaatgcagattgatgctactggagatgattatggcgatcctgacttgttttctattagtgttattaagggtggaaaacaacttgaagctgttgaatcagcagagcttaatgtggaagatgaaattggagacagtgagaatgaggatactcaagctcttgaagactctgatgaggaaattgattctgatgaggaacagcagaggtatgatgcccagcttgaggagatgcttgatgaagcttatgagcgctttgtaactaaaaagggtggtgaaataaaacaagaacgcaagcgtgcgaaacgaatcaatcctgatgctgatgcagacctgttagagggaggtgaagatgatggtgatgttgaaatggatcaagattttgatgaagatcaagatcaggagaccaatccccttctgttatctctagatgaacagaggccaactaaagagcagattgtaaagcaatggtatagtcaggatgtgttcacagaagctgtaaccggcgttactgagcagagtgacactgaagatgaaagggagagtttgcagaggaataagaagatggatactggcaaaaaggaaaaggtggctaaagcacagcgtttgcaacaagaagattttgagattgtaccagcagaacctgtccgaaacgaagaggattcatcttcatcttctgatgaatcagatcaatcagaggatgatctcgatgattacagaaaggctgaagtactagcctatgctaagaagatgctgaggaagaaacagagagagcagatacttgatgatgcttacaacaagcacatgtttgatgatgaagggttacccaactggtttgttgaggatgaaaagcgacataggcagcccatgaagcctgttacacgtgaggaagtagcagcgatgagggctcagtttaaggagattgatgcccgtccatccaagaaggttgcagaggccaaggctcggaagaagcgtgttgccatgaagaaacttgacaaggcacgccaaaaggcagatgctatagcagaccagaatgacataaacgagcgatcaaagaggaagatgatcgaccagatttacaggaaggcgatgccaaagaggcctcagaaggagtatgttgttgcaaagaagggggttcaggtgagggctggcaaagggaaggtgttggtggatccacggatgaagaaggacaagcgggccagcgggactgggaagaaagggaagaagggcggcaaaggcgcaaaggggaagggtggcctgaaaggcatgagagggaaagctgggaagaaggctgggaaagccccgcggtaa

SEQ ID NO: 4980 - protein, 819 aa, Sorghum bicolor
  misc_feature: Ceres ANNOT ID no. 6040769
  misc_feature (22)..(203): Pfam Id: FtsJ Pfam Desc: FtsJ-like methyltransferase
  misc_feature (554)..(792): Pfam Id: Spb1_C Pfam Desc: Spb1 C-terminal domain
  misc_feature (1)..(814): NCBI GI: 115465501 NCBI Desc: os05g0567400 [oryza sativa (japonica cultivar-group)]
  misc_feature (1)..(819): NCBI GI: 102139739 NCBI Desc: ftsj-like methyltransferase family protein [musa acuminata]
  misc_feature (1)..(818): NCBI GI: 17381234 NCBI Desc: at4g25730/f14m19_10 [arabidopsis thaliana]
  misc_feature (1)..(818): NCBI GI: 22328933 NCBI Desc: ftsj-like methyltransferase family protein [arabidopsis thaliana]
  misc_feature (3)..(819): NCBI GI: 92887660 NCBI Desc: ribosomal rna methyltransferase rrmj/ftsj [medicago truncatula]
  misc_feature: Down-regulated in shoot tissues in response to aminocyclopropane carboxylic treatment
MGKAKGKQRQDKFYHLAKEQGYRSRAAFKLLQLDARFRFLPTARSVLDLCAAPGGWVQVAVNHAPVGAFVVGVDLVPIRPIRGAHSLTEDITTTKCRAAVRRLMDSNGVSAFDVVLHDGSPNVGGAWAQEATSQSALVIDALRLATMFLAPKGAFITKVFRSQDYNAIMYCLKQFFEKVEATKPSASRSTSAEIYIICQKYKAPAKIQPELLDIKHLFSVVPEQTKSRDVMDGRKKRHRDGYEEGNTTLRKVGLASDFVWSDAQAPLEFLGSYNAISFDNPESLPIKNHELTTDDIKNFCEDLLLLDKNSFKHILKWRIRLRKSLSASSQVTPKVNDAVENTKVTDDDVLLQEMEELTSVIDRNKKREKKRLSKRRAKDKARKATGMQIDATGDDYGDPDLFSISVIKGGKQLEAVESAELNVEDEIGDSENEDTQALEDSDEEIDSDEEQQRYDAQLEEMLDEAYERFVTKKGGEIKQERKRAKRINPDADADLLEGGEDDGDVEMDQDFDEDQDQETNPLLLSLDEQRPTKEQIVKQWYSQDVFTEAVTGVTEQSDTEDERESLQRNKKMDTGKKEKVAKAQRLQQEDFEIVPAEPVRNEEDSSSSSDESDQSEDDLDDYRKAEVLAYAKKMLRKKQREQILDDAYNKHMFDDEGLPNWFVEDEKRHRQPMKPVTREEVAAMRAQFKEIDARPSKKVAEAKARKKRVAMKKLDKARQKADAIADQNDINERSKRKMIDQIYRKAMPKRPQKEYVVAKKGVQVRAGKGKVLVDPRMKKDKRASGTGKKGKKGGKGAKGKGGLKGMRGKAGKKAGKAPR

SEQ ID NO: 4981 - DNA, 330 bp, Sorghum bicolor
  misc_feature: Ceres ANNOT ID no. 6040771
  misc_feature: Encodes the peptide sequence at SEQ ID NO 4982
atgtctgcctcgcggagctcctctcccaactccatgtcaaagtggagccccaaagagaacaagatgtttgaacaggcactcgcctactatggcgagggcacacccaaccggtgggacaaggtgtccagcgccatgggaggcatcaagtctgctgaggaggtgcgctgccactatgaagatcttgactatgacgtcaagatgattgagtcaggccatgtaccgtacccccagtacaagacacagggattctggacccgaggctcactaatgcccactaattatgtgggctccaatcctagtattatgacaaaaatctcctacttccaatag

SEQ ID NO: 4982 - protein, 109 aa, Sorghum bicolor
  misc_feature: Ceres ANNOT ID no. 6040771
  misc_feature (3)..(89): NCBI GI: 145356202 NCBI Desc: dna binding / transcription factor [arabidopsis thaliana]
  misc_feature (4)..(89): NCBI GI: 112292446 NCBI Desc: atrl1 [arabidopsis thaliana]
  misc_feature (6)..(82): NCBI GI: 38566494 NCBI Desc: at4g36570 [arabidopsis thaliana]
  misc_feature (6)..(79): NCBI GI: 124360540 NCBI Desc: homeodomain-related [medicago truncatula]
  misc_feature (11)..(95): NCBI GI: 110931770 NCBI Desc: myb transcription factor myb164 [glycine max]
  misc_feature: The sequence is a functional homolog of SEQ ID NO 1973 in the 11/479,226US patent application
  misc_feature: The sequence is a functional homolog of SEQ ID NO 880 in the 11/435,388US patent application
  misc_feature: Useful for making plants with modulated growth and phenotype characteristics
  misc_feature: Useful for making plants with modulated nitrogen use efficiency
  misc_feature: Useful for making plants with modulated nitrogen use efficiency
  misc_feature: GREAT-hit functional homolog of the protein sequence given in SEQ ID NO 13253
  misc_feature: The sequence is a functional homolog of SEQ ID NO 880 in the 20060272060 US patent application
  misc_feature: Useful for making plants with modulated nitrogen use efficiency
  misc_feature: Functional homolog of the protein sequence given in SEQ ID NO 13253
  misc_feature: The sequence is a functional homolog of SEQ ID NO 1973 in the 11/479,226 US patent application
  misc_feature: The sequence is a functional homolog of SEQ ID NO 880 in the 11/435,388 US patent application
  misc_feature: Useful for making plants with altered lignin content
  misc_feature: Useful for making plants with modulated low light sensitivity
  misc_feature: Functional homolog of the protein sequence given in SEQ ID NO 12938
  misc_feature: The sequence is a functional homolog of SEQ ID NO 2720 in the 10/374,780 US patent application
  misc_feature: The sequence is a functional homolog of SEQ ID NO 360 in the 10/225,066 US patent application
  misc_feature: The sequence is a functional homolog of SEQ ID NO 876 in the 11/435,388 US patent application
  misc_feature: The sequence is a functional homolog of SEQ ID NO 976 in the 11/435,388 US patent application
  misc_feature: The sequence is a functional homolog of SEQ ID NO 510 in the 10/666,642 US patent application
  misc_feature: The sequence is a functional homolog of SEQ ID NO 1404 in the 11/479,226 US patent application
  misc_feature: The sequence is a functional homolog of SEQ ID NO 662 in the 10/412,699 US patent application
  misc_feature: The sequence is a functional homolog of SEQ ID NO 944 in the 11/435,388 US patent application
  misc_feature: The sequence is a functional homolog of SEQ ID NO 1893 in the 11/479,226 US patent application
  misc_feature: The sequence is a functional homolog of SEQ ID NO 2678 in the 10/374,780 US patent application
  misc_feature: The sequence is a functional homolog of SEQ ID NO 340 in the 10/225,066 US patent application
  misc_feature: The sequence is a functional homolog of SEQ ID NO 1930 in the 10/412,699 US patent application
  misc_feature: The sequence is a functional homolog of SEQ ID NO 246 in the 10/714,887 US patent application
  misc_feature: The sequence is a functional homolog of SEQ ID NO 246 in the 11/435,388 US patent application
  misc_feature: The sequence is a functional homolog of SEQ ID NO 452 in the 10/374,780 US patent application
  misc_feature: The sequence is a functional homolog of SEQ ID NO 88 in the 10/225,068 US patent application
  misc_feature: The sequence is a functional homolog of SEQ ID NO 984 in the 10/225,066 US patent application
MSASRSSSPNSMSKWSPKENKMFEQALAYYGEGTPNRWDKVSSAMGGIKSAEEVRCHYEDLDYDVKMIESGHVPYPQYKTQGFWTRGSLMPTNYVGSNPSIMTKISYFQ

SEQ ID NO: 4983 - DNA, 1485 bp, Sorghum bicolor
  misc_feature: Ceres ANNOT ID no. 6040774
  misc_feature: Encodes the peptide sequence at SEQ ID NO 4984
atgggtggcggcggcagcaacagaggcggcgccggcgaggagagcggcagcgaccacgacggcgggctgcggaagccgctgctccacacgggcagctggtaccggatgagctcgcggcagtccagcgtcgcccccggggcctcctccatggccgtcctgcgggagtcccacgtctccgccttcctctgcacactcatcgtcgcgctcggccccattcagttcggcttcaccagcggcttctcctccccgacccaggacaccatggtccgggacctcaacctctccatctccgagttctcggcgttcggctcgctgtccaacgtcggcgccatggtcggggcgatcgccagcgggcagatggccgagcacattggccgtaaagggttgttgatgattgctgcaatcccgaatatcatcggttggcttgcgatctcctttgcaaaagatgcctcatttctttatatgggacgattgcttgaagggtttggtgtcggcatcatatcctatacggtacctgtatacatagcagagatatctcctcagaacatgagaggagctcttggttctgtgaaccagttgtctgtgacctttggcatattcttggcctatttgctcggcatgtttgttccttggagacttctagctgtgatcggagccttgccctgcacagtgttgattcctggactattcttcattccagaatctcccagatggctggcaaagatgaatttgatggaagattgtgagacgtccctacaagtgctgagggggtttgagactgacataacgacagaaagagcagtgacatcatcaagtaagaggactacaataagttttcaagaattaaaccaaaagaaataccgcacgccactacttctaggaattggcctacttgtactacaaaatttaagtggaatcaacggtgtactgttttatgcaagtaacatcttcaaagctgctggtgttacaaacagcaacttggccacctgttcacttggagctatccaggtccttgctactggagttacgacatggttgttagacagagctggacgacgcatgcttctcattatttctacctctggcatgactctatgccttcttgctgtttctgttgtattttttgtcaaggataagacttcacaggattctaactcgtactacatattaactatgatctccttggtttctatcgtggcttttgtcattaccttctcgtttggtatgggtgccattccatggctcatgatgtctgagatcctcccagttagcatcaagagtctcggcggaagcatcgcaacactggccaactggctgacatctttcgccataacaatgacgacgaacttgatgctaacctggagtgttggaggcactttcctctcgtacatggttgtgagcgccttcacccttgtttttgtcgtgctttgggtgccggagacgaagggaagaactctagaggagatacaattttcgtttcgctga

SEQ ID NO: 4984 - protein, 494 aa, Sorghum bicolor
  misc_feature: Ceres ANNOT ID no. 6040774
  misc_feature (63)..(493): Pfam Id: Sugar_tr Pfam Desc: Sugar (and other) transporter
  misc_feature (67)..(445): Pfam Id: MFS_1 Pfam Desc: Major Facilitator Superfamily
  misc_feature (13)..(494): NCBI GI: 126635783 NCBI Desc: sugar transporter protein [ananas comosus]
  misc_feature (12)..(494): NCBI GI: 5091611 NCBI Desc: 10a19i.3 [oryza sativa (japonica cultivar-group)]
  misc_feature (14)..(494): NCBI GI: 1209756 NCBI Desc: integral membrane protein [beta vulgaris]
  misc_feature (64)..(492): NCBI GI: 124360168 NCBI Desc: general substrate transporter [medicago truncatula]
  misc_feature (62)..(492): NCBI GI: 124361039 NCBI Desc: general substrate transporter; sugar transporter superfamily [medicago truncatula]
  misc_feature: The plant produces a reduced number of seeds.
  misc_feature: Useful for biocontainment applications
  misc_feature: Functional homolog of the protein sequence given in SEQ ID NO 13576
  misc_feature: Useful for biocontainment applications
  misc_feature: Functional homolog of the protein sequence given in SEQ ID NO 13576
  misc_feature: The sequence is a functional homolog of SEQ ID NO. 488 in the 11/188,298 US application
  misc_feature: The sequence is a functional homolog of SEQ ID NO. 449 in the 11/188,298 US application
  misc_feature: The sequence is a functional homolog of SEQ ID NO. 331 in the 11/188,298 US application
  misc_feature: The sequence is a functional homolog of SEQ ID NO. 296 in the 11/188,298 US application
MGGGGSNRGGAGEESGSDHDGGLRKPLLHTGSWYRMSSRQSSVAPGASSMAVLRESHVSAFLCTLIVALGPIQFGFTSGFSSPTQDTMVRDLNLSISEFSAFGSLSNVGAMVGAIASGQMAEHIGRKGLLMIAAIPNIIGWLAISFAKDASFLYMGRLLEGFGVGIISYTVPVYIAEISPQNMRGALGSVNQLSVTFGIFLAYLLGMFVPWRLLAVIGALPCTVLIPGLFFIPESPRWLAKMNLMEDCETSLQVLRGFETDITTERAVTSSSKRTTISFQELNQKKYRTPLLLGIGLLVLQNLSGINGVLFYASNIFKAAGVTNSNLATCSLGAIQVLATGVTTWLLDRAGRRMLLIISTSGMTLCLLAVSVVFFVKDKTSQDSNSYYILTMISLVSIVAFVITFSFGMGAIPWLMMSEILPVSIKSLGGSIATLANWLTSFAITMTTNLMLTWSVGGTFLSYMVVSAFTLVFVVLWVPETKGRTLEEIQFSFR

SEQ ID NO: 4985 - DNA, 1506 bp, Sorghum bicolor
  misc_feature: Ceres ANNOT ID no. 6040777
  misc_feature: Encodes the peptide sequence at SEQ ID NO 4986
atggcgagcaacagggcatccggcagcgagtacgagagcggcagcgaccacgacggcgcgctgcagaagccgctgctgcccaacagcgggagctggtaccggatggggatggggtcgcgccagtccagcctcaacgccgccggcacctcctccatggccgtcctgcgcgagtcccacgtctccgccttcctctgcacgctcatcgtcgcgctcggccccatccagttcggcttcaccggcggctactcctccccgacgcaggccagcatcatccgggacctcaacctctccatctccgagttctcggtgttcggctcgctctccaacgtgggcgccatggtcggggcgatcgccagcgggcagatggccgagtacatgggccgcaaagggtcgttgatgattgcagcgattccgaacgtcattggttggcttgcaatctcctttgcaaaagactcttcatttctgtatatgggacgcttacttgaaggatttggtgtcggtatcatttcctatgtggtaccagtatacatagcagagatatctcctcagaacatgagaggggctctaggttctgtgaaccagttgtctgtaacccttggtatcatgtttgcctatttgctcggcttatttgttccttggaggcttcttgcagtaataggaaccttgccctgcatagtgttgatacctggcctattcttcattccggaatctccaagatggctggcaaagatgaatatgatggatgattgtgagacttctctacaagttctgaggggattcgatgctgacatcactgcagaagtgaatgatataaagagagcagtaacatcagcaaacagaaggactacaatccattttcaggagttgaaccaaaagaaataccgaacacccctaattataggaattggtctacttgtgctgcaacagctaagtggaataaatggtatactgttttatgcaagtagcatcttcaaagctgcaggtctcaaggacagtgacttggacacatttgcacttggagctattcaggttcttgccactgttgttacaaccatgttcttggacagagctggtcgacgaatcctccttattatttcttctgctgggatgactataagccttcttgtagttgctattgtattttacatcaaggataatctttcacatgactctgacttgtataacatcttaagtatggtgtccttggttggtgtcgtggcctatgtcattgccttctccttcggtatgggtgccattccttggatcataatgtccgagatcctcccagttagcatcaagagtcttgcaggaagctttgcgacccttgccaactggttgacatcctttggaataacaatgacagccaacttgctgatcagctggagtgctggaggtacgtttgcctcctacatgattgtgagtgccttcactctcgtgtttgtaatcatttgggtgccagagacgaagggaagaaccctcgaggagatacaatggtcattccgctga

SEQ ID NO: 4986 - protein, 501 aa, Sorghum bicolor
  misc_feature: Ceres ANNOT ID no. 6040777
  misc_feature (65)..(500): Pfam Id: Sugar_tr Pfam Desc: Sugar (and other) transporter
  misc_feature (69)..(452): Pfam Id: MFS_1 Pfam Desc: Major Facilitator Superfamily
  misc_feature (12)..(501): NCBI GI: 126635783 NCBI Desc: sugar transporter protein [ananas comosus]
  misc_feature (3)..(501): NCBI GI: 5091611 NCBI Desc: 10a19i.3 [oryza sativa (japonica cultivar-group)]
  misc_feature (9)..(501): NCBI GI: 1209756 NCBI Desc: integral membrane protein [beta vulgaris]
  misc_feature (21)..(241): NCBI GI: 8778437 NCBI Desc: f18o14.22 [arabidopsis thaliana]
  misc_feature (66)..(499): NCBI GI: 124360168 NCBI Desc: general substrate transporter [medicago truncatula]
  misc_feature: The plant produces a reduced number of seeds.
  misc_feature: Useful for biocontainment applications
  misc_feature: Functional homolog of the protein sequence given in SEQ ID NO 13576
  misc_feature: Useful for biocontainment applications
  misc_feature: Functional homolog of the protein sequence given in SEQ ID NO 13576
  misc_feature: The sequence is a functional homolog of SEQ ID NO. 488 in the 11/188,298 US application
  misc_feature: The sequence is a functional homolog of SEQ ID NO. 449 in the 11/188,298 US application
  misc_feature: The sequence is a functional homolog of SEQ ID NO. 331 in the 11/188,298 US application
  misc_feature: The sequence is a functional homolog of SEQ ID NO. 296 in the 11/188,298 US application
MASNRASGSEYESGSDHDGALQKPLLPNSGSWYRMGMGSRQSSLNAAGTSSMAVLRESHVSAFLCTLIVALGPIQFGFTGGYSSPTQASIIRDLNLSISEFSVFGSLSNVGAMVGAIASGQMAEYMGRKGSLMIAAIPNVIGWLAISFAKDSSFLYMGRLLEGFGVGIISYVVPVYIAEISPQNMRGALGSVNQLSVTLGIMFAYLLGLFVPWRLLAVIGTLPCIVLIPGLFFIPESPRWLAKMNMMDDCETSLQVLRGFDADITAEVNDIKRAVTSANRRTTIHFQELNQKKYRTPLIIGIGLLVLQQLSGINGILFYASSIFKAAGLKDSDLDTFALGAIQVLATVVTTMFLDRAGRRILLIISSAGMTISLLVVAIVFYIKDNLSHDSDLYNILSMVSLVGVVAYVIAFSFGMGAIPWIIMSEILPVSIKSLAGSFATLANWLTSFGITMTANLLISWSAGGTFASYMIVSAFTLVFVIIWVPETKGRTLEEIQWSFR

SEQ ID NO: 4987 - DNA, 1224 bp, Sorghum bicolor
  misc_feature: Ceres ANNOT ID no. 6040791
  misc_feature: Encodes the peptide sequence at SEQ ID NO 4988
atggtatcctaccatccttccctgtctctgctccgcccatccgtcctcaccgcccgggccagcgtcatcggccggtgctccacacccaacgccttcgtgtccatccccgtcgtctctgcggcgccccttcgcctgcggcctctgctgcgcgccgccgccggtggagcagcctcgccggtcggtggtaatggaggcaaacgcgctgttccgccttccgcgctgctcatcaacttcgcgcgtagcaacttcctcccgcttgctctcattagtggggtcatactcggtctcctagatcctactcttggatgccttgctcacgaatactccctgtcgaagttcagcacttttgggatattcgttatgtcaggactgaccctgcgaactaaggagcttggtacagcattagaagcttggcctgctgcattatatggactaggatctattttgctgcttacaccctttgtttctcaatttatcatgcaagttcagttcttccctcgtgaatttatcactggattagctatattttgctgcatgccaacaacattatcaagtggagtcatactaacacagcttgttggtggtaattctgcactagctcttgcaatgacagtttcatccaatttacttggcattataattgtacctctttctcttgcaagatacattggcactggagctggtgtgtctttgcctactgagaagttatttagaagtctggtcaccagacttctaatccctcttattatagggaaggttgctcgagaagcctcaaaaggtattgctgattttgttgatagaaaccaacaaggattttcagttggaaatgcagttcttctcagcctagtcccatggattcaaataagtagatcaagatcactaatcttatctgttcaagtggaagcttttgctgctgctattactgttggagtgcttatacatcttgcactgttggctttcaacattgcaatgttgcatatcttgtcacgtcttggaaagaaaggggattcagtctttgcaaagaaagagtacacacgagctgtcattttggtgtccagtcagaaaacattgccagtgatgataactgtggttgagcagcttggaggagccctcggggagtcgggacttctagtcatcccttgtgtttttgcacacattaaccagatcattgtcgattctatcatagtaaattggtggcgcaggagggatcaacaaaataagtaa

SEQ ID NO: 4988 - protein, 407 aa, Sorghum bicolor
  misc_feature: Ceres ANNOT ID no. 6040791
  misc_feature (115)..(298): Pfam Id: SBF Pfam Desc: Sodium Bile acid symporter family
  misc_feature (78)..(393): NCBI GI: 145343497 NCBI Desc: bass family transporter: sodium ion/bile acid [ostreococcus lucimarinus cce9901]
  misc_feature (75)..(396): NCBI GI: 71480739 NCBI Desc: p7 [xenopus laevis]
  misc_feature (75)..(396): NCBI GI: 89272913 NCBI Desc: novel protein [xenopus tropicalis]
  misc_feature (75)..(396): NCBI GI: 113196587 NCBI Desc: p7 isoform c [homo sapiens]
  misc_feature (75)..(396): NCBI GI: 56159731 NCBI Desc: p7 [rattus norvegicus]
MVSYHPSLSLLRPSVLTARASVIGRCSTPNAFVSIPVVSAAPLRLRPLLRAAAGGAASPVGGNGGKRAVPPSALLINFARSNFLPLALISGVILGLLDPTLGCLAHEYSLSKFSTFGIFVMSGLTLRTKELGTALEAWPAALYGLGSILLLTPFVSQFIMQVQFFPREFITGLAIFCCMPTTLSSGVILTQLVGGNSALALAMTVSSNLLGIIIVPLSLARYIGTGAGVSLPTEKLFRSLVTRLLIPLIIGKVAREASKGIADFVDRNQQGFSVGNAVLLSLVPWIQISRSRSLILSVQVEAFAAAITVGVLIHLALLAFNIAMLHILSRLGKKGDSVFAKKEYTRAVILVSSQKTLPVMITVVEQLGGALGESGLLVIPCVFAHINQIIVDSIIVNWWRRRDQQNK

SEQ ID NO: 4989 - DNA, 1149 bp, Sorghum bicolor
  misc_feature: Ceres ANNOT ID no. 6040800
  misc_feature: Encodes the peptide sequence at SEQ ID NO 4990
atggctcaggatgaagctgtggctacccagaagactggaaatacagcatccccttctaaggattatccaactccttctccatatcctgattggtcgaccatgcaggcatattatggccctggtgtcttgccaccaacatattttgctccagcaatagctccaggccatccaccgccatacatgtggggtcctcagcctataatgccacccccttttgggacaccatatgctgcagtatacccacatggtggagcttacccacacccccttgtgcccatgatgtcaactccattgagcatggagcccgccaaatctgcaaacagcaaggagaaaaattccaataagaaacttaaggaaatagatcggactgcagtgtctgctggcagtggtaacagtaaaagaacaatgtcatccagtgaagattacagtgcagagggctccagcgatgtaaacgaccagaaggtgaacaaaacgtccaggaagcagaactcagatgatggacctggtgcagaaaccaccacaggtgcaaacacggaatgtgttttagctcctaaccatacgatggggaatggtgctattttgccacatcactgctttccagctccagtaattaagcccagcgctacaaatgtcgccaactcgagggtgataggcacagcgatatctccatcacctagtgtgatggtcccagctcatactgcattaccagctgacttatcagtcaaggatgagagggaattgaagcgtgaaaagaggaagcagtcaaatagggagtctgctagacgatcaaggctgagaaaacaggctgagacagaggagttggctacacaagtggagtcccttactacagagaacacgtcccttaggtctgaaatcggcaggctaacagagagctcggagaagctcagattagaaaattccgctctaatggtgaagctgaaggacactgcagcactgacccctgcagaaccatctccgcacacagcagtcacatcctcgtcctctccgggtgccgccgcggaaaatttcctttccatgatcgacagcgccaaggcggccggcgtcagcaggcacacggagcacggcgagcccaagctccggcagctcctggactccagtccggcaacagacgtcgctgccgtaagctga

SEQ ID NO: 4990 - protein, 382 aa, Sorghum bicolor
  misc_feature: Ceres ANNOT ID no. 6040800
  misc_feature (1)..(156): Pfam Id: MFMR Pfam Desc: G-box binding protein MFMR
  misc_feature (244)..(307): Pfam Id: bZIP_1 Pfam Desc: bZIP transcription factor
  misc_feature (244)..(298): Pfam Id: bZIP_2 Pfam Desc: Basic region leucine zipper
  misc_feature (1)..(382): NCBI GI: 498643 NCBI Desc: g-box binding factor 1
  misc_feature (1)..(297): NCBI GI: 49345143 NCBI Desc: salt-stress inducible bzip protein [oryza sativa (indica cultivar-group)]
  misc_feature (1)..(297): NCBI GI: 33465887 NCBI Desc: g-box binding protein [oryza sativa (japonica cultivar-group)]
  misc_feature (1)..(297): NCBI GI: 1147632 NCBI Desc: osbz8
  misc_feature (4)..(316): NCBI GI: 1399005 NCBI Desc: transcription factor
  misc_feature: The sequence is a functional homolog of SEQ ID NO 110 in the 10/374,780US patent application
  misc_feature: The sequence is a functional homolog of SEQ ID NO 1104 in the 10/225,066US patent application
  misc_feature: The sequence is a functional homolog of SEQ ID NO 1108 in the 10/225,066US patent application
  misc_feature: The sequence is a functional homolog of SEQ ID NO 12 in the 10/412,699US patent application
  misc_feature: The sequence is a functional homolog of SEQ ID NO 1225 in the 10/412,699US patent application
  misc_feature: The sequence is a functional homolog of SEQ ID NO 159 in the 11/479,226US patent application
  misc_feature: The sequence is a functional homolog of SEQ ID NO 1762 in the 10/374,780US patent application
  misc_feature: The sequence is a functional homolog of SEQ ID NO 2 in the 10/374,780US patent application
  misc_feature: The sequence is a functional homolog of SEQ ID NO 2218 in the 10/374,780US patent application
  misc_feature: The sequence is a functional homolog of SEQ ID NO 36 in the 10/412,699US patent application
  misc_feature: The sequence is a functional homolog of SEQ ID NO 362 in the 10/412,699US patent application
  misc_feature: The sequence is a functional homolog of SEQ ID NO 464 in the 11/435,388US patent application
  misc_feature: The sequence is a functional homolog of SEQ ID NO 466 in the 11/435,388US patent application
  misc_feature: The sequence is a functional homolog of SEQ ID NO 492 in the 10/225,066US patent application
  misc_feature: The sequence is a functional homolog of SEQ ID NO 847 in the 11/479,226US patent application
  misc_feature: The sequence is a functional homolog of SEQ ID NO 910 in the 10/374,780US patent application
  misc_feature: The sequence is a functional homolog of SEQ ID NO 911 in the 10/374,780US patent application
  misc_feature: The sequence is a functional homolog of SEQ ID NO 912 in the 10/374,780US patent application
  misc_feature: The sequence is a functional homolog of SEQ ID NO 913 in the 10/374,780US patent application
  misc_feature: The sequence is a functional homolog of SEQ ID NO 922 in the 10/374,780US patent application
  misc_feature: Useful for making plants with modulated growth and phenotype characteristics
  misc_feature: Useful for making plants with modulated nitrogen use efficiency
  misc_feature: Functional homolog of the protein sequence given in SEQ ID NO 12961
  misc_feature: The sequence is a functional homolog of SEQ ID NO 12 in the 20040045049 US patent application
  misc_feature: The sequence is a functional homolog of SEQ ID NO 1225 in the 20040045049 US patent application
  misc_feature: The sequence is a functional homolog of SEQ ID NO 36 in the 20040045049 US patent application
  misc_feature: The sequence is a functional homolog of SEQ ID NO 362 in the 20040045049 US patent application
  misc_feature: The sequence is a functional homolog of SEQ ID NO 1762 in the 20060162006 US patent application
  misc_feature: The sequence is a functional homolog of SEQ ID NO 910 in the 20060162006 US patent application
  misc_feature: The sequence is a functional homolog of SEQ ID NO 911 in the 20060162006 US patent application
  misc_feature: The sequence is a functional homolog of SEQ ID NO 912 in the 20060162006 US patent application
  misc_feature: The sequence is a functional homolog of SEQ ID NO 1225 in the 10/412,699 US patent application
  misc_feature: The sequence is a functional homolog of SEQ ID NO 922 in the 10/374,780 US patent application
  misc_feature: The sequence is a functional homolog of SEQ ID NO. 512 in the 11/188,298 US application
  misc_feature: The sequence is a functional homolog of SEQ ID NO. 337 in the 11/188,298 US application
MAQDEAVATQKTGNTASPSKDYPTPSPYPDWSTMQAYYGPGVLPPTYFAPAIAPGHPPPYMWGPQPIMPPPFGTPYAAVYPHGGAYPHPLVPMMSTPLSMEPAKSANSKEKNSNKKLKEIDRTAVSAGSGNSKRTMSSSEDYSAEGSSDVNDQKVNKTSRKQNSDDGPGAETTTGANTECVLAPNHTMGNGAILPHHCFPAPVIKPSATNVANSRVIGTAISPSPSVMVPAHTALPADLSVKDERELKREKRKQSNRESARRSRLRKQAETEELATQVESLTTENTSLRSEIGRLTESSEKLRLENSALMVKLKDTAALTPAEPSPHTAVTSSSSPGAAAENFLSMIDSAKAAGVSRHTEHGEPKLRQLLDSSPATDVAAVS

SEQ ID NO: 4991 - DNA, 957 bp, Sorghum bicolor
  misc_feature: Ceres ANNOT ID no. 6040802
  misc_feature: Encodes the peptide sequence at SEQ ID NO 4992
atgagcatgggacgcttcgtcaactccatggatccgaggtcggggctggaggtgatcagggactggaacggcgtcgcccaggtcgtgctccgctcgcccaagggagcctccgcgcgggtgagcctgcacggcggccaggtcgtctcctggaggaacgaccgcggcgaggagctcctcttcaccagcagcaaggcaatcttcaagccgccaaatgcaatgcgaggtggaattcagatgtgtttcccacagtttggatactcggggacattggagcgacatggatttgcaagaaacaggatatgggccctggatgatgagcatccaccactgactcataatgataacggcagcaaagtttctgttgaccttatactaaagccatctgaagatgacctcaagtgctggccacattgttttgagttccgtctgagggtctctctttcaaaggatggggacttgtcattaatatcacgcatcaggaatgtcaatggcaagccattcagtttctcatttgcttatcacacatatctttctgtttctgacatcagtgaggttaggattgaaggtctggagacacttgattatcttgacaaccttagccacaaagaacggtttacggaacaaggagatgccataacatttgagtcagaggtcgaccgagtctacgttagctccccaaatgtagtagcggttcttgaccatgagaagaaacactcatttgtcataagaaaggaaggacttcctgacgttgttgtgtggaatccatgggaaaagaaatcgaagaccatgatagacttgggtgatgaggagtacaagcagatgctttgcgttgatgcggccgctgtggagagagcaatcacgctgaaaccaggggaggagtggactgggaagctggagctttctgcagttttatccaccaactgcagcgatcatcttgatcaccctgtcagcatctag

SEQ ID NO: 4992 - protein, 318 aa, Sorghum bicolor
  misc_feature: Ceres ANNOT ID no. 6040802
  misc_feature (26)..(301): Pfam Id: Aldose_epim Pfam Desc: Aldose 1-epimerase
  misc_feature (1)..(317): NCBI GI: 115438971 NCBI Desc: os01g0658700 [oryza sativa (japonica cultivar-group)]
  misc_feature (3)..(312): NCBI GI: 144922979 NCBI Desc: galactose mutarotase-like [medicago truncatula]
  misc_feature (14)..(313): NCBI GI: 124360080 NCBI Desc: galactose mutarotase-like [medicago truncatula]
  misc_feature (12)..(318): NCBI GI: 549984 NCBI Desc: possible apospory-associated protein
  misc_feature (23)..(313): NCBI GI: 38344152 NCBI Desc: osjnba0041a02.19 [oryza sativa (japonica cultivar-group)]
MSMGRFVNSMDPRSGLEVIRDWNGVAQVVLRSPKGASARVSLHGGQVVSWRNDRGEELLFTSSKAIFKPPNAMRGGIQMCFPQFGYSGTLERHGFARNRIWALDDEHPPLTHNDNGSKVSVDLILKPSEDDLKCWPHCFEFRLRVSLSKDGDLSLISRIRNVNGKPFSFSFAYHTYLSVSDISEVRIEGLETLDYLDNLSHKERFTEQGDAITFESEVDRVYVSSPNVVAVLDHEKKHSFVIRKEGLPDVVVWNPWEKKSKTMIDLGDEEYKQMLCVDAAAVERAITLKPGEEWTGKLELSAVLSTNCSDHLDHPVSI

SEQ ID NO: 4993 - DNA, 2049 bp, Sorghum bicolor
  misc_feature: Ceres ANNOT ID no. 6040818
  misc_feature: Encodes the peptide sequence at SEQ ID NO 4994
atggccagaccctgcggcgccgcgctgcagcggcacgcggcagtggccgtccttcgcacggcggccgccgctggcgacctgtccaagggaaaggcgctccacgcccggctcatcacagccgcccatttcgacgtcgtcctgcacaacaacctcatctccttctacgccaagtgcggccgggtcgggctcgcccgcaaggtgttcgacgcaatgcccttccggaacgccgtgtccggaaacctcctcatgtccgcatacgcttccctggggcggcataaggactcgctcgcgctgctcagggtggtcgactttgacctgaacgagtacgttctgtcagcagcggtgtctgcaaccgccaatgtcaggagctatgacatggggaggcagtgccatgggtatgctgttaaggctgggctggctgagcaacgctatgttttcaacgctgtgctatatatgtactgtcagtgtgctcacatggaggatgcagcgaaggtatttgagaatgtttctggttttgatgcattcgcattcaactcaatgataaatgggtttcttgatcgggggctactggatggttcattcgggattgtgagaaaaatgactgaggaggttgagaaatgggattatgtgtcttatgtcgcagttcttgggcattgtgctagcatgaaggactttgtgcttgggattcaggtgcatgcccaggctttgaagaagaggcttgaactaaatgtgtatgtggggagtgcacttgttgatatgtatgggaaatgtgaccatgctcatgaagctaatcatgcattcgaggttctgccagagaagaatgttgtttcttggacagctgttatgactgcttacaaccaaaatgagctgtatgaagatgcattgcaattgttcttggacatggaaatggaaggagttcaacccaatgaattcacttatgctgtggttctcaacagttgtgctggccttgcagccttgagaactggtaacacccttggtgcctgtactatgaaatctgggcattgggaccatttgctagtcagtaatggcctcctgaacatgtactcaaagagtggcagcattgaagatgcgcacagagtcttcatttccatgccatttcgtgatgtagtctcttggaatttgattatcacaggctatgcgcatcatggccttgcaaaggaagcgatggaagcatttcacagtatgctatcagcagcagtggtcccgtcttatgtcacctttgttggagtattgtcagcttgtgctcagttgggtcttgttgatgaagcattctactacttgaatactatgatgaaggaagttggaattacacctgggaaggaacattatacttgtatggttggtttgttatgcagagttggacggctagatgaggctgagaggttcatagtgaataattgcattggcacagatgttgttgcatggcgatcactactaagttcttgtcaggtatataaaaattatggtcttggtcatcgagtagctgaacagattcttcagttggagcccaatgatattggaacctatgttttactctctaacatgtatgcaaaagccaacagatgggatggcgttgtgaaggtccggaagcatatgagggagaggggcgttaggaaagcacctggtgtaagttggattcacttgggaagtgatgttcatgttttcacatcggaggagaaagtacatccacagatggaccaaatcaccgaaaaacttgaagagctgatcgaccagattaaaactatcggatatattccaaattttgcagtggtcctacatgatattgaggatgaacaaaaagaggagcaccttatgtatcatagtgagaaattggctctagcctttggccttattcacacacctaagggagcaacaatccatatcatgaaaaacctcaggatatgtgatgattgccatgttgctatcaaactcatatcagttgtcactggcagaaaaatagttgtgagggatgctgttcgatttcattgtatagaaggtggggtttgctcgtgcaacgattattggtaa

SEQ ID NO: 4994 - protein, 682 aa, Sorghum bicolor
  misc_feature: Ceres ANNOT ID no. 6040818
  misc_feature (276)..(310): Pfam Id: PPR Pfam Desc: PPR repeat
  misc_feature (377)..(411): Pfam Id: PPR Pfam Desc: PPR repeat
  misc_feature (43)..(682): NCBI GI: 92871537 NCBI Desc: tetratricopeptide-like helical [medicago truncatula]
  misc_feature (17)..(682): NCBI GI: 9758344 NCBI Desc: selenium-binding protein-like [arabidopsis thaliana]
  misc_feature (6)..(682): NCBI GI: 54695180 NCBI Desc: ppr986-12 [physcomitrella patens]
  misc_feature (15)..(682): NCBI GI: 92873274 NCBI Desc: tetratricopeptide-like helical [medicago truncatula]
  misc_feature (33)..(682): NCBI GI: 140039544 NCBI Desc: tetratricopeptide-like helical [medicago truncatula]
MARPCGAALQRHAAVAVLRTAAAAGDLSKGKALHARLITAAHFDVVLHNNLISFYAKCGRVGLARKVFDAMPFRNAVSGNLLMSAYASLGRHKDSLALLRVVDFDLNEYVLSAAVSATANVRSYDMGRQCHGYAVKAGLAEQRYVFNAVLYMYCQCAHMEDAAKVFENVSGFDAFAFNSMINGFLDRGLLDGSFGIVRKMTEEVEKWDYVSYVAVLGHCASMKDFVLGIQVHAQALKKRLELNVYVGSALVDMYGKCDHAHEANHAFEVLPEKNVVSWTAVMTAYNQNELYEDALQLFLDMEMEGVQPNEFTYAVVLNSCAGLAALRTGNTLGACTMKSGHWDHLLVSNGLLNMYSKSGSIEDAHRVFISMPFRDVVSWNLIITGYAHHGLAKEAMEAFHSMLSAAVVPSYVTFVGVLSACAQLGLVDEAFYYLNTMMKEVGITPGKEHYTCMVGLLCRVGRLDEAERFIVNNCIGTDVVAWRSLLSSCQVYKNYGLGHRVAEQILQLEPNDIGTYVLLSNMYAKANRWDGVVKVRKHMRERGVRKAPGVSWIHLGSDVHVFTSEEKVHPQMDQITEKLEELIDQIKTIGYIPNFAVVLHDIEDEQKEEHLMYHSEKLALAFGLIHTPKGATIHIMKNLRICDDCHVAIKLISVVTGRKIVVRDAVRFHCIEGGVCSCNDYW

SEQ ID NO: 4995 - DNA, 504 bp, Sorghum bicolor
  misc_feature: Ceres ANNOT ID no. 6040849
  misc_feature: Encodes the peptide sequence at SEQ ID NO 4996
atgggagatcggcagcagcagcacgcgcacgggcacggcggcggagagcacccggcggcagcggacccgccgtcgtcggcgacgctgctgcggcgggtgcagacccacgcgcccaactcgacgcaggtggtgggcttcctgacgctgctcgtctccggcgccgtgctgctgctcctcacggggctcacgctgacgggcgccgtcgtggcgctcgtcttcctgggccccatcgcgctgctcaccagccccatctgggtgcccatcgccgtcgcgctcttcgtcctcaccgccgccgcgctctccgcctgcggcttcgtcgtcgccgcgctcgccgtgggcacctggatgtaccgctacttcacgggccgacaccccgtcggcgccgaccgggtggactacgcgcgcagccggatcgccgacacggccagccacgtcaaggactacgcgcgcgagtacggcggctacctgcacaaccgctccaaggacgccgcgcccggcgcctag

SEQ ID NO: 4996 - protein, 167 aa, Sorghum bicolor
  misc_feature: Ceres ANNOT ID no. 6040849
  misc_feature (39)..(156): Pfam Id: Oleosin Pfam Desc: Oleosin
  misc_feature (18)..(167): NCBI GI: 61658206 NCBI Desc: ole-5 [coffea canephora]
  misc_feature (29)..(167): NCBI GI: 21311555 NCBI Desc: 15.8 kda oleosin [theobroma cacao]
  misc_feature (29)..(157): NCBI GI: 3643595 NCBI Desc: oleosin [arabidopsis thaliana]
  misc_feature (29)..(157): NCBI GI: 42569328 NCBI Desc: glycine-rich protein / oleosin [arabidopsis thaliana]
  misc_feature (42)..(166): NCBI GI: 52001241 NCBI Desc: oleosin 3 [arachis hypogaea]
MGDRQQQHAHGHGGGEHPAAADPPSSATLLRRVQTHAPNSTQVVGFLTLLVSGAVLLLLTGLTLTGAVVALVFLGPIALLTSPIWVPIAVALFVLTAAALSACGFVVAALAVGTWMYRYFTGRHPVGADRVDYARSRIADTASHVKDYAREYGGYLHNRSKDAAPGA

SEQ ID NO: 4997 - DNA, 342 bp, Sorghum bicolor
  misc_feature: Ceres ANNOT ID no. 6040859
  misc_feature: Encodes the peptide sequence at SEQ ID NO 4998
atgatttctgatggtttgtgcaggatgaagttcattgctgcctacctgcttgctgttcttgctggtaactccagcccctcagctgaggacttgacagccattctggagtcagttggctgtgaagttgacaatgaaaggatggaactcctgctgtcccaactgagcggtaaggacattaccgagctcattgctgcgggcagggagaagtttgcttcagtcccatgtggcggtggcggtgtagctgttgcggcagctgcccctgctgctggtggagctgctcctgcagctgaggcgaagaaagaagagaaggtggaagagaaggaagaaagtgatgatctttag

SEQ ID NO: 4998 - protein, 113 aa, Sorghum bicolor
  misc_feature: Ceres ANNOT ID no. 6040859
  misc_feature (25)..(114): Pfam Id: Ribosomal_60s Pfam Desc: 60s Acidic ribosomal protein
  misc_feature (9)..(112): NCBI GI: 790508 NCBI Desc: 60s acidic ribosomal protein [zea mays]
  misc_feature (9)..(112): NCBI GI: 4204372 NCBI Desc: acidic ribosomal protein p2a-2 [zea mays]
  misc_feature (9)..(112): NCBI GI: 899610 NCBI Desc: acidic ribosomal protein p2
  misc_feature (17)..(112): NCBI GI: 4204374 NCBI Desc: acidic ribosomal protein p2a-3 [zea mays]
  misc_feature (10)..(112): NCBI GI: 32400824 NCBI Desc: acidic ribosomal protein p2a-2 [triticum aestivum]
  misc_feature: Abnormal phyllotaxy, leaf number higher than wild-type
  misc_feature: The plant flowers significantly late compared to wild-type.
  misc_feature: The plant is abnormally large.
  misc_feature: The plant is abnormally small.
  misc_feature: The plant produces a reduced number of seeds.
  misc_feature: Useful for biocontainment applications
  misc_feature: Useful for making plants with altered oil content
  misc_feature: Useful for making plants with modulated biomass
  misc_feature: Useful for making plants with modulated flowering time
  misc_feature: Useful for making plants with modulated drought sensitivity
  misc_feature: Functional homolog of the protein sequence given in SEQ ID NO 13443
  misc_feature: Functional homolog of the protein sequence given in SEQ ID NO 13447
  misc_feature: Useful for making plants with altered oil content
  misc_feature: Useful for making plants with modulated biomass
  misc_feature: Functional homolog of the protein sequence given in SEQ ID NO 13447
MISDGLCRMKFIAAYLLAVLAGNSSPSAEDLTAILESVGCEVDNERMELLLSQLSGKDITELIAAGREKFASVPCGGGGVAVAAAAPAAGGAAPAAEAKKEEKVEEKEESDDL

SEQ ID NO: 4999 - DNA, 1251 bp, Sorghum bicolor
  misc_feature: Ceres ANNOT ID no. 6040863
  misc_feature: Encodes the peptide sequence at SEQ ID NO 5000
atgcagcacgccagcgaccaccccgccggcgggggcgggagcgccgagggggaggccttcgtcccgcgcggcgggccccagcagggcctgcgccgccgcaccggccccgtcccgctcgactactcaagcccccgcagcggccgcgcgggcgacgggaggcgctccaccttccgggaggacgtcgggcacgccgccgccgagacgtacctcgtcacgggactcgcattcaccctgctcggatacctcggggttggttatcggtggatatcgcagcttattgcactccttgtgtatgcagttttactcatgcctggtttcataaaagttgggtactactatttcttttcaagtcaggttattagaagtgtagtctatggagaacaaccaagaaataggttggatttgtacatgcccagagataacagcaaatccagtccagttgtggcatttgtaactggtggagcttggatcattggttacaaggcgtggggtgctctccttggaaggcggttagcagagagaggaattatagtagcttgtattgattacagaaatttccctcaaggaacaataagcgacatggtcactgatgcttctgaggcaatatcattcatctgtaaaaatgttgttagctttggaggggatcctgataaaatttacttgatgggtcaatcagcaggagcacatattgcggcctgtgctctcttagagcaagcagttaaagaatccaagggagagagtacctattggaatctggctcaaataaaagcgtattttggtttatctggaggatacaacatccagaatttggttgatcactttcatgaacgtggtctttatcgttcaatatttctcagcataatggagggagaggaatcactgccacgtttctcacctgaaattgtcgccaaaaaattaagtgcagaaaccatatctctgctacctcagattgtactactgcatggaacagcagattactccataccatcatctgcgagtgcaacttttgcggatgttcttaaacaagctggtggaaaagtagagttacaattgtatgaagggaaaacacatactgatgtatttttacaggatccactaaggggtggcagggacaaaatgcttgaagatgttttatctgtcattcatgttgatgatgcaagtgcgcgtgagaaggccgcttcagcacctaccccggagcgcctggtttatgagtggcaaattaaattggcccgccaaattagtcccttctaa

SEQ ID NO: 5000 - protein, 416 aa, Sorghum bicolor
  misc_feature: Ceres ANNOT ID no. 6040863
  misc_feature (148)..(363): Pfam Id: Abhydrolase_3 Pfam Desc: alpha/beta hydrolase fold
  misc_feature (14)..(332): NCBI GI: 55297181 NCBI Desc: carboxylesterase-like [oryza sativa (japonica cultivar-group)]
  misc_feature (157)..(416): NCBI GI: 9755631 NCBI Desc: carboxylesterase-like protein [arabidopsis thaliana]
  misc_feature (120)..(266): NCBI GI: 28855211 NCBI Desc: esterase/lipase/thioesterase family protein [pseudomonas syringae pv. tomato str. dc3000]
  misc_feature (133)..(272): NCBI GI: 84368161 NCBI Desc: carboxylesterase [xanthomonas oryzae pv. oryzae maff 311018]
  misc_feature (120)..(266): NCBI GI: 71736016 NCBI Desc: esterase/lipase/thioesterase family protein [pseudomonas syringae pv. phaseolicola 1448a]
MQHASDHPAGGGGSAEGEAFVPRGGPQQGLRRRTGPVPLDYSSPRSGRAGDGRRSTFREDVGHAAAETYLVTGLAFTLLGYLGVGYRWISQLIALLVYAVLLMPGFIKVGYYYFFSSQVIRSVVYGEQPRNRLDLYMPRDNSKSSPVVAFVTGGAWIIGYKAWGALLGRRLAERGIIVACIDYRNFPQGTISDMVTDASEAISFICKNVVSFGGDPDKIYLMGQSAGAHIAACALLEQAVKESKGESTYWNLAQIKAYFGLSGGYNIQNLVDHFHERGLYRSIFLSIMEGEESLPRFSPEIVAKKLSAETISLLPQIVLLHGTADYSIPSSASATFADVLKQAGGKVELQLYEGKTHTDVFLQDPLRGGRDKMLEDVLSVIHVDDASAREKAASAPTPERLVYEWQIKLARQISPF

SEQ ID NO: 5001 - DNA, 561 bp, Sorghum bicolor
  misc_feature: Ceres ANNOT ID no. 6040864
  misc_feature: Encodes the peptide sequence at SEQ ID NO 5002
atggcaaggtcagcaccggcggcggcagcagcggcctcttctccggcgccgaagccacagccacagccacagccgcatccacatccgcagctgcggggcagccagctgaagcagctgcgggagatcttccagcggttcgacatggacggcgacggcagcctgacgcagctagagctagcggcgctgctgcggtcgctgggcctgcgcccgacgggggaggaggcgcgggcgctgctggccgccatggactcggacggcaacggcttggtggagttcggcgagctggcggccgccatcgcgccgctgctcaccacgcagacgcacctcgtcgaccaggcccagctcctggaggtgttccgcgccttcgaccgcgacggcaacggattcatctccgccgccgagctggcgcgctccatggcccgacttggccagccgctcaccttcgaggagctcacgcgcatgatgcgcgacgctgacgccgatggcgatggcgtcatcagcttccaggagttcgccgccgtcatggccaagtccgccctcgacttcctcggcgtcgcatga

SEQ ID NO: 5002 - protein, 186 aa, Sorghum bicolor
  misc_feature: Ceres ANNOT ID no. 6040864
  misc_feature (38)..(66): Pfam Id: efhand Pfam Desc: EF hand
  misc_feature (114)..(142): Pfam Id: efhand Pfam Desc: EF hand
  misc_feature (150)..(178): Pfam Id: efhand Pfam Desc: EF hand
  misc_feature (30)..(186): NCBI GI: 53791542 NCBI Desc: calmodulin-like [oryza sativa (japonica cultivar-group)]
  misc_feature (30)..(185): NCBI GI: 140049278 NCBI Desc: flagellar calcium-binding protein (calflagin) [medicago truncatula]
  misc_feature (30)..(175): NCBI GI: 4959142 NCBI Desc: calmodulin mutant syncam2 [synthetic construct]
  misc_feature (30)..(175): NCBI GI: 4959144 NCBI Desc: calmodulin mutant syncam6 [synthetic construct]
  misc_feature (30)..(175): NCBI GI: 4959148 NCBI Desc: calmodulin mutant syncam35 [synthetic construct]
  misc_feature: Abnormal phyllotaxy, leaf number higher than wild-type
  misc_feature: The plant flowers significantly late compared to wild-type.
  misc_feature: The plant is abnormally large.
  misc_feature: The plant is abnormally small.
  misc_feature: The plant produces a reduced number of seeds.
  misc_feature: Useful for biocontainment applications
  misc_feature: Useful for making plants with modulated biomass
  misc_feature: Useful for making plants with modulated flowering time
  misc_feature: Useful for making plants with modulated salt sensitivity
  misc_feature: Useful for making plants with modulated drought sensitivity
  misc_feature: Functional homolog of the protein sequence given in SEQ ID NO 13443
  misc_feature: Functional homolog of the protein sequence given in SEQ ID NO 13444
  misc_feature: Useful for making plants with modulated salt sensitivity
  misc_feature: Functional homolog of the protein sequence given in SEQ ID NO 13894
MARSAPAAAAAASSPAPKPQPQPQPHPHPQLRGSQLKQLREIFQRFDMDGDGSLTQLELAALLRSLGLRPTGEEARALLAAMDSDGNGLVEFGELAAAIAPLLTTQTHLVDQAQLLEVFRAFDRDGNGFISAAELARSMARLGQPLTFEELTRMMRDADADGDGVISFQEFAAVMAKSALDFLGVA

SEQ ID NO: 5003 - DNA, 1104 bp, Sorghum bicolor
  misc_feature: Ceres ANNOT ID no. 6040871
  misc_feature: Encodes the peptide sequence at SEQ ID NO 5004
atgggggtgctgcggagcacgcagagcctggaggccgaggtggaggagatgcgcgccgcgctgctgctccacggcgcgtgggcgtggaggcccggcggcgggggtgccgccaagcgcgcggcccgcgccgcggagcccgccggcgcggaggcgcgcaccgtgtgcgtcacggggggcacgtccttccttggcttcgccgtcgtcgactgcctgctccgccacggctacgatgtccgcctcgccatcgagacgcaagaggaccttgacaagctgcgggagatggagatgtttggggagaatggcagggacggggtctggactgtgatcgcaaatgtgatggacccggagagcttgcatgaagcttttgacggctgtgttggtgtctttcacacctcgtcacttgtggatccagggggcatctccggttacacgaaacacatggcacgcttggaagccaaagcagcagagcaggtggtcgaagcatgtgtgaggacagagtccgtgaggaagtgcgttctcacgtcgtcactgttggcatgtgtgtggaggcaaaactaccctcatgaccgccggttcccaaccaccattgatgagaactgttggagcgatgagagcttctgccgggacaacaagctatggctgtcacttggcaagacgatggcggaaaaggcggcatggagggcagcacgggggacagacctgaagctagtgaccatatgccctgcacttgtaaccgggccaggattccggaggcggaaccctactccatccattgcctacctcaaaggagcgcatgccatgctcgccgaaggcctgctggcgacagcgaacgtggaaagagtggctgaggcgcacgtccgcgtgtacgaggagatgagcggcacggccggggggcggtacatctgctacgaccacgtggtccgacgaggcgaggagttcgcggagctgcagcggcagctggggctcccgggcagggttccagcgacgcccgacgacgacgaccggccgccgcggttccagctctgcaacaggaagctgtcggcgctgatgtccgcgcggaggaggtgcacctacgacgcctacttccccgtgttgtacgagtga

SEQ ID NO: 5004 - protein, 367 aa, Sorghum bicolor
  misc_feature: Ceres ANNOT ID no. 6040871
  misc_feature (54)..(303): Pfam Id: Epimerase Pfam Desc: NAD dependent epimerase/dehydratase family
  misc_feature (55)..(338): Pfam Id: 3Beta_HSD Pfam Desc: 3-beta hydroxysteroid dehydrogenase/isomerase family
  misc_feature (52)..(187): Pfam Id: adh_short Pfam Desc: short chain dehydrogenase
  misc_feature (1)..(367): NCBI GI: 115438789 NCBI Desc: os01g0639200 [oryza sativa (japonica cultivar-group)]
  misc_feature (147)..(367): NCBI GI: 55297607 NCBI Desc: cinnamoyl coa reductase-like [oryza sativa (japonica cultivar-group)]
  misc_feature (1)..(358): NCBI GI: 21553833 NCBI Desc: cinnamoyl coa reductase-like protein [arabidopsis thaliana]
  misc_feature (1)..(144): NCBI GI: 55297608 NCBI Desc: cinnamoyl coa reductase-like [oryza sativa (japonica cultivar-group)]
  misc_feature (55)..(356): NCBI GI: 7269948 NCBI Desc: cinnamoyl-coa reductase-like protein [arabidopsis thaliana]
MGVLRSTQSLEAEVEEMRAALLLHGAWAWRPGGGGAAKRAARAAEPAGAEARTVCVTGGTSFLGFAVVDCLLRHGYDVRLAIETQEDLDKLREMEMFGENGRDGVWTVIANVMDPESLHEAFDGCVGVFHTSSLVDPGGISGYTKHMARLEAKAAEQVVEACVRTESVRKCVLTSSLLACVWRQNYPHDRRFPTTIDENCWSDESFCRDNKLWLSLGKTMAEKAAWRAARGTDLKLVTICPALVTGPGFRRRNPTPSIAYLKGAHAMLAEGLLATANVERVAEAHVRVYEEMSGTAGGRYICYDHVVRRGEEFAELQRQLGLPGRVPATPDDDDRPPRFQLCNRKLSALMSARRRCTYDAYFPVLYE

SEQ ID NO: 5005 - DNA, 1614 bp, Sorghum bicolor
  misc_feature: Ceres ANNOT ID no. 6040872
  misc_feature: Encodes the peptide sequence at SEQ ID NO 5006
  misc_feature: Down-regulated in shoot tissues in response to salicylic acid treatment
atgatgctgaggctaaaaggtctcaccttccttctcctcctcgtcctctgctccagcgttcatcaatgcgaggcgaggagcggcaagaattggagttggaggcgaagcagcagcagagcaccgtccacctccgcgttcaggagaaaagggaaagcaaagagcagcagcagcggttcccacaagcagagcggcaaagggagtcgtcagagtccataccagcccagcccggccatcacacctgctagcccgagcggcgaccctgtgcagggcaatggaagccaggcggctcccgctccagcaatgccagcacctaacggcggcgggtatggatacccattgctgactccgccgccgttgcagccctcaccatcggcaacttcaccaccagcagcgccatcatcacaggatacagtcttcaacgtggtggactttggagctaagggtgatggagttactgatgatactcaggcctttgaagcagcatgggcagcagcatgcaaggtggaggcatctacagttctcgtaccatctgaacatgagtttgttgtgggcccaatctcattctctgggccttactgtaaaccaaatattctattccagctagatggaactattttagctcaaaccagtgcaagagtgtggggttccggtttgcttcaatggcttgagttcacaaagctaactggaatagcaatccaaggcagtggtgtcataaatggtagggggcaacaatggtggacatattcagatccaaatgatgatgacaacgacgacgcatactatgtggagctcgataagatgccacagattaaacctacggcactgaggttttatggtagttccaatgtcacggtaactgggataacgattgtcaacagctcccagtgccatctcaagttcgatagctgtcaaggagtcatggttcacgacttgaccatctcttcccctgagcatagtcccaacactgatggaatacacctgcaaaactccaaagaagtcagcattcaccacactaacctggcttgcggtgatgactgtgtttccatacagacaggatgcagtgatgtaaacatacataacgtgaactgcggaccagggcatggaatcagcattggtggtctaggaaggtacaacacaaaagcatgtgtatccaacatcaccgtaagagatgtgaaaatgttcagaacaatgactggtgtcagaatcaagacttggcagggtggttcagggctggtccaaggcataaggttctcaaacatacaggtttcagaagtccaaacaccgataataatagaccaattctactgcgacaaaacaacgtgcaggaaccagacatcagcggtggccgtttcaggcgttcagtacgagaacatcaggggcaccttcacgatcaaacctgcccacttcgcgtgcagcgacagctcgccttgttcggagatcactctcactgggatacaactcaagcccctgctagtgccacagtaccacctgtacaaccccttctgctggcaggcatttggagagctctacacccccaccgtgccccccatatcttgcttgcagatcggcaagccagcagggaacagcgtgctgtctgacggtgacctttgctga

SEQ ID NO: 5006 - protein, 537 aa, Sorghum bicolor
  misc_feature: Ceres ANNOT ID no. 6040872
  misc_feature (166)..(502): Pfam Id: Glyco_hydro_28 Pfam Desc: Glycosyl hydrolases family 28
  misc_feature (1)..(537): NCBI GI: 55297585 NCBI Desc: polygalacturonase pg1-like [oryza sativa (japonica cultivar-group)]
  misc_feature (228)..(537): NCBI GI: 115465629 NCBI Desc: os05g0578600 [oryza sativa (japonica cultivar-group)]
  misc_feature (201)..(537): NCBI GI: 55297593 NCBI Desc: polygalacturonase pg1-like [oryza sativa (japonica cultivar-group)]
  misc_feature (130)..(537): NCBI GI: 5669846 NCBI Desc: polygalacturonase pg1 [glycine max]
  misc_feature (137)..(526): NCBI GI: 5669848 NCBI Desc: polygalacturonase pg2 [glycine max]
  misc_feature: Useful for making plants with altered cell wall content and/or composition
  misc_feature: GREAT-hit functional homolog of the protein sequence encoded by LOCUS at1g60590
  misc_feature: Useful for making plants with altered carbohydrate content
  misc_feature: Functional homolog of the protein sequence given in SEQ ID NO 13896
  misc_feature: Useful for making plants with altered cell wall content and/or composition
  misc_feature: Functional homolog of the protein sequence given in SEQ ID NO 13897
  misc_feature: Down-regulated in shoot tissues in response to salicylic acid treatment
  misc_feature: The sequence is a functional homolog of SEQ ID NO. 450 in the 11/188,298 US application
MMLRLKGLTFLLLLVLCSSVHQCEARSGKNWSWRRSSSRAPSTSAFRRKGKAKSSSSGSHKQSGKGSRQSPYQPSPAITPASPSGDPVQGNGSQAAPAPAMPAPNGGGYGYPLLTPPPLQPSPSATSPPAAPSSQDTVFNVVDFGAKGDGVTDDTQAFEAAWAAACKVEASTVLVPSEHEFVVGPISFSGPYCKPNILFQLDGTILAQTSARVWGSGLLQWLEFTKLTGIAIQGSGVINGRGQQWWTYSDPNDDDNDDAYYVELDKMPQIKPTALRFYGSSNVTVTGITIVNSSQCHLKFDSCQGVMVHDLTISSPEHSPNTDGIHLQNSKEVSIHHTNLACGDDCVSIQTGCSDVNIHNVNCGPGHGISIGGLGRYNTKACVSNITVRDVKMFRTMTGVRIKTWQGGSGLVQGIRFSNIQVSEVQTPIIIDQFYCDKTTCRNQTSAVAVSGVQYENIRGTFTIKPAHFACSDSSPCSEITLTGIQLKPLLVPQYHLYNPFCWQAFGELYTPTVPPISCLQIGKPAGNSVLSDGDLC

SEQ ID NO: 5007 - DNA, 1524 bp, Sorghum bicolor
  misc_feature: Ceres ANNOT ID no. 6040876
  misc_feature: Encodes the peptide sequence at SEQ ID NO 5008
atgagctttcgggaccaggagagtggcggggaggatgcgggcaggacgtcctccgcgtccgacctgcggaagccgctcctgaacaccgggagctggtaccgcatgccgccgccgggcggcatgatgggctcgcggcagtcgagcctcatggagcgcctaggctcctctgccttctccctccgagacgttgctatctcggcgacgctctgcacgctcattgtggctctaggtcctatccagttcggtttcacctgcggttactcctctcccacgcaggacgccatcattgctgacctcggcctctcactctccgagttctctctgttcggatcgttatcaaatgtaggggcgatggtaggtgccatctccagtgggcaacttgcagagtatatcggccgcaaggggtctctcatgattgctgcaattccaaacataattgggtggcttgcgatatcatttgcaaaagattcctcattcttgtttatgggccggctgctagaaggatttggagtgggtgtaatatcttatacagtaccggtttatattgcagaaatcgctcctcaggatcagaggggagctcttggttctgtcaatcagctctccgtcacagttggtatattgcttgcctacctgtttggcatgtttgttccctggagaattcttgctgttctaggcattttaccttgttcaatcctgattcctggactgttctttgtccctgaatccccaaggtggctggcaaaaatggggaagatggaggattttgaatattcactgcaagttctgcgaggatttcagacggacattacagcagaagtaaatgaaataaagagatcagtagcatcatcaaggaggaggacaaccgccataaggtttgctgatatcaagcagaagagatacagtgttccccttgcgataggaatcggtctccttgtcctgcagcagctaagtggtgtcaatggcattctattttatgctgggagcatcttcaaagctgctggtattacaaacagtaatctagcaacctttggtttgggggctgttcaggtgattgctactggagtgacaacctggttgactgacaaagctggtcgaaggcttcttctcattatttctaccacaggaatggtcattactcttgtcattgtttctgtgtcattttttgtgaaggacaacataactgccggttctcacttatactctgcaatgagtatgctttcactggctggacttgtggcatttgtgattgcattttctcttggcttgggagcaattccatgggtcattatgtctgagattcttcctgttaacattaagagccttgctggaagtgttgcaacccttgcgaactggctaacagcatgggccattacaatgactgcaagcctaatgttaaactggagcaatggaggaacctttgctatctatgccgctgtgtctgccatggccctcattttcgtgtgtttgtgggtgccggagaccaagggaagaacattagaggaaatcgcattctcattccgctga

SEQ ID NO: 5008 - protein, 507 aa, Sorghum bicolor
  misc_feature: Ceres ANNOT ID no. 6040876
  misc_feature (70)..(506): Pfam Id: Sugar_tr Pfam Desc: Sugar (and other) transporter
  misc_feature (72)..(461): Pfam Id: MFS_1 Pfam Desc: Major Facilitator Superfamily
  misc_feature (1)..(507): NCBI GI: 5091611 NCBI Desc: 10a19i.3 [oryza sativa (japonica cultivar-group)]
  misc_feature (1)..(507): NCBI GI: 126635783 NCBI Desc: sugar transporter protein [ananas comosus]
  misc_feature (8)..(507): NCBI GI: 1209756 NCBI Desc: integral membrane protein [beta vulgaris]
  misc_feature (12)..(246): NCBI GI: 8778437 NCBI Desc: f18o14.22 [arabidopsis thaliana]
  misc_feature (17)..(505): NCBI GI: 124360168 NCBI Desc: general substrate transporter [medicago truncatula]
  misc_feature: The plant produces a reduced number of seeds.
  misc_feature: Useful for biocontainment applications
  misc_feature: GREAT-hit functional homolog of the protein sequence given in SEQ ID NO 13576
  misc_feature: Useful for biocontainment applications
  misc_feature: Functional homolog of the protein sequence given in SEQ ID NO 13576
  misc_feature: The sequence is a functional homolog of SEQ ID NO. 488 in the 11/188,298 US application
  misc_feature: The sequence is a functional homolog of SEQ ID NO. 449 in the 11/188,298 US application
  misc_feature: The sequence is a functional homolog of SEQ ID NO. 331 in the 11/188,298 US application
  misc_feature: The sequence is a functional homolog of SEQ ID NO. 296 in the 11/188,298 US application
MSFRDQESGGEDAGRTSSASDLRKPLLNTGSWYRMPPPGGMMGSRQSSLMERLGSSAFSLRDVAISATLCTLIVALGPIQFGFTCGYSSPTQDAIIADLGLSLSEFSLFGSLSNVGAMVGAISSGQLAEYIGRKGSLMIAAIPNIIGWLAISFAKDSSFLFMGRLLEGFGVGVISYTVPVYIAEIAPQDQRGALGSVNQLSVTVGILLAYLFGMFVPWRILAVLGILPCSILIPGLFFVPESPRWLAKMGKMEDFEYSLQVLRGFQTDITAEVNEIKRSVASSRRRTTAIRFADIKQKRYSVPLAIGIGLLVLQQLSGVNGILFYAGSIFKAAGITNSNLATFGLGAVQVIATGVTTWLTDKAGRRLLLIISTTGMVITLVIVSVSFFVKDNITAGSHLYSAMSMLSLAGLVAFVIAFSLGLGAIPWVIMSEILPVNIKSLAGSVATLANWLTAWAITMTASLMLNWSNGGTFAIYAAVSAMALIFVCLWVPETKGRTLEEIAFSFR

SEQ ID NO: 5009 - DNA, 330 bp, Sorghum bicolor
  misc_feature: Ceres ANNOT ID no. 6040882
  misc_feature: Encodes the peptide sequence at SEQ ID NO 5010
atggcttccggcgggtcgtcgtcgtcgtcgtcccgggcgtggacgcagcggcagaacaagcagttcgagtgcgcgctggcggtgtatgaccgggagacaccggaccggtggcacaacatcgcccgctacatgggcggcaccaagtccgccgacgaggtgcgccgccacttcgagcagctcgtccacgacgtcacccagatcgaggccggccgcgtccccttcccccgctacggctacggcagcgcgccgcccgccggcggcggcggccttgacgacaccaggggaatacccctggcgccgcccatgcatacgggcgaggctttcacctag

SEQ ID NO: 5010 - protein, 109 aa, Sorghum bicolor
  misc_feature: Ceres ANNOT ID no. 6040882
  misc_feature (11)..(61): Pfam Id: Myb_DNA-binding Pfam Desc: Myb-like DNA-binding domain
  misc_feature (7)..(90): NCBI GI: 110931770 NCBI Desc: myb transcription factor myb164 [glycine max]
  misc_feature (1)..(77): NCBI GI: 38566494 NCBI Desc: at4g36570 [arabidopsis thaliana]
  misc_feature (1)..(77): NCBI GI: 115438765 NCBI Desc: os01g0635200 [oryza sativa (japonica cultivar-group)]
  misc_feature (1)..(77): NCBI GI: 145356202 NCBI Desc: dna binding / transcription factor [arabidopsis thaliana]
  misc_feature (3)..(77): NCBI GI: 112292446 NCBI Desc: atrl1 [arabidopsis thaliana]
  misc_feature: Useful for making plants with altered Lignin content
  misc_feature: Useful for making plants with modulated low light sensitivity
  misc_feature: Functional homolog of the protein sequence given in SEQ ID NO 12938
  misc_feature: Useful for making plants with altered lignin content
  misc_feature: Functional homolog of the protein sequence given in SEQ ID NO 13095
  misc_feature: Useful for making plants with modulated low light sensitivity
  misc_feature: Functional homolog of the protein sequence given in SEQ ID NO 12938
  misc_feature: Useful for making plants with modulated flowering time
  misc_feature: Functional homolog of the protein sequence given in SEQ ID NO 13566
  misc_feature: The sequence is a functional homolog of SEQ ID NO 976 in the 11/435,388 US patent application
  misc_feature: The sequence is a functional homolog of SEQ ID NO 1973 in the 11/479,226 US patent application
  misc_feature: The sequence is a functional homolog of SEQ ID NO 880 in the 11/435,388 US patent application
  misc_feature: The sequence is a functional homolog of SEQ ID NO 2720 in the 10/374,780 US patent application
  misc_feature: The sequence is a functional homolog of SEQ ID NO 360 in the 10/225,066 US patent application
  misc_feature: The sequence is a functional homolog of SEQ ID NO 876 in the 11/435,388 US patent application
  misc_feature: Useful for making plants with modulated nitrogen use efficiency
  misc_feature: The sequence is a functional homolog of SEQ ID NO 1404 in the 11/479,226 US patent application
  misc_feature: The sequence is a functional homolog of SEQ ID NO 662 in the 10/412,699 US patent application
  misc_feature: The sequence is a functional homolog of SEQ ID NO 944 in the 11/435,388 US patent application
  misc_feature: The sequence is a functional homolog of SEQ ID NO 510 in the 10/666,642 US patent application
  misc_feature: The sequence is a functional homolog of SEQ ID NO 120 in the 11/375,241 US patent application
  misc_feature: The sequence is a functional homolog of SEQ ID NO 2680 in the 10/374,780 US patent application
  misc_feature: The sequence is a functional homolog of SEQ ID NO 654 in the 10/225,066 US patent application
MASGGSSSSSSRAWTQRQNKQFECALAVYDRETPDRWHNIARYMGGTKSADEVRRHFEQLVHDVTQIEAGRVPFPRYGYGSAPPAGGGGLDDTRGIPLAPPMHTGEAFT

SEQ ID NO: 5011 - DNA, 1560 bp, Sorghum bicolor
  misc_feature: Ceres ANNOT ID no. 6040886
  misc_feature: Encodes the peptide sequence at SEQ ID NO 5012
  misc_feature: Up-regulated in root tissues in response to methyl jasmonate treatment
  misc_feature: Up-regulated in shoot tissues in response to methyl jasmonate treatment
  misc_feature: Up-regulated in shoot tissues in response to salicylic acid treatment
atgcagttcagcagcgtgtttcccctagagggaaaagcatgtatgagcccagtgaggagaggcggtgaaggcgcttggagtgagagggtgaggattgggaactcctgcagcatcaggcgcaacaaggcattgaggaggatgtgttttggtgcaaggggtgctgtgagcagcgctcagtgcgtgctcacatcagatgctggcccagacactcttgtcgtccgaacatcctttcggaggaattatgctgatcctaacgaagttgccgccgttattttgggtggtggtactgggactcagcttttccctctcacaagcacaagggccactcctgctgttcctattggaggatgttacaggcttattgatatccccatgagcaactgtttcaacagtggcataaacaagatattcgtcatgactcagttcaactcagcttctcttaaccgtcacattcaccgtacgtatcttggtgggggaatcaacttcactgatggatctgttgaggtgctggctgcaacacaaatgcctggggaggctgctggttggttccagggcacagcagatgctgttagaaaatttatctgggtacttgaggattattacaagcataaagctatagagcacattttgattttgtcaggagatcagctctatcgtatggattacatggagcttgtgcagaaacatgtagatgacaacgcagacattactttatcgtgcgctcctgttggagagagtcgagcatctgactatggattagtcaagttcgacagttcaggccgtgtaattcagttctctgagaaaccaaagggggctgccttggaagaaatgaaagtggataccagctttcttaatttcgccattgacgacccaactaaatatccctatattgcttcaatgggagtttacgtttttaagagagatgttcttttagaccttctaaagtcaaggtatgctgaactgcatgactttggttctgaaattctgcccaaagctttacatgagcacaatgtacaggcgtatgtcttcactgactactgggaggacattggaacaatcagatcattctttgatgcaaacatggccctctgcgagcagcctccaaagtttgagttttatgatccgaaaacaccattcttcacttcccctcggtacttgccaccaacgaagtcggataagtgcaggattaaagacgcgatcatttcgcatggctgcttcttgcgtgaatgtgccattgagcattctattgtcggtgttcgttcacgcctaaactctggatgcgagctcaagaacaccatgatgatgggtgcggatttgtatgagactgaagacgagatttcacggctactatcagagggcaaggtgcccattggggtaggggagaatacaaagataagcaactgcatcatcgacatgaacgcgagggtcggaagaaacgtctctataacaaacaccgagggcgtccaagaagctgaccggccggagctaggatactacatcaggtctgggatcgtggtgatcctgaagaacgcaaccatcaaggacggcaccgtcatatag

SEQ ID NO: 5012 - protein, 519 aa, Sorghum bicolor
  misc_feature: Ceres ANNOT ID no. 6040886
  misc_feature (88)..(366): Pfam Id: NTP_transferase Pfam Desc: Nucleotidyl transferase
  misc_feature (1)..(519): NCBI GI: 115465649 NCBI Desc: os05g0580000 [oryza sativa (japonica cultivar-group)]
  misc_feature (1)..(519): NCBI GI: 2627058 NCBI Desc: adp glucose pyrophosphorylase large subunit [oryza sativa (japonica cultivar-group)]
  misc_feature (1)..(519): NCBI GI: 5091608 NCBI Desc: 10a19i.12 [oryza sativa (japonica cultivar-group)]
  misc_feature (1)..(519): NCBI GI: 995746 NCBI Desc: adp-glucose pyrophosphorylase large subunit [triticum aestivum]
  misc_feature (1)..(519): NCBI GI: 1707923 NCBI Desc: glucose-1-phosphate adenylyltransferase large subunit 1, chloroplast precursor (adp-glucose synthase) (adp-glucose pyrophosphorylase) (agpase s) (alpha-d-glucose-1-phosphate adenyl
  misc_feature (1)..(519): NCBI GI: 1707923 (continued) transferase) (bepl)
  misc_feature (1)..(519): SWISSPROT Homolog: EC 2.7.7.27 Glucose-1-phosphate adenylyltransferase large subunit, chloroplastprecursor
  misc_feature: The sequence is a functional homolog of SEQ ID NO 38 in US patent 7312378
  misc_feature: The sequence is a functional homolog of SEQ ID NO 37 in US patent 7312378
  misc_feature: The sequence is a functional homolog of SEQ ID NO 39 in US patent 7312378
  misc_feature: Up-regulated in root tissues in response to methyl jasmonate treatment
  misc_feature: Up-regulated in shoot tissues in response to methyl jasmonate treatment
  misc_feature: Up-regulated in shoot tissues in response to salicylic acid treatment
  misc_feature: The sequence is a functional homolog of SEQ ID NO. 451 in the 11/188,298 US application
MQFSSVFPLEGKACMSPVRRGGEGAWSERVRIGNSCSIRRNKALRRMCFGARGAVSSAQCVLTSDAGPDTLVVRTSFRRNYADPNEVAAVILGGGTGTQLFPLTSTRATPAVPIGGCYRLIDIPMSNCFNSGINKIFVMTQFNSASLNRHIHRTYLGGGINFTDGSVEVLAATQMPGEAAGWFQGTADAVRKFIWVLEDYYKHKAIEHILILSGDQLYRMDYMELVQKHVDDNADITLSCAPVGESRASDYGLVKFDSSGRVIQFSEKPKGAALEEMKVDTSFLNFAIDDPTKYPYIASMGVYVFKRDVLLDLLKSRYAELHDFGSEILPKALHEHNVQAYVFTDYWEDIGTIRSFFDANMALCEQPPKFEFYDPKTPFFTSPRYLPPTKSDKCRIKDAIISHGCFLRECAIEHSIVGVRSRLNSGCELKNTMMMGADLYETEDEISRLLSEGKVPIGVGENTKISNCIIDMNARVGRNVSITNTEGVQEADRPELGYYIRSGIVVILKNATIKDGTVI

SEQ ID NO: 5013 - DNA, 951 bp, Sorghum bicolor
  misc_feature: Ceres ANNOT ID no. 6040901
  misc_feature: Encodes the peptide sequence at SEQ ID NO 5014
atggaggctccgctcctcctccccgtctccaccgcccccgctgcctcatcctgcgtcgatatcatcaccgccgacgccgcgccgtcgggccctccggcgccctcctcctcctcctcctcctccccttccaccaagagcatcgtgctccgcgtggcggttgtgatcaccgtggcgtgcgcgtccctgttcgcgcagcacgaggccggcaagggcttcgccgtcgccgtcgcgaacgacgcgccgcgtggcagcgccacggcgcggcggttcgacctgctgttcgtgtccaacggccgcgccgagcgcgccctcctgcacgccagccgcggcgtggagcgcgcgctattcccggacccgtcgttcccgcgcaggccggtccgccgcgtcaccgtccggatggccggccacaacctcaccgcgggcgccacggtgcacgccgcggcgcccggggagtacgtcgtcaccctgagccccagcctcgtcgcgtcgacctcggccggcacacgccgcacgacgcacgtggccaccgcgatgcgccgcgccgtggcgcgcatgtggctatgggacggccacggcgccgcacccgcgcgcgtcaccgagtccatggtcgagtacctcgcgtccgtcgcggcggccggcgacggcaccggggacgaggcggcggcaacacctctgtctgccgtggacgaccacgggtgcagcatgtcggcgcggctcctgaggcacctggaggcgcggcgcgagggcttcgtggcgcggctgaaccgcgcgatgaaggaccggtggagcgacgccgccgtggacgcggcactcggcgcgccggtccggctcgcctgccaccacgcggctgcgacgacgacgacgccattgaccgggcaggacgacgaccccaccgccgcgctggccggctccacgtcggacgccgccggtgggtccagcgtggcaatatga

SEQ ID NO: 5014 - protein, 316 aa, Sorghum bicolor
  misc_feature: Ceres ANNOT ID no. 6040901
  misc_feature (69)..(282): Pfam Id: BSP Pfam Desc: Plant Basic Secretory Protein
  misc_feature (42)..(279): NCBI GI: 140063131 NCBI Desc: plant basic secretory protein [medicago truncatula]
  misc_feature (10)..(315): NCBI GI: 90102218 NCBI Desc: antifreeze glycoprotein [boreogadus saida]
MEAPLLLPVSTAPAASSCVDIITADAAPSGPPAPSSSSSSSPSTKSIVLRVAVVITVACASLFAQHEAGKGFAVAVANDAPRGSATARRFDLLFVSNGRAERALLHASRGVERALFPDPSFPRRPVRRVTVRMAGHNLTAGATVHAAAPGEYVVTLSPSLVASTSAGTRRTTHVATAMRRAVARMWLWDGHGAAPARVTESMVEYLASVAAAGDGTGDEAAATPLSAVDDHGCSMSARLLRHLEARREGFVARLNRAMKDRWSDAAVDAALGAPVRLACHHAAATTTTPLTGQDDDPTAALAGSTSDAAGGSSVAI

SEQ ID NO: 5015 - DNA, 1221 bp, Sorghum bicolor
  misc_feature: Ceres ANNOT ID no. 6040905
  misc_feature: Encodes the peptide sequence at SEQ ID NO 5016
atgctgtctctgagctgcccaggggtgtcgtccatgagcaagacggcgctcgatttggggcagctggtggccccctgccgcagccgctgtaccggcgcgtgggcgtcgcccagacggcggcgcacgccatgtgtttgcttcgttgcctcactggccaccgcccagcctggaactgcggctgttgatgtgccggcacggacgattcctgctgtgacaacagcaagcgcccctgcccctgaacgcacttctgtttcttcgctgctcgaggttgtctcggacgacttgctcaacctcaacaacaatctcaaatcgcttgttggtgcagaaaatccagttttagtttctgcagcagaacaaattttcggtgctggtggaaagagattaagaccagcattagtttttctggtgtccagagcaactgctgaattagctgctttgtcggagctaactactgaacatcagcgcttggctgagatcatagagatgattcatactgcaagtctaatacatgatgatgtcatagacgatagtgggatgcgaagaggaaaagaaacaatccaccagctctatggcacacgggtggctgtgctcgctggcgattttatgtttgcacagtcttcttggtttcttgcaaacctagaaaacattgaagtcatcaagctcatcagccaggtaatcaaggatttcgctagtggtgagataaagcaagcatcaacacttttcgactgcgacgtcacgctcgacgattatctgctgaagagctattacaagaccgcttctctgatcgcggcaagcacaaggtctgccgccatattcagcggcatggacaccaccatctgcgagcagatgtacgaatacggcaggaacctggggctctccttccaggtcgtggacgacatcctcgacttcacccagtcagcggagcagctcgggaagccagcggggagtgacctggcgaaaggaaacctgacggctccggtgatcttcgcgctgcaagacgagccacggctgcgggagatcatcgactctgagttcagcgagccgggatccctggcggccgcggtcgagctcgtccaccggagcggcggtatcaggagagctcaggagctcgctgaggagaaaggcgcgctggcgattcagagcctgcagtgccttccgaggagcgagttcagaagcgccctcgagagggtggtgcactacaatctccagcggattcagtag

SEQ ID NO: 5016 - protein, 406 aa, Sorghum bicolor
  misc_feature: Ceres ANNOT ID no. 6040905
  misc_feature (113)..(372): Pfam Id: polyprenyl_synt Pfam Desc: Polyprenyl synthetase
  misc_feature (35)..(405): NCBI GI: 115488130 NCBI Desc: os12g0271700 [oryza sativa (japonica cultivar-group)]
  misc_feature (1)..(405): NCBI GI: 90200410 NCBI Desc: solanesyl diphosphate synthase [hevea brasiliensis]
  misc_feature (83)..(405): NCBI GI: 5734760 NCBI Desc: very similar to prenyl transferase [arabidopsis thaliana]
  misc_feature (83)..(406): NCBI GI: 114324644 NCBI Desc: solanesyl diphosphate synthase [lycopersicon esculentum]
  misc_feature (83)..(405): NCBI GI: 4836881 NCBI Desc: very similar to prenyltransferases [arabidopsis thaliana]
MLSLSCPGVSSMSKTALDLGQLVAPCRSRCTGAWASPRRRRTPCVCFVASLATAQPGTAAVDVPARTIPAVTTASAPAPERTSVSSLLEVVSDDLLNLNNNLKSLVGAENPVLVSAAEQIFGAGGKRLRPALVFLVSRATAELAALSELTTEHQRLAEIIEMIHTASLIHDDVIDDSGMRRGKETIHQLYGTRVAVLAGDFMFAQSSWFLANLENIEVIKLISQVIKDFASGEIKQASTLFDCDVTLDDYLLKSYYKTASLIAASTRSAAIFSGMDTTICEQMYEYGRNLGLSFQVVDDILDFTQSAEQLGKPAGSDLAKGNLTAPVIFALQDEPRLREIIDSEFSEPGSLAAAVELVHRSGGIRRAQELAEEKGALAIQSLQCLPRSEFRSALERVVHYNLQRIQ

SEQ ID NO: 5017 - DNA, 3075 bp, Sorghum bicolor
  misc_feature: Ceres ANNOT ID no. 6040907
  misc_feature: Encodes the peptide sequence at SEQ ID NO 5018
atgaggaagaaggtggacgagcgcatccgcacgctgatcgagaacggcgtgcggcagcggcagcgctccatgttcgtcatcgtcggagacaagtcgcgggaccagatcgtcaacctcaactacatgctcaccaagtcccgcgtcaagtcgcgcccctccgtcctctggtgctaccgcgacaagctcgagatcagcagccacaagaagaagcgcggcaagcagatcaagaagctcatgcagcggggtctcctggaccctgagaaggccgacccgttctccctcttcatggagacctcagacattacgtactgcctctacagagactctgagcgggtccttggtaacacattcggcatgtgcatactgcaggactttgaggcgctgacgcctaaccttcttgcacggaccattgagacagttgagggtggtggtttgataatcctgctgctccgctcactgtcttcgctaaccagcctctatacaatggtcatggatgtccatgaaagatttcgaacagagtctcatactcaagcggccgcgaggttcaatgagaggttcttgctgtctatagcatcatgcaaagcatgtgttgtgatggatgatgaacttaacattttgccgatatcatctcacatgaaattcatacaaccagttacaaacaatgaggattctgagggattgtcgaaacgggagagggagttgaaagacctcaaggatcaatttcgtgaagactttcccgttggtcctttaattggaaagtgctgcacaatggatcagggtaaagctgtcatcaactttcttgactctattttggataagtccctgaggagtacggttgctttgcttgctgcacgcggacgtggtaaatcagcagcccttggtcttgccattgctggagccgtagcagctgggtattcaaatatattcgtcaccgccccaagtccagagaacttaaaaactctgtttgactttgtgtgcaagggaataaatgcattggagtacaaggagcatttgcattatgatgtggtgaagagtgctgatccagaactgaagaaagcaacagttcaaataaatgtctataagcaacatcgtcagacaatccagtatctgagaccacatgatcatggaaagctttctcaagttgaactccttgttatcgatgaagctgctgctattccattgccaattgttaagtccatgcttggtccatacctagttttcctctcttccactgtcaatgggtacgaaggtacaggtcgatcattgtctctgaagcttcttcagcaactagaatcccaaagccagccatctgctcaatctaatggatctaattccagtaggctctttaagaaaattgaattgaccgaatctattagatatgcctctggtgaccctattgagacctggcttaatgacttgctttgtttggaccttgcaaactccattccaaatatcagcaggctacctcacccaaaagaatgtgatctgtattatgtcaaccgggacacacttttctcatatcacaaggagagcgagatatttttacagcggatgatggcactttatgttgcttcccactacaaaaattcgcctaatgacttgcagttaatggcggatgcaccagcacatcatttatttgtattgcttggccctgttgatgagtccaaaaaccagctccctgatatcctgtgtgtaatccaggtttgcttggaaggacaaatatctcgaaagtcagctatgaaaagcctaagtgagggccgttcaccttccggcgatcaaataccatggaaattttgtgaacagttccaagataatgtatttccaagtctctcaggagctcgtatagtgcgaattgctgtccatcctagcgccttgaggcttgggtatggttcagctgccgtggatcttctaacaaggtactatgaaggggaaatgataaactttgatgacgatgaggaggaaacagaagagcctgaagtgaacattactgaagctgcagagaaggcttcactgctagaagagaacataaaacctagagcaaatcttccgccactccttgttcatcttcgtgatcgtcgtcgtgagaagctccattatcttggtgtatcttttggactaacacaagagcttttccgcttttggcggaagcacaacttctatccgttctatgttggccagattccaagtgctgttactggtgagcatacttgtatggtgttgaggcccttaaatagtgatgacattgaagttagcgagtcaaacaaatgtggatttttggatccgttttatcaagatttcagacaaagattcaggcggcttttgggaacttctttccggcatctcaattttaagctttcaatgagcgtcttggcttcgaagattgattactcaaaccatgagccttcagaatatgataataatagtacttcaaagttattgggagacatgttgtcaccacatgacatgaaacggctagaagcatattcaaacaatttagtcgattatcatctgattctggaccttgtacccatccttgcacaccagtatttttcggagaggcttccagtgtcattgcatggtgcccaagcagctgttttgttctgtatgggtctgcaggacaaagacataggcactgtaaaggaagaactcgggatagaaagggaacaggttctatcaaacttcatcaagacaatgaagaagttgtatggttatcttcataacattgcaggaaaagaaattgaagcaaccttacctcgactgaaagagattgaaatggccccacttagcaaatcaatggatgaggaccttgcagaagcagccaaggaagttgaggaacagagaagagccgcaaatgaagctcctgtggacccaaagattctgcagaaatatgcaattggtgacgacaacgagatcgagaaggccctgcagaacaccaaggtgtctgcaagcggcatcatcagcgtgaagtccaacaaaacaaaggcagacaagaaagagaagcacaaggaatcaggcaaatcgaaaagaaaaggaacagacggtggcagatccgagtcgaaaaagaagaggtcttaa

SEQ ID NO: 5018 - protein, 1024 aa, Sorghum bicolor
  misc_feature: Ceres ANNOT ID no. 6040907
  misc_feature (1)..(1023): NCBI GI: 92885189 NCBI Desc: dead/deah box helicase, n-terminal [medicago truncatula]
  misc_feature (367)..(1024): NCBI GI: 77553763 NCBI Desc: ai429152 protein [oryza sativa (japonica cultivar-group)]
  misc_feature (2)..(1023): NCBI GI: 12697963 NCBI Desc: kiaa1709 protein [homo sapiens]
  misc_feature (2)..(478): NCBI GI: 44986376 NCBI Desc: agr346cp [eremothecium gossypii]
  misc_feature (2)..(478): NCBI GI: 45201442 NCBI Desc: agr346cp [eremothecium gossypii]
MRKKVDERIRTLIENGVRQRQRSMFVIVGDKSRDQIVNLNYMLTKSRVKSRPSVLWCYRDKLEISSHKKKRGKQIKKLMQRGLLDPEKADPFSLFMETSDITYCLYRDSERVLGNTFGMCILQDFEALTPNLLARTIETVEGGGLIILLLRSLSSLTSLYTMVMDVHERFRTESHTQAAARFNERFLLSIASCKACVVMDDELNILPISSHMKFIQPVTNNEDSEGLSKRERELKDLKDQFREDFPVGPLIGKCCTMDQGKAVINFLDSILDKSLRSTVALLAARGRGKSAALGLAIAGAVAAGYSNIFVTAPSPENLKTLFDFVCKGINALEYKEHLHYDVVKSADPELKKATVQINVYKQHRQTIQYLRPHDHGKLSQVELLVIDEAAAIPLPIVKSMLGPYLVFLSSTVNGYEGTGRSLSLKLLQQLESQSQPSAQSNGSNSSRLFKKIELTESIRYASGDPIETWLNDLLCLDLANSIPNISRLPHPKECDLYYVNRDTLFSYHKESEIFLQRMMALYVASHYKNSPNDLQLMADAPAHHLFVLLGPVDESKNQLPDILCVIQVCLEGQISRKSAMKSLSEGRSPSGDQIPWKFCEQFQDNVFPSLSGARIVRIAVHPSALRLGYGSAAVDLLTRYYEGEMINFDDDEEETEEPEVNITEAAEKASLLEENIKPRANLPPLLVHLRDRRREKLHYLGVSFGLTQELFRFWRKHNFYPFYVGQIPSAVTGEHTCMVLRPLNSDDIEVSESNKCGFLDPFYQDFRQRFRRLLGTSFRHLNFKLSMSVLASKIDYSNHEPSEYDNNSTSKLLGDMLSPHDMKRLEAYSNNLVDYHLILDLVPILAHQYFSERLPVSLHGAQAAVLFCMGLQDKDIGTVKEELGIEREQVLSNFIKTMKKLYGYLHNIAGKEIEATLPRLKEIEMAPLSKSMDEDLAEAAKEVEEQRRAANEAPVDPKILQKYAIGDDNEIEKALQNTKVSASGIISVKSNKTKADKKEKHKESGKSKRKGTDGGRSESKKKRS

SEQ ID NO: 5019 - DNA, 1623 bp, Sorghum bicolor
  misc_feature: Ceres ANNOT ID no. 6040909
  misc_feature: Encodes the peptide sequence at SEQ ID NO 5020
atggaggtcttcggccccgtcacgcccggacaggtgtcatttttgctaggtctattccctgtcctcatcgcatggatctactctgaaatcctcgaatacaagaaatctttgtctcatgggaaagttcattcagacactaatttggataatggaaccatcaaggaggatgacaagtcagtattacttgaaggaggacagttgaaatcaccatctacaaagttcaggaatttgtctaccaaagcaaatttgttacggtttataactatggacgagtcttttctgcttgaaaaccgtgctgtactgagagccatggctgaatttggcgttgtcctggtttatttttacatttgtgaccggacaaacatatttccagaaagcaagaagagctacaaccgtgatctgtttctgtttctgtacattcttctcatcatagcatcagcgcttacttcacttaagaagcatcatgaaaaatcagcattttcaggaaagtccatactctatcttaatcgtcaccagactgaggaatggaaagggtggatgcaggtcttatttctgatgtaccattattttgctgctactgagatatacaatgcaatccgtgtgttcattgcttgctatgtctggatgactggatttgggaatttctcatattactatatcaagaaagattttagcattgcaagatttgctcagatgatgtggaggctaaatttctttgtggcattctgttgcattgtccttgacaatgatctcatgctttattatatctgcccaatgcacaccctatttactcttatggtatatggatcacttggtctatttaacaaatacaatgagataccatcaatcatggctattaagattgcttgctgcttcctgtctgtaattttgatatgggaaattcctggggtatttgaactattgtgggccccctttacatttctgctaggctataaagatccatccccatccaaggcacacttacccctgctacatgagtggcatttccgatctggcctcgatcgatacatatggattgttggaatgatttatgcttacttccatcctaatgttgaaagatggatggagaagctggaagaatctgagactaaggttagattatcaatcaagggaaccattgtcactctttcgttgacggctggttttctgtggtacgaatatatatacaagctagacaaagttacatacaacaagtaccatccctacacgtcatggatccctataactgtttatatctgcctgcgtaattgcacccagcagttgaggagtgcctctttggctctttttgcatggcttggcaagattacactagagacttatatttctcagatccatatttggcttaggtctaacatgccaaatggacagccaaaatggcttctttgtttcataccagattatcctatgcttaacttcatgcttactacggcgatctatcttcttctatcataccgtgtgtttgagatcacaagcgtcttgagggcggcctttatccccagtagggataatagccgtctataccaaaatttcattgctgggatcgccatctcagtgtgcttgtatctctgctcacttattctcctgaagattcctgttgtatag

SEQ ID NO: 5020 - protein, 540 aa, Sorghum bicolor
  misc_feature: Ceres ANNOT ID no. 6040909
  misc_feature (113)..(352): Pfam Id: Cas1p Pfam Desc: Cas1p-like protein
  misc_feature (1)..(540): NCBI GI: 55297065 NCBI Desc: o-acetyltransferase-like [oryza sativa (japonica cultivar-group)]
  misc_feature (5)..(537): NCBI GI: 15983464 NCBI Desc: at5g46340/mpl12_14 [arabidopsis thaliana]
  misc_feature (85)..(538): NCBI GI: 42562402 NCBI Desc: acetyltransferase-related [arabidopsis thaliana]
  misc_feature (100)..(535): NCBI GI: 17016934 NCBI Desc: o-acetyltransferase [homo sapiens]
  misc_feature (100)..(535): NCBI GI: 51094891 NCBI Desc: o-acetyltransferase [homo sapiens]
MEVFGPVTPGQVSFLLGLFPVLIAWIYSEILEYKKSLSHGKVHSDTNLDNGTIKEDDKSVLLEGGQLKSPSTKFRNLSTKANLLRFITMDESFLLENRAVLRAMAEFGVVLVYFYICDRTNIFPESKKSYNRDLFLFLYILLIIASALTSLKKHHEKSAFSGKSILYLNRHQTEEWKGWMQVLFLMYHYFAATEIYNAIRVFIACYVWMTGFGNFSYYYIKKDFSIARFAQMMWRLNFFVAFCCIVLDNDLMLYYICPMHTLFTLMVYGSLGLFNKYNEIPSIMAIKIACCFLSVILIWEIPGVFELLWAPFTFLLGYKDPSPSKAHLPLLHEWHFRSGLDRYIWIVGMIYAYFHPNVERWMEKLEESETKVRLSIKGTIVTLSLTAGFLWYEYIYKLDKVTYNKYHPYTSWIPITVYICLRNCTQQLRSASLALFAWLGKITLETYISQIHIWLRSNMPNGQPKWLLCFIPDYPMLNFMLTTAIYLLLSYRVFEITSVLRAAFIPSRDNSRLYQNFIAGIAISVCLYLCSLILLKIPVV

SEQ ID NO: 5021 - DNA, 882 bp, Sorghum bicolor
  misc_feature: Ceres ANNOT ID no. 6040912
  misc_feature: Encodes the peptide sequence at SEQ ID NO 5022
atgatgggaggctggggggtttcggatgggtacgagggatcaaagaggacacgaatgatgatggaatcgaatccctacttcgcagtgaatgcagggagtccattggatgtctcaaagagggccaggatgatggaaccaggtgctccctattttggggctgtgggaagcaacactggtggtgcgagcggaagcttctaccagccctttaacagcaacttagctggtgcaggggttagcactggtatccaaagctttccaggtgtccggctgcgaggtctcccttttgattgcaccgacattgacatctgcaagttctttgtggggctggacatagtggattgcctcctggttaacaagaatgggcgctttaccggtgaggcgtttgtggtcttcccaacagccatgcaagcagaatttgcgctgcatcgcaacaagcagaacatgggccggaggtacattgaggtgttcagatgcaagaagcaggaatattattgcgcaatagccagtgaggtgaaccagggtggttactttgagccggagtaccgccgctccccacctcctccaaggcctaagaagccgtctgaagacaagggcagcatggagtatacagaggttctgaggctccgtgggcttccctactctgccaccactgaggacatcatcaagttcttccaggagtacgagctgactgaggagaatgtgcacattgggtaccgctcagatgggaaggctacgggtgaagcctttgttgagttcccaacagctgaagttgcaaagacggccatgtgcaaggataaaatgaccatgtggactaggtatgtggagctgttcccgtcaaccccagaggaggccagcagggcaaaatcccgaggcaggcattga

SEQ ID NO: 5022 - protein, 293 aa, Sorghum bicolor
  misc_feature: Ceres ANNOT ID no. 6040912
  misc_feature (88)..(155): Pfam Id: RRM_1 Pfam Desc: RNA recognition motif. (a.k.a. RRM, RBD, or RNP domain)
  misc_feature (206)..(276): Pfam Id: RRM_1 Pfam Desc: RNA recognition motif. (a.k.a. RRM, RBD, or RNP domain)
  misc_feature (2)..(271): NCBI GI: 115487172 NCBI Desc: os12g0131000 [oryza sativa (japonica cultivar-group)]
  misc_feature (36)..(292): NCBI GI: 145359708 NCBI Desc: rna binding [arabidopsis thaliana]
  misc_feature (88)..(215): NCBI GI: 20987708 NCBI Desc: hnrpf protein [mus musculus]
  misc_feature (88)..(215): NCBI GI: 20073357 NCBI Desc: hnrpf protein [mus musculus]
  misc_feature (88)..(198): NCBI GI: 14141159 NCBI Desc: heterogeneous nuclear ribonucleoprotein h3 isoform b [homo sapiens]
  misc_feature: Useful for making plants with altered alkaloid content
  misc_feature: GREAT-hit functional homolog of the protein sequence given in SEQ ID NO 13184
  misc_feature: Useful for making plants with altered alkaloid content
  misc_feature: Functional homolog of the protein sequence given in SEQ ID NO 13184
MMGGWGVSDGYEGSKRTRMMMESNPYFAVNAGSPLDVSKRARMMEPGAPYFGAVGSNTGGASGSFYQPFNSNLAGAGVSTGIQSFPGVRLRGLPFDCTDIDICKFFVGLDIVDCLLVNKNGRFTGEAFVVFPTAMQAEFALHRNKQNMGRRYIEVFRCKKQEYYCAIASEVNQGGYFEPEYRRSPPPPRPKKPSEDKGSMEYTEVLRLRGLPYSATTEDIIKFFQEYELTEENVHIGYRSDGKATGEAFVEFPTAEVAKTAMCKDKMTMWTRYVELFPSTPEEASRAKSRGRH

SEQ ID NO: 5023 - DNA, 879 bp, Sorghum bicolor
  misc_feature: Ceres ANNOT ID no. 6040913
  misc_feature: Encodes the peptide sequence at SEQ ID NO 5024
atgatgggaggctggggggtttcggatgggtacgagggatcaaagaggccacgaatgatgatggaatcgaatccctacttcgcagtgaacgcagggagtccattggatgtctcaaagaggtctaggatggtggaaccaggcccctattttggggctatgggaagcaacgctggtggtgccagtggtggcttctaccagcccttcaacagcaacttagctggtgcaggggctagcactggcatccaaaactttccaggtgtccggctgcgtggtctcccttttgattgcaacgacattgacatctgcaagttctttgtgggactggacatagtggactgcctcctggttaacaagaatgggcgcttcactggtgaggcttttgtggtcttcccaacagctatgcaagcagaatttgcgctgcatcgcaacaggcagaacatgggccggagatatgttgaggtgttcagatgcaagaagcaggagtactactgtgcaatagccaacgaggtgagccagggtggttactttgagtcagagtaccgccgctccccacctcctccaaggtctaagaagccggctgaagacaagggcagtatggagtacactgaggtgctgaagctccgtgggcttccctactctgccaccactgaggacatcatcaagttcttcctggagtatgagctgacagaggagaatgtgcatattgcataccgctcagatgggaaagctactggtgaagcctttgttgagttccccactgctgaagttgccaagacggccatgtgcaaggataagatgaccattgggacgaggtatgtagagctgttcccgtcgaccccagaggaggcgagcagggcgagaacccgaggcaggcattga

SEQ ID NO: 5024 - protein, 292 aa, Sorghum bicolor
  misc_feature: Ceres ANNOT ID no. 6040913
  misc_feature (87)..(154): Pfam Id: RRM_1 Pfam Desc: RNA recognition motif. (a.k.a. RRM, RBD, or RNP domain)
  misc_feature (205)..(275): Pfam Id: RRM_1 Pfam Desc: RNA recognition motif. (a.k.a. RRM, RBD, or RNP domain)
  misc_feature (2)..(270): NCBI GI: 115487172 NCBI Desc: os12g0131000 [oryza sativa (japonica cultivar-group)]
  misc_feature (38)..(291): NCBI GI: 145359708 NCBI Desc: rna binding [arabidopsis thaliana]
  misc_feature (78)..(161): NCBI GI: 1085318 NCBI Desc: grsf-1 protein - human (fragment)
  misc_feature (78)..(161): NCBI GI: 119626036 NCBI Desc: g-rich rna sequence binding factor 1, isoform cra_a [homo sapiens]
  misc_feature (78)..(161): NCBI GI: 517196 NCBI Desc: g-rich sequence factor-1 [homo sapiens]
  misc_feature: Useful for making plants with altered alkaloid content
  misc_feature: GREAT-hit functional homolog of the protein sequence given in SEQ ID NO 13184
  misc_feature: Useful for making plants with altered alkaloid content
  misc_feature: Functional homolog of the protein sequence given in SEQ ID NO 13184
MMGGWGVSDGYEGSKRPRMMMESNPYFAVNAGSPLDVSKRSRMVEPGPYFGAMGSNAGGASGGFYQPFNSNLAGAGASTGIQNFPGVRLRGLPFDCNDIDICKFFVGLDIVDCLLVNKNGRFTGEAFVVFPTAMQAEFALHRNRQNMGRRYVEVFRCKKQEYYCAIANEVSQGGYFESEYRRSPPPPRSKKPAEDKGSMEYTEVLKLRGLPYSATTEDIIKFFLEYELTEENVHIAYRSDGKATGEAFVEFPTAEVAKTAMCKDKMTIGTRYVELFPSTPEEASRARTRGRH

SEQ ID NO: 5025 - DNA, 759 bp, Sorghum bicolor
  misc_feature: Ceres ANNOT ID no. 6040926
  misc_feature: Encodes the peptide sequence at SEQ ID NO 5026
atggccgacgccgccaacccgccgaccaagcccaccaaagccgcctccgccgcacctttcgtcgtctttgacgccgccgccagcgccaaggccagcaaacccaaagccgcagccgccgacgccgtcgtcagcgccgatgccccgacgcacggccgtggctgccgctgggcgcggtgggcgtgctgcggcgtggctgtcgccggcgcgctgacggccgcggcggtgctggcgctgtcgctcaccgtgctcagggtgcgggacccgacgctgtccatggagtccgtggccgtcacgcgcttcagcgtgcgcttcgacgccgcgcacccggcgcggccgctgcggatcaacgtcacgctgtccggcgacatcgtgatccacaaccccaactacgagtcgatgcggttcggcgccagctccacggagatcttcgtggaaggagcagcggagccgggccccgttggcgtcgggcgcgcgccgcccggagaggtccccgcgcgcggcgccagccgggtgggcgccgaagtcgacgtgctcgtcgacagggtcgcgcccgccgtggtggcccaggtgctgttcggcggcggcgaggtgcgcctcgacacccgcaccgccgtcgacggcagggtcagcctgctcggcggactctacggccgccgcaccgtaagggtcgccatgcgctgccgcgtcgcgctccgcgtctcggccgcggccgtcgccgtcgccggcagccccgcgtgcgtcgccgacttcggacgctga

SEQ ID NO: 5026 - protein, 252 aa, Sorghum bicolor
  misc_feature: Ceres ANNOT ID no. 6040926
  misc_feature (80)..(227): Pfam Id: Hin1 Pfam Desc: Harpin-induced protein 1 (Hin1)
  misc_feature (6)..(248): NCBI GI: 15624041 NCBI Desc: b1060h01.30 [oryza sativa (japonica cultivar-group)]
  misc_feature (40)..(238): NCBI GI: 94549041 NCBI Desc: plant cell wall protein sltfr88 [lycopersicon esculentum]
MADAANPPTKPTKAASAAPFVVFDAAASAKASKPKAAAADAVVSADAPTHGRGCRWARWACCGVAVAGALTAAAVLALSLTVLRVRDPTLSMESVAVTRFSVRFDAAHPARPLRINVTLSGDIVIHNPNYESMRFGASSTEIFVEGAAEPGPVGVGRAPPGEVPARGASRVGAEVDVLVDRVAPAVVAQVLFGGGEVRLDTRTAVDGRVSLLGGLYGRRTVRVAMRCRVALRVSAAAVAVAGSPACVADFGR

SEQ ID NO: 5027 - DNA, 2508 bp, Sorghum bicolor
  misc_feature: Ceres ANNOT ID no. 6040929
  misc_feature: Encodes the peptide sequence at SEQ ID NO 5028
atggagcagaggagcctgctggtgtcggcgctgggcgtcggcgtcggcgtggggctggggctcgcgtcggccaagtgggcggtacagccggcgcccaacggcgacggtttcggcgccggcggcgcagagctggaggccgagctgcggcggctggtactcgacggccgcgagtgcgacgtcaccttcgacgagttcccttactacctcagcgatcagacgagggaggtgctcatcagcgcggctttcgtccacctcaagaacgcagagctgtccaagcacatccggaacctctccgccgccagccgcgccatcctgctctccggccccacagagccttacctgcagtcgctcgcgaaagctctgtcccactacttcaaggcgcgcttgctaattgtggacgccaccgacttctcgcttcggatccaaagcaaatacgggggctccactaaagccacggcacgtaatcagtctgtaactgagaccacattcgggaggatgtctgatctcattggatcctttatggcatatcctaagaaggatgagcctagagaatcacagcgtcgtcagacaagcaacacagatttaagggcgagtacaccttcgcttaggaaaaatgcctctgtatcatccgacatgggcgatcatgcctcacaatgtgcaggaaattcagtgaggcgaaccggtagctggtgtttcgaggagaaagttctgatacagtcactctacaaggttatggtttctgtgtctgaaaacggtccgattattctttacataagggatgtggaccatttcctctggaaatcgcaaagaacttactcaatgttccagaaaatgttggccaaactatccggtcaagtgttgatacttggttctcgactactcagtcctgatgctgataacagggatgcggatgagagaattagtaccctgtttccttaccatgttgatatcaaagctcctgaggaggagacccatctaaattgttggaaaagccaaattgaggaagacacaagaaaaatccagatgcaagataatagaaaccatatcatagaggtactatcagcaaatgatctagactgtgatgatttgagctcaatcagtgaagcagatactatggttctcagtaattacatagaggaaatcattgtctcagctgtctcctaccacttgattcacaacaaggaccctgaatacagaaatggaaagctcatgctatcttctaaaagtttgtcccatggtttaagcattttccaaggtggccatggtgggaaagacaccctgaaattggaaggaacaaaggatggtttgaaaggagctcctggatctaagaaaactgacacagttccggttggcgaaggtccattgccaccacaaaaaccagaagttccagacaatgagtttgaaaagcgtatcagaccagaggttattctggcaagtgagataggagtgacatttgatgacattggagccctggctgatatcaaagagtctcttcaggagttggttatgcttcctcttcgacggcctgatcttttcaaaggaggacttctgaagccctgcagagggattttgctgtttgggccacctggaaccgggaagaccatgcttgcaaaggctatagcaaatgacgccggggccagcttcatcaatgtatcgatgtccaccatcacatccaaatggtttggggaggatgagaaaaatgtccgggcattgttcagtttggctgccaaggtagctcccactatcatttttgtggatgaggtagacagcatgttggggcagcgcgctcgctacggtgaacatgaggccatgcggaagatcaagaacgagttcatgagtcactgggatggtctcttgtcaaaaacaggtgaaagaattcttgttcttgccgcgacaaataggccgtttgaccttgatgaagccatcatcaggagatttgagcgcagaatcatggttgggcttccaactcaagagagcagagagctgatcttgaggacactactgtcaaaagagaaaattgaggaaaatattgatttcaaggaacttgcgaccatgacggagggatacagtggcagtgatctcaagaatctctgtgtcactgctgcttaccgccctgttagggagctattgaagaaagagagagagaaagaactggagcgaagggaaaaagagtcaaaagataaggcggtggagaattcggaagctccagaggctaagaaggagagctcagaaagcaaagacgctccgaagagcaaggagggttcagaaagcagcgaagacgagagttcagacagcaagtcggatagctcggaggcgaaggctgaaggcgagaaggaagcggccatagatcttaggccactgacgatggaagacctcaggcaggcaaagaaccaggttgcagcgagcttcgcctccgagggtgctgtgatgaacgagctcaagcaatggaacgacctgtacggcgaagggggctccaggaaaaaacagcagctgacgtacttcttgtag

SEQ ID NO: 5028 - protein, 835 aa, Sorghum bicolor
  misc_feature: Ceres ANNOT ID no. 6040929
  misc_feature (522)..(707): Pfam Id: AAA Pfam Desc: ATPase family associated with various cellular activities(AAA)
  misc_feature (1)..(474): NCBI GI: 145334803 NCBI Desc: atp binding / nucleoside-triphosphatase/ nucleotide binding [arabidopsis thaliana]
  misc_feature (457)..(720): NCBI GI: 6692099 NCBI Desc: f22c12.12 [arabidopsis thaliana]
  misc_feature (1)..(461): NCBI GI: 92870453 NCBI Desc: aaa atpase, central region; dead/deah box helicase, n-terminal [medicago truncatula]
  misc_feature (6)..(474): NCBI GI: 30102500 NCBI Desc: at1g64110/f22c12_22 [arabidopsis thaliana]
  misc_feature (457)..(739): NCBI GI: 30696968 NCBI Desc: aaa-type atpase family protein [arabidopsis thaliana]
  misc_feature: The sequence is a functional homolog of SEQ ID NO. 471 in the 11/188,298 US application
  misc_feature: The sequence is a functional homolog of SEQ ID NO. 462 in the 11/188,298 US application
MEQRSLLVSALGVGVGVGLGLASAKWAVQPAPNGDGFGAGGAELEAELRRLVLDGRECDVTFDEFPYYLSDQTREVLISAAFVHLKNAELSKHIRNLSAASRAILLSGPTEPYLQSLAKALSHYFKARLLIVDATDFSLRIQSKYGGSTKATARNQSVTETTFGRMSDLIGSFMAYPKKDEPRESQRRQTSNTDLRASTPSLRKNASVSSDMGDHASQCAGNSVRRTGSWCFEEKVLIQSLYKVMVSVSENGPIILYIRDVDHFLWKSQRTYSMFQKMLAKLSGQVLILGSRLLSPDADNRDADERISTLFPYHVDIKAPEEETHLNCWKSQIEEDTRKIQMQDNRNHIIEVLSANDLDCDDLSSISEADTMVLSNYIEEIIVSAVSYHLIHNKDPEYRNGKLMLSSKSLSHGLSIFQGGHGGKDTLKLEGTKDGLKGAPGSKKTDTVPVGEGPLPPQKPEVPDNEFEKRIRPEVILASEIGVTFDDIGALADIKESLQELVMLPLRRPDLFKGGLLKPCRGILLFGPPGTGKTMLAKAIANDAGASFINVSMSTITSKWFGEDEKNVRALFSLAAKVAPTIIFVDEVDSMLGQRARYGEHEAMRKIKNEFMSHWDGLLSKTGERILVLAATNRPFDLDEAIIRRFERRIMVGLPTQESRELILRTLLSKEKIEENIDFKELATMTEGYSGSDLKNLCVTAAYRPVRELLKKEREKELERREKESKDKAVENSEAPEAKKESSESKDAPKSKEGSESSEDESSDSKSDSSEAKAEGEKEAAIDLRPLTMEDLRQAKNQVAASFASEGAVMNELKQWNDLYGEGGSRKKQQLTYFL

SEQ ID NO: 5029 - DNA, 2184 bp, Sorghum bicolor
  misc_feature: Ceres ANNOT ID no. 6040943
  misc_feature: Encodes the peptide sequence at SEQ ID NO 5030
atggaccagctccgccaggtgggcgaggccctcggcggcgtgcaagcgctcatggccttcgccgacgatctccgcatcaacccgcggcaatgcagcctcctcgccgacgcctgcgcgctggctttcgccgccgtagccgccgaggtgcgcgcccacctccgcttcagcgagcgcctggccaagtggaagcccctggaggcgccgctccgggagctccaccgcgccgtccgcgacgccgagggctacgtccgccactgcctggagccgcgggacagctggtgggcgcgcgccgccgcggccacgcacggcgccgactgcgtggagcagcacatgcacagcctgctgtggagcgtcgccctggtgctggaggccgtcgagctcgtctcggaggtgacggggtccgacccggacgagctcgcccggcggcggctgctgttcgccaaggactacgacagggacatgctggagccgaggctgttccggcagaggctcggcgcgcggtacctggccacgcgtgagctcgccgccaggatggacgcggcgtggaaggaggaccggtggctcctgttgcagtacctcgaggaacggaggagcccgggctcgccgaagccgctgacgcggaacgagcaccggctggccgacctcctgacggcgccgcgcgggaaggtgcacccggcgtccgtgctcctgcagggcgacttccacgtgaggaggcgcctggtgggcaacctcaaggaggtgcagtggatgggggagtccttcgccgtgaagcacttcgtcggcgccgacgccgacgccgtgggcgccgaggccgcgctgctcacctccgtggcgcacccgaacgtagcgcactgccggtactgcttccacgacgaggacaagcgggagttcttcctcgtcatggaccagctcatgaccaaggacctggccagccacgtgaaggaggtgaacaacgccaagcgccgggtgccgttcccgctcgccgtcgtcgtcgacgtcatgctgcagatcgcgcggggaatggagtacctgcactcgaggaagatctaccacggcgacctgaacccgtccaacgtgctcgtcaggacgcggcacgcggacgcgcacctccacgtcaaggtcgccgggttcgggcagtccgcggcgaccgtggccgccgccaaccccaggcccagccctagggcgtcggcgaaagcagcaaacgccaccgtcgccgcctccaacccttgcatctggtacgccccggaggtgttcgagcaggaggcggccaagtgcacggagaaggcggacgtgtacagcttcgggatggtctgcttcgagctgctgacggggaagatcccgttcgaggacaaccacctgcagggggagcacatgagcaagaacatccgcaccggcgagcggccgctgttcccgttccaggcgcccaagtacctgaccagcctcaccaagcggtgctggcacggggacccggcgcagcggccggcgttcgcgtccatctgccgcgtcctccgctacgtgaagcggttcgtggtcatgaacccggcccccgcggagcagccggacgcgacgccgccgccgccgcccgtgccgcccgtggactacctcgacgtcgaggcgagcctgcagaggaggttcccggcgtggcagtccggaaacgcggcgccgcgcgtctccgacgtgccgttccagatgttcgcgtacagggtgatggagaaggagaggaacagggcggccatcctgcacatcggcggcggcggcagggacaaggcctccgactccagcagcgaaggcaactcgctgtgcggggacgagagcggcagcgcgacgctgtcggacgccgatgctctgtccgtgtcgagccgcggcaccaccatcaccaccaccactacgcggtcgctgccggaccgcgctggcagcaggaaggcgtcgccgagcgaccgcgccagcagcaggaaggcgtcgccgaggaaggtggatagcagcagggtcgcaacccggctagcagggcgaccggaaaaatccaagtcgatggagaagtccaagtcgatgggcgtggtgaggccgccgcagatcatcaggcggacgcagaggatcaagtcggacggccacctgaattcggacgtgataccgtctccccggcggcgcggttccggcggggggcacgcttcagactctgaaatctga

SEQ ID NO: 5030 - protein, 727 aa, Sorghum bicolor
  misc_feature: Ceres ANNOT ID no. 6040943
  misc_feature (234)..(503): Pfam Id: Pkinase Pfam Desc: Protein kinase domain
  misc_feature (244)..(503): Pfam Id: Pkinase_Tyr Pfam Desc: Protein tyrosine kinase
  misc_feature (1)..(641): NCBI GI: 8920583 NCBI Desc: contains similarity to a photoreceptor from ceratodon purpureus gby10901 and contains an eukaryotic protein kinase pf00069 domain. ests gbn96753, gbai993724 come from this gene.
  misc_feature (1)..(641): NCBI GI: 8920583 (continued) [arabidopsis thaliana]
  misc_feature (1)..(696): NCBI GI: 79320679 NCBI Desc: atp binding / kinase/ protein kinase/ protein serine/threonine kinase/ protein-tyrosine kinase [arabidopsis thaliana]
  misc_feature (222)..(641): NCBI GI: 15223409 NCBI Desc: protein kinase-related [arabidopsis thaliana]
  misc_feature (222)..(470): NCBI GI: 52421275 NCBI Desc: at1g01450 [arabidopsis thaliana]
  misc_feature (244)..(524): NCBI GI: 1813953 NCBI Desc: photoreceptor [ceratodon purpureus]
  misc_feature: The sequence is a functional homolog of SEQ ID NO. 323 in the 11/188,298 US application
  misc_feature: The sequence is a functional homolog of SEQ ID NO. 340 in the 11/188,298 US application
  misc_feature: The sequence is a functional homolog of SEQ ID NO. 495 in the 11/188,298 US application
  misc_feature: The sequence is a functional homolog of SEQ ID NO. 312 in the 11/188,298 US application
  misc_feature: The sequence is a functional homolog of SEQ ID NO. 464 in the 11/188,298 US application
  misc_feature: The sequence is a functional homolog of SEQ ID NO. 391 in the 11/188,298 US application
  misc_feature: The sequence is a functional homolog of SEQ ID NO. 311 in the 11/188,298 US application
  misc_feature: The sequence is a functional homolog of SEQ ID NO. 358 in the 11/188,298 US application
  misc_feature: The sequence is a functional homolog of SEQ ID NO. 366 in the 11/188,298 US application
  misc_feature: The sequence is a functional homolog of SEQ ID NO. 446 in the 11/188,298 US application
  misc_feature: The sequence is a functional homolog of SEQ ID NO. 520 in the 11/188,298 US application
  misc_feature: The sequence is a functional homolog of SEQ ID NO. 498 in the 11/188,298 US application
MDQLRQVGEALGGVQALMAFADDLRINPRQCSLLADACALAFAAVAAEVRAHLRFSERLAKWKPLEAPLRELHRAVRDAEGYVRHCLEPRDSWWARAAAATHGADCVEQHMHSLLWSVALVLEAVELVSEVTGSDPDELARRRLLFAKDYDRDMLEPRLFRQRLGARYLATRELAARMDAAWKEDRWLLLQYLEERRSPGSPKPLTRNEHRLADLLTAPRGKVHPASVLLQGDFHVRRRLVGNLKEVQWMGESFAVKHFVGADADAVGAEAALLTSVAHPNVAHCRYCFHDEDKREFFLVMDQLMTKDLASHVKEVNNAKRRVPFPLAVVVDVMLQIARGMEYLHSRKIYHGDLNPSNVLVRTRHADAHLHVKVAGFGQSAATVAAANPRPSPRASAKAANATVAASNPCIWYAPEVFEQEAAKCTEKADVYSFGMVCFELLTGKIPFEDNHLQGEHMSKNIRTGERPLFPFQAPKYLTSLTKRCWHGDPAQRPAFASICRVLRYVKRFVVMNPAPAEQPDATPPPPPVPPVDYLDVEASLQRRFPAWQSGNAAPRVSDVPFQMFAYRVMEKERNRAAILHIGGGGRDKASDSSSEGNSLCGDESGSATLSDADALSVSSRGTTITTTTTRSLPDRAGSRKASPSDRASSRKASPRKVDSSRVATRLAGRPEKSKSMEKSKSMGVVRPPQIIRRTQRIKSDGHLNSDVIPSPRRRGSGGGHASDSEI

SEQ ID NO: 5031 - DNA, 2328 bp, Sorghum bicolor
  misc_feature: Ceres ANNOT ID no. 6040950
  misc_feature: Encodes the peptide sequence at SEQ ID NO 5032
atgggcgggggccgcgcccaggtgaacaaggcccacaagagccgcttcgcgtccaaggcctcccgccacgcgcacaagatagacaaggtcaggagcggcaagtcagagaccagccatcgcgccgccgtcaagggtgcccgtgccgcgcgcatccagcagagcaaggcgatacgtgataaaaaacgtgctgctttgctgaaggagaaacgttcatcaaatggaccttcaagcgcaccacgtgtcattgttcttgttggcctttcttcatcagcaaatgttggatcactagccaaagatcttcttgcactagcggaaggcagtgatgggaaactgaaatcatctaccgttgcttctcctacttataagtttcgaaccacggtactgcaagcaccatatggtgatcttaccacatgcatggaactggcaaaggttgctgatttgttagcattcgtactaccagccaattcattctactgtggtgattcgaacggtccaattgacgagtttggttctcaatgtctgtctgtatttagagccatgggcttacctagtacagctgttttcatccgtgatcttccagcggataataaaagtaggcaggaattgaagaaagcagcaacttctttcctttctgcagagctgcctgaggactgcaagttttacttagcaggcacaaaggatgatttgcataagttcatgtggcatttcaaggagcagcacctttcatcgccacattggagaagccagaggccttatgttatgtctgagcaggtcttcataaatcctgatgaaaatacgggattgtgcacattgctcgtgtctggatatctgcgggcccacaatctttcggtgaatcagcttttaggccaaattgatgtcctcaaggatccatgtcctcttagtgagcggaaaagctctgatgtaatggaaactgaagataatggaattcagattgttaacacctttgttccagacccttcgagtcaggaacccttacttgttgaaaatgtgccagatcctcttgccggggagcagacttggccaacggaagaagatatggaggaggctgacataaacaacaaacagagaaaattggtaaagaggaagcttccccgaggcacttcagagtaccaggctgcttggattgttgatgacacagatgatgaagataacgactctgataatgacaaccaggctggttctggaatggtcattgatgagcaaggtcactcagaccaaggaagtgatggttcggatatagatgcagtgtctcactttacagagaagttcgatggagaaactgttggggatactgagatggcagatgaagaaaatttgactaaagaccagatagaggcagagattaagaaaatcaaagaagctaatgctgatgatgaagaatttcccgatgaggtggagacaccattagatgtcccagcaaagaagcggtttgcaaaatacagaggactaaagtcatttaggacatcatcctgggatcctaaggaatcattgccaccggactatgcaagaatatttgcatttgataattttacacgaacacaaaagcatgtctttgctaaaattgccgagttagatggaggcatgaaggattgtgctcaagtgggatcatatgtaaggctttatgtgaaaaatgttcccactgatatagcatccaaactttgtcaaccatcaagaagaatacctgtggttgtttctggtcttcttcaacatgagtccaaaatgtcagttcttcacttcagcataaagaaacatgactcatacgaagctcctatcaaatctaaggagcctttgattttcaatgttggattccggcaatttacagcaaggccattgttttcatccgacaacatcaactgcaataaacataaaatggaaagatttctacaccatgggcggttttctgttgcctctgtatatgctccaatttctttccctccacttcctctaatagttctgaagaacagagatggcgagcaacctgccattgctgctataggttcactaaaaagtgtggatccagatcggatcattctgaagaaaattgttttgactgggtatccacagagagtctcaaaactgaaagcaatcgtgcgttacatgttccacaatcctgacgatgtaaaatggttcaagcctgttgagttgtggacaaaacatggacgtcggggccgcatcaaggagactgttggtactcatggtgccatgaaatgcatattcaatagcagcattcagcagcatgatacagtgtgcatgagcttgtacaaacgcgcttacccgaaatggcctgaacagctctaccacgtataa

SEQ ID NO: 5032 - protein, 775 aa, Sorghum bicolor
  misc_feature: Ceres ANNOT ID no. 6040950
  misc_feature (228)..(298): Pfam Id: AARP2CN Pfam Desc: AARP2CN (NUC121) domain
  misc_feature (1)..(721): NCBI GI: 6691183 NCBI Desc: f7f22.4 [arabidopsis thaliana]
  misc_feature (3)..(773): NCBI GI: 56205386 NCBI Desc: novel protein [mus musculus]
  misc_feature (3)..(773): NCBI GI: 37360364 NCBI Desc: mkiaa1401 protein [mus musculus]
  misc_feature (3)..(773): NCBI GI: 7243183 NCBI Desc: kiaa1401 protein [homo sapiens]
  misc_feature (46)..(773): NCBI GI: 45945954 NCBI Desc: flj10534 protein [homo sapiens]
MGGGRAQVNKAHKSRFASKASRHAHKIDKVRSGKSETSHRAAVKGARAARIQQSKAIRDKKRAALLKEKRSSNGPSSAPRVIVLVGLSSSANVGSLAKDLLALAEGSDGKLKSSTVASPTYKFRTTVLQAPYGDLTTCMELAKVADLLAFVLPANSFYCGDSNGPIDEFGSQCLSVFRAMGLPSTAVFIRDLPADNKSRQELKKAATSFLSAELPEDCKFYLAGTKDDLHKFMWHFKEQHLSSPHWRSQRPYVMSEQVFINPDENTGLCTLLVSGYLRAHNLSVNQLLGQIDVLKDPCPLSERKSSDVMETEDNGIQIVNTFVPDPSSQEPLLVENVPDPLAGEQTWPTEEDMEEADINNKQRKLVKRKLPRGTSEYQAAWIVDDTDDEDNDSDNDNQAGSGMVIDEQGHSDQGSDGSDIDAVSHFTEKFDGETVGDTEMADEENLTKDQIEAEIKKIKEANADDEEFPDEVETPLDVPAKKRFAKYRGLKSFRTSSWDPKESLPPDYARIFAFDNFTRTQKHVFAKIAELDGGMKDCAQVGSYVRLYVKNVPTDIASKLCQPSRRIPVVVSGLLQHESKMSVLHFSIKKHDSYEAPIKSKEPLIFNVGFRQFTARPLFSSDNINCNKHKMERFLHHGRFSVASVYAPISFPPLPLIVLKNRDGEQPAIAAIGSLKSVDPDRIILKKIVLTGYPQRVSKLKAIVRYMFHNPDDVKWFKPVELWTKHGRRGRIKETVGTHGAMKCIFNSSIQQHDTVCMSLYKRAYPKWPEQLYHV

SEQ ID NO: 5033 - DNA, 1746 bp, Sorghum bicolor
  misc_feature: Ceres ANNOT ID no. 6040953
  misc_feature: Encodes the peptide sequence at SEQ ID NO 5034
atgccgatctgtagctgtgaagaaactatccatgagtttgagatgctaacacgcgatgctgggcgtgtacagaaggatacactgaaaaagatccttgagttgaatgctgatgctgaatatctgaagaagttcggcctcaatggcaggactgatgtagagagctacaaatcctgcatcccgttgtgtgtgcacagtgatcttgagccatacatccataggatcgctgatggtgatagctctccactcctcactgggaagcccgtcacctccctttccctcagttccggaacaacacagggcaagcccaagttcttgccatttactgatgaattgcttgagaccacacttcaaatattccagacttcatatgcatttaggaaccgtaagtatccaataggaagaggaaaagcgttgcagtttatctatggtagcaagcaagtggtaacaaaaggtggcatccttgccacaactgcaacgacaaacttgtaccggagggcacgttacaaggaagggatgaaggatatccagtctcaatgctgcagccctgatgaagttgtttttggccctgacttcaatcagtccttgtattgtcacttgctctgtgggctaatatactctgacgaggtccatcaggtgttctcgccatttgctcacagcttagtccatgcatttcaaacatttgaggaggtttgggaagatctatgtgctgacataagaggtggtgtcctctcagagaaagttacagtgccatctattcgtgaagctgttacaaaaatcctgaagcccaaccctgagcttgctgacttgatctataagaagtgcatgggcttgagcaactggtatggtgtaattccagcgctctggccaaatgcaaagtatgtctatggtatcatgacaggttccatggagccatacctaaaaaagttgaggcactatgctgggcacttgcctctgataagtgcagattacggtgcatctgaaggatgggttggtgctaatataaaccccacactaccacctgaacaggtgacatacgctgttctcccccagaccggttattttgagttcattcgtttggagaaacccgaaggtgaggagacggagaatagtgcctccattcattacatagaatcagaaccagttggcctgaccgaagttgaggtcggaaaaatctatgaagttgtgataactacctttggaggtctatatcgctaccggctaggagatattgtgaaggtagcaggcttccacaactcaacacccgagctccggttcatctgccgcagaagcctagtcctgagcatcaacatcgacaagaacaccgagaaagacctccagctggctgttgaggaggcagcaaagctcttggatgcagagaagctggaaattgtggatttcactagctttgtggagaagtcaagtgaccctggtcgctatgtcatcttctgggagctgagctccgatgcaagtgaggatgtgttacgaagctgcgcaaattgcttggacctagcctttgttgatgcaggatatatgggttcaaggaagatcaaagccattggcccacttgagctacggattctgaaaaagggaaccttcaaggagattctagatcacttcctgagccttggtggcgccgtgagtcagttcaagacacctcgattcgtcagtccgttgaatgtcaaggttctgcagatactaaataggaacaccaccggaagttacttcagtaccgcctatgggctctga

SEQ ID NO: 5034 - protein, 581 aa, Sorghum bicolor
  misc_feature: Ceres ANNOT ID no. 6040953
  misc_feature (8)..(565): Pfam Id: GH3 Pfam Desc: GH3 auxin-responsive promoter
  misc_feature (1)..(580): NCBI GI: 75123648 NCBI Desc: probable indole-3-acetic acid-amido synthetase gh3.5 (auxin-responsive gh3-like protein 5) (osgh3-5)
  misc_feature (7)..(579): NCBI GI: 86212374 NCBI Desc: jasmonic acid-amino acid-conjugating enzyme [nicotiana attenuata]
  misc_feature (74)..(579): NCBI GI: 145331421 NCBI Desc: jar1 (jasmonate resistant 1) [arabidopsis thaliana]
  misc_feature (7)..(469): NCBI GI: 75269829 NCBI Desc: probable indole-3-acetic acid-amido synthetase gh3.12 (auxin-responsive gh3-like protein 12) (osgh3-12)
  misc_feature (5)..(428): NCBI GI: 82592859 NCBI Desc: probable indole-3-acetic acid-amido synthetase gh3.3 (auxin-responsive gh3-like protein 3) (osgh3-3)
  misc_feature: Useful for making plants with modulated light quality sensitivity
  misc_feature: Functional homolog of the protein sequence given in SEQ ID NO 13895
MPICSCEETIHEFEMLTRDAGRVQKDTLKKILELNADAEYLKKFGLNGRTDVESYKSCIPLCVHSDLEPYIHRIADGDSSPLLTGKPVTSLSLSSGTTQGKPKFLPFTDELLETTLQIFQTSYAFRNRKYPIGRGKALQFIYGSKQVVTKGGILATTATTNLYRRARYKEGMKDIQSQCCSPDEVVFGPDFNQSLYCHLLCGLIYSDEVHQVFSPFAHSLVHAFQTFEEVWEDLCADIRGGVLSEKVTVPSIREAVTKILKPNPELADLIYKKCMGLSNWYGVIPALWPNAKYVYGIMTGSMEPYLKKLRHYAGHLPLISADYGASEGWVGANINPTLPPEQVTYAVLPQTGYFEFIRLEKPEGEETENSASIHYIESEPVGLTEVEVGKIYEVVITTFGGLYRYRLGDIVKVAGFHNSTPELRFICRRSLVLSINIDKNTEKDLQLAVEEAAKLLDAEKLEIVDFTSFVEKSSDPGRYVIFWELSSDASEDVLRSCANCLDLAFVDAGYMGSRKIKAIGPLELRILKKGTFKEILDHFLSLGGAVSQFKTPRFVSPLNVKVLQILNRNTTGSYFSTAYGL

SEQ ID NO: 5035 - DNA, 1773 bp, Sorghum bicolor
  misc_feature: Ceres ANNOT ID no. 6040991
  misc_feature: Encodes the peptide sequence at SEQ ID NO 5036
atgggcttgcagatgatccatggcaggccctgcgcctattgctgcccgtcgtcgtcgtcctcctcctcctcctcgtcttcctcctctgcgtggatgatgcaggccctgcccccgaagcagtctcaccatccattgaatggagggaagccaattttctctgaatcccttgcagcactggcggccatgcatctcctgctaaaacgtcgcagagaccgcagcagcagggacattgcatcttcatccggcgtcctccaaatcacagagaacaaatcagccgcggccaacttaacaaaacacaagcaggtgatgagtgcagaaaggaagctccttgatgacgctcttgacagaactagtgttcagtatgagagctggatggatgaagagacatcgttctggatggacagggataacacgaacaacaattttcagtacggtttgttaatgcagaaccttgaggaattggagacgagtttggctggtaaagacttgaagattctggaaaatgacatccttgcacacattcagcagcttggagctctgagatcgttcgatgcgtctacggccgtgggcgccaccctgctagacaccctaacacatgatcaaccagacagctctctgcttgaccaacaaatcatcgagtttgatccagagacgactcctctggacgaggaggagcaagaagatagccaagtagtcgtcgtccggagtggcaagagtgaggagaggaagctgaagagagtcagagcgtcagagaaaggatccaggatctcagtgaaagtgaatccacgaagacccaagaaatcatcccggaaggcgagtagcagccagtttatatccgagtggaaaagtcacccaggacgaaggaggatcattgtgcgtgagcaatcagcactgctagcgaccatcaaggaatgcgcaagccttgagaagattagggagaagatggtgaaggaagggcaggaggtgagctaccacaggtgggcagaggcagctggaatggacgaggcagagctgatgagcaggctgcagacaggctactgctgccgggagaggctgctggtgaccaccgagtggctggtcaggtgcatcgcaagatcatacaccggcatggggacggccttggacgatctgcttcaggctgggaagatgggcgttcttgacggcgccgagaagttcgacacccggaaggggtgcaggttctccacgtacgtcaagtactggatcaggaaagggatgctcgctctcctcgctgaaaactcaggagtcaccctgctgcctgcaagaatggagagcatcatgcgcaaggtgaaggaggcgcggcgtgggatcaggtacagcgagggcaggaacccgtcggactcggaggtggccgcggccgtcggcgtgtcggtggccaacgtgaggctggcgcgcaagtgctcccgcaggcccgtctcgctctactcggagatcgggatcgggcagcacgccaagttcgcggaggtgatcccggacgaggcggcggcggccgcggaggcgcccgacgaggcggcgctgttccggggccagctgagggagcggctgctgctggtgctgggcaggctgccggcgcgggagggacacgtgctgaggctccgacacgggctggaggacggccggtgcaggtcgctggaggagatcggcggcatgtaccgcgtgtccaaggagtggatcaggaagatcgagaagtcggccatggccaggctcagggacgacgacgacgtgcgtcgcgacctccacgacttcgtctgctga

SEQ ID NO: 5036 - protein, 590 aa, Sorghum bicolor
  misc_feature: Ceres ANNOT ID no. 6040991
  misc_feature (524)..(577): Pfam Id: Sigma70_r4 Pfam Desc: Sigma-70, region 4
  misc_feature (426)..(507): Pfam Id: Sigma70_r3 Pfam Desc: Sigma-70 region 3
  misc_feature (353)..(422): Pfam Id: Sigma70_r2 Pfam Desc: Sigma-70 region 2
  misc_feature (22)..(589): NCBI GI: 20159761 NCBI Desc: sigma factor protein [zea mays]
  misc_feature (83)..(492): NCBI GI: 115465761 NCBI Desc: os05g0589200 [oryza sativa (japonica cultivar-group)]
  misc_feature (126)..(580): NCBI GI: 39840783 NCBI Desc: sigma factor [spinacia oleracea]
  misc_feature (154)..(577): NCBI GI: 7363220 NCBI Desc: sigma factor 3 [sinapis alba]
  misc_feature (156)..(577): NCBI GI: 85813983 NCBI Desc: sigma factor [spinacia oleracea]
MGLQMIHGRPCAYCCPSSSSSSSSSSSSSAWMMQALPPKQSHHPLNGGKPIFSESLAALAAMHLLLKRRRDRSSRDIASSSGVLQITENKSAAANLTKHKQVMSAERKLLDDALDRTSVQYESWMDEETSFWMDRDNTNNNFQYGLLMQNLEELETSLAGKDLKILENDILAHIQQLGALRSFDASTAVGATLLDTLTHDQPDSSLLDQQIIEFDPETTPLDEEEQEDSQVVVVRSGKSEERKLKRVRASEKGSRISVKVNPRRPKKSSRKASSSQFISEWKSHPGRRRIIVREQSALLATIKECASLEKIREKMVKEGQEVSYHRWAEAAGMDEAELMSRLQTGYCCRERLLVTTEWLVRCIARSYTGMGTALDDLLQAGKMGVLDGAEKFDTRKGCRFSTYVKYWIRKGMLALLAENSGVTLLPARMESIMRKVKEARRGIRYSEGRNPSDSEVAAAVGVSVANVRLARKCSRRPVSLYSEIGIGQHAKFAEVIPDEAAAAAEAPDEAALFRGQLRERLLLVLGRLPAREGHVLRLRHGLEDGRCRSLEEIGGMYRVSKEWIRKIEKSAMARLRDDDDVRRDLHDFVC

SEQ ID NO: 5037 - DNA, 846 bp, Sorghum bicolor
  misc_feature: Ceres ANNOT ID no. 6040994
  misc_feature: Encodes the peptide sequence at SEQ ID NO 5038
atgcatgccgtggcgagtagatgctccaactgcggcagctacggccatggctcgatagcctgccgcatcgccaccgcagaccaccagagagggagtgaagccgccaccatgcgctgcggccgcggtggcgccgccgccgccgcagggctgaggctgttcggggtgcagctccatgccgcctcaacatgtagcggtggcgccgccgctccgacgacgccgacggcaccgtcgttgcagctgcacaggagctacagcgtggactgcggctgcctgagcctgcagggcggctggcctctgcctgtcgcgctgtcgccgtcgtccggctgcgacggttgctacctctcggacgacggcggtcgcgggtcggcggcgttgcgggagcgggagaggaagaaaggggtgccgtggagcgaggaggagcaccggctgttcctggtggggctggagaagctgggcaggggcgattggcgcggcatctccaggggcttcgtcaccaccaggacgcccacgcaggtggccagccacgcccagaagttcttcctccggcagaacggcgccggcgccggcgccggcgccacgaagaagagcagcaagcgccgctccagcctcttcgacatggttcaggaatgtgagagtggaagcagacacgtcgtgctcgtcgtctccaacacgtcaggttgcaaggccgccggaagctcgaactctctgtctcccaaggcatcagtttcagagatggacgaggagcagcaagcacatggacggtaccattgctccccgctgaacctggagcttggcatgtccctatcatcgtcgtcgtcgtcgacgacgccgtccattggaacctag

SEQ ID NO: 5038 - protein, 281 aa, Sorghum bicolor
  misc_feature: Ceres ANNOT ID no. 6040994
  misc_feature (133)..(180): Pfam Id: Myb_DNA-binding Pfam Desc: Myb-like DNA-binding domain
  misc_feature (37)..(250): NCBI GI: 12406995 NCBI Desc: mcb2 protein [hordeum vulgare subsp. vulgare]
  misc_feature (113)..(232): NCBI GI: 92869601 NCBI Desc: zinc finger, cchc-type; homeodomain-related [medicago truncatula]
  misc_feature (113)..(251): NCBI GI: 110931712 NCBI Desc: myb transcription factor myb127 [glycine max]
  misc_feature (41)..(260): NCBI GI: 110931652 NCBI Desc: myb transcription factor myb52 [glycine max]
  misc_feature (7)..(209): NCBI GI: 41618924 NCBI Desc: myb transcription factor [arabidopsis thaliana]
  misc_feature: The sequence is a functional homolog of SEQ ID NO 1072 in the 10/225,066US patent application
  misc_feature: The sequence is a functional homolog of SEQ ID NO 130 in the 10/412,699US patent application
  misc_feature: The sequence is a functional homolog of SEQ ID NO 2258 in the 10/374,780US patent application
  misc_feature: The sequence is a functional homolog of SEQ ID NO 306 in the 11/479,226US patent application
  misc_feature: Useful for making plants with modulated growth and phenotype characteristics
  misc_feature: The sequence is a functional homolog of SEQ ID NO 130 in the 20040045049 US patent application
  misc_feature: The sequence is a functional homolog of SEQ ID NO. 514 in the 11/188,298 US application
MHAVASRCSNCGSYGHGSIACRIATADHQRGSEAATMRCGRGGAAAAAGLRLFGVQLHAASTCSGGAAAPTTPTAPSLQLHRSYSVDCGCLSLQGGWPLPVALSPSSGCDGCYLSDDGGRGSAALRERERKKGVPWSEEEHRLFLVGLEKLGRGDWRGISRGFVTTRTPTQVASHAQKFFLRQNGAGAGAGATKKSSKRRSSLFDMVQECESGSRHVVLVVSNTSGCKAAGSSNSLSPKASVSEMDEEQQAHGRYHCSPLNLELGMSLSSSSSSTTPSIGT

SEQ ID NO: 5039 - DNA, 1296 bp, Sorghum bicolor
  misc_feature: Ceres ANNOT ID no. 6040997
  misc_feature: Encodes the peptide sequence at SEQ ID NO 5040
atgtcggcgccggcgactgaagcgacgtcgttttcgtcgtttgacgacctgaacgcggacgtggtggccgagatcctgttccgcctaccgtcggcgtccgtgctccggtgccgcgccgtctgcagggcatggcgcgacgtcgcaagcgggccggagttcgtagcggcctattcccggcgccggcccctggagctcgtggtgcagcgccatggtgacaacggcgtgctggacgccatcccgctggccaccctcgacgaggccagccgccggtgtctccaccccgggtacccctcctccaactccaacgaccctgctgctgctgccacggggacggggggggatcagtactcgctgatgggttcttgcggcgatctcttgctgttcgagaggaaccaccgtgcaggtgcaggcatgggtggtgacaggcagctctgggtctgcaacccggtgacccggcagtggtcccccgtggcactgccgcaccgcaacgggaaaagcctgctctgcggcctgtacctccaccggccgtccggcgagcaccggctcctattcctcaccaacgacacctgtcgcgacatcaccgggccggcgtcgcactacgtcggctcgctcgagctcgacacctaccgctaccgctaccggcgagtaggaggaccggcgctcgcagccgtctatttcttgatgggcctgaccataacagcccagtgtcttgattatcacggcaagcttcactggctccaccaccccgaggtgacggagacggacaagatcctggcgttcgacacggtgtccgagacgttccggcggacgatgccgcgcccgccgttgttagggacgaagaagcagtacggcgaaatgcccatcctttccctgctggagatggacgggaagctggccgtggcagccacccccgacctcgattcctccatgcgcatggacctctgggtgctggaggactacgacagcgacgacggcgagagctggacctgccgccaccggatcgacctgtcagccctgtcgttaccgccgtcgaggttgctgcgtcatccatgctgctgggctatgggcgctcacagtgacgatgatgtgattcttttgggggacatggccagtctttcactgctgctgtaccatcttacggagaagagggtgctcaaacgaattcaagtcgttgctagtaataaaaagtctccgcagaccacttacatgtgggcccttgtgttcagggatagccttgacacacacgcctttttccatcttcacacgccggggatctcaacaaattcgtctatgtaa

SEQ ID NO: 5040 - protein, 431 aa, Sorghum bicolor
  misc_feature: Ceres ANNOT ID no. 6040997
  misc_feature (12)..(59): Pfam Id: F-box Pfam Desc: F-box domain
  misc_feature (240)..(420): NCBI GI: 38346536 NCBI Desc: osjnba0040d17.11 [oryza sativa (japonica cultivar-group)]
  misc_feature (118)..(420): NCBI GI: 38346045 NCBI Desc: osjnba0059d20.17 [oryza sativa (japonica cultivar-group)]
  misc_feature (17)..(191): NCBI GI: 108708134 NCBI Desc: f-box domain containing protein [oryza sativa (japonica cultivar-group)]
  misc_feature (240)..(420): NCBI GI: 115457216 NCBI Desc: os04g0193300 [oryza sativa (japonica cultivar-group)]
  misc_feature (240)..(420): NCBI GI: 38346527 NCBI Desc: osjnba0040d17.2 [oryza sativa (japonica cultivar-group)]
  misc_feature: The sequence is a functional homolog of SEQ ID NO. 456 in the 11/188,298 US application
MSAPATEATSFSSFDDLNADVVAEILFRLPSASVLRCRAVCRAWRDVASGPEFVAAYSRRRPLELVVQRHGDNGVLDAIPLATLDEASRRCLHPGYPSSNSNDPAAAATGTGGDQYSLMGSCGDLLLFERNHRAGAGMGGDRQLWVCNPVTRQWSPVALPHRNGKSLLCGLYLHRPSGEHRLLFLTNDTCRDITGPASHYVGSLELDTYRYRYRRVGGPALAAVYFLMGLTITAQCLDYHGKLHWLHHPEVTETDKILAFDTVSETFRRTMPRPPLLGTKKQYGEMPILSLLEMDGKLAVAATPDLDSSMRMDLWVLEDYDSDDGESWTCRHRIDLSALSLPPSRLLRHPCCWAMGAHSDDDVILLGDMASLSLLLYHLTEKRVLKRIQVVASNKKSPQTTYMWALVFRDSLDTHAFFHLHTPGISTNSSM

SEQ ID NO: 5041 - DNA, 822 bp, Sorghum bicolor
  misc_feature: Ceres ANNOT ID no. 6041010
  misc_feature: Encodes the peptide sequence at SEQ ID NO 5042
atgcggtggtacgcgaacgtgaaggaggtcggcggcggcgacacgacggtggtgctggcgcacggctacggcgccaaccagacgctgtgggacaagctcctgccggctctctccgagcaccacagggtcatcctcttcgactgggacttcaccggcgccggtgacgacgaagaggcagggcggtacacgttcggcaggttcgccgacgacctgatcgcgctcatggacgacaagggggtgcgcggcgcggtggtggtggggcactccatgtccgccatggccgcctgcatcgcctccgtcaggaggcctgacctcttcgcccacctcgtcctcctctgcgcgtcccccagggcgagcatcgacggcatgctgggcgccatgtcgtcggactttgtcgcctgggtgaagggcttcgtccccaacgccgccggcggcgactcgtccgccgccgtggcgctggagcagagtttcctgtcgatgcaccggagcgtggcgctggaggtggcccggatgatcttcctgggcgaccagcgcggggtcctcgacgccgtggccgcgccgtgcaccgtcgtccaggtggcgggcgacttcgcggcgccccccgccgtggcggagtacatgaggcaaaggatgatgacgaggtccccggaggcggaggcggaggtggaggtggtggtcatggactccgtcggccacttcccgcagctcgtcgcgccgcagcagctgctcgccgtgctccagcgcgtgctccagcgtgaagaggaggacgagcaggcgggtgaagcggccaaggtggtggatggcatcgatgtcatggcctag

SEQ ID NO: 5042 - protein, 273 aa, Sorghum bicolor
  misc_feature: Ceres ANNOT ID no. 6041010
  misc_feature (41)..(248): Pfam Id: Abhydrolase_1 Pfam Desc: alpha/beta hydrolase fold
  misc_feature (6)..(266): NCBI GI: 20521314 NCBI Desc: hydrolase-like [oryza sativa (japonica cultivar-group)]
  misc_feature (6)..(253): NCBI GI: 92883690 NCBI Desc: alpha/beta hydrolase fold [medicago truncatula]
  misc_feature (6)..(251): NCBI GI: 92880621 NCBI Desc: alpha/beta hydrolase fold [medicago truncatula]
  misc_feature (6)..(204): NCBI GI: 94442920 NCBI Desc: hydrolase [platanus x acerifolia]
  misc_feature (6)..(243): NCBI GI: 45656451 NCBI Desc: hydrolase [leptospira interrogans serovar copenhageni str. fiocruz l1-130]
MRWYANVKEVGGGDTTVVLAHGYGANQTLWDKLLPALSEHHRVILFDWDFTGAGDDEEAGRYTFGRFADDLIALMDDKGVRGAVVVGHSMSAMAACIASVRRPDLFAHLVLLCASPRASIDGMLGAMSSDFVAWVKGFVPNAAGGDSSAAVALEQSFLSMHRSVALEVARMIFLGDQRGVLDAVAAPCTVVQVAGDFAAPPAVAEYMRQRMMTRSPEAEAEVEVVVMDSVGHFPQLVAPQQLLAVLQRVLQREEEDEQAGEAAKVVDGIDVMA

SEQ ID NO: 5043 - DNA, 837 bp, Sorghum bicolor
  misc_feature: Ceres ANNOT ID no. 6041017
  misc_feature: Encodes the peptide sequence at SEQ ID NO 5044
atgggcaacctgtgctgctgtgttcaaggagcagttggcaagttagacggcgtgcatgagccaggatgccactgcatgccttggttcgttgggaagcgtgtagctggtcatctcacactcaggctgcagcaactggatgtgcgctgtgagaccaaaacaaaggacaatgtctttgtcaatgtggtggcatctattcagtaccgcgctctggctggcaaagcaagtgatgcattctacaaactgagcaacacaaggtcccagatccaagcttacgtctttgacgttatcagagcaagcgttcccaagctccatttggacgatgctttcgagcagaaggacgagatcgcaaaggctgtggaggaagagcttgagaaggccatgtcggcttatggctttgagatcgtgcagactctcattgtggacatcgagccagatgaacatgtgaagcgcgcaatgaacgagatcaacgcagctgcgaggctgagggcggctgcaaacgagaaagcagaggcagagaagattgtgcagatcaagcgtgcggagggggaggcggaagccaagtacctgtctgggctgggtattgcacggcagcggcaggcgatcgttgatgggctgagggacagcgtgcttgggttctccgtgaacgtgccgggcaccaccgccaaggacgtcatggacatggtgctcatcacccagtacttcgacaccatgaaggagattggcgcatcatccaaggcttcatcagtgttcatcccacatggcccaggtgcagtgcgcgacatcgccacgcagatccgcgacggcctcctgcagggctcctctgtcacccagcactag

SEQ ID NO: 5044 - protein, 278 aa, Sorghum bicolor
  misc_feature: Ceres ANNOT ID no. 6041017
  misc_feature (6)..(173): Pfam Id: Band_7 Pfam Desc: SPFH domain / Band 7 family
  misc_feature (1)..(278): NCBI GI: 7716470 NCBI Desc: hypersensitive-induced response protein [zea mays]
  misc_feature (1)..(278): NCBI GI: 23345050 NCBI Desc: hypersensitive-induced reaction protein 3 [hordeum vulgare subsp. vulgare]
  misc_feature (1)..(274): NCBI GI: 21554781 NCBI Desc: hypersensitive-induced response protein [arabidopsis thaliana]
  misc_feature (1)..(273): NCBI GI: 46452120 NCBI Desc: hypersensitive-induced reaction protein [capsicum annuum]
  misc_feature (8)..(275): NCBI GI: 14150732 NCBI Desc: hypersensitive-induced response protein [oryza sativa]
MGNLCCCVQGAVGKLDGVHEPGCHCMPWFVGKRVAGHLTLRLQQLDVRCETKTKDNVFVNVVASIQYRALAGKASDAFYKLSNTRSQIQAYVFDVIRASVPKLHLDDAFEQKDEIAKAVEEELEKAMSAYGFEIVQTLIVDIEPDEHVKRAMNEINAAARLRAAANEKAEAEKIVQIKRAEGEAEAKYLSGLGIARQRQAIVDGLRDSVLGFSVNVPGTTAKDVMDMVLITQYFDTMKEIGASSKASSVFIPHGPGAVRDIATQIRDGLLQGSSVTQH

SEQ ID NO: 5045 - DNA, 954 bp, Sorghum bicolor
  misc_feature: Ceres ANNOT ID no. 6041019
  misc_feature: Encodes the peptide sequence at SEQ ID NO 5046
atggccgccgccgccgccgccggcaacaagcaaggaggaggaggctgctgcaagccgccgcctgcagcagctgatcaggagttgttggacccgaggtacgagtggcaggagaatgccaccagcttcatcctccgcatccacctctcaggcttcaggaaacaagatttcagggtgcaagtcgacggcgccggccgcctcaccgtccgcggccagcgctccgacgccgccaccaaccccaggcactcccgcttcagcaaggtcttccagctgccctccacctccaacctcgacgacatcgccggccgcttcgacgccggagtcctcacgctcaccgtacccaagcgcctgcctgcgtcgcagcagcaggtccgccaggatcaggatcaggcggcggccaagcagcaggaaaaggcaaaggcgccgcccaaggacgacaccgttgccaaggacgaggcggatgccaccgacaagaaaaccgctgccgagcagcaggtggcggacgccaagagcggcaaaccggagccagagcagcagcagcacaaggcggcggcgccaccaccaccggccgtgaggaaggaggaaggcaagcccaaagccggcgccgctgcaccaccaacagcagcagccgacacgaagaagcaggccacgcccaaggccgagccgccgccactggagaggaaggcggtcgatacggagagcctggcggagagggtgaagcggcgcgccgaggaagagcgggccgaaaccgcggctgcggcagaggcggagcgccagaggaagggcttcaaggagcgcgtggcggaggagctgcaggggctggcgggctccgagtgggcggagggcctcgtggagacggtgaagaagaacaaggaggtgatcgccgccgccgtcgccgccttctcccttggcgtcttcgtctccagcaagctcttctgcaggtccagcaggaactaa

SEQ ID NO: 5046 - protein, 317 aa, Sorghum bicolor
  misc_feature: Ceres ANNOT ID no. 6041019
  misc_feature (34)..(126): Pfam Id: HSP20 Pfam Desc: Hsp20/alpha crystallin family
  misc_feature (15)..(151): NCBI GI: 140039776 NCBI Desc: heat shock protein hsp20 [medicago truncatula]
  misc_feature (27)..(258): NCBI GI: 18483234 NCBI Desc: small heat shock-like protein [sorghum bicolor]
  misc_feature (114)..(310): NCBI GI: 50120311 NCBI Desc: tola protein [erwinia carotovora subsp. atroseptica scri1043]
  misc_feature (118)..(281): NCBI GI: 75175938 NCBI Desc: cog3064: membrane protein involved in colicin uptake [shigella boydii bs512]
  misc_feature (114)..(280): NCBI GI: 75194899 NCBI Desc: cog3064: membrane protein involved in colicin uptake [escherichia coli hs]
  misc_feature: The sequence is a functional homolog of SEQ ID NO. 374 in the 11/188,298 US application
MAAAAAAGNKQGGGGCCKPPPAAADQELLDPRYEWQENATSFILRIHLSGFRKQDFRVQVDGAGRLTVRGQRSDAATNPRHSRFSKVFQLPSTSNLDDIAGRFDAGVLTLTVPKRLPASQQQVRQDQDQAAAKQQEKAKAPPKDDTVAKDEADATDKKTAAEQQVADAKSGKPEPEQQQHKAAAPPPPAVRKEEGKPKAGAAAPPTAAADTKKQATPKAEPPPLERKAVDTESLAERVKRRAEEERAETAAAAEAERQRKGFKERVAEELQGLAGSEWAEGLVETVKKNKEVIAAAVAAFSLGVFVSSKLFCRSSRN

SEQ ID NO: 5047 - DNA, 1152 bp, Sorghum bicolor
  misc_feature: Ceres ANNOT ID no. 6041020
  misc_feature: Encodes the peptide sequence at SEQ ID NO 5048
atggcgctcgcgctgcgctgtcccccggccgccacctcctcccggagccccttcctgccgtcgccctcaccggccccgccggggaggctcccgaggaggccgcccgccagctggaggtgccacggctactacggcgacgacggatttcgcaagagctacgaccacatccccaagcagttccgcgaggagaacctcaaggatggactgatggataattacaagaatgttcctcaattcctttatggattaagttctgcacagatggaaatgtttatgaatgacgacaatccttataatcgccaatcccagaaagtcacagaggaaagcgtatctgctgctaggagttacgatgaatttggtatgtacaccttgtcaggcatgcatgagggtcctgcaagttacagcatgggtatgggcatggggggcagcatgagcatgagcatgggcagaggagggagagggtatagaagaatgagaagctctgctccagatctgccatcattgctactggactctcgaattatatttcttggaatgcctattgttccagcagtaactgagcttattgctgctcaatttctatggctagattatgacgaccgcacaaaacccatttatctgtatataaactccactggaactatggacgaaaataacgaacttgttgcatctgaaactgatgcttatgcaattgctgattttatcaatcgaagcaaatccaaggtttacacaatcaatcttagcatggcatatggtcaggctgcgatgcttctttcccttggtgtcaagggcaaaagaggagtgctgccaaattcaatcactaaattacacctgcctaaggtgcacaaatctggtggagctgccattgatatgtggattaaggcaaaagagttagatacaaacacagactactacctcgaactcttgtctaaaggagttggtaaaccaaaggaagagctcgctgagttccttaagggcccaaggtacttcagagcacaagaggctattgattatggacttgctgatacgatcttgcactcactggatggttctttcaagccaaagctggccaaagcacaggcgatgcggcagtcaggtaagcgtgcagctgctggagctgggagatggtcaactccaaccgcacccaggtag

SEQ ID NO: 5048 - protein, 383 aa, Sorghum bicolor
  misc_feature: Ceres ANNOT ID no. 6041020
  misc_feature (160)..(348): Pfam Id: CLP_protease Pfam Desc: Clp protease
  misc_feature (15)..(374): NCBI GI: 23308343 NCBI Desc: at1g49970/f2j10_5 [arabidopsis thaliana]
  misc_feature (163)..(347): NCBI GI: 115435898 NCBI Desc: os01g0271400 [oryza sativa (japonica cultivar-group)]
  misc_feature (157)..(345): NCBI GI: 51971563 NCBI Desc: clpp protease complex subunit clpr3 [arabidopsis thaliana]
  misc_feature (157)..(345): NCBI GI: 51970012 NCBI Desc: clpp protease complex subunit clpr3 [arabidopsis thaliana]
  misc_feature (148)..(345): NCBI GI: 13794458 NCBI Desc: atp-dependent clp protease proteolytic subunit [guillardia theta]
MALALRCPPAATSSRSPFLPSPSPAPPGRLPRRPPASWRCHGYYGDDGFRKSYDHIPKQFREENLKDGLMDNYKNVPQFLYGLSSAQMEMFMNDDNPYNRQSQKVTEESVSAARSYDEFGMYTLSGMHEGPASYSMGMGMGGSMSMSMGRGGRGYRRMRSSAPDLPSLLLDSRIIFLGMPIVPAVTELIAAQFLWLDYDDRTKPIYLYINSTGTMDENNELVASETDAYAIADFINRSKSKVYTINLSMAYGQAAMLLSLGVKGKRGVLPNSITKLHLPKVHKSGGAAIDMWIKAKELDTNTDYYLELLSKGVGKPKEELAEFLKGPRYFRAQEAIDYGLADTILHSLDGSFKPKLAKAQAMRQSGKRAAAGAGRWSTPTAPR

SEQ ID NO: 5049 - DNA, 3270 bp, Sorghum bicolor
  misc_feature: Ceres ANNOT ID no. 6041024
  misc_feature: Encodes the peptide sequence at SEQ ID NO 5050
  misc_feature: Up-regulated in root tissues in response to methyl jasmonate treatment
atgagcgtgtggaactacgtcgtcacggcgcacaagcccaccagcgtcagccactcctgcgtcggcaactttaccagccccaaccagctcaatctcattatcgcgaaatgtacccggatcgagatccatttgctgacccctcagggccttcagccgatgcttgacgtacctatatatggaagaattgcaacgattgagctcttccggcctcataatgagactcaggattttcttttcattgctacggagaggtacaaattctgtgttctgcaatgggatgcagaaaaatcagagctaatcaccagagccatgggtgatgtttctgatcgcattggccgccctactgacaatggacagattggaatcatcgaccctgactgcagactcattggcctccatctctatgatggcttatttaaggttataccatttgacaacaaagggcagctgaaggaagctttcaatatcagactggaagaacttcaagtactggacatcaaatttctgcatggttgtgttaaacctactattgttgtcctctaccaggataataaagacgtgaggcatgttaagacttatgaagttgcactgaaggacaaagattttgttgagggtccttggtctcagaataatgtagacaatggtgctggtttgttaataccagtaccagctccacttggtggtgtgataataattggcgaggagcaaatagtttactgcaatgccaattctacatttaaagcgataccaataaaacaatccatcattagagcttatggacgggttgacccagatggttctcgatatttactcggtgataatactggaattcttcatttacttgtccttacccatgaacgagaaagggttactggtttgaaaattgaatacttgggagagacttccattgcatcatcaatttcatatctcgataatggcgttgtttatgttggttcacggtttggcgattcacagctggtgaagctgaacctccaagctgatgcaagtggttcatttgtggaaatccttgaacggtatgttaatcttggaccgattgtggacttttgcgtggttgaccttgataggcagggtcaaggtcaggtggtcacttgttctggggcatttaaagatggttcccttcgggtggttcggaatggtatagggattaatgagcaggcttcagtagaactccaaggcataaagggattatggtcattgaaatcttcgttcaatgatccatatgacatgtaccttgttgtgagctttataagtgagacacgattcttggcaatgaacatggaagatgaactagaagagactgagatagaggggtttgatgcacaaactcaaaccctgttttgtcagaatgcgaccaatgatcttcttatacaggttactgctaattctgttcggctagtcagttgtacctcccgggagctagtggatcaatggaatgcaccagcaggattctcagtcaatgttgcttcagctaatgctagtcaggttctgttggcaaccggtggtggccatctcgtttacctggaaattagggattctaaacttgttgaagtgaagcatgcacagctagaacatgagatttcttgccttgatttgaacccaatcggggagaatccacagtatagttccctagctgctgttgggatgtggacagatataagcgttagaatattttcacttccagaccttgaattaataaggaaggaaaatttgggtggagaaattgttcctcggtctgttctgctgtgcaccttggagggggtttcatatttgctttgtgctcttggggatggtaatcttttcagttttctgctgaatgcaagtacaggtgaactgactgatagaaagaaagttacccttgggacccaacccatcagccttcgtaccttctcatcaaagggtaccacccatgtgtttgcttcatcagataggccaactgtcatctatagcagcaataagaagcttctctatagcaatgtcaatttgaaagaggttaatcatatgtgccctttcaatacagctgcttttccagacagtcttgcaattgctaaagagggtgagctttcaattggaactattgatgatatccagaagcttcatatccgcacaatcccccttaatgaacaagcacgtcgcatttgtcaccaggagcaatcaaagacactagcattttgcagtttcaagtacaaccagagtgtggaggaaagtgagactcatttaatacgtctgctagatcatcagacttttgagtccctgtgtgtatatcctctagatcaatatgaatttggctgctccatcattagctgttcttttgcggatgataataatgtttattactgtgtgggaactgcatatgttatacctgaagaaaatgaaccaacaaagggtcgaatccttgtatttgcagttgaagatggaagtttgcaattaattgtggagaaagaaaccaaaggagcagtttattcactgaatgcattcaatgggaaattgttggctgctatcaaccagaagattcaattatataagtggatgtcacgcgaggatggttcacatgagctgcaatctgagtgtggccaccatgggcacatacttgccttgtatactcaaacgcgtggtgacttcattgtggttggcgatctgatgaaatcaatatctttgctggtgtataagcatgaggaaagtgcaattgaagagcgtgctagggattacaatgcaaactggatgactgcagttgagatgcttgatgatgaagtctatgttggggcggagaatggctataacctattcaccgtgcgcaagaacagcgatgcagccacagatgacgaaagggccaggcttgaggtcgtgggggagtaccatcttggggagtttgtgaacagattccgccatggttcactggtgatgcgccttccagactcagagattgggcagatccctacagtcatctttggcacaataaacggggtaattggcattattgcctccctcccgcatgatcaatacgtcttcctggagaagctgcagtcgactcttgtgaagtacataaagggcgttgggaacctgagccatgagcaatggcggtcgttccataacgacaagaagacggcggaggctcggaacttccttgacggtgacctgatcgagtcgttccttgaccttagccggagcaagatggaggaggtgtccaaggctatgggcgtcccggtggaggagctgtccaagagggtggaagagctgacgaggcttcactag

SEQ ID NO: 5050 - protein, 1089 aa, Sorghum bicolor
  misc_feature: Ceres ANNOT ID no. 6041024
  misc_feature (741)..(1028): Pfam Id: CPSF_A Pfam Desc: CPSF A subunit region
  misc_feature (1)..(1089): NCBI GI: 12082087 NCBI Desc: uv-damaged dna binding protein [oryza sativa (japonica cultivar-group)]
  misc_feature (1)..(1089): NCBI GI: 38455768 NCBI Desc: uv damaged dna binding protein 1 [lycopersicon esculentum]
  misc_feature (1)..(1089): NCBI GI: 49484911 NCBI Desc: uv-damaged dna binding protein 1 [lycopersicon cheesmanii]
  misc_feature (1)..(1089): NCBI GI: 62318656 NCBI Desc: uv-damaged dna-binding protein- like [arabidopsis thaliana]
  misc_feature (1)..(1011): NCBI GI: 140069634 NCBI Desc: cpsf a subunit, c-terminal; cytochrome cd1-nitrite reductase-like, c-terminal haem d1 [medicago truncatula]
  misc_feature: Up-regulated in root tissues in response to methyl jasmonate treatment
MSVWNYVVTAHKPTSVSHSCVGNFTSPNQLNLIIAKCTRIEIHLLTPQGLQPMLDVPIYGRIATIELFRPHNETQDFLFIATERYKFCVLQWDAEKSELITRAMGDVSDRIGRPTDNGQIGIIDPDCRLIGLHLYDGLFKVIPFDNKGQLKEAFNIRLEELQVLDIKFLHGCVKPTIVVLYQDNKDVRHVKTYEVALKDKDFVEGPWSQNNVDNGAGLLIPVPAPLGGVIIIGEEQIVYCNANSTFKAIPIKQSIIRAYGRVDPDGSRYLLGDNTGILHLLVLTHERERVTGLKIEYLGETSIASSISYLDNGVVYVGSRFGDSQLVKLNLQADASGSFVEILERYVNLGPIVDFCVVDLDRQGQGQVVTCSGAFKDGSLRVVRNGIGINEQASVELQGIKGLWSLKSSFNDPYDMYLVVSFISETRFLAMNMEDELEETEIEGFDAQTQTLFCQNATNDLLIQVTANSVRLVSCTSRELVDQWNAPAGFSVNVASANASQVLLATGGGHLVYLEIRDSKLVEVKHAQLEHEISCLDLNPIGENPQYSSLAAVGMWTDISVRIFSLPDLELIRKENLGGEIVPRSVLLCTLEGVSYLLCALGDGNLFSFLLNASTGELTDRKKVTLGTQPISLRTFSSKGTTHVFASSDRPTVIYSSNKKLLYSNVNLKEVNHMCPFNTAAFPDSLAIAKEGELSIGTIDDIQKLHIRTIPLNEQARRICHQEQSKTLAFCSFKYNQSVEESETHLIRLLDHQTFESLCVYPLDQYEFGCSIISCSFADDNNVYYCVGTAYVIPEENEPTKGRILVFAVEDGSLQLIVEKETKGAVYSLNAFNGKLLAAINQKIQLYKWMSREDGSHELQSECGHHGHILALYTQTRGDFIVVGDLMKSISLLVYKHEESAIEERARDYNANWMTAVEMLDDEVYVGAENGYNLFTVRKNSDAATDDERARLEVVGEYHLGEFVNRFRHGSLVMRLPDSEIGQIPTVIFGTINGVIGIIASLPHDQYVFLEKLQSTLVKYIKGVGNLSHEQWRSFHNDKKTAEARNFLDGDLIESFLDLSRSKMEEVSKAMGVPVEELSKRVEELTRLH

SEQ ID NO: 5051 - DNA, 2274 bp, Sorghum bicolor
  misc_feature: Ceres ANNOT ID no. 6041025
  misc_feature: Encodes the peptide sequence at SEQ ID NO 5052
atgttctggcgcatgaccggcctctccgcggcctcgcccgtggatacaattctggacaaggagaactttacgttggaagagcttcttgacgaggatgaaatcatccaggagtgcaaagcactgaatactcgactcataaatttcttgcgagataaggcccaagtgcagcagttgcttcgttacattgtggaagaagttccagaggaatcagagaagaaacagtctttcaagtttccatttatcgcttgtgagatttttacttgtgaaattgacattattttgagaaccttggtagaggatgttgagctaatggatttacttttctcatttgtaaaacctgaccatccgcatagtaccttgttagctggttacttcagtaaggtggttatctgtttgatgctacggaagactgcttctcttatgaattatgttcaggagcatccaaatattgttgtccagcttgtcgacctcattggtatcacatcaataatggaggtgttgatgagattgattggtgctgatgaaaccatatactcgaatttcgcggatacgttgcattggttagagaatacagatgtactggaaatgattgtggataaatttagctcatcagactctcctgaagtgcatgcaaatgctgctgaaatcctttctgccgtaactcgatgcgctcctcctgctcttgctgcgaaaatatgcagcccaagttttgttggtaggttgtttcgtcacgctcttgaggagtcaagaccaaaatctgttctggttcattcattgtcagtgtgtatatctttgttggaccccaaaagactagcatcagcctcataccaagcatttagaagcaacttaactcacgggacgctggtcacagccagtccagaaacagttgatggtatgctggagagtgacttgttgaagttactggacattacttcttctgaaaatgttttgcctacaacttatggatgtttgcatccacctcttggaaaacaccgtttgaagattgtagagttcatctctgttttgctaacaattggtagcgaagttgctgagaaggagctaataaaccaatcagtgataaagcattgcattgatttattttttctgtacccttataataactttttgcatcatcatgttgagaacattattgtttcttgccttgaggttaaaagaaatcaattgactgaccatatccttaatgactgtggccttgtcgttaaagtccttgctgctgaaaaaagtccatctctgccagtggattctaatgggccaacgttaccgtcagaagggaaacaacctccaagaattgggaatattggacacataactcgaatagcgaataagctcattcaattgggaaatagtaacagcatgatccagagtcacttgcaggagaacagcgagtgggctgtatggcaaacagatgtcctggtcaaacgcaatgaggtggagaacgtttaccattgggcatgtggccgtccaacttctctacatgatcgtgggagggatagcgacgacgacgacttccgagacagagactatgatgtggcagcacttgctaataatctgagccaggcatttcgatatgggatatacagcaatgatgacattgaagaggcacaaggatcccacgaacgagatgatgaggatgtctactttgatgacgagtcggctgaagtagtaatatcttcattgcgtttgggggatgatcaggacagcagttccctcttcacgaattcaaactggtttacgtttgatggagatagaggaatcaatgatcgcctagctgcctctgttccttcatcatcccccaattctgaagagatttccttgaacacggaggaaactgatgaagtgctaactggtgaaaccactggcactgagtcactgctggaaagtgcatcccttgaaaatggtcctgttgaggaggccaaggagctagcagaagttgctaacgacagtgatgctaccacggttagtgagaaaattttgtgtacagaagagcatagcgcctcccatgagcctgaaacctctgagcggcctgtggatgctcaagagggccagactggaggtgtggctgaagcaacgagcacagagggagcaacgaatgaacctttcagctcttctgagcctggcaacttgccagaatctggtgacaccgattgtcacactgccaactcatctgagcctaatgagattgcccatgaatcaggatcacctgcggaggttgatgatgaaaagaaatctgagattgccacaacaaatgaatga

SEQ ID NO: 5052 - protein, 757 aa, Sorghum bicolor
  misc_feature: Ceres ANNOT ID no. 6041025
  misc_feature (129)..(487): Pfam Id: SAPS Pfam Desc: SIT4 phosphatase-associated protein
  misc_feature (1)..(717): NCBI GI: 116309949 NCBI Desc: h0714h04.7 [oryza sativa (indica cultivar-group)]
  misc_feature (1)..(717): NCBI GI: 38344337 NCBI Desc: osjnba0058k23.19 [oryza sativa (japonica cultivar-group)]
  misc_feature (1)..(632): NCBI GI: 115460612 NCBI Desc: os04g0620400 [oryza sativa (japonica cultivar-group)]
  misc_feature (1)..(756): NCBI GI: 42562411 NCBI Desc: sit4 phosphatase-associated family protein [arabidopsis thaliana]
  misc_feature (1)..(756): NCBI GI: 6634768 NCBI Desc: contains similarity to gbd21822 orf from lilium longiflorum. ests gbt03978, gbr89954, gbai995107, gbt20998, gbr65384 come from this gene. [arabidopsis thaliana]
MFWRMTGLSAASPVDTILDKENFTLEELLDEDEIIQECKALNTRLINFLRDKAQVQQLLRYIVEEVPEESEKKQSFKFPFIACEIFTCEIDIILRTLVEDVELMDLLFSFVKPDHPHSTLLAGYFSKVVICLMLRKTASLMNYVQEHPNIVVQLVDLIGITSIMEVLMRLIGADETIYSNFADTLHWLENTDVLEMIVDKFSSSDSPEVHANAAEILSAVTRCAPPALAAKICSPSFVGRLFRHALEESRPKSVLVHSLSVCISLLDPKRLASASYQAFRSNLTHGTLVTASPETVDGMLESDLLKLLDITSSENVLPTTYGCLHPPLGKHRLKIVEFISVLLTIGSEVAEKELINQSVIKHCIDLFFLYPYNNFLHHHVENIIVSCLEVKRNQLTDHILNDCGLVVKVLAAEKSPSLPVDSNGPTLPSEGKQPPRIGNIGHITRIANKLIQLGNSNSMIQSHLQENSEWAVWQTDVLVKRNEVENVYHWACGRPTSLHDRGRDSDDDDFRDRDYDVAALANNLSQAFRYGIYSNDDIEEAQGSHERDDEDVYFDDESAEVVISSLRLGDDQDSSSLFTNSNWFTFDGDRGINDRLAASVPSSSPNSEEISLNTEETDEVLTGETTGTESLLESASLENGPVEEAKELAEVANDSDATTVSEKILCTEEHSASHEPETSERPVDAQEGQTGGVAEATSTEGATNEPFSSSEPGNLPESGDTDCHTANSSEPNEIAHESGSPAEVDDEKKSEIATTNE

SEQ ID NO: 5053 - DNA, 1425 bp, Sorghum bicolor
  misc_feature: Ceres ANNOT ID no. 6041053
  misc_feature: Encodes the peptide sequence at SEQ ID NO 5054
  misc_feature: Up-regulated in shoot tissues in response to salicylic acid treatment
atggagccgcgcatcggcaacaggttccgcgtcggccgcaagctggggagtggctcctttggggagatctacctcggcaccaacgtgcagaccaacgaggaggtcgcaattaaactggaaaatgttaagacaaagcatcctcaattgctttatgaatcgaaattgtacagaatacttcaaggaggaactggaattccaaatgttaagtggtttggtgttgagggtgattacaatgttttggttatggacttactgggaccaagccttgaagatctttttagcttttgtaacaggaagctgtccctcaaaactgttttgatgcttgctgatcaaatgatcaatcgagttgagtttgttcattccaagtcattcttgcatagagatattaagccggacaattttctcatgggtcttgggaaaagggcaaaccaggtttatgttatcgattttggacttgcaaagaagtacagagatacatcaacacaccagcacattccatacagagagaacaagaacttgactggaacagcaagatatgcaagtgtaaatacccaccttggaattgaacaaagccggagggatgacatggaatctcttggatatgtactgatgtacttcttgagaggaagccttccatggcagggcctgaaagctgggaacaagaaacaaaagtatgaaaagatcagcgaaaggaaaattgctacttcaactgaggctctctgtcgtggatatcctactgaatttgcttcttacttccattactgtcgctcactacgttttgaagatgcaccggactatcagtacctgaagagattgttcagagaccttttcattcgggaaggctttcagtttgattatgtttttgactggaccattctaaagtaccaacaggcacagatgaccactgctccaacacgtgcaattgctccaccagtaggacaaagctctgggatggctcctgtggcaaacaacaatagacattcaggcactgaagagggaaggagaagtgggtggtcagacatggacccaacgcgacgccaggctccaccaccagttataaatgccggcagcctagcgaagcagaagtcccctgttcggcctgagacatcgacatccaaagatgctgtgttctccagttcgacttttttgggacgttcaagcggatcttcaaggcggcctgctgtctctagtagccgagagccaagcactgaagcagagcaaacacgtagccgcacgactgacgcaagcccaggggcattccagaggtctggagccccacggtggagcccgcagatgcctgactcctcggacggcaggcgctcgtcttccggcaggcgccactcatctaacccgaagaactacgagtctaccattaggggcatgcagggcctaaacttcgacggcgacgacagggttcactattag

SEQ ID NO: 5054 - protein, 474 aa, Sorghum bicolor
  misc_feature: Ceres ANNOT ID no. 6041053
  misc_feature (9)..(273): Pfam Id: Pkinase Pfam Desc: Protein kinase domain
  misc_feature (9)..(273): Pfam Id: Pkinase_Tyr Pfam Desc: Protein tyrosine kinase
  misc_feature (1)..(474): NCBI GI: 92873006 NCBI Desc: protein kinase [medicago truncatula]
  misc_feature (1)..(473): NCBI GI: 121501708 NCBI Desc: casein kinase [beta vulgaris]
  misc_feature (1)..(470): NCBI GI: 124361134 NCBI Desc: protein kinase [medicago truncatula]
  misc_feature (40)..(466): NCBI GI: 6635385 NCBI Desc: casein kinase i-like protein [brassica oleracea]
  misc_feature (1)..(388): NCBI GI: 549973 NCBI Desc: casein kinase i-like protein; similar to the rat delta isoform of casein kinase i, swiss-prot accession number q06486
  misc_feature (1)..(423): SWISSPROT Homolog: EC 2.7.11.1 Casein kinase I isoform delta-like
  misc_feature: The sequence is a functional homolog of SEQ ID NO 32 in US patent 7179962
  misc_feature: Up-regulated in shoot tissues in response to salicylic acid treatment
  misc_feature: The sequence is a functional homolog of SEQ ID NO. 310 in the 11/188,298 US application
  misc_feature: The sequence is a functional homolog of SEQ ID NO. 332 in the 11/188,298 US application
  misc_feature: The sequence is a functional homolog of SEQ ID NO. 311 in the 11/188,298 US application
  misc_feature: The sequence is a functional homolog of SEQ ID NO. 498 in the 11/188,298 US application
  misc_feature: The sequence is a functional homolog of SEQ ID NO. 358 in the 11/188,298 US application
  misc_feature: The sequence is a functional homolog of SEQ ID NO. 464 in the 11/188,298 US application
  misc_feature: The sequence is a functional homolog of SEQ ID NO. 312 in the 11/188,298 US application
  misc_feature: The sequence is a functional homolog of SEQ ID NO. 399 in the 11/188,298 US application
  misc_feature: The sequence is a functional homolog of SEQ ID NO. 520 in the 11/188,298 US application
  misc_feature: The sequence is a functional homolog of SEQ ID NO. 323 in the 11/188,298 US application
  misc_feature: The sequence is a functional homolog of SEQ ID NO. 441 in the 11/188,298 US application
  misc_feature: The sequence is a functional homolog of SEQ ID NO. 366 in the 11/188,298 US application
  misc_feature: The sequence is a functional homolog of SEQ ID NO. 340 in the 11/188,298 US application
  misc_feature: The sequence is a functional homolog of SEQ ID NO. 495 in the 11/188,298 US application
MEPRIGNRFRVGRKLGSGSFGEIYLGTNVQTNEEVAIKLENVKTKHPQLLYESKLYRILQGGTGIPNVKWFGVEGDYNVLVMDLLGPSLEDLFSFCNRKLSLKTVLMLADQMINRVEFVHSKSFLHRDIKPDNFLMGLGKRANQVYVIDFGLAKKYRDTSTHQHIPYRENKNLTGTARYASVNTHLGIEQSRRDDMESLGYVLMYFLRGSLPWQGLKAGNKKQKYEKISERKIATSTEALCRGYPTEFASYFHYCRSLRFEDAPDYQYLKRLFRDLFIREGFQFDYVFDWTILKYQQAQMTTAPTRAIAPPVGQSSGMAPVANNNRHSGTEEGRRSGWSDMDPTRRQAPPPVINAGSLAKQKSPVRPETSTSKDAVFSSSTFLGRSSGSSRRPAVSSSREPSTEAEQTRSRTTDASPGAFQRSGAPRWSPQMPDSSDGRRSSSGRRHSSNPKNYESTIRGMQGLNFDGDDRVHY

SEQ ID NO: 5055 - DNA, 903 bp, Sorghum bicolor
  misc_feature: Ceres ANNOT ID no. 6041068
  misc_feature: Encodes the peptide sequence at SEQ ID NO 5056
atggagaccactgaacctctacaggatatcatgtgtgagtttcgtgctggtaagatgtctcttgagggaacacgagtggttcctgacacacgcaagggtcttgtccgcgttgggaggggtgaagaaggtttagtccattttcagtggcttgatcgtggacagaacatcgttgaagatgatcaaatcatctttcctgatgaggcggtgtttgagaaggtcacagaatcttctggaagggtttacatcttgaagttcaagcatgacagcagaaaattcttcttctggatgcaggaaccaaatgctaatggggatgcccagacttgcatgcaagttaatgcctacataaaccgaccattagatgctgaggctgatcttcgagtacctattgaagcagaaatgtctgaagatacggccgatgatgatatctcttccagagctgggaatttagttgagagcatgaccgctgatttggctggtgaagtgacgtctgctgctggacctgtactcttggaggatctgcagagaattctgagtgcaatacagccatcaggactaggactaggagacatcttgaagcctgatttggtcttgccattaattgagaacttgcccattgaacaattagcatcacatcttccggagggctcatggactcctgctgatatcattgagcttctccaaagtcctcctttgcgccaacagttagatgcattcacccacgttctacggactgggcagatagaccttgcacaatttggagttgaccccagcaaatataagttcacggttgcctcgttcctggaggcattggaagactcggttggaagaggtgcctctgaagctggagacaaggatggagaggcccagcgaggcagtgggaatgatgccatggacgagagttga

SEQ ID NO: 5056 - protein, 300 aa, Sorghum bicolor
  misc_feature: Ceres ANNOT ID no. 6041068
  misc_feature (9)..(281): Pfam Id: ARM_1 Pfam Desc: Adhesion regulating molecule conserved region
  misc_feature (7)..(284): NCBI GI: 27363336 NCBI Desc: at2g26590/t9j22.26 [arabidopsis thaliana]
  misc_feature (11)..(159): NCBI GI: 61363711 NCBI Desc: adhesion regulating molecule 1 [synthetic construct]
  misc_feature (11)..(159): NCBI GI: 1853971 NCBI Desc: mr 110,000 antigen [homo sapiens]
  misc_feature (11)..(159): NCBI GI: 28373194 NCBI Desc: adhesion regulating molecule 1 precursor [homo sapiens]
  misc_feature (11)..(159): NCBI GI: 118776484 NCBI Desc: tpa: regulatory particle non-atpase 13 [homo sapiens]
METTEPLQDIMCEFRAGKMSLEGTRVVPDTRKGLVRVGRGEEGLVHFQWLDRGQNIVEDDQIIFPDEAVFEKVTESSGRVYILKFKHDSRKFFFWMQEPNANGDAQTCMQVNAYINRPLDAEADLRVPIEAEMSEDTADDDISSRAGNLVESMTADLAGEVTSAAGPVLLEDLQRILSAIQPSGLGLGDILKPDLVLPLIENLPIEQLASHLPEGSWTPADIIELLQSPPLRQQLDAFTHVLRTGQIDLAQFGVDPSKYKFTVASFLEALEDSVGRGASEAGDKDGEAQRGSGNDAMDES

SEQ ID NO: 5057 - DNA, 1440 bp, Sorghum bicolor
  misc_feature: Ceres ANNOT ID no. 6041069
  misc_feature: Encodes the peptide sequence at SEQ ID NO 5058
atggacacccagccggtactcgctcccgctatcgatgccagcgctagcgtcatgtgccagctgctgagccccgagggagaccctctcggcgctgcgctctatctgccccagaacgtcggcaccccgcagctccaggagattgtcaatcagctcctccacaatgaggagaagttgccctatgcattctacgttggagacgaggagctctctgtccagctgggcgcttacatgcggcaaaagaatgccaatgttgaggttactctgcgcatagtatgccaaccacaagcacttttccggatcaggccggtcaaccgatgctctgccacgattgctggccacacggaagctgtaattgctgtttcttttagccctgatggaaagagtttggcgagtggttcaggtgacaccaatgttcgcttttgggacctgagtacacagactccattgttcacatgtaaaggacacaaaaattgggttctctgcattgcgtggtcacctgatggaaaacaacttgttagtggaagcaagtcgggagaactaatattatgggacccaaaaactggaaaccagttgggcactccacttatgggacacaggaaatggattactgctgtatcatgggagccagttcatttacagtctccatgccgccgctttgtaagtgcaagcaaggatggtgatgctcgcatttgggacgtcaccacaaggaaatgtattatttcccttacaggtcacactagttcagtgacttgtgtcaagtggggtggagatggtttgatttatactggttctcaagattgtttaatcaaagtatgggaaacttctcagggaaagttggtcaaaacattgaagggtcacgggcactgggtgaattcgcttgccttgagcacggaatatgttctccgtactggagcatatgaccacacaggcaaaacgttttcgactgccgaagaaatgaaagaggctgctcttgtgagatacaagaagatgaggggtaatgctccggagagactagtttctggttctgatgattttacaatgtttctttgggaaccaacaattagtaaacaacctaaagctcgcatgactggtcatcagaagcttgtaaaccatgtttacttttcccctgatgggcaatggttggcaagtgcatcctttgataaatctgtcaagttgtggaacggtattacaggtaaatttgttgcagctttcagagggcacgttgcagatgtctaccagatcagctggtctgctgacagtaggcttctacttagcggaagcaaggattccactctaaagatttgggatattcgaacgcacaagttgaaaatggacctgccgggccacgcagatgaggtgtacacagttgattggagccctgacggtgaaaaggtggcgtctggtggcaaggatcgggtgctcaagctatggatgaactga

SEQ ID NO: 5058 - protein, 479 aa, Sorghum bicolor
  misc_feature: Ceres ANNOT ID no. 6041069
  misc_feature (104)..(142): Pfam Id: WD40 Pfam Desc: WD domain, G-beta repeat
  misc_feature (146)..(184): Pfam Id: WD40 Pfam Desc: WD domain, G-beta repeat
  misc_feature (189)..(232): Pfam Id: WD40 Pfam Desc: WD domain, G-beta repeat
  misc_feature (236)..(273): Pfam Id: WD40 Pfam Desc: WD domain, G-beta repeat
  misc_feature (277)..(351): Pfam Id: WD40 Pfam Desc: WD domain, G-beta repeat
  misc_feature (356)..(394): Pfam Id: WD40 Pfam Desc: WD domain, G-beta repeat
  misc_feature (398)..(436): Pfam Id: WD40 Pfam Desc: WD domain, G-beta repeat
  misc_feature (440)..(478): Pfam Id: WD40 Pfam Desc: WD domain, G-beta repeat
  misc_feature (16)..(77): Pfam Id: NLE Pfam Desc: NLE (NUC135) domain
  misc_feature (12)..(478): NCBI GI: 40557601 NCBI Desc: notchless-like protein [solanum chacoense]
  misc_feature (17)..(477): NCBI GI: 73921225 NCBI Desc: notchless homolog 1
  misc_feature (17)..(477): NCBI GI: 33877287 NCBI Desc: flj10458 protein [homo sapiens]
  misc_feature (17)..(477): NCBI GI: 21703860 NCBI Desc: notchless gene homolog [mus musculus]
  misc_feature (6)..(477): NCBI GI: 119600571 NCBI Desc: notchless homolog 1 (drosophila), isoform cra_a [homo sapiens]
  misc_feature: The sequence is a functional homolog of SEQ ID NO. 502 in the 11/188,298 US application
  misc_feature: The sequence is a functional homolog of SEQ ID NO. 485 in the 11/188,298 US application
MDTQPVLAPAIDASASVMCQLLSPEGDPLGAALYLPQNVGTPQLQEIVNQLLHNEEKLPYAFYVGDEELSVQLGAYMRQKNANVEVTLRIVCQPQALFRIRPVNRCSATIAGHTEAVIAVSFSPDGKSLASGSGDTNVRFWDLSTQTPLFTCKGHKNWVLCIAWSPDGKQLVSGSKSGELILWDPKTGNQLGTPLMGHRKWITAVSWEPVHLQSPCRRFVSASKDGDARIWDVTTRKCIISLTGHTSSVTCVKWGGDGLIYTGSQDCLIKVWETSQGKLVKTLKGHGHWVNSLALSTEYVLRTGAYDHTGKTFSTAEEMKEAALVRYKKMRGNAPERLVSGSDDFTMFLWEPTISKQPKARMTGHQKLVNHVYFSPDGQWLASASFDKSVKLWNGITGKFVAAFRGHVADVYQISWSADSRLLLSGSKDSTLKIWDIRTHKLKMDLPGHADEVYTVDWSPDGEKVASGGKDRVLKLWMN

SEQ ID NO: 5059 - DNA, 765 bp, Sorghum bicolor
  misc_feature: Ceres ANNOT ID no. 6041080
  misc_feature: Encodes the peptide sequence at SEQ ID NO 5060
atggatgatgtacatggacggatagaggtcttcccccaatactttgtgccatcaaaagaagctatggagactcctgatggtctatcaacaagtaagaataacctggatagtccaccaagttcacgtcggcgttcctggactccaagacgagttaagggagctgcatccattttgaatttattgtccattccccgcataagatggtctatgagcaatgaggatgatgacaagcagattgaattatctagagctgaagtagagactttacgaaccgaaattgcagaggctgaggaaagggaatctcacttaaaagctcggttggaaaatatcgatgaagttctgagatttgcacgtctttctggctatctctacattcgaagtcgatggtcccaactccctggagaaccacctatattagacgatgctgatgtggatgactggctacctcgctttgttgttctacaagggcagtgtttgtactattatctgaaatctacagatctgagcccacaagaatctacactgttatgtgatgttgttgaagtagggcagcttccaaactttgtgccagaggacgaaaagacaagatatgcgttttatctgttgacccgtcaaggattgaagtttgaatgctccagtacctccgaaatacaggttgattcatgggtaagagcactgtcaagtgactgcaaattgcgagatggtgctggtgatgatgataagatgaagacgccgagtagccaagtagaagctgggtcatggtag

SEQ ID NO: 5060 - protein, 254 aa, Sorghum bicolor
  misc_feature: Ceres ANNOT ID no. 6041080
  misc_feature (117)..(231): Pfam Id: PH Pfam Desc: PH domain
  misc_feature (1)..(231): NCBI GI: 42573011 NCBI Desc: pleckstrin homology (ph) domain-containing protein-related [arabidopsis thaliana]
MDDVHGRIEVFPQYFVPSKEAMETPDGLSTSKNNLDSPPSSRRRSWTPRRVKGAASILNLLSIPRIRWSMSNEDDDKQIELSRAEVETLRTEIAEAEERESHLKARLENIDEVLRFARLSGYLYIRSRWSQLPGEPPILDDADVDDWLPRFVVLQGQCLYYYLKSTDLSPQESTLLCDVVEVGQLPNFVPEDEKTRYAFYLLTRQGLKFECSSTSEIQVDSWVRALSSDCKLRDGAGDDDKMKTPSSQVEAGSW

SEQ ID NO: 5061 - DNA, 660 bp, Sorghum bicolor
  misc_feature: Ceres ANNOT ID no. 6041087
  misc_feature: Encodes the peptide sequence at SEQ ID NO 5062
atggatgctcgaatcgccaccgctggtgttggcgttggcggcggcgccgggacatgtgccgccggcggattcgtctgggacgtgctgctgtggcgccggggccgcgccgacgtgagcgcctgcctgctggcggccaccgtctcctcctggctgctcttctacggcggcctggtccgcggctacaccttgctgtccctcgcctccagcgtgctcctcctgctcctcaccgtgctcttcctgtgggccaaggcagcgcgcctcctcaacaggccgcagcctcccgtgccggagctgcgtgttccgcagcaggccgtggacgatgcggcggcgctgctgcgctctgctctcgacgccgccttggatgccttccgggacatcgcgctgggcagggactcgctgctcttctaccgagccttcctctgcctgtggagcgtctccatcgtcggcagcctcacagatttcccaaccgcctgctacgcaagcatcgtggctgctctgaccatcccggcgctgtaccacaggcaccaagaatgcatccgcacctacatgagcttcgcctacatgaacctccggatgtacgagatggtgtacgagaggttgtccatgaaatgcttcctcaggatcagggactgggtcatggagctactcaaggatccatga

SEQ ID NO: 5062 - protein, 219 aa, Sorghum bicolor
  misc_feature: Ceres ANNOT ID no. 6041087
  misc_feature (25)..(218): Pfam Id: Reticulon Pfam Desc: Reticulon
  misc_feature (1)..(219): NCBI GI: 115457912 NCBI Desc: os04g0367400 [oryza sativa (japonica cultivar-group)]
  misc_feature (30)..(219): NCBI GI: 116309603 NCBI Desc: osigba0092j07.5 [oryza sativa (indica cultivar-group)]
  misc_feature (22)..(187): NCBI GI: 38345298 NCBI Desc: osjnba0043a12.26 [oryza sativa (japonica cultivar-group)]
  misc_feature (25)..(143): NCBI GI: 145332641 NCBI Desc: reticulon family protein (rtnlb11) [arabidopsis thaliana]
  misc_feature (23)..(203): NCBI GI: 38604042 NCBI Desc: at2g15280 [arabidopsis thaliana]
MDARIATAGVGVGGGAGTCAAGGFVWDVLLWRRGRADVSACLLAATVSSWLLFYGGLVRGYTLLSLASSVLLLLLTVLFLWAKAARLLNRPQPPVPELRVPQQAVDDAAALLRSALDAALDAFRDIALGRDSLLFYRAFLCLWSVSIVGSLTDFPTACYASIVAALTIPALYHRHQECIRTYMSFAYMNLRMYEMVYERLSMKCFLRIRDWVMELLKDP

SEQ ID NO: 5063 - DNA, 870 bp, Sorghum bicolor
  misc_feature: Ceres ANNOT ID no. 6041092
  misc_feature: Encodes the peptide sequence at SEQ ID NO 5064
atggagttctggggtctcgaggttaagcctggaagcactgttaaatgtgagcctggacatggctttatcttgcacctttcccaggctgctcttggggaatcaaagaaaagtgacagtgtcttgatgtatgtcaaagttgatgatgagaagcttgccattggcaccctctctattgacaagaaccctcagatacagtgtgatttggttttcgataaagagttcgagctgtcgcacacatcaaaaactaccagtgtctttctcacagatgaggaggaggaggagctgaacgttcctgttatcaaggaaaacggaaaagctgaagggaaggagaagcagaaaagtcaagagaaggcagtttctgcagcttcaaaatcaagtcttgcttctaggcttgttggaaagaaaagcaaggatgaggatgattctgatgaggatgagactgatgattcggatgtggatgagacggatgattctgatgagggtgagggattatctcctgaagaaggcgacgatgatgattcaagtgatgaggatgataccagtgagggtgaggaggaaacgccaacacctaagaagccagaggcaggcaagaagagagctgctgaaaatgctctgaaaactctgctttctgataagaaagtaaaggttgccacaccgtcagcccagaagacaggtggcaagaagggcgccacccatgtggcaactccatacccagccaagcgggcgggcaagacccctgcaaacaatgacaagtcaaaggagaggtctccaagatctggtcggtcggtcccttgcaaatcgtgcagcaagacgttcaacagtgagatggctctgcaggctcactcaaaggcgaagcatcgggccaagtga

SEQ ID NO: 5064 - protein, 289 aa, Sorghum bicolor
  misc_feature: Ceres ANNOT ID no. 6041092
  misc_feature (1)..(289): NCBI GI: 7716948 NCBI Desc: histone deacetylase 2 isoform b [zea mays]
  misc_feature (1)..(289): NCBI GI: 7716950 NCBI Desc: histone deacetylase 2 isoform c [zea mays]
  misc_feature (1)..(285): NCBI GI: 73919937 NCBI Desc: histone deacetylase 2a (hd2a) (zm-hd2a) (nucleolar histone deacetylase hd2-p39)
  misc_feature (1)..(289): NCBI GI: 115465847 NCBI Desc: os05g0597100 [oryza sativa (japonica cultivar-group)]
  misc_feature (90)..(289): NCBI GI: 109716218 NCBI Desc: histone deacetylase hdac2 [triticum aestivum]
  misc_feature: Useful for making plants with altered Lignin content
  misc_feature: Useful for making plants with modulated drought sensitivity
  misc_feature: Functional homolog of the protein sequence given in SEQ ID NO 12957
MEFWGLEVKPGSTVKCEPGHGFILHLSQAALGESKKSDSVLMYVKVDDEKLAIGTLSIDKNPQIQCDLVFDKEFELSHTSKTTSVFLTDEEEEELNVPVIKENGKAEGKEKQKSQEKAVSAASKSSLASRLVGKKSKDEDDSDEDETDDSDVDETDDSDEGEGLSPEEGDDDDSSDEDDTSEGEEETPTPKKPEAGKKRAAENALKTLLSDKKVKVATPSAQKTGGKKGATHVATPYPAKRAGKTPANNDKSKERSPRSGRSVPCKSCSKTFNSEMALQAHSKAKHRAK

SEQ ID NO: 5065 - DNA, 1110 bp, Sorghum bicolor
  misc_feature: Ceres ANNOT ID no. 6041173
  misc_feature: Encodes the peptide sequence at SEQ ID NO 5066
atgcggggggtgacaagcgcggcgaagcgcgccggggagatggcgttcaacgccggcggcggcgccgtcaactggttcccgggccacatggccgcagcctcccgcgccatccgcgaccgtctcaagctcgccgacctcgtcatcgaggtccgcgacgcccgcattccattatcctcagcaaatgaagaccttcaaccagtgctctcagcaaagaggcgaattcttgctctaaacaagaaggatctagcaaaccccaatataatgaataggtggcttaatcattttgaatcatgtaagcaggattgtatttcagtaaacgcacatagctccaattctgttaatcagcttcttggttttgctgagctgaaactaaaggaagcaatctcaaaggaacccacccttctgattatgcttgttggtgtccctaatgttggcaagtccgcactcataaattccattcatagaattgctacttctcgttttccagtgaaagataaaaaaaaacgggctacagtggggccactgccaggtgttacacaagatattgcggggtataagattgcaactcagcccagtatttatgtgcttgatacacctggtgttcttgtgccaagcataccagatatggagacaggtttaaagcttgctttaacaggagctgttaaagactcggtagtcggggaagaacgtatagcaaaatatttattatctcttcttaacattagaaagacgcctctacactgggagcggttgttgcacagagaagaagagttatgtgaagagatatgcagcagtgataaaaaagacaattcgttacgaaggaaacggttgaataactctgatgccgtatatgttcaggatttagtgtcggaggtgcagaggacactatgtcgtacattcctgaacttcaccggcaacaccgtggaagaaagtgagctggaaaccctcatagacatgcagcttgtggcgctccgcaaggtgttcaggatacctcataagccgttcgatgaaacacagggccctacctctaagaagctgctgactctcttcagatcagggaagcttgggccgttcatccttgacgaccttcctgatgcatctgagaattaa

SEQ ID NO: 5066 - protein, 369 aa, Sorghum bicolor
  misc_feature: Ceres ANNOT ID no. 6041173
  misc_feature (134)..(249): Pfam Id: MMR_HSR1 Pfam Desc: GTPase of unknown function
  misc_feature (1)..(365): NCBI GI: 62701701 NCBI Desc: short integuments 2 [oryza sativa (japonica cultivar-group)]
  misc_feature (8)..(361): NCBI GI: 3600035 NCBI Desc: contains similarity to gtp-binding proteins [arabidopsis thaliana]
  misc_feature (2)..(268): NCBI GI: 67944523 NCBI Desc: gtpase-like protein [bos taurus]
  misc_feature (2)..(240): NCBI GI: 55664852 NCBI Desc: novel protein [homo sapiens]
  misc_feature (2)..(240): NCBI GI: 13325182 NCBI Desc: sprn protein [homo sapiens]
MRGVTSAAKRAGEMAFNAGGGAVNWFPGHMAAASRAIRDRLKLADLVIEVRDARIPLSSANEDLQPVLSAKRRILALNKKDLANPNIMNRWLNHFESCKQDCISVNAHSSNSVNQLLGFAELKLKEAISKEPTLLIMLVGVPNVGKSALINSIHRIATSRFPVKDKKKRATVGPLPGVTQDIAGYKIATQPSIYVLDTPGVLVPSIPDMETGLKLALTGAVKDSVVGEERIAKYLLSLLNIRKTPLHWERLLHREEELCEEICSSDKKDNSLRRKRLNNSDAVYVQDLVSEVQRTLCRTFLNFTGNTVEESELETLIDMQLVALRKVFRIPHKPFDETQGPTSKKLLTLFRSGKLGPFILDDLPDASEN

SEQ ID NO: 5067 - DNA, 312 bp, Sorghum bicolor
  misc_feature: Ceres ANNOT ID no. 6041182
  misc_feature: Encodes the peptide sequence at SEQ ID NO 5068
atggaggtggagtcggccaagtgcgagtgctgcggcctgcgcgaggactgcaccggggagtacatcgccgccgtcaaggcgggcttcggcggccggtggctctgcgggctctgctccgaggcggtgcgcgacgaggtggccgccaagaagcggggcgacctggagggcgcgctcagggaccacatgtccttctgcgccaagttcggcaagaagggacccgcgttccgcgtcgccgacggcatgcgccagatgctgcgcaggcggtccagcgacatctcctccgccgccgccgcttcctccgccgcctcatga

SEQ ID NO: 5068 - protein, 103 aa, Sorghum bicolor
  misc_feature: Ceres ANNOT ID no. 6041182
  misc_feature (1)..(91): NCBI GI: 7715593 NCBI Desc: f20b17.20 [arabidopsis thaliana]
  misc_feature (1)..(64): NCBI GI: 144923428 NCBI Desc: 4fe-4s ferredoxin, iron-sulfur binding [medicago truncatula]
  misc_feature (2)..(103): NCBI GI: 4587551 NCBI Desc: f15i1.18 [arabidopsis thaliana]
MEVESAKCECCGLREDCTGEYIAAVKAGFGGRWLCGLCSEAVRDEVAAKKRGDLEGALRDHMSFCAKFGKKGPAFRVADGMRQMLRRRSSDISSAAAASSAAS

SEQ ID NO: 5069 - DNA, 210 bp, Sorghum bicolor
  misc_feature: Ceres ANNOT ID no. 6041238
  misc_feature: Encodes the peptide sequence at SEQ ID NO 5070
atggcggactgggggccggtgctgatcgggctggtgctcttcatcctgctgtcgccgggcctgctgttccagatccccggcaagggccggatcatcgagttcggcaacttccagaccagcggcctctccatcctcatccacgccgtcatctacttcgccctcctcgccatcttcctcctcgccgtcggcgtccacatttacctcggctag

SEQ ID NO: 5070 - protein, 69 aa, Sorghum bicolor
  misc_feature: Ceres ANNOT ID no. 6041238
  misc_feature (1)..(69): NCBI GI: 115485585 NCBI Desc: os11g0496500 [oryza sativa (japonica cultivar-group)]
  misc_feature (2)..(68): NCBI GI: 1532168 NCBI Desc: localized according to blastn similarity to est sequences; therefore, the coding span corresponds only to an area of similarity since the initation codon and stop codon could not
  misc_feature (2)..(68): NCBI GI: 1532168 (continued) be precisely determined [arabidopsis thaliana]
  misc_feature (3)..(67): NCBI GI: 1532167 NCBI Desc: localized according to blastn similarity to est sequences; therefore, the coding span corresponds only to an area of similarity since the initation codon and stop codon could not
  misc_feature (3)..(67): NCBI GI: 1532167 (continued) be precisely determined [arabidopsis thaliana]
  misc_feature (1)..(64): NCBI GI: 10178281 NCBI Desc: katanin p80 subunit-like protein [arabidopsis thaliana]
  misc_feature: Useful for making plants with altered cell wall content and/or composition
  misc_feature: Functional homolog of the protein sequence encoded by LOCUS at3g01950
  misc_feature: Functional homolog of the protein sequence encoded by LOCUS at5g14110
  misc_feature: GREAT-hit functional homolog of the protein sequence encoded by LOCUS at5g63500
  misc_feature: Useful for making plants with altered cell wall content and/or composition
  misc_feature: Functional homolog of the protein sequence given in SEQ ID NO 13690
MADWGPVLIGLVLFILLSPGLLFQIPGKGRIIEFGNFQTSGLSILIHAVIYFALLAIFLLAVGVHIYLG

SEQ ID NO: 5071 - DNA, 630 bp, Sorghum bicolor
  misc_feature: Ceres ANNOT ID no. 6041251
  misc_feature: Encodes the peptide sequence at SEQ ID NO 5072
atggaggggaccgtgttcacaccctcccttgaggggatgaagcatgtcaagtcggagagtggcgtgatcctgaccaagccgtttctccaagtatgcaagcaaatccttccagtgctagagaaatttgggtcagccatgtcgattgtcaagacggacattggaggcaatatcacgaggctggagacaaaatatgcttctgatcctacaaagtatgaacagttgcacagcttggtgaaagtagaagtcagcgccaagactgccaaaagctctagcagctgtactaatggccttctctggctgacaagagccatggacttcttggttgcgctgttccacaatttggtacatcatccagactggcagatgtcacaagcttgcagtgacgcttacagcaaaacactgaagaaatggcatggctggttggcgagttcgagcttttcggttgccataaagcttgcaccagacaggaagaagttcatggacatcatcagtggttcaggcgacatcaacgctgatattgagaagttctgcgcaacattctcccctttgctggcagaaaaccacaagtttctggctgttgatggtgtttttggatatgtgaaagtatggcattatcaccatcaacaataa

SEQ ID NO: 5072 - protein, 209 aa, Sorghum bicolor
  misc_feature: Ceres ANNOT ID no. 6041251
  misc_feature (10)..(201): Pfam Id: GLTP Pfam Desc: Glycolipid transfer protein (GLTP)
  misc_feature (1)..(196): NCBI GI: 47847777 NCBI Desc: glycolipid transfer protein-like [oryza sativa (japonica cultivar-group)]
  misc_feature (25)..(192): NCBI GI: 38344077 NCBI Desc: osjnba0006b20.21 [oryza sativa (japonica cultivar-group)]
  misc_feature (25)..(192): NCBI GI: 116309799 NCBI Desc: h0525c06.1 [oryza sativa (indica cultivar-group)]
  misc_feature (25)..(204): NCBI GI: 115474419 NCBI Desc: os08g0108700 [oryza sativa (japonica cultivar-group)]
  misc_feature (64)..(191): NCBI GI: 18402939 NCBI Desc: glycolipid transfer protein-related [arabidopsis thaliana]
  misc_feature: Useful for making plants with modulated oxidative stress sensitivity
  misc_feature: Functional homolog of the protein sequence given in SEQ ID NO 13075
  misc_feature: Useful for making plants with modulated oxidative stress sensitivity
  misc_feature: Functional homolog of the protein sequence given in SEQ ID NO 13075
MEGTVFTPSLEGMKHVKSESGVILTKPFLQVCKQILPVLEKFGSAMSIVKTDIGGNITRLETKYASDPTKYEQLHSLVKVEVSAKTAKSSSSCTNGLLWLTRAMDFLVALFHNLVHHPDWQMSQACSDAYSKTLKKWHGWLASSSFSVAIKLAPDRKKFMDIISGSGDINADIEKFCATFSPLLAENHKFLAVDGVFGYVKVWHYHHQQ

SEQ ID NO: 5073 - DNA, 1551 bp, Sorghum bicolor
  misc_feature: Ceres ANNOT ID no. 6041253
  misc_feature: Encodes the peptide sequence at SEQ ID NO 5074
atggggttgcagcagtccaaggaggagctgctgtaccagcaggtcaactacggcaacgtcgacgggattcgcaccctccgggggcagggcgttggccttgagtggattgacaaggaagggaagacacccctgatggtggcctgtatgcggcccgatctgttcgacgtagccaaggtgctgatcgagttgggagctaatgtcaatgcctaccggcctgggtcacattgtgggacagcattgcaccatgctgccaagaaaggacttcagcagactgtccatttactactctcacatggagctaatccattcataccaaacgatgattgcaataccgcccttgaattggcaagggaaaaaggtcatgtgaatgttgtacgtgccatagagggacggctttctcttttttgtggatggatgagggagaactatgctcctgcttttttggatgcaattgctccacagttcatgacaagaaaaatttgggctgttattttaccccgtgaagtgcgaactccaaccaggcctcttaagttagagttagctatatatcccgaattacaggcttctaaaccacgtgttgtagttaaactatggaaatgtcaaattgaacaaccaaagcttaatcaggctgacccttccattatcatttttgacaaaggaacaaagactcgatacaagatcttaccggcctatgaaggtgacaaacagcagcttcaatggttttataatgcctgttgtggcatggcacaggttttcaacacggctccagtaccaccagcaaatctcccaatgccaaacccggcaccagcaaattcatctgtggcgccttcagaactatctgcacccagcaaggaggatgttgaattagcaatggctatcaatgcctccattcaatcagctattgcagagggagtacccaatgttcaaccaaatgcatccactcccaacaacaatggctggagtatccctccaagtaattctcacaacggatggggaccatcagtcactcctgcaccatcaaagacgagtggccaatcccaagcccgggtagatgccccaagcagcagcagcacgtacaatggatgggatgtgcctggaacaagctctggtcaaagttcatcaaaaccccacaaaaccgaaaccaaccctccagtcttgattccacaggaagcacttcaggctcttccaaccccaaccgcgccaccattcgctgaagaaaccttctacagtggtcctgttcactatccatccatagactctacgcctgttgatgtaaccatgccggctaccaccgaaggcggtacaacaggcagtacaacggcagcagcacctacaaaacaggaagaaaacgaagctgatgcaagtgacagcggcaaaactccctccggtacttgtgttatatgtttggatgcccctgtggaaggcgcctgcatcccatgcggtcacatggctggctgcatgtcctgcttgaaggacatagagtcgaagaagtggggatgccctatctgccgtgccacgattaaccaggttgttcgcctctatgctgtttga

SEQ ID NO: 5074 - protein, 516 aa, Sorghum bicolor
  misc_feature: Ceres ANNOT ID no. 6041253
  misc_feature (39)..(72): Pfam Id: Ank Pfam Desc: Ankyrin repeat
  misc_feature (75)..(107): Pfam Id: Ank Pfam Desc: Ankyrin repeat
  misc_feature (1)..(516): NCBI GI: 33146928 NCBI Desc: auxin-regulated protein-like protein [oryza sativa (japonica cultivar-group)]
  misc_feature (1)..(438): NCBI GI: 109676318 NCBI Desc: auxin-regulated protein-like protein [populus trichocarpa]
  misc_feature (256)..(516): NCBI GI: 33146929 NCBI Desc: auxin-regulated protein-like protein [oryza sativa (japonica cultivar-group)]
  misc_feature (1)..(380): NCBI GI: 16974317 NCBI Desc: at3g23280/k14b15_17 [arabidopsis thaliana]
  misc_feature (1)..(218): NCBI GI: 20148547 NCBI Desc: ankyrin homolog [arabidopsis thaliana]
  misc_feature: The sequence is a functional homolog of SEQ ID NO 1839 in the 10/374,780US patent application
  misc_feature: The sequence is a functional homolog of SEQ ID NO 413 in the 11/479,226US patent application
  misc_feature: The sequence is a functional homolog of SEQ ID NO 834 in the 11/435,388US patent application
  misc_feature: Useful for making plants with modulated growth and phenotype characteristics
  misc_feature: The sequence is a functional homolog of SEQ ID NO 1839 in the 20060162006 US patent application
  misc_feature: The sequence is a functional homolog of SEQ ID NO 834 in the 20060272060 US patent application
  misc_feature: The sequence is a functional homolog of SEQ ID NO 413 in the 11/479,226 US patent application
  misc_feature: The sequence is a functional homolog of SEQ ID NO 834 in the 11/435,388 US patent application
MGLQQSKEELLYQQVNYGNVDGIRTLRGQGVGLEWIDKEGKTPLMVACMRPDLFDVAKVLIELGANVNAYRPGSHCGTALHHAAKKGLQQTVHLLLSHGANPFIPNDDCNTALELAREKGHVNVVRAIEGRLSLFCGWMRENYAPAFLDAIAPQFMTRKIWAVILPREVRTPTRPLKLELAIYPELQASKPRVVVKLWKCQIEQPKLNQADPSIIIFDKGTKTRYKILPAYEGDKQQLQWFYNACCGMAQVFNTAPVPPANLPMPNPAPANSSVAPSELSAPSKEDVELAMAINASIQSAIAEGVPNVQPNASTPNNNGWSIPPSNSHNGWGPSVTPAPSKTSGQSQARVDAPSSSSTYNGWDVPGTSSGQSSSKPHKTETNPPVLIPQEALQALPTPTAPPFAEETFYSGPVHYPSIDSTPVDVTMPATTEGGTTGSTTAAAPTKQEENEADASDSGKTPSGTCVICLDAPVEGACIPCGHMAGCMSCLKDIESKKWGCPICRATINQVVRLYAV

SEQ ID NO: 5075 - DNA, 204 bp, Sorghum bicolor
  misc_feature: Ceres ANNOT ID no. 6041279
  misc_feature: Encodes the peptide sequence at SEQ ID NO 5076
atggatccgcagcagccggagcccgtcagctacctctgcggagattgtggagctgagaacaccctgaagcccggagatgtcatccagtgccgtgagtgtggctaccgcatcctctacaagaagcgcacccgccggagtaagaccacatcgttccttctcctttcattcaaatatatgcgattccttgttttcctcatcggttaa

SEQ ID NO: 5076 - protein, 67 aa, Sorghum bicolor
  misc_feature: Ceres ANNOT ID no. 6041279
  misc_feature (11)..(42): Pfam Id: DNA_RNApol_7kD Pfam Desc: DNA directed RNA polymerase, 7 kDa subunit
  misc_feature (9)..(45): NCBI GI: 119358854 NCBI Desc: rpc10 rpc10 subunit of rna polymerases i, ii, and iii, probable (ic) [ostreococcus tauri]
  misc_feature (9)..(45): NCBI GI: 145342466 NCBI Desc: rpc10 subunit of rna polymerases i, ii, and iii, probable [ostreococcus lucimarinus cce9901]
  misc_feature (1)..(45): NCBI GI: 8248885 NCBI Desc: metallothionein-i gene transcription activator [mus sp.]
  misc_feature (1)..(45): NCBI GI: 4826924 NCBI Desc: dna directed rna polymerase ii polypeptide k [homo sapiens]
  misc_feature (1)..(45): NCBI GI: 119612204 NCBI Desc: polymerase (rna) ii (dna directed) polypeptide k, 7.0kda, isoform cra_a [homo sapiens]
  misc_feature (1)..(45): SWISSPROT Homolog: EC 2.7.7.6 DNA-directed RNA polymerases I, II, and III 7.0 kDa polypeptide
MDPQQPEPVSYLCGDCGAENTLKPGDVIQCRECGYRILYKKRTRRSKTTSFLLLSFKYMRFLVFLIG

SEQ ID NO: 5077 - DNA, 1212 bp, Sorghum bicolor
  misc_feature: Ceres ANNOT ID no. 6041530
  misc_feature: Encodes the peptide sequence at SEQ ID NO 5078
atggagcggttcggcgtgctgggcacgcggctgggcctggacggcgtcggcatcggcggaggaggaggtggaggcgagctgccgccggggttccggttccacccgacggacgaggagctcatcacctactacctcctccgcaaggccgtcgacggcagcttctgcggccgcgccatcgccgagatcgacctcaacaagtgcgagccatgggagctcccagccgccattgctgacgatcaccacacaacagacaaggcgaagatgggggagaaggagtggtacttctacagcctccgcgaccgcaagtacccgacggggctgcgcaccaaccgcgccacggtggccgggtactggaaggccaccggcaaggaccgcgagatccgcagcggccgctccggcgcgctggtcggcatgaagaagacgctcgtcttctaccgcggccgcgcacccaaaggacacaagacgcactgggtcatgcacgagttccgcctcgacggcacctacgcctaccatttcctccccacctccacaagggatgagtgggtgatcgcgagggtgttccagaagcccggcgaggtcccacccgcccgcaagcaacaccaccgcctcggcggcctgagcagcgccggcgagtcctgcttctcggactccacctcggcctccatcggcggcggcggaggcgcgtcggcttcatccgcgcctcgcccgctgccgctcacggtcacggacgcctcatcgctgtcgctgtttgcggccaatgccgccgccgacggcgacaccagctcctactgcggcggccacggcggtggcgccgccaacactggcaacaaactggtcaccggccgtgagctcgtgccctgcttctccactagcaccaccaccggcgccgccctggatgccgccgcgctcggcatcgggcagccgtacaacgcagcagtcccgccgccgctggccttcgaggcgccgccgctgccgactccggccttcttcccgaacctgcgttcgtccctgcaggtgcaggacaaccacctccagctgccactgttcctctccgcaggcggaggaggcggcctgtccgggacgctgggtggcggggctctccaccactggcccttcgccggcatggaggtcaaggtcgagggccgctccgcgccgccgcagatggccgtcggccccggccagctcgatggcgccttcggctggggcttctag

SEQ ID NO: 5078 - protein, 403 aa, Sorghum bicolor
  misc_feature: Ceres ANNOT ID no. 6041530
  misc_feature (27)..(165): Pfam Id: NAM Pfam Desc: No apical meristem (NAM) protein
  misc_feature (27)..(189): NCBI GI: 6066595 NCBI Desc: nam [petunia x hybrida]
  misc_feature (21)..(370): NCBI GI: 10177257 NCBI Desc: cuc2 [arabidopsis thaliana]
  misc_feature (27)..(261): NCBI GI: 15232511 NCBI Desc: cup-shaped cotyledon1 protein / cuc1 protein (cuc1) [arabidopsis thaliana]
  misc_feature (26)..(251): NCBI GI: 22597158 NCBI Desc: no apical meristem-like protein [glycine max]
  misc_feature (26)..(251): NCBI GI: 62546191 NCBI Desc: nac5 protein [glycine max]
  misc_feature: The sequence is a functional homolog of SEQ ID NO 476 in the 10/666,642US patent application
  misc_feature: The sequence is a functional homolog of SEQ ID NO 492 in the 11/435,388US patent application
  misc_feature: The sequence is a functional homolog of SEQ ID NO 741 in the 11/479,226US patent application
  misc_feature: Useful for making plants with modulated growth and phenotype characteristics
  misc_feature: The sequence is a functional homolog of SEQ ID NO 492 in the 20060272060 US patent application
  misc_feature: The sequence is a functional homolog of SEQ ID NO 476 in the 20070033671 US patent application
  misc_feature: The sequence is a functional homolog of SEQ ID NO 476 in the 10/666,642 US patent application
  misc_feature: The sequence is a functional homolog of SEQ ID NO 2776 in the 10/374,780 US patent application
  misc_feature: The sequence is a functional homolog of SEQ ID NO 416 in the 10/225,066 US patent application
  misc_feature: The sequence is a functional homolog of SEQ ID NO 2346 in the 10/374,780 US patent application
  misc_feature: The sequence is a functional homolog of SEQ ID NO 238 in the 10/225,068 US patent application
  misc_feature: The sequence is a functional homolog of SEQ ID NO 338 in the 10/412,699 US patent application
  misc_feature: The sequence is a functional homolog of SEQ ID NO 774 in the 11/479,226 US patent application
  misc_feature: The sequence is a functional homolog of SEQ ID NO 2470 in the 10/374,780 US patent application
  misc_feature: The sequence is a functional homolog of SEQ ID NO 798 in the 10/225,066 US patent application
  misc_feature: The sequence is a functional homolog of SEQ ID NO 1196 in the 10/412,699 US patent application
  misc_feature: The sequence is a functional homolog of SEQ ID NO 865 in the 10/374,780 US patent application
  misc_feature: The sequence is a functional homolog of SEQ ID NO 100 in the 10/374,780 US patent application
  misc_feature: The sequence is a functional homolog of SEQ ID NO 318 in the 10/412,699 US patent application
  misc_feature: The sequence is a functional homolog of SEQ ID NO 749 in the 11/479,226 US patent application
  misc_feature: The sequence is a functional homolog of SEQ ID NO 884 in the 10/225,066 US patent application
  misc_feature: The sequence is a functional homolog of SEQ ID NO 316 in the 10/412,699 US patent application
  misc_feature: The sequence is a functional homolog of SEQ ID NO 738 in the 11/479,226 US patent application
  misc_feature: The sequence is a functional homolog of SEQ ID NO 102 in the 10/374,780 US patent application
  misc_feature: The sequence is a functional homolog of SEQ ID NO 886 in the 10/225,066 US patent application
  misc_feature: Useful for making plants with altered carbohydrate content
  misc_feature: Functional homolog of the protein sequence given in SEQ ID NO 13622
  misc_feature: The sequence is a functional homolog of SEQ ID NO. 362 in the 11/188,298 US application
  misc_feature: The sequence is a functional homolog of SEQ ID NO. 466 in the 11/188,298 US application
  misc_feature: The sequence is a functional homolog of SEQ ID NO. 335 in the 11/188,298 US application
MERFGVLGTRLGLDGVGIGGGGGGGELPPGFRFHPTDEELITYYLLRKAVDGSFCGRAIAEIDLNKCEPWELPAAIADDHHTTDKAKMGEKEWYFYSLRDRKYPTGLRTNRATVAGYWKATGKDREIRSGRSGALVGMKKTLVFYRGRAPKGHKTHWVMHEFRLDGTYAYHFLPTSTRDEWVIARVFQKPGEVPPARKQHHRLGGLSSAGESCFSDSTSASIGGGGGASASSAPRPLPLTVTDASSLSLFAANAAADGDTSSYCGGHGGGAANTGNKLVTGRELVPCFSTSTTTGAALDAAALGIGQPYNAAVPPPLAFEAPPLPTPAFFPNLRSSLQVQDNHLQLPLFLSAGGGGGLSGTLGGGALHHWPFAGMEVKVEGRSAPPQMAVGPGQLDGAFGWGF

SEQ ID NO: 5079 - DNA, 1245 bp, Sorghum bicolor
  misc_feature: Ceres ANNOT ID no. 6041555
  misc_feature: Encodes the peptide sequence at SEQ ID NO 5080
atgggtctcatagaactcttcgccacggcatgtgtcccggtctttaacatgcttctgataaccggagttggatcatttttagcaactgattttgctggcatactaagcaaagaagcaagaaaatatttgaacaatatagtattttatgtattcaatccctcccttgttgcaatatacttggcaaaaacaatcaccatggaaagcttggcaaaactgtggtttatgccagtaaatattcttcttgcttttatctttggtctattctttggatggattgtggtaaaagttacaagagcacctgccaagctaaaaggcctcattttgggatgttgttctgctggcaatttgggcaatatttttctcatcatcattccagctctttgcaaagagaaaggaagcccgtttggagcacctgatgtttgtcaggatattggactagcatattcttcactctcactggctatcggtgctgttttcctttggtcgattgtgtataacattgttcatgtcacatcaaacgtgacggaaggagatgatagtgctcaaacaaatgaaacaaaagtgttaaattctggaaatgctacaggagctattgcagaagagaactgctccacctcaaatgactgcaccgatgaatgtgcacttcctttgatatcgacgagcatacgtccaattaaagataaggaaccaatgttggggagaggatggaagtttttgtcatcaatttctaaaacagttgacttgaagaagctctttgctccttcaaccattgcagtgattgttggcttcataattggaggaacacctctgattagaaatgctataattggcgaaagcgccccacttcgtgtcctgcaggaatcgtctgaattgataggtggaggcgcaattccatccgtcacattgataatgggagcaaaccttctgaacggagtacaaggcggggcaagtgttccaccgtcagtgatagccggtgtcatagttgtcagatacattctgctcccgctgctcggcacggcgctggtgaaaggagcagtctggctgggcctcatccagccagaccccctataccagttcatcctccatctgcagtacgccgtgccacccgcaatgaacatcgggactataatgcagctgtttggcgttggggagagcgagtgctcggtgatctttgtgtgggtgtatgcgctcgcctccgtcgccgtgaccatctggtccgccttcttcatgtggatgctgtcgtga

SEQ ID NO: 5080 - protein, 414 aa, Sorghum bicolor
  misc_feature: Ceres ANNOT ID no. 6041555
  misc_feature (9)..(406): Pfam Id: Mem_trans Pfam Desc: Membrane transport protein
  misc_feature (1)..(413): NCBI GI: 140066984 NCBI Desc: auxin efflux carrier [medicago truncatula]
  misc_feature (1)..(414): NCBI GI: 92867962 NCBI Desc: auxin efflux carrier [medicago truncatula]
  misc_feature (1)..(414): NCBI GI: 115480587 NCBI Desc: os09g0554300 [oryza sativa (japonica cultivar-group)]
  misc_feature (1)..(414): NCBI GI: 92867960 NCBI Desc: auxin efflux carrier [medicago truncatula]
  misc_feature (1)..(339): NCBI GI: 22329697 NCBI Desc: auxin efflux carrier family protein [arabidopsis thaliana]
MGLIELFATACVPVFNMLLITGVGSFLATDFAGILSKEARKYLNNIVFYVFNPSLVAIYLAKTITMESLAKLWFMPVNILLAFIFGLFFGWIVVKVTRAPAKLKGLILGCCSAGNLGNIFLIIIPALCKEKGSPFGAPDVCQDIGLAYSSLSLAIGAVFLWSIVYNIVHVTSNVTEGDDSAQTNETKVLNSGNATGAIAEENCSTSNDCTDECALPLISTSIRPIKDKEPMLGRGWKFLSSISKTVDLKKLFAPSTIAVIVGFIIGGTPLIRNAIIGESAPLRVLQESSELIGGGAIPSVTLIMGANLLNGVQGGASVPPSVIAGVIVVRYILLPLLGTALVKGAVWLGLIQPDPLYQFILHLQYAVPPAMNIGTIMQLFGVGESECSVIFVWVYALASVAVTIWSAFFMWMLS

SEQ ID NO: 5081 - DNA, 1245 bp, Sorghum bicolor
  misc_feature: Ceres ANNOT ID no. 6041556
  misc_feature: Encodes the peptide sequence at SEQ ID NO 5082
atggatctcttagaactcttcgtcacggcttgtgtcccggtctttaacatgcttctggtaactggtgttgggtcgtttttggcaaccgattttgctggcatactaagcaaagaagcaagaaaacatttaaacaatatagtattttatgtattcagtccctctcttgttgcaatctatttggcaaaaacaatcaccatggaaagcttggccaaactgtggtttatgccagtaaatattcttcttgcttttacctttggtttatcctttggatggattgtggtaaaagttacaagagcacctgccaagctaagaggcctcattttgggttgttgttctgctggcaatttgggcaacatttttcttatcatcattccagctctttgccaagagaagggaagcccgtttggagcagctgatgtttgtcagaatattggactagcatattcttcactctcaatggctattggtgctgtttttgtgtggtcgattgcatataatattgtccgtgtcacatcaaatttgacggaaggagatgctgatgctcaaacaaatgaaacaaaagtgttaaattcaggaaatgctataggaagtgttgccgaagagaactgctccgcctcaaatgattgcgccgatgaatgtacactccctttgatattgacaagcatacgtccaactaaagataagcattcaatgttggagagagcacagaaggttttatcatcaatttctgaagctgttgacttgaagaagctctttgctccttcaactattgcagtgattgtcggtttcataattggaggaacacctctgattagaaatgctataattggtgacagcgccccacttcgtgtcctgcaggaatcggctgaattgataggtggaggagcaattccgtccatcacattgataatgggagcaaaccttctgaacggagtacgaggcggtgcaagtgttccaccgtcggtgatagctggcgtcatagttgttagatacattctgctcccgctgctcggcacggcgctggtgaagggagcagtccggctgggcctcatccagccagacccgctgtaccagttcatcctccatctgcaatacgccgtgccacccgcaatgaacatcgggactataatgcagttgtttggcgtcggggagagcgagtgctcggtgatcttcgtgtgggtgtacgcgctcgcctccgtcgccgtcaccatctggtccgccttcttcatgtggacgctgtcgtga

SEQ ID NO: 5082 - protein, 414 aa, Sorghum bicolor
  misc_feature: Ceres ANNOT ID no. 6041556
  misc_feature (9)..(406): Pfam Id: Mem_trans Pfam Desc: Membrane transport protein
  misc_feature (1)..(201): NCBI GI: 22329697 NCBI Desc: auxin efflux carrier family protein [arabidopsis thaliana]
  misc_feature (1)..(411): NCBI GI: 140066984 NCBI Desc: auxin efflux carrier [medicago truncatula]
  misc_feature (1)..(414): NCBI GI: 92867962 NCBI Desc: auxin efflux carrier [medicago truncatula]
  misc_feature (1)..(414): NCBI GI: 92867960 NCBI Desc: auxin efflux carrier [medicago truncatula]
  misc_feature (1)..(414): NCBI GI: 115480587 NCBI Desc: os09g0554300 [oryza sativa (japonica cultivar-group)]
MDLLELFVTACVPVFNMLLVTGVGSFLATDFAGILSKEARKHLNNIVFYVFSPSLVAIYLAKTITMESLAKLWFMPVNILLAFTFGLSFGWIVVKVTRAPAKLRGLILGCCSAGNLGNIFLIIIPALCQEKGSPFGAADVCQNIGLAYSSLSMAIGAVFVWSIAYNIVRVTSNLTEGDADAQTNETKVLNSGNAIGSVAEENCSASNDCADECTLPLILTSIRPTKDKHSMLERAQKVLSSISEAVDLKKLFAPSTIAVIVGFIIGGTPLIRNAIIGDSAPLRVLQESAELIGGGAIPSITLIMGANLLNGVRGGASVPPSVIAGVIVVRYILLPLLGTALVKGAVRLGLIQPDPLYQFILHLQYAVPPAMNIGTIMQLFGVGESECSVIFVWVYALASVAVTIWSAFFMWTLS

SEQ ID NO: 5083 - DNA, 1146 bp, Sorghum bicolor
  misc_feature: Ceres ANNOT ID no. 6041557
  misc_feature: Encodes the peptide sequence at SEQ ID NO 5084
atgatggaggtgagcccgtctccggagcaaggagtgatggcgggaagggagccgttcgggctgccgaagaccccggcgacgccgccgtcctcgggggtcacgcagagcctgcgcatggcgtacacgacggacggcaccgccatcttcaccccggtgagctccgcaccgcccgcaacggcaacgtaccaccagcccgtggctgcttcaagcttggctggcgtaggaggcaatggtggcgcgccggtgcactcgggcggcgcgggtgagccggtggccaagaagaagcgtggtcggccaagaaagtacggccccgacggctccatgtcgctggcattggtgcccgtgcccgcatccatcgctgcagcaccggcgccggcgccggcggctcctggagcttccggtcctttctcacctagcggcccgaaggcgctcaacactgcgccgtcagcgtcgccggacggcgcgaagaagcggggccggccgaagggttccaccaacaagaagcacgtgcctgctcttgggccaacaggggcaggttttacacctcatcttatttttgtaaaagccggagaggacgtatcggcaaagatcatgtccttctctcagcacgggacacgcgcggtttgcatcctttcagcaaatggcgccatatcaaatgtgacccttcggcaatctgctacttcaggtggaacggtgacatacgagggtcgtttcgagatactgtctctgtccgggtcgtttcttctgtcagagaatggcggccatcgcagtcgaactggtgggctcagcgtttcgctagcaggcccagatggccgtgtcctgggcggtagtgttgccggacttctgacagctgcttcaccggtacagatcgtagtggggagcttcgacgccgatggaaagaaggagccgaagcggaagaagcttgctccgtcaccgtcagacccatcgccggcgccactaaagctcgcgccggcgacgacgggcgtggcggcagggccgagcagcccgccgtcgagagggacactgagcctgagcgagtcatccagcggcgccccgagcccgccgcacgcaggggccagcggcggcggcggcggccatgggcagcagcagcagccaggggtcttctccggcctgtcctggaaatga

SEQ ID NO: 5084 - protein, 381 aa, Sorghum bicolor
  misc_feature: Ceres ANNOT ID no. 6041557
  misc_feature (1)..(381): NCBI GI: 119657406 NCBI Desc: tpa: at-hook motif nuclear localized protein 2 [oryza sativa (japonica cultivar-group)]
  misc_feature (93)..(381): NCBI GI: 115477244 NCBI Desc: os08g0512400 [oryza sativa (japonica cultivar-group)]
  misc_feature (137)..(361): NCBI GI: 20196849 NCBI Desc: at-hook dna-binding protein (ahp1) [arabidopsis thaliana]
  misc_feature (137)..(361): NCBI GI: 2598227 NCBI Desc: at-hook protein 1 [arabidopsis thaliana]
  misc_feature (137)..(361): NCBI GI: 14326504 NCBI Desc: at2g33620/f4p9.39 [arabidopsis thaliana]
  misc_feature: The sequence is a functional homolog of SEQ ID NO 10 in the 10/225,066US patent application
  misc_feature: The sequence is a functional homolog of SEQ ID NO 10 in the 10/669,824US patent application
  misc_feature: The sequence is a functional homolog of SEQ ID NO 10 in the 10/870,198US patent application
  misc_feature: The sequence is a functional homolog of SEQ ID NO 1012 in the 10/225,066US patent application
  misc_feature: The sequence is a functional homolog of SEQ ID NO 124 in the 10/374,780US patent application
  misc_feature: The sequence is a functional homolog of SEQ ID NO 136 in the 11/375,241US patent application
  misc_feature: The sequence is a functional homolog of SEQ ID NO 1395 in the 10/374,780US patent application
  misc_feature: The sequence is a functional homolog of SEQ ID NO 1399 in the 10/374,780US patent application
  misc_feature: The sequence is a functional homolog of SEQ ID NO 1400 in the 10/374,780US patent application
  misc_feature: The sequence is a functional homolog of SEQ ID NO 1402 in the 10/374,780US patent application
  misc_feature: The sequence is a functional homolog of SEQ ID NO 1403 in the 10/374,780US patent application
  misc_feature: The sequence is a functional homolog of SEQ ID NO 1404 in the 10/374,780US patent application
  misc_feature: The sequence is a functional homolog of SEQ ID NO 1406 in the 10/374,780US patent application
  misc_feature: The sequence is a functional homolog of SEQ ID NO 1408 in the 10/374,780US patent application
  misc_feature: The sequence is a functional homolog of SEQ ID NO 1410 in the 10/374,780US patent application
  misc_feature: The sequence is a functional homolog of SEQ ID NO 1446 in the 10/666,642US patent application
  misc_feature: The sequence is a functional homolog of SEQ ID NO 150 in the 10/412,699US patent application
  misc_feature: The sequence is a functional homolog of SEQ ID NO 1507 in the 10/412,699US patent application
  misc_feature: The sequence is a functional homolog of SEQ ID NO 1509 in the 10/412,699US patent application
  misc_feature: The sequence is a functional homolog of SEQ ID NO 1510 in the 10/412,699US patent application
  misc_feature: The sequence is a functional homolog of SEQ ID NO 1781 in the 11/479,226US patent application
  misc_feature: The sequence is a functional homolog of SEQ ID NO 1873 in the 11/479,226US patent application
  misc_feature: The sequence is a functional homolog of SEQ ID NO 206 in the 10/374,780US patent application
  misc_feature: The sequence is a functional homolog of SEQ ID NO 22 in the 10/669,824US patent application
  misc_feature: The sequence is a functional homolog of SEQ ID NO 22 in the 10/870,198US patent application
  misc_feature: The sequence is a functional homolog of SEQ ID NO 26 in the 10/669,824US patent application
  misc_feature: The sequence is a functional homolog of SEQ ID NO 26 in the 10/870,198US patent application
  misc_feature: The sequence is a functional homolog of SEQ ID NO 2606 in the 10/374,780US patent application
  misc_feature: The sequence is a functional homolog of SEQ ID NO 270 in the 10/374,780US patent application
  misc_feature: The sequence is a functional homolog of SEQ ID NO 28 in the 10/669,824US patent application
  misc_feature: The sequence is a functional homolog of SEQ ID NO 28 in the 10/870,198US patent application
  misc_feature: The sequence is a functional homolog of SEQ ID NO 2836 in the 10/374,780US patent application
  misc_feature: The sequence is a functional homolog of SEQ ID NO 296 in the 10/225,066US patent application
  misc_feature: The sequence is a functional homolog of SEQ ID NO 304 in the 10/374,780US patent application
  misc_feature: The sequence is a functional homolog of SEQ ID NO 32 in the 10/669,824US patent application
  misc_feature: The sequence is a functional homolog of SEQ ID NO 32 in the 10/870,198US patent application
  misc_feature: The sequence is a functional homolog of SEQ ID NO 340 in the 11/435,388US patent application
  misc_feature: The sequence is a functional homolog of SEQ ID NO 342 in the 10/714,887US patent application
  misc_feature: The sequence is a functional homolog of SEQ ID NO 344 in the 11/435,388US patent application
  misc_feature: The sequence is a functional homolog of SEQ ID NO 346 in the 10/714,887US patent application
  misc_feature: The sequence is a functional homolog of SEQ ID NO 346 in the 11/435,388US patent application
  misc_feature: The sequence is a functional homolog of SEQ ID NO 348 in the 10/714,887US patent application
  misc_feature: The sequence is a functional homolog of SEQ ID NO 348 in the 11/435,388US patent application
  misc_feature: The sequence is a functional homolog of SEQ ID NO 350 in the 10/714,887US patent application
  misc_feature: The sequence is a functional homolog of SEQ ID NO 350 in the 11/435,388US patent application
  misc_feature: The sequence is a functional homolog of SEQ ID NO 352 in the 10/714,887US patent application
  misc_feature: The sequence is a functional homolog of SEQ ID NO 352 in the 11/435,388US patent application
  misc_feature: The sequence is a functional homolog of SEQ ID NO 354 in the 10/714,887US patent application
  misc_feature: The sequence is a functional homolog of SEQ ID NO 38 in the 10/669,824US patent application
  misc_feature: The sequence is a functional homolog of SEQ ID NO 38 in the 10/870,198US patent application
  misc_feature: The sequence is a functional homolog of SEQ ID NO 4 in the 10/225,066US patent application
  misc_feature: The sequence is a functional homolog of SEQ ID NO 436 in the 11/435,388US patent application
  misc_feature: The sequence is a functional homolog of SEQ ID NO 44 in the 10/225,066US patent application
  misc_feature: The sequence is a functional homolog of SEQ ID NO 446 in the 10/225,066US patent application
  misc_feature: The sequence is a functional homolog of SEQ ID NO 64 in the 10/669,824US patent application
  misc_feature: The sequence is a functional homolog of SEQ ID NO 64 in the 10/870,198US patent application
  misc_feature: The sequence is a functional homolog of SEQ ID NO 74 in the 11/375,241US patent application
  misc_feature: The sequence is a functional homolog of SEQ ID NO 830 in the 11/435,388US patent application
  misc_feature: The sequence is a functional homolog of SEQ ID NO 838 in the 10/225,066US patent application
  misc_feature: The sequence is a functional homolog of SEQ ID NO 878 in the 10/412,699US patent application
  misc_feature: The sequence is a functional homolog of SEQ ID NO 90 in the 10/669,824US patent application
  misc_feature: Useful for making plants with modulated growth and phenotype characteristics
  misc_feature: The sequence is a functional homolog of SEQ ID NO 150 in the 20040045049 US patent application
  misc_feature: The sequence is a functional homolog of SEQ ID NO 1507 in the 20040045049 US patent application
  misc_feature: The sequence is a functional homolog of SEQ ID NO 1509 in the 20040045049 US patent application
  misc_feature: The sequence is a functional homolog of SEQ ID NO 1510 in the 20040045049 US patent application
  misc_feature: The sequence is a functional homolog of SEQ ID NO 878 in the 20040045049 US patent application
  misc_feature: The sequence is a functional homolog of SEQ ID NO 26 in the 20040128712 US patent application
  misc_feature: The sequence is a functional homolog of SEQ ID NO 28 in the 20040128712 US patent application
  misc_feature: The sequence is a functional homolog of SEQ ID NO 32 in the 20040128712 US patent application
  misc_feature: The sequence is a functional homolog of SEQ ID NO 38 in the 20040128712 US patent application
  misc_feature: The sequence is a functional homolog of SEQ ID NO 64 in the 20040128712 US patent application
  misc_feature: The sequence is a functional homolog of SEQ ID NO 90 in the 20040128712 US patent application
  misc_feature: The sequence is a functional homolog of SEQ ID NO 10 in the 20050160493 US patent application
  misc_feature: The sequence is a functional homolog of SEQ ID NO 1012 in the 20050160493 US patent application
  misc_feature: The sequence is a functional homolog of SEQ ID NO 4 in the 20050160493 US patent application
  misc_feature: The sequence is a functional homolog of SEQ ID NO 44 in the 20050160493 US patent application
  misc_feature: The sequence is a functional homolog of SEQ ID NO 446 in the 20050160493 US patent application
  misc_feature: The sequence is a functional homolog of SEQ ID NO 1012 in the 10/225,066 US patent application
  misc_feature: The sequence is a functional homolog of SEQ ID NO 124 in the 10/374,780 US patent application
  misc_feature: Useful for making plants with modulated light quality response
  misc_feature: Functional homolog of the protein sequence given in SEQ ID NO 13898
  misc_feature: The sequence is a functional homolog of SEQ ID NO 1499 in the 11/479,226 US patent application
  misc_feature: The sequence is a functional homolog of SEQ ID NO 2526 in the 10/374,780 US patent application
  misc_feature: The sequence is a functional homolog of SEQ ID NO 720 in the 10/412,699 US patent application
  misc_feature: The sequence is a functional homolog of SEQ ID NO 762 in the 10/225,066 US patent application
MMEVSPSPEQGVMAGREPFGLPKTPATPPSSGVTQSLRMAYTTDGTAIFTPVSSAPPATATYHQPVAASSLAGVGGNGGAPVHSGGAGEPVAKKKRGRPRKYGPDGSMSLALVPVPASIAAAPAPAPAAPGASGPFSPSGPKALNTAPSASPDGAKKRGRPKGSTNKKHVPALGPTGAGFTPHLIFVKAGEDVSAKIMSFSQHGTRAVCILSANGAISNVTLRQSATSGGTVTYEGRFEILSLSGSFLLSENGGHRSRTGGLSVSLAGPDGRVLGGSVAGLLTAASPVQIVVGSFDADGKKEPKRKKLAPSPSDPSPAPLKLAPATTGVAAGPSSPPSRGTLSLSESSSGAPSPPHAGASGGGGGHGQQQQPGVFSGLSWK

SEQ ID NO: 5085 - DNA, 1830 bp, Sorghum bicolor
  misc_feature: Ceres ANNOT ID no. 6041573
  misc_feature: Encodes the peptide sequence at SEQ ID NO 5086
atggatcaacttgccatgcttgcgacggagctgggtgactcgtcggactttgaggtggagggcatccagaacctcactgagaatgatgtcagcgacgaggagattgagcctgaggacctggcgcggcgaatgtggaaggacagagtcaggctgaggaggatcaaggagcgccagcagaagctcgccctgcagcaggcagagctggagaagttgaggcccaagccgatatccgaccaggccatgcgcaagaagatgtcaagggcgcatgacgggatcctcaagtacatgctcaagctgatgcaggtgtgcaatgcgcgtgggttcgtgtatgggatcatcccggacaaggggaagcctgtcagtggcgcttctgataatatcagagcttggtggaaggagaaggtgaagtttgataagaatgggcctgcagcaattgagaaatacgactctgagaacttagtaaccgcaaatgcccagagtggtggaagtaagaacccgcacagcttgatggatctccaagatgccactcttggttcactgctttcctcattgatgcagcattgtgatccaccgcagcgcaagtacccattggagaagggtgttccgcccccttggtggccttcagggaaggaggaatggtggattgccttgggccttccaagcggccaaattcctccatacaagaaaccacatgatcttaagaaggtttggaaggctggtgtgcttacaggtgtgatcaagcacatgtctcccaactttgataagataagaaatcatgtacggaaatcaaaatgtttgcaggataaaatgactgcaaaagaaagcctgatttggctgggagttttacagagagaagaaagccttgttcacagaattgacaatggtgtatcagagattactccgcgcagtatgccagaggacagaaatggggacacaaatagcagcagtaatgagtatgatgtgtatggttttgaggatgctcctgtttctacatcatctaaagatgatgaacaagatctgtctccagttacacaatctgctgttgagcatgtcccaaaaagaggaagggaaagggcttacaataaacaccctaatcagatcgttcctggtaaggcaaaagaaccaccaaagagaaaaaaagcacgccgcagctccactgttaccgagccagatgcacgcagagttgttgatgcaccagaaaactcaagaaatttgattcctgatatgaatagactggatcaagtagaaatccaaggcaggtctaaccagattgtcatttttgaccatggggacaccacaactgaagctttacaacacagaggagatgctcaagtacaggtccaccttcctggtgctgaggttaataacttcaatagtgccccaactgcaaaccctactcctataagcatatgtatgggtgaccagcctttaccttatcaaaataatgacagcacaaggtcgagatctgaaaatagttttccagtagatgctcatcctggtttaaataatctgcccagcagttatcagaacttacctccgaaacaatcactaccactttccatgatggatcatcatgtggttcccatgggtatcagggcacctactgatagcattccttatggtgatcatatactaggtggtggaagttcaacttctgttcctggagatatgcagcagctcatagattttcctttctatggtgaccaagataagtttgttggcagttcctttgagggattgcctctagactatatcagtatcagcagtccaatcccagatattgatgacttgttgcatgatgatgatttaatggaatacttggggacataa

SEQ ID NO: 5086 - protein, 609 aa, Sorghum bicolor
  misc_feature: Ceres ANNOT ID no. 6041573
  misc_feature (20)..(417): Pfam Id: EIN3 Pfam Desc: Ethylene insensitive 3
  misc_feature (1)..(563): NCBI GI: 115479887 NCBI Desc: os09g0490200 [oryza sativa (japonica cultivar-group)]
  misc_feature (1)..(609): NCBI GI: 121309568 NCBI Desc: ethylene signal transcription factor [musa acuminata]
  misc_feature (3)..(608): NCBI GI: 10241607 NCBI Desc: ethylene insensitive (ein3/eil)-like transcription regulator [fagus sylvatica]
  misc_feature (14)..(606): NCBI GI: 117549794 NCBI Desc: eil1 [prunus persica]
  misc_feature (25)..(371): NCBI GI: 15425733 NCBI Desc: ein3-like protein [cucumis melo]
  misc_feature: The sequence is a functional homolog of SEQ ID NO 204 in the 10/225,068US patent application
  misc_feature: The sequence is a functional homolog of SEQ ID NO 2468 in the 10/374,780US patent application
  misc_feature: Useful for making plants with modulated growth and phenotype characteristics
  misc_feature: The sequence is a functional homolog of SEQ ID NO 204 in the 20050120408 US patent application
  misc_feature: The sequence is a functional homolog of SEQ ID NO 1350 in the 11/479,226 US patent application
  misc_feature: The sequence is a functional homolog of SEQ ID NO 2464 in the 10/374,780 US patent application
  misc_feature: The sequence is a functional homolog of SEQ ID NO 632 in the 10/412,699 US patent application
  misc_feature: The sequence is a functional homolog of SEQ ID NO 818 in the 10/225,066 US patent application
MDQLAMLATELGDSSDFEVEGIQNLTENDVSDEEIEPEDLARRMWKDRVRLRRIKERQQKLALQQAELEKLRPKPISDQAMRKKMSRAHDGILKYMLKLMQVCNARGFVYGIIPDKGKPVSGASDNIRAWWKEKVKFDKNGPAAIEKYDSENLVTANAQSGGSKNPHSLMDLQDATLGSLLSSLMQHCDPPQRKYPLEKGVPPPWWPSGKEEWWIALGLPSGQIPPYKKPHDLKKVWKAGVLTGVIKHMSPNFDKIRNHVRKSKCLQDKMTAKESLIWLGVLQREESLVHRIDNGVSEITPRSMPEDRNGDTNSSSNEYDVYGFEDAPVSTSSKDDEQDLSPVTQSAVEHVPKRGRERAYNKHPNQIVPGKAKEPPKRKKARRSSTVTEPDARRVVDAPENSRNLIPDMNRLDQVEIQGRSNQIVIFDHGDTTTEALQHRGDAQVQVHLPGAEVNNFNSAPTANPTPISICMGDQPLPYQNNDSTRSRSENSFPVDAHPGLNNLPSSYQNLPPKQSLPLSMMDHHVVPMGIRAPTDSIPYGDHILGGGSSTSVPGDMQQLIDFPFYGDQDKFVGSSFEGLPLDYISISSPIPDIDDLLHDDDLMEYLGT

SEQ ID NO: 5087 - DNA, 1206 bp, Sorghum bicolor
  misc_feature: Ceres ANNOT ID no. 6041611
  misc_feature: Encodes the peptide sequence at SEQ ID NO 5088
atgccggcgatgttggcggcgaagtttacggttctccatctatcccagtcaccttcgccgcagtcgagcttccgccttggcatccgcccctccccggcggcgagggcccgctctgtcgctccgcgggcagcagcctctgcgaccgccgtatccgctaaaccggcggcggcttcgtctcccctggttgcggaccgcaaggtcgtccgtatcgggcttcccagcaagggccgtatggccgagcaaaccctaagcctcctcaagagttgccaattgtcggtgaggcagcttaacccacggcagtacactgcggatatcccgctgattccaaatttggaggtttggttccaaaggcctaaggacattgttcgtaaacttcagtcaggcgatcttgaccttggtattgtgggttttgacatagttagtgaatacggggagggcactgaggatttagtggttgttcatgacgctcttgactttggacattgtcgtttgtcccttgcggtacctaaggaaggcatttttgagaacataattactttggaagatttgttaaagatgcctgaatggacagaagaaaggccactgcgtgttgttacaggatttggatatctaggcgataagttcttaagagagaaaggttttaagcatgttcgctttttatctgctgatggagctcttgagtcatatcctcctatgggtatggctgatgctattgtggatctcgtaagtagcggaacgaccttgcgtgagaataacctaaaggaaattgatggtggagtagttttacaaagccaggccactcttgtagcaagtaggaaatctctgcacaagcgtaaaggtgtgttggaggttactcatgagttgcttgaaagactagaagctcacctaagagcaactgcagagttaatggtcaccgcaaacatgaggggaaacagcgcagaagaagtggcagagagagttcttagccagacatcaatatgtggattgcagggcccgactgtaagtcctgtctattgcagacgtgatggaaaagttgatttggaatactatgccattaatgtggttgttccacagaagttgctttacaaatctatccaacaactgagatcaattggtggcagcggagtcttggtaacaaagctgacctacatattcgatgaagagacaccaaggtggcgcaatctcctctcggagctggggttgtaa

SEQ ID NO: 5088 - protein, 401 aa, Sorghum bicolor
  misc_feature: Ceres ANNOT ID no. 6041611
  misc_feature (116)..(296): Pfam Id: HisG Pfam Desc: ATP phosphoribosyltransferase
  misc_feature (297)..(384): Pfam Id: HisG_C Pfam Desc: HisG, C-terminal domain
  misc_feature (45)..(401): NCBI GI: 92868832 NCBI Desc: atp phosphoribosyltransferase [medicago truncatula]
  misc_feature (37)..(401): NCBI GI: 50313437 NCBI Desc: chloroplast atp phosphoribosyl transferase [alyssum lesbiacum]
  misc_feature (17)..(401): NCBI GI: 21593999 NCBI Desc: atp phosphoribosyl transferase [arabidopsis thaliana]
  misc_feature (10)..(401): NCBI GI: 50313453 NCBI Desc: chloroplast atp phosphoribosyl transferase [alyssum montanum]
  misc_feature (2)..(401): NCBI GI: 2688839 NCBI Desc: atp phosphoribosyltransferase [thlaspi goesingense]
MPAMLAAKFTVLHLSQSPSPQSSFRLGIRPSPAARARSVAPRAAASATAVSAKPAAASSPLVADRKVVRIGLPSKGRMAEQTLSLLKSCQLSVRQLNPRQYTADIPLIPNLEVWFQRPKDIVRKLQSGDLDLGIVGFDIVSEYGEGTEDLVVVHDALDFGHCRLSLAVPKEGIFENIITLEDLLKMPEWTEERPLRVVTGFGYLGDKFLREKGFKHVRFLSADGALESYPPMGMADAIVDLVSSGTTLRENNLKEIDGGVVLQSQATLVASRKSLHKRKGVLEVTHELLERLEAHLRATAELMVTANMRGNSAEEVAERVLSQTSICGLQGPTVSPVYCRRDGKVDLEYYAINVVVPQKLLYKSIQQLRSIGGSGVLVTKLTYIFDEETPRWRNLLSELGL

SEQ ID NO: 5089 - DNA, 1080 bp, Sorghum bicolor
  misc_feature: Ceres ANNOT ID no. 6041624
  misc_feature: Encodes the peptide sequence at SEQ ID NO 5090
atggcgaccgcctctctattctccctcccgtcgctccgtgccctctcccgcacctccgcccggtgctcccggttccagaccctcgccgctaggaagccagtggagtcctcctcctccaccgccaccagcggcagccgcagaagcggaggcaaggggggcgggcttctgtcggtgctggaccgcgcgctggcagacgaggaggagtatcggcgcgcgcgcgcccaggtgcagcgcaagggcgtggaggtggaagggtacgccgtcgaggggatctcggtgggcgggcacgagacctgcgtcaccgtgccgtcgctgaacgtcgcgttcgacatcggccgcgggccgcagttcgccgtcagccaggactatctcttcatcacccacgcccacctcgaccacatcggtggtcttccaatgtacatagcgacccgtggcctctacaacttgaagcctcctactgtatttgtaccaccctgcatcaaggatgatgttgaggatctgcttcaagtccatcgtaggatgagtcaaattgagctgaaagttgaattagttgcacttgatttgggagagacatatgaaatacgtaatgatcttgttgccaggccatttcagacataccacgctatacctagccagggttatgtcatctactctattcgaagaaagttgaaaaaacagtatgctcatttgaagggtagtcaaataatgaaactgaagcaatcaggaactgagattacagatacgatactgtacccagaagttgccttcacaggagatacaaagtctgattttattcttgacccaagaaatgcagatgccctgagagcaaaggttctcataactgaggcaacgttcctagatgaccatgttgatgttgagcatgctagggaacatggccacatgcatctttctgagataatggagcattcccagtggttcaggaacgaaacaatcgtactcactcatttctcaaatcgatatagtcttgaggatattcatcaggctgtttccaggctgcaacctaagctaaattcaaagattgttgctctaacagaaggcttcaaatctgaatatagataa

SEQ ID NO: 5090 - protein, 359 aa, Sorghum bicolor
  misc_feature: Ceres ANNOT ID no. 6041624
  misc_feature (51)..(358): NCBI GI: 20975607 NCBI Desc: rnase z [arabidopsis thaliana]
  misc_feature (77)..(354): NCBI GI: 20975609 NCBI Desc: rnase z [arabidopsis thaliana]
  misc_feature (77)..(354): NCBI GI: 5882718 NCBI Desc: ests gbaa067482 and gbai100542 come from this gene. [arabidopsis thaliana]
  misc_feature (81)..(249): NCBI GI: 41017597 NCBI Desc: nuclear ribonuclease z (rnase z) (trna 3 endonuclease) (zinc phosphodiesterase elac)
  misc_feature (86)..(342): NCBI GI: 24216098 NCBI Desc: probable metallo-beta-lactamase superfamily protein [leptospira interrogans serovar lai str. 56601]
  misc_feature (51)..(358): SWISSPROT Homolog: EC 3.1.26.11 Ribonuclease Z, chloroplast precursor
  misc_feature: Useful for biocontainment applications
  misc_feature: Useful for making plants with modulated time to senescence
  misc_feature: Functional homolog of the protein sequence given in SEQ ID NO 13532
MATASLFSLPSLRALSRTSARCSRFQTLAARKPVESSSSTATSGSRRSGGKGGGLLSVLDRALADEEEYRRARAQVQRKGVEVEGYAVEGISVGGHETCVTVPSLNVAFDIGRGPQFAVSQDYLFITHAHLDHIGGLPMYIATRGLYNLKPPTVFVPPCIKDDVEDLLQVHRRMSQIELKVELVALDLGETYEIRNDLVARPFQTYHAIPSQGYVIYSIRRKLKKQYAHLKGSQIMKLKQSGTEITDTILYPEVAFTGDTKSDFILDPRNADALRAKVLITEATFLDDHVDVEHAREHGHMHLSEIMEHSQWFRNETIVLTHFSNRYSLEDIHQAVSRLQPKLNSKIVALTEGFKSEYR

SEQ ID NO: 5091 - DNA, 1878 bp, Sorghum bicolor
  misc_feature: Ceres ANNOT ID no. 6041652
  misc_feature: Encodes the peptide sequence at SEQ ID NO 5092
atgtcaggtagtaaaacgcggtttttcttggtttcttggctcaaacaaaacgatggagctgacgcgccgctctccctcactgcagtgagccatgccgacgagcacgagatatctctgtgcgatcccaactccgaggacgaccggcggcgtcggaagatcgggtcgctgccgcggaaggctatccatgcgctgcgcaagaagcgcgcccggcggcgcgtcactgacttccggttccccgcggccatctccatcgaggacgtccgcgacgccgaggaggagcgcgccgtcgccgccttccgcgaccgtctcgccgcgcaccgcctcctcccggacaagcacgacgactaccacatgatgctgaggtttctgaaagccaggaagttcgattccgagaaggcgatgcaaatgtggtcggagatgctgaggtggaggaaagagtttggtgccgacacgatcttggaggactttgagttcgacgagctcgacgatgtactccagtactatcctcagggctaccatggcgtcgaccgcgaaggcaggccggtgtacattgagaggctgggcaaagttgatcccaacaagctcatgcagatcaccacggtggatcgctacatcaagtaccatgtgcaggaattcgagagggccttcagggagaggttccctgcctgcacactggcagccaagaggcacattgactccactaccactatactggacgtccaaggcgtggggttcaagaatttctcaaagaccgcaagggagcttgtccaacgtatgcagagagtagacagtgactactatcctgagacgctacatcagatgtatgttgtgaatgcaggcagtgggtttaaactgatctggaacagtattaagggattccttgacccaaaaacttcttccaagatccatgttcttggttcgaactaccagagcagacttattgaagttattgactcaagtgaattgccaaaatttcttggcggatcatgcacatgtagtgacaagggtggttgcctcgggtctaataggggtccatggaatgaccctgtcattatgaagctaatacacagtatggaaggtggtagtactagagaaataaagcaagtttctgacggggatgaaagaagtggctcttccctaaggacagaaaacctgaagggtatgctcagtgacatatctaacgctgaatctgagtcggatgttgatgatgttggtttaacagttgtccaaaagagtacagaccacagtttacttaccccagttcatgaagaagtcaaggggtcagattcttcgatattctgtagttctggcagtaagcatctcctagacatgactcctccccagggatcccctccaatggaggtgcccattcaattgacctgccagaaatattttcctacctttggatggctaaacaatttagggagtacttatattagtttgcatggtacatctgctggaaggactttggaaaaccttgttactggactgatcgcagtcttgatcagaatatcatctttcttccaccttttcgtctatagacaagaaagatttctagaaaatgtccatccttatgctgcatcagagcaaccaaaaccacaagttgtaagagaagaggacatgagtgcttgcttacagcgtctcaagaagctcgagtcactgtgcgatcacctcatgagcaaacctccagatatgccgaaagagaaagaacttctattgttgcagtccttcgatcggattaaatcccttgaggctgaactggacatgacgaaaaaagcgttgcaggctgccgtggaaaagcagatggaattggtggatacggtggaggctctgcagcaccgatcgtctagcgttaggagccttgcaggaatgggttga

SEQ ID NO: 5092 - protein, 625 aa, Sorghum bicolor
  misc_feature: Ceres ANNOT ID no. 6041652
  misc_feature (169)..(355): Pfam Id: CRAL_TRIO Pfam Desc: CRAL/TRIO domain
  misc_feature (83)..(152): Pfam Id: CRAL_TRIO_N Pfam Desc: CRAL/TRIO, N-terminus
  misc_feature (45)..(455): NCBI GI: 86438771 NCBI Desc: sec14 cytosolic factor (secretion factor 14) family protein [brachypodium sylvaticum]
  misc_feature (25)..(449): NCBI GI: 38423984 NCBI Desc: phosphatidylinositol transfer-like [oryza sativa (japonica cultivar-group)]
  misc_feature (30)..(609): NCBI GI: 14486705 NCBI Desc: phosphatidylinositol transfer-like protein iii [lotus japonicus]
  misc_feature (50)..(610): NCBI GI: 140039258 NCBI Desc: cellular retinaldehyde-binding/triple function, n-terminal [medicago truncatula]
  misc_feature (30)..(609): NCBI GI: 92870325 NCBI Desc: cellular retinaldehyde-binding/triple function, n-terminal [medicago truncatula]
MSGSKTRFFLVSWLKQNDGADAPLSLTAVSHADEHEISLCDPNSEDDRRRRKIGSLPRKAIHALRKKRARRRVTDFRFPAAISIEDVRDAEEERAVAAFRDRLAAHRLLPDKHDDYHMMLRFLKARKFDSEKAMQMWSEMLRWRKEFGADTILEDFEFDELDDVLQYYPQGYHGVDREGRPVYIERLGKVDPNKLMQITTVDRYIKYHVQEFERAFRERFPACTLAAKRHIDSTTTILDVQGVGFKNFSKTARELVQRMQRVDSDYYPETLHQMYVVNAGSGFKLIWNSIKGFLDPKTSSKIHVLGSNYQSRLIEVIDSSELPKFLGGSCTCSDKGGCLGSNRGPWNDPVIMKLIHSMEGGSTREIKQVSDGDERSGSSLRTENLKGMLSDISNAESESDVDDVGLTVVQKSTDHSLLTPVHEEVKGSDSSIFCSSGSKHLLDMTPPQGSPPMEVPIQLTCQKYFPTFGWLNNLGSTYISLHGTSAGRTLENLVTGLIAVLIRISSFFHLFVYRQERFLENVHPYAASEQPKPQVVREEDMSACLQRLKKLESLCDHLMSKPPDMPKEKELLLLQSFDRIKSLEAELDMTKKALQAAVEKQMELVDTVEALQHRSSSVRSLAGMG

SEQ ID NO: 5093 - DNA, 1878 bp, Sorghum bicolor; identical to SEQ ID NO: 5091
  misc_feature: Ceres ANNOT ID no. 6041657
  misc_feature: Encodes the peptide sequence at SEQ ID NO 5094

SEQ ID NO: 5094 - protein, 625 aa, Sorghum bicolor; identical to SEQ ID NO: 5092
  misc_feature: Ceres ANNOT ID no. 6041657
  misc_feature (169)..(355): Pfam Id: CRAL_TRIO Pfam Desc: CRAL/TRIO domain
  misc_feature (83)..(152): Pfam Id: CRAL_TRIO_N Pfam Desc: CRAL/TRIO, N-terminus
  misc_feature (45)..(455): NCBI GI: 86438771 NCBI Desc: sec14 cytosolic factor (secretion factor 14) family protein [brachypodium sylvaticum]
  misc_feature (25)..(449): NCBI GI: 38423984 NCBI Desc: phosphatidylinositol transfer-like [oryza sativa (japonica cultivar-group)]
  misc_feature (30)..(609): NCBI GI: 14486705 NCBI Desc: phosphatidylinositol transfer-like protein iii [lotus japonicus]
  misc_feature (50)..(610): NCBI GI: 140039258 NCBI Desc: cellular retinaldehyde-binding/triple function, n-terminal [medicago truncatula]
  misc_feature (30)..(609): NCBI GI: 92870325 NCBI Desc: cellular retinaldehyde-binding/triple function, n-terminal [medicago truncatula]

SEQ ID NO: 5095 - DNA, 2163 bp, Sorghum bicolor
  misc_feature: Ceres ANNOT ID no. 6041669
  misc_feature: Encodes the peptide sequence at SEQ ID NO 5096
atgctgctgcggcgccgccggcggtgccggggcgtggtgctgctcctcctcctcgcgtcggtgctcgcgcccctcgtgctgtacggcggctcccccgtctcggtcgcgcccctcccggactccaccgtggcgagcggcgcgttcgacccggagggcgcgtccaatctggtgtggccgcacatggcagcgtccgcggtgtctctggccaaagatttgataattgaaaggcttggggagcacaagaaccgtgtgctatcagcaactgatcgctggcaagtggttgaggcagggagcagcaagagccgtccatctggaaaatcagatactgctgctgtcagggagcggagggcggaagaggaaggtgacccggttgtcgtggggaatggcagtgctggcttggggcaggacggcatcattaaggaggttgtgggaagccagagaagggcagatggatctggtgagaccggggatagcagggaggttggggagcagaacggaaaagaagttgggatggagttgcctcacgcaactgacgtgctgcagaaaaatgggtcagatggactagaaatgaacgacggttctggactgcgcactgttcgaatcctgaattcatcttctatcaaggtagggttctatcttgatctaactgctaaaggcctacttttccaggaaagtggtgctcatagttcatccaacaagactagagagcagcaaacaagtgcaagtaacagtaacactgctcaccatggaacaaatagtattgctggtcaaaccacaactttgtcagatgctacaatccacatcatcaaggaccagctaacaagagcaaagatgtaccttggattgtttgcttctaggggtaatcatggcttcgtgagggagctccgtgcacggatgagggatatacaacgagcactaggcgatgcgaccagtgatcggcaattacctcagaacgtccacagcaaaattagagcaatggagcagacattggtgaaggtcaggagaattcatgatagttgctctagtgctgtgaataggatcaaaacagtccttcactcaacagagcagcaactcgaatcaaacaaaagacaagctaactatctagcgcaagtggcagcaaaatctctacccaagggtctccattgccttacactgcggcttacaaatgagtactatttcaccaactcaaagaataaggactttccctacgtgcagaagctggaagaccccaaactctatcattatgccttgttttcagacaatgtattggctgctgcagtggttgttaactcaactcttgtccatgctaagaagccagaaaaacatgtattccacattgtgactgataggcttaactatgctgcaatgaaaatgtggttcctggctaatcccttgggtaaagctgccattcaggttcagaacattgaagagtttacatggttaaattcaagctacagtccagttctgaagcaattggaaacccagtttatgattaattactacttcagaactgggcatgctaggcatgatgaaaatccgaagtttcggaaccccaagtacttgtcaattctcaaccatctgaggttctatctccctgagatcttcccaaagcttaacaaggtgttatttctggacgatgatactgtagtgcagcgagacctaagtgctctttggttggtagatctcaaaggcaaggttaatggtgctgtcgagacctgtagacaggcattccataggtttgataagtacctcaacttctcaaaccctcttattgccaagaattttgatccacatgcttgcggttgggcatatggcatgaacatgtttgatttgtctgagtggagaaagcaaaacatcactgaggtctaccatacctggcagaagttgaatgaaaacaggctattgtggaagctaggtaccctcccggctggtcttgtaaccttctggaaccgcacgttccctcttgatcattcgtggcatcaattaggacttgggtacaacccaaatgtcaacgaaaaggatatcaggcgagcggctgtcatccactacaatggaaacttgaagccctggcttgagattggattgcccaaataccgcaagtactggtcagcacacgtcaattacgatcaagtgtttctacgggagtgcaatataaacccgtga

SEQ ID NO: 5096 - protein, 720 aa, Sorghum bicolor
  misc_feature: Ceres ANNOT ID no. 6041669
  misc_feature (382)..(694): Pfam Id: Glyco_transf_8 Pfam Desc: Glycosyl transferase family 8
  misc_feature (5)..(720): NCBI GI: 52077295 NCBI Desc: glycosyltransferase family-like [oryza sativa (japonica cultivar-group)]
  misc_feature (97)..(720): NCBI GI: 86438644 NCBI Desc: glycosyl transferase-like protein [brachypodium sylvaticum]
  misc_feature (153)..(720): NCBI GI: 86439693 NCBI Desc: glycosyl transferase-like protein [triticum aestivum]
  misc_feature (230)..(720): NCBI GI: 86438770 NCBI Desc: glycosyl transferase-like protein [brachypodium sylvaticum]
  misc_feature (306)..(720): NCBI GI: 42408867 NCBI Desc: glycosyltransferase family-like [oryza sativa (japonica cultivar-group)]
  misc_feature: Useful for making plants with altered cell wall content and/or composition
  misc_feature: Functional homolog of the protein sequence encoded by LOCUS at5g47780
  misc_feature: Useful for making plants with altered cell wall content and/or composition
  misc_feature: Functional homolog of the protein sequence given in SEQ ID NO 13899
  misc_feature: Useful for making plants with altered carbohydrate content
  misc_feature: Functional homolog of the protein sequence given in SEQ ID NO 13900
MLLRRRRRCRGVVLLLLLASVLAPLVLYGGSPVSVAPLPDSTVASGAFDPEGASNLVWPHMAASAVSLAKDLIIERLGEHKNRVLSATDRWQVVEAGSSKSRPSGKSDTAAVRERRAEEEGDPVVVGNGSAGLGQDGIIKEVVGSQRRADGSGETGDSREVGEQNGKEVGMELPHATDVLQKNGSDGLEMNDGSGLRTVRILNSSSIKVGFYLDLTAKGLLFQESGAHSSSNKTREQQTSASNSNTAHHGTNSIAGQTTTLSDATIHIIKDQLTRAKMYLGLFASRGNHGFVRELRARMRDIQRALGDATSDRQLPQNVHSKIRAMEQTLVKVRRIHDSCSSAVNRIKTVLHSTEQQLESNKRQANYLAQVAAKSLPKGLHCLTLRLTNEYYFTNSKNKDFPYVQKLEDPKLYHYALFSDNVLAAAVVVNSTLVHAKKPEKHVFHIVTDRLNYAAMKMWFLANPLGKAAIQVQNIEEFTWLNSSYSPVLKQLETQFMINYYFRTGHARHDENPKFRNPKYLSILNHLRFYLPEIFPKLNKVLFLDDDTVVQRDLSALWLVDLKGKVNGAVETCRQAFHRFDKYLNFSNPLIAKNFDPHACGWAYGMNMFDLSEWRKQNITEVYHTWQKLNENRLLWKLGTLPAGLVTFWNRTFPLDHSWHQLGLGYNPNVNEKDIRRAAVIHYNGNLKPWLEIGLPKYRKYWSAHVNYDQVFLRECNINP

SEQ ID NO: 5097 - DNA, 267 bp, Sorghum bicolor
  misc_feature: Ceres ANNOT ID no. 6041706
  misc_feature: Encodes the peptide sequence at SEQ ID NO 5098
atggcaagagctctcgcctacggtggagcagctgccgcagctggcttcgtcccgccgtggctcatggtgctcggtgtggccctgctctccgtctgggccatcacgctcaccgtcctcctctgtggggacagctctaacggaccgagacggcgaccaagatactccggaggtggtggaggtggagggggcgatggcggagggggcggctgtggcggtggcggtggcggtggagggggagggggctgtggtggtggcggcggttgctag

SEQ ID NO: 5098 - protein, 88 aa, Sorghum bicolor
  misc_feature: Ceres ANNOT ID no. 6041706
  misc_feature (30)..(87): NCBI GI: 115458522 NCBI Desc: os04g0438100 [oryza sativa (japonica cultivar-group)]
  misc_feature (48)..(87): NCBI GI: 78183598 NCBI Desc: rna-binding region rnp-1 [synechococcus sp. cc9902]
  misc_feature (46)..(86): NCBI GI: 33862287 NCBI Desc: rna-binding region rnp-1 (rna recognition motif) [prochlorococcus marinus str. mit 9313]
  misc_feature (46)..(87): NCBI GI: 37522099 NCBI Desc: rna-binding protein [gloeobacter violaceus pcc 7421]
  misc_feature (42)..(87): NCBI GI: 123231975 NCBI Desc: zinc finger, x-linked, duplicated a [mus musculus]
MARALAYGGAAAAAGFVPPWLMVLGVALLSVWAITLTVLLCGDSSNGPRRRPRYSGGGGGGGGDGGGGGCGGGGGGGGGGGCGGGGGC

SEQ ID NO: 5099 - DNA, 1134 bp, Sorghum bicolor
  misc_feature: Ceres ANNOT ID no. 6041714
  misc_feature: Encodes the peptide sequence at SEQ ID NO 5100
atggggcgagacaagagccggcgtctctccggcagccgcgacttccggcagcgcctggtgctggcgacgctcacctccaccgccgtcaccatcgtggacatccgctccggggacgcggcgccggggctccgccctcacgaggtctccctcctccgcctcctcgacaagatctccgaccaccacaccattgagctcaacgatacaggaacgaagctgaagtaccgaccgggagtgattatagggggaaagggccttgagcacgattgcggggtacaccggggtattggctacttccttgagccgctcatactgcttggtctatttgcgagggctcctatatcgattcggctcaaaggaatcactaatgatacgaaggacccttctgtggatactttccggacaacaaccttgcatatgctcaagcactttggtgttcctctggagggtttcgatctaaaaattgatagccgtggatctcctcctcttggtggcggtgaggtgtctctctgggttcgcaatataaatagcacattgacggcagcaaattgggtagatgaaggtatggtgaagaggataaggggtgtttcgttcgccactagagtatcgccacaattgcaaagccgcattatatatgctgcacgtggaatcttcaatcgcttcattcctgatgttcatatagacaaggatcatagatctggttctgctggtgggaggtcaccaggctatggtgtaacattagttgctgagaccactacgggatgcctgctctctgtagatgtcactgtgagttgtcctagtgttgatgaaataaatgaagaatctgagaagcctgagctgacttctccagaggatcttggtgttcaagctgcatcaatgctactagaagaggtggctcaaggaggtgttgttgactctacacatcagggccttctatttatcctgtgtgctttatgcccacctgatgtatcaaaggttcgagtgggacagctgactccatatggtatagagacacttcgaaacatcagagattttctggacgtcaagttcatcatcaagcctgatcccaattcgaacacagttacattaaaatgtgttggtgcgggagtgaagaatcttgctcggaagatttcataa

SEQ ID NO: 5100 - protein, 377 aa, Sorghum bicolor
  misc_feature: Ceres ANNOT ID no. 6041714
  misc_feature (9)..(353): Pfam Id: RTC Pfam Desc: RNA 3'-terminal phosphate cyclase
  misc_feature (184)..(300): Pfam Id: RTC_insert Pfam Desc: RNA 3'-terminal phosphate cyclase (RTC), insert domain
  misc_feature (7)..(377): NCBI GI: 51968414 NCBI Desc: rna 3'-terminal phosphate cyclase-like protein [arabidopsis thaliana]
  misc_feature (8)..(376): NCBI GI: 28277297 NCBI Desc: mgc53171 protein [xenopus laevis]
  misc_feature (10)..(376): NCBI GI: 55662085 NCBI Desc: otthump00000044448 [homo sapiens]
  misc_feature (10)..(376): NCBI GI: 7688192 NCBI Desc: rna 3'-terminal phosphate cyclase-like protein [homo sapiens]
  misc_feature (11)..(376): NCBI GI: 51467978 NCBI Desc: rna terminal phosphate cyclase-like 1 [danio rerio]
MGRDKSRRLSGSRDFRQRLVLATLTSTAVTIVDIRSGDAAPGLRPHEVSLLRLLDKISDHHTIELNDTGTKLKYRPGVIIGGKGLEHDCGVHRGIGYFLEPLILLGLFARAPISIRLKGITNDTKDPSVDTFRTTTLHMLKHFGVPLEGFDLKIDSRGSPPLGGGEVSLWVRNINSTLTAANWVDEGMVKRIRGVSFATRVSPQLQSRIIYAARGIFNRFIPDVHIDKDHRSGSAGGRSPGYGVTLVAETTTGCLLSVDVTVSCPSVDEINEESEKPELTSPEDLGVQAASMLLEEVAQGGVVDSTHQGLLFILCALCPPDVSKVRVGQLTPYGIETLRNIRDFLDVKFIIKPDPNSNTVTLKCVGAGVKNLARKIS

SEQ ID NO: 5101 - DNA, 2187 bp, Sorghum bicolor
  misc_feature: Ceres ANNOT ID no. 6041718
  misc_feature: Encodes the peptide sequence at SEQ ID NO 5102
atggagaggcagaggctgttcgccacggagaagcacggtggcagggccctgtacaggctccacgccgtcaccgtgttcctggggatatgcctgctgctcggctacagggcgacgcacgtcccggctgccggccccggcagggcggcgtggctggggatgctcgcggcggagctgtggttcgccttctactgggtcatcacgcagtccgtgcgctggtgccccatccgccgccgcgccttcgtcgacaggctcgccgccagatttggagaccggcttccctgtgtggacatcttcgtatgcacagcggacccgcagtcggagccaccaagccttgtcatggccacagtcctgtcactcatggcatacaactacccccctgagaaactgagcgtgtacctctcggacgatgggggatccattctaactttctacgccatgtgggagatctctgccttcgcaaaacactggcttccattctgcaggaggtataacattgagccacggtcaccggcagcttactttgcggcgtcagataagcctcatgatccacacgccttacaagagtggtcatccgtcaaagacctgtatgaagaaatgacagagcgaatcgattccgctgctaggtcaggcaaggttcctgaagaaatcaaagttcaacataaaggattttcagagtggaatacaggtattacctcaaaggatcaccacccaattgttcagattctgatagatggaaagaacagcaatgcagttgacaatgaaggaaatgtactgccaacactggtgtacatggcacgagagaagaggcctcaataccaccataacttcaaagctggggcaatgaacgctctgataagggtgtcatcagtgataagcaacagccctatcatcatgaatgtggactgcgatatgtactcaaacaatagcgattcaattagagatgcgatgtgcttcttccttgatgaagaaatgggtcacaaaatcgcatttgtgcagtaccctcagaactacaataatatgaccaagaacaacatatatggtaactccctcaatgtcatcaatgaggtggagttgagcggtctggacacttggggcggcccattgtacattggcactggatgcttccatagaagggagaccctatgcggcaggaggttcaccaaagactacaaggaagactgggacagaggaatcaagacagagcacagctgcatagaaaagactgaagagaaagcaaagtcattagcaacttgcacttacgaacataacacgcagtggggagatgagatgggactgaaatatggctgcccagtggaagatgttatcaccggactggcgatacattgtagaggatgggagtcggtctatagcaatctcccaagagctggatttatcggtgtagggccaacaacacttgctcagacaatactgcaacacaagcgatggagcgagggtaatttcagtatttttctttcaaagttctgccccttcttgtatgggcatggaaaaaccaagttaccccatcaaatgggatactcaatctatggtttatgggcacccaactcactgcctacactgtattatgttgtcatcccttcactattccttctcaagggcatccccttgttccctgaggtaatgagtccgtggatcacacctttcatatatgtctcagttgtgaagaatatttacagcgcatatgaggcattatcatgtggggaaacattgagaggatggtggaatgcacaaaggatgtggatggtcaaaagaataacctcatacctctacggcgtcattgacaccatccggaaggtgttgggactgtcaaatatggggtttgtagtttcaccaaaggtaagcgatgaagatgaatcaaaaaggtatgagcaagaaatcatggaatttggaacgccgtcgtcggaatatgtgatcatcgcaaccattgcactattgaaccttgtgtgtctggtgggaggactatatcaaataatcctggcaagtggcgagaataaaatggcattgaatgtatttttcctccaagtcattctctgcggggtgctagtgatcatcaatgtcccaatctatgaagccatgttcctcaggaaagacagagggagaataccattctcagtcacactggcctccattggctttgtaatgctggccctctttgtaccattcttttga

SEQ ID NO: 5102 - protein, 728 aa, Sorghum bicolor
  misc_feature: Ceres ANNOT ID no. 6041718
  misc_feature (1)..(729): Pfam Id: Cellulose_synt Pfam Desc: Cellulose synthase
  misc_feature (2)..(726): NCBI GI: 16519225 NCBI Desc: cellulose synthase-like protein oscsle1 [oryza sativa]
  misc_feature (3)..(720): NCBI GI: 115448407 NCBI Desc: os02g0725300 [oryza sativa (japonica cultivar-group)]
  misc_feature (3)..(720): NCBI GI: 16519227 NCBI Desc: cellulose synthase-like protein oscsle2 [oryza sativa]
  misc_feature (2)..(548): NCBI GI: 115479753 NCBI Desc: os09g0478200 [oryza sativa (japonica cultivar-group)]
  misc_feature (6)..(728): NCBI GI: 71493366 NCBI Desc: cellulose synthase-like protein csle [nicotiana tabacum]
  misc_feature: Useful for making plants with altered cell wall content and/or composition
  misc_feature: GREAT-hit functional homolog of the protein sequence encoded by LOCUS at1g55850
  misc_feature: Functional homolog of the protein sequence encoded by LOCUS at4g23990
  misc_feature: Functional homolog of the protein sequence encoded by LOCUS at4g24000
  misc_feature: Useful for making plants with altered cell wall content and/or composition
  misc_feature: Functional homolog of the protein sequence given in SEQ ID NO 13903
MERQRLFATEKHGGRALYRLHAVTVFLGICLLLGYRATHVPAAGPGRAAWLGMLAAELWFAFYWVITQSVRWCPIRRRAFVDRLAARFGDRLPCVDIFVCTADPQSEPPSLVMATVLSLMAYNYPPEKLSVYLSDDGGSILTFYAMWEISAFAKHWLPFCRRYNIEPRSPAAYFAASDKPHDPHALQEWSSVKDLYEEMTERIDSAARSGKVPEEIKVQHKGFSEWNTGITSKDHHPIVQILIDGKNSNAVDNEGNVLPTLVYMAREKRPQYHHNFKAGAMNALIRVSSVISNSPIIMNVDCDMYSNNSDSIRDAMCFFLDEEMGHKIAFVQYPQNYNNMTKNNIYGNSLNVINEVELSGLDTWGGPLYIGTGCFHRRETLCGRRFTKDYKEDWDRGIKTEHSCIEKTEEKAKSLATCTYEHNTQWGDEMGLKYGCPVEDVITGLAIHCRGWESVYSNLPRAGFIGVGPTTLAQTILQHKRWSEGNFSIFLSKFCPFLYGHGKTKLPHQMGYSIYGLWAPNSLPTLYYVVIPSLFLLKGIPLFPEVMSPWITPFIYVSVVKNIYSAYEALSCGETLRGWWNAQRMWMVKRITSYLYGVIDTIRKVLGLSNMGFVVSPKVSDEDESKRYEQEIMEFGTPSSEYVIIATIALLNLVCLVGGLYQIILASGENKMALNVFFLQVILCGVLVIINVPIYEAMFLRKDRGRIPFSVTLASIGFVMLALFVPFF

SEQ ID NO: 5103 - DNA, 1485 bp, Sorghum bicolor
  misc_feature: Ceres ANNOT ID no. 6041724
  misc_feature: Encodes the peptide sequence at SEQ ID NO 5104
atggaacacgccggggtcgcggagcgccttcacggcaagacggtcctcatcacgggcgccaccggattcatagcgaaacttcttgtagagaagatcctgcggctgcagccgcgggtgaagcggctgtacctcctcgtgcgcgcccgtgaccaggattcagcaacggagcgagtccgctcagagattatgcagcttcagatattcctctctttgcgagagaagtaccaaaaccatttcacttcatggttctgggacaagatcttccccgtggcaggagatgtctcattgaacaatttgggtatagggaatgttcatcttgctgaagatatagtgaaagaaacaaatatcatcatccacatggctgctgcagttaacttcagagaaagatatgatacagctttggcgataaacacaatgggcatgaagcatcttctggacgtcgcgttgagatgtgtaaagctagagctcgttcttcttgtgtcaactgcttacgttaactcgaagaaatcaggagtcgtgctggagaagccacttcaacagtacaggagctatgatggccaatcagaattagatatttcagaagaaatagcatttgcagaggcgaagctggaagagctagtttgcagcagtgcttcagaagatgctataaggcacaccatgaagaagattgggacagaaagggctcggaagtttggatggatgaacacctatgtttttacaaaggcgatggctgagatgctggcatatgaacacagatcacggctcccaattttcatcatccgcccaacttccacaacaagcacgttgatggagccttttcctggatggatagaaggaatcaaaacaattgacgtatgggttactaattatggtatggggcatctaaagtttcttcctggagatgtcacaaccatcatggacattgtacctgcagacattgtggtcaatgcgatgctttgtatcatcagttgccaccctcaaggaccattggacttgatttaccatattggttcttccatgcgcaacccactaaagattggagatctgctgcatgcaatgttcagatacttcttggagaaaccatttgtcggtgcagagggagaggtaatcaaggtgaagcagctggttgtgccagcaacaatggacagcttctatgagcacatggacatacactacaagatgcctttggaggatatggtacgccgtggattatctaccactggggagcaagacagatacaaccatctcaagagagagtacaatttcacagtggctgttgcagaagtgtttcaggcaggcacgttcttcaagaggaggtttgatgactccaacatgcagaggcttatcacgtttctgaacgaaagagacagagaactgatcccctgtgatagcaagttcattaattggaagaagtacctcatggaaatccacttccctagtgtcatggaatgtgaatcaagggaagcaacaagggctaggctttaa

SEQ ID NO: 5104 - protein, 494 aa, Sorghum bicolor
  misc_feature: Ceres ANNOT ID no. 6041724
  misc_feature (17)..(318): Pfam Id: NAD_binding_4 Pfam Desc: Male sterility protein
  misc_feature (1)..(483): NCBI GI: 5020217 NCBI Desc: acyl coa reductase [synthetic construct]
  misc_feature (10)..(482): NCBI GI: 110736755 NCBI Desc: acyl coa reductase -like protein [arabidopsis thaliana]
  misc_feature (1)..(483): NCBI GI: 5020215 NCBI Desc: acyl coa reductase [simmondsia chinensis]
  misc_feature (1)..(493): NCBI GI: 38346871 NCBI Desc: osjnbb0002n06.11 [oryza sativa (japonica cultivar-group)]
  misc_feature (10)..(482): NCBI GI: 91806528 NCBI Desc: acyl coa reductase [arabidopsis thaliana]
MEHAGVAERLHGKTVLITGATGFIAKLLVEKILRLQPRVKRLYLLVRARDQDSATERVRSEIMQLQIFLSLREKYQNHFTSWFWDKIFPVAGDVSLNNLGIGNVHLAEDIVKETNIIIHMAAAVNFRERYDTALAINTMGMKHLLDVALRCVKLELVLLVSTAYVNSKKSGVVLEKPLQQYRSYDGQSELDISEEIAFAEAKLEELVCSSASEDAIRHTMKKIGTERARKFGWMNTYVFTKAMAEMLAYEHRSRLPIFIIRPTSTTSTLMEPFPGWIEGIKTIDVWVTNYGMGHLKFLPGDVTTIMDIVPADIVVNAMLCIISCHPQGPLDLIYHIGSSMRNPLKIGDLLHAMFRYFLEKPFVGAEGEVIKVKQLVVPATMDSFYEHMDIHYKMPLEDMVRRGLSTTGEQDRYNHLKREYNFTVAVAEVFQAGTFFKRRFDDSNMQRLITFLNERDRELIPCDSKFINWKKYLMEIHFPSVMECESREATRARL

SEQ ID NO: 5105 - DNA, 2325 bp, Sorghum bicolor
  misc_feature: Ceres ANNOT ID no. 6041736
  misc_feature: Encodes the peptide sequence at SEQ ID NO 5106
atgctctgccggcgcccgtgccccggcgtgttcctccgcctcttcgccacttcctgccgccgcagctccctccacccctcgcagccgcacctcccgagagctacagcgcttccgacgctgcctgtggcgaagaaggtccccttcaatgcgtcggcgcacgggaggtcgtggagcgacccgtaccactggatgcgcgacacctccgacccggacctcgcggccctcctcgccgcagagaacgcgtatgccgacgccttcgtcggctcggcaggtggcggcggcctccgcgcgcgcctcgccgccgagatgcgcgcccggctgcccgcttccgccgccacaccgcctcagccctgggggccttggttgtattatcagtatgttccagagggaaaggaataccctgttttatctaggaagctgaggccttctagtggcctggtcggaactctgcttgattacctttctggttcagagaaggagcaagtgttgcttgactggaacgaggttgcagaaaaaaatggttatgtccacattgggacttgtcgaatctctccagatcataggtttcttgcatatacagttgatacatctgggggtgaactattttcccttgaagtgaaagatcttctgtctgagcttgtcatctttagtccaccagacaagggaatagttagtttggcatgggctggcagcagtgaaagtttattttacactgtctgtgatgagactctacgtcctaaccaggttttctgtaaaaagttgcaatcggatgatgcagggtttttagttttcacagagaaagatgcaaactgttgcgtggatattacaagcacaaaagattttaagtatattactgtttttgtgatcgaatctgataatctaagagaaggcttatggcctatacggaaccgtgttgacaaagttcagtactttttggagcaccacaatgggttcttttacattcttaccaatgctcctgtaaatgataccgaaatgacaactgaaggctactatctggccaggtgtagggctgaaaagtcactggtggatagatggcagattgtgacgttacctgcgccggactgcaccattcaggatatggacatttttcatgataatttagttctctatcttcaaaagaatgggactcctcttttttgctccatcaatatgccaattgatgttgatgttcaggagccaaaggaacttgatgatctcaatccatggtttttccccataccgtcagagttatgcagcattgttgctggatccaacaatgattttatgtcatctacttatcggctagttgtttcatcacctgtgataccagacttaactgtggactatgatttgagaaaaaagactttcaccatccttcatcaagaggaagtaactaccctctctgcaaatctaggcagcctgggctttcaatccaatgcttcaagcatccaacaaaacctgcatcttgttgaaaattcacaaagttggagtgatctttccaagctattctcgtgtcaaaggactgaagttatatcacatgatggtgttctaatacctttagtcatcctgtattcacgggaagcacattgtcatggagaatcacctgggatcttatatggttatggagcttatggagaagatttggacaaaagctggtgttctgagaggttaagtctcctctctcgaggttgggttcttgcatttgcagatgttaggggtggaggggatttatcatggcatctggcaggaaccaaagctaacaagataaattcaattcaagattttgctgcatgtggtatgcatctcataaaggaaggctttgttcaccaaaatcgtctttgtgctataggctgtagtgctggtggtctgctagtgggcgctgttattaatatgcgtccagacttattttctgctgcagttctcaaggttccttttcttgatatctgcaacacaattttggatcctactttgcctctcactgtcttggactatgaagagtttggtgaccctaatatcccagctgaatttgaggcgatcagcagttattctccttatgataacttagcacatggtgtatgctatcctccagtcctggtgactgcctcgtttaatgatacaagggtaggagtttgggaagctgctaagtgggttgcaaaagtaagagatatcacatgcacatcctgttcccagtcagttattctcaaaactaatatgcaaagtggccattttggtgagggtggacgtttcatgcactgtgatgagacagcctttgagtatgcatttctcatgaaggccttgggtttggatgacatagctatgccgtag

SEQ ID NO: 5106 - protein, 774 aa, Sorghum bicolor
  misc_feature: Ceres ANNOT ID no. 6041736
  misc_feature (551)..(769): Pfam Id: Peptidase_S9 Pfam Desc: Prolyl oligopeptidase family
  misc_feature (40)..(462): Pfam Id: Peptidase_S9_N Pfam Desc: Prolyl oligopeptidase, N-terminal beta-propeller domain
  misc_feature (1)..(770): NCBI GI: 52077333 NCBI Desc: protease ii -like [oryza sativa (japonica cultivar-group)]
  misc_feature (41)..(767): NCBI GI: 30697784 NCBI Desc: prolyl oligopeptidase family protein [arabidopsis thaliana]
  misc_feature (500)..(768): NCBI GI: 118064302 NCBI Desc: oligopeptidase b [roseiflexus castenholzii dsm 13941]
  misc_feature (502)..(768): NCBI GI: 76260681 NCBI Desc: peptidase s9, prolyl oligopeptidase active site region:peptidase s9a, prolyl oligopeptidase, n-terminal beta-propeller [chloroflexus aurantiacus j-10-fl]
  misc_feature (502)..(769): NCBI GI: 37519698 NCBI Desc: oligopeptidase [gloeobacter violaceus pcc 7421]
MLCRRPCPGVFLRLFATSCRRSSLHPSQPHLPRATALPTLPVAKKVPFNASAHGRSWSDPYHWMRDTSDPDLAALLAAENAYADAFVGSAGGGGLRARLAAEMRARLPASAATPPQPWGPWLYYQYVPEGKEYPVLSRKLRPSSGLVGTLLDYLSGSEKEQVLLDWNEVAEKNGYVHIGTCRISPDHRFLAYTVDTSGGELFSLEVKDLLSELVIFSPPDKGIVSLAWAGSSESLFYTVCDETLRPNQVFCKKLQSDDAGFLVFTEKDANCCVDITSTKDFKYITVFVIESDNLREGLWPIRNRVDKVQYFLEHHNGFFYILTNAPVNDTEMTTEGYYLARCRAEKSLVDRWQIVTLPAPDCTIQDMDIFHDNLVLYLQKNGTPLFCSINMPIDVDVQEPKELDDLNPWFFPIPSELCSIVAGSNNDFMSSTYRLVVSSPVIPDLTVDYDLRKKTFTILHQEEVTTLSANLGSLGFQSNASSIQQNLHLVENSQSWSDLSKLFSCQRTEVISHDGVLIPLVILYSREAHCHGESPGILYGYGAYGEDLDKSWCSERLSLLSRGWVLAFADVRGGGDLSWHLAGTKANKINSIQDFAACGMHLIKEGFVHQNRLCAIGCSAGGLLVGAVINMRPDLFSAAVLKVPFLDICNTILDPTLPLTVLDYEEFGDPNIPAEFEAISSYSPYDNLAHGVCYPPVLVTASFNDTRVGVWEAAKWVAKVRDITCTSCSQSVILKTNMQSGHFGEGGRFMHCDETAFEYAFLMKALGLDDIAMP

SEQ ID NO: 5107 - DNA, 1563 bp, Sorghum bicolor
  misc_feature: Ceres ANNOT ID no. 6041739
  misc_feature: Encodes the peptide sequence at SEQ ID NO 5108
atgggcatccaagggaacaaggcggggacgcacgagcacgacttcctctcgctgtacgcggccgccgccgccgccaaggacgctcccctcctgctccaccacgactccaaggcgccgccgccgccagcctctcaaggtaatttcctcttgaagacgcacgacttcctgcagccgttggatcagaaaccgggagcgccgccggagccgtcgccgctccccgcttccgccgcggcggagagcaggcaccggcagcagcagcagcagcaggtggtgcacgcgctgcccctgcccggcggcgtcggcaccttcagcatcagccccgcgcccgtgtcggtcgcgctgccggcgcccgccgtcgtcaagtcggagccgccgttcgtgctctggggccagcctgccgcgacgctgcagccgggcgcgcgagggcaccagcagcagcagtgggcgctccccttcgccggcgccgggcaggtcaggccgccgccgccgcagcagcaccaggcgccaccggataggaagggccgtggcggcggcggaggcggggtcatggagtctggctccagatccagcggtggggcggggttcgacgacgacgacgccctcaccacgcgccgcgaggtctcctcctcgctccaagatttgactgtaagggtggacaggaagggtgggagctgcagcgatggtggtacagatcagcggccaaacacaccgcggtcaaaacactcagccacagagcagcgcagacgcagcaagatcaatgataggttccagatactcagggagctgttgccacacaatgatcaaaagagagacaaagcaacatttctcttggaggttattgaatatatacggtttttgcaagagaaagtgcaaaaatacgaggcaacattcccagaatggaaccaagaaaatgcaaagatgcttccatggtcaaatatgtattttcgatcattctggaaaaatgcacagagtaaaggccaaatcccaggagattccccgcctgacccttcacatttcatgagaaatggatcctcccctggatctaatttcactgggaaaatcgatgataatcacaacatagtgacatctgcagctgcatcaggggcacaggatcaggcagaaactgatcacatggctagcgggtgctacagatcagcagaaactccagcgaatattacaaataatgctatatctcagtcccagcctcaatggacaggtccatcccctgtggatgactctgcagtaaacagtgaaatgcttaacaaccagcagttggcaatagatgaaggaacgatcagtgtgtccagtaattattcccaagagttacttaactcgttgactcacgcccttcaaagctcaggtgtagatttgtcccaagccagcatctccgtgcagatcaacctgggaaagcgtgctgtcaagagacctgttgctccttccaactccaaggaaccagctgatccagcatctagtaacgaattaggccatcagctgatgatgttgggtgccggtgccgacaatctctctcacacaacgaagcggcataaaccgggcaacagctga

SEQ ID NO: 5108 - protein, 520 aa, Sorghum bicolor
  misc_feature: Ceres ANNOT ID no. 6041739
  misc_feature (237)..(287): Pfam Id: HLH Pfam Desc: Helix-loop-helix DNA-binding domain
  misc_feature (29)..(520): NCBI GI: 50726634 NCBI Desc: bhlh protein family-like [oryza sativa (japonica cultivar-group)]
  misc_feature (1)..(520): NCBI GI: 42408484 NCBI Desc: bhlh protein family-like [oryza sativa (japonica cultivar-group)]
  misc_feature (182)..(312): NCBI GI: 8346550 NCBI Desc: myc-like protein [arabidopsis thaliana]
  misc_feature (163)..(440): NCBI GI: 46390601 NCBI Desc: bhlh protein-like [oryza sativa (japonica cultivar-group)]
  misc_feature (182)..(312): NCBI GI: 30682248 NCBI Desc: basic helix-loop-helix (bhlh) family protein [arabidopsis thaliana]
  misc_feature: Abnormal phyllotaxy, leaf number higher than wild-type
  misc_feature: The sequence is a functional homolog of SEQ ID NO 1378 in the 10/374,780US patent application
  misc_feature: The sequence is a functional homolog of SEQ ID NO 1499 in the 10/412,699US patent application
  misc_feature: Useful for making plants with altered terpenoid content
  misc_feature: Useful for making plants with modulated biomass
  misc_feature: Useful for making plants with modulated growth and phenotype characteristics
  misc_feature: GREAT-hit functional homolog of the protein sequence given in SEQ ID NO 13050
  misc_feature: The sequence is a functional homolog of SEQ ID NO 1499 in the 20040045049 US patent application
  misc_feature: Functional homolog of the protein sequence given in SEQ ID NO 13554
  misc_feature: The sequence is a functional homolog of SEQ ID NO. 414 in the 11/188,298 US application
  misc_feature: The sequence is a functional homolog of SEQ ID NO. 483 in the 11/188,298 US application
MGIQGNKAGTHEHDFLSLYAAAAAAKDAPLLLHHDSKAPPPPASQGNFLLKTHDFLQPLDQKPGAPPEPSPLPASAAAESRHRQQQQQQVVHALPLPGGVGTFSISPAPVSVALPAPAVVKSEPPFVLWGQPAATLQPGARGHQQQQWALPFAGAGQVRPPPPQQHQAPPDRKGRGGGGGGVMESGSRSSGGAGFDDDDALTTRREVSSSLQDLTVRVDRKGGSCSDGGTDQRPNTPRSKHSATEQRRRSKINDRFQILRELLPHNDQKRDKATFLLEVIEYIRFLQEKVQKYEATFPEWNQENAKMLPWSNMYFRSFWKNAQSKGQIPGDSPPDPSHFMRNGSSPGSNFTGKIDDNHNIVTSAAASGAQDQAETDHMASGCYRSAETPANITNNAISQSQPQWTGPSPVDDSAVNSEMLNNQQLAIDEGTISVSSNYSQELLNSLTHALQSSGVDLSQASISVQINLGKRAVKRPVAPSNSKEPADPASSNELGHQLMMLGAGADNLSHTTKRHKPGNS

SEQ ID NO: 5109 - DNA, 561 bp, Sorghum bicolor
  misc_feature: Ceres ANNOT ID no. 6041751
  misc_feature: Encodes the peptide sequence at SEQ ID NO 5110
atgctgcagcagcaccattaccatggaggagtggctagccttcactgcctctcaaatccggaccaggcattccacgctcactaccacagcaacatgatcgccatgccgcccactccgctattccaccacctctcgccttctacctttgaacaacctatccacgaagcacaggcggttgtcgctgccggcaacagtccagccggctccggcagtaccgatgatgcctacggcggcggcggccgcacggcaatggcggaggctgagcggaggcggcggaggatggtctccaacagggagtccgccaggagatcacgcatgcgcaagcagcggcagctcaccgagctgtgggcgcaggtcgtccacctccgcggggccaaccgccgcctcctcgacgagctgaaccgcgcaatgaggggctgcagtgatgtgtgctgcgagaacgcccggcttgagaaagagaagaccgatctcagtaccaagctcgagcggctcacccaggcgcagaacaccgccacgccaagctcctcctcagagccgcaacatgacaccgcgcgctactga

SEQ ID NO: 5110 - protein, 186 aa, Sorghum bicolor
  misc_feature: Ceres ANNOT ID no. 6041751
  misc_feature (85)..(148): Pfam Id: bZIP_1 Pfam Desc: bZIP transcription factor
  misc_feature (11)..(157): NCBI GI: 113367190 NCBI Desc: bzip transcription factor bzip73b [glycine max]
  misc_feature (31)..(169): NCBI GI: 20198170 NCBI Desc: bzip protein (atbzip48) [arabidopsis thaliana]
  misc_feature (88)..(183): NCBI GI: 92889024 NCBI Desc: camp response element binding (creb) protein [medicago truncatula]
  misc_feature (88)..(161): NCBI GI: 13430400 NCBI Desc: bzip transcription factor [phaseolus vulgaris]
  misc_feature (88)..(161): NCBI GI: 113367166 NCBI Desc: bzip transcription factor bzip35 [glycine max]
  misc_feature: The sequence is a functional homolog of SEQ ID NO 2522 in the 10/374,780US patent application
  misc_feature: The sequence is a functional homolog of SEQ ID NO 622 in the 10/225,066US patent application
  misc_feature: The sequence is a functional homolog of SEQ ID NO 702 in the 10/412,699US patent application
  misc_feature: The sequence is a functional homolog of SEQ ID NO 910 in the 10/374,780US patent application
  misc_feature: Useful for making plants with modulated growth and phenotype characteristics
  misc_feature: The sequence is a functional homolog of SEQ ID NO 702 in the 20040045049 US patent application
  misc_feature: The sequence is a functional homolog of SEQ ID NO 910 in the 20060162006 US patent application
  misc_feature: The sequence is a functional homolog of SEQ ID NO. 337 in the 11/188,298 US application
MLQQHHYHGGVASLHCLSNPDQAFHAHYHSNMIAMPPTPLFHHLSPSTFEQPIHEAQAVVAAGNSPAGSGSTDDAYGGGGRTAMAEAERRRRRMVSNRESARRSRMRKQRQLTELWAQVVHLRGANRRLLDELNRAMRGCSDVCCENARLEKEKTDLSTKLERLTQAQNTATPSSSSEPQHDTARY

SEQ ID NO: 5111 - DNA, 2580 bp, Sorghum bicolor
  misc_feature: Ceres ANNOT ID no. 6041771
  misc_feature: Encodes the peptide sequence at SEQ ID NO 5112
atgggaggcgggcggaagcgcgggcgcacgcagcgccgccacttcaagcagggccgcgagaacgtctggaagcacaaccctcagcgtcctcccgccggcgaaggaggcgaggggcgggagggcaatccctcgtggcagcccttcgccaccgagaacccgtccttcgaggagtactacaaggagcagcaaattgttcctgaggaagagtgggatagcttcatgagtatgcttcggaagccattacctgccacttttaggattaatgcgagctgtcagttttatcaagatatctgctcacaattggaaaacgacttcaggaaatcattagagactgaggtgaccgatgaacatgaagaagatgctattaggcctttgccttggtacccgggtaatcttgcatggcatttgaacttttctcgaatgcagctgaggagaaaccaggcacttgagagttttcatgaattcttgaagagagagaacgaagttggcaatataactaggcaagaggctgtcagtatggtcccaccactgtttctgaatgtgcaacctgatcatcatattcttgacagatctaaaactttccagttacttgagatgattcaccagtcaacgaagcctggagtgcttccaaatgccttggtggtagctaatgatgttgatgtgcaaagatgcaatcttcttattcaccagaccaagagaatgtgcacagctaacttgattgtgacaaatcatgaagcacaaaactttcctggttgtaatcttgcaaagttctgttcagaagtgtgtatggatgaggcaaaactgcagaggttggagtttgaccgcgttctttgtgatgtgccttgtagtggtgatgggactgtccgtaaggctcctgatatgtggaggaaatggaatgctggtatggggaacggacttcatcgcctgcaagtggaaattgctatgcgtggtatgggtttgctcaaagtgggtgggaggatggtttattcaacatgttcaatgaaccctgttgaaaatgaagctgttgttgctgagattttgcggagatgtggggactctgttgaacttcttgatgtttctaatgagctacctgaattagcccgtcgtcctggacttagcacctggaaggtacgggatagagggtcttggtttggtgttcacgaagatgtacctcgctacaggaagcatgtgatatcaccaagtatgtttccctctgggaaaggcagcaaagatagtcttacggtgagcagcagcgttgaggtcaacacagatgtagctgatgctgacatgaaggattcaacagacattggagagggagaacaagaaacaaatataacaattgatgacagtgataatgctgacaatctgaaaaccaaagagggaaccaaagttgattgtgagtttggtgaggttacagctagtagttataaaaagtcaaattctactcccatccgtacagaacattcagattatccactgcatcgctgtatgagaattgttgctcatgaccagaacagtggggcatttttcattgcagtccttcataaactctccccactgaacgagaaccaggtgatagatggggtaaaaggtgaacagaatatttcaaaagacaaaactgagaaacttgagaaagatttaggatcagataaggcatcatctgaagaaaatatagtgcatcatgaagtgattgataatacaaatgttctggatggagaacaaaatgaagacagggataacaaaagttcaaaagataagagctcagaggattctaaggtgaatgttaatgaggcggaaaagggtcaagcaggaacaagggataggaggaggcagcagaaccaaggcaggtggagaggggttgaccctgtgatattttttaaagatgaagcaacagtcaaaagtattgtatctttctatggtatcatggattcatttccacttgaaggtcatctcgtgactagaaatcctgatgctagtcatgttaagagaatatactatgtgtcaaaatctgttcaagatgctttgcagctcaacataaaagttggcgagcggcttaagatcacctcactaggcctaaagatatttgaaaggcagtcttcaaaggaaggctcaccatgcacatttaggttgtcatcagagggattgccgctcctgcttccatacatcacaaaacagattctatatgcgtctgcaattgacttccagcatcttttacagtacaggactattaagtttcctgattttgtggatgcaaaatttggtgaggaagcttcagctttgcttccaggttgctgtgtcgtagtattacgtgaagatccctcagctattgccatcgtttgctggaaaggaaagaccaacttgtgtgtcatggtttctccactagatgggaaagaactgcttgagaggatttcattgcgttttgggctgaaaatccccaaaggggataaagagaaacccagcgaggagattgctggatcagacgagctgcttgattgtgccactgaggtggacgatcaagaatgttttcctgaaagcaaagcatcggacatcgaaatatcagatgctaaggatgctgactag

SEQ ID NO: 5112 - protein, 859 aa, Sorghum bicolor
  misc_feature: Ceres ANNOT ID no. 6041771
  misc_feature (111)..(390): Pfam Id: Nol1_Nop2_Fmu Pfam Desc: NOL1/NOP2/sun family
  misc_feature (3)..(458): NCBI GI: 42409394 NCBI Desc: proliferating-cell nucleolar antigen-like protein [oryza sativa (japonica cultivar-group)]
  misc_feature (1)..(436): NCBI GI: 42567548 NCBI Desc: nol1/nop2/sun family protein [arabidopsis thaliana]
  misc_feature (214)..(436): NCBI GI: 7271055 NCBI Desc: proliferating-cell nucleolar antigen-like protein [arabidopsis thaliana]
  misc_feature (16)..(404): NCBI GI: 46250336 NCBI Desc: loc414460 protein [xenopus laevis]
  misc_feature (4)..(404): NCBI GI: 62857697 NCBI Desc: nsun2 [xenopus tropicalis]
MGGGRKRGRTQRRHFKQGRENVWKHNPQRPPAGEGGEGREGNPSWQPFATENPSFEEYYKEQQIVPEEEWDSFMSMLRKPLPATFRINASCQFYQDICSQLENDFRKSLETEVTDEHEEDAIRPLPWYPGNLAWHLNFSRMQLRRNQALESFHEFLKRENEVGNITRQEAVSMVPPLFLNVQPDHHILDRSKTFQLLEMIHQSTKPGVLPNALVVANDVDVQRCNLLIHQTKRMCTANLIVTNHEAQNFPGCNLAKFCSEVCMDEAKLQRLEFDRVLCDVPCSGDGTVRKAPDMWRKWNAGMGNGLHRLQVEIAMRGMGLLKVGGRMVYSTCSMNPVENEAVVAEILRRCGDSVELLDVSNELPELARRPGLSTWKVRDRGSWFGVHEDVPRYRKHVISPSMFPSGKGSKDSLTVSSSVEVNTDVADADMKDSTDIGEGEQETNITIDDSDNADNLKTKEGTKVDCEFGEVTASSYKKSNSTPIRTEHSDYPLHRCMRIVAHDQNSGAFFIAVLHKLSPLNENQVIDGVKGEQNISKDKTEKLEKDLGSDKASSEENIVHHEVIDNTNVLDGEQNEDRDNKSSKDKSSEDSKVNVNEAEKGQAGTRDRRRQQNQGRWRGVDPVIFFKDEATVKSIVSFYGIMDSFPLEGHLVTRNPDASHVKRIYYVSKSVQDALQLNIKVGERLKITSLGLKIFERQSSKEGSPCTFRLSSEGLPLLLPYITKQILYASAIDFQHLLQYRTIKFPDFVDAKFGEEASALLPGCCVVVLREDPSAIAIVCWKGKTNLCVMVSPLDGKELLERISLRFGLKIPKGDKEKPSEEIAGSDELLDCATEVDDQECFPESKASDIEISDAKDAD

SEQ ID NO: 5113 - DNA, 1023 bp, Sorghum bicolor
  misc_feature: Ceres ANNOT ID no. 6041772
  misc_feature: Encodes the peptide sequence at SEQ ID NO 5114
atggcggtcccccgcggatgcctcctccgcctgctcgccgtcgccgtgttcctcgcgttcctctgctgccgcggcgaggcggcggtgagggagctcaaggtcgggtactacgcggagacgtgcccggaggcggaggacatcgtccgcgagaccatggcgcgcgcgcgggcacgcgaggcccgcagcgtcgcctccgtcatgcgcctccagttccacgactgcttcgtcaacgggtgcgacggctccgtgctgatggacgccacgccgacgatgcccggcgagaaggaggcgctgtccaacatcgactccctgcgctcgttcgaggtcgtcgacgagatcaaggaggcgctggaggagcgctgccccggcgtcgtctcctgcgccgacatcgtcatcatggccgcccgcgacgccgttgtcctgaccggtgggcccaactgggaggtgcgtctcgggcgcgatgacagcctgacggcgagccaggaggactcggataacatcatgccgagcccgcgcgccaacgcgagctctctcatccgcctcttcgcggggctcaacctcagcgtcaccgacctcgtcgcgctctcgggctcgcactccatcggcgaggcccgctgcttctccatcgtcttccgcctctacaaccagtccggatccggccgcccggacccccacatggacgccgcctaccgccgcgcgctcgaggcgctctgcccgaagggcggcaacgaggaggtcacgggaggcctggacgccaccccgcgcgtcttcgacaaccagtacttcaaggacctcgtcgcgctccgcggcttcctcaactccgaccagacgctcttctctgacaacgccaggactcgccgcgtcgtcaagcagttcagcaagaaccaggacgccttcttcagagcattcatcgaggggatgatcaagatgggggagctgcagaacccccggaaaggggagatacggcgcaactgccgcgttgctaactgctcgccggtggcgccccgagtcgtcgacatctga

SEQ ID NO: 5114 - protein, 340 aa, Sorghum bicolor
  misc_feature: Ceres ANNOT ID no. 6041772
  misc_feature (48)..(295): Pfam Id: peroxidase Pfam Desc: Peroxidase
  misc_feature (1)..(329): NCBI GI: 57635159 NCBI Desc: peroxidase 7 [triticum monococcum]
  misc_feature (28)..(333): NCBI GI: 19698448 NCBI Desc: gaiacol peroxidase [gossypium hirsutum]
  misc_feature (14)..(329): NCBI GI: 1403134 NCBI Desc: peroxidase [arabidopsis thaliana]
  misc_feature (14)..(329): NCBI GI: 21593604 NCBI Desc: peroxidase atp n [arabidopsis thaliana]
  misc_feature (1)..(329): NCBI GI: 1429215 NCBI Desc: peroxidase atp6a [arabidopsis thaliana]
  misc_feature (32)..(333): SWISSPROT Homolog: EC 1.11.1.7 Peroxidase 17 precursor
  misc_feature: Useful for making plants with altered cell wall content and/or composition
  misc_feature: GREAT-hit functional homolog of the protein sequence encoded by LOCUS at2g22420
  misc_feature: Useful for making plants with altered carbohydrate content
  misc_feature: Functional homolog of the protein sequence given in SEQ ID NO 13901
  misc_feature: Useful for making plants with altered cell wall content and/or composition
  misc_feature: Functional homolog of the protein sequence given in SEQ ID NO 13902
MAVPRGCLLRLLAVAVFLAFLCCRGEAAVRELKVGYYAETCPEAEDIVRETMARARAREARSVASVMRLQFHDCFVNGCDGSVLMDATPTMPGEKEALSNIDSLRSFEVVDEIKEALEERCPGVVSCADIVIMAARDAVVLTGGPNWEVRLGRDDSLTASQEDSDNIMPSPRANASSLIRLFAGLNLSVTDLVALSGSHSIGEARCFSIVFRLYNQSGSGRPDPHMDAAYRRALEALCPKGGNEEVTGGLDATPRVFDNQYFKDLVALRGFLNSDQTLFSDNARTRRVVKQFSKNQDAFFRAFIEGMIKMGELQNPRKGEIRRNCRVANCSPVAPRVVDI

SEQ ID NO: 5115 - DNA, 1674 bp, Sorghum bicolor
  misc_feature: Ceres ANNOT ID no. 6041776
  misc_feature: Encodes the peptide sequence at SEQ ID NO 5116
atggagaacctccacctcgccatcgcccaccgcccgcctctgccggtaccggcggcgggccacctccgccgccgccacctccacctccaccacctccccgccccactctcccttcccagcacctcccactccctttcctccccgcatcatcaccgccttactcccacccttcgccgccacctccgcccgcctcttcgcgtctcccagacccctgatgctaaccccgagcccgagcctgagcctgagtccgagcccactggcgcgaagctagtgccgttcgtcatctccgtcgcggtcggcctcgccgtgcggttcctcgcgccgcggcccgttgaggtgagcccgcaggcatggcagctcctctccatcttcctctccaccatcgcggggctggtgcttggcccgctccccgtcggcgcgtgggccttcctcgggctcaccgccgccgtcgccactcgcacgctccccttcgccgccgccttctccgccttcaccaacgaggtcatctggctcatcgtcatctccttcttcttcgcgcgcgggttcgtcaagacgggcctcggagaccgaatcgccacctacttcgtcaagtggctcgggagcagcacgctcggcctgtcctacgggctcaccatcagcgaggcctgcatcgcgccggccatgcccagcaccacggcgagggccggaggcgtgttcctgcccatcatcaagtcgctctcgctgtcggccgagagcaagcccaaccatccatcgtcacggaagcttgggtcctatcttgtgatgacgcaattccaggcaagtggtaactcgagtgctttattcctcactgctgcagcacaaaacctgttgtgcttgaagctagcagaggagcttggtgtattcattgcaaatccatgggtatcatggttcaaagctgctagcttgccagctcttgctgctctgctagcaacaccatatttgctgtacaaaatcttcccccctgaaacaaaggacaccccagatgccccagcattggctgaagagaaactgaagcgcatgggccctgtgactaaaaacgaatgggttatgattggcacaatgattcttgcagtctccttatgggtttttggggatgctattggtgtgccaagtgttgtggctgcaatgcttgggctctccattcttctccttctcggtgtgctagactgggatgattgcttgaatgagaaatcagcatgggatacattggcttggtttgcggttctggttggaatggcagcacaactcactaacctgggaattgtttcttggatgtcaagctgtgttgccaagctgcttcagtcattctcgttgagttggccagtggcattttgtattcttgagggctcctactttctgatccactacctatttgcaagccaaactggacatgttggagccttatactctgcgtttctggctatgcatatagcggccggtgttcctcgtgcactgtcagcacttgctttggcatttaacacaaatctgttcggtgcaatcactcattatagtagtgggcaggctgcagtatactttggagccgggtatattgagcttccagatgttttcaggctgggttttataacagccttgattaacacgttcatctggggagttgttggaaccatttggtggaaatttttggggctgtactga

SEQ ID NO: 5116 - protein, 557 aa, Sorghum bicolor
  misc_feature: Ceres ANNOT ID no. 6041776
  misc_feature (87)..(557): Pfam Id: Na_sulph_symp Pfam Desc: Sodium:sulfate symporter transmembrane region
  misc_feature (1)..(557): NCBI GI: 40363461 NCBI Desc: plastidic general dicarboxylate transporter [zea mays]
  misc_feature (1)..(557): NCBI GI: 22121976 NCBI Desc: glutamate/malate translocator [sorghum bicolor]
  misc_feature (1)..(557): NCBI GI: 40363463 NCBI Desc: plastidic general dicarboxylate transporter [zea mays]
  misc_feature (1)..(557): NCBI GI: 40363465 NCBI Desc: plastidic general dicarboxylate transporter [zea mays]
  misc_feature (64)..(557): NCBI GI: 22121982 NCBI Desc: glutamate/malate translocator [nicotiana tabacum]
MENLHLAIAHRPPLPVPAAGHLRRRHLHLHHLPAPLSLPSTSHSLSSPHHHRLTPTLRRHLRPPLRVSQTPDANPEPEPEPESEPTGAKLVPFVISVAVGLAVRFLAPRPVEVSPQAWQLLSIFLSTIAGLVLGPLPVGAWAFLGLTAAVATRTLPFAAAFSAFTNEVIWLIVISFFFARGFVKTGLGDRIATYFVKWLGSSTLGLSYGLTISEACIAPAMPSTTARAGGVFLPIIKSLSLSAESKPNHPSSRKLGSYLVMTQFQASGNSSALFLTAAAQNLLCLKLAEELGVFIANPWVSWFKAASLPALAALLATPYLLYKIFPPETKDTPDAPALAEEKLKRMGPVTKNEWVMIGTMILAVSLWVFGDAIGVPSVVAAMLGLSILLLLGVLDWDDCLNEKSAWDTLAWFAVLVGMAAQLTNLGIVSWMSSCVAKLLQSFSLSWPVAFCILEGSYFLIHYLFASQTGHVGALYSAFLAMHIAAGVPRALSALALAFNTNLFGAITHYSSGQAAVYFGAGYIELPDVFRLGFITALINTFIWGVVGTIWWKFLGLY

SEQ ID NO: 5117 - DNA, 2355 bp, Sorghum bicolor
  misc_feature: Ceres ANNOT ID no. 6041777
  misc_feature: Encodes the peptide sequence at SEQ ID NO 5118
  misc_feature: Up-regulated in root tissues in response to methyl jasmonate treatment
  misc_feature: Up-regulated in shoot tissues in response to methyl jasmonate treatment
atggattccgtcggtacaaatcggcccccgctgcgctccgttgctgccgcagtcactcgacgcagcgcgctcctgtgtccgcctcgccacctcgggctcggcaatcgttttgcggagactaagcttgggatcgcgtctgggtgtggaggaggagggtattttggaaaggtacagcgatttaacgccttgcggaataccactacgaaagttcagagcgggaaggcggggtcaagtgtgaccaaggaaatgggacacacctcatctggcagtgaagtgcccttgaaatattcttcaggcaaagctttccctctaggagtgtcacaagttgacgatgggctaaattttgcaatattctcacagcatgcttcttctgtcaccctttgcttgaaacttcatgagagaggcacccaagatgatgcagacattgtagagtttcctttagaccgccaaaagaacaaaactggagatatatggcatgtgtcggtggagggtttgcctgcttctggtgttctttatgggtatcgcattaatggtcctcaagggtggcaacaaggtcatagatttgatgacagcgttattcttctggacccttatgcaaaattagtttctggccgtaagcactttgcggttgaagaagagaaaccaagccagcttttcggaacatatgattttgatagctcaccttttgactggggtgacaattataggcttcctaatttgcctgagacagatcttgttatatatgaaatgaatgtccgtgccttcactgcggatgagtcaagcaggcttggtccagcttttcgtggaagttaccttggtgtcattgataaaattcctcatttgctggaacttggcgttaatgcagtggaactacttcctgtttttgagtttgatgagctggagttgaagaggttccctaacccaagggaccacatggtaaatacatggggatattctacaatcaacttttttgcgcccatgagtcgttatgctagtgcgggtggtggacctgtggctgcttccaaagagctcaaacagatggtcaaggcatttcataatgctggaattgaggttattctggatgtggtttacaaccatacaaatgaagcagatgatgctaacccttatgtgacttcctttcgtggcattgataacaaggtctattacatgttagatctcaacaacaatgctcagctgctgaacttctcgggttgcgggaatacactaaactgcaaccaccctgttgtcaaggagcttgtactcgacagtttgagacattgggttacggagtatcacatagatggatttcggtttgaccttgcaagtgttctttgtcgtggaccagatggcagtcctcttgatgcacctccactcattaaggtacttgcacctccactcattaaggaaattgccaaagactctgtattgtctagatgtaagatcattgctgaaccttgggactgtggtggcctttatctagtagggaagttccctaattgggacaggtgggctgaatggaacgggaagtacagagatgatattcgaagatttattaagggagatcctggtatgaagggggtgtttgcaactcgtgtttctggttctgcagatctctaccaggtgaacaatcggaagccttaccatagtgtgaactttgtaattgctcatgatggatttactttatgtgaccttgtttcatataactccaagcacaatgatgcgaatggagaaggtggtcgtgatgggtgcaatgacaacgacagctggaactgtggcattgaaggagaaacaaatgatttgaatgtgctaagtattcgttcaaggcaaatgaagaactttcatgtggcattaatgatttcccagggtactccaatgatgctgatgggagacgaatatggtcacacacgttatggaaacaacaacagctatggacatgatactcacataaataattttcagtggggccagttggaagaaagaaaggatggccatttcaggtttttctcagagatgatcaagtttcggcgtaaccatcctatactgagacgagacaggtttctcaataaaaatgatatcacctggcatgaaaataattgggagaaccaggacagcaaatttttggcattcacgatacatgatcacaattctggtggagatatctatttggcattcaatgctcatgagtattttgtggatgctgtaattcccccaccaccacagcataaatcttggagtcgtgtggtggataccaacctggaatcaccaaaggatattgtcccagaaggggtgccattcacaggttcagggtacaggattgctccctactcttccatcttgcttaaggcaaagccttag

SEQ ID NO: 5118 - protein, 784 aa, Sorghum bicolor
  misc_feature: Ceres ANNOT ID no. 6041777
  misc_feature (103)..(199): Pfam Id: Isoamylase_N Pfam Desc: Isoamylase N-terminal domain
  misc_feature (249)..(675): Pfam Id: Alpha-amylase Pfam Desc: Alpha amylase, catalytic domain
  misc_feature (83)..(784): NCBI GI: 29126649 NCBI Desc: isoamylase-type starch debranching enzyme iso3 [zea mays]
  misc_feature (1)..(784): NCBI GI: 58865274 NCBI Desc: isoamylase [hordeum vulgare]
  misc_feature (95)..(783): NCBI GI: 27728149 NCBI Desc: isoamylase isoform 3 [solanum tuberosum]
  misc_feature (52)..(783): NCBI GI: 139867062 NCBI Desc: isoamylase-type starch-debranching enzyme 3 [phaseolus vulgaris]
  misc_feature (43)..(783): NCBI GI: 73698629 NCBI Desc: isoamylase isoform 3 [pisum sativum]
  misc_feature: Up-regulated in root tissues in response to methyl jasmonate treatment
  misc_feature: Up-regulated in shoot tissues in response to methyl jasmonate treatment
  misc_feature: The sequence is a functional homolog of SEQ ID NO. 305 in the 11/188,298 US application
MDSVGTNRPPLRSVAAAVTRRSALLCPPRHLGLGNRFAETKLGIASGCGGGGYFGKVQRFNALRNTTTKVQSGKAGSSVTKEMGHTSSGSEVPLKYSSGKAFPLGVSQVDDGLNFAIFSQHASSVTLCLKLHERGTQDDADIVEFPLDRQKNKTGDIWHVSVEGLPASGVLYGYRINGPQGWQQGHRFDDSVILLDPYAKLVSGRKHFAVEEEKPSQLFGTYDFDSSPFDWGDNYRLPNLPETDLVIYEMNVRAFTADESSRLGPAFRGSYLGVIDKIPHLLELGVNAVELLPVFEFDELELKRFPNPRDHMVNTWGYSTINFFAPMSRYASAGGGPVAASKELKQMVKAFHNAGIEVILDVVYNHTNEADDANPYVTSFRGIDNKVYYMLDLNNNAQLLNFSGCGNTLNCNHPVVKELVLDSLRHWVTEYHIDGFRFDLASVLCRGPDGSPLDAPPLIKVLAPPLIKEIAKDSVLSRCKIIAEPWDCGGLYLVGKFPNWDRWAEWNGKYRDDIRRFIKGDPGMKGVFATRVSGSADLYQVNNRKPYHSVNFVIAHDGFTLCDLVSYNSKHNDANGEGGRDGCNDNDSWNCGIEGETNDLNVLSIRSRQMKNFHVALMISQGTPMMLMGDEYGHTRYGNNNSYGHDTHINNFQWGQLEERKDGHFRFFSEMIKFRRNHPILRRDRFLNKNDITWHENNWENQDSKFLAFTIHDHNSGGDIYLAFNAHEYFVDAVIPPPPQHKSWSRVVDTNLESPKDIVPEGVPFTGSGYRIAPYSSILLKAKP

SEQ ID NO: 5119 - DNA, 1017 bp, Sorghum bicolor
  misc_feature: Ceres ANNOT ID no. 6041789
  misc_feature: Encodes the peptide sequence at SEQ ID NO 5120
atggcactggaggccgcccttgtgctttcccagcagcagtcctcctcccagcaaggcagtcgctttgggtgcggtgccatggcagcaggagggccttggagtagtctgttgtttagtggaatagaggaggtggtggagatgggtggcgccgccggcgccgccggcagctggaacgcggccgcgtgctcgccgccgcagctcctgcaggagctgggtgacaacacggctgccggcgcgctgcctgcggcgtccgggaggtgtgcgagtggcggcgccggtcaggatgccccggcaccggcgcccggaagaaggaagcggcgcaggatgaggccggtgaagaacgaggaggaagtggagagccagcggatgatccacattgccgtggagcgcaaccgccgcaagcagatgaacgagtacctcgcagcgctccgctccctcatgccgccggcctactcgcaacggggcgatcaggcgtccatcgtcggcggcgcgatcaacttcgtcaaggagctggagcagctgctccagtcgctggaggcgcagaggcgttcctcgcagcgccctgccgacgacgtcgatcccgacgacgcagggccgttcgcggacttcttcaccttcccgcagtactcgatgtgcgctgtcgtcgcgggcgcggccccagagaacaagaacgccgaccaccgtgagggcgccggcggcgccgaggaggaggcgtccgggtcgaagccatcggccgtggccgacgtcgaggcgaccatggtggagagccacgccaaccttcgggtgctgtcccggcgccggccgaggcagctgctgcggctggtgctggggctccagggccaccgcctcaccgtgctccacctcaacatgagcagcgccggccacatggtgctctactcgtttagcctcaaggtggaggatgattgccagcttacctctgtggatgagattgcagctgcggctcatcagatcgtcgagaagatcaatgaagaacaaggctgcagcttattagaatag

SEQ ID NO: 5120 - protein, 338 aa, Sorghum bicolor
  misc_feature: Ceres ANNOT ID no. 6041789
  misc_feature (121)..(172): Pfam Id: HLH Pfam Desc: Helix-loop-helix DNA-binding domain
  misc_feature (99)..(239): NCBI GI: 18395124 NCBI Desc: basic helix-loop-helix (bhlh) family protein [arabidopsis thaliana]
  misc_feature (95)..(332): NCBI GI: 124359713 NCBI Desc: helix-loop-helix dna-binding [medicago truncatula]
  misc_feature (59)..(337): NCBI GI: 116311027 NCBI Desc: osigba0142i02-osigba0101b20.1 [oryza sativa (indica cultivar-group)]
  misc_feature (99)..(331): NCBI GI: 140063709 NCBI Desc: helix-loop-helix dna-binding [medicago truncatula]
  misc_feature (99)..(305): NCBI GI: 28558779 NCBI Desc: helix-loop-helix-like protein [cucumis melo]
  misc_feature: The plant produces a reduced number of seeds.
  misc_feature: The sequence is a functional homolog of SEQ ID NO 1500 in the 10/374,780US patent application
  misc_feature: The sequence is a functional homolog of SEQ ID NO 1501 in the 10/374,780US patent application
  misc_feature: The sequence is a functional homolog of SEQ ID NO 1503 in the 10/374,780US patent application
  misc_feature: The sequence is a functional homolog of SEQ ID NO 1504 in the 10/374,780US patent application
  misc_feature: The sequence is a functional homolog of SEQ ID NO 1899 in the 10/374,780US patent application
  misc_feature: The sequence is a functional homolog of SEQ ID NO 2744 in the 10/374,780US patent application
  misc_feature: The sequence is a functional homolog of SEQ ID NO 290 in the 10/374,780US patent application
  misc_feature: The sequence is a functional homolog of SEQ ID NO 6 in the 10/225,066US patent application
  misc_feature: The sequence is a functional homolog of SEQ ID NO 674 in the 10/225,066US patent application
  misc_feature: Useful for biocontainment applications
  misc_feature: Useful for making plants with modulated growth and phenotype characteristics
  misc_feature: Useful for making plants with modulated nitrogen use efficiency
  misc_feature: Functional homolog of the protein sequence given in SEQ ID NO 13213
  misc_feature: Functional homolog of the protein sequence encoded by LOCUS at4g01460
  misc_feature: The sequence is a functional homolog of SEQ ID NO 6 in the 20050160493 US patent application
  misc_feature: The sequence is a functional homolog of SEQ ID NO 674 in the 20050160493 US patent application
  misc_feature: The sequence is a functional homolog of SEQ ID NO 1500 in the 20060162006 US patent application
  misc_feature: The sequence is a functional homolog of SEQ ID NO 1501 in the 20060162006 US patent application
  misc_feature: The sequence is a functional homolog of SEQ ID NO 1503 in the 20060162006 US patent application
  misc_feature: The sequence is a functional homolog of SEQ ID NO 1504 in the 20060162006 US patent application
  misc_feature: The sequence is a functional homolog of SEQ ID NO 1899 in the 20060162006 US patent application
  misc_feature: The sequence is a functional homolog of SEQ ID NO. 483 in the 11/188,298 US application
MALEAALVLSQQQSSSQQGSRFGCGAMAAGGPWSSLLFSGIEEVVEMGGAAGAAGSWNAAACSPPQLLQELGDNTAAGALPAASGRCASGGAGQDAPAPAPGRRKRRRMRPVKNEEEVESQRMIHIAVERNRRKQMNEYLAALRSLMPPAYSQRGDQASIVGGAINFVKELEQLLQSLEAQRRSSQRPADDVDPDDAGPFADFFTFPQYSMCAVVAGAAPENKNADHREGAGGAEEEASGSKPSAVADVEATMVESHANLRVLSRRRPRQLLRLVLGLQGHRLTVLHLNMSSAGHMVLYSFSLKVEDDCQLTSVDEIAAAAHQIVEKINEEQGCSLLE

SEQ ID NO: 5121 - DNA, 1434 bp, Sorghum bicolor
  misc_feature: Ceres ANNOT ID no. 6041795
  misc_feature: Encodes the peptide sequence at SEQ ID NO 5122
atggagagtcagagcgccgtcgtcccgctcattgccgagctcccggagaagcggggaggcaaaaccctggtggaggaggtatgggaggagtccaagaagctgtgggaagtcaccggcccggccgcctttacggggatggtactctacagcatgaccatcgtcagccaggccttcgccggccaccttggtgaccgccatctcgccgctttctccatcgccaacaccgtcatatctggccttaactttggcattttgcttggcatggcgagtgcgctggagacattatgcggccaagcctacggtgcaaagcagtactcgatgatgggcacctatctccagcgctcatggctcgtcctcctcgccttcgcggtgctccttgctccgacgtacatcttcagcgggcagctgctcatggtcctgggccagcccgccgagctgtctcgcgaggcgggcttgctcggcatgtacctgctcccgctgcacctcatgtttgccatccagctgccgctcaacaagttcttgcagtgccagcgcaagaactgggtcatcgcgctgtcctcggtgctgggtttcccggtgcacgtcgtggcgacctggctgctggcgcagcgctttcagcttggcgtcctgggcgcagcgatgtcactcaacctgtcctgggcgctcatcacgggcctgcagctcgcgtacgctgttggcggtgggtgcccagagacgtggagagggttctcgtcgtcggcattcatgggcttgaaggacttcgtcagcttgtccgtcgcgtcgggagtcatgacgtgcttggagagttggtactaccggttattgattttcctaacggcgtacgcgaagaacgcagaattggctgtggatgcactgtctatctgcttgagttgggctggatgggagatgatgattcatttcgggttcttagcaggcactggggtgagggttgccaatgagctaggcgccaataatggacgagctgcaaagtttgcgacgatcgtgtccacgacgacatcattcctgatctgcctcttaattagttcactcgcactcattttccatgacaaactcgcaatactgttcacgtctagtgaggctgtgatcgatgcagttgacggtatttctgttctgctagccctcaccatcctcctcaatggcatccaacctgtgctatccggagttgccgttggttcagggtggcaagcgctagttgcgtatgtgaacattgggagctactacattatcggtgttcctttcggtgttctgctagcatggggtttccactacggggtccttggcatttgggttggaatgatcggtggcacgatggtgcaaactctgattctttcatttatcaccttacgatgcgactggaatgaagaggcactgaaagcttctagcagaatgcggacatggagcagctccaagtga

SEQ ID NO: 5122 - protein, 477 aa, Sorghum bicolor
  misc_feature: Ceres ANNOT ID no. 6041795
  misc_feature (40)..(200): Pfam Id: MatE Pfam Desc: MatE
  misc_feature (260)..(423): Pfam Id: MatE Pfam Desc: MatE
  misc_feature (4)..(473): NCBI GI: 91806846 NCBI Desc: ripening-responsive protein [arabidopsis thaliana]
  misc_feature (6)..(301): NCBI GI: 72384467 NCBI Desc: 52o08_38 [brassica rapa subsp. pekinensis]
  misc_feature (6)..(301): NCBI GI: 72255624 NCBI Desc: 117m18_23 [brassica rapa]
  misc_feature (23)..(446): NCBI GI: 12231296 NCBI Desc: ripening regulated protein ddtfr18 [lycopersicon esculentum]
  misc_feature (88)..(474): NCBI GI: 115451229 NCBI Desc: os03g0188100 [oryza sativa (japonica cultivar-group)]
MESQSAVVPLIAELPEKRGGKTLVEEVWEESKKLWEVTGPAAFTGMVLYSMTIVSQAFAGHLGDRHLAAFSIANTVISGLNFGILLGMASALETLCGQAYGAKQYSMMGTYLQRSWLVLLAFAVLLAPTYIFSGQLLMVLGQPAELSREAGLLGMYLLPLHLMFAIQLPLNKFLQCQRKNWVIALSSVLGFPVHVVATWLLAQRFQLGVLGAAMSLNLSWALITGLQLAYAVGGGCPETWRGFSSSAFMGLKDFVSLSVASGVMTCLESWYYRLLIFLTAYAKNAELAVDALSICLSWAGWEMMIHFGFLAGTGVRVANELGANNGRAAKFATIVSTTTSFLICLLISSLALIFHDKLAILFTSSEAVIDAVDGISVLLALTILLNGIQPVLSGVAVGSGWQALVAYVNIGSYYIIGVPFGVLLAWGFHYGVLGIWVGMIGGTMVQTLILSFITLRCDWNEEALKASSRMRTWSSSK

SEQ ID NO: 5123 - DNA, 1443 bp, Sorghum bicolor
  misc_feature: Ceres ANNOT ID no. 6041799
  misc_feature: Encodes the peptide sequence at SEQ ID NO 5124
atggagagtcagagcgatgtcccgctcctcccgacgctcccgcggccgccgccggagaagaggggaggaggcaagatccagttccagggacgcctggggagggaggtgtgggaggagtccaagaagctgggggcagtcgtcggcccggccgtcttcatgaacctggtcttctcctccatgaacctcgtcagccagtccttcgccggccacctcggcgacctcgacctcgccgccttctccatcgccaacaccgtagtagacggcttcaacttcgccatgctgcttggcatggcgagtgcaacggagacgctgtgcggccaggcgtacggggcaaagcagtaccacatgctgggcatctacctgcagcgctcgtggctcgttctcctggccttcgccgtcctgctcgctccggtctacgtcttcagcgggcagctgctcgccgcgttcggccagcccgccgagctcgcgcgcgcggcgggctcggtcagcgtgtacttcctgccgtcgcacttcatgtacgccattcacctgccggtcatgacgttcctgcagtgccagcgcaagaactgggtgcccacggtcgccacggcggcggtcttcgccgtgcacgtcgccgccacctggctactggtgaattgtctcgggctcggcgtctttggtgtggccatggcgttcaacatttcctgggcggtcctggcggcgctgctgctctcgtacgccctcggcggcgggtgcccggagacgtggagtgggttctcgacgtcggcgttcgtggacttgaaggagtttgttatgttgtctgcgtcgtcgggtgtcatggtgtgcttggagaattggtactaccggatattgattttcctcactgcttacatgaagagtgcagagctagctgtggatgcactgtctatctgtatgagtttgaccggatgggagatgatgattcatatgggattcttagaaggcactggtgtgagagtagccaatgaactcggggccgccaatgcacatggtgcaagatttgcgacaatcgtgtcaacagcaatgtcctttctgatcagcctcttcgctagtttactggcactgattttccacaacaagctggccatgatcttctcatcaagtgaggctgtgatagatgcagtggataacatttccgttctgctggccctcaccatccttctgaatgggatccaacctgtgctctctgggtggcaagctctagttgcttatgtgaatgttggaagttactactttattggtgttcctcttggtgttctgctaggatggcgtttcaactatggcgtccctggcatctgggccgggatgatcagtggcacaacaatgcagacactaattctggcagtgatcacccttcgatgcgattggaataaggaggcactgaaagctggtaacagagtgcggcaatggagtagcaccaagtga

SEQ ID NO: 5124 - protein, 480 aa, Sorghum bicolor
  misc_feature: Ceres ANNOT ID no. 6041799
  misc_feature (49)..(209): Pfam Id: MatE Pfam Desc: MatE
  misc_feature (269)..(426): Pfam Id: MatE Pfam Desc: MatE
  misc_feature (30)..(476): NCBI GI: 91806846 NCBI Desc: ripening-responsive protein [arabidopsis thaliana]
  misc_feature (32)..(449): NCBI GI: 12231296 NCBI Desc: ripening regulated protein ddtfr18 [lycopersicon esculentum]
  misc_feature (97)..(480): NCBI GI: 115451229 NCBI Desc: os03g0188100 [oryza sativa (japonica cultivar-group)]
  misc_feature (30)..(477): NCBI GI: 72384425 NCBI Desc: 4d11_27 [brassica rapa subsp. pekinensis]
  misc_feature (32)..(480): NCBI GI: 92893030 NCBI Desc: multi antimicrobial extrusion protein mate [medicago truncatula]
MESQSDVPLLPTLPRPPPEKRGGGKIQFQGRLGREVWEESKKLGAVVGPAVFMNLVFSSMNLVSQSFAGHLGDLDLAAFSIANTVVDGFNFAMLLGMASATETLCGQAYGAKQYHMLGIYLQRSWLVLLAFAVLLAPVYVFSGQLLAAFGQPAELARAAGSVSVYFLPSHFMYAIHLPVMTFLQCQRKNWVPTVATAAVFAVHVAATWLLVNCLGLGVFGVAMAFNISWAVLAALLLSYALGGGCPETWSGFSTSAFVDLKEFVMLSASSGVMVCLENWYYRILIFLTAYMKSAELAVDALSICMSLTGWEMMIHMGFLEGTGVRVANELGAANAHGARFATIVSTAMSFLISLFASLLALIFHNKLAMIFSSSEAVIDAVDNISVLLALTILLNGIQPVLSGWQALVAYVNVGSYYFIGVPLGVLLGWRFNYGVPGIWAGMISGTTMQTLILAVITLRCDWNKEALKAGNRVRQWSSTK

SEQ ID NO: 5125 - DNA, 876 bp, Sorghum bicolor
  misc_feature: Ceres ANNOT ID no. 6041801
  misc_feature: Encodes the peptide sequence at SEQ ID NO 5126
atggacgtggaagcagcgcgcaaggacgacttgacgccgccaacgccgccaacaccacgccgcggcaagggcaaggtgatgcaccgcctcctggtggcgctcaactgcgggatgctggcattgggcaccacggcggggccgctcctcgtccgcctctactacgacaagggcggccaacgggagtggctgtccgcgtgcctccagtccgtcggctggccactccttctgatccccgtggcggcttcctacgccgcgcgccgcgcccgcgacaagcggggcggccccgtccccgtcctgctcacgccgccgcgcgtgctgctggccgccgcgggcctcggcgtcgccacgggcgccgacaactacatctacgcctacagcctccggtacctccccgtctccacctccgcgatcctcatctcgacgcagctcgccttcacggtgctcttcgcgttcctcatcgtgcggcagcggctgacgcccgccacggtgaacgccgtcgcgctgctgaccgtgggcgccgccgtgctgggcctgcacgtctcgtccgaccgccccaggggcgtcgccagagccaagtacctgctgggcttcgcgctggcgctcggcgccgcggcgctctacggcctcatcctgccgctggtcgagctcgcgtacaggcgcgcggcggcagcaggcggcggccgcgcggtcacgtacgcgctggtgatggagatgcagctggtgatggggttcttcgccaccgcgttctgcaccgtcggcatgaccatcgacaaggacttccaggtgtgtgtgccttatgtacatttgcttgtcgcctacgtgtcacttctagactcaccatgcgagttggtcgccgcatgtcttgaaaggccataa

SEQ ID NO: 5126 - protein, 291 aa, Sorghum bicolor
  misc_feature: Ceres ANNOT ID no. 6041801
  misc_feature (1)..(261): NCBI GI: 115479665 NCBI Desc: os09g0467500 [oryza sativa (japonica cultivar-group)]
  misc_feature (31)..(262): NCBI GI: 7620007 NCBI Desc: purine permease [arabidopsis thaliana]
  misc_feature (10)..(254): NCBI GI: 56202284 NCBI Desc: purine permease-like protein [oryza sativa (japonica cultivar-group)]
  misc_feature (28)..(261): NCBI GI: 145360271 NCBI Desc: atpup5 (arabidopsis thaliana purine permease 5); purine transporter
  misc_feature (17)..(254): NCBI GI: 42571763 NCBI Desc: purine permease family protein [arabidopsis thaliana]
MDVEAARKDDLTPPTPPTPRRGKGKVMHRLLVALNCGMLALGTTAGPLLVRLYYDKGGQREWLSACLQSVGWPLLLIPVAASYAARRARDKRGGPVPVLLTPPRVLLAAAGLGVATGADNYIYAYSLRYLPVSTSAILISTQLAFTVLFAFLIVRQRLTPATVNAVALLTVGAAVLGLHVSSDRPRGVARAKYLLGFALALGAAALYGLILPLVELAYRRAAAAGGGRAVTYALVMEMQLVMGFFATAFCTVGMTIDKDFQVCVPYVHLLVAYVSLLDSPCELVAACLERP

SEQ ID NO: 5127 - DNA, 672 bp, Sorghum bicolor
  misc_feature: Ceres ANNOT ID no. 6041812
  misc_feature: Encodes the peptide sequence at SEQ ID NO 5128
atgcagcgggacgcgagaagctggtcgccggcggcggccacggaggccggcggccgcccttacgcgatgccttcgcccgtgcagccgtcgtccacgagtccgtgcaccaaggagacggtgaagaatgcactgtcgcggtgggggcggaaggtcggcgaggcgacgaggaaggccgaggatctgtcgcgcaacacatggcagcacttgaggacggcgcctagcatcgcggaggccgcggtggggaggatcgcgcaggggaccaaggtgctggcggaaggcggccacgacaggatattccggcaggccttcagcgccccgccggacgagcagctgcgcaagtcctacgcgtgctacctctccacggccgccggcccggtgatgggcgtcatgtacctgtccacggccagggtcgccttctgcagcgacagccccctgtcctacgaggcctccggcggcgacaggacggagtggagccactacaaggtggcgattcctcttcaccggctgagggcggcgagcccgtcagccaacaagctgaagcccgcggagaagttcatccagctggtgtcggtggacagccacgagttctggttcttgggcttcgtcaactacgacagcgcggtagcgcacctgcaggaagcgctgagcggcttccgcaacctgcaggcgtga

SEQ ID NO: 5128 - protein, 223 aa, Sorghum bicolor
  misc_feature: Ceres ANNOT ID no. 6041812
  misc_feature (97)..(176): Pfam Id: GRAM Pfam Desc: GRAM domain
  misc_feature (11)..(165): NCBI GI: 42570873 NCBI Desc: gram domain-containing protein / aba-responsive protein-related [arabidopsis thaliana]
  misc_feature (3)..(219): NCBI GI: 38454154 NCBI Desc: at5g13200 [arabidopsis thaliana]
  misc_feature (20)..(220): NCBI GI: 140038631 NCBI Desc: gram [medicago truncatula]
  misc_feature (3)..(195): NCBI GI: 4103635 NCBI Desc: aba-responsive protein [hordeum vulgare]
  misc_feature (91)..(216): NCBI GI: 115488548 NCBI Desc: os12g0478200 [oryza sativa (japonica cultivar-group)]
  misc_feature: The sequence is a functional homolog of SEQ ID NO. 430 in the 11/188,298 US application
MQRDARSWSPAAATEAGGRPYAMPSPVQPSSTSPCTKETVKNALSRWGRKVGEATRKAEDLSRNTWQHLRTAPSIAEAAVGRIAQGTKVLAEGGHDRIFRQAFSAPPDEQLRKSYACYLSTAAGPVMGVMYLSTARVAFCSDSPLSYEASGGDRTEWSHYKVAIPLHRLRAASPSANKLKPAEKFIQLVSVDSHEFWFLGFVNYDSAVAHLQEALSGFRNLQA

SEQ ID NO: 5129 - DNA, 1848 bp, Sorghum bicolor
  misc_feature: Ceres ANNOT ID no. 6041818
  misc_feature: Encodes the peptide sequence at SEQ ID NO 5130
atggcgtccatctccggcgcggcggcgccgccatcttccgcggcgtgccggctgcggctgctgccccggcacctcctgctccggccctcccacctccgcctcctccgcgcgccccactccatcgccgacctctcccgctccagctcctccaattccgccccgaccccggcccagccgctgccggagaacggcagcggcgtccgcgcggtggagaaggacccgatcaagctctgggagcgctacgtcgagtggctgtaccagcacaaggagctcggcctcttcgtcgacgtcagccggatggggttcacggacgacttcctgcagcagatggagccccggatgcagcaggccttcgccgccatgcgggagctcgagaagggcgccatcgccaacccggacgagggccgcatggtcggccactactggctccgcgacccggccctcgcgcccaactccttcctccgcaacaagatcgagaccgcgctcgacagtatcctcgccttctcccaagatgtcgtctctggcaagattcaatccccagctggtcgtttcacttcaattctctctataggaatcggagggtcagctttgggcccccaatttgttgctgaggcacttgcacctgataaccctccactgaagataagatttattgacaacaccgatcctgctggtattgatcatcaaattgctcaactaggacctgaactggcaactactcttgtaattgtcatttctaagagcggaggcacacctgaaacccgcaatggtctactggaagtacagaaagccttcagagatgcggggctgcaattctcgaaacagggtgttgcaattactcaagaaaattctctgttggataacactgccagaatagagggatggttagctcggtttcctatgtttgactgggttggtggtaggacttcagaaatgtcagctgtgggtttacttccagctgcattgcagggtattgatatcaaggaaatgctagctggtgcagctttaatggatgaggaaacccggaccactgtggttaaagaaaatccagcagcattgcttgcattatgttggtattgggcaacagaagggataggcaaaaaggatatggttgtacttccttacaaggatagtttgttacttttgagtagatatttgcaacaacttgtcatggaatctcttgggaaagaatttgacctggacggcaaccgggttaatcaaggtctaaccgtatatggtaacaaaggaagcactgaccagcacgcttacattcagcagctgagagaaggtgtacacaacttctttgttacttttattgaggtcttgcgtgacaggcctcctggtcatgattgggagcttgaacctggagtcacatgtggtgactatttgtttgggatgttgcagggaacccgttctgctctttatgcaaatgaccgggagtctatctctgttaccgtgcaagaggtaactcctagagctgttggagcactggttgcactttatgaacgtgctgtggggatttatgcttctttggttaatatcaatgcctatcatcagcctggtgttgaggctgggaaaaaggcagcaggagaagtattggctcttcagaaaagggtgctgactgtattaaacgaggccacctgcgagaaccctggtgagccattgagtatagatgaaattgcagatcgctgccattgccctgaagatattgagatgatctacaaaataatccagcacatggctgctaacgacagagcacttatagcagaaggcagctgcggctcacctcgcagcgttaaggtgtacctcggtgagtgcaatgtagacgaagatatgcaggccgcatag

SEQ ID NO: 5130 - protein, 615 aa, Sorghum bicolor
  misc_feature: Ceres ANNOT ID no. 6041818
  misc_feature (96)..(541): Pfam Id: PGI Pfam Desc: Phosphoglucose isomerase
  misc_feature (1)..(615): NCBI GI: 41529312 NCBI Desc: glucose-6-phosphate isomerase [oryza sativa (japonica cultivar-group)]
  misc_feature (39)..(610): NCBI GI: 51340062 NCBI Desc: glucose-6-phosphate isomerase [lycopersicon esculentum]
  misc_feature (42)..(610): NCBI GI: 3413511 NCBI Desc: glucose-6-phosphate isomerase [spinacia oleracea]
  misc_feature (1)..(610): NCBI GI: 7269312 NCBI Desc: glucose-6-phosphate isomerase [arabidopsis thaliana]
  misc_feature (1)..(610): NCBI GI: 6690395 NCBI Desc: phosphoglucose isomerase precursor [arabidopsis thaliana]
  misc_feature (73)..(603): SWISSPROT Homolog: EC 5.3.1.9 Glucose-6-phosphate isomerase
  misc_feature: Useful for making plants with modulated flowering time
  misc_feature: GREAT-hit functional homolog of the protein sequence given in SEQ ID NO 13394
  misc_feature: Useful for making plants with modulated flowering time
  misc_feature: Functional homolog of the protein sequence given in SEQ ID NO 13394
MASISGAAAPPSSAACRLRLLPRHLLLRPSHLRLLRAPHSIADLSRSSSSNSAPTPAQPLPENGSGVRAVEKDPIKLWERYVEWLYQHKELGLFVDVSRMGFTDDFLQQMEPRMQQAFAAMRELEKGAIANPDEGRMVGHYWLRDPALAPNSFLRNKIETALDSILAFSQDVVSGKIQSPAGRFTSILSIGIGGSALGPQFVAEALAPDNPPLKIRFIDNTDPAGIDHQIAQLGPELATTLVIVISKSGGTPETRNGLLEVQKAFRDAGLQFSKQGVAITQENSLLDNTARIEGWLARFPMFDWVGGRTSEMSAVGLLPAALQGIDIKEMLAGAALMDEETRTTVVKENPAALLALCWYWATEGIGKKDMVVLPYKDSLLLLSRYLQQLVMESLGKEFDLDGNRVNQGLTVYGNKGSTDQHAYIQQLREGVHNFFVTFIEVLRDRPPGHDWELEPGVTCGDYLFGMLQGTRSALYANDRESISVTVQEVTPRAVGALVALYERAVGIYASLVNINAYHQPGVEAGKKAAGEVLALQKRVLTVLNEATCENPGEPLSIDEIADRCHCPEDIEMIYKIIQHMAANDRALIAEGSCGSPRSVKVYLGECNVDEDMQAA

SEQ ID NO: 5131 - DNA, 921 bp, Sorghum bicolor
  misc_feature: Ceres ANNOT ID no. 6041830
  misc_feature: Encodes the peptide sequence at SEQ ID NO 5132
  misc_feature: Up-regulated in root tissues in response to methyl jasmonate treatment
  misc_feature: Up-regulated in shoot tissues in response to methyl jasmonate treatment
atggctagcggcgtcctccaccgcgccggctcactatgtctccgccccgccgccgagccagccgccgctgactccggccggggccacggcgcggtgatgatcggtgattcgaggacgcagcgcgctgctgctctgcggcttggaggatctagccggagagagttattatctgtcacaatggcctccagagatcacactggcttgacccggcaacttctggattttcaacacgatacaatggatgaggtaggtgcagaacatgatccattcgtggatttgaaagcgagattcctggacttcaaacacagaaactgtgtggagaatttttcaaattaccaaagtcttgctcagcagcaaacaccaaagttcatggtgattgcttgtgctgactccagggtctgccctaccgctgttttagggtttcagccgggggaagcatttacagttcgtaatgtggcaaatttggtaccaccatatgagcatggggggtcagagactagtgcagcactagagtttgctgtcaatacactccaggtagaaaatgtactggtggtaggccacagtaggtgtgggggcatccaggcactaatgagcatgaaagatgattcgacctccggaagcttcattaaaaactgggtttcaattggtaagagcgcaaggttaagcacgaaagctgctgctggaaatttgagttttgacatgcagtgcaaacattgtgaaaaggagtcaataaatagctctctgttgaacttgttaacatacccatggatagagaagagggtgaatgaaggtactttgaatcttcatggaggctactacaactttattgattgcacatttgagaaatggacattattgtaccgtgaaggtttggaaggtggaagcaagtatgctataaagaataggtccacctggtcttga

SEQ ID NO: 5132 - protein, 306 aa, Sorghum bicolor
  misc_feature: Ceres ANNOT ID no. 6041830
  misc_feature (116)..(284): Pfam Id: Pro_CA Pfam Desc: Carbonic anhydrase
  misc_feature (33)..(306): NCBI GI: 79326253 NCBI Desc: carbonate dehydratase/ zinc ion binding [arabidopsis thaliana]
  misc_feature (71)..(306): NCBI GI: 79320225 NCBI Desc: carbonate dehydratase/ zinc ion binding [arabidopsis thaliana]
  misc_feature (10)..(261): NCBI GI: 30696219 NCBI Desc: carbonic anhydrase family protein / carbonate dehydratase family protein [arabidopsis thaliana]
  misc_feature (136)..(306): NCBI GI: 7270306 NCBI Desc: carbonate dehydratase-like protein [arabidopsis thaliana]
  misc_feature (37)..(285): NCBI GI: 27652186 NCBI Desc: carbonic anhydrase 3 [flaveria bidentis]
  misc_feature (93)..(285): SWISSPROT Homolog: EC 4.2.1.1 Carbonic anhydrase, chloroplast precursor
  misc_feature: Up-regulated in root tissues in response to methyl jasmonate treatment
  misc_feature: Up-regulated in shoot tissues in response to methyl jasmonate treatment
MASGVLHRAGSLCLRPAAEPAAADSGRGHGAVMIGDSRTQRAAALRLGGSSRRELLSVTMASRDHTGLTRQLLDFQHDTMDEVGAEHDPFVDLKARFLDFKHRNCVENFSNYQSLAQQQTPKFMVIACADSRVCPTAVLGFQPGEAFTVRNVANLVPPYEHGGSETSAALEFAVNTLQVENVLVVGHSRCGGIQALMSMKDDSTSGSFIKNWVSIGKSARLSTKAAAGNLSFDMQCKHCEKESINSSLLNLLTYPWIEKRVNEGTLNLHGGYYNFIDCTFEKWTLLYREGLEGGSKYAIKNRSTWS

SEQ ID NO: 5133 - DNA, 774 bp, Sorghum bicolor
  misc_feature: Ceres ANNOT ID no. 6041836
  misc_feature: Encodes the peptide sequence at SEQ ID NO 5134
atgccgtctttcatcgacggccccactttccggtcgctgctccggccgtccaccaatgggcgccggacgacgacaaagatctccgacagcggcggaggcggcggcggcggaggcagcagcagcggcggcgggatcttcaagatattcaagctcatgcccatgctctcgtccggctgcaagatggtggcgctgctcggcaagcacaacagccgtgcgctgctggcggaccacgccacgacggtgacgctgttcggccaccgccgcggccgcgtgagcctggcgatccacgaggacacccgcgcgccgccgctgttcctcatcgagctgcccatgctgacgagcgcgctgcaccgggagatctcgtcggggaccgtcaagctggcgctcgagagcgacacccgcagcgcccggcgccggctcgtggaggagtacgtctgggccgtctactgcaacggacgcaaggccgggtacgccatccggaggaaggatgcctccgacgacgagcgccacgtgctgcgcctgctgcgcggcgtgtccatgggcgccggcgtgctcccggcggcccccgagaaggaaggcggcgtgcccgcggggcctgacggcgagctcacgtacgtgcgcgcccgcgtcgagcgcgtcgtcggttccaaggactcggaggccttctacatgatcaaccccgaggagggtggaaacggcggcgacaataataatggtgccggaggaggcggcggcgcgccggagctgagcattttcctagtaaggatgaaatga

SEQ ID NO: 5134 - protein, 257 aa, Sorghum bicolor
  misc_feature: Ceres ANNOT ID no. 6041836
  misc_feature (131)..(256): NCBI GI: 115438821 NCBI Desc: os01g0642600 [oryza sativa (japonica cultivar-group)]
  misc_feature (63)..(256): NCBI GI: 115465611 NCBI Desc: os05g0577100 [oryza sativa (japonica cultivar-group)]
  misc_feature (105)..(256): NCBI GI: 115448223 NCBI Desc: os02g0709600 [oryza sativa (japonica cultivar-group)]
  misc_feature (50)..(256): NCBI GI: 21741231 NCBI Desc: osjnbb0034i13.25 [oryza sativa (japonica cultivar-group)]
MPSFIDGPTFRSLLRPSTNGRRTTTKISDSGGGGGGGGSSSGGGIFKIFKLMPMLSSGCKMVALLGKHNSRALLADHATTVTLFGHRRGRVSLAIHEDTRAPPLFLIELPMLTSALHREISSGTVKLALESDTRSARRRLVEEYVWAVYCNGRKAGYAIRRKDASDDERHVLRLLRGVSMGAGVLPAAPEKEGGVPAGPDGELTYVRARVERVVGSKDSEAFYMINPEEGGNGGDNNNGAGGGGGAPELSIFLVRMK

SEQ ID NO: 5135 - DNA, 1317 bp, Sorghum bicolor
  misc_feature: Ceres ANNOT ID no. 6041858
  misc_feature: Encodes the peptide sequence at SEQ ID NO 5136
atgcaggcggcggcggtgaatggcgcgggcgacgtgcagaagccccaccaccaccaccagcagcagccggtggtggtgggggcgccgcctccgccggcggccgtggtgccgtcccattgggttgccatgccgttcgcgccgcctcccggggccgcggccatggtgatgcagccgcaccagatggcgccggcgccgccccaccagttcgcggcggcccacttcgtgccgttccacgccgtcgcgccgccgccgccgcgggcggcgcccgtgccagcggtcgcactgggctcccccgcaccgcatcaggccgggcacgaggagaacaagaccatctgggtcggcgacctccattactggatggacgagaactacctccacagctgcttcggctacaccggcgaggttgtggcgattaaagtcattcgcaataagcagactggacagtctgaaggatatggatttgttgagttctacagtcatgctgcagctgaaaaagttcttgaagggttttctggtcatattatgccaaataccgaccagccttttaggttaaattgggcatcgtttagcatgggagataggcgctcagatgttgcttcagatcattccatatttgtaggcgatcttgcttctgatgtcaatgatgccacactactggaggctttctccagcaggtactcctctgtcaaaggtgccaaagttgtcattgatgctaacactggtagatcgaaaggttatggcttcgtgagatttggagatgacagtgagaagacacatgccatgactgagatgaatggtgtgtattgctcttctaggcccatgagaattggcccagcaactccaagaaaatcatcaggtacttctggatcaaatggttcatctgctcgatcagacggaggagatttgacaaacacaacagtatttgtgggtgggctcgacccaaatgttagtgaagaggaccttaggcaaaccttctcccagtatggagaaatttcttcggtaaagattccagttgggaaacaatgtggcttcgtgcagtttgctcagagaaagaacgcggaggacgcattgcaaggattaaatggcagtactattggcaaacagaccgtgcgtctttcatggggtcgcaacccagcaaacaagcagtttagaggcgacaacggcaaccagtggaacaacgggggaatgtactacgcggcgtccccgttctacaacggctacggttaccctgcggcgccgttccctgatccaggcatgtacgctgctccagcctacggtgcctacccgttctatggcaaccagcagcaagtgagctga

SEQ ID NO: 5136 - protein, 438 aa, Sorghum bicolor
  misc_feature: Ceres ANNOT ID no. 6041858
  misc_feature (111)..(182): Pfam Id: RRM_1 Pfam Desc: RNA recognition motif. (a.k.a. RRM, RBD, or RNP domain)
  misc_feature (204)..(276): Pfam Id: RRM_1 Pfam Desc: RNA recognition motif. (a.k.a. RRM, RBD, or RNP domain)
  misc_feature (307)..(372): Pfam Id: RRM_1 Pfam Desc: RNA recognition motif. (a.k.a. RRM, RBD, or RNP domain)
  misc_feature (81)..(438): NCBI GI: 115479619 NCBI Desc: os09g0462700 [oryza sativa (japonica cultivar-group)]
  misc_feature (1)..(438): NCBI GI: 115458668 NCBI Desc: os04g0449900 [oryza sativa (japonica cultivar-group)]
  misc_feature (1)..(438): NCBI GI: 116310076 NCBI Desc: h0818e04.14 [oryza sativa (indica cultivar-group)]
  misc_feature (20)..(438): NCBI GI: 15594035 NCBI Desc: nucleic acid binding protein [nicotiana tabacum]
  misc_feature (97)..(436): NCBI GI: 9663769 NCBI Desc: rna binding protein 47 [nicotiana plumbaginifolia]
  misc_feature: Useful for making plants with altered terpenoid content
  misc_feature: Functional homolog of the protein sequence given in SEQ ID NO 12954
  misc_feature: The sequence is a functional homolog of SEQ ID NO 536 in the 10/666,642 US patent application
  misc_feature: The sequence is a functional homolog of SEQ ID NO 252 in the 10/714,887 US patent application
  misc_feature: The sequence is a functional homolog of SEQ ID NO 252 in the 11/435,388 US patent application
  misc_feature: The sequence is a functional homolog of SEQ ID NO 568 in the 10/666,642 US patent application
  misc_feature: The sequence is a functional homolog of SEQ ID NO 1484 in the 10/666,642 US patent application
  misc_feature: The sequence is a functional homolog of SEQ ID NO 278 in the 10/714,887 US patent application
  misc_feature: The sequence is a functional homolog of SEQ ID NO 278 in the 11/435,388 US patent application
  misc_feature: The sequence is a functional homolog of SEQ ID NO. 339 in the 11/188,298 US application
  misc_feature: The sequence is a functional homolog of SEQ ID NO. 458 in the 11/188,298 US application
MQAAAVNGAGDVQKPHHHHQQQPVVVGAPPPPAAVVPSHWVAMPFAPPPGAAAMVMQPHQMAPAPPHQFAAAHFVPFHAVAPPPPRAAPVPAVALGSPAPHQAGHEENKTIWVGDLHYWMDENYLHSCFGYTGEVVAIKVIRNKQTGQSEGYGFVEFYSHAAAEKVLEGFSGHIMPNTDQPFRLNWASFSMGDRRSDVASDHSIFVGDLASDVNDATLLEAFSSRYSSVKGAKVVIDANTGRSKGYGFVRFGDDSEKTHAMTEMNGVYCSSRPMRIGPATPRKSSGTSGSNGSSARSDGGDLTNTTVFVGGLDPNVSEEDLRQTFSQYGEISSVKIPVGKQCGFVQFAQRKNAEDALQGLNGSTIGKQTVRLSWGRNPANKQFRGDNGNQWNNGGMYYAASPFYNGYGYPAAPFPDPGMYAAPAYGAYPFYGNQQQVS

SEQ ID NO: 5137 - DNA, 984 bp, Sorghum bicolor
  misc_feature: Ceres ANNOT ID no. 6041863
  misc_feature: Encodes the peptide sequence at SEQ ID NO 5138
atgtccaacgccgacgtgggcgacggcgacgaggtcgtcctcgacgcccccggcttcatacgcgtgtacaagagcggccgcgtcgagcgcttccttccggtcgacttcgccccgccctctactgacgccgccaccggcgtctcctcaaaggacgtcgccatcctccgagacgcctgcgtatcggctcgcatttacctcccggcggccccctcctccggaagttacagcggcaagctccccgtcctggtgttcttccacggcggcgggttctgcctcggttcggcgtccgacgcggcggtgcacgcccacgccaatcggctcgccgcggcggccggcgcaatcgtcgtgtcggtggaataccgcctcgcgccggagcatccggtccccgcgctctacggggacgcatgggcggcgctccagtgggtggccgagcacgccgcgggccgggggcaggagccctggctgaccgcccacgcggacctcgggcgcgtccacgtcggcggagagagcgcgggcgccaacattgcgcaccacgccgcgatgcgcgctggcagcgaggagctgggccacggcgtcaagctcagctcgctcgtgctgatccatccctacttcctgggaggcgagagctccgagacagacgagatgggcgtagcgttgctccgcgagctcgtccggctgtggccggtggtgtgcccgggcacgagcgggtgcgacggcgacccgttgatcaatccgatggcagagggcgcccccaatctctctaccttggggtgccggcgcgtgctggtgtgcgtcgggggaaaggacccgatgaggggcagaggaaggctgtattgtgagaagctgaagggaagtgggtggcgcggggaggtggaggactgggaggcggacggtcagggacacggtttccatctctcgtgcgccatgagcgcagaggcggaggcgcaagtccgggtcatcgctgagtttctgagctatggatga

SEQ ID NO: 5138 - protein, 327 aa, Sorghum bicolor
  misc_feature: Ceres ANNOT ID no. 6041863
  misc_feature (82)..(305): Pfam Id: Abhydrolase_3 Pfam Desc: alpha/beta hydrolase fold
  misc_feature (7)..(325): NCBI GI: 82697977 NCBI Desc: cxe carboxylesterase [actinidia eriantha]
  misc_feature (10)..(325): NCBI GI: 82697943 NCBI Desc: cxe carboxylesterase [malus pumila]
  misc_feature (10)..(324): NCBI GI: 92875380 NCBI Desc: esterase/lipase/thioesterase [medicago truncatula]
  misc_feature (11)..(324): NCBI GI: 115476872 NCBI Desc: os08g0475000 [oryza sativa (japonica cultivar-group)]
  misc_feature (2)..(324): NCBI GI: 56692178 NCBI Desc: 2-hydroxyisoflavanone dehydratase [glycyrrhiza echinata]
MSNADVGDGDEVVLDAPGFIRVYKSGRVERFLPVDFAPPSTDAATGVSSKDVAILRDACVSARIYLPAAPSSGSYSGKLPVLVFFHGGGFCLGSASDAAVHAHANRLAAAAGAIVVSVEYRLAPEHPVPALYGDAWAALQWVAEHAAGRGQEPWLTAHADLGRVHVGGESAGANIAHHAAMRAGSEELGHGVKLSSLVLIHPYFLGGESSETDEMGVALLRELVRLWPVVCPGTSGCDGDPLINPMAEGAPNLSTLGCRRVLVCVGGKDPMRGRGRLYCEKLKGSGWRGEVEDWEADGQGHGFHLSCAMSAEAEAQVRVIAEFLSYG

SEQ ID NO: 5139 - DNA, 1092 bp, Sorghum bicolor
  misc_feature: Ceres ANNOT ID no. 6041866
  misc_feature: Encodes the peptide sequence at SEQ ID NO 5140
atgcccaaactgtcgtgccgggtgctctgcgcggctattctcatcgcttcgctggccgctctgctcttccggttcccgatccataggctcctcagtccccacgccgccatggaccccgactccgagctcgagttcgagatgcccggcgtcttgcgcgtgtacaagacaggccgcgtcgagcgcttcgatggcaccgagaccgtcccgccgtcccccgacggcgaccccgccaacggcgtcgcgtccaaggacgtcgtcctcgacgccgccgctggcatctacgcgcgcctctacctccccgccggagtggatcccgggaagaagctccccgtcgtcgtgttcttccacggcggtgcgttcatggtccacacccccgcctccccgctgtaccacatctactccgcctccctcgctgccgcggcgcccgccgtcgtcgtctccgttgactaccgcctggcgcccgagcaccgcatccccgccgcctacgacgacgcgttcgcggccctgaaggcggtcgtcgccgcgtgccgcgcggatggcgccgaggcggaggcggaggcggagccctggctcgccgcgcacggcgacgcctcccgcatcgtcctcgcgggtgacagcgccggcggtaacatggcgcacaacgtggcgataaggctgcgcaaggaaggcggcatcgtgggttacggcgacacggtcagcggcgtcgtcctcctgcacccttacttttgggggaaagagccgctgggcgcggagcccacggatcccggctaccgcgcaatgttcgaccccacgtgggagttcatctgcgccggaaagttcggcctcgaccacccctacatcaacccaatggcgtcgccggaggagtggaggcagctcgggtctcgccgcgtgctggtgaccacggcggaccagtgctggttcgtggagagggcaagagcgtacgcagaggggatcaagaagtgcggctgggagggggagctcgagttctacgagaccaaggacgaggcgcacgtcttcttcttgcctaaacacggcagcgacaacgccgtcaaggagctcgccgtcgtggccgaattcatcaggcgctgttga

SEQ ID NO: 5140 - protein, 363 aa, Sorghum bicolor
  misc_feature: Ceres ANNOT ID no. 6041866
  misc_feature (112)..(341): Pfam Id: Abhydrolase_3 Pfam Desc: alpha/beta hydrolase fold
  misc_feature (2)..(363): NCBI GI: 115479607 NCBI Desc: os09g0461900 [oryza sativa (japonica cultivar-group)]
  misc_feature (30)..(362): NCBI GI: 115476872 NCBI Desc: os08g0475000 [oryza sativa (japonica cultivar-group)]
  misc_feature (42)..(360): NCBI GI: 115476870 NCBI Desc: os08g0474800 [oryza sativa (japonica cultivar-group)]
  misc_feature (64)..(354): NCBI GI: 82697967 NCBI Desc: cxe carboxylesterase [actinidia deliciosa]
  misc_feature (40)..(362): NCBI GI: 82697943 NCBI Desc: cxe carboxylesterase [malus pumila]
MPKLSCRVLCAAILIASLAALLFRFPIHRLLSPHAAMDPDSELEFEMPGVLRVYKTGRVERFDGTETVPPSPDGDPANGVASKDVVLDAAAGIYARLYLPAGVDPGKKLPVVVFFHGGAFMVHTPASPLYHIYSASLAAAAPAVVVSVDYRLAPEHRIPAAYDDAFAALKAVVAACRADGAEAEAEAEPWLAAHGDASRIVLAGDSAGGNMAHNVAIRLRKEGGIVGYGDTVSGVVLLHPYFWGKEPLGAEPTDPGYRAMFDPTWEFICAGKFGLDHPYINPMASPEEWRQLGSRRVLVTTADQCWFVERARAYAEGIKKCGWEGELEFYETKDEAHVFFLPKHGSDNAVKELAVVAEFIRRC

SEQ ID NO: 5141 - DNA, 2289 bp, Sorghum bicolor
  misc_feature: Ceres ANNOT ID no. 6041873
  misc_feature: Encodes the peptide sequence at SEQ ID NO 5142
atgtctgagttccttgacctagaggtacaagatgggataaggatgccctggaatgttattccaggcacaaaacaggagactgtgaactgtgtgattcctgtttccgctatctatacacctttgaaatcaattcctgatatcccggttctcccatattcaccccttcgctgtcgcatgtgtcgttccatcctcaaccctttctccattgttgactatgttgctaagatctgggtctgtccattctgctttcaacgcaaccagttcccacaacactactcgtcaatctcagaaaataatctccctgcagaactctttcctcagtataccaccgttgagtacatatcctcaactgaaactggtcctatagttccaccagttttcatttttgttgtagatacttgcatgattgaagaagaaattggttatttgaagtccgcactggcacaagctgttgagctattgccagataattcccttgttggattcattacattcgggacgtatgtgcaggttcatgaattgggttttggcttgttgccgaagtcatatgtattcaagggaacaaaggaggtcaccaaggaacaaatattggaacaaatgtgcttctttgcagggaagaaaatgcccaccacaggcgtgatcgctggtaccagagatggtctttcatctgagagcatctctaggtttctgctgcctgcttctgaatgcgagtttgtgttgaactcagttatagaagaaatacaaaaggacccttggcctgttccagctgatcagcgtgcatctaggtgcactggagctgccttaagtgttgcagccaatctccttggggtttgtgttcctggatcaggtgctaggataatggcatttgttggtggtccatctacagagggccccggttctattgtatccaaatccttatcagagcccattcgctcacacaaagaccttgataaagactcagcaccactttatgataaagctgttaagttctatgatcaaatagcgaagcagcttgtgcaccaagggcatgtgctggatttgtttgcttgtgcagtcgaccaggttggagtcgctgaaatgaaggttgcaattgagaagactggaggaattgttgtgcttgctgaaagttttggccattctgttttcaaagactcacttctccgcatctttcagtcaacagatgacaaccttggtttatcattcaatggtattcttgagattaactgttcaaaggatgtaaaggttcaaggcatcattggaccctgttcttccctggagaagaaaagtcctttgtcttccgacactgttattggtcaaggaaacactagcgcttggaagatgtgcggccttgacaggaagacatcactttgcttggtatatgatattgcaaaaaaggatggcccagattcaattggtcaatcaacaagcaatcagttctactttcagttcttaacctactatcagcacaatgagggtcagatgagattaagatcgaccacaatctccaggagatgggtctctggtgataacaatgtggaggagctagtagccggctttgatcaagaagctgcagctgcagtcatggcacgcttggtgtcatttaagatggaaactgaggttgattttgacccagtaagatggcttgatcgggctttgatacgtatatgctcaaaatttggagactatcagaaggagacaccctcatccttcagtttatccccacggctgtcaatatttccccagtttatatttaatttgaggcgttctcaatttgttcaggtttttaataacagtcctgatgaaactgcgtattttaggatgatgttagatagagagaatgtagccaatgcagttgtgatgattcaaccttcacttatatcctattcatttcaatcagggccagagccagttctcttggatgcaactgcaattgcttctgacaagatccttttgttggactcttattttactgttgtcatattccatggggtaaccattgcacagtggcgaaatgctggctaccaagatcaagaaggtcacgaggtgtttgcccagttgttaaaagcaccacatgaggaagctaatttaataataaaggagcgatttcctgtaccccgtttggtagtatgtgatcaatatggatctcaggctcgatttttactggcgaagctaaatccatcagtgacatataactcggataatgcctcccctggtggagacgtcatattcacagatgatgtgagcttccaggttttcatggaccatctccagcggctagcagtccaatag

SEQ ID NO: 5142 - protein, 762 aa, Sorghum bicolor
  misc_feature: Ceres ANNOT ID no. 6041873
  misc_feature (122)..(390): Pfam Id: Sec23_trunk Pfam Desc: Sec23/Sec24 trunk domain
  misc_feature (400)..(506): Pfam Id: Sec23_BS Pfam Desc: Sec23/Sec24 beta-sandwich domain
  misc_feature (521)..(621): Pfam Id: Sec23_helical Pfam Desc: Sec23/Sec24 helical domain
  misc_feature (53)..(92): Pfam Id: zf-Sec23_Sec24 Pfam Desc: Sec23/Sec24 zinc finger
  misc_feature (630)..(720): Pfam Id: Gelsolin Pfam Desc: Gelsolin repeat
  misc_feature (2)..(762): NCBI GI: 140068525 NCBI Desc: zinc finger, sec23/sec24-type; sec23/sec24 trunk region; sec23/sec24 helical region; gelsolin region; sec23/sec24 beta-sandwich [medicago truncatula]
  misc_feature (1)..(762): NCBI GI: 140063092 NCBI Desc: zinc finger, sec23/sec24-type; sec23/sec24 trunk region; sec23/sec24 helical region; gelsolin region; sec23/sec24 beta-sandwich [medicago truncatula]
  misc_feature (3)..(762): NCBI GI: 7268121 NCBI Desc: transport protein [arabidopsis thaliana]
  misc_feature (3)..(762): NCBI GI: 20147367 NCBI Desc: at4g14160/dl3120w [arabidopsis thaliana]
  misc_feature (88)..(762): NCBI GI: 15912297 NCBI Desc: at1g05520/t25n20_16 [arabidopsis thaliana]
MSEFLDLEVQDGIRMPWNVIPGTKQETVNCVIPVSAIYTPLKSIPDIPVLPYSPLRCRMCRSILNPFSIVDYVAKIWVCPFCFQRNQFPQHYSSISENNLPAELFPQYTTVEYISSTETGPIVPPVFIFVVDTCMIEEEIGYLKSALAQAVELLPDNSLVGFITFGTYVQVHELGFGLLPKSYVFKGTKEVTKEQILEQMCFFAGKKMPTTGVIAGTRDGLSSESISRFLLPASECEFVLNSVIEEIQKDPWPVPADQRASRCTGAALSVAANLLGVCVPGSGARIMAFVGGPSTEGPGSIVSKSLSEPIRSHKDLDKDSAPLYDKAVKFYDQIAKQLVHQGHVLDLFACAVDQVGVAEMKVAIEKTGGIVVLAESFGHSVFKDSLLRIFQSTDDNLGLSFNGILEINCSKDVKVQGIIGPCSSLEKKSPLSSDTVIGQGNTSAWKMCGLDRKTSLCLVYDIAKKDGPDSIGQSTSNQFYFQFLTYYQHNEGQMRLRSTTISRRWVSGDNNVEELVAGFDQEAAAAVMARLVSFKMETEVDFDPVRWLDRALIRICSKFGDYQKETPSSFSLSPRLSIFPQFIFNLRRSQFVQVFNNSPDETAYFRMMLDRENVANAVVMIQPSLISYSFQSGPEPVLLDATAIASDKILLLDSYFTVVIFHGVTIAQWRNAGYQDQEGHEVFAQLLKAPHEEANLIIKERFPVPRLVVCDQYGSQARFLLAKLNPSVTYNSDNASPGGDVIFTDDVSFQVFMDHLQRLAVQ

SEQ ID NO: 5143 - DNA, 525 bp, Sorghum bicolor
  misc_feature: Ceres ANNOT ID no. 6041876
  misc_feature: Encodes the peptide sequence at SEQ ID NO 5144
atggttctaagcagcaatatttcggttcggaaaactttatatgaggttttatctgtgagtgaagatgctacatatgatgaaatccgtgcagcatacaggtctgctgctctgaccacacaccctgacaaagcacatacaactctcgagtcgtctgtgccttccagtgagcaacaagaattttttagtgtgcagaaagcatgggaaatcctacgccacccaacatctagagcagactatgataagcagctgcaatcatccagacagaacattgagatcatcgcgtctgaaatcgaagtcggggatatgatcatcgagagcactgctgatactctagtgctgctgtacccatgcaggtgtggtgattatttttccatcactaagtgtgaacttagtgggatgggacatttggtcagtggagatggagaagtagaactgcaggcgtctgattctgcatcagcttccattgttctgggctgtggctcttgttctctgaaaataaagttggttataaatgaaacttcatga

SEQ ID NO: 5144 - protein, 174 aa, Sorghum bicolor
  misc_feature: Ceres ANNOT ID no. 6041876
  misc_feature (12)..(80): Pfam Id: DnaJ Pfam Desc: DnaJ domain
  misc_feature (95)..(172): Pfam Id: zf-CSL Pfam Desc: CSL zinc finger
  misc_feature (1)..(174): NCBI GI: 115476866 NCBI Desc: os08g0474600 [oryza sativa (japonica cultivar-group)]
  misc_feature (1)..(130): NCBI GI: 92868083 NCBI Desc: heat shock protein dnaj, n-terminal [medicago truncatula]
  misc_feature (4)..(140): NCBI GI: 116128056 NCBI Desc: ensangp00000017982 [anopheles gambiae str. pest]
  misc_feature (17)..(87): NCBI GI: 77454996 NCBI Desc: cg2911 [drosophila yakuba]
  misc_feature (14)..(102): NCBI GI: 125775699 NCBI Desc: ga15512-pa [drosophila pseudoobscura]
  misc_feature: Useful for making plants with altered protein content
  misc_feature: Useful for making plants with modulated drought sensitivity
  misc_feature: Useful for making plants with modulated seed size
  misc_feature: Useful for making plants with modulated nitrogen use efficiency
  misc_feature: GREAT-hit functional homolog of the protein sequence given in SEQ ID NO 13481
  misc_feature: GREAT-hit functional homolog of the protein sequence given in SEQ ID NO 13491
  misc_feature: GREAT-hit functional homolog of the protein sequence given in SEQ ID NO 13493
MVLSSNISVRKTLYEVLSVSEDATYDEIRAAYRSAALTTHPDKAHTTLESSVPSSEQQEFFSVQKAWEILRHPTSRADYDKQLQSSRQNIEIIASEIEVGDMIIESTADTLVLLYPCRCGDYFSITKCELSGMGHLVSGDGEVELQASDSASASIVLGCGSCSLKIKLVINETS

SEQ ID NO: 5145 - DNA, 258 bp, Sorghum bicolor
  misc_feature: Ceres ANNOT ID no. 6041879
  misc_feature: Encodes the peptide sequence at SEQ ID NO 5146
atggcagccgccgctgccacggcgacgacgacggtggtgccgagatgcagcaagcgcgagggcgacattgcgggcgccggcacgtcgccgaacaaggggaagatagggaggtcgtcgccgccggcggaggaggtggaggcgttcctcgccgcagcggagagcggcatggcgcggcgcttcgcagccaagtacaactatgacgtcgtgaaggacgctcccatggacggtcggtacgagtgggtccgggtggggccatga

SEQ ID NO: 5146 - protein, 85 aa, Sorghum bicolor
  misc_feature: Ceres ANNOT ID no. 6041879
  misc_feature (37)..(84): Pfam Id: CDI Pfam Desc: Cyclin-dependent kinase inhibitor
  misc_feature (37)..(85): NCBI GI: 46844158 NCBI Desc: cyclin-dependent kinase inhibitor 1;2 [glycine max]
  misc_feature (37)..(85): NCBI GI: 12081915 NCBI Desc: cyclin dependent kinase inhibitor [pisum sativum]
  misc_feature (39)..(80): NCBI GI: 81251431 NCBI Desc: kip-related protein 3 [oryza sativa (japonica cultivar-group)]
  misc_feature (17)..(83): NCBI GI: 62530442 NCBI Desc: cyclin-dependent kinase inhibitor 2 [zea mays]
  misc_feature (37)..(85): NCBI GI: 42362358 NCBI Desc: cyclin-dependent kinase inhibitor 1;1 [glycine max]
MAAAAATATTTVVPRCSKREGDIAGAGTSPNKGKIGRSSPPAEEVEAFLAAAESGMARRFAAKYNYDVVKDAPMDGRYEWVRVGP

SEQ ID NO: 5147 - DNA, 1314 bp, Sorghum bicolor
  misc_feature: Ceres ANNOT ID no. 6041889
  misc_feature: Encodes the peptide sequence at SEQ ID NO 5148
atggcggcggcggcgccggcggcgttgtcgccggggacggtgcctttgggggtgctgctgcggcgggaggtgaccaaggagcggatggagcggccggacgtgctgtgcggggaggccaaccgcagccgcaagggcgaggacttcacgctgctccgcgcagacgccggccagcgcatccccggggacccctccacctccttctccgtcttcgcgcttttcgatgggcacaacggatcaggagctgccatatacgcaagggagaatctgttgaagaatgtcttgcgtgccattcctacatgtttctgcagagaggagtggcttgccgtgctcccacgtgcgcttgttgcagcgttcgtcaagaccgataaagatttccaggcagtagctgaaacttctggtacaactgtgacatttgtgataaaagacgagtgggttgtgactgtagcatctgtcggtgattcacgttgcatactagaatctgccgatggttcaatttattttttatcagctgatcaccgctttgactccaacccagatgaggtcaagcgcgtgacagcatgtgggagcaaagttgggaaaatggacattgtcggtggtccagaggttggtcctctaagatgttggccaggtggcctgtgtttatctagatcgataggggatttggatgttggtgaatgcatcattgctgttcctcatgttaagcaagtgaagctttctaatgctggaggcagaattgtcattgcaagcgatggtgtatgggatgatttgacatgtgaaatggctcttgactgttcccgtgggttctcatcagatgtagctgcccatcgaattgttaatgaagcaacccggcctcgaggaatcagggatgatactacttgcatcgtaattgacattctaccaccagaaaatatagccccgatcccgagtcctcctaagagaccgagcaggattgcattcaataatatgtttcggagaagatctctggatgttcccttcaaaacaaatagatcagaatatgctgaacctgatgtggtggaagaaatatttgaagatggctctccgatgctttctaaaaggctaactaccggatatacacttgagaaaatctttgcaccctccagttgtgcagtttgtctggtacggttgaaatctggagagggaatttcagtgcatgctaacccattgcaacatgaaaaactacaaggttggcagggtcctttcctatgcctgagctgtcatgaaaagaaagaagcaatggaagggaaacgccggccaagaggatcttcaacaaatgtcttcggtcacatgtgctag

SEQ ID NO: 5148 - protein, 437 aa, Sorghum bicolor
  misc_feature: Ceres ANNOT ID no. 6041889
  misc_feature (35)..(291): Pfam Id: PP2C Pfam Desc: Protein phosphatase 2C
  misc_feature (1)..(434): NCBI GI: 116310073 NCBI Desc: h0818e04.11 [oryza sativa (indica cultivar-group)]
  misc_feature (12)..(434): NCBI GI: 38344839 NCBI Desc: osjnba0064h22.20 [oryza sativa (japonica cultivar-group)]
  misc_feature (12)..(437): NCBI GI: 115458662 NCBI Desc: os04g0449400 [oryza sativa (japonica cultivar-group)]
  misc_feature (14)..(432): NCBI GI: 115453381 NCBI Desc: os03g0395100 [oryza sativa (japonica cultivar-group)]
  misc_feature (9)..(430): NCBI GI: 92879648 NCBI Desc: protein phosphatase 2c-like [medicago truncatula]
  misc_feature: The sequence is a functional homolog of SEQ ID NO. 363 in the 11/188,298 US application
  misc_feature: The sequence is a functional homolog of SEQ ID NO. 386 in the 11/188,298 US application
  misc_feature: The sequence is a functional homolog of SEQ ID NO. 406 in the 11/188,298 US application
  misc_feature: The sequence is a functional homolog of SEQ ID NO. 448 in the 11/188,298 US application
MAAAAPAALSPGTVPLGVLLRREVTKERMERPDVLCGEANRSRKGEDFTLLRADAGQRIPGDPSTSFSVFALFDGHNGSGAAIYARENLLKNVLRAIPTCFCREEWLAVLPRALVAAFVKTDKDFQAVAETSGTTVTFVIKDEWVVTVASVGDSRCILESADGSIYFLSADHRFDSNPDEVKRVTACGSKVGKMDIVGGPEVGPLRCWPGGLCLSRSIGDLDVGECIIAVPHVKQVKLSNAGGRIVIASDGVWDDLTCEMALDCSRGFSSDVAAHRIVNEATRPRGIRDDTTCIVIDILPPENIAPIPSPPKRPSRIAFNNMFRRRSLDVPFKTNRSEYAEPDVVEEIFEDGSPMLSKRLTTGYTLEKIFAPSSCAVCLVRLKSGEGISVHANPLQHEKLQGWQGPFLCLSCHEKKEAMEGKRRPRGSSTNVFGHMC

SEQ ID NO: 5149 - DNA, 555 bp, Sorghum bicolor
  misc_feature: Ceres ANNOT ID no. 6041897
  misc_feature: Encodes the peptide sequence at SEQ ID NO 5150
atgtctcatctgagcatcctctccttcaagtacaatctcgcgaagctccggtccaaggccggccggccaattgggcggccgctgtcggccagggaccgccagtactccgacctgagcacctacaagcccgacgacgaggagatgaagaaagttttcagcatgatagctggccaatcccacgggaagatcagcaagaaagacctgcagctgctgctggagaggttcgggaaggcggacgccgccgccgaggcccggcggatgatgtgcgtcgcggaccacaacaaggacgggtacatggacctggaggagttcatggaggtgcaccggaacggcgtgcagctcggggacatccgtcgggccttcttcgtgttcgacaggaacggggacggcaggatcagcgcggaggaggtcatgacggtgctgtgcaacctcgggcagagctgcagcctggatgactgccggaagatggtgagggaggtcgacaggaacggcgatggcttcgtggacatggacgagttcatggtcatgatgactcgcccgcggaggaagccgtga

SEQ ID NO: 5150 - protein, 184 aa, Sorghum bicolor
  misc_feature: Ceres ANNOT ID no. 6041897
  misc_feature (116)..(144): Pfam Id: efhand Pfam Desc: EF hand
  misc_feature (152)..(180): Pfam Id: efhand Pfam Desc: EF hand
  misc_feature (1)..(182): NCBI GI: 92871581 NCBI Desc: calcium-binding ef-hand [medicago truncatula]
  misc_feature (14)..(177): NCBI GI: 19386815 NCBI Desc: b1147a04.10 [oryza sativa (japonica cultivar-group)]
  misc_feature (47)..(178): NCBI GI: 5391446 NCBI Desc: pollen allergen jun o 4 [juniperus oxycedrus]
  misc_feature (42)..(177): NCBI GI: 28301674 NCBI Desc: calcium-binding protein [lotus corniculatus var. japonicus]
  misc_feature (39)..(179): NCBI GI: 62249491 NCBI Desc: calcium-binding protein [ambrosia artemisiifolia]
MSHLSILSFKYNLAKLRSKAGRPIGRPLSARDRQYSDLSTYKPDDEEMKKVFSMIAGQSHGKISKKDLQLLLERFGKADAAAEARRMMCVADHNKDGYMDLEEFMEVHRNGVQLGDIRRAFFVFDRNGDGRISAEEVMTVLCNLGQSCSLDDCRKMVREVDRNGDGFVDMDEFMVMMTRPRRKP

SEQ ID NO: 5151 - DNA, 885 bp, Sorghum bicolor
  misc_feature: Ceres ANNOT ID no. 6041905
  misc_feature: Encodes the peptide sequence at SEQ ID NO 5152
atgaccaagaagctcatctccgccatggccgggaagcaaggtttcaaggagcagcagttcaatgatcagaggagacagcaggcttcgattcaaggagacgacatcgccaagagcctggtggggttcggcggcggcggcggcaggctgatctcccatgagcaggaggacgccatcatcgtggcggcgctgcggcacgtggtgtccgggtacagcacgccgccgccggaggtcgtcacggtggcgggcggcgagccgtgcggggtctgcggcatcgacggatgcctcggctgcgacttcttcggggcggcgccggagctgacgcaacaggaagcagtgaacttcggcacagggcagatggtagcgacagctgcggcagcggcggccggaggggagcacgggcagaggacgcggcggcgtcggaagaagaacatgtaccgcggcgtgcggcagcggccgtgggggaagtgggcggcggagatccgcgacccgcggcgcgcggcgcgcgtgtggctgggcacgttcgacaccgcggaggaggccgccagggcctacgactgcgccgccatcgagttccgcggcgcgcgcgccaagctcaatttcccgggccacgaggcgttgctgccgttccagggccatggccatggcggcgacgcttgcgccaccgcggcggcgaacgccgagacgcagacgacaccgatgctgatgacgccgtcgccgtgcagtgcagacgccgcggcggcggcgccgggagactggcagctgggcggcggcgtggacggcggagagggagacgaggtgtgggaaggtctgctacaggacctgatgaagcaggacgaggcggacctctggttcttgccattttccggcgctgcatctagtttttga

SEQ ID NO: 5152 - protein, 294 aa, Sorghum bicolor
  misc_feature: Ceres ANNOT ID no. 6041905
  misc_feature (143)..(194): Pfam Id: AP2 Pfam Desc: AP2 domain
  misc_feature (1)..(294): NCBI GI: 51536200 NCBI Desc: ethylene-binding protein-like [oryza sativa (japonica cultivar-group)]
  misc_feature (121)..(284): NCBI GI: 115476860 NCBI Desc: os08g0474000 [oryza sativa (japonica cultivar-group)]
  misc_feature (134)..(201): NCBI GI: 92871591 NCBI Desc: pathogenesis-related transcriptional factor and erf [medicago truncatula]
  misc_feature (134)..(201): NCBI GI: 92871585 NCBI Desc: pathogenesis-related transcriptional factor and erf [medicago truncatula]
  misc_feature (84)..(200): NCBI GI: 129560505 NCBI Desc: wound-responsive ap2 like factor 1 [nicotiana tabacum]
  misc_feature: Abnormal phyllotaxy, leaf number higher than wild-type
  misc_feature: Bushy plant with varying petiole angles, abnormal phyllotaxy, leafnumber higher than wild-type
  misc_feature: No seed is being produced by the plant
  misc_feature: The plant flowers significantly late compared to wild-type.
  misc_feature: The plant is abnormally small.
  misc_feature: The plant produces a reduced number of seeds.
  misc_feature: The sequence is a functional homolog of SEQ ID NO 1291 in the 10/374,780US patent application
  misc_feature: The sequence is a functional homolog of SEQ ID NO 1754 in the 10/374,780US patent application
  misc_feature: Useful for biocontainment applications
  misc_feature: Useful for making plants with altered terpenoid content
  misc_feature: Useful for making plants with modulated biomass
  misc_feature: Useful for making plants with modulated flowering time
  misc_feature: Useful for making plants with modulated growth and phenotype characteristics
  misc_feature: Useful for making plants with modulated seed size
  misc_feature: Useful for making plants with modulated nitrogen use efficiency
  misc_feature: Functional homolog of the protein sequence given in SEQ ID NO 13051
  misc_feature: Functional homolog of the protein sequence given in SEQ ID NO 13481
  misc_feature: Functional homolog of the protein sequence given in SEQ ID NO 13510
  misc_feature: The sequence is a functional homolog of SEQ ID NO 1291 in the 20060162006 US patent application
  misc_feature: The sequence is a functional homolog of SEQ ID NO 1754 in the 20060162006 US patent application
  misc_feature: The sequence is a functional homolog of SEQ ID NO 14 in the 10/903,236 US patent application
  misc_feature: The sequence is a functional homolog of SEQ ID NO 1737 in the 10/374,780 US patent application
  misc_feature: The sequence is a functional homolog of SEQ ID NO 2129 in the 10/666,642 US patent application
  misc_feature: The sequence is a functional homolog of SEQ ID NO 74 in the 10/714,887 US patent application
  misc_feature: The sequence is a functional homolog of SEQ ID NO 74 in the 11/435,388 US patent application
MTKKLISAMAGKQGFKEQQFNDQRRQQASIQGDDIAKSLVGFGGGGGRLISHEQEDAIIVAALRHVVSGYSTPPPEVVTVAGGEPCGVCGIDGCLGCDFFGAAPELTQQEAVNFGTGQMVATAAAAAAGGEHGQRTRRRRKKNMYRGVRQRPWGKWAAEIRDPRRAARVWLGTFDTAEEAARAYDCAAIEFRGARAKLNFPGHEALLPFQGHGHGGDACATAAANAETQTTPMLMTPSPCSADAAAAAPGDWQLGGGVDGGEGDEVWEGLLQDLMKQDEADLWFLPFSGAASSF

SEQ ID NO: 5153 - DNA, 1851 bp, Sorghum bicolor
  misc_feature: Ceres ANNOT ID no. 6041924
  misc_feature: Encodes the peptide sequence at SEQ ID NO 5154
atgcggggtggcggcggtgcttccgggcttgcgtttcggggcgtggtggaggaggaggaagaagaggcagtggtttcggcgccggagaggccaatgcagcggcggcggcagcggcggaggtggggagaggaggtggacgacggctactcgccgagctccacgggcggcggcgggagcagctgctgcgattccttcggctgcgactcgcctttggccgggttcgtgcgcccagatggtgacccagatacagatctggagacagatgggttggccacttcctcctccagtgcctttaccgagcggcaggacgacgaagcagaggaggtgctgtgcggggtgaaggaagaggagtgggctcaggtacaagaaccggccaagaatccggcggcaggccgtgccaccgcagaatgccataaccagcggtaccggacggaggctgctgttcttttgcatggtaggaaggggtcgaagcagcggccagcctcacttgaccttggtagccctggatttcatggagccacgttttctccaagtttcgtgattggtggtgtggggttgatgaacaaaggacttggagcatcactcatcaggtcagacgtgtttcatagtcctgggacgccgaactatccacgacaccgtgcatcagtgttggggtgccagaaagggtggagctctgagagagttccacatccttctaaaggaagtaggagatatccaggcagcagtatggcatttccctacagcaatgggaggacattgccctcgaaatgggaggatgcagagaggtggatcttcagtcccaattccagtgacgcgcttggaagaactacggttgctcatgctcggcgaccaaagtctaaaagtggtcccctggggcctccaggaagacttggtggacagtattcatctgtttcttcagtgtcattgcttgatagtgggagagctggacctattacagcaaattcacctttcatggcaggagtactaatgcccgaacatgtttgtggaggaaaaaatacaaatggaacctattcaggtagaccaattggtgacgaaatcagcattggaagaggagtcaaaatttgtccactgaatggtggatctcatcccattcgaacttccagagttcgccagcgattagattatgcactcgaatcatctgcttcattgcctagcacgcgagaatctatccaagacgagcaggttgaaattactgaagattcagcttctactattgcttctataatttctaggaaagatgctgcaacccagaccagcccagagctaagtaggtcctcttcgcccaacactagaccaacatttaatcgttccctgtcgacagaacaagtgaaagagagcgggagctgtttctcagatcttgatatcagggatgttcagatggatgaccgagtgactttgactaggtggtcaaagaaaaatgtaacacggtcgtctaacaagaattcaacaaacataatagaatggaaggaaaagacagtggagtcaaattcttcatcctggggctttgcggaagcgaagtgcatatctaagattgatagagaggacacaaaaattactgcatgggagaatattcaaaaagcaaaagctgaggcagcaattcagaagttagtgattaagctcgagaagaaaagatcatcttccctggataagattttgaacaccctcaagtctgctcaaagaaaagcccaggtgatgcgtgagcgtgagcgtgatgcagtaacagcaaaccaagatggaaaaggctctaggaaggcaaaaaagagagtgcagcttagcaagaatggtcaaatcagttcactgagtggctgcttcacttgccatgctttctga

SEQ ID NO: 5154 - protein, 616 aa, Sorghum bicolor
  misc_feature: Ceres ANNOT ID no. 6041924
  misc_feature (495)..(609): Pfam Id: Remorin_C Pfam Desc: Remorin, C-terminal region
  misc_feature (4)..(616): NCBI GI: 51536297 NCBI Desc: remorin protein-like [oryza sativa (japonica cultivar-group)]
  misc_feature (187)..(615): NCBI GI: 46805746 NCBI Desc: remorin protein-like [oryza sativa (japonica cultivar-group)]
  misc_feature (189)..(361): NCBI GI: 42571771 NCBI Desc: remorin family protein [arabidopsis thaliana]
  misc_feature (356)..(616): NCBI GI: 83853834 NCBI Desc: remorin [glycine max]
  misc_feature (398)..(614): NCBI GI: 92884019 NCBI Desc: remorin, c-terminal region [medicago truncatula]
  misc_feature: The sequence is a functional homolog of SEQ ID NO 104 in the 10/666,642US patent application
  misc_feature: The sequence is a functional homolog of SEQ ID NO 1040 in the 10/666,642US patent application
  misc_feature: The sequence is a functional homolog of SEQ ID NO 1041 in the 10/666,642US patent application
  misc_feature: The sequence is a functional homolog of SEQ ID NO 1042 in the 10/666,642US patent application
  misc_feature: The sequence is a functional homolog of SEQ ID NO 933 in the 11/479,226US patent application
  misc_feature: Useful for making plants with modulated growth and phenotype characteristics
  misc_feature: The sequence is a functional homolog of SEQ ID NO 933 in the 20070022495 US patent application
  misc_feature: The sequence is a functional homolog of SEQ ID NO 104 in the 20070033671 US patent application
  misc_feature: The sequence is a functional homolog of SEQ ID NO 1040 in the 20070033671 US patent application
  misc_feature: The sequence is a functional homolog of SEQ ID NO 1041 in the 20070033671 US patent application
  misc_feature: The sequence is a functional homolog of SEQ ID NO 1042 in the 20070033671 US patent application
MRGGGGASGLAFRGVVEEEEEEAVVSAPERPMQRRRQRRRWGEEVDDGYSPSSTGGGGSSCCDSFGCDSPLAGFVRPDGDPDTDLETDGLATSSSSAFTERQDDEAEEVLCGVKEEEWAQVQEPAKNPAAGRATAECHNQRYRTEAAVLLHGRKGSKQRPASLDLGSPGFHGATFSPSFVIGGVGLMNKGLGASLIRSDVFHSPGTPNYPRHRASVLGCQKGWSSERVPHPSKGSRRYPGSSMAFPYSNGRTLPSKWEDAERWIFSPNSSDALGRTTVAHARRPKSKSGPLGPPGRLGGQYSSVSSVSLLDSGRAGPITANSPFMAGVLMPEHVCGGKNTNGTYSGRPIGDEISIGRGVKICPLNGGSHPIRTSRVRQRLDYALESSASLPSTRESIQDEQVEITEDSASTIASIISRKDAATQTSPELSRSSSPNTRPTFNRSLSTEQVKESGSCFSDLDIRDVQMDDRVTLTRWSKKNVTRSSNKNSTNIIEWKEKTVESNSSSWGFAEAKCISKIDREDTKITAWENIQKAKAEAAIQKLVIKLEKKRSSSLDKILNTLKSAQRKAQVMRERERDAVTANQDGKGSRKAKKRVQLSKNGQISSLSGCFTCHAF

SEQ ID NO: 5155 - DNA, 981 bp, Sorghum bicolor
  misc_feature: Ceres ANNOT ID no. 6041930
  misc_feature: Encodes the peptide sequence at SEQ ID NO 5156
atggattccggcagcgcggaggtgattttcgagagccattacttccgattattcagtgacggtcatgtcgagcgtaccggcggcatggacaccgtgcccgccggcttcgacgccgacaccggcgtcacatccaaagatgtcgttatcgacgccgccacgggcgtcgccgcgaggctgtaccttccatccatccagacggtcaggacgccatcggggtccgacggcggctgcacgacgaagaagcttcccatcctcgtcgtcttccacggtgggttcttcatcctcggctcatcccgtgaccccaacttccaccgctacatgaactggcttgtcgcgagcgcccgcgtcgtcgctgtctccgtcgactaccgcctcgcgcctgagcacccgctccctgctgcctacgacgactcctgggccgcgctcaactgggcggtgtccggcgcggcggatccttggctgtccgaccacggcgacctcggccgggtattcgtggccggtgccagcgccggcgcgaacatcgcccacaacgtggccgtcgccgccgcgggcatgaacggcctgcaagctgcaccgcgcatagaaggcgtgatcctactccacccttcgttctgcggcgagcagaggatggaagacgaagcagaagagttcttggaagctaacaagaagaggtgggcggtcatcttccccggcgcgagcaatggatctgacgaccccaggattaatccgatggcggccagtgttggcgcgccgggcctggcgagattggcaggcaagaagctgtttgtctccacggcgtcggaggatgccagggcgccaaggggccgagcgtactgcgacgccgtgaggaccggcggttggaccgggaagctgcagtggttcgaatcagaaggtaagggacactgcttcttcgtccatgattacggtagccacgaggcggtcgcgctgatggatcaagtggtggctttcattgctggctag

SEQ ID NO: 5156 - protein, 326 aa, Sorghum bicolor
  misc_feature: Ceres ANNOT ID no. 6041930
  misc_feature (85)..(305): Pfam Id: Abhydrolase_3 Pfam Desc: alpha/beta hydrolase fold
  misc_feature (17)..(324): NCBI GI: 115476870 NCBI Desc: os08g0474800 [oryza sativa (japonica cultivar-group)]
  misc_feature (17)..(325): NCBI GI: 38344841 NCBI Desc: osjnba0064h22.22 [oryza sativa (japonica cultivar-group)]
  misc_feature (17)..(325): NCBI GI: 116310075 NCBI Desc: h0818e04.13 [oryza sativa (indica cultivar-group)]
  misc_feature (7)..(324): NCBI GI: 115476872 NCBI Desc: os08g0475000 [oryza sativa (japonica cultivar-group)]
  misc_feature (1)..(324): NCBI GI: 92875385 NCBI Desc: esterase/lipase/thioesterase [medicago truncatula]
MDSGSAEVIFESHYFRLFSDGHVERTGGMDTVPAGFDADTGVTSKDVVIDAATGVAARLYLPSIQTVRTPSGSDGGCTTKKLPILVVFHGGFFILGSSRDPNFHRYMNWLVASARVVAVSVDYRLAPEHPLPAAYDDSWAALNWAVSGAADPWLSDHGDLGRVFVAGASAGANIAHNVAVAAAGMNGLQAAPRIEGVILLHPSFCGEQRMEDEAEEFLEANKKRWAVIFPGASNGSDDPRINPMAASVGAPGLARLAGKKLFVSTASEDARAPRGRAYCDAVRTGGWTGKLQWFESEGKGHCFFVHDYGSHEAVALMDQVVAFIAG

SEQ ID NO: 5157 - DNA, 975 bp, Sorghum bicolor
  misc_feature: Ceres ANNOT ID no. 6041931
  misc_feature: Encodes the peptide sequence at SEQ ID NO 5158
atggattccagttccagctccagcagcagagtggtcgccttcgattgcagctccttccgactatacatggacggccacgtcgagcgcgctgccaatcgcatggaaaccgtgtccgccggcttcgacgcggacacgggcgtggtctccaaagaggtcgtcatcgacgccgccaccggcgccaccgtgcggctctacctaccgcctgctgtccagggaggagccaccacgacgaagctcccgatcgtcgtcttcttccacggcggctacttcatcgtcggctcaactagcgaaccgatgtaccatcgctacgtcaactcgctggtcgccagagcacgcgtcgtcgctgtctccgtcgactaccgcctcgcgccggagcacccgctcccggcagcctacgacgactcctgggccgcgctcaggtggtcggtctccgccggcgcggacccgtggctgtccgaccacggcgacctcggccgtgtcttcctggtcggagtcagcgccggcggtaacatcgtccacaacatggccgtctccgtgggcgtgaacggcttgttgccagccgccgaaccgccgcgcatagaaggcgtgatcctactccacccttccttttccagcgagcacaagatggaggcagaagaaggggggttctggcgagctaacaataacaggtgggcggtcatcttccccggcgcgatcggcggcgcggacgatccgaggattaacccgatggcggccggcgcgccgagcctagcgaagctggtgggtgagaggctgctcgtctgcacggcgtctttggacccgagggcgccgagggggccggcatactgccaggccgtgcgggccagcgggtggcgcgggaaggtggagtggttcgagacagaaggtgaggaccatggtttcttcgtccacaaccccggcaaccacaaggcggttgaggttatggatcgagtggttgctttcctcgaggaccagtga

SEQ ID NO: 5158 - protein, 324 aa, Sorghum bicolor
  misc_feature: Ceres ANNOT ID no. 6041931
  misc_feature (82)..(302): Pfam Id: Abhydrolase_3 Pfam Desc: alpha/beta hydrolase fold
  misc_feature (21)..(321): NCBI GI: 38344841 NCBI Desc: osjnba0064h22.22 [oryza sativa (japonica cultivar-group)]
  misc_feature (21)..(321): NCBI GI: 116310075 NCBI Desc: h0818e04.13 [oryza sativa (indica cultivar-group)]
  misc_feature (21)..(323): NCBI GI: 115476870 NCBI Desc: os08g0474800 [oryza sativa (japonica cultivar-group)]
  misc_feature (12)..(322): NCBI GI: 115476872 NCBI Desc: os08g0475000 [oryza sativa (japonica cultivar-group)]
  misc_feature (3)..(321): NCBI GI: 82697951 NCBI Desc: cxe carboxylesterase [malus pumila]
MDSSSSSSSRVVAFDCSSFRLYMDGHVERAANRMETVSAGFDADTGVVSKEVVIDAATGATVRLYLPPAVQGGATTTKLPIVVFFHGGYFIVGSTSEPMYHRYVNSLVARARVVAVSVDYRLAPEHPLPAAYDDSWAALRWSVSAGADPWLSDHGDLGRVFLVGVSAGGNIVHNMAVSVGVNGLLPAAEPPRIEGVILLHPSFSSEHKMEAEEGGFWRANNNRWAVIFPGAIGGADDPRINPMAAGAPSLAKLVGERLLVCTASLDPRAPRGPAYCQAVRASGWRGKVEWFETEGEDHGFFVHNPGNHKAVEVMDRVVAFLEDQ

SEQ ID NO: 5159 - DNA, 786 bp, Sorghum bicolor
  misc_feature: Ceres ANNOT ID no. 6041934
  misc_feature: Encodes the peptide sequence at SEQ ID NO 5160
atggagtttgacctgctcaattacagcccggaagcgcagcttgagctgatgaacacgatgctccagctggagcagctcactgcgctggacgcccatcagtcgtcgccgatggcacctgtctcgccgccgatatccccggtgcaaacccatgcaggtcatcacaacagcttctcaccgcctccgccacacatgtcgacgatcacgaccaccaccgccgggtacccagcagagcagtaccacacaccgccggcggccgccctgtacgcggccgctaccggcggcagcctcgatcacctccaggactgctacgtgctgtcgtcgtccccgggccccgacaacaacaacaacaacaacggcggcgccgcggccgcggccgcgctgcagcaggccatggggtcgtcgtcgccgacgtcggcggacgcgatgcgggaggccatcttccacatcgccgcgctgcagccggtggagatcgacccggaggcggtgcgtccccctaagcgccggaacgtgcgcatctccaaagacccgcagagcgtggcggcgcggctgcggcgggagcgcatcagcgagcgcatccgcaccctgcagcgcctcgtgccggggggcaccaagatggacacggcgtccatgctggacgaggccatccactacgtcaagttcctcaagtcccaggtgcagtccctggagcgcgccgccgccgccacccaccgcgccgccgcgctcggcgccgcctacccggccttccacgcgccgtggcagtacgcgctgccccacggcgacatgtga

SEQ ID NO: 5160 - protein, 261 aa, Sorghum bicolor
  misc_feature: Ceres ANNOT ID no. 6041934
  misc_feature (175)..(222): Pfam Id: HLH Pfam Desc: Helix-loop-helix DNA-binding domain
  misc_feature (73)..(252): NCBI GI: 51536285 NCBI Desc: basic helix-loop-helix (bhlh)-like protein [oryza sativa (japonica cultivar-group)]
  misc_feature (138)..(233): NCBI GI: 92897159 NCBI Desc: helix-loop-helix dna-binding [medicago truncatula]
  misc_feature (42)..(244): NCBI GI: 83853819 NCBI Desc: bhelix-loop-helix transcription factor [glycine max]
  misc_feature (132)..(257): NCBI GI: 83853832 NCBI Desc: bhelix-loop-helix transcription factor [glycine max]
  misc_feature (141)..(229): NCBI GI: 140071559 NCBI Desc: helix-loop-helix dna-binding [medicago truncatula]
  misc_feature: The sequence is a functional homolog of SEQ ID NO 12 in the 10/225,066US patent application
  misc_feature: The sequence is a functional homolog of SEQ ID NO 120 in the 10/225,066US patent application
  misc_feature: The sequence is a functional homolog of SEQ ID NO 1208 in the 10/666,642US patent application
  misc_feature: The sequence is a functional homolog of SEQ ID NO 16 in the 10/412,699US patent application
  misc_feature: The sequence is a functional homolog of SEQ ID NO 1658 in the 10/374,780US patent application
  misc_feature: The sequence is a functional homolog of SEQ ID NO 1679 in the 10/412,699US patent application
  misc_feature: The sequence is a functional homolog of SEQ ID NO 1889 in the 11/479,226US patent application
  misc_feature: The sequence is a functional homolog of SEQ ID NO 1937 in the 10/374,780US patent application
  misc_feature: The sequence is a functional homolog of SEQ ID NO 1938 in the 10/374,780US patent application
  misc_feature: The sequence is a functional homolog of SEQ ID NO 1939 in the 10/374,780US patent application
  misc_feature: The sequence is a functional homolog of SEQ ID NO 218 in the 10/374,780US patent application
  misc_feature: The sequence is a functional homolog of SEQ ID NO 2676 in the 10/374,780US patent application
  misc_feature: Useful for biocontainment applications
  misc_feature: Useful for making plants with modulated growth and phenotype characteristics
  misc_feature: The sequence is a functional homolog of SEQ ID NO 16 in the 20040045049 US patent application
  misc_feature: The sequence is a functional homolog of SEQ ID NO 1679 in the 20040045049 US patent application
  misc_feature: The sequence is a functional homolog of SEQ ID NO 12 in the 20050160493 US patent application
  misc_feature: The sequence is a functional homolog of SEQ ID NO 120 in the 20050160493 US patent application
  misc_feature: The sequence is a functional homolog of SEQ ID NO 1937 in the 20060162006 US patent application
  misc_feature: The sequence is a functional homolog of SEQ ID NO 1938 in the 20060162006 US patent application
  misc_feature: The sequence is a functional homolog of SEQ ID NO 1939 in the 20060162006 US patent application
  misc_feature: The sequence is a functional homolog of SEQ ID NO 1208 in the 20070033671 US patent application
  misc_feature: GREAT-hit functional homolog of the protein sequence given in SEQ ID NO 13582
  misc_feature: Useful for biocontainment applications
  misc_feature: Functional homolog of the protein sequence given in SEQ ID NO 13582
  misc_feature: The sequence is a functional homolog of SEQ ID NO 1938 in the 10/374,780 US patent application
MEFDLLNYSPEAQLELMNTMLQLEQLTALDAHQSSPMAPVSPPISPVQTHAGHHNSFSPPPPHMSTITTTTAGYPAEQYHTPPAAALYAAATGGSLDHLQDCYVLSSSPGPDNNNNNNGGAAAAAALQQAMGSSSPTSADAMREAIFHIAALQPVEIDPEAVRPPKRRNVRISKDPQSVAARLRRERISERIRTLQRLVPGGTKMDTASMLDEAIHYVKFLKSQVQSLERAAAATHRAAALGAAYPAFHAPWQYALPHGDM

SEQ ID NO: 5161 - DNA, 1062 bp, Sorghum bicolor
  misc_feature: Ceres ANNOT ID no. 6041946
  misc_feature: Encodes the peptide sequence at SEQ ID NO 5162
atggcgccgcgccagccgctgctccccagcttcctctacgcggcgtcgtcgcccggcggcagggatgcgcggcctccggtggtggtggcgagggcgccgagcgagccgccgttcggcaagatcgagatgttctcgcccgcctactacgcggcgggcgccatcggcggggccgcggcctgcgggttcacgcacgccgccgtcacgccgctcgacgtcatcaagtgcaacatccagatcgaccctgccaagtacaagagcacctcgtcggcgttcggcgtggtgatgagggagcagggcctccggggcttcttcagggggtgggcgccgacgttcgtgggctacagcgcgcagggcgcgttcaagtacggcctctacgagttcttcaagaagaagtacgccgacatggccggacccgagtacgccgccaagtacaagaccgtcatctacctcgcgggatcggccaccgccgaggtcttcgccgacgtcgcgctctgccccatggaggccgtcaaggtccgggtgcagacgcagcctgggttcgccagggggctcagcgatggattccccaagatcgtcagggccgaaggctacgcagggctattcagaggactggttcctctttgggggcgacagattccctacaccatgatgaagttcgcgacatacgagaacatcgtggaggtgacctacaagcacctcatcccgacgccaaaggatgagtgtagcaaacctctccagctcggagtcagcttcgggagcggctacgtcgccggagtcttctgcgccgccgtttcgcaccctgcagacaacttggtttccttcctcaacaactccaagggagccaccgttggagatgctgtcaagaaccttggcttgttgggccttttcacccgcggccttcctcttcgcattctgatggtcggtaccctgactggagctcagtgggtgatctatgattccttcaaagttatgattggactgtttgaagcactgccccctagaaatgcaaggagcaacagagttactgagcacaacactgggagcacaacagaattaaactaa

SEQ ID NO: 5162 - protein, 353 aa, Sorghum bicolor
  misc_feature: Ceres ANNOT ID no. 6041946
  misc_feature (48)..(136): Pfam Id: Mito_carr Pfam Desc: Mitochondrial carrier protein
  misc_feature (145)..(233): Pfam Id: Mito_carr Pfam Desc: Mitochondrial carrier protein
  misc_feature (246)..(329): Pfam Id: Mito_carr Pfam Desc: Mitochondrial carrier protein
  misc_feature (4)..(327): NCBI GI: 38344833 NCBI Desc: osjnba0064h22.14 [oryza sativa (japonica cultivar-group)]
  misc_feature (4)..(327): NCBI GI: 116310067 NCBI Desc: h0818e04.5 [oryza sativa (indica cultivar-group)]
  misc_feature (16)..(327): NCBI GI: 23505897 NCBI Desc: at5g14040/mua22_4 [arabidopsis thaliana]
  misc_feature (4)..(327): NCBI GI: 3318613 NCBI Desc: mitochondrial phosphate transporter [zea mays]
  misc_feature (18)..(327): NCBI GI: 3318611 NCBI Desc: mitochondrial phosphate transporter [glycine max]
  misc_feature: The sequence is a functional homolog of SEQ ID NO. 398 in the 11/188,298 US application
  misc_feature: The sequence is a functional homolog of SEQ ID NO. 517 in the 11/188,298 US application
  misc_feature: The sequence is a functional homolog of SEQ ID NO. 385 in the 11/188,298 US application
MAPRQPLLPSFLYAASSPGGRDARPPVVVARAPSEPPFGKIEMFSPAYYAAGAIGGAAACGFTHAAVTPLDVIKCNIQIDPAKYKSTSSAFGVVMREQGLRGFFRGWAPTFVGYSAQGAFKYGLYEFFKKKYADMAGPEYAAKYKTVIYLAGSATAEVFADVALCPMEAVKVRVQTQPGFARGLSDGFPKIVRAEGYAGLFRGLVPLWGRQIPYTMMKFATYENIVEVTYKHLIPTPKDECSKPLQLGVSFGSGYVAGVFCAAVSHPADNLVSFLNNSKGATVGDAVKNLGLLGLFTRGLPLRILMVGTLTGAQWVIYDSFKVMIGLFEALPPRNARSNRVTEHNTGSTTELN

SEQ ID NO: 5163 - DNA, 1269 bp, Sorghum bicolor
  misc_feature: Ceres ANNOT ID no. 6041947
  misc_feature: Encodes the peptide sequence at SEQ ID NO 5164
atggaatgggacggcgaggtcggcatgaactccgtcccggacggcgtcgtgcagcacatcctgtcgatgctcagcaacgcccgcgacgtggccgcctgcgcctgcgtctgccgccgctggcgcgactgcgtcccctacctacccgcgctcttcttccagcggaacgccttcgacgcggccaggggcgccgcggacgacgtcatcggccggatggtggcctccgtcgcgcgcctcagggagctggtcatctactgccccttctccatggcgcgcctcccggcctggctcgccgcgcggagcgccacgctccgggtgctcgagctgcggatggacgccgccgccgacaaggtcgcggaaggtgggcacctcgactgcatcggcctggctgcgagcctggaggagctcaggctctggggagtgtctctcattgccgcgcccgcgtggggccggatggagcggctccgcgtgctggaggttgtcggtgcgccgctgcgggatagcgctgtgagagacgccatcgccgcgtgccccaacctcaccgatctgtctctgctgggctgcgactgctccggcacggtggctatcgaccttcaactgctccagcggtgccggctcgacatcgtcggcgccggcaactgctcgctcttgctcaccgcgcctcgcgtggagtccctcgagatccagggcttcagctggatcactctgcgtggtggccacagcctccgccgcctctcaattgccaagagcagcgggagggttcacaaggtggatactgggaatctcccagatctggatcacctctctctgcgcggtgttcagtggaactgggccgcagtgagctcggtgctgcagtgcgctagcgaagtgaagcatctagtgatgaagatagagttctgtggggacttggacgcactccagccgttcccggaagtcgatttggttgacttcttcgacagccacccgaagctccgcaaatttgagatccatggtgccatgttcgctgccctgtgtcagaaaaatagcctgaaaaatttgaattccaggttcatcatcccttgtttggaagaggttctgatcactgtacgctccccgctcaatgctgaacagaagctgaacactctcgagtcgcttgtgaagtacagtgtgaggctgcggacgatggtcatcagaatctcacagatgaagaattgccatgaagctgctgatgagttctttgaggagatatgtaagttcaagtacatgaactacaggaaagtgcgaattgaataa

SEQ ID NO: 5164 - protein, 422 aa, Sorghum bicolor
  misc_feature: Ceres ANNOT ID no. 6041947
  misc_feature (5)..(422): NCBI GI: 51535955 NCBI Desc: f-box protein-like [oryza sativa (japonica cultivar-group)]
  misc_feature (9)..(422): NCBI GI: 124360281 NCBI Desc: cyclin-like f-box [medicago truncatula]
  misc_feature (9)..(422): NCBI GI: 53850513 NCBI Desc: at1g10780 [arabidopsis thaliana]
  misc_feature (9)..(415): NCBI GI: 6573744 NCBI Desc: f20b24.20 [arabidopsis thaliana]
  misc_feature (111)..(422): NCBI GI: 42407412 NCBI Desc: f-box protein family-like [oryza sativa (japonica cultivar-group)]
MEWDGEVGMNSVPDGVVQHILSMLSNARDVAACACVCRRWRDCVPYLPALFFQRNAFDAARGAADDVIGRMVASVARLRELVIYCPFSMARLPAWLAARSATLRVLELRMDAAADKVAEGGHLDCIGLAASLEELRLWGVSLIAAPAWGRMERLRVLEVVGAPLRDSAVRDAIAACPNLTDLSLLGCDCSGTVAIDLQLLQRCRLDIVGAGNCSLLLTAPRVESLEIQGFSWITLRGGHSLRRLSIAKSSGRVHKVDTGNLPDLDHLSLRGVQWNWAAVSSVLQCASEVKHLVMKIEFCGDLDALQPFPEVDLVDFFDSHPKLRKFEIHGAMFAALCQKNSLKNLNSRFIIPCLEEVLITVRSPLNAEQKLNTLESLVKYSVRLRTMVIRISQMKNCHEAADEFFEEICKFKYMNYRKVRIE

SEQ ID NO: 5165 - DNA, 1410 bp, Sorghum bicolor
  misc_feature: Ceres ANNOT ID no. 6041954
  misc_feature: Encodes the peptide sequence at SEQ ID NO 5166
atgaatctggccgcctttccctccagctccaccaccaccaccacccttgccacgcccgcgacgctcccatggcatgagatgccattaataaattcctccgccactacctcgtcattgctgctccgccgctcgctctgcgcgtcgctccggaggatctcccacatggcctcctacgccgcctcccccacctccgcgcccgccgccaccgcctccaccgagaacggcgccgcgaaggcgacggagcagcggcccgtgcaggtcgcaaagcggttggaaaagttcaagacaacaattttcactcagatgagcatgcttgccatcaagcatggagcaataaaccttggccagggctttccaaattttgatggcccagactttgtgaaagaagctgcaattcaagctatcaatgctgggaagaatcagtatgcaagagggtttggtgtgcctgaactgaactcggctattgctgaaaggttcctgaaggacagtggattgcaagttgaccctgacaaagaagttactgttacatctggatgcactgaagcaatagcttcaacaatactaggtctgattaatcctggcgatgaggtgatattgtttgctccattctacgattcatatgaggccacactgtcgatggccggtgccaatgtaaaggccattaccctccgtgctccagatttcgcagtcccgcttgaagagctggaggcggcagtctccaagaacaccaaagcgataatgataaacacaccgcataatccaactgggaaaatgttcactagagaggagcttgaatttattgccaccctctgcaaggaaaatgatgttttgctgttctctgatgaggtctatgacaaattgtcgtttgaggctgatcacatatcaatggcttctatccctggcatgtatgagaggactgtgaccatgaactctctggggaagacattctctcttacaggatggaagattgggtgggcaatcgcaccgccacacctgacatggggtcttaggcaagcacactcattcctgacatttgccacctgcacaccaatgcaagcagcagcggcagcagctctgagagcaccagatagctactatgaggaactgaagagggactacagtgcaaagaaggctatactgttagaaggactagaagctgcagggtttattgtttacccatcgagtggaacatacttcatcatggtggaccacaccccattcggtttcgacaatgacatagagttctgcgagtacttgattcgtgaagtcggcgtggccgctataccaccgagcgtattttatctcaaccctgaggaggggaagaacctggtgaggtttaccttctgcaaggatgaagatacgctgcgtggcgcggtcgagaggatgaagacgaggctcaggaagaaatga

SEQ ID NO: 5166 - protein, 469 aa, Sorghum bicolor
  misc_feature: Ceres ANNOT ID no. 6041954
  misc_feature (109)..(462): Pfam Id: Aminotran_1_2 Pfam Desc: Aminotransferase class I and II
  misc_feature (83)..(466): NCBI GI: 108757334 NCBI Desc: aminotransferase, classes i and ii [myxococcus xanthus dk 1622]
  misc_feature (88)..(466): NCBI GI: 115378438 NCBI Desc: transaminase [stigmatella aurantiaca dw4/3-1]
  misc_feature (88)..(462): NCBI GI: 118046876 NCBI Desc: aminotransferase, class i and ii [chloroflexus aggregans dsm 9485]
  misc_feature (88)..(462): NCBI GI: 76261206 NCBI Desc: aminotransferase, class i and ii [chloroflexus aurantiacus j-10-fl]
  misc_feature (88)..(463): NCBI GI: 113940906 NCBI Desc: aminotransferase, class i and ii [herpetosiphon aurantiacus atcc 23779]
  misc_feature: Useful for making plants with modulated nitrogen use efficiency
  misc_feature: GREAT-hit functional homolog of the protein sequence encoded by LOCUS at1g77670
  misc_feature: Useful for making plants with modulated nitrogen use efficiency
  misc_feature: Functional homolog of the protein sequence given in SEQ ID NO 13905
  misc_feature: The sequence is a functional homolog of SEQ ID NO. 526 in the 11/188,298 US application
  misc_feature: The sequence is a functional homolog of SEQ ID NO. 286 in the 11/188,298 US application
  misc_feature: The sequence is a functional homolog of SEQ ID NO. 527 in the 11/188,298 US application
MNLAAFPSSSTTTTTLATPATLPWHEMPLINSSATTSSLLLRRSLCASLRRISHMASYAASPTSAPAATASTENGAAKATEQRPVQVAKRLEKFKTTIFTQMSMLAIKHGAINLGQGFPNFDGPDFVKEAAIQAINAGKNQYARGFGVPELNSAIAERFLKDSGLQVDPDKEVTVTSGCTEAIASTILGLINPGDEVILFAPFYDSYEATLSMAGANVKAITLRAPDFAVPLEELEAAVSKNTKAIMINTPHNPTGKMFTREELEFIATLCKENDVLLFSDEVYDKLSFEADHISMASIPGMYERTVTMNSLGKTFSLTGWKIGWAIAPPHLTWGLRQAHSFLTFATCTPMQAAAAAALRAPDSYYEELKRDYSAKKAILLEGLEAAGFIVYPSSGTYFIMVDHTPFGFDNDIEFCEYLIREVGVAAIPPSVFYLNPEEGKNLVRFTFCKDEDTLRGAVERMKTRLRKK

SEQ ID NO: 5167 - DNA, 1224 bp, Sorghum bicolor
  misc_feature: Ceres ANNOT ID no. 6041958
  misc_feature: Encodes the peptide sequence at SEQ ID NO 5168
  misc_feature: Up-regulated in shoot tissues in response to methyl jasmonate treatment
  misc_feature: Up-regulated in root tissues in response to methyl jasmonate treatment
  misc_feature: Up-regulated in root tissues in response to salicylic acid treatment
  misc_feature: Up-regulated in shoot tissues in response to salicylic acid treatment
atggcgatccgcatcaccgtctcctactccggctacgtggcgcagaacctcgccgcgtcgctcggccaccgcttctcctccgcctccgcctccgcctctggcagccgcctcctccacgacggcgcctggcgccccttctgcatcttcacctccacccgccagcccgagcagcaccgcaacagcggcagcggcagcgaccgccatgacggaggcgaccacaaccacccgaagccccaggccatcgccgccggagctcactcgttgctgctcacgcgtgcgtgcttatcgtccaagtcgccgccgccgtctcttgccgtggggctgctctcggtgctcgcgcagaggacgggaccgacgcctggggccaccggatcggcggcttctcttgcaggctcgtctccgatttcgctcggtttcaaccctacgtccttcctcccgttcttgcagacagcgaagtggctcccgtgcagcgaccttgccacctcgtcgtcttcggcaccctcttcccctccccgctcgctggcgccttcggctccccccaggaaggcgttgattgctggtgatagtggtactgttactgctggtgcgtctggttctgccggaattgcgacgagcagtggtgctggtgcagcgatgagcaggagcaactggctgtcgagatgggtgagctcctgctccgatgacgccaagacggcgtttgcagctgtgaccgtgccacttctctacggctcgtccctggctgagcccaagtccatcccgtccaagtccatgtacccgaccttcgatatcggtgatcggatccttgccgagaaggtctcgtacatattccgggatccggaaatttcggacattgtgatcttccgggctcccccaggacttcaggcttatggttacagctcaggtgatgtgttcatcaagagagttgtggccaagggaggagactatgtcgaagtgcatgatggcaagctgttcgttaatggagtagttcaggatgaggattatgtgctggagccacacaactacgagctggaaccagtgcttgtaccggaaggttttgtgtttgtgctgggagacaaccgcaacaacagctttgattcccataactggggcccacttccagtgaggaatattgttggtagatctattctccggtattggccgccatcgaagattagtgatacaatttatgatcctgatgcaacccgattcgcggtgccgtcctga

SEQ ID NO: 5168 - protein, 407 aa, Sorghum bicolor
  misc_feature: Ceres ANNOT ID no. 6041958
  misc_feature (251)..(328): Pfam Id: Peptidase_S24 Pfam Desc: Peptidase S24-like
  misc_feature (129)..(397): NCBI GI: 51536582 NCBI Desc: at1g05140 [arabidopsis thaliana]
  misc_feature (168)..(395): NCBI GI: 144924728 NCBI Desc: peptidase s26a, signal peptidase i [medicago truncatula]
  misc_feature (258)..(395): NCBI GI: 71535009 NCBI Desc: chloroplast thylakoidal processing peptidase [medicago sativa]
  misc_feature (215)..(395): NCBI GI: 126656044 NCBI Desc: leader peptidase i [cyanothece sp. ccy0110]
  misc_feature (206)..(395): NCBI GI: 67922441 NCBI Desc: signal peptidase i [crocosphaera watsonii wh 8501]
  misc_feature: Up-regulated in shoot tissues in response to methyl jasmonate treatment
  misc_feature: Up-regulated in root tissues in response to methyl jasmonate treatment
  misc_feature: Up-regulated in root tissues in response to salicylic acid treatment
  misc_feature: Up-regulated in shoot tissues in response to salicylic acid treatment
MAIRITVSYSGYVAQNLAASLGHRFSSASASASGSRLLHDGAWRPFCIFTSTRQPEQHRNSGSGSDRHDGGDHNHPKPQAIAAGAHSLLLTRACLSSKSPPPSLAVGLLSVLAQRTGPTPGATGSAASLAGSSPISLGFNPTSFLPFLQTAKWLPCSDLATSSSSAPSSPPRSLAPSAPPRKALIAGDSGTVTAGASGSAGIATSSGAGAAMSRSNWLSRWVSSCSDDAKTAFAAVTVPLLYGSSLAEPKSIPSKSMYPTFDIGDRILAEKVSYIFRDPEISDIVIFRAPPGLQAYGYSSGDVFIKRVVAKGGDYVEVHDGKLFVNGVVQDEDYVLEPHNYELEPVLVPEGFVFVLGDNRNNSFDSHNWGPLPVRNIVGRSILRYWPPSKISDTIYDPDATRFAVPS

SEQ ID NO: 5169 - DNA, 933 bp, Sorghum bicolor
  misc_feature: Ceres ANNOT ID no. 6041960
  misc_feature: Encodes the peptide sequence at SEQ ID NO 5170
atggcctctgcggggtcatccgaggaggaggaggaggaggaggcgtgcagggagatccggggcgcgtccggcacgccgcgtcgcctgggcctcctcctggctccgcggagccccgccgagaggcagcagatcagggcggcgtaccgcgcgacgttcggcgaggacctcgccgcgacgctgcacggcaaccaggacgacgagctctgcaagctgctctacctgtggggggcgctggaaccggcggagcgggacgccgtcgtggcgcgggaggcggtcgagggcggcgtcaccgtcgccggctaccgcgccctcgtcgaggtgttcacgcgccggaagcaggaccagctcttcttcaccaagcaggcatacatggccaggttcaggaggaacctggaccaggacatcatgctgctgctggctctggcggcctcccgcaggtcgcaccacgacgacctcagccagcacgtagccaaatgcgacgcgaggaggctgcacgacaccaagaacagtggtgctggctccgtcgtcgacgaggctgtgatcctcgagatgttcagcaagaggagcatcccacagctcaggctggccttctgcagctacaagcacatatacgggcatgactataccaaggcactgaagattaatgggtctggtaaatttgaagaatctctgagagttgttgtcaagtgcatctacaacccttccaagtattactctaagttactgcagagaagtatgctatctgcagcaactgataaaaggatggtaacaagagctatcttgggcagcgatgatgtcggtatagatgagatcagatcagcgttcaagagtagttatggaaggaaccttgcagactacatccaagaaaacttgcctgagagtgattacaaagactttcttgtggctgtggcaagagggtcagtggcaccatga

SEQ ID NO: 5170 - protein, 310 aa, Sorghum bicolor
  misc_feature: Ceres ANNOT ID no. 6041960
  misc_feature (159)..(227): Pfam Id: Annexin Pfam Desc: Annexin
  misc_feature (14)..(304): NCBI GI: 3493172 NCBI Desc: fiber annexin [gossypium hirsutum]
  misc_feature (14)..(304): NCBI GI: 15214410 NCBI Desc: annexin [gossypium hirsutum]
  misc_feature (14)..(304): NCBI GI: 33357398 NCBI Desc: chain a, annexin gh1 from cotton
  misc_feature (16)..(303): NCBI GI: 6272285 NCBI Desc: annexin p33 [zea mays]
  misc_feature (14)..(308): NCBI GI: 2459926 NCBI Desc: annexin [lavatera thuringiaca]
MASAGSSEEEEEEEACREIRGASGTPRRLGLLLAPRSPAERQQIRAAYRATFGEDLAATLHGNQDDELCKLLYLWGALEPAERDAVVAREAVEGGVTVAGYRALVEVFTRRKQDQLFFTKQAYMARFRRNLDQDIMLLLALAASRRSHHDDLSQHVAKCDARRLHDTKNSGAGSVVDEAVILEMFSKRSIPQLRLAFCSYKHIYGHDYTKALKINGSGKFEESLRVVVKCIYNPSKYYSKLLQRSMLSAATDKRMVTRAILGSDDVGIDEIRSAFKSSYGRNLADYIQENLPESDYKDFLVAVARGSVAP

SEQ ID NO: 5171 - DNA, 1185 bp, Sorghum bicolor
  misc_feature: Ceres ANNOT ID no. 6041963
  misc_feature: Encodes the peptide sequence at SEQ ID NO 5172
atgaagcccaagaacggcggccccgcctcggaaaggaggatgctctcgcgccggatactgatcctctgcttcctcagcttcttcctcggcatgctcgtcacggacctgtttggtggatcggtgccgagcccggtcgtggtgcagagccggtggcacgagcgcgacagggagctgcagagcctttctgaagattttgttgcaaagccgaaaccagctgaagatagtgacattatgggggaggtgtcgaagactcatgaggctatacaatccttagaaaagtcaattgacacactacagatggagctggcagcaaagcgcagcagcaatgagcttcttggggaaagtacaggcggcataagtaagcagaggagaaaggcgtttgtagtgattggggtcaacaccgccttcagtagcaggaagcgtcgggattctgtgagggagacttggatgcctcaaggtgagaaactcaagaaactggaggacaagggaatcatcatccgatttacgataggacatagtgctacatcaaacaacgtccttgataaagctatagacgcagaggatgaaatgcatcacgactttcttaggctggatcatgttgaagggtaccacaagctatctgcaaagaccaagatattcttctccactgctgtggccttatgggatgcagatttctatgtcaaggtggacgacgatgttcacctaaacctagggatgctcatcgcaacccttggtcggcataaattgaaaccacgggtgtatattggttgtatgaagtcgggaccggtcctttctgacaagaatgcaaaataccatgagcctgagttctggaagttcggagaagacgggaacaagtactttagacatgccacagggcagctctatgccatctccaaggatcttgccacctacatctcgatcaaccagcccatattgcataaatacgcgaatgaagatgtgtctctcggcgcatggtttatcggcctagatgtggagcacatcgacgacagggacatgtgctgtggcacacctccagattgtgagtggaaagcacaagccgggaacgtttgtgttgcgtcgtttgactggcagtgtagtggggtctgcaatccagttgagaggctaaaatacgtgcactcgagatgcagcgaaggggaggatgcaatttggagtgcctcgttctga

SEQ ID NO: 5172 - protein, 394 aa, Sorghum bicolor
  misc_feature: Ceres ANNOT ID no. 6041963
  misc_feature (140)..(337): Pfam Id: Galactosyl_T Pfam Desc: Galactosyltransferase
  misc_feature (1)..(382): NCBI GI: 115446789 NCBI Desc: os02g0566800 [oryza sativa (japonica cultivar-group)]
  misc_feature (19)..(394): NCBI GI: 4138265 NCBI Desc: avr9 elicitor response protein [nicotiana tabacum]
  misc_feature (12)..(391): NCBI GI: 145362395 NCBI Desc: galactosyltransferase family protein [arabidopsis thaliana]
  misc_feature (1)..(394): NCBI GI: 21360399 NCBI Desc: at1g05170/yup8h12_22 [arabidopsis thaliana]
  misc_feature (1)..(394): NCBI GI: 145323746 NCBI Desc: galactosyltransferase family protein [arabidopsis thaliana]
  misc_feature: Useful for making plants with altered carbohydrate content
  misc_feature: Functional homolog of the protein sequence given in SEQ ID NO 13658
MKPKNGGPASERRMLSRRILILCFLSFFLGMLVTDLFGGSVPSPVVVQSRWHERDRELQSLSEDFVAKPKPAEDSDIMGEVSKTHEAIQSLEKSIDTLQMELAAKRSSNELLGESTGGISKQRRKAFVVIGVNTAFSSRKRRDSVRETWMPQGEKLKKLEDKGIIIRFTIGHSATSNNVLDKAIDAEDEMHHDFLRLDHVEGYHKLSAKTKIFFSTAVALWDADFYVKVDDDVHLNLGMLIATLGRHKLKPRVYIGCMKSGPVLSDKNAKYHEPEFWKFGEDGNKYFRHATGQLYAISKDLATYISINQPILHKYANEDVSLGAWFIGLDVEHIDDRDMCCGTPPDCEWKAQAGNVCVASFDWQCSGVCNPVERLKYVHSRCSEGEDAIWSASF

SEQ ID NO: 5173 - DNA, 1371 bp, Sorghum bicolor
  misc_feature: Ceres ANNOT ID no. 6041965
  misc_feature: Encodes the peptide sequence at SEQ ID NO 5174
atggagcaaagattggtagtgctggtgcttgcgatagcgtcgttgtactacgcttgcccggtggcatcagcagcgttcgtgggggacgacgacgtccgtgtcgcgctaaagcatgtcgacgcagggaagcagctgtccaggtccgagctgatccggcgcgccatgcagcggagcaaggcgagggcggccgcgctctccgcggtgaggaaccgcgccgccagcgcccgcttctctggcaagaacgacgatcagcgaacgacgccgccgaccggcgtgtccgtgcgcccgtcgggggacctcgagtacgtcgtcgacctcgccatcggcacgcccccgcagcccgtctcggcgctgctcgacaccggcagcgacctcatctggacgcagtgcgcgccgtgcgccagctgccttgcgcagccggacccgctgttcgcgccgggggagtcggcgtcgtacgagcccatgcggtgcgccgggcagctctgctccgacattctgcaccacggctgcgagatgccggacacgtgcacctaccgctacaactacggcgacggcacgatgaccatgggcgtctacgccacggagcgcttcaccttcacgtcgtcgggcggcgataggctcatgaccgtcccgctcggtttcggctgcggctccatgaacgtcggcagcctgaacaacggctccggcatcgtgggcttcggccggaacccgctctcgctggtgtcgcagctctccatccgccgcttctcctactgcctcacgtcctacggcagcggcaggaagagcaccctcctgttcgggtccctgtccggtggagtctacggcgacgccaccggccccgtgcagaccacgccgctcctccagagcctccagaacccgaccttctactacgtccacctcgcgggcctgacagtcggcgccagacggctgcggataccggagtcggcgttcgcgctccggcccgatggatcgggcggcgtgatcgtcgactccggcaccgcgctcacgctgctaccgggcgcggtgctcgcggaggtggtgcgggcgttccgccagcagctgaggctcccgttcgcgaacggcggcaaccccgaagacggcgtgtgcttcctggtgccagcggcctggcggcgctcgtcgtcgacgtcacaggtgccggtcccaaggatggtgttccatttccaggacgcggacctcgacctgccgcggcgaaactacgtcctggacgaccacaggaagggccgcctgtgcctcctcctggcggactccggcgatgatggctcgacgattggcaacctggtgcagcaggacatgcgcgtgctctacgatttggaggcagagaccttgtcgttcgctccggcacaatgctga

SEQ ID NO: 5174 - protein, 456 aa, Sorghum bicolor
  misc_feature: Ceres ANNOT ID no. 6041965
  misc_feature (101)..(454): Pfam Id: Asp Pfam Desc: Eukaryotic aspartyl protease
  misc_feature (1)..(456): NCBI GI: 115458644 NCBI Desc: os04g0448300 [oryza sativa (japonica cultivar-group)]
  misc_feature (32)..(456): NCBI GI: 38344829 NCBI Desc: osjnba0064h22.10 [oryza sativa (japonica cultivar-group)]
  misc_feature (32)..(456): NCBI GI: 116310063 NCBI Desc: h0818e04.1 [oryza sativa (indica cultivar-group)]
  misc_feature (33)..(456): NCBI GI: 61214233 NCBI Desc: aspartic proteinase nepenthesin-1 precursor (nepenthesin-i)
  misc_feature (32)..(456): NCBI GI: 61214232 NCBI Desc: aspartic proteinase nepenthesin-2 precursor (nepenthesin-ii)
MEQRLVVLVLAIASLYYACPVASAAFVGDDDVRVALKHVDAGKQLSRSELIRRAMQRSKARAAALSAVRNRAASARFSGKNDDQRTTPPTGVSVRPSGDLEYVVDLAIGTPPQPVSALLDTGSDLIWTQCAPCASCLAQPDPLFAPGESASYEPMRCAGQLCSDILHHGCEMPDTCTYRYNYGDGTMTMGVYATERFTFTSSGGDRLMTVPLGFGCGSMNVGSLNNGSGIVGFGRNPLSLVSQLSIRRFSYCLTSYGSGRKSTLLFGSLSGGVYGDATGPVQTTPLLQSLQNPTFYYVHLAGLTVGARRLRIPESAFALRPDGSGGVIVDSGTALTLLPGAVLAEVVRAFRQQLRLPFANGGNPEDGVCFLVPAAWRRSSSTSQVPVPRMVFHFQDADLDLPRRNYVLDDHRKGRLCLLLADSGDDGSTIGNLVQQDMRVLYDLEAETLSFAPAQC

SEQ ID NO: 5175 - DNA, 720 bp, Sorghum bicolor
  misc_feature: Ceres ANNOT ID no. 6041969
  misc_feature: Encodes the peptide sequence at SEQ ID NO 5176
atgaccaagtatacgaggaacaaaaaatgttcatctcatcaacttagatcatcacatcactggaaaccccacagtagttccagattcaaaaaagtttccagcaaggagataccatttgcagctatagagaaatgtgcatggacagatgcaacttgtccagtttgcatggaatttccacacaacgctgttcttctactttgttcatcacatggcaatggctgtcgtccatatatttgtgcttccggctaccagcactcaaattgtcttaatcagcttgtagagtcatgcagaaaagtagcctccgaggacctagatgcaatagagcttgcgtgtcccctttgccgtggtgaggtcaagggatataccttggttgagcctgctcggaagaagctgaatcacaagaggaggagctgcatggaagatggctgttcatacatgggcacatacagagagctctgcaagcatgtccaaaagaagcacccttctgcaaacccacgagctgtggaccccttacatgcttacagatggaagcggcttctatttcgaagttcattgcaagatatgatttgttcaactacttcagaggttatgcgaaggttattttctctcatccttcagtttgacgagattatggctgcttcgcgagagggtggtgatcgtcatggtgctaccaatgataatttgctgccaagcgctaatgcagaatccactgatccatga

SEQ ID NO: 5176 - protein, 239 aa, Sorghum bicolor
  misc_feature: Ceres ANNOT ID no. 6041969
  misc_feature (101)..(196): NCBI GI: 82568695 NCBI Desc: pm27 [prunus mume]
  misc_feature (1)..(108): NCBI GI: 92895183 NCBI Desc: traf-like [medicago truncatula]
  misc_feature (94)..(218): NCBI GI: 38346521 NCBI Desc: osjnba0027h09.16 [oryza sativa (japonica cultivar-group)]
  misc_feature (94)..(218): NCBI GI: 116317899 NCBI Desc: osigba0131j24.4 [oryza sativa (indica cultivar-group)]
  misc_feature (93)..(196): NCBI GI: 115444251 NCBI Desc: os02g0150900 [oryza sativa (japonica cultivar-group)]
  misc_feature: The sequence is a functional homolog of SEQ ID NO 10 in the 10/225,066US patent application
  misc_feature: The sequence is a functional homolog of SEQ ID NO 104 in the 10/225,066US patent application
  misc_feature: The sequence is a functional homolog of SEQ ID NO 1042 in the 10/225,066US patent application
  misc_feature: The sequence is a functional homolog of SEQ ID NO 136 in the 11/375,241US patent application
  misc_feature: The sequence is a functional homolog of SEQ ID NO 187 in the 11/479,226US patent application
  misc_feature: The sequence is a functional homolog of SEQ ID NO 1873 in the 11/479,226US patent application
  misc_feature: The sequence is a functional homolog of SEQ ID NO 2228 in the 10/374,780US patent application
  misc_feature: The sequence is a functional homolog of SEQ ID NO 2650 in the 10/374,780US patent application
  misc_feature: The sequence is a functional homolog of SEQ ID NO 304 in the 10/374,780US patent application
  misc_feature: The sequence is a functional homolog of SEQ ID NO 838 in the 10/225,066US patent application
  misc_feature: Useful for making plants with modulated growth and phenotype characteristics
  misc_feature: The sequence is a functional homolog of SEQ ID NO 10 in the 20050160493 US patent application
  misc_feature: The sequence is a functional homolog of SEQ ID NO 104 in the 20050160493 US patent application
  misc_feature: The sequence is a functional homolog of SEQ ID NO 1042 in the 20050160493 US patent application
  misc_feature: Useful for making plants with modulated heat sensitivity
  misc_feature: Functional homolog of the protein sequence given in SEQ ID NO 13904
MTKYTRNKKCSSHQLRSSHHWKPHSSSRFKKVSSKEIPFAAIEKCAWTDATCPVCMEFPHNAVLLLCSSHGNGCRPYICASGYQHSNCLNQLVESCRKVASEDLDAIELACPLCRGEVKGYTLVEPARKKLNHKRRSCMEDGCSYMGTYRELCKHVQKKHPSANPRAVDPLHAYRWKRLLFRSSLQDMICSTTSEVMRRLFSLILQFDEIMAASREGGDRHGATNDNLLPSANAESTDP

SEQ ID NO: 5177 - DNA, 1320 bp, Sorghum bicolor
  misc_feature: Ceres ANNOT ID no. 6041970
  misc_feature: Encodes the peptide sequence at SEQ ID NO 5178
  misc_feature: Up-regulated in shoot tissues in response to salicylic acid treatment
atgcgttccgccgtcgtcgcggcgctcctcctagtggcagcggtcgcctccccggccgccgcactctactccgccggctcccccgtcctccagctcaaccccaacaacttcaaatcgaaggtgctgaactcgaacggcgtggtgctggttgagttcttcgcgccgtggtgcgggcactgcaagcagctggcgcccgcctgggagaaggctgccggcgtgctcaagggcgtcgccacggtcgcagcgctagatgccgatgcgcaccaggcgctcgcgcaggaatatggaatcaggggatttcccactattaaggtgttttcccctggtaaacctccagtcgattatcaaggagcaagagatgtaaagccaatcgtagagtttgctctgtcacaggttaagtcccttcttagagaaaggttgagtggtaaggcatcagcagggtcaaatggcaagacatctggaggttcaagtgagaaaagtgaaccaagtgcatcagtagaattaaattcacgtaacttcgatgaactcgttgtcaaaagcaaggacctttggattgtggaattctttgcgccatggtgtgggcactgcaagaaattggcacctgaatggaaaaaggctgcaaagaacttgaagggacaagtgaagctaggccatgttgattgtgatgctgaaaagtccttgatgagcaagtacaaggtggaaggttttccaactattttggtatttggtgctgataaggagagcccattcctctaccagggggctagagtttcatctgccattgagtcctttgcattggagcagttggaagccaactctggcccagctgaagtttctgagttgactggaccggatgtcatggaagagaagtgtgcttctgctgccatttgttttgtatcattccttccagacatccttgattcaaaggcagaaggaagaaacaagtaccttgagcttctgctctctgttgctgaaaagtttaaaaagagtccatacagttttgtctggacagctgctggcaagcaagcgaatcttgagaaccaggttggagtgggcggttacggctatccagccatggtagctctcaacgtgaaaaaaggtgcatacactccactccgtagtgccttccagcgcgacgaaatcatcgagtttgtgaaggaagcagggcgcggtggaaagggaaatcttcctctgaacggtgcacctacagtagtcacgtccgagccgtgggacggcaaagatggagaggttattgaagaggatgaattctcccttgacgagctcatgggcgacagctcctcagtaaacgatgagttgtga

SEQ ID NO: 5178 - protein, 439 aa, Sorghum bicolor
  misc_feature: Ceres ANNOT ID no. 6041970
  misc_feature (28)..(131): Pfam Id: Thioredoxin Pfam Desc: Thioredoxin
  misc_feature (164)..(268): Pfam Id: Thioredoxin Pfam Desc: Thioredoxin
  misc_feature (1)..(439): NCBI GI: 59861273 NCBI Desc: protein disulfide isomerase [zea mays]
  misc_feature (2)..(438): NCBI GI: 79336174 NCBI Desc: atpdil2-2; electron transporter/ isomerase/ thiol-disulfide exchange intermediate [arabidopsis thaliana]
  misc_feature (20)..(439): NCBI GI: 62510933 NCBI Desc: protein disulfide-isomerase a6 precursor (thioredoxin domain containing protein 7)
  misc_feature (1)..(439): NCBI GI: 50418205 NCBI Desc: mgc79068 protein [xenopus laevis]
  misc_feature (20)..(439): NCBI GI: 62296810 NCBI Desc: protein disulfide-isomerase a6 precursor (protein disulfide isomerase p5) (calcium-binding protein 1) (cabp1)
  misc_feature: Up-regulated in shoot tissues in response to salicylic acid treatment
MRSAVVAALLLVAAVASPAAALYSAGSPVLQLNPNNFKSKVLNSNGVVLVEFFAPWCGHCKQLAPAWEKAAGVLKGVATVAALDADAHQALAQEYGIRGFPTIKVFSPGKPPVDYQGARDVKPIVEFALSQVKSLLRERLSGKASAGSNGKTSGGSSEKSEPSASVELNSRNFDELVVKSKDLWIVEFFAPWCGHCKKLAPEWKKAAKNLKGQVKLGHVDCDAEKSLMSKYKVEGFPTILVFGADKESPFLYQGARVSSAIESFALEQLEANSGPAEVSELTGPDVMEEKCASAAICFVSFLPDILDSKAEGRNKYLELLLSVAEKFKKSPYSFVWTAAGKQANLENQVGVGGYGYPAMVALNVKKGAYTPLRSAFQRDEIIEFVKEAGRGGKGNLPLNGAPTVVTSEPWDGKDGEVIEEDEFSLDELMGDSSSVNDEL

SEQ ID NO: 5179 - DNA, 990 bp, Sorghum bicolor
  misc_feature: Ceres ANNOT ID no. 6041976
  misc_feature: Encodes the peptide sequence at SEQ ID NO 5180
  misc_feature: Up-regulated in shoot tissues in response to methyl jasmonate treatment
  misc_feature: Up-regulated in root tissues in response to methyl jasmonate treatment
atggcgcctgcattgtcattcccgatcatcgacatggggctgctcgccggggaggagaggccggcggcgatggagctgctgcgcgatgcgtgcgagaactggggcttcttcgagattctgaaccacggcatctcgacggagctgatggacgaggtggagaagctgaccaaggaccactacaagcgggtgcgcgagcagaggttcctcgacttcgccagcaagacgctcgcggacgccaaggcggcggagaacctggactgggagagcaccttcttcgtccgccacctcccggaatccaacctcgccgagataccggacctcgacgacggctaccggcgcgtgatgaggcggttcgccggcgagctggaggcgctggcggagcggctgctggacctcctctgcgagaacctcggcctcgaggggggctacctcgcgcgggcgttccgcgggcgcagcacgggcgccccgacgttcggcaccaaggtgagcagctacccgccgtgcccgcgcccggacctcgtgagcggcctgcgcgcgcacaccgacgccggcggcatcatcctgctgttccaggacgaccgcgtcggcgggctccagctgctcaagggcggcgagtgggtggacgtgccgccgctgcgccacgccatcgtcgtcaacctgggagaccagctggaggtggtcaccaacggcgcgtacaagagcgtgatgcaccgggtggtggcgcagcccgacggcaacaggatgtccatcgcctccttctacaacccgggcagcgacgccgtcatctttcccgcgccggcgctggtgaacaaggcccaggaccaggaggccgccgcggggaatggggatggggtcggggtgtaccccaggttcgtgttcgaggactacatgaagctgtacgtgcggcacaagttcgaggccaaggagccacggttcgaggccttcaggtccatggagacggacagctccaactgcatagccatcgcgtaa

SEQ ID NO: 5180 - protein, 329 aa, Sorghum bicolor
  misc_feature: Ceres ANNOT ID no. 6041976
  misc_feature (156)..(256): Pfam Id: 2OG-FeII_Oxy Pfam Desc: 2OG-Fe(II) oxygenase superfamily
  misc_feature (1)..(329): NCBI GI: 41615359 NCBI Desc: 1-aminocyclopropane-1-carboxylate oxidase [saccharum officinarum]
  misc_feature (1)..(329): NCBI GI: 123255925 NCBI Desc: 1-aminocyclopropane-1-carboxylate oxidase [saccharum arundinaceum]
  misc_feature (1)..(329): NCBI GI: 76789648 NCBI Desc: 1-aminocyclopropane-1-carboxylate oxidase 1 (acc oxidase 1) (ethylene-forming enzyme) (efe)
  misc_feature (1)..(329): NCBI GI: 51536088 NCBI Desc: 1-aminocyclopropane-1-carboxylate oxidase (acc oxidase) [oryza sativa (japonica cultivar-group)]
  misc_feature (1)..(329): NCBI GI: 12862572 NCBI Desc: 1-aminocyclopropane-1-carboxylate oxidase [phyllostachys edulis]
  misc_feature (1)..(329): SWISSPROT Homolog: EC 1.14.17.4 1-aminocyclopropane-1-carboxylate oxidase 1
  misc_feature: Useful for making plants with modulated heat sensitivity
  misc_feature: Functional homolog of the protein sequence given in SEQ ID NO 12924
  misc_feature: Useful for making plants with modulated heat sensitivity
  misc_feature: Functional homolog of the protein sequence given in SEQ ID NO 12924
  misc_feature: Up-regulated in shoot tissues in response to methyl jasmonate treatment
  misc_feature: Up-regulated in root tissues in response to methyl jasmonate treatment
  misc_feature: The sequence is a functional homolog of SEQ ID NO. 278 in the 11/188,298 US application
  misc_feature: The sequence is a functional homolog of SEQ ID NO. 513 in the 11/188,298 US application
MAPALSFPIIDMGLLAGEERPAAMELLRDACENWGFFEILNHGISTELMDEVEKLTKDHYKRVREQRFLDFASKTLADAKAAENLDWESTFFVRHLPESNLAEIPDLDDGYRRVMRRFAGELEALAERLLDLLCENLGLEGGYLARAFRGRSTGAPTFGTKVSSYPPCPRPDLVSGLRAHTDAGGIILLFQDDRVGGLQLLKGGEWVDVPPLRHAIVVNLGDQLEVVTNGAYKSVMHRVVAQPDGNRMSIASFYNPGSDAVIFPAPALVNKAQDQEAAAGNGDGVGVYPRFVFEDYMKLYVRHKFEAKEPRFEAFRSMETDSSNCIAIA

SEQ ID NO: 5181 - DNA, 1209 bp, Sorghum bicolor
  misc_feature: Ceres ANNOT ID no. 6041981
  misc_feature: Encodes the peptide sequence at SEQ ID NO 5182
atgacgtcgtccatgcggcagtggtggcgccgcgccgccgcggcgctcaaggacaggaggagcctgctcctggcgcgcctccgcccgcgccgggccggacaccaccgggagctggaggcggccgtgatccgcgccacgagccacgaggaccggtggatggactaccggagcgccgcgcgggtgttcgcgtgggcgcgctcgtcgccctcgtgcctccggcccgccatgtgcgcgctggcgcgccgcgcgcggcggacgcggtgctgggtcgtggcgctcaagtcgctcatggtcgcgcacggcatcctcctccgctcgggcctcgcgccaagcgcggcccgcgccgggctcgtcgtccccttcgagctcgctgatttccgagaccggtcctcgttctcctcgtcgtcggcggcgaggtccctggccttctccgcctttgtgcgcgcgtacttccggtttctggactaccgctcccacctcgccgcgcaggtggacaccgacggcgacgacgccgccaataagtgctcggatgatccccaaacggcctttcttgatcggatagccaagaaacagttcctgctcgacctgctcctgcaaatccgcccgtacggcgacggcatggaggtgccgctcgtcctcgaggccatggactgcgcactcatcgagatcttccaggtgtacggcgagatatgtaccggcatagcgcggttcctcgtcagcggcgttcaatgcagaccggcgaagccgacgatggacaaggcggccacggcggaaggggtgaaggtgctctggcgggcggtggagcagggcgctcagctctcgtcctacttcgacctgtgccgcgggctcggcgtggccaacgcccgcaagctcccggcggcgttcgttcgcttgaaagacgacgacgttcgggacctcgagcggatcctcatgactgacatccaggacgataacagtgacgaggcggagccggaaccggaggcagaggggatggcggcgccggctgacgtgaaggacgcggggccaacgtcgacgaccactacggtggtgacgacgacaacggaatgggtggcattcgacgaggagaattcaagcgctggcgttgtcgcctacgacgacggcgggggtcacgtctctaatcactggaaccccttcgtcgctgcgccgtcagacggtcgggaagtcggaaatctgatcgagcttttctag

SEQ ID NO: 5182 - protein, 402 aa, Sorghum bicolor
  misc_feature: Ceres ANNOT ID no. 6041981
  misc_feature (35)..(306): Pfam Id: ANTH Pfam Desc: ANTH domain
  misc_feature (112)..(291): NCBI GI: 115479457 NCBI Desc: os09g0449500 [oryza sativa (japonica cultivar-group)]
  misc_feature (5)..(345): NCBI GI: 50251206 NCBI Desc: synaptosomal-associated protein 91-like [oryza sativa (japonica cultivar-group)]
  misc_feature (4)..(357): NCBI GI: 56785152 NCBI Desc: clathrin assembly protein ap180 short form-like [oryza sativa (japonica cultivar-group)]
  misc_feature (1)..(350): NCBI GI: 144925059 NCBI Desc: anth [medicago truncatula]
  misc_feature (9)..(343): NCBI GI: 52077380 NCBI Desc: phosphoprotein-like [oryza sativa (japonica cultivar-group)]
MTSSMRQWWRRAAAALKDRRSLLLARLRPRRAGHHRELEAAVIRATSHEDRWMDYRSAARVFAWARSSPSCLRPAMCALARRARRTRCWVVALKSLMVAHGILLRSGLAPSAARAGLVVPFELADFRDRSSFSSSSAARSLAFSAFVRAYFRFLDYRSHLAAQVDTDGDDAANKCSDDPQTAFLDRIAKKQFLLDLLLQIRPYGDGMEVPLVLEAMDCALIEIFQVYGEICTGIARFLVSGVQCRPAKPTMDKAATAEGVKVLWRAVEQGAQLSSYFDLCRGLGVANARKLPAAFVRLKDDDVRDLERILMTDIQDDNSDEAEPEPEAEGMAAPADVKDAGPTSTTTTVVTTTTEWVAFDEENSSAGVVAYDDGGGHVSNHWNPFVAAPSDGREVGNLIELF

SEQ ID NO: 5183 - DNA, 1500 bp, Sorghum bicolor
  misc_feature: Ceres ANNOT ID no. 6041983
  misc_feature: Encodes the peptide sequence at SEQ ID NO 5184
atgttgggattctgcgcgcccgcggccggtccacctcccgacgaggcgacgccggagccgttccgttcgctgcagatcgctacctgcacggccgccgccgccgccacgacaaagaagaagcgccggcccgccggcacaccagacccggacgcggaggtggtgtcgctgtcgccgcggacgctgctggagtcggaccggtacgtgtgcgagatctgcgggcaggggttccagcgcgaccagaacctgcagatgcaccggcggcggcacaaggtgccgtggaagctgctgaagcgggaggccggggaggcggcgcggaagcgggtgttcgtgtgcccggagcccagctgcctgcaccacgacccttcccacgcgctgggcgacctcgtcggcatcaagaagcacttccgccgcaagcacagcggccagcgccagtgggcctgcgcccgctgctccaaggcctacgccgtccactccgactacaaggcccacctcaagacctgcggcacccgcggccactcctgcgactgcggccgcgtcttctcccgggtggagagcttcatagagcaccaagacacctgcaacgccgggagggcacgggcagacgccgcatcgccggcgtgtggcgccggtgtggcagctgctgctagtgcggggtcgcagcagcaggcgccgccggccatgtcactgtcgaggacggcgtcgagcaccaggaccagcccgtccagcgacattgccatcagcccggtggcatggcccggttcggcaccggcgattccaagccctacgaccgcggcgttccaccggttcgaacaagtcccgtcgcctcggacgccgccatcggaccaccgccgcggcgggcatcacaacctcgagctccagctcatgccgccgtcctgcggcggcgcgccacgcactccggccgccgttcctccacagagccaccacgccgccgccatgcagctgcagctgtccatcggcgtctgcggcggcgggatcggggacgacgcgggggagcgcggcggcgaggtggtgatgctggccgcagcagcgagggagaaggaggaggaggcgcgggagcagctgcgtcaggcggtggcggagaaggcggcggcggacgaggcccgcgcgcaggcgaagcggcacgcggagctggccgagcaggagctggcgagcgccaagcggatgcggcggcaggcgcaggtggagctgagccgcgcccacgcgctccgggagcacgccgtgcgccaggtgaacgcgacgctcctccagatcacctgcctcggctgccgccacaagttccgcgcgcgggcgccgcagctgatgatggacgccgccgtggcgggccccgaggtggcctgcagctacatgtcctccgtcgtgacagcagagggcggcgacgccgaggtcgtcgacgacgagccgccgcccctcgacggcgcggacgccatgctacagcggcggcgccaacaacacgccatggccatggacgtcgtcctctag

SEQ ID NO: 5184 - protein, 499 aa, Sorghum bicolor
  misc_feature: Ceres ANNOT ID no. 6041983
  misc_feature (67)..(89): Pfam Id: zf-C2H2 Pfam Desc: Zinc finger, C2H2 type
  misc_feature (16)..(240): NCBI GI: 145328244 NCBI Desc: sgr5 (shoot gravitropism 5) [arabidopsis thaliana]
  misc_feature (101)..(263): NCBI GI: 115451787 NCBI Desc: os03g0237200 [oryza sativa (japonica cultivar-group)]
  misc_feature (16)..(240): NCBI GI: 79549667 NCBI Desc: nucleic acid binding / transcription factor/ zinc ion binding [arabidopsis thaliana]
  misc_feature (84)..(253): NCBI GI: 145326688 NCBI Desc: atidd14 (arabidopsis thaliana indeterminate(id)-domain 14) [arabidopsis thaliana]
  misc_feature (37)..(247): NCBI GI: 140064565 NCBI Desc: zinc finger, c2h2-type [medicago truncatula]
  misc_feature: The sequence is a functional homolog of SEQ ID NO 1074 in the 10/666,642US patent application
  misc_feature: The sequence is a functional homolog of SEQ ID NO 1075 in the 10/666,642US patent application
  misc_feature: The sequence is a functional homolog of SEQ ID NO 1076 in the 10/666,642US patent application
  misc_feature: The sequence is a functional homolog of SEQ ID NO 1077 in the 10/666,642US patent application
  misc_feature: The sequence is a functional homolog of SEQ ID NO 1078 in the 10/666,642US patent application
  misc_feature: The sequence is a functional homolog of SEQ ID NO 1079 in the 10/666,642US patent application
  misc_feature: The sequence is a functional homolog of SEQ ID NO 1086 in the 10/666,642US patent application
  misc_feature: The sequence is a functional homolog of SEQ ID NO 1087 in the 10/666,642US patent application
  misc_feature: The sequence is a functional homolog of SEQ ID NO 178 in the 10/225,068US patent application
  misc_feature: The sequence is a functional homolog of SEQ ID NO 1785 in the 10/374,780US patent application
  misc_feature: The sequence is a functional homolog of SEQ ID NO 358 in the 10/374,780US patent application
  misc_feature: The sequence is a functional homolog of SEQ ID NO 584 in the 10/666,642US patent application
  misc_feature: The sequence is a functional homolog of SEQ ID NO 902 in the 11/435,388US patent application
  misc_feature: The sequence is a functional homolog of SEQ ID NO 960 in the 11/435,388US patent application
  misc_feature: Useful for making plants with modulated growth and phenotype characteristics
  misc_feature: The sequence is a functional homolog of SEQ ID NO 178 in the 20050120408 US patent application
  misc_feature: The sequence is a functional homolog of SEQ ID NO 1785 in the 20060162006 US patent application
  misc_feature: The sequence is a functional homolog of SEQ ID NO 902 in the 20060272060 US patent application
  misc_feature: The sequence is a functional homolog of SEQ ID NO 960 in the 20060272060 US patent application
  misc_feature: The sequence is a functional homolog of SEQ ID NO 1074 in the 20070033671 US patent application
  misc_feature: The sequence is a functional homolog of SEQ ID NO 1075 in the 20070033671 US patent application
  misc_feature: The sequence is a functional homolog of SEQ ID NO 1076 in the 20070033671 US patent application
  misc_feature: The sequence is a functional homolog of SEQ ID NO 1078 in the 20070033671 US patent application
  misc_feature: The sequence is a functional homolog of SEQ ID NO 1079 in the 20070033671 US patent application
  misc_feature: The sequence is a functional homolog of SEQ ID NO 1086 in the 20070033671 US patent application
  misc_feature: The sequence is a functional homolog of SEQ ID NO 1087 in the 20070033671 US patent application
  misc_feature: The sequence is a functional homolog of SEQ ID NO 1087 in the 10/666,642 US patent application
  misc_feature: Useful for making plants with altered lignin content
  misc_feature: Functional homolog of the protein sequence given in SEQ ID NO 13275
  misc_feature: The sequence is a functional homolog of SEQ ID NO. 455 in the 11/188,298 US application
MLGFCAPAAGPPPDEATPEPFRSLQIATCTAAAAATTKKKRRPAGTPDPDAEVVSLSPRTLLESDRYVCEICGQGFQRDQNLQMHRRRHKVPWKLLKREAGEAARKRVFVCPEPSCLHHDPSHALGDLVGIKKHFRRKHSGQRQWACARCSKAYAVHSDYKAHLKTCGTRGHSCDCGRVFSRVESFIEHQDTCNAGRARADAASPACGAGVAAAASAGSQQQAPPAMSLSRTASSTRTSPSSDIAISPVAWPGSAPAIPSPTTAAFHRFEQVPSPRTPPSDHRRGGHHNLELQLMPPSCGGAPRTPAAVPPQSHHAAAMQLQLSIGVCGGGIGDDAGERGGEVVMLAAAAREKEEEAREQLRQAVAEKAAADEARAQAKRHAELAEQELASAKRMRRQAQVELSRAHALREHAVRQVNATLLQITCLGCRHKFRARAPQLMMDAAVAGPEVACSYMSSVVTAEGGDAEVVDDEPPPLDGADAMLQRRRQQHAMAMDVVL

SEQ ID NO: 5185 - DNA, 1110 bp, Sorghum bicolor
  misc_feature: Ceres ANNOT ID no. 6042004
  misc_feature: Encodes the peptide sequence at SEQ ID NO 5186
atggagttggggctcagcttgggggagaccatggcggatgccggcagggacctcgtgcttgggcttgggatgggcgtcgtcggagtgcggagggaggaggaagccgccgagagggggagtaggagggatagggacgcgaggagggagctggagttcgggacgacggggtggtgcggcgcccggtcctcgccggagccgccagccgtgcgactcacgctcctgcccggcctggtgccccgcctcggcggcctcccgtggccgccgccgccgccgccgccgccgccgtcgtccgagaccaaccggcatttggaggcgtcgacgacgcgtggcttcgacgttaaccgtgcgccgtcgctgtccgtggccggtgccgccgcggcggaggaggacgaggagcacgacgaggcgggcgcggcggcggcgtcgtcgtcgcccaacaacagcgcgggctccttcccgacggacttctccgcgcagggcggccaggtggcgcccggaggcgggggcgaccgcggcgcgtgctcccgcgccagcgacgacgacgacggcgggtcggcgcgcaagaagctgcgcctctccaaggagcagtccgcgttcctggaggagagcttcaaggagcacgccacgctgaacccgaagcagaagctggcgctggcgaagcagctcaacctccggccgcgccaggtggaggtgtggttccagaaccgcagagccaggacgaagctgaagcagacggaggtggactgcgagtacctgaagcgctgctgcgagacgctgacggaggagaaccggcggctgcagaaggagctagccgagctccgcgcgctcaagacggtgcaccctttctacatgcacctcccggccaccaccctctccatgtgcccctcctgcgagcgcgtcgcctccaactcctccgcccctgccgtcgcaccggtggcgccagcgtcgtcgccctcccctgctgctactggcattgcggcatcgtcggccccgtcggagcagcagaggccatcgtcgttcgcagctctgttctcgtccccccttaaccgcccgctggtggccgcccaggcgcaaccgcaaccgcgaccgcaggcgccggccagctcttga

SEQ ID NO: 5186 - protein, 369 aa, Sorghum bicolor
  misc_feature: Ceres ANNOT ID no. 6042004
  misc_feature (243)..(287): Pfam Id: HALZ Pfam Desc: Homeobox associated leucine zipper
  misc_feature (188)..(242): Pfam Id: Homeobox Pfam Desc: Homeobox domain
  misc_feature (213)..(369): NCBI GI: 115476796 NCBI Desc: os08g0465000 [oryza sativa (japonica cultivar-group)]
  misc_feature (1)..(306): NCBI GI: 83833844 NCBI Desc: type ii homeodomain-leucine zipper protein [medicago sativa]
  misc_feature (119)..(310): NCBI GI: 22326632 NCBI Desc: homeobox-leucine zipper protein 14 (hat14) / hd-zip protein 14 [arabidopsis thaliana]
  misc_feature (119)..(310): NCBI GI: 29028870 NCBI Desc: at5g06710 [arabidopsis thaliana]
  misc_feature (96)..(339): NCBI GI: 30984526 NCBI Desc: at3g60390 [arabidopsis thaliana]
  misc_feature: The sequence is a functional homolog of SEQ ID NO 1674 in the 10/374,780US patent application
  misc_feature: The sequence is a functional homolog of SEQ ID NO 254 in the 10/412,699US patent application
  misc_feature: The sequence is a functional homolog of SEQ ID NO 542 in the 11/479,226US patent application
  misc_feature: The sequence is a functional homolog of SEQ ID NO 550 in the 11/479,226US patent application
  misc_feature: Useful for making plants with modulated growth and phenotype characteristics
  misc_feature: The sequence is a functional homolog of SEQ ID NO 254 in the 20040045049 US patent application
  misc_feature: The sequence is a functional homolog of SEQ ID NO 1674 in the 20060162006 US patent application
  misc_feature: The sequence is a functional homolog of SEQ ID NO 542 in the 20070022495 US patent application
  misc_feature: The sequence is a functional homolog of SEQ ID NO 1674 in the 10/374,780 US patent application
MELGLSLGETMADAGRDLVLGLGMGVVGVRREEEAAERGSRRDRDARRELEFGTTGWCGARSSPEPPAVRLTLLPGLVPRLGGLPWPPPPPPPPPSSETNRHLEASTTRGFDVNRAPSLSVAGAAAAEEDEEHDEAGAAAASSSPNNSAGSFPTDFSAQGGQVAPGGGGDRGACSRASDDDDGGSARKKLRLSKEQSAFLEESFKEHATLNPKQKLALAKQLNLRPRQVEVWFQNRRARTKLKQTEVDCEYLKRCCETLTEENRRLQKELAELRALKTVHPFYMHLPATTLSMCPSCERVASNSSAPAVAPVAPASSPSPAATGIAASSAPSEQQRPSSFAALFSSPLNRPLVAAQAQPQPRPQAPASS

SEQ ID NO: 5187 - DNA, 2118 bp, Sorghum bicolor
  misc_feature: Ceres ANNOT ID no. 6042008
  misc_feature: Encodes the peptide sequence at SEQ ID NO 5188
  misc_feature: Down-regulated in shoot tissues in response to aminocyclopropane carboxylic treatment
  misc_feature: Down-regulated in root tissues in response to salicylic acid treatment
atggatctgcgtgccccaccaaccaattatcccaaaacttttttatcttccattatcctatggcgtcgtctccacgaccatcaccatcaccaccaccactcgctgcagcggcccactggactcggccgcgactccgtcgtcgcgagatccagcgccgtcgtcgcgccgcctacgccgacgccgctgccgccgccgacgctgctgccggagatgccgagcccgacgatccggaggctggacgtggcctcgccggtgccggcggacatcgacatcgccaacgccgtcgagccgctcccgatcgccgacatcgcggcggagctcggcctccggcccgaccactacgacctctacggcaagtacaaggccaaggtcttgctgtcggttcttgatgacctcaaggcgcagcaggatggatactacgtcgtggtcggcggcatcacgccgacgcccctcggggagggcaagtccaccaccaccgtcggtctgtgtcaggctcttggcgctttccttgataaaaaggttgtcacatgccttcgtcaaccatcacaagggcctacctttggaatcaagggaggtgcagctggaggtggctacagccaagttatacccatggatgagttcaatcttcatctgacaggcgatatccatgcaattacggctgcaaacaatctacttgctgctgctattgatacaaggatcttccatgaaaattctcagtcagacaaaggactgttcaacagattgtgtccggcaaacaaggaaggcaagaggcactttgctgacgtaatgttcagacgtctgacaaagttgggcatttcaaagacagaccccaatgagcttacaccagatgaaatcaggcgttttgcaaggcttgatatcgaccctgagtccattacatggagacgggtgatggatgtcaatgaccgtttcctgagaaaaatcactattggacagggccctgaagaaaaaggtatggtgagagaaacaggctttgatatatctgtagctagtgaaataatggctgtattagctcttacaacttccctcgctgacatgagagaaaggcttggaagaatggtgatagggaacagcaagtcaggtgagccgataactgctgatgatcttggggttggaggtgcgttgactgtcctaatgaaagatgctattcatcccaccctcatgcaaactcttgaaggcacaccagttttagtacatgctggaccgtttgctaacattgctcatggaaattcttcaattgttgctgataagattgctttgaagttggttgggaagggtggctttgttgttactgaggcaggttttggtgctgatattggaactgagaagttcatggacatcaaatgtaggtatagtggattggtgccacagtgtgctattattgtggccacaattagagctctcaaaatgcatggaggggggcctgaggtggtggctggaaagcctctggatcatgcatatgtgagcgaaaatgtggcccttgttgaagctggatgtgtaaatctggctaaacatatatcaaacacgaggagttatggagttaatgttgtagttgcaatcaacaaatttgcatcagatactgaagcagaaatgaatgtggtgcgtagtgcatcaatggctgctggtgcttttgacgctgtcgtctgcacgcaccatgcccatggtggtaaaggagcggtcgagcttggacttgctgtccaacgagcatgtgaaagccagacagaacctctgaagtttttgtatcctttggaatctagcataaaggagaagattgagtcaattgctaagttttatggtgccagtggtgttgaatactccgagcaggctgagaagcagattgagatgtacaccaagcaagggttctccaacctccccatctgcatggcgaagacccaatactcattctcacacgtcccatccatgaagggcgcgccgacgggctttgttctaccaataagagatgtgagggccagtatcggagctgggttcatctacccgctcgtgggcaccatgagcacgatgcctgggcttcccacaaggccctgcttctacgagatcgatgtagacactgccaccgggaaggtcatgggcctgtcatga

SEQ ID NO: 5188 - protein, 705 aa, Sorghum bicolor
  misc_feature: Ceres ANNOT ID no. 6042008
  misc_feature (85)..(705): Pfam Id: FTHFS Pfam Desc: Formate--tetrahydrofolate ligase
  misc_feature (1)..(705): NCBI GI: 115479433 NCBI Desc: os09g0446800 [oryza sativa (japonica cultivar-group)]
  misc_feature (73)..(705): NCBI GI: 20148441 NCBI Desc: 10-formyltetrahydrofolate synthetase [arabidopsis thaliana]
  misc_feature (73)..(705): NCBI GI: 2507455 NCBI Desc: formate--tetrahydrofolate ligase (formyltetrahydrofolate synthetase) (fhs) (fthfs)
  misc_feature (73)..(705): NCBI GI: 92892664 NCBI Desc: formate-tetrahydrofolate ligase, fthfs [medicago truncatula]
  misc_feature (78)..(705): NCBI GI: 60464052 NCBI Desc: formate-dihydrofolate ligase [dictyostelium discoideum]
  misc_feature (73)..(705): SWISSPROT Homolog: EC 6.3.4.3 Formate--tetrahydrofolate ligase
  misc_feature: Down-regulated in shoot tissues in response to aminocyclopropane carboxylic treatment
  misc_feature: Down-regulated in root tissues in response to salicylic acid treatment
MDLRAPPTNYPKTFLSSIILWRRLHDHHHHHHHSLQRPTGLGRDSVVARSSAVVAPPTPTPLPPPTLLPEMPSPTIRRLDVASPVPADIDIANAVEPLPIADIAAELGLRPDHYDLYGKYKAKVLLSVLDDLKAQQDGYYVVVGGITPTPLGEGKSTTTVGLCQALGAFLDKKVVTCLRQPSQGPTFGIKGGAAGGGYSQVIPMDEFNLHLTGDIHAITAANNLLAAAIDTRIFHENSQSDKGLFNRLCPANKEGKRHFADVMFRRLTKLGISKTDPNELTPDEIRRFARLDIDPESITWRRVMDVNDRFLRKITIGQGPEEKGMVRETGFDISVASEIMAVLALTTSLADMRERLGRMVIGNSKSGEPITADDLGVGGALTVLMKDAIHPTLMQTLEGTPVLVHAGPFANIAHGNSSIVADKIALKLVGKGGFVVTEAGFGADIGTEKFMDIKCRYSGLVPQCAIIVATIRALKMHGGGPEVVAGKPLDHAYVSENVALVEAGCVNLAKHISNTRSYGVNVVVAINKFASDTEAEMNVVRSASMAAGAFDAVVCTHHAHGGKGAVELGLAVQRACESQTEPLKFLYPLESSIKEKIESIAKFYGASGVEYSEQAEKQIEMYTKQGFSNLPICMAKTQYSFSHVPSMKGAPTGFVLPIRDVRASIGAGFIYPLVGTMSTMPGLPTRPCFYEIDVDTATGKVMGLS

SEQ ID NO: 5189 - DNA, 930 bp, Sorghum bicolor
  misc_feature: Ceres ANNOT ID no. 6042022
  misc_feature: Encodes the peptide sequence at SEQ ID NO 5190
atgagcgagcaaggcgggcagcacgtcgggggtaccagcccgtcggacacggccatcgagtccttctcgcagctccccttcgtccgccccaagcccccgcagccgccggcgtcctcgtccagtccctcgtcgatccggctgttcggcttcgaggttccacccgacgccgtcacgtcctcctccgcaaccagtgatgctaccgcggccagcagcgccaccgcagcgggcggccaggtggtggtgtcgggtgccggtgcaggtgcaggcgacggcagcggcagcggcggcgcagggcgcaagttcgagtgccactactgctgccggaacttcccgacgtcgcaggcgctgggcgggcaccagaacgcgcacaagcgggagcggcagcacgcgaagcgcgcgcagtaccagagcgcgatggccatgcatcacgcgcactaccctgcaggctaccatccccacgcgtaccccgccttcactgctagctaccaccaccgcttcggcatggcgcggtacgagcccccgccgggaccgccgccgcactacccctcgtggtccagccaccatcccacgcaggctgccgctccgccgccggtggtggtgcccagatactacggcggggccgccggctccctgtcgcagcccatcaacggcagccccgtgccggctgccgctctctggcgggtcccggccgttaccgtggccgccgcggcgccactggtgcgccaggagcggccggcgccgctgtccttgggcggaggacgtggcgaggacgcaatggcaggagcaaggaaagggaacgtagcagcaggacacggaggctcgcgttcttcctcctcgtcatccacctcgtcgcagcatgaacgccgccgggcaggtgctgctgctgctgcagagaacagagagaacgtgagtcttgatctcactttgtaa

SEQ ID NO: 5190 - protein, 309 aa, Sorghum bicolor
  misc_feature: Ceres ANNOT ID no. 6042022
  misc_feature (42)..(309): NCBI GI: 115479419 NCBI Desc: os09g0445500 [oryza sativa (japonica cultivar-group)]
  misc_feature (42)..(309): NCBI GI: 51536147 NCBI Desc: zinc finger protein-like [oryza sativa (japonica cultivar-group)]
  misc_feature (19)..(165): NCBI GI: 790687 NCBI Desc: zinc finger protein
  misc_feature (77)..(265): NCBI GI: 51091156 NCBI Desc: zinc finger protein-like [oryza sativa (japonica cultivar-group)]
  misc_feature (10)..(186): NCBI GI: 32362299 NCBI Desc: at3g58070 [arabidopsis thaliana]
  misc_feature: Abnormal phyllotaxy, leaf number higher than wild-type
  misc_feature: The plant flowers significantly late compared to wild-type.
  misc_feature: The plant is abnormally large.
  misc_feature: The plant is abnormally small.
  misc_feature: The plant produces a reduced number of seeds.
  misc_feature: The sequence is a functional homolog of SEQ ID NO 10 in the 10/412,699US patent application
  misc_feature: The sequence is a functional homolog of SEQ ID NO 1013 in the 10/666,642US patent application
  misc_feature: The sequence is a functional homolog of SEQ ID NO 1090 in the 10/412,699US patent application
  misc_feature: The sequence is a functional homolog of SEQ ID NO 1091 in the 10/412,699US patent application
  misc_feature: The sequence is a functional homolog of SEQ ID NO 1092 in the 10/412,699US patent application
  misc_feature: The sequence is a functional homolog of SEQ ID NO 1093 in the 10/412,699US patent application
  misc_feature: The sequence is a functional homolog of SEQ ID NO 1094 in the 10/412,699US patent application
  misc_feature: The sequence is a functional homolog of SEQ ID NO 124 in the 11/479,226US patent application
  misc_feature: The sequence is a functional homolog of SEQ ID NO 1279 in the 10/666,642US patent application
  misc_feature: The sequence is a functional homolog of SEQ ID NO 1289 in the 10/666,642US patent application
  misc_feature: The sequence is a functional homolog of SEQ ID NO 1290 in the 10/666,642US patent application
  misc_feature: The sequence is a functional homolog of SEQ ID NO 1494 in the 10/666,642US patent application
  misc_feature: The sequence is a functional homolog of SEQ ID NO 18 in the 10/412,699US patent application
  misc_feature: The sequence is a functional homolog of SEQ ID NO 1894 in the 10/412,699US patent application
  misc_feature: The sequence is a functional homolog of SEQ ID NO 2158 in the 10/374,780US patent application
  misc_feature: The sequence is a functional homolog of SEQ ID NO 250 in the 11/375,241US patent application
  misc_feature: The sequence is a functional homolog of SEQ ID NO 334 in the 10/666,642US patent application
  misc_feature: The sequence is a functional homolog of SEQ ID NO 623 in the 10/374,780US patent application
  misc_feature: The sequence is a functional homolog of SEQ ID NO 624 in the 10/374,780US patent application
  misc_feature: The sequence is a functional homolog of SEQ ID NO 635 in the 10/374,780US patent application
  misc_feature: The sequence is a functional homolog of SEQ ID NO 636 in the 10/374,780US patent application
  misc_feature: The sequence is a functional homolog of SEQ ID NO 637 in the 10/374,780US patent application
  misc_feature: The sequence is a functional homolog of SEQ ID NO 638 in the 10/374,780US patent application
  misc_feature: The sequence is a functional homolog of SEQ ID NO 639 in the 10/374,780US patent application
  misc_feature: The sequence is a functional homolog of SEQ ID NO 760 in the 10/666,642US patent application
  misc_feature: The sequence is a functional homolog of SEQ ID NO 761 in the 10/666,642US patent application
  misc_feature: The sequence is a functional homolog of SEQ ID NO 762 in the 10/666,642US patent application
  misc_feature: The sequence is a functional homolog of SEQ ID NO 763 in the 10/666,642US patent application
  misc_feature: The sequence is a functional homolog of SEQ ID NO 814 in the 11/435,388US patent application
  misc_feature: Useful for biocontainment applications
  misc_feature: Useful for making plants with altered alkaloid content
  misc_feature: Useful for making plants with altered terpenoid content
  misc_feature: Useful for making plants with modulated biomass
  misc_feature: Useful for making plants with modulated flowering time
  misc_feature: Useful for making plants with modulated growth and phenotype characteristics
  misc_feature: Useful for making plants with modulated drought sensitivity
  misc_feature: Functional homolog of the protein sequence given in SEQ ID NO 13265
  misc_feature: Functional homolog of the protein sequence given in SEQ ID NO 13272
  misc_feature: Functional homolog of the protein sequence given in SEQ ID NO 13309
  misc_feature: The sequence is a functional homolog of SEQ ID NO 10 in the 20040045049 US patent application
  misc_feature: The sequence is a functional homolog of SEQ ID NO 1090 in the 20040045049 US patent application
  misc_feature: The sequence is a functional homolog of SEQ ID NO 1091 in the 20040045049 US patent application
  misc_feature: The sequence is a functional homolog of SEQ ID NO 1092 in the 20040045049 US patent application
  misc_feature: The sequence is a functional homolog of SEQ ID NO 1093 in the 20040045049 US patent application
  misc_feature: The sequence is a functional homolog of SEQ ID NO 1094 in the 20040045049 US patent application
  misc_feature: The sequence is a functional homolog of SEQ ID NO 18 in the 20040045049 US patent application
  misc_feature: The sequence is a functional homolog of SEQ ID NO 1894 in the 20040045049 US patent application
  misc_feature: The sequence is a functional homolog of SEQ ID NO 623 in the 20060162006 US patent application
  misc_feature: The sequence is a functional homolog of SEQ ID NO 624 in the 20060162006 US patent application
  misc_feature: The sequence is a functional homolog of SEQ ID NO 1013 in the 20070033671 US patent application
  misc_feature: Functional homolog of the protein sequence given in SEQ ID NO 13581
MSEQGGQHVGGTSPSDTAIESFSQLPFVRPKPPQPPASSSSPSSIRLFGFEVPPDAVTSSSATSDATAASSATAAGGQVVVSGAGAGAGDGSGSGGAGRKFECHYCCRNFPTSQALGGHQNAHKRERQHAKRAQYQSAMAMHHAHYPAGYHPHAYPAFTASYHHRFGMARYEPPPGPPPHYPSWSSHHPTQAAAPPPVVVPRYYGGAAGSLSQPINGSPVPAAALWRVPAVTVAAAAPLVRQERPAPLSLGGGRGEDAMAGARKGNVAAGHGGSRSSSSSSTSSQHERRRAGAAAAAENRENVSLDLTL

SEQ ID NO: 5191 - DNA, 2049 bp, Sorghum bicolor
  misc_feature: Ceres ANNOT ID no. 6042034
  misc_feature: Encodes the peptide sequence at SEQ ID NO 5192
atgtcgctcctgcggcggcggaagcagccgcagccgccgccgccgccctcggacggcgacgggtccgaccacgacgacagcgacaaggggaagaagccgtcctcgtcctcgtcctccgcgccgccgtccaaggaggccacgaggcggaccaaggccaagtggtcgtgcgtggacagctgctgctggctggtcgggtgcgtgtgctccgcctggtggctgctgctctttctctacaacgcgatgccggcctcgttcccgcagtatgtcacggaggccatcacggggccgctcccggaccctcccggggtcaagctgcagaaggaggggctccgtgttaagcaccccgtcgtcttcgtccccggcatcgtcaccggagggctcgagctatgggagggccaccagtgcgccgaggggctcttccgcaagcggctatggggcggcacatttggtgacgtatacaagagacctctatgctgggttgaacatatgtctttggacaacgaaacaggattagacaaacctggaataagggttaggccagtcacaggccttgttgcagcagactatttcgttcctggatattttgtttgggctgtcttaattgccaatttagctcgtattggatatgaagaaaagaccatgtacatggctgcatatgattggaggttatctttccagaacactgaggttcgtgatcaaactttgagcagaataaagagcaacattgaactcatggtagcaacaaatggtggaaatagggtggtagtgatcccgcactccatgggggtcctctattttctgcattttatgaaatgggttgaagcacctcctcccatgggaggcggcggcggtccaaactggtgtgagaagcatattaaagctgtaatgaatattggtggacctttcttaggagttcccaaggcagttgctgggcttttctcatctgaagccaaagatgttgccgttgctagagctattgctcctgatgttctggactccgattttcttgggctccaaactttgcgccatttgatgcgtatgacccgaacatgggattcgacaatgtcaatgattcctaaaggtggtgatacaatttggggaaatctggattggtctccagaagatggccttgaatgtaaagctaagaagcacaaaaccaatgataccgaggtttctaaggatagcaatggggaaaatgtcgaagttcaacctgagcctattaactatggaaggctggtatcctttggtaaagatgtagcggaagcaccttcttcagagattgagcagatagaatttcgtgatgctgttaaaggtaatagtattgcccattcaaatacttcatgccgggagatctggacagaatatcatgaattaggatggggtggaataaaggcagttgaggactacaaagtttacactgctagttctgttatagacctccttcacttcgttgctccaaggatgatgcagcgtggaaatgtccacttctcatatggaattgctgataacttggatgatccgaaataccaacattacaaatattggtcaaaccccttggaaacaaagctaccgaatgctcctgacatggaaatattttcgatgtacggagtaggcattcctaccgaaagggcatatgtctataaggttgccccgcaggcagagtgtaatatacctttccggattgactcctcggctgaaggtggggaggaaaatagctgcttgaaagggggtgtttacttagctgatggtgatgaaactgttccagttcttagtgcgggctacatgtgtgcaaaaggatggcgtggcaaaactcgtttcaaccctgccggcagcaagacttacgtgagagaatacagccattcaccaccctcgactctcctggaaggcaggggcactcagagcggtgcacatgttgatataatggggaactttgctctgattgaggacatcatcagaatagctgctggggcaaccggtgaggaaattggtggcgaccaggtttattcagatatattcaaatggtcagagaagatcaaattgaaattgtaa

SEQ ID NO: 5192 - protein, 682 aa, Sorghum bicolor
  misc_feature: Ceres ANNOT ID no. 6042034
  misc_feature (126)..(644): Pfam Id: LACT Pfam Desc: Lecithin:cholesterol acyltransferase
  misc_feature (1)..(682): NCBI GI: 37785695 NCBI Desc: lecithine cholesterol acyltransferase-like protein [medicago truncatula]
  misc_feature (163)..(682): NCBI GI: 37724553 NCBI Desc: lecithine cholesterol acyltransferase-like protein [arabidopsis thaliana]
  misc_feature (102)..(377): NCBI GI: 44984229 NCBI Desc: afl179cp [eremothecium gossypii]
  misc_feature (102)..(377): NCBI GI: 45198342 NCBI Desc: afl179cp [eremothecium gossypii]
  misc_feature (102)..(363): NCBI GI: 4176531 NCBI Desc: spbc776.14 [schizosaccharomyces pombe]
MSLLRRRKQPQPPPPPSDGDGSDHDDSDKGKKPSSSSSSAPPSKEATRRTKAKWSCVDSCCWLVGCVCSAWWLLLFLYNAMPASFPQYVTEAITGPLPDPPGVKLQKEGLRVKHPVVFVPGIVTGGLELWEGHQCAEGLFRKRLWGGTFGDVYKRPLCWVEHMSLDNETGLDKPGIRVRPVTGLVAADYFVPGYFVWAVLIANLARIGYEEKTMYMAAYDWRLSFQNTEVRDQTLSRIKSNIELMVATNGGNRVVVIPHSMGVLYFLHFMKWVEAPPPMGGGGGPNWCEKHIKAVMNIGGPFLGVPKAVAGLFSSEAKDVAVARAIAPDVLDSDFLGLQTLRHLMRMTRTWDSTMSMIPKGGDTIWGNLDWSPEDGLECKAKKHKTNDTEVSKDSNGENVEVQPEPINYGRLVSFGKDVAEAPSSEIEQIEFRDAVKGNSIAHSNTSCREIWTEYHELGWGGIKAVEDYKVYTASSVIDLLHFVAPRMMQRGNVHFSYGIADNLDDPKYQHYKYWSNPLETKLPNAPDMEIFSMYGVGIPTERAYVYKVAPQAECNIPFRIDSSAEGGEENSCLKGGVYLADGDETVPVLSAGYMCAKGWRGKTRFNPAGSKTYVREYSHSPPSTLLEGRGTQSGAHVDIMGNFALIEDIIRIAAGATGEEIGGDQVYSDIFKWSEKIKLKL

SEQ ID NO: 5193 - DNA, 678 bp, Sorghum bicolor
  misc_feature: Ceres ANNOT ID no. 6042040
  misc_feature: Encodes the peptide sequence at SEQ ID NO 5194
atgccccccgtcaaatggttgatgcactggcacccgagccccggggcgacgatcaacagccagatcctctcggaggcgtgtggctgcgcggagtccctcggcggctccaaggacgggaagtggaagacctccatcttcttctaccgcgccatgacccgggacggctcggggggccccgcggggcagcagcaccccgacttgcctagggagctcctcggcgtcgcgctccacgagcgcccggggctctacttctccatcgtccgcgcccagcgcctcgtcctccaggccgatgcagcgttcccccaggtcatggagaagctccagtcctacagaatccgcgtcgccctcaactttgaggggtttcagtatcaactgggtgatttctgcctgaggataggaaaatgtgttcctaataattctgaagcactgagaggaatcatgatggaggtagagtattatcccttatcttccattgaaaaatccaaggcagtcatggaggacttctttgacatatggcaggaaacaattgggaagaagtcattacctggtcaattcattcatgtagactcgaacttttcagattatggtctttcagatcaatattcttttcaacatactgcagttcaatatgcaacttgcttgcagcagctcatggctgcagtaacagtcagggcctag

SEQ ID NO: 5194 - protein, 225 aa, Sorghum bicolor
  misc_feature: Ceres ANNOT ID no. 6042040
  misc_feature (1)..(216): Pfam Id: TATA_RF Pfam Desc: TATA-binding related factor (TRF)
MPPVKWLMHWHPSPGATINSQILSEACGCAESLGGSKDGKWKTSIFFYRAMTRDGSGGPAGQQHPDLPRELLGVALHERPGLYFSIVRAQRLVLQADAAFPQVMEKLQSYRIRVALNFEGFQYQLGDFCLRIGKCVPNNSEALRGIMMEVEYYPLSSIEKSKAVMEDFFDIWQETIGKKSLPGQFIHVDSNFSDYGLSDQYSFQHTAVQYATCLQQLMAAVTVRA

SEQ ID NO: 5195 - DNA, 918 bp, Sorghum bicolor
  misc_feature: Ceres ANNOT ID no. 6042045
  misc_feature: Encodes the peptide sequence at SEQ ID NO 5196
atgcctccccacaacattgaaaccgggcaccaggacgtggtgcacgatgtcgccatggattactacgggaagcgcatcgcgacggcctcctcggacaacaccataaagatcgtcggcgtcagtggcacctcgcaccagcagctggccaccctgagcgggcaccaggggccggtctggcaggttgtgtgggcacaccccaagtttggctccatgctcgcgtcctgcggctacgatggctgtgtgatcatatggaaggaagggggcaggcctgacgagtgggttcaggctcatacattcaccgagcacaagtcctccgtcaactccattgcttgggcgccccatgagcttgggctatgcttggcgtgtggttcttctgacgggaacatttcggtgtttactgcgcgtgctgatggaatttgggacactacacgcattgatcaggcgcatccagtgggggtgacttcggtgtcttgggctccagcaatggcccctggcgctctgatcactgctggaccttctggtcagtttgagtatgtccagaaactcgcatctggtggctgtgacaacactgttaaagtatggaagctgcagaatggaagttggaggatggattgcttccctgcccttcagatgcacaaggactgggtgagggatgtggcctgggctccaaacctcggccttccaaagtctaccattgctagtgcatctcaggatggaactgttgtgatctggactgaggcgaaggaaggtgagcaatgggtaggcagggttttgcatgacttcaaaacccccgtgtggaggctgtcatggtcgcttactgggaatattctggctgcttctgatggtaataacaatgtgaccttgtggaaggaagctgttgatggtgagtggcagcaagtgacgactgttgaaccataa

SEQ ID NO: 5196 - protein, 305 aa, Sorghum bicolor
  misc_feature: Ceres ANNOT ID no. 6042045
  misc_feature (1)..(39): Pfam Id: WD40 Pfam Desc: WD domain, G-beta repeat
  misc_feature (45)..(85): Pfam Id: WD40 Pfam Desc: WD domain, G-beta repeat
  misc_feature (93)..(133): Pfam Id: WD40 Pfam Desc: WD domain, G-beta repeat
  misc_feature (140)..(195): Pfam Id: WD40 Pfam Desc: WD domain, G-beta repeat
  misc_feature (203)..(245): Pfam Id: WD40 Pfam Desc: WD domain, G-beta repeat
  misc_feature (1)..(304): NCBI GI: 18147582 NCBI Desc: sec13p [oryza sativa]
  misc_feature (1)..(304): NCBI GI: 83283979 NCBI Desc: protein transport sec13-like protein [solanum tuberosum]
  misc_feature (4)..(303): NCBI GI: 12805321 NCBI Desc: sec13l1 protein [mus musculus]
  misc_feature (4)..(303): NCBI GI: 54261633 NCBI Desc: sec13-like 1 [rattus norvegicus]
  misc_feature (4)..(303): NCBI GI: 52632407 NCBI Desc: sec13-like 1, isoform a [homo sapiens]
  misc_feature: The sequence is a functional homolog of SEQ ID NO. 485 in the 11/188,298 US application
  misc_feature: The sequence is a functional homolog of SEQ ID NO. 502 in the 11/188,298 US application
MPPHNIETGHQDVVHDVAMDYYGKRIATASSDNTIKIVGVSGTSHQQLATLSGHQGPVWQVVWAHPKFGSMLASCGYDGCVIIWKEGGRPDEWVQAHTFTEHKSSVNSIAWAPHELGLCLACGSSDGNISVFTARADGIWDTTRIDQAHPVGVTSVSWAPAMAPGALITAGPSGQFEYVQKLASGGCDNTVKVWKLQNGSWRMDCFPALQMHKDWVRDVAWAPNLGLPKSTIASASQDGTVVIWTEAKEGEQWVGRVLHDFKTPVWRLSWSLTGNILAASDGNNNVTLWKEAVDGEWQQVTTVEP

SEQ ID NO: 5197 - DNA, 1530 bp, Sorghum bicolor
  misc_feature: Ceres ANNOT ID no. 6042075
  misc_feature: Encodes the peptide sequence at SEQ ID NO 5198
  misc_feature: Up-regulated in shoot tissues in response to methyl jasmonate treatment
  misc_feature: Up-regulated in shoot tissues in response to salicylic acid treatment
atgggggccttcgcgaaggaggagcaccagttcctcgccgagctcggcctcgcgcagcgcaacccgggcgcgttcgtatgcggcgcgtggggcggctcgggccccgccgtcacctccaccagcccgaccaacaaccaggtcatcgcggaggtcgtggaggcgtccgtgcaggactatgaggagggcatgcgcgcctgcttcgatgccgccaagacatggatggcgtttcctgctccgaagcgaggagagattgttaggcaaatcggtgacgcactgagagcaaagctccatcaccttggcaggcttgtgtcacttgagatggggaaaattcttcctgaagggatcggtgaggttcaggaaatcatcgacatgtgtgattatgctgtggggctaagtcgccaactaaatggatccattataccatctgaacgaccaaaccatatgatgatggaggtgtggaatccccttggagttgtgggtgttataacggcatttaattttccttgcgctgtgcttggttggaatgcttgcattgctttggtctgtggaaactgtgttgtctggaaaggtgccccaacgactccactgatcactattgcaatgactaaaatagtggctagcgtattggagaagaacaatttgccaggcgcaattttcacatccttttgtggtggcactgaaattggtcaagcaattgccgttgacactaggatacctttggtttcattcactggaagtacaagggctggtctgatggttcaacaacaagttaatgcaagatttggtaaatgccttcttgaacttagcggaaacaatgccatcattgttatggatgacgcagatatccagctagctgtgcgttctgtcttgtttgctgctgtcggtacagcaggacaacgctgcactacatgccgtaggctgattcttcatgaaagcatatatcaaactttccttgatcaacttgttgaggtatacaaacaagtccgaattggggatccgttggagaagggcaccttactgggaccactgcacactcctgcttcaaaagagaactttttgaaaggcgttcaaaccattaaatctcagggagggaaaatcctttttggaggatctgccattgaatcagaaggaaacttcgtgcaaccaacaattgtggaaattacaccttctgcagcagttgtgaaagaagaactctttggtcctgtcctttatgttatgaaatttcagagcttgaaggaagcaattgaaatcaataactctgttcctcaaggattgagcagttctatatttacaaagaggccagaaattatttttaagtggctcgggccccatggtagtgattgtggtatagtgaatgtgaacatacctactaacggtgctgaaatcggtggagcatttggtggagaaaaggcaactggtggtggacgagaagcagggagtgattcctggaagcagtacatgaggagggcgacttgtacaatcaactatggaagcgagctacctctagcccagggaatcaattttggttaa

SEQ ID NO: 5198 - protein, 509 aa, Sorghum bicolor
  misc_feature: Ceres ANNOT ID no. 6042075
  misc_feature (30)..(491): Pfam Id: Aldedh Pfam Desc: Aldehyde dehydrogenase family
  misc_feature (1)..(509): NCBI GI: 115479375 NCBI Desc: os09g0440300 [oryza sativa (japonica cultivar-group)]
  misc_feature (1)..(509): NCBI GI: 11995457 NCBI Desc: aldehyde dehydrogenase [oryza sativa]
  misc_feature (1)..(509): NCBI GI: 59860157 NCBI Desc: aldehyde dehydrogenase family 7 member a1 [euphorbia characias]
  misc_feature (1)..(509): NCBI GI: 29893325 NCBI Desc: aldehyde dehydrogenase family 7 member a1 [glycine max]
  misc_feature (1)..(491): NCBI GI: 25090053 NCBI Desc: aldehyde dehydrogenase family 7 member a1 (antiquitin 1) (brassica turgor-responsive/drought-induced gene 26 protein) (btg-26)
  misc_feature (1)..(509): SWISSPROT Homolog: EC 1.2.1.3 Aldehyde dehydrogenase family 7 member A1
  misc_feature (8)..(508): SWISSPROT Homolog: EC 1.2.1.31 Alpha-aminoadipic semialdehyde dehydrogenase
  misc_feature: Up-regulated in shoot tissues in response to methyl jasmonate treatment
  misc_feature: Up-regulated in shoot tissues in response to salicylic acid treatment
  misc_feature: The sequence is a functional homolog of SEQ ID NO. 537 in the 11/188,298 US application
  misc_feature: The sequence is a functional homolog of SEQ ID NO. 442 in the 11/188,298 US application
  misc_feature: The sequence is a functional homolog of SEQ ID NO. 304 in the 11/188,298 US application
  misc_feature: The sequence is a functional homolog of SEQ ID NO. 475 in the 11/188,298 US application
  misc_feature: The sequence is a functional homolog of SEQ ID NO. 428 in the 11/188,298 US application
  misc_feature: The sequence is a functional homolog of SEQ ID NO. 437 in the 11/188,298 US application
  misc_feature: The sequence is a functional homolog of SEQ ID NO. 435 in the 11/188,298 US application
  misc_feature: The sequence is a functional homolog of SEQ ID NO. 477 in the 11/188,298 US application
MGAFAKEEHQFLAELGLAQRNPGAFVCGAWGGSGPAVTSTSPTNNQVIAEVVEASVQDYEEGMRACFDAAKTWMAFPAPKRGEIVRQIGDALRAKLHHLGRLVSLEMGKILPEGIGEVQEIIDMCDYAVGLSRQLNGSIIPSERPNHMMMEVWNPLGVVGVITAFNFPCAVLGWNACIALVCGNCVVWKGAPTTPLITIAMTKIVASVLEKNNLPGAIFTSFCGGTEIGQAIAVDTRIPLVSFTGSTRAGLMVQQQVNARFGKCLLELSGNNAIIVMDDADIQLAVRSVLFAAVGTAGQRCTTCRRLILHESIYQTFLDQLVEVYKQVRIGDPLEKGTLLGPLHTPASKENFLKGVQTIKSQGGKILFGGSAIESEGNFVQPTIVEITPSAAVVKEELFGPVLYVMKFQSLKEAIEINNSVPQGLSSSIFTKRPEIIFKWLGPHGSDCGIVNVNIPTNGAEIGGAFGGEKATGGGREAGSDSWKQYMRRATCTINYGSELPLAQGINFG

SEQ ID NO: 5199 - DNA, 1686 bp, Sorghum bicolor
  misc_feature: Ceres ANNOT ID no. 6042076
  misc_feature: Encodes the peptide sequence at SEQ ID NO 5200
atgtcgatgcgtagccgtagcggggtggaggtggtcgccagcagggggtgcgcgcggctggtgatccccgggatgcatcacaacccctcttccgccgcatccgtctcctcctcctcctcctcctccgcggcctcgcgcggggccgccggctgcggcggtgcgggtgcggcggcggcagcagcgcgcgccgatgggcccttcgcaggcctcgtcatctgcgtcactgggctgtccaaagaggcgagggttcaggtgaaggaggcgacggagcggctcgggggcgagtacagcgggagcttgcaccccaagtgcacgcacctcgtccacagctttgccgggcgcaagttcgagcatgcactgaagcatggtccgaggaacgggctattcctcgttacgctgggttggtttgttgactgcgtgcggaggaacatgaggttggatgaatccttgtttgccatcaaaagcattggggagaatggtgtgccgctcggggatttcaaccgccttgttggagtccctgttaacgagaagtcttgccttccaccactgatatttcaggacaaggcatgctcagatatgacccggaagcattcgctccagactcctggaaaagaaggtggtcatgatgggttggtttttatgaatgacacagtctacattgaccctgcgatatctgatgagatgaggaaaaagatttctgatgctgctacgagagaaggtgcaaagttgctggagcactggtttattggctgccctgccacgtatattgtctgtgaggatgcttctgttaagagatatgtaggccactcagataacattgtaactccactttggatcttgaaaacagtgaaggagaaaaacttgcagcgccttgtccatttgtcttccgacctagctaggcatgttgccatggttctggaaaatgtccagacatctgaagagaataggaaacttggaagtgttccttctataagcacaagctcctgtggtcgtccatcaacccaagaggagattgatgaagtccatcaagagagacaaaagtttgttgaagtggcaaagaaagaagttcgagaccgccgtgctcgtcgaatgcagtcatgtgaagtacccattcacccgatcactccggccacgcttctggattcaatctgctggacaatctctgagccagcttcatctgcgtcaatttatatggattcttcatggtccgatgatgccaatgagcagcaaagcaccacttacttcgatgcaaatggggatgtgagggatccagatcaaacaactgataatctttcccgtccactgaaagaaagtgagcgaagtgacctgatcttcaagaatcacttccttaccatactcttccctattgatcgttttggagaggttggaccttcctcaaagacgttttataacaatggtggctttacgtgcatacaagtactggatcacatctacaacttctatcaggagaacatgtcaaccaacgagatagacatggccttgcatacagattcccggcatgccgatcgacttcgatctttgtattcaactgttgaatcagtagagaaaggacttgtagcttttaaaagaatagactttttaggaagcagaagaagttttgaggcactaaagcgcatcaacagggaaaataatagcaatgtatatgaacttgtgattagggcatga

SEQ ID NO: 5200 - protein, 561 aa, Sorghum bicolor
  misc_feature: Ceres ANNOT ID no. 6042076
  misc_feature (62)..(140): Pfam Id: BRCT Pfam Desc: BRCA1 C Terminus (BRCT) domain
  misc_feature (63)..(552): NCBI GI: 144923434 NCBI Desc: brct [medicago truncatula]
  misc_feature (67)..(151): NCBI GI: 119599581 NCBI Desc: topoisomerase (dna) ii binding protein 1, isoform cra_c [homo sapiens]
  misc_feature (67)..(151): NCBI GI: 5902138 NCBI Desc: topoisomerase (dna) ii binding protein 1 [homo sapiens]
  misc_feature (67)..(151): NCBI GI: 133778287 NCBI Desc: topoisomerase (dna) ii binding protein 1 [homo sapiens]
  misc_feature (67)..(151): NCBI GI: 62901464 NCBI Desc: dna topoisomerase ii binding protein 1 (dna topoisomerase iibeta-binding protein 1) (topbp1)
MSMRSRSGVEVVASRGCARLVIPGMHHNPSSAASVSSSSSSSAASRGAAGCGGAGAAAAAARADGPFAGLVICVTGLSKEARVQVKEATERLGGEYSGSLHPKCTHLVHSFAGRKFEHALKHGPRNGLFLVTLGWFVDCVRRNMRLDESLFAIKSIGENGVPLGDFNRLVGVPVNEKSCLPPLIFQDKACSDMTRKHSLQTPGKEGGHDGLVFMNDTVYIDPAISDEMRKKISDAATREGAKLLEHWFIGCPATYIVCEDASVKRYVGHSDNIVTPLWILKTVKEKNLQRLVHLSSDLARHVAMVLENVQTSEENRKLGSVPSISTSSCGRPSTQEEIDEVHQERQKFVEVAKKEVRDRRARRMQSCEVPIHPITPATLLDSICWTISEPASSASIYMDSSWSDDANEQQSTTYFDANGDVRDPDQTTDNLSRPLKESERSDLIFKNHFLTILFPIDRFGEVGPSSKTFYNNGGFTCIQVLDHIYNFYQENMSTNEIDMALHTDSRHADRLRSLYSTVESVEKGLVAFKRIDFLGSRRSFEALKRINRENNSNVYELVIRA

SEQ ID NO: 5201 - DNA, 831 bp, Sorghum bicolor
  misc_feature: Ceres ANNOT ID no. 6042082
  misc_feature: Encodes the peptide sequence at SEQ ID NO 5202
atggctctgccgtccgccggctcgttcgcggcatgcagcctccagccaagcagggttagcattcgggcgtgccatgccccgaggccgccgccacacctgcagccgggtgcggctgcggcggtatcgtctgcgaggacgcggcagcagcgccgggcgaacgcgaccaagggtggagtgtccaccgtgtgcgagccgctgggccccgaccggccggtctggttccccggcaaacccgctccgccgtggctcgacggcagccttccaggagactttggatttgaccctctcggactaggttcggatccggagtcgctgcggtggttcgcgcaggcggagctgatgcacgggcggtgggcgatgctggcggcggcggggatcctgatcccggacctgctggcgcggtggggcttcatcgacgccggctactcgtggttcgacgccgggtcccgcgagtacttcgcggacccgtggacgctcttcatctcgcagatggcgctgatggggtgggcggagagccggcggtgggcggacatcctcaagcccggctgcgtcgacatcgagccgcgcttccccaaccgcaagaaccccgtcccggacgtcgggtaccccggcggcatttggttcgactgggccaactggggccgcgggtccccggagcccgtcatggtgctgcgcaccaaggagatcaagaacggccgcctcgccatgctcgccttcgtcggcttctggttccaggccgtgtacaccggccagggccccatcgacaacctcctcgcgcacctcgccgaccccggccactgcaacatcttctcggcgttcacgtcccactga

SEQ ID NO: 5202 - protein, 276 aa, Sorghum bicolor
  misc_feature: Ceres ANNOT ID no. 6042082
  misc_feature (78)..(247): Pfam Id: Chloroa_b-bind Pfam Desc: Chlorophyll A-B binding protein
  misc_feature (8)..(271): NCBI GI: 8954053 NCBI Desc: contains similarity to a chlorophyll a/b-binding protein type ii from arabidopsis thaliana gis46295 and contains a chlorophyll a-b binding proteins pf00504 domain
  misc_feature (8)..(276): NCBI GI: 541565 NCBI Desc: psi type ii chlorophyll a/b-binding protein
  misc_feature (10)..(274): NCBI GI: 602359 NCBI Desc: type ii chlorophyll a/b binding protein from photosystem i [pisum sativum]
  misc_feature (38)..(274): NCBI GI: 19180 NCBI Desc: chlorophyll a/b-binding protein [lycopersicon esculentum]
  misc_feature (36)..(275): NCBI GI: 20792 NCBI Desc: type ii chlorophyll a /b-binding protein [pinus sylvestris]
  misc_feature: Useful for making plants with modulated oxidative stress sensitivity
  misc_feature: GREAT-hit functional homolog of the protein sequence given in SEQ ID NO 13028
  misc_feature: Useful for making plants with modulated oxidative stress sensitivity
  misc_feature: Functional homolog of the protein sequence given in SEQ ID NO 13028
MALPSAGSFAACSLQPSRVSIRACHAPRPPPHLQPGAAAAVSSARTRQQRRANATKGGVSTVCEPLGPDRPVWFPGKPAPPWLDGSLPGDFGFDPLGLGSDPESLRWFAQAELMHGRWAMLAAAGILIPDLLARWGFIDAGYSWFDAGSREYFADPWTLFISQMALMGWAESRRWADILKPGCVDIEPRFPNRKNPVPDVGYPGGIWFDWANWGRGSPEPVMVLRTKEIKNGRLAMLAFVGFWFQAVYTGQGPIDNLLAHLADPGHCNIFSAFTSH

SEQ ID NO: 5203 - DNA, 1557 bp, Sorghum bicolor
  misc_feature: Ceres ANNOT ID no. 6042083
  misc_feature: Encodes the peptide sequence at SEQ ID NO 5204
atgctggagaccgccgccgccgcctcctccccccgcgccgcggccgcggcagtcgccgctggggcggccgcggtcgtttcctccccgcggcggggcggaggcgccgcgcaccaccaccggcggtggggcccgtcctcgatcagggcttaccatctcctgctcgcgttctggctggtgggcttcgcgctcgtcgtcgtgtggcagaccacctccgcgggccgcgtgcggctctacacgcgcccgccgatgcccaagcgcgccgcggcgtctttgtctttggggcagtgggtggcctccccgcccgtctacgatctgagggagtttggggcagtcggggacgggcggacggttaacacagctgcgttcgagtctgccatcgcggccatcgctgagaggggcgggggcaggctcaccgttccagccgggcggtggctcacagcgccgttcaacctcaccagccacatgattctcttccttgccgctggtgctgagatcctagggattcaggatgaaagatattggccattaatgtctccattaccatcatacggctatggaagagagcacaagggacctcgatatgggagccttatacatggccaagacctgaaggatgtgactataacaggtcataatggtaccataaatggacaaggtcaaagttggtgggtaaaatttcggagaaaactccttaatcacacaaggggtcctctggtgcagctcatgcgatcaagtgacattatcatttctaatatcactcttcgtgattctcccttctggactcttcacacgtatgactgcaagaatgttactatatcagaaaccaccatcttggctccaattgctggagctccaaatactgatggaatagatccagattcttgtgaaaatgtggtgataaaaaattgttacatttctgttggtgatgatgggatagccataaagagtggttgggatcaatatggaattgcttatggtcgtccatctgctaacattgttattcagaatgtcgtaatccgctctatggtcagtgctggagtatcgattggaagcgagatgtctggtggtgtctcggatgttttggtagagaatgttcatgtctgggattcacggcgaggcgtgaggataaagactgcgcctggaagaggggcctatgtaaccaacatcgtgtaccggaacataaccttggaaaatgtacgtgtcggtatagtgataaagacagactacaacgagcacccagacgaaggcttcgacccaaaggctgtccccaccatcgggaatatttcttacacatcaatccatgggcatcgtgtgcgagtaccggtcaggatacagggaagcgcagagatccctgtgaagaatgttaccttccatgacatgtcaatcggtatagtagacaagaagcaccatgttttccagtgctccttcgtccaggggcaggtcattggctatgttttccctgtgccttgcaagaacctggacctgtatgacgagcggcgtgagctggttaaacaatcaacgttacagaatatctctgatatcgactacagtttttga

SEQ ID NO: 5204 - protein, 518 aa, Sorghum bicolor
  misc_feature: Ceres ANNOT ID no. 6042083
  misc_feature (130)..(490): Pfam Id: Glyco_hydro_28 Pfam Desc: Glycosyl hydrolases family 28
  misc_feature (293)..(518): NCBI GI: 92891796 NCBI Desc: glycoside hydrolase, family 28 [medicago truncatula]
  misc_feature (52)..(516): NCBI GI: 7529266 NCBI Desc: polygalacturonase-like protein [arabidopsis thaliana]
  misc_feature (52)..(516): NCBI GI: 23506093 NCBI Desc: at3g42950/f18p9_110 [arabidopsis thaliana]
  misc_feature (45)..(516): NCBI GI: 15221958 NCBI Desc: glycoside hydrolase family 28 protein / polygalacturonase (pectinase) family protein [arabidopsis thaliana]
  misc_feature (169)..(516): NCBI GI: 8954055 NCBI Desc: contains similarity to a polygalacturonase-like protein gi7529266 from arabidopsis thaliana bac f18p9 gbal138654 and contains multiple polygalacturonase (pectinase) pf00295
  misc_feature (169)..(516): NCBI GI: 8954055 (continued) domains
  misc_feature: Useful for making plants with altered cell wall content and/or composition
  misc_feature: Functional homolog of the protein sequence encoded by LOCUS at3g42950
  misc_feature: Useful for making plants with altered cell wall content and/or composition
  misc_feature: Functional homolog of the protein sequence given in SEQ ID NO 13906
  misc_feature: Useful for making plants with altered carbohydrate content
  misc_feature: Functional homolog of the protein sequence given in SEQ ID NO 13716
  misc_feature: The sequence is a functional homolog of SEQ ID NO. 450 in the 11/188,298 US application
MLETAAAASSPRAAAAAVAAGAAAVVSSPRRGGGAAHHHRRWGPSSIRAYHLLLAFWLVGFALVVVWQTTSAGRVRLYTRPPMPKRAAASLSLGQWVASPPVYDLREFGAVGDGRTVNTAAFESAIAAIAERGGGRLTVPAGRWLTAPFNLTSHMILFLAAGAEILGIQDERYWPLMSPLPSYGYGREHKGPRYGSLIHGQDLKDVTITGHNGTINGQGQSWWVKFRRKLLNHTRGPLVQLMRSSDIIISNITLRDSPFWTLHTYDCKNVTISETTILAPIAGAPNTDGIDPDSCENVVIKNCYISVGDDGIAIKSGWDQYGIAYGRPSANIVIQNVVIRSMVSAGVSIGSEMSGGVSDVLVENVHVWDSRRGVRIKTAPGRGAYVTNIVYRNITLENVRVGIVIKTDYNEHPDEGFDPKAVPTIGNISYTSIHGHRVRVPVRIQGSAEIPVKNVTFHDMSIGIVDKKHHVFQCSFVQGQVIGYVFPVPCKNLDLYDERRELVKQSTLQNISDIDYSF

SEQ ID NO: 5205 - DNA, 2847 bp, Sorghum bicolor
  misc_feature: Ceres ANNOT ID no. 6042086
  misc_feature: Encodes the peptide sequence at SEQ ID NO 5206
atggcggcgagtggcaagctctcggcgaagccctccccgtcgccgacggtcgctcccgcctcgcgccccaaattcacagccgttaccttcctcggtgactgtgacgacgacgacgacttccaacctcctcgcccccgcccattgaagccttgcaatggcgccgccgcacttcggctccgcaagaagctcaaggcttcatcctcctccgcttcctccgggaaggagaacagttccgccgccggtggtgccgttgctgcggtggggatcgcctcgacagccgcgaaggatgccggaaccctagccacctgctcaagggttagtggcggcgttcccaaatcgaagaaacgaaaggccggagaaatttgcggcctctcgaggtacggatctgatagcaccaaactaagttgtaaaccgaagataggattggatagatatggatatggcaaagggagctccagttccttgcccaattcgttagaatcgagggttttggcgctcggtgcggtatgtgatttgggagttgggcgctgtgaggtggctcaagtagctggtaccttagttcttgaggaggggcacgccacagaggagctggctggctctgagtgtgatcctccaaaaacggagaagaagctgggcagttctggagctgtagagggacattatgactccaggttgattgaaccggggcttattgaatcagatgcaaaccgggagtctgtaactgcttgttcatatgattcagaagtgcttgattcagggattcttggctcactgactgataaacaggacacgaagaaagcaaacggggtggcatctgaatgtggttttgggcttcagaacgggaactatcacttgcattctctacagtcagagctcctaatgtcgaacgcaaagtatgattctagggtttttgctagcaatgaaatccaagagcctggtttgggagctggtaacttgatttcacaagagaggaacgtagcagcaggacattctgcatgtacaacccctgaaaatgtgactatggagaataaatcaagtgagcatgaggcttgtaaggggaagtgccgctctaattcatctgaatcaaagcttcaagaatcccatatgatccatgactttgaagttgatggttgtgatgatttcgagattgggacacagctcagtgagctcattaacttgtgtatgaaggattccatagagggacagttaaactttagtgcatctcccatggaacagaacacattggattctaagcgactcggttcagactatgaagtgaaatgccctctctgtggatcggatatatctgatttaagcgaggagctccggcagctgcatactaacaattgtcttgacgaaccagctaaggaatctagtcccaaccataaaaaagagccctgtgctggacaaaatgttgaaactggacgtgttgtcgaatggttaagaaaccttgggttatccaagtatgaggaggtttttatcagagaagaagttgactgggaaaccttgcagtggctcactgaagaggatctgttgggtatcgggatcacctctcttggaccaagaaagaaaattatccatgctctaggagagttacggaagaaacatgacgatccctgtgaagtggaagatgtcgtgttaaattcagaaaatactaagaagactaaacttccgatgaatggtaataaattaattactgaatactttcaatgttcctcatttgatcaaagacaaagaagggtatgcaaagtcaacaagccatctaatctgaacgagaagaaaatttctagtgctaaaatacccactagaagaagtgctggtaaaggaaaggttaaagatacacctctttggtgttgcatcccagggaccccttttcgagtggatgcatttcgctacttgagaggcgattgttcccactggtttctcacacacttccatgtggatcattatcaaggcttgactagaagcttttgtcatgggaagatatactgttcgtcaattacagcaagtcttgtgcatcataagattggtatcccatgggatagattgcatgtattgaccctaaatgaaaagctcactattggtggagttagtttgacatgttttgatgccaatcattgccctggatcaatcattattctctttgagcctcccaacggtaaagctgttttgcacaccggagacttccggttttcttccgagatggccaacaatcctgttttgcagtcttctcatatccacactctaatacttgacacaacctattgcaatccacggtatgacttcccaagtcaagagattgtaatacagttcgttatcgaggccatccaagcagaagctttcaatccaaaaacattgtttttgattggtagctacacaattggaaaagaaagactgtttatggaggttgctcgtttgcttcagaagaaaatatatgttggagctgcaaagctgcaaatattgaaacatttagagcttcctcaggagattatgcactggtttacagccaatgaagcagaaagtcacatacatgttgtccccatgtggactctagcaagcttcaagcggatgaaatatttatcaaatcaatatgccggccagtttgacctcatagtggcgttttgtcctactggttgggcatttggcaaaggtaggaaaaagacaccaggcaaaaggtggcaacaaggatcaatcatcagatacgaagtgccctacagtgaacacagcagtttcacggaactgcaagaatttgtcaagttcatatcaccagagcacataatccctagtgtgaacaacgatggccctgagagtgcagatgctatgcttgcccagctgttaaacgagtag

SEQ ID NO: 5206 - protein, 948 aa, Sorghum bicolor
  misc_feature: Ceres ANNOT ID no. 6042086
  misc_feature (833)..(931): Pfam Id: DRMBL Pfam Desc: DNA repair metallo-beta-lactamase
  misc_feature (470)..(533): Pfam Id: SAM_1 Pfam Desc: SAM domain (Sterile alpha motif)
  misc_feature (469)..(535): Pfam Id: SAM_2 Pfam Desc: SAM domain (Sterile alpha motif)
  misc_feature (11)..(948): NCBI GI: 115479355 NCBI Desc: os09g0439000 [oryza sativa (japonica cultivar-group)]
  misc_feature (587)..(941): NCBI GI: 1495267 NCBI Desc: orf12 [arabidopsis thaliana]
  misc_feature (548)..(943): NCBI GI: 38345210 NCBI Desc: osjnbb0012e08.8 [oryza sativa (japonica cultivar-group)]
  misc_feature (548)..(943): NCBI GI: 116309317 NCBI Desc: osigba0155k12.7 [oryza sativa (indica cultivar-group)]
  misc_feature (605)..(941): NCBI GI: 73620752 NCBI Desc: dna cross-link repair 1a protein
  misc_feature: Useful for making plants with altered sterol content
  misc_feature: Useful for making plants with modulated low light sensitivity
  misc_feature: Useful for making plants with modulated seed size
  misc_feature: Useful for making plants with modulated nitrogen use efficiency
  misc_feature: GREAT-hit functional homolog of the protein sequence given in SEQ ID NO 13481
  misc_feature: GREAT-hit functional homolog of the protein sequence given in SEQ ID NO 13504
  misc_feature: GREAT-hit functional homolog of the protein sequence given in SEQ ID NO 13505
  misc_feature: Useful for making plants with modulated low light sensitivity
  misc_feature: Useful for making plants with modulated nitrogen use efficiency
  misc_feature: Functional homolog of the protein sequence given in SEQ ID NO 13505
MAASGKLSAKPSPSPTVAPASRPKFTAVTFLGDCDDDDDFQPPRPRPLKPCNGAAALRLRKKLKASSSSASSGKENSSAAGGAVAAVGIASTAAKDAGTLATCSRVSGGVPKSKKRKAGEICGLSRYGSDSTKLSCKPKIGLDRYGYGKGSSSSLPNSLESRVLALGAVCDLGVGRCEVAQVAGTLVLEEGHATEELAGSECDPPKTEKKLGSSGAVEGHYDSRLIEPGLIESDANRESVTACSYDSEVLDSGILGSLTDKQDTKKANGVASECGFGLQNGNYHLHSLQSELLMSNAKYDSRVFASNEIQEPGLGAGNLISQERNVAAGHSACTTPENVTMENKSSEHEACKGKCRSNSSESKLQESHMIHDFEVDGCDDFEIGTQLSELINLCMKDSIEGQLNFSASPMEQNTLDSKRLGSDYEVKCPLCGSDISDLSEELRQLHTNNCLDEPAKESSPNHKKEPCAGQNVETGRVVEWLRNLGLSKYEEVFIREEVDWETLQWLTEEDLLGIGITSLGPRKKIIHALGELRKKHDDPCEVEDVVLNSENTKKTKLPMNGNKLITEYFQCSSFDQRQRRVCKVNKPSNLNEKKISSAKIPTRRSAGKGKVKDTPLWCCIPGTPFRVDAFRYLRGDCSHWFLTHFHVDHYQGLTRSFCHGKIYCSSITASLVHHKIGIPWDRLHVLTLNEKLTIGGVSLTCFDANHCPGSIIILFEPPNGKAVLHTGDFRFSSEMANNPVLQSSHIHTLILDTTYCNPRYDFPSQEIVIQFVIEAIQAEAFNPKTLFLIGSYTIGKERLFMEVARLLQKKIYVGAAKLQILKHLELPQEIMHWFTANEAESHIHVVPMWTLASFKRMKYLSNQYAGQFDLIVAFCPTGWAFGKGRKKTPGKRWQQGSIIRYEVPYSEHSSFTELQEFVKFISPEHIIPSVNNDGPESADAMLAQLLNE

SEQ ID NO: 5207 - DNA, 774 bp, Sorghum bicolor
  misc_feature: Ceres ANNOT ID no. 6042087
  misc_feature: Encodes the peptide sequence at SEQ ID NO 5208
atggcgtcggtgcagctgtctgggccgcgggtggtggcggctgcgaaaccagctacggtgggcgggctcctcctgacgccgtcccttgcggtgccaacggggcggagggccagggggctcgtggtgagggccgccacggtcgtgtcacccaagtatacttccataaaaccattgggagacagagtacttgtgaagatcaagacatctgaggctaaatctgagggagggattttacttccagtatcagttcagacaagaccacaaggaggggaagttgttgcggttggagaagggagaagtttcggaagtaacagcattgagatcagtgttccggttggtgcacaagttgtctactcgaaatacgcgggcacagaattgaaattcaatgatgccgaccatctcattttgaaagaggatgacataattggtattctcgacagtgatgatgtgaaggatatgaaaccgctgaatgatcgcattctgattaaggttgctgaagctgaagaacaaactgctggtggtttgctattgacgcaggcgactaaggagaaaccttctgttggaacagtggtagccgttggcccagggccattgggtgaggacggcagcaggaatcccctgcggatcactcctggaagcaacgtgatgtatagcaagtatgcagggagtgagttcaagggcgaggacggtcagtacatcgtgctcaggtcgtctgacgtcatggctgttcttacctctgattccgaagcatacagcgccatttatgaaatgtag

SEQ ID NO: 5208 - protein, 257 aa, Sorghum bicolor
  misc_feature: Ceres ANNOT ID no. 6042087
  misc_feature (54)..(145): Pfam Id: Cpn10 Pfam Desc: Chaperonin 10 Kd subunit
  misc_feature (152)..(244): Pfam Id: Cpn10 Pfam Desc: Chaperonin 10 Kd subunit
  misc_feature (33)..(245): NCBI GI: 50660327 NCBI Desc: chloroplast chaperonin 21 [vitis vinifera]
  misc_feature (1)..(245): NCBI GI: 21780187 NCBI Desc: cp10-like protein [gossypium hirsutum]
  misc_feature (40)..(245): NCBI GI: 7331143 NCBI Desc: chaperonin 21 precursor [lycopersicon esculentum]
  misc_feature (1)..(245): NCBI GI: 3057150 NCBI Desc: chaperonin 10 [arabidopsis thaliana]
  misc_feature (29)..(245): NCBI GI: 92891804 NCBI Desc: groes-like [medicago truncatula]
MASVQLSGPRVVAAAKPATVGGLLLTPSLAVPTGRRARGLVVRAATVVSPKYTSIKPLGDRVLVKIKTSEAKSEGGILLPVSVQTRPQGGEVVAVGEGRSFGSNSIEISVPVGAQVVYSKYAGTELKFNDADHLILKEDDIIGILDSDDVKDMKPLNDRILIKVAEAEEQTAGGLLLTQATKEKPSVGTVVAVGPGPLGEDGSRNPLRITPGSNVMYSKYAGSEFKGEDGQYIVLRSSDVMAVLTSDSEAYSAIYEM

SEQ ID NO: 5209 - DNA, 1152 bp, Sorghum bicolor
  misc_feature: Ceres ANNOT ID no. 6042090
  misc_feature: Encodes the peptide sequence at SEQ ID NO 5210
atgggatcggagggacgggcctggaacggcgccgccggcagcagcggccatggcggcggcggcggcggcgtagaggcgaaagcgatcaccgcggctctgtcggccgcggaggttcccaggatggcggtctccgtcgacatctcgctgccgctcccggagatgtcgcctgacatcatatatctctgcaagcaattggtcattgggtggtgtaagattgacagctcccgcttctccatcgagaccgtgtccggaggcatcaccaatctattgctcaaggtttctgtcaaagaagacgacggcaatgagtctgctgttactgtccggttgtatggaccgaatacggacttggtgattgatcggaaaagggaattgaaggcgataccgtatctctcagctgcagggttcggggctcagctacttggaatatttgggaatggagtagttcagtcattcatctatgctcgaacactgtcacctgcagctgaaattgccaaggagctacataaattccatcaagtagacataccagggtctaaacaaccgcaattgtggaatgatatattcaagtttttgaagaaagctgcagcattgaagtttgaggataacgagcagcagaagagatatgaaaagatctcatttagagaaatacaagatgaagttcaagaacttaaggatctcttggacactatgcatgcgcctgtggtttatgcacacaatgacttgctttcaggaaatctgatgctcaatgatttggaagggaagctatattttattgattttgagtatgggtcatacagctaccgtggctatgacattgcaaatcatttcaatgagtatgctggacttgattgtgactataatttgtacccagataaagatgcccagtataacttcttcaggaattatctacgccctgatagacctagtgaggcacaggcacaagatatggaagtactttatgtggaaacaaacactttcagactagcatcgcacatttactgggcattatgggcccttattcaggcaaaggtatccccaattgactttgactatcttggatacttcttcttacggtatggtgagtacaagaaacagagggagccctgcttctccttggcacaaagctttctctccaagccaagaaatgtctag

SEQ ID NO: 5210 - protein, 383 aa, Sorghum bicolor
  misc_feature: Ceres ANNOT ID no. 6042090
  misc_feature (101)..(294): Pfam Id: Choline_kinase Pfam Desc: Choline/ethanolamine kinase
  misc_feature (78)..(313): Pfam Id: APH Pfam Desc: Phosphotransferase enzyme family
  misc_feature (90)..(224): NCBI GI: 115479351 NCBI Desc: os09g0438400 [oryza sativa (japonica cultivar-group)]
  misc_feature (37)..(366): NCBI GI: 14194720 NCBI Desc: ethanolamine kinase (eki)
  misc_feature (37)..(366): NCBI GI: 119616884 NCBI Desc: ethanolamine kinase 1, isoform cra_a [homo sapiens]
  misc_feature (38)..(372): NCBI GI: 56207286 NCBI Desc: novel protein similar to vertebrate ethanolamine kinase 1 (etnk1) [danio rerio]
  misc_feature (23)..(372): NCBI GI: 14603244 NCBI Desc: etnk2 protein [homo sapiens]
MGSEGRAWNGAAGSSGHGGGGGGVEAKAITAALSAAEVPRMAVSVDISLPLPEMSPDIIYLCKQLVIGWCKIDSSRFSIETVSGGITNLLLKVSVKEDDGNESAVTVRLYGPNTDLVIDRKRELKAIPYLSAAGFGAQLLGIFGNGVVQSFIYARTLSPAAEIAKELHKFHQVDIPGSKQPQLWNDIFKFLKKAAALKFEDNEQQKRYEKISFREIQDEVQELKDLLDTMHAPVVYAHNDLLSGNLMLNDLEGKLYFIDFEYGSYSYRGYDIANHFNEYAGLDCDYNLYPDKDAQYNFFRNYLRPDRPSEAQAQDMEVLYVETNTFRLASHIYWALWALIQAKVSPIDFDYLGYFFLRYGEYKKQREPCFSLAQSFLSKPRNV

SEQ ID NO: 5211 - DNA, 2310 bp, Sorghum bicolor
  misc_feature: Ceres ANNOT ID no. 6042135
  misc_feature: Encodes the peptide sequence at SEQ ID NO 5212
atgtctcatcaaatccaaagcttctcgcggaacaactgtgtgcttctcgcggtgctgtgtggcaagtatgctgagaagcgcgcaccagcagcgaggtctgggctggaggcgaaacggccgcggccgtcgtacccgttcccggagctcagctcggctgggagattggaggtccacaccctgttcaatcctacaccggagcagttcctagaggcacagcgggtggtgcagccaaacttcttgtacattcagggtcaacagctcgaggatgagaaggagattggctcacttgtgtggggggacgccgatgtctctgatccgcaggcgtttagcactcttatcagcccaccattcccaacaatagtatatctggaagttcctattggtgaaaaacttgcccaagcagttcactcaaaggggatcccatatgtaatatactggagaaattcattttcgtcttatgccgcatctcattttcgccatgcgttgatgtcagtagttcaaagttcggtgagccatacttgggatgcttttcagcttgctcatgcatccttccgtctatattgtgtaagaaacaatcatgtgcaaagtgttaagcttggccctcgtctccttggggatgctccaaaaataaatataagcccacctgagactgaaatggttgatgaagaaggttcttctgaagtgaccccggctataaaaatatacgatgaagtaatcaacatgaaactacttctatgtggagtgccatgcaacttggatccttgtttattgggctctttagaagacggtctgaatgcacttctgaatattgaaatccgtgggagcaaactgcagaatcgaatcagtgcttctccaccacctctcgaagctgcatctctaccacgtgggatggttactatgcgctgtgatatcactacatgcagtatttcccatgtgtcactccttgtttctggtagcgcacaaacttgttttgatgaccagcttctagagagccacatcaagaatgaaattattgagaagagccagttagtccgtgctctctcaaatagtgaggacaagttaccatcaagcgagcctctaacttccatgtccacggcttgtggggcttctacctttgaagtttggatgtcacttcctaagtgggcagcacaggtcctaaagcatctagcgccagatatacaatacaggagcttggttgcacttggtattggttgtataaatggtactcctgttgcttcctttgagaggcgagatgcagaccgtcttcttttcttttgcacaagtcagtgcaaagatttggctaatgaaaatggtccatattttcatctgccaagatggtcagcctcccttaccaaggacagaacaaaggtgggttcagaatcaaaacaaagtctgttgggtgcaaatggagttttggaagacaagaagcatatgatggaaggtccttcctcattgtcagccgtcaaggctaaattaaagcctgcaactatgaggcccattccccactctcgaaaacaacaaatgcatccttttatgggtttacctgaaacttcccttcatgaaactagtattgtgaagccaagcttgccagttgcgccaactgttaagcacaattcagtttcttctgccccaaccacgcacagaaaatcaacatcagggccatcacatactccttcagtcattcaattgaatcctctgccaatgaagaaacatggatgtgataggttgcctatccaagtatgctctgaggaggacttcttgaaggatgtcatgcagtttttaatccagaggggccacaatcgacttgtacctcatggaggactagctgaatttcctgatgcaatccttaacgccaagcgccttgatctttataacttgtacaaggaggtggtgtctagaggtggattttatgtgggtaatggcataaactggaagggtcaagtcttctcaaagatgcgtaaccatactgcaacaaacagaatgactggtgtagggaacacgttgaaaaggcactacgaaacatacttgttggaatatgagttagcgcatgatgatgtggatggtgaatgctgcttactttgtcacagtagcgcacctggagattgggtgaactgtggtttatgtggtgaatgggctcactttggttgcgacagacgacaaggactaggcactttcaaggattacgctaagacagatggtttggaatacatctgcccccattgtagcttagcaaactacaagaagaagccaccaccaccaaaagcagctaacggtttttctaatacagcatctgtaccacgaaatgtttaa

SEQ ID NO: 5212 - protein, 769 aa, Sorghum bicolor
  misc_feature: Ceres ANNOT ID no. 6042135
  misc_feature (577)..(699): Pfam Id: ARID Pfam Desc: ARID/BRIGHT DNA binding domain
  misc_feature (690)..(744): Pfam Id: PHD Pfam Desc: PHD-finger
  misc_feature (4)..(769): NCBI GI: 115476700 NCBI Desc: os08g0451400 [oryza sativa (japonica cultivar-group)]
  misc_feature (80)..(769): NCBI GI: 42407626 NCBI Desc: fiber protein-like [oryza sativa (japonica cultivar-group)]
  misc_feature (6)..(533): NCBI GI: 34849889 NCBI Desc: at3g43240 [arabidopsis thaliana]
  misc_feature (1)..(759): NCBI GI: 144923184 NCBI Desc: at-rich interaction region; zinc finger, fyve/phd-type [medicago truncatula]
  misc_feature (1)..(767): NCBI GI: 140072127 NCBI Desc: at-rich interaction region; zinc finger, fyve/phd-type [medicago truncatula]
MSHQIQSFSRNNCVLLAVLCGKYAEKRAPAARSGLEAKRPRPSYPFPELSSAGRLEVHTLFNPTPEQFLEAQRVVQPNFLYIQGQQLEDEKEIGSLVWGDADVSDPQAFSTLISPPFPTIVYLEVPIGEKLAQAVHSKGIPYVIYWRNSFSSYAASHFRHALMSVVQSSVSHTWDAFQLAHASFRLYCVRNNHVQSVKLGPRLLGDAPKINISPPETEMVDEEGSSEVTPAIKIYDEVINMKLLLCGVPCNLDPCLLGSLEDGLNALLNIEIRGSKLQNRISASPPPLEAASLPRGMVTMRCDITTCSISHVSLLVSGSAQTCFDDQLLESHIKNEIIEKSQLVRALSNSEDKLPSSEPLTSMSTACGASTFEVWMSLPKWAAQVLKHLAPDIQYRSLVALGIGCINGTPVASFERRDADRLLFFCTSQCKDLANENGPYFHLPRWSASLTKDRTKVGSESKQSLLGANGVLEDKKHMMEGPSSLSAVKAKLKPATMRPIPHSRKQQMHPFMGLPETSLHETSIVKPSLPVAPTVKHNSVSSAPTTHRKSTSGPSHTPSVIQLNPLPMKKHGCDRLPIQVCSEEDFLKDVMQFLIQRGHNRLVPHGGLAEFPDAILNAKRLDLYNLYKEVVSRGGFYVGNGINWKGQVFSKMRNHTATNRMTGVGNTLKRHYETYLLEYELAHDDVDGECCLLCHSSAPGDWVNCGLCGEWAHFGCDRRQGLGTFKDYAKTDGLEYICPHCSLANYKKKPPPPKAANGFSNTASVPRNV

SEQ ID NO: 5213 - DNA, 1377 bp, Sorghum bicolor
  misc_feature: Ceres ANNOT ID no. 6042142
  misc_feature: Encodes the peptide sequence at SEQ ID NO 5214
atgtcgtacaacaaggccccgtccatcaccgccgagaccataaatcccagggtcaagatcttcagctacgcaccttgcggggagatcctcaagcacgcagagcggttggagcaggagatggaggaaaaccctggttctctgccttttcaagagataatatactgcaatcttgggaacccccaggttcttggtcagccaccattaactttctttcgtgaggttctttccctgtgtgacaatccaaccctcctgaacagagatgaaacatgtgccttattcagtccttacagcataagaagagctaggaggatcataaataagattccgaacaaagacactggtggatatactgatagtcagggaatcaaatggctacgtcaagtagttgcagacgggattactggaagagatggttttccatccaatgcagatgatatttttctaacagatggagctagctcggcggtgccatacaatcttactgaagataatggttgggggcttgagatttttgaagtcaagagatgcttggaagaggctcgttcagctggcttgactgttagagctatggtggtcataaatccaggcaatcctactgggcaggtgctttccatcaccaaccaggaagagatagtggaattttgtcggaaggaaggtctggttatacttgcggatgaggtataccaggagaatatctatgcagagaacaaaaaattcaattctttcaaaaaagtggccagatcacttggttatgacgaaaatgacctctccctagtttcatttaattctgtttcaatgagctacggggaaagtggcagaagaggaggctacatggaggtgactggtttagcagctgatgtgaagtatcagatgtgcaaggtggcttctttaacaatctgccccaacatagctggccaaattcttatcagccttgcaatggatccaccaaagctaggagatgaatcttttgagttatttgatgatgagaaggaaaagatccgtttatctttctggaagcgagccaagaccctagagaaagcattcagcagcatggagggcgtgagctgcaacaagttagagggtgcactgtacttgttcccacggctccaccttccctctgccgcgatcagggccgctgaatccaagggagtttcacctgacacattctacgctcaccgcctgcttgacgccactgggatcgccgttgtgccgggctctgggttccaccaggaatctgggtcgatccatatccggtgcacgatccttcctgacgaaggcaaaatcgcatcaatgatcccacgcctctgtgcgttccataaggcgttcatgaatgagttccggggttctcagcagcgcatgcacgatctccgccgttga

SEQ ID NO: 5214 - protein, 458 aa, Sorghum bicolor
  misc_feature: Ceres ANNOT ID no. 6042142
  misc_feature (72)..(435): Pfam Id: Aminotran_1_2 Pfam Desc: Aminotransferase class I and II
  misc_feature (110)..(447): NCBI GI: 296204 NCBI Desc: alanine aminotransferase [panicum miliaceum]
  misc_feature (110)..(447): NCBI GI: 3694807 NCBI Desc: alanine aminotransferase [zea mays]
  misc_feature (139)..(448): NCBI GI: 37953301 NCBI Desc: alanine aminotransferase [capsicum annuum]
  misc_feature (110)..(447): NCBI GI: 1703227 NCBI Desc: alanine aminotransferase 2 (gpt) (glutamic--pyruvic transaminase 2) (glutamic--alanine transaminase 2) (alaat-2)
  misc_feature (110)..(447): NCBI GI: 469148 NCBI Desc: alanine aminotransferase [hordeum vulgare subsp. vulgare]
  misc_feature (110)..(447): SWISSPROT Homolog: EC 2.6.1.2 Alanine aminotransferase 2
  misc_feature: Useful for making plants with modulated nitrogen use efficiency
  misc_feature: Functional homolog of the protein sequence encoded by LOCUS at1g72330
  misc_feature: The sequence is a functional homolog of SEQ ID NO. 526 in the 11/188,298 US application
MSYNKAPSITAETINPRVKIFSYAPCGEILKHAERLEQEMEENPGSLPFQEIIYCNLGNPQVLGQPPLTFFREVLSLCDNPTLLNRDETCALFSPYSIRRARRIINKIPNKDTGGYTDSQGIKWLRQVVADGITGRDGFPSNADDIFLTDGASSAVPYNLTEDNGWGLEIFEVKRCLEEARSAGLTVRAMVVINPGNPTGQVLSITNQEEIVEFCRKEGLVILADEVYQENIYAENKKFNSFKKVARSLGYDENDLSLVSFNSVSMSYGESGRRGGYMEVTGLAADVKYQMCKVASLTICPNIAGQILISLAMDPPKLGDESFELFDDEKEKIRLSFWKRAKTLEKAFSSMEGVSCNKLEGALYLFPRLHLPSAAIRAAESKGVSPDTFYAHRLLDATGIAVVPGSGFHQESGSIHIRCTILPDEGKIASMIPRLCAFHKAFMNEFRGSQQRMHDLRR

SEQ ID NO: 5215 - DNA, 1008 bp, Sorghum bicolor
  misc_feature: Ceres ANNOT ID no. 6042154
  misc_feature: Encodes the peptide sequence at SEQ ID NO 5216
atgaagaccacttcgtcgcacgggctccacaccgcgtcgctctgcacgccgtacctcctcctggtgccgctcggcctcctcgccctgctgctggcgctcccgagcctcggctcctcccacacccgctcccagggcctcggcgtgctctgccgcggcgcgacggagtactccgacgacggcgccggcggctaccactccgtcgcgccgacgggcgccgacgacgagaagaagaagaaggcctccgtcgtcgtcgccgccgacgccgacgccgagacgacgacgccggagctgagcctgctcgtgggcgtgctgaccatgccgagccggcgggagcggcgggacatcgtgcggatggcctacgcgctgcagcctcctccttcgcggccggcgcgcgtggacgtgcgcttcgtcttctgcaacgtgacggacccggtggacgcggcgctggtggcggtggaggcccggcgccacggcgacgtgctggtgctcgactgcacggagaacatgaacgacggcaagacgcacgcgtacctgtcctcggtgccgcggctcttcgcgtcggggcgctacgactacgtgatgaagaccgacgacgacacgtacctgcgcgtggcggcgctggtggaggagctccgctccaagccccgccacgacgtctacctgggctacggcttccccgtcggcgacgaccccatgccgttcatgcacggcatgggctacgtcgtgtcgtgggacgtcgcgcgctgggtgtccgccaaccaggacatcctccgccacaacgacacgcacgggcccgaggacctgctcgtcgggaaatggctcaacatcggcggcaggggcaagaaccggtacgacctcaagccgcggatgtacgacctcagctggttcatggacaacttccggccggacaccatcgccgtgcacatgctcaaggacaaccgacggtgggcggccacgttcaggtacttcaacgtcaccgccggcatcaacctgtcccacctgccgtga

SEQ ID NO: 5216 - protein, 335 aa, Sorghum bicolor
  misc_feature: Ceres ANNOT ID no. 6042154
  misc_feature (111)..(287): Pfam Id: Galactosyl_T Pfam Desc: Galactosyltransferase
  misc_feature (95)..(329): NCBI GI: 115479301 NCBI Desc: os09g0433500 [oryza sativa (japonica cultivar-group)]
  misc_feature (86)..(274): NCBI GI: 89269053 NCBI Desc: udp-gal:betagal beta 1,3-galactosyltransferase polypeptide 6 [xenopus tropicalis]
  misc_feature (71)..(295): NCBI GI: 68063765 NCBI Desc: beta-1,3-galactosyltransferase sqv-2 (squashed vulva protein 2)
  misc_feature (91)..(222): NCBI GI: 7269547 NCBI Desc: avr9 elicitor response like protein [arabidopsis thaliana]
  misc_feature (91)..(222): NCBI GI: 21553519 NCBI Desc: avr9 elicitor response-like protein [arabidopsis thaliana]
  misc_feature: The sequence is a functional homolog of SEQ ID NO. 346 in the 11/188,298 US application
MKTTSSHGLHTASLCTPYLLLVPLGLLALLLALPSLGSSHTRSQGLGVLCRGATEYSDDGAGGYHSVAPTGADDEKKKKASVVVAADADAETTTPELSLLVGVLTMPSRRERRDIVRMAYALQPPPSRPARVDVRFVFCNVTDPVDAALVAVEARRHGDVLVLDCTENMNDGKTHAYLSSVPRLFASGRYDYVMKTDDDTYLRVAALVEELRSKPRHDVYLGYGFPVGDDPMPFMHGMGYVVSWDVARWVSANQDILRHNDTHGPEDLLVGKWLNIGGRGKNRYDLKPRMYDLSWFMDNFRPDTIAVHMLKDNRRWAATFRYFNVTAGINLSHLP

SEQ ID NO: 5217 - DNA, 1614 bp, Sorghum bicolor
  misc_feature: Ceres ANNOT ID no. 6042164
  misc_feature: Encodes the peptide sequence at SEQ ID NO 5218
atggagtactgggcggcgctggcgtcgctcatgggcgcgttcgcgttcctgcagggggtggtgcacgcgatgttcccggcggagctgcgtgctgcgctggcgcggctgctcggcaggctcacgcgcgccttctccccctactgctacttcgacgtgacggagatggaaggcatgagcaccaacgagatctacgacgccgtgcagctgtacctcagcagcaccgccgcgccggcgtccggggcgcgcctcagcctgtcgcgcccgctcaacgcctcctccttcaccttcgggctcgccgccagcgaccgcgtcgtcgacaccttcgccggctgcgccgtcacgtgggagcacgtggtcgcgccgcgccagggccagggcttctcgtggcgcccgctccccgaggagaagcgccgcttcacgctccgcatccgccgcggcgacagggacaagctgctcccggcgtacctcgaccacatcctcgccgcggcggccgacatcaagcgccgcagccaggaccggatgctctacaccaacgcgcggggcggggtcatggactcgcgcggcctgccctgggaccccgtgccgtttaagcacccgagcacgttcgacacgctcgccatggacccggcgcggaaggcggctatcatggccgacctccgggacttcgccgacggcagcgccttctacgagcgcaccggacgcgcatggaagcgcggctacctcctgtatggcccaccgggcaccggcaagtccagcatgatcgcggccatggccaacttcctcggctacgacgtgtacgacctggagctgaccgaggtgagcagcaacgcggagctccgcaagctgctgatgaagacgacgtccaagtccatcatcgtgatcgaggacatcgactgctccgtcgacctcaccaaccgcgcggccgcgccgccgaagccgaagccgaatccgcggccgagcatcaccgtcgacggcgccatggtcaaccaggacgggggcgccggcggggcgggccagtccatcacgctctccggcctgctcaacttcacggacggcctgtggtcgtgctgcggcgcggagcgcatcttcgtgttcaccaccaaccacatcgagaagctggacccggcgctgctccggtcgggccgcatggacatgcacgtcttcatgtcctactgctcgttcccggcgctcaagatcctgctcaagaactacctcggcttccaggacgacgaggagctggaccgcctcagcgacagcgacgccatgcgcgggctggaggagtgggtggacgccgcggagatcacgccggcggacgtgagcgaggtgctgatcaagaaccgtaggagcggcaagacggaggcaatgcaggggctgctggacgaattcagggcccgcgccgagacgcggggccggggcttcagcgacggagctgccgccgcggcggggaacgaggccgccggcggcgacggcgagaacgaggaggaagaggaggaggaggagaaacgggcgctggagagccccaaggaggccgggaaggagcaggacgtgggcggcattgacagctgcgcggacggacaggatgaggaagcggaggagggaaagaaacaggtgtga

SEQ ID NO: 5218 - protein, 537 aa, Sorghum bicolor
  misc_feature: Ceres ANNOT ID no. 6042164
  misc_feature (239)..(438): Pfam Id: AAA Pfam Desc: ATPase family associated with various cellular activities(AAA)
  misc_feature (2)..(506): NCBI GI: 19715599 NCBI Desc: at4g25830/f14m19_110 [arabidopsis thaliana]
  misc_feature (21)..(506): NCBI GI: 62321200 NCBI Desc: bcs1 like mitochondrial protein [arabidopsis thaliana]
  misc_feature (33)..(493): NCBI GI: 50510113 NCBI Desc: aaa-type atpase-like [oryza sativa (japonica cultivar-group)]
  misc_feature (1)..(465): NCBI GI: 115479423 NCBI Desc: os09g0445700 [oryza sativa (japonica cultivar-group)]
  misc_feature (1)..(503): NCBI GI: 55276711 NCBI Desc: atpase 2 [hordeum vulgare subsp. vulgare]
  misc_feature: The sequence is a functional homolog of SEQ ID NO. 462 in the 11/188,298 US application
  misc_feature: The sequence is a functional homolog of SEQ ID NO. 471 in the 11/188,298 US application
MEYWAALASLMGAFAFLQGVVHAMFPAELRAALARLLGRLTRAFSPYCYFDVTEMEGMSTNEIYDAVQLYLSSTAAPASGARLSLSRPLNASSFTFGLAASDRVVDTFAGCAVTWEHVVAPRQGQGFSWRPLPEEKRRFTLRIRRGDRDKLLPAYLDHILAAAADIKRRSQDRMLYTNARGGVMDSRGLPWDPVPFKHPSTFDTLAMDPARKAAIMADLRDFADGSAFYERTGRAWKRGYLLYGPPGTGKSSMIAAMANFLGYDVYDLELTEVSSNAELRKLLMKTTSKSIIVIEDIDCSVDLTNRAAAPPKPKPNPRPSITVDGAMVNQDGGAGGAGQSITLSGLLNFTDGLWSCCGAERIFVFTTNHIEKLDPALLRSGRMDMHVFMSYCSFPALKILLKNYLGFQDDEELDRLSDSDAMRGLEEWVDAAEITPADVSEVLIKNRRSGKTEAMQGLLDEFRARAETRGRGFSDGAAAAAGNEAAGGDGENEEEEEEEEKRALESPKEAGKEQDVGGIDSCADGQDEEAEEGKKQV

SEQ ID NO: 5219 - DNA, 1683 bp, Sorghum bicolor
  misc_feature: Ceres ANNOT ID no. 6042180
  misc_feature: Encodes the peptide sequence at SEQ ID NO 5220
atgatgctgataaggccgccgcggtttgtctccccctcgcccaggccagggccgcgcgagccccgcctccgccggcctctcgatgcctccagaatcttctcctcccctcggccccccggtcgccgttcccgcccgcgcccccagctcgcctctccgtccaccgacctccgccgcctcactgcccgcatcgtcgacctcacccgccgcaggcagctcgcccagatcatggaggaggtggaagcaacgcggcgtcgtgtgcgtgggggcgggttgctcaacaccatcgtcatgaacgcggttctagaggcctgtgtgcgctgcggcgacgtcgaccgtgcgcttcggctcttcgaggaaatgcgcgggcccaacgggtgcggtgtcgacggtgtctcctacggcatcctgctcaagggcctgggtatagcaagaaggattgatgaagcatttgaaatactggaatcaattgagaaagattcttccattgggagccccaggctctctcctcatctcatttgtggttttctaaatgcccttattgaagcaggagatatgaggcgtgccaatgctcttgttgcccgtttccgcaaggtcctttatgagggtcactctgtcttactatacaacttactgatgaaggaagaagctaataaggaaagtaaccctgaactccttccggatgctgttacctacacaacattacttaagggtttaggaaataaccgggacctttattcagttttgaatattgttgtggagatgaaatcttcattaatatcactcgacaggactgcatacactgctatggtagatgccttgctagcttgtgggtccattgatggggccctttgtgtttttggtgatataataaagcatgctggcaagaacaaagatttgagacctaaacctcatctctatctttcgatcatgagagcttttgctaccagaggtgatgttgatatggtcatgagattgaacaagcgcatgtggccggattcagttggagcaattagccgtgctgccaaagaagaggcacatgagctattaatggaagctgctataaataataatcagatagatttggctagaggccttctaagacaaatagtgaacgagaaggaatgtttctcttggacaagtagagtaggactggtcgcagttaaagttgaaagcttatctggattcaccaactctcttctaacgccccacatatttccacagattatcttgaatgatccagttgagaagtatatggttccatttcaagaatctcgaccattacctgcagacttaatcttgcggaaggctgtgatgcgattcttgaaagatcgtgcagttcctcttgtcgatgattggggaggttgtgttggcattgttcatcgtgatgattgtaccaagctggatgcacctcttctatcgatgtctagagggccacctttgtgcgtgcctacttcaaccaccgtggagcacgtcattgacctcctcctcagagagaagtccgagatggtgattgtggtgaagagtggtaacatgtacgaaggaagctacacatccagctcaagacccttgggcgttttctccctcgccatactatggagcttcactggcgactacgactcgtcggaatcagatatccccgacgcaggcacatcctgggcaacaagacccaaacaagacgcctga

SEQ ID NO: 5220 - protein, 560 aa, Sorghum bicolor
  misc_feature: Ceres ANNOT ID no. 6042180
  misc_feature (229)..(263): Pfam Id: PPR Pfam Desc: PPR repeat
  misc_feature (418)..(519): Pfam Id: CBS Pfam Desc: CBS domain pair
  misc_feature (1)..(548): NCBI GI: 115479291 NCBI Desc: os09g0431600 [oryza sativa (japonica cultivar-group)]
  misc_feature (1)..(255): NCBI GI: 50726328 NCBI Desc: pentatricopeptide (ppr) repeat-containing protein / cbs domain-containing protein-like [oryza sativa (japonica cultivar-group)]
  misc_feature (65)..(329): NCBI GI: 90265197 NCBI Desc: b0812a04.6 [oryza sativa (indica cultivar-group)]
  misc_feature (65)..(329): NCBI GI: 38567720 NCBI Desc: b1358b12.18 [oryza sativa (japonica cultivar-group)]
  misc_feature (89)..(329): NCBI GI: 7268804 NCBI Desc: membrane-associated salt-inducible-like protein [arabidopsis thaliana]
MMLIRPPRFVSPSPRPGPREPRLRRPLDASRIFSSPRPPGRRSRPRPQLASPSTDLRRLTARIVDLTRRRQLAQIMEEVEATRRRVRGGGLLNTIVMNAVLEACVRCGDVDRALRLFEEMRGPNGCGVDGVSYGILLKGLGIARRIDEAFEILESIEKDSSIGSPRLSPHLICGFLNALIEAGDMRRANALVARFRKVLYEGHSVLLYNLLMKEEANKESNPELLPDAVTYTTLLKGLGNNRDLYSVLNIVVEMKSSLISLDRTAYTAMVDALLACGSIDGALCVFGDIIKHAGKNKDLRPKPHLYLSIMRAFATRGDVDMVMRLNKRMWPDSVGAISRAAKEEAHELLMEAAINNNQIDLARGLLRQIVNEKECFSWTSRVGLVAVKVESLSGFTNSLLTPHIFPQIILNDPVEKYMVPFQESRPLPADLILRKAVMRFLKDRAVPLVDDWGGCVGIVHRDDCTKLDAPLLSMSRGPPLCVPTSTTVEHVIDLLLREKSEMVIVVKSGNMYEGSYTSSSRPLGVFSLAILWSFTGDYDSSESDIPDAGTSWATRPKQDA

SEQ ID NO: 5221 - DNA, 2913 bp, Sorghum bicolor
  misc_feature: Ceres ANNOT ID no. 6042184
  misc_feature: Encodes the peptide sequence at SEQ ID NO 5222
atgcagcgacgaccgttacccaaccgagcaaaagaatcggtttattcctcctttaggtgtccccatgaaagcggttccgtatcggcactctcgtttcgtcgtcgtcttctcgccgtcctcctcctctgcctcgtcgtcggtgcgcagcaaggcgaggggcaggcggcgggcccagctgccggtgccgccggagcgaggcggcgggtggacgtgggggtgatcctggaccggacgacatggctggggaacatcagctgggcgtgcatggagctggcactcgaggacttctacgccgacgcgagccacgccaactacagcaccagggtcacgctgcacctccgggacaccccggccgggccgagcgccgtcgacgccgcgtccgcaggtgttgatctactaaaaaatgtccgtgtgcaagcaatcgtcgggccacagacatctagccaagctaaatttcttgcagagcttgggaacaaggcatcagttccaatcatttccttttctgcaaatagcccgtcccggtcatccagccagaccccatactttatcaggacggcatggaacgactcctgccaagctgaagctattgcctcacttgtccataaatacaattggagggaagtcatccctatcatcgaggacaatgattccaacactagattcatccctgatctcattgatgccctgggacatgtcgatactcgtgtgcagtacaggtgcaagatccatccttctgctggagaagctgagataaagcatgctatatcaagcttaaaagtaaattggacaagcgtctttgttgtgcgcatgtcatatcagttagcccttaagtttttccagcttgcaaaggatgagggaatgatgggccagggctatgtctggattacagcatatggtttgacagatatcttcaatgtagttggttatcctgcacttgatgtgatgcaaggtgttgttgggattgagccttatgttgaagaaactgtgagactgaacaaattcagacaaagatggcatgagaaatataggttggaaaatcctggtacatcaattaatgagcccataacgtctggtctatatgcatatgatacagtatgggcaatagcattagcagcagagaagggcggatatgttaattcagactttgtgccgtctgaaacaaacaatgggtccactgatttcgacaaaataagtacttctagggctgctgaaaaatttcgtgatgcattcttgaaggttaatttcacaggcattagtgggcaatttgtcattcaggatatgcagttagtatcaacaacttacaaaattatcaatatagctggtcgggagaggagagcagttggtttttggactccaggattgaacatatccagaatttctatcgtatggccaggaggcagtgagacgacacctagaggatggcttttgccagtgaataaaaaactcaaaataggagtacctgtgaaacctgggtttagcagttttataagatctgaagatggtacccccaaggggttctgcattgatgtatttgaggaagtcattggtaaacttccctacaaagttcccaagcattatgtggaatttggaaatggaaaaggagaaagtaatggaacttatgatgaactcgtctacaaagtttatcttaaggaattcgatgcggtagtaggtgacataacaattttggccaaccgttctctatatgtggactacactcttccttatactgagtcaggggtacgcatgctggttccagttcgggaccagagacagaagactgcatggacattcctagaaccattaacagctgatctatggttaggaactggagcctttattgtcttcacaggttttatagtttggtttatcgagcacagaacgaatcaggaattcagaggaccgccagccagtcagattggatcagtcttctacttctccttctcaacacttgtatttgctcatagggagaggattgtgaacaatttatcaagaattgcagtagttctttggctttttgtggtgctaatattgcagcagagttatactgcaagcttaagctcaattctcacggtagaacagcttcaaccaacagtcaccaatatagatgaagttatcagacgaggggattatgttggctacctcaatgattctttcatgcctgagcttttgaaaaggttgaaaattaatgaaacaaaaatgaaggccttcagctctcctgaggagtacaatgacgccctatcaactagaaaagttgccgtcattgttgatgaaataccatacctcaaagtgtttctctcaaagtattgccacaagtacactatggttgggccaacttacaaatttgatggatttggttatgcgtttcctcgaggttctccacttacacctgaaatttcaaggggaatactggaactagcatcaaatggcagaatggatgaactggagaaacagttgtatggtgatacgtcgtgcccagacaaagatgactcccaaacttcaagcagtcttacgttgcatagctttcttgggctgttcataatcactgggacaacttcattactggcactgattttgcatgtaattatttccctttatgatcatcggagtcattggatcaatggcagcggtcagatatcatggcatgaattgcttgctgttctcttcaagatttttcatgagcgtgataatagctctaatactccggataatgaggagcctgaaatggaagatatagatcctccaacagctgagagtccatggagcatgtctaatcacatcatcgagaatgttgattcagacactgatacaggaagcacaccagatggagaaggaactccgggcagggaagtttcgaatcaggatcttggtccaccatcatttgcatacatgcattctgagggggcaatggagtaa

SEQ ID NO: 5222 - protein, 970 aa, Sorghum bicolor
  misc_feature: Ceres ANNOT ID no. 6042184
  misc_feature (602)..(862): Pfam Id: Lig_chan Pfam Desc: Ligand-gated ion channel
  misc_feature (84)..(441): Pfam Id: ANF_receptor Pfam Desc: Receptor family ligand binding region
  misc_feature (58)..(959): NCBI GI: 30013669 NCBI Desc: avr9/cf-9 rapidly elicited protein 141 [nicotiana tabacum]
  misc_feature (461)..(870): NCBI GI: 41017231 NCBI Desc: glutamate receptor 2.5 precursor (ligand-gated ion channel 2.5)
  misc_feature (69)..(899): NCBI GI: 41017205 NCBI Desc: glutamate receptor 2.7 precursor (ligand-gated ion channel 2.7)
  misc_feature (69)..(900): NCBI GI: 41017226 NCBI Desc: glutamate receptor 2.8 precursor (ligand-gated ion channel 2.8)
  misc_feature (69)..(900): NCBI GI: 12964235 NCBI Desc: ligand gated channel-like protein precursor [arabidopsis thaliana]
MQRRPLPNRAKESVYSSFRCPHESGSVSALSFRRRLLAVLLLCLVVGAQQGEGQAAGPAAGAAGARRRVDVGVILDRTTWLGNISWACMELALEDFYADASHANYSTRVTLHLRDTPAGPSAVDAASAGVDLLKNVRVQAIVGPQTSSQAKFLAELGNKASVPIISFSANSPSRSSSQTPYFIRTAWNDSCQAEAIASLVHKYNWREVIPIIEDNDSNTRFIPDLIDALGHVDTRVQYRCKIHPSAGEAEIKHAISSLKVNWTSVFVVRMSYQLALKFFQLAKDEGMMGQGYVWITAYGLTDIFNVVGYPALDVMQGVVGIEPYVEETVRLNKFRQRWHEKYRLENPGTSINEPITSGLYAYDTVWAIALAAEKGGYVNSDFVPSETNNGSTDFDKISTSRAAEKFRDAFLKVNFTGISGQFVIQDMQLVSTTYKIINIAGRERRAVGFWTPGLNISRISIVWPGGSETTPRGWLLPVNKKLKIGVPVKPGFSSFIRSEDGTPKGFCIDVFEEVIGKLPYKVPKHYVEFGNGKGESNGTYDELVYKVYLKEFDAVVGDITILANRSLYVDYTLPYTESGVRMLVPVRDQRQKTAWTFLEPLTADLWLGTGAFIVFTGFIVWFIEHRTNQEFRGPPASQIGSVFYFSFSTLVFAHRERIVNNLSRIAVVLWLFVVLILQQSYTASLSSILTVEQLQPTVTNIDEVIRRGDYVGYLNDSFMPELLKRLKINETKMKAFSSPEEYNDALSTRKVAVIVDEIPYLKVFLSKYCHKYTMVGPTYKFDGFGYAFPRGSPLTPEISRGILELASNGRMDELEKQLYGDTSCPDKDDSQTSSSLTLHSFLGLFIITGTTSLLALILHVIISLYDHRSHWINGSGQISWHELLAVLFKIFHERDNSSNTPDNEEPEMEDIDPPTAESPWSMSNHIIENVDSDTDTGSTPDGEGTPGREVSNQDLGPPSFAYMHSEGAME

SEQ ID NO: 5223 - DNA, 2934 bp, Sorghum bicolor
  misc_feature: Ceres ANNOT ID no. 6042186
  misc_feature: Encodes the peptide sequence at SEQ ID NO 5224
atggccggcctcgcccggcaccctcccttcctccgtgtgttctacctcatcggcctgctggcctcgctcatcccggccacgtcgccggcgcagccaccggagacggtcgcggtggggctcatcatcgacgccgactcgcccgtcggcaggatcgccagcaccaccatccgatggcgctcgacgacttctacgccgccttccccaacgcctccgcgcgggtccgccttctgcagcacgactccggcggggacgtcgtcgccgccgcgtccgccgctgatgacgacccagggcgcgcgcgccatcctgggcccgcagtcctccgtcgagtccgccttcgtcgcggacctcgccacgcgcgccgaggtccccgtcgtgtccttctcggcgaccagcccgtcggtgtcccactccgaggcgcgcttcttcgcgcgcgccgcgctcagcgacgccgcgcaggcggaggccatcgccgcgctcgccacctacttcggctggcgccgcgtcgtgcccatctaccaggacgacgactacggcgccgccttcgtgccgttcctcgtcgacgcgctcacggcggcgcgcgcggaggtgccctaccgctgcgcgctgcccgctggggcgtccagggacgccgtcgccgccgcgatgtaccgcctcgagtccgagcagacgcgcgccttcgtggtgcacgcgcgcacggagctcgcggagctcgtcttcgccgccgccgtggaggccgggatgatggcggaggggtacgcgtgggtcatcaccgacgggctcacgggcctcctcggctccttccacccgccgcagggcgtcatcgggctcgcgccccacgtgccgcccaccgcacgcctgcgcggcgtccggaagcggtgggcgcacaggttcatgcgccagcaccaggacgccgatccggctcacgccgagatgggatgctacgcgctgtgggcgtacgacgccgcgtgggccgtcgcgtccgcggccgagcgacttagcaccggcgacgacctgtcgtcgtcgctaccggggctcgtcggcggcaggagcggccccaccgacttctccgggctcgggaagtcaatgtccggtgagaagttcctcgaggcaataaccagcactacattcgagggcctcggcggcaggttcgagctcctcaacggcgagctgccagtgccggccttccggatcgtcaacatcatggacaacgccaaggagcggggcatcggattctggacgcacaaggccggactgcataggcagctggggcgcggccgcggcgggatcgcgtcgaacagcgggctcgcgccggtgatctggccggcggactcgaccgtcgtgcccattggctgggtccagccgacgagcggccggaagctgcaggtggcgatgccggcggggcgcgtcgaccctgggtaccggtcgatcatgcacctcgacgtcgacccagcaacgaaccggacggtagccggcgggttcgtgatcgaggtgttcgaggcggcggtgcgtctgctgccctacgcgctgccgttcgagtacgtgctagtgggctccatgcgctacgatgctctaatcgagagggtcggcaaaggggagttcgacacggcggtggcggacatcaccatcacggcggagcggtcgaagcacgtggacttcacgctgccgtacatgtcgtcggggatctccatggtggtgccggtgcgcgaccagcgcagcaagcgcgccgcctgggtcttcctcaagccgctcagctacgacctctggctcgtcagcttcgccttcttggtcttcaccggcttcgtcgtctgggccgtggagcaccgcagcaacgaggagttccgtggcccgccgtcctaccagatcggcaccctcctctacttcggcttttcaaccctcgtctttgcacatagggagaacctgaagagcaacctgtcgcggatcgtggtggtggtgtgggtgttcgtggtgctcatcctgcagtccagctacacggcgagcctgacgtccatgctgacggtgccgcagcttgagccggcgatcggggacttcacctccctgtggcgggggacggacaaggtcgggatcttgaacaactccttcatgcgggcggccatggacaagtcgggcttccctcagtccaggctcgagccgtaccaggccacgcagagcttccacgaggcgctgctcaacggcaccatcggcgccatcgtcgacgagacgccctacctcaggctcttcctcacgtcctactgcgacaacttcaccaagatcgcccagagcaacaagaccggcggcttcggcttcgcgttccccaaggggtcgccgtacgtggcggacctgtcgcgggcgatcctgaacctcacggagagcgacgagatgagcttgatcgagcgcaagtggttcggcgacgcggacggctgcgcggcgcagggcagccagttcacgtcggagaggctcagcttcgacagcttctggggcctgttcctcatcaccggcgccacctccctcctctgctgcgcgctgcacctgctcatcttcgtcgtggccaaccgccggcggatctgggcgtcgcgcgtgccatggaggaacaggctccggatcttcctcaagctcctcgacgacagggacctctcgtcgcacacgttcaggaccaacaaggatggcggcgggtcggtggctgatcggagcgctaacgacgcgggcgcctccccgtccccggccgtcgtgcgcatggaagccggcagcccgctcagcgtgtccaaccacacgtacgacatgagcgactggtcgtttggtgcgccgagcccggcacctgctgcagctgcaggtgagaatgagatcgtcgagctggctggcgccggcgaggcagaggaggtggccgcagctcccaaccctgacggctccggtgatcaaagtggcacagcccacaactga

SEQ ID NO: 5224 - protein, 977 aa, Sorghum bicolor
  misc_feature: Ceres ANNOT ID no. 6042186
  misc_feature (584)..(845): Pfam Id: Lig_chan Pfam Desc: Ligand-gated ion channel
  misc_feature (44)..(402): Pfam Id: ANF_receptor Pfam Desc: Receptor family ligand binding region
  misc_feature (10)..(931): NCBI GI: 41017226 NCBI Desc: glutamate receptor 2.8 precursor (ligand-gated ion channel 2.8)
  misc_feature (10)..(931): NCBI GI: 12964235 NCBI Desc: ligand gated channel-like protein precursor [arabidopsis thaliana]
  misc_feature (36)..(939): NCBI GI: 30013669 NCBI Desc: avr9/cf-9 rapidly elicited protein 141 [nicotiana tabacum]
  misc_feature (92)..(885): NCBI GI: 41017205 NCBI Desc: glutamate receptor 2.7 precursor (ligand-gated ion channel 2.7)
  misc_feature (100)..(853): NCBI GI: 41017232 NCBI Desc: glutamate receptor 2.6 precursor (ligand-gated ion channel 2.6)
MAGLARHPPFLRVFYLIGLLASLIPATSPAQPPETVAVGLIIDADSPVGRIASTTIRWRSTTSTPPSPTPPRGSAFCSTTPAGTSSPPRPPLMTTQGARAILGPQSSVESAFVADLATRAEVPVVSFSATSPSVSHSEARFFARAALSDAAQAEAIAALATYFGWRRVVPIYQDDDYGAAFVPFLVDALTAARAEVPYRCALPAGASRDAVAAAMYRLESEQTRAFVVHARTELAELVFAAAVEAGMMAEGYAWVITDGLTGLLGSFHPPQGVIGLAPHVPPTARLRGVRKRWAHRFMRQHQDADPAHAEMGCYALWAYDAAWAVASAAERLSTGDDLSSSLPGLVGGRSGPTDFSGLGKSMSGEKFLEAITSTTFEGLGGRFELLNGELPVPAFRIVNIMDNAKERGIGFWTHKAGLHRQLGRGRGGIASNSGLAPVIWPADSTVVPIGWVQPTSGRKLQVAMPAGRVDPGYRSIMHLDVDPATNRTVAGGFVIEVFEAAVRLLPYALPFEYVLVGSMRYDALIERVGKGEFDTAVADITITAERSKHVDFTLPYMSSGISMVVPVRDQRSKRAAWVFLKPLSYDLWLVSFAFLVFTGFVVWAVEHRSNEEFRGPPSYQIGTLLYFGFSTLVFAHRENLKSNLSRIVVVVWVFVVLILQSSYTASLTSMLTVPQLEPAIGDFTSLWRGTDKVGILNNSFMRAAMDKSGFPQSRLEPYQATQSFHEALLNGTIGAIVDETPYLRLFLTSYCDNFTKIAQSNKTGGFGFAFPKGSPYVADLSRAILNLTESDEMSLIERKWFGDADGCAAQGSQFTSERLSFDSFWGLFLITGATSLLCCALHLLIFVVANRRRIWASRVPWRNRLRIFLKLLDDRDLSSHTFRTNKDGGGSVADRSANDAGASPSPAVVRMEAGSPLSVSNHTYDMSDWSFGAPSPAPAAAAGENEIVELAGAGEAEEVAAAPNPDGSGDQSGTAHN

SEQ ID NO: 5225 - DNA, 2841 bp, Sorghum bicolor
  misc_feature: Ceres ANNOT ID no. 6042193
  misc_feature: Encodes the peptide sequence at SEQ ID NO 5226
atggacagaacacctcaatccatcctcttcctgctgctactcatcttcagtcctagtgcagctcagaacaccatcggaagcagcccaaacaaattccatgttggtgtgatccttgacttgggttcaccggtggggaaagtaggtcggacaagcgtgtcacttgccttggaagatttctacgcatcccaccgcaattgcagcacgaaggtggttctccatttcaaggattcggcaggcaatgatgtccaagctgcttcagcagctattgaattactggagacatacaaagtgcaagccatcattggtccccagaaatcatcagaagctgtgtttatatccaaccttgggaatacaacacaagtacctattgtatccttcactgcaacaagtccctcacttacttcagatattatgccgtattttgtgcgtgcaacattgaatgactcagttcaagtgaatagtattgcctctcttatcaaagcctatggatggagagaggtggttccagtatatgatgataccgactatgggaggggcattctaccacacctcattgacgcccttcaacaaatagatgctcatattccatatcgtagtgttatctccttgtcagcaacaagtgaaaacattatgcaagagctcttcaagctaaagacaatgcaaacaagggtattcattgttcatatgtcatcgaccagggcctcccttctcttcacaaaagccaaggaggcagggatgatgaccaaaggatttgtgtggatcattacaaatggattagcaaatatcattgattcactcaatccatctatcatcgaggcgatgaatggggtaataggagtaagatttcatgtccccagatcaaaagaacttgaaagtttttccataagatggaacagaatgtaccaacaagacaacccaaccgaatcaccatttaataaactaagcattttcgggctatggggatatgatacagtttgggcattagcacaagcggcagaaaagattggggtattaattaacaaaaataagagactgcagttcagtaaaaattctacatgcttggagtcattggctgtttctagatttggaccagagctcctaacagcaattgtacagaacaaattcagaggcttaagtggaaatttcgaccttacagacagacagctgcaagtgtctgcattgcaaataataaatgtggttgggaggagttggagacatattggattttggactttgaaaaatggttttccataccagttaaatcaaaatggtttgaaattaacaatgccagcctcaatgcaacatctaaatccagtgatttggccaggagaatcaacagaagtaccaaggggttgggaacttcctgcaagtgctaacaagattagggttggtgtgcacacaagtgcatatccagagtttataaaaacatcaaaggatcctgtcacgaatgcaacaagagcgagtggactctcaataaacatatttgaggaggcagtaaagagactgccttttgcacttccttacgagtaccaagcatttgataccgttgatacacaaagtacagggagctataatgattttgtttaccaagtttatcttcagagatatgacatggcaattggagacataacaatcagatataacagaacgatgtatgtcgacttcactataccatacacagaatcaggagtggcgatgattgtcccagtcaaggaaaaagtcaacaataacatgtggattttcttgaaaccactaaccaaagaaatgtggtttggaagcataatgttctttatatatactggaattgttgtctggctgttagagcgactaagtggcaatggatatctaaatggtcccttttcactcaaacaacttgggattgtgatgtttttctccatattcgaagagaaggagaagctggaatgttttttgtctagaatacttctacttgtatggatgtttgttcttctggtgctagcatcaagttatactgcaagcttcgcatcaatgcttcttgtacagcagctttcaccaacggtcactgacattcatgaactccaaaagcaaggagcgtatgtagggttccaccgaggttcctacatagagggcctgttggaagatatcggttttgaaaaatcaaaaataagaccctatgatactcctgatgacttccacattgctctttctaatgaaggcagacatggtggtgttgctgccctcgttctggaagtcccatacatcaaattgtttctcgccaaatactgcaacggttacacaatggttggacctatatacaaaagtgctggctttgcatttgcacttcctaagcgatctccgctacttactgaaatatcaagggcaatcctcaacataacagaaggagatagcatcattcaaatcgagaagaaatggattgatcaaaacagttgccaaaatgaggaagaagttgctgattcaggtgctatcactttttgcaactttgggggattattcctcctaactggacttgtgacaacctgctccctttctatagtcttgctgaggaaccagtacaaaaaaggtcaacggatcaacacagattatcagaatgaacaaggacatgggccacaagaagaaaatgggcacattcaagacggagatcaaaacaatgaagaaaatggaggttgcaatgatatagagaaccaagccacaacaatatccatgcctcgtccgaacacgaatagtgatgagctaagggactgcccgcagaataacaaggcaatagcattgacttgttttggttctcaagtcacccacaggggaggcgtaacaaatataggtgatcaagtggctcaagtttag

SEQ ID NO: 5226 - protein, 946 aa, Sorghum bicolor
  misc_feature: Ceres ANNOT ID no. 6042193
  misc_feature (47)..(401): Pfam Id: ANF_receptor Pfam Desc: Receptor family ligand binding region
  misc_feature (586)..(848): Pfam Id: Lig_chan Pfam Desc: Ligand-gated ion channel
  misc_feature (11)..(534): NCBI GI: 115479275 NCBI Desc: os09g0428300 [oryza sativa (japonica cultivar-group)]
  misc_feature (34)..(860): NCBI GI: 30013669 NCBI Desc: avr9/cf-9 rapidly elicited protein 141 [nicotiana tabacum]
  misc_feature (9)..(863): NCBI GI: 41017226 NCBI Desc: glutamate receptor 2.8 precursor (ligand-gated ion channel 2.8)
  misc_feature (9)..(863): NCBI GI: 12964235 NCBI Desc: ligand gated channel-like protein precursor [arabidopsis thaliana]
  misc_feature (34)..(867): NCBI GI: 41017232 NCBI Desc: glutamate receptor 2.6 precursor (ligand-gated ion channel 2.6)
MDRTPQSILFLLLLIFSPSAAQNTIGSSPNKFHVGVILDLGSPVGKVGRTSVSLALEDFYASHRNCSTKVVLHFKDSAGNDVQAASAAIELLETYKVQAIIGPQKSSEAVFISNLGNTTQVPIVSFTATSPSLTSDIMPYFVRATLNDSVQVNSIASLIKAYGWREVVPVYDDTDYGRGILPHLIDALQQIDAHIPYRSVISLSATSENIMQELFKLKTMQTRVFIVHMSSTRASLLFTKAKEAGMMTKGFVWIITNGLANIIDSLNPSIIEAMNGVIGVRFHVPRSKELESFSIRWNRMYQQDNPTESPFNKLSIFGLWGYDTVWALAQAAEKIGVLINKNKRLQFSKNSTCLESLAVSRFGPELLTAIVQNKFRGLSGNFDLTDRQLQVSALQIINVVGRSWRHIGFWTLKNGFPYQLNQNGLKLTMPASMQHLNPVIWPGESTEVPRGWELPASANKIRVGVHTSAYPEFIKTSKDPVTNATRASGLSINIFEEAVKRLPFALPYEYQAFDTVDTQSTGSYNDFVYQVYLQRYDMAIGDITIRYNRTMYVDFTIPYTESGVAMIVPVKEKVNNNMWIFLKPLTKEMWFGSIMFFIYTGIVVWLLERLSGNGYLNGPFSLKQLGIVMFFSIFEEKEKLECFLSRILLLVWMFVLLVLASSYTASFASMLLVQQLSPTVTDIHELQKQGAYVGFHRGSYIEGLLEDIGFEKSKIRPYDTPDDFHIALSNEGRHGGVAALVLEVPYIKLFLAKYCNGYTMVGPIYKSAGFAFALPKRSPLLTEISRAILNITEGDSIIQIEKKWIDQNSCQNEEEVADSGAITFCNFGGLFLLTGLVTTCSLSIVLLRNQYKKGQRINTDYQNEQGHGPQEENGHIQDGDQNNEENGGCNDIENQATTISMPRPNTNSDELRDCPQNNKAIALTCFGSQVTHRGGVTNIGDQVAQV

SEQ ID NO: 5227 - DNA, 2838 bp, Sorghum bicolor
  misc_feature: Ceres ANNOT ID no. 6042195
  misc_feature: Encodes the peptide sequence at SEQ ID NO 5228
atggaaatagctaacagaatcattctgctcctcttgttattacctggaattgctgttgcacaaaatgcttctggaggaagaacacaggaggtccatgtgggggtcatccttgatttggggtccttggtcggcaaaatagcaatcaccagcatttcattggctctagaggacttctatgctgcccaccaaaactatagcacaaagcttgttctccacatcagggattccaagagtgatgatgtccaggctgcatctcaagctcttgacctgttggagaattacaatgtagaaactatcattggtcctgagaaatcttcacaagctatatttatctcggaacttggaactaaaagtcatgttccagtcatctccttcactgcaacaagcccaactctatccactagcagtcttccatattttgtcagagcaacactaaatgactcagcacaagtgagctgcattgcctcaataattaaggcctatggatggagaaaggtcatctcaatctatgaagactctgaatacggtagaggtatcatatcttaccttgtcgatgtcctccaagaagttaatgtgcaggttccctaccgcagtgtgattcctccatcagcaactagtgaacaaattaccaaagaattatataagctgatgacaatgcaaacaagggtctacattgtgcacatgtcctcgatgttggcctccaccctcttcttaaaagctaaagaaataggaatgatggaaaaagggcatgtatggatcataactggtggagtaaccaatctcatagattctttgcatccttctgtcgtggaatcaatgaatggtgccttgggtgtccacttttatgttcccaaatcaacagaactggataacttcactacaaggtggaatatgaggtaccgaattgacaacccgactgacccaccctcaaaattaagcatctttggactgtggagctatgatacaatctgggcagtagcacaagctgcagaaaaggttggacttgccaatgccacatttcggaaaccaatatccaaacaaaaaacaacagacttggaaaccttggaaacatctagtaatggtccagaactcttgaaggaaatcatgcagagtaaatttataggtttgagtggcaggtttgacctttcagacaggcagctggttgtttcagcatttcaaataataaatatatttggaagagggtggagagaaataggatattggagtgcacaaaatggactttcaagaaaattaaatcaatcacaaccaacaacatattcaacctcaatgccagatctgaaccctgtgatctggccaggagaaaccacagacatacctaaaggctttgaggttcctgcaagtgggaagaagcttcaagttggtgtacgcccaagtggatatcaacaatttataaaggttgagaaggatcaaatcacaggtgcaactaaagcaactggcctttcagttgatgtgtttgaagaggcagtaaagatacttccatatgcagttccttttgagtatatattatttggctctccggaggatacaagtagcagaagctatgatgattttgtctaccaagttcatcttaagatatacgatatagtgattggagatataacaataagatataacagaactttctacgctgactttactgtgccatacacggaatcagggatagcaatggtggttcctgtcagggacagcataaacaagaacacatggattttcttgaagccactaacacctggcatgtggcttgggagcattgcattctttatctacactggtgtagtggtgttctcattggagtttctaggcaacaatcagaatgttcgtcggccaattcccagacagctcgggattctaatctttttctccctattcgaagagaaagagattgtggaacgctttttatctcggatagtgctgattgtgtggctgtgttttcttctggtagttacatcaagttacactgcaaacttgtcatcaatgttgactgtacaacagcttcatcctactgtgaatgatatccaagaactcctaaaaagtggagaaaatgtaggataccatcgtggttcatatgtcaagggacttttggaagaacttggttttgaaagatccaagatcaagccctatgatacaccagacgattttcacaatgcactttcaacaggaagcagtaatggtggtattgcagctctcgtgcatgaagttccttacattaaactgttccttgcaaaccactgcaaaggttacactatggtcggaccaatttataaggctgcaggttttggatatgcacttgcaaagggaaatcccctactcagcgacatctcaaaggcaatcctaaatgtaacagggggagataccatacttcaaatcgagaaaaaatggatagggtatcaaaatgactgccaaaatgtgggtcccatcacaggttcaagcagcctcacctttgacaacttcagggaactgttcatcctaactggagctgcttcaacttcttctcttttgatagcattggtaatttatgcctacaaaaagcagcacagatcaacagaagtcatagaagttgatagaacgcaggtagaagaaaacagagcaaatgaagataagaatgagcctcaagaaggaaaccaaggagtggcacctgaggaccatgtccagtttagacgagacagggaagaaaacgaccagctgcatgagcaaactggttcagaaagggtgggtgacagaaatcctcacacaagcacagatgcgtgcaatggttcagttgcctctcacaggggcgaaccaatcactgttctccaagcagaatccatcagaagttga

SEQ ID NO: 5228 - protein, 945 aa, Sorghum bicolor
  misc_feature: Ceres ANNOT ID no. 6042195
  misc_feature (46)..(399): Pfam Id: ANF_receptor Pfam Desc: Receptor family ligand binding region
  misc_feature (583)..(845): Pfam Id: Lig_chan Pfam Desc: Ligand-gated ion channel
  misc_feature (9)..(532): NCBI GI: 115479275 NCBI Desc: os09g0428300 [oryza sativa (japonica cultivar-group)]
  misc_feature (7)..(889): NCBI GI: 30013669 NCBI Desc: avr9/cf-9 rapidly elicited protein 141 [nicotiana tabacum]
  misc_feature (8)..(852): NCBI GI: 41017226 NCBI Desc: glutamate receptor 2.8 precursor (ligand-gated ion channel 2.8)
  misc_feature (8)..(852): NCBI GI: 12964235 NCBI Desc: ligand gated channel-like protein precursor [arabidopsis thaliana]
  misc_feature (11)..(852): NCBI GI: 41017205 NCBI Desc: glutamate receptor 2.7 precursor (ligand-gated ion channel 2.7)
MEIANRIILLLLLLPGIAVAQNASGGRTQEVHVGVILDLGSLVGKIAITSISLALEDFYAAHQNYSTKLVLHIRDSKSDDVQAASQALDLLENYNVETIIGPEKSSQAIFISELGTKSHVPVISFTATSPTLSTSSLPYFVRATLNDSAQVSCIASIIKAYGWRKVISIYEDSEYGRGIISYLVDVLQEVNVQVPYRSVIPPSATSEQITKELYKLMTMQTRVYIVHMSSMLASTLFLKAKEIGMMEKGHVWIITGGVTNLIDSLHPSVVESMNGALGVHFYVPKSTELDNFTTRWNMRYRIDNPTDPPSKLSIFGLWSYDTIWAVAQAAEKVGLANATFRKPISKQKTTDLETLETSSNGPELLKEIMQSKFIGLSGRFDLSDRQLVVSAFQIINIFGRGWREIGYWSAQNGLSRKLNQSQPTTYSTSMPDLNPVIWPGETTDIPKGFEVPASGKKLQVGVRPSGYQQFIKVEKDQITGATKATGLSVDVFEEAVKILPYAVPFEYILFGSPEDTSSRSYDDFVYQVHLKIYDIVIGDITIRYNRTFYADFTVPYTESGIAMVVPVRDSINKNTWIFLKPLTPGMWLGSIAFFIYTGVVVFSLEFLGNNQNVRRPIPRQLGILIFFSLFEEKEIVERFLSRIVLIVWLCFLLVVTSSYTANLSSMLTVQQLHPTVNDIQELLKSGENVGYHRGSYVKGLLEELGFERSKIKPYDTPDDFHNALSTGSSNGGIAALVHEVPYIKLFLANHCKGYTMVGPIYKAAGFGYALAKGNPLLSDISKAILNVTGGDTILQIEKKWIGYQNDCQNVGPITGSSSLTFDNFRELFILTGAASTSSLLIALVIYAYKKQHRSTEVIEVDRTQVEENRANEDKNEPQEGNQGVAPEDHVQFRRDREENDQLHEQTGSERVGDRNPHTSTDACNGSVASHRGEPITVLQAESIRS

SEQ ID NO: 5229 - DNA, 2103 bp, Sorghum bicolor
  misc_feature: Ceres ANNOT ID no. 6042201
  misc_feature: Encodes the peptide sequence at SEQ ID NO 5230
atggtgccgggtctgggcctggcctactcgtgggggagggatgcccggcggggcacgccggtggtggtgaccatggagaaccccaactactcggtggtggagattgacgggcccgaggcggaggcgctccaggccggcgtgcctgtgcctcctcccacggacaaaggccggggccggagcgccaagcagttcacctgggtgttgctcctccgcgcgcaccgtgccgctgggtgcctcgcgtcgctcgcagccgtcacctgggcgctgccgtctgccgtcgccaagcgcttccggcgggccgccgccgccgagggcctcggccacggccggggttggctgctctacaggttcatcaaggccctcttggcgctctctatgctcgccctcaccgtcgagctggcggcctactggaacgggtggcactttcagaggccgaatttgaccgtgccggaattgcatgtgctggaggtggaggacattcaggggtggctgcacacggcctacctcgcgtggatgtcattccgagcagactacatccgacggccgatcgagttcttgtccaaagtctgcatcttgctgtttgttgtccagtcgttggatcgcctcgccttgtgcatcggttgcttctggattaagctcaggaaaatcaagccgaggattgaaggggacccattccgggagggttcagggtatctgcacccaatggtgcttgttcagattcctatgtgcaatgagaaggaggtatatgagcagtcgatttcagccgtctgccagctagattggcctagggataaatttctaatccaggtgcttgatgattcgagcgacgagagcattcaaatgttgatcaaagcagaagtttctaagtggaaccagctgggtgtgaacattatctatcggcatcgggtgctgaggactgggtataaagctgggaacctcaattctgcaatgagctatgactatgtcaagaattttgaattcgttgccatttttgacgcggacttccaaccaagccctgattttctcaagaaaacaattccacattttgaggggaaccctgaggttggactagttcaagcccgatggagctttgtgaacaaggatgagaacctcttgacccgccttcagaatatcaacctttgcttccactttgaagtggagcagcaggtcaatggggtcttcttgaacttctttgggttcaatggaactgctggagtttggaggatccaagctttggaagaatcaggaggctggcttgagcggacaaccgtggaggatatggatattgctgttcgcgcacacctgaatggatggaagttcatcttcctgaatgatgtaaaggtcttgtgtgaagttccagaatcttatgaagcatatcggaaacagcaacaccggtggcattctggcccaatgcaccttttccggctgtgccttccggacataattactgccaagatctcctcatggaagaaggcaaatttaatactattgttctttcttttgaggaagttgatacttcctttctattctttcacattattttgtgtcattcttccactaaccatgttcgttcccgaggccgagttgcctgtgtgggtcatctgttatgtgccggttttcatgtccttcttgaatattctgccatccccaagatcatttcccttcattgtaccatacctcctcttcgagaacaccatgtcagtgaccaagttcaacgcaatggtgtctgggttgttcaaacttgggagctcttacgaatgggttgtcactaagaaatctggtcgatcatctgaattggatctcttgacatcgtcagaaaagaataggaagtgcatcacacttcctcagctccagaagcaattgcctgaaaagaatgaattgatcgagatcaacgtgcctaaggaacagcatgagaaggtgccacatgatgccaaaaaggctaacaaaatctacaagaaggagcttgctctttctctgctcctactgactgctgcgactcggagcctcttgtctgctcaagggattcatttctacttccttctgttccagggggtgtcattccttgtcgttggccttgatctaattggtgaacagataagttga

SEQ ID NO: 5230 - protein, 700 aa, Sorghum bicolor
  misc_feature: Ceres ANNOT ID no. 6042201
  misc_feature (4)..(699): NCBI GI: 34419218 NCBI Desc: tpa: cellulose synthase-like c2 [oryza sativa (indica cultivar-group)]
  misc_feature (55)..(699): NCBI GI: 50726490 NCBI Desc: cslc2 [oryza sativa (japonica cultivar-group)]
  misc_feature (215)..(699): NCBI GI: 115479273 NCBI Desc: os09g0428000 [oryza sativa (japonica cultivar-group)]
  misc_feature (215)..(699): NCBI GI: 17385981 NCBI Desc: cslc2 [oryza sativa]
  misc_feature (11)..(700): NCBI GI: 114224789 NCBI Desc: cellulose synthase-like c3 [physcomitrella patens]
  misc_feature: Useful for making plants with altered cell wall content and/or composition
  misc_feature: GREAT-hit functional homolog of the protein sequence encoded by LOCUS at2g24630
  misc_feature: Functional homolog of the protein sequence encoded by LOCUS at3g28180
  misc_feature: GREAT-hit functional homolog of the protein sequence encoded by LOCUS at4g31590
  misc_feature: Useful for making plants with altered cell wall content and/or composition
  misc_feature: Functional homolog of the protein sequence given in SEQ ID NO 13908
  misc_feature: Useful for making plants with altered carbohydrate content
  misc_feature: Functional homolog of the protein sequence given in SEQ ID NO 13855
  misc_feature: The sequence is a functional homolog of SEQ ID NO. 403 in the 11/188,298 US application
MVPGLGLAYSWGRDARRGTPVVVTMENPNYSVVEIDGPEAEALQAGVPVPPPTDKGRGRSAKQFTWVLLLRAHRAAGCLASLAAVTWALPSAVAKRFRRAAAAEGLGHGRGWLLYRFIKALLALSMLALTVELAAYWNGWHFQRPNLTVPELHVLEVEDIQGWLHTAYLAWMSFRADYIRRPIEFLSKVCILLFVVQSLDRLALCIGCFWIKLRKIKPRIEGDPFREGSGYLHPMVLVQIPMCNEKEVYEQSISAVCQLDWPRDKFLIQVLDDSSDESIQMLIKAEVSKWNQLGVNIIYRHRVLRTGYKAGNLNSAMSYDYVKNFEFVAIFDADFQPSPDFLKKTIPHFEGNPEVGLVQARWSFVNKDENLLTRLQNINLCFHFEVEQQVNGVFLNFFGFNGTAGVWRIQALEESGGWLERTTVEDMDIAVRAHLNGWKFIFLNDVKVLCEVPESYEAYRKQQHRWHSGPMHLFRLCLPDIITAKISSWKKANLILLFFLLRKLILPFYSFTLFCVILPLTMFVPEAELPVWVICYVPVFMSFLNILPSPRSFPFIVPYLLFENTMSVTKFNAMVSGLFKLGSSYEWVVTKKSGRSSELDLLTSSEKNRKCITLPQLQKQLPEKNELIEINVPKEQHEKVPHDAKKANKIYKKELALSLLLLTAATRSLLSAQGIHFYFLLFQGVSFLVVGLDLIGEQIS

SEQ ID NO: 5231 - DNA, 1620 bp, Sorghum bicolor
  misc_feature: Ceres ANNOT ID no. 6042227
  misc_feature: Encodes the peptide sequence at SEQ ID NO 5232
atggcgtcggctcgacttcgcctacgcctcctcgacggctacggtctcctcatgtcgccggcgctctccgcgacggcgctgcggtcctcgcgaggcctgcgcgcgctctgcacgctctccaccacgctgcggtcgggcgccggcgaggacgagatcgagcgcatccgccgcgagttcgaggacgccaagcgcaactacctcagcatccccgccgccatcaaggacatgcccaagatgaacccgcaaggcatttacgtcaacaagaacgtcaagctggacgacctccaggtctacggcttcgactacgactacacgctgtcgcactactccgagcacctgcagtgcctcatttacaatcttgcaaaaaaacacttggtcaatgagttgaagtatccggagagttgcttgcagtacgagtatgacggcaccttccctatcaggggtctgtactatgacagacttaaagggtgccttctcaagctcgatttcttcggctcgattgaaccagatggttgcttctttgggcggcagaggctgagtttgagtgagataaaagagctctatggcacacgtcatattggcagagatcaagctcgtaaccttgttgggctgatggatgtcttctgttttagtgaggcatgtctgattgccgatattgttcagcactttatagatgcaaaactggagtttgatccatcttacgtatacgaggatgtaaaccaatcgattcagcatgttcacagaagtggtttaattcacaggcaaattctttctgagcctcagaaatttctgatgaaaaaaagccaggtgttccgtttcttgaagatgcttaaagagaaagggaaaaagctatttcttcttactaattcacctttctactttgtagatggagggatgcgttatttgctagaggaccaacattttgatggaaattcctggagggaactgtttgatgttgtgattgcgcaggcaaataaaccaactttctataactcagatcacccattcagggtgtatgacactcaaaaggacaccttagcttttactgcagttgacaagtttctgccagatcaagtatactaccatggctgtttgaaatcatttctgcagatcacaaaatggagaggcccagaggtgatatattttggtgaccatcttttgagtgacttgagaggaccttcaaaagctggttggcgaacagctgctgtaatccgagaacttgaggatgaaatagaaatccagaacggtgacagctatcgattccaacaggcaaaattgagtataatacatgatctacttgggaaagtccatgcaactgtggttagcaccgagaaagggcaagtctacagagcgttgctcgatgagttgaatgcagaaagacgacaatgccgatctgggattcgagatttgttcaatagctcttttggtgcaacatttcttacagacactggaagggaatcatcatttgcctatcacattcatcaatacgccgatatttacacgagcaagcttgagaacttcttatcatatgctcctgaatcttggcttcatccacctcatgacataaagatcatgccacacaatgcgaaggtcccagcaagcctgttcagtacctcctag

SEQ ID NO: 5232 - protein, 539 aa, Sorghum bicolor
  misc_feature: Ceres ANNOT ID no. 6042227
  misc_feature (159)..(534): Pfam Id: 5_nucleotid Pfam Desc: 5' nucleotidase family
  misc_feature (1)..(539): NCBI GI: 50725908 NCBI Desc: nucleotidase-like protein [oryza sativa (japonica cultivar-group)]
  misc_feature (73)..(531): NCBI GI: 60471528 NCBI Desc: 5'-nucleotidase [dictyostelium discoideum]
  misc_feature (73)..(531): NCBI GI: 42733885 NCBI Desc: similar to homo sapiens (human). tu12b1-ty [dictyostelium discoideum]
  misc_feature (34)..(518): NCBI GI: 119618123 NCBI Desc: 5'-nucleotidase domain containing 3, isoform cra_c [homo sapiens]
  misc_feature (79)..(518): NCBI GI: 7706749 NCBI Desc: tu12b1-ty protein [homo sapiens]
MASARLRLRLLDGYGLLMSPALSATALRSSRGLRALCTLSTTLRSGAGEDEIERIRREFEDAKRNYLSIPAAIKDMPKMNPQGIYVNKNVKLDDLQVYGFDYDYTLSHYSEHLQCLIYNLAKKHLVNELKYPESCLQYEYDGTFPIRGLYYDRLKGCLLKLDFFGSIEPDGCFFGRQRLSLSEIKELYGTRHIGRDQARNLVGLMDVFCFSEACLIADIVQHFIDAKLEFDPSYVYEDVNQSIQHVHRSGLIHRQILSEPQKFLMKKSQVFRFLKMLKEKGKKLFLLTNSPFYFVDGGMRYLLEDQHFDGNSWRELFDVVIAQANKPTFYNSDHPFRVYDTQKDTLAFTAVDKFLPDQVYYHGCLKSFLQITKWRGPEVIYFGDHLLSDLRGPSKAGWRTAAVIRELEDEIEIQNGDSYRFQQAKLSIIHDLLGKVHATVVSTEKGQVYRALLDELNAERRQCRSGIRDLFNSSFGATFLTDTGRESSFAYHIHQYADIYTSKLENFLSYAPESWLHPPHDIKIMPHNAKVPASLFSTS

SEQ ID NO: 5233 - DNA, 1590 bp, Sorghum bicolor
  misc_feature: Ceres ANNOT ID no. 6042239
  misc_feature: Encodes the peptide sequence at SEQ ID NO 5234
atggcatggggagcttgcactgctgcgctcctgctgctgctcctcctcgccgccgccgccgccaccgcagcagcaggtggtaatggcggcggcgtgcattgccttcaccttgaggaggacgggagccggcaccggcaccagcaccacctcagcaggagagccttgcggcaggggaggcagaggcacccgcaccacctgaggtcaagagccgtgggtggcgccacggtgctcgagctcaggcaccgcagcttcagctccgcgccgccggccagtagcagggaggaggaggtggacggcctcctgtccaccgacgccgcgcgcgtgtcgtcgctgcaacggcgcatcgacaggtacaggcggctgatgatcacctcgtcggccgaggtggcggtggcggtggccgcgtccaaggcgcaggtgcccgtcacctcgggcgccaagctccggacgctcaactacgtggccaccgtcgggctgggcggcggcgaggccacggtgatcgtggacacggccagcgagctcacctgggtgcagtgcgcgccgtgcgagtcgtgccacgaccagcaggacccgctcttcgacccgtcctcgtcgccgtcctacgccgccgtgccctgcaactcctcctcctgcgacgcgctgcagctggccacgggcggcacgtcgggcggcgccgcggcgtgccagggccaggaccagtcggcggcggcctgcagctacacgctcagctaccgcgacggctcctactcccgcggcgtgctggcgcacgacaggctgagcctggccggggaggtcatcgacggcttcgtgttcggctgcggcaccagcaaccagggcccgccgttcggcggcacgtcgggcctcatggggctcggccggagccagctctcgctcgtctcccagaccatggaccagttcggcggcgtcttctcctactgcctcccgctcaaggagtccgactcgtcggggtccctcgtcatcggcgacgactcgtcggtgtaccggaactcgacaccgatcgtgtacgcctccatggtgtccgaccctctccaaggtcccttctacttcgtgaacctgaccgggatcacggtcggcggccaggaggtggaatcctcgggcttctcgtccggcggcggcggcggcaaggccatcatcgactccggcaccgtgatcacgagcctcgtgccgtcgatctacaacgccgtcaaggccgagttcctgagccagttcgcagagtacccgcaggctccggggttctccatcctcgacacgtgcttcaacatgaccgggctcagggaggtccaggtgcccagcctgaagctcgtgttcgacggcggcgtggaggtggaggtggactccggcggcgtgctctacttcgtcagcagcgactcctcgcaggtgtgcctcgccatggcgcccctgaaatccgagtacgagaccaacatcatcggcaactaccagcagaagaacctgagggtcatctttgacacctcgggctctcaggggcagcagccatgggctatatatgtgaatatctttatacttgcagatttgtttctgagattacctctggtgattggcaaatggtaa

SEQ ID NO: 5234 - protein, 529 aa, Sorghum bicolor
  misc_feature: Ceres ANNOT ID no. 6042239
  misc_feature (152)..(472): Pfam Id: Asp Pfam Desc: Eukaryotic aspartyl protease
  misc_feature (33)..(501): NCBI GI: 2541876 NCBI Desc: cnd41, chloroplast nucleoid dna binding protein [nicotiana tabacum]
  misc_feature (100)..(501): NCBI GI: 24430421 NCBI Desc: 41 kd chloroplast nucleoid dna binding protein (cnd41) [nicotiana sylvestris]
  misc_feature (114)..(501): NCBI GI: 8979711 NCBI Desc: nucleoid dna-binding protein cnd41-like protein [arabidopsis thaliana]
  misc_feature (73)..(499): NCBI GI: 53792202 NCBI Desc: nucleoid dna-binding protein cnd41-like [oryza sativa (japonica cultivar-group)]
  misc_feature (73)..(499): NCBI GI: 115438424 NCBI Desc: os01g0608300 [oryza sativa (japonica cultivar-group)]
MAWGACTAALLLLLLLAAAAATAAAGGNGGGVHCLHLEEDGSRHRHQHHLSRRALRQGRQRHPHHLRSRAVGGATVLELRHRSFSSAPPASSREEEVDGLLSTDAARVSSLQRRIDRYRRLMITSSAEVAVAVAASKAQVPVTSGAKLRTLNYVATVGLGGGEATVIVDTASELTWVQCAPCESCHDQQDPLFDPSSSPSYAAVPCNSSSCDALQLATGGTSGGAAACQGQDQSAAACSYTLSYRDGSYSRGVLAHDRLSLAGEVIDGFVFGCGTSNQGPPFGGTSGLMGLGRSQLSLVSQTMDQFGGVFSYCLPLKESDSSGSLVIGDDSSVYRNSTPIVYASMVSDPLQGPFYFVNLTGITVGGQEVESSGFSSGGGGGKAIIDSGTVITSLVPSIYNAVKAEFLSQFAEYPQAPGFSILDTCFNMTGLREVQVPSLKLVFDGGVEVEVDSGGVLYFVSSDSSQVCLAMAPLKSEYETNIIGNYQQKNLRVIFDTSGSQGQQPWAIYVNIFILADLFLRLPLVIGKW

SEQ ID NO: 5235 - DNA, 1524 bp, Sorghum bicolor
  misc_feature: Ceres ANNOT ID no. 6042240
  misc_feature: Encodes the peptide sequence at SEQ ID NO 5236
atggacgcggatagcctcgtcggccaggacccgacgtcgggggcgcggccaagcggcggggagcgcgactgggcggcggccgtgctgaagccggtgcggtggatgcggatgctgtgccgggagctgggcgcgacgttcgtggctggggtggtgctggtgtacggcctcagccagggcttcgccggctccttcttccgagtggcgtcggactactactggaaggacgtgcagcggttgcaaccggccactgtgcagttcctctccgtcttcttcttcattccatgggtgctcaagccgctctgggggatcatgaccgacgtctttcccgtctgcgggtaccgccgccgcccgtacttcctcttctcaggaatacttggaacggtttcagctgctattgttgcaataactgttggattgccagtgagttctgctgtactttgcttggtgggaatctcaacagcagtcgccattgctgatgtaacaatagatgcttgcattgcaaagaatagtattgataagccggcgctggctccagacatgcagagcctttgtgcattttcatcatctctaggtgcacttgttgggtatgctacaagtggcatgtttgtccatcatcttggagcacagggtgcgttaggtgttatggctatagctcctgccacagtggttttccttggatttttcatatatgaactgaaagcacgtcaacataatgttaaagagaaggttttgaacaaggttagtggcgcagtgaaaggaatggttcggactataaggtatccagtagtgtggaaaccatctctttacatgttcctttcgctggctctgagtatcagcacccatgaggggcaattctactggtatactaacaagacaccacctaatcctggattttcacaggaattcgtcgggctggtccacgccatcggcgcggtggcgtccatgctgggcgtcgtcgtctaccacaagtggctcaaggactacccgttccggagcatcctcctgtacgcgcagctgctgtacggcgtgtcggggctcctggacctcaccttcgtgctccggtggaacctggcgctgggcgtccccgacgcggcgttcgtgaccctggaggagtgcgtgtcccgcgtggtgggccgcgtccgcctgatgccgatgatggtgctgagcaccaggctgtgcccgccgggcatggagggcaccttcttcgcgctgctcatgtgcatcgacagcctcggcgcgctggcggccaaggccggcggcgcggcggcgctgcgcgcgctgcgggtgaccaggaccgacttcggccgcctctggctcgccgtgctgctcaggaacgtgctcaggctcgccacgctcgccgccatcggcctcgtgcccgccgcggggcagacagacgtgctgctggtgccaagcgagctcggtctggtgctggtgagctcgccggctagtgtggccgacgacgaggacgaagagaggctgcagctggcgatgctcacttcacacactgacgacgacgatgtataa

SEQ ID NO: 5236 - protein, 507 aa, Sorghum bicolor
  misc_feature: Ceres ANNOT ID no. 6042240
  misc_feature (58)..(471): Pfam Id: BT1 Pfam Desc: BT1 family
  misc_feature (18)..(506): NCBI GI: 50726132 NCBI Desc: integral membrane transporter-like protein [oryza sativa (japonica cultivar-group)]
  misc_feature (4)..(507): NCBI GI: 92897812 NCBI Desc: biopterin transport-related protein bt1; major facilitator superfamily mfs_1 [medicago truncatula]
  misc_feature (31)..(473): NCBI GI: 55773865 NCBI Desc: integral membrane transporter-like protein [oryza sativa (japonica cultivar-group)]
  misc_feature (20)..(503): NCBI GI: 15238691 NCBI Desc: integral membrane transporter family protein [arabidopsis thaliana]
  misc_feature (9)..(473): NCBI GI: 70663896 NCBI Desc: osjnba0029h02.8 [oryza sativa (japonica cultivar-group)]
MDADSLVGQDPTSGARPSGGERDWAAAVLKPVRWMRMLCRELGATFVAGVVLVYGLSQGFAGSFFRVASDYYWKDVQRLQPATVQFLSVFFFIPWVLKPLWGIMTDVFPVCGYRRRPYFLFSGILGTVSAAIVAITVGLPVSSAVLCLVGISTAVAIADVTIDACIAKNSIDKPALAPDMQSLCAFSSSLGALVGYATSGMFVHHLGAQGALGVMAIAPATVVFLGFFIYELKARQHNVKEKVLNKVSGAVKGMVRTIRYPVVWKPSLYMFLSLALSISTHEGQFYWYTNKTPPNPGFSQEFVGLVHAIGAVASMLGVVVYHKWLKDYPFRSILLYAQLLYGVSGLLDLTFVLRWNLALGVPDAAFVTLEECVSRVVGRVRLMPMMVLSTRLCPPGMEGTFFALLMCIDSLGALAAKAGGAAALRALRVTRTDFGRLWLAVLLRNVLRLATLAAIGLVPAAGQTDVLLVPSELGLVLVSSPASVADDEDEERLQLAMLTSHTDDDDV

SEQ ID NO: 5237 - DNA, 3150 bp, Sorghum bicolor
  misc_feature: Ceres ANNOT ID no. 6042247
  misc_feature: Encodes the peptide sequence at SEQ ID NO 5238
  misc_feature: Down-regulated in shoot tissues in response to salicylic acid treatment
  misc_feature: Up-regulated in shoot tissues in response to methyl jasmonate treatment
  misc_feature: Down-regulated in root tissues in response to methyl jasmonate treatment
atggaggccagcgccgggctggtggccgggtcgcacaaccggaacgagctggtgctgatccggggccacgaggaccccaagccgctgcgggcgctgagcgggcaggtgtgcgagatttgcggcgacgaggtcgggctcacggtggacggcgacctcttcgtcgcctgcaacgagtgcggcttccccgtgtgccggccctgctacgagtacgagcgccgggagggcacgcagaactgcccacagtgcaagacgcggtacaagcgcctcaaggggagcccgagggttgccggggacgatgacgaggaggacatcgacgacctggagcacgagttcaacatcgacgacgagaagcagaagcagctggagggcggcatgcagaacagccagatcaccgaggcgatgctgcacggcaagatgagctacgggaggggccccgacgacggcgagggcaacaacaccccgcagatcccgcccatcatcaccggctcccgctccgtgccggtgagcggtgagtttccgattaccaacgggtatggctatggccacggcgagctctcgtcttccctgcacaagcgcatccatccctaccctgtgtctgagccagggagtgccaagtgggacgagaagaaagaagtgagctggaaggagaggatggacgactggaagtccaagcacggcggcgccgatcccgaagacatggacgccgacgtgccactggacgacgaggcgaggcagccgctgtcgcggaaggtgtcgatcgcgtcgagcaaggtgaacccgtaccggatggtcatcgtggtgcgtctcgtcgtgctcgccttcttcctccgctaccgcatcctgcaccctgtcccggacgccatcgggctgtggctcgtctccatcatctgcgagatctggttcgccatctcctggatcctggaccagttccccaagtggttccccatcgaccgcgagacgtacctggaccgcctcaccctccggtacgagagggaaggggagccgtcgctgctgtcggcggtggacctcttcgtgagcacggtggacccgctcaaggagccgccgctggtgaccgccaacaccgtgctctccatcctcgccgtcgactaccccgtcgacaaggtctcctgctacgtctccgacgacggcgcgtccatgctcaccttcgaggcgctgtcggagacggccgagttcgcgcgcaagtgggtgccgttctgcaagaagttcagcatcgagccacgcgcgcccgagttctacttctcgctcaaggtcgactacctcaaggacaaggtgcagcctaccttcgtgcaggagcgccgcgccatgaagagagagtacgaggagttcaaggtccggatcaacgcgctggtggccaaggccatgaaggtgccggcggaggggtggatcatgaaggacggcacgccgtggcccgggaacaacacccgcgaccaccccggcatgatccaggtgttcctgggacacagcggcggccacgacaccgagggcaacgagctgccccgcctcgtgtacgtctcccgtgagaagcgcccgggcttccagcaccacaagaaggccggcgccatgaacgctctgatccgcgtctccgccgtgctgaccaacgcgcccttcatgctcaacttggactgtgatcactacatcaacaacagcaaggccatccgggaggccatgtgtttcctcatggaccctcaggtcggccggaaggtctgctacgtgcagttcccgcagaggttcgacggcatcgacgcgcacgaccgatacgccaacaggaacaccgtcttcttcgacatcaacatgaaggggctggacggcatccagggcccggtgtacgtcgggacagggtgcgtgttccggcggcaggcgctctacggctacaaccctcccaagggtcccaagaggcccaagatggtgacctgcgactgctgcccctgcttcggtcgcaagaagcgcaagcacgccaaggacgggctgccggagggcaccgcggatatcggagtggacagtgacaaggagatgctcatgtcccatatgaacttcgagaagcgtttcgggcagtccgcggcgttcgtcacgtccacgctcatggaggaaggcggcgtccctccgtcgtcgagccccgccgcgctcctcaaggaggccatccatgtcatcagctgcggctacgaggacaagaccgactggggactggagcttgggtggatctacgggtcgatcacggaggacatcctgacggggttcaagatgcactgccgcgggtggcgctccgtgtactgcatgccgaagcgggcggcgttcaaggggtcggcgcccatcaatctatccgaccgtctcaaccaggtgctccggtgggcgctggggtccgtcgagatcttcttcagccgccacagcccgctgctgtacggctacaagaacggcaacctcaagtggctggagcgcttcgcctacatcaacaccaccatctaccctttcacctcgctcccgctgctcgcctactgtaccctccccgccgtatgcctcctcaccggcaagttcatcatgccgtcgattagcacgttcgccagcttgttcttcatcgcgctcttcatgtccatcttcgcgacgggcatcctggagatgcggtggagcggggtgagcatcgaggagtggtggaggaacgagcagttctgggtcatcggcggcgtgtcggcgcatctcttcgccgtcgtgcagggcctgctcaaggtcctggcagggatcgacaccaacttcaccgtcacctccaaggccaccggcgacgaggacgacgagttcgccgagctctacgcattcaagtggaccacgctcctcatcccgcccaccacgctgctcatcatcaacatcatcggcgtcgtggccggcatctccgacgccatcaacaacgggtaccagtcatggggcccgctcttcggcaagctcttcttcgcattctgggtcatcgtccacctctacccgttcctcaaggggctcatggggcgccagaacaggacgcccaccattgttgtcatctggtccgtgctgctggcctccatcttctccctgctctgggtcaggatcgaccccttcatcgtcaggacaaagggcccggacgtcaggcagtgtggcatcaactgctga

SEQ ID NO: 5238 - protein, 1049 aa, Sorghum bicolor
  misc_feature: Ceres ANNOT ID no. 6042247
  misc_feature (246)..(1044): Pfam Id: Cellulose_synt Pfam Desc: Cellulose synthase
  misc_feature (1)..(1049): NCBI GI: 38532104 NCBI Desc: cellulose synthase catalytic subunit 12 [zea mays]
  misc_feature (1)..(1049): NCBI GI: 67003911 NCBI Desc: cellulose synthase 3 [eucalyptus grandis]
  misc_feature (1)..(1049): NCBI GI: 23534479 NCBI Desc: cellulose synthase [populus tremuloides]
  misc_feature (1)..(1049): NCBI GI: 92870152 NCBI Desc: zinc finger, ring-type; cellulose synthase; zinc finger, fyve/phd-type [medicago truncatula]
  misc_feature (108)..(1049): NCBI GI: 73917715 NCBI Desc: cellulose synthase a catalytic subunit 7 [udp-forming] (atcesa-7) (irregular xylem protein 3) (atirx3)
  misc_feature (108)..(1049): SWISSPROT Homolog: EC 2.4.1.12 Cellulose synthase A catalytic subunit 7 [UDP-forming]
  misc_feature: Useful for making plants with altered cell wall content and/or composition
  misc_feature: Functional homolog of the protein sequence encoded by LOCUS at5g05170
  misc_feature: GREAT-hit functional homolog of the protein sequence encoded by LOCUS at5g17420
  misc_feature: Useful for making plants with altered cell wall content and/or composition
  misc_feature: Useful for making plants with modulated biomass
  misc_feature: Functional homolog of the protein sequence given in SEQ ID NO 13909
  misc_feature: The sequence is a functional homolog of SEQ ID NO 26 in US patent 7312377
  misc_feature: Useful for making plants with modulated plant growth and development
  misc_feature: Functional homolog of the protein sequence given in SEQ ID NO 13629
  misc_feature: Down-regulated in shoot tissues in response to salicylic acid treatment
  misc_feature: Up-regulated in shoot tissues in response to methyl jasmonate treatment
  misc_feature: Down-regulated in root tissues in response to methyl jasmonate treatment
MEASAGLVAGSHNRNELVLIRGHEDPKPLRALSGQVCEICGDEVGLTVDGDLFVACNECGFPVCRPCYEYERREGTQNCPQCKTRYKRLKGSPRVAGDDDEEDIDDLEHEFNIDDEKQKQLEGGMQNSQITEAMLHGKMSYGRGPDDGEGNNTPQIPPIITGSRSVPVSGEFPITNGYGYGHGELSSSLHKRIHPYPVSEPGSAKWDEKKEVSWKERMDDWKSKHGGADPEDMDADVPLDDEARQPLSRKVSIASSKVNPYRMVIVVRLVVLAFFLRYRILHPVPDAIGLWLVSIICEIWFAISWILDQFPKWFPIDRETYLDRLTLRYEREGEPSLLSAVDLFVSTVDPLKEPPLVTANTVLSILAVDYPVDKVSCYVSDDGASMLTFEALSETAEFARKWVPFCKKFSIEPRAPEFYFSLKVDYLKDKVQPTFVQERRAMKREYEEFKVRINALVAKAMKVPAEGWIMKDGTPWPGNNTRDHPGMIQVFLGHSGGHDTEGNELPRLVYVSREKRPGFQHHKKAGAMNALIRVSAVLTNAPFMLNLDCDHYINNSKAIREAMCFLMDPQVGRKVCYVQFPQRFDGIDAHDRYANRNTVFFDINMKGLDGIQGPVYVGTGCVFRRQALYGYNPPKGPKRPKMVTCDCCPCFGRKKRKHAKDGLPEGTADIGVDSDKEMLMSHMNFEKRFGQSAAFVTSTLMEEGGVPPSSSPAALLKEAIHVISCGYEDKTDWGLELGWIYGSITEDILTGFKMHCRGWRSVYCMPKRAAFKGSAPINLSDRLNQVLRWALGSVEIFFSRHSPLLYGYKNGNLKWLERFAYINTTIYPFTSLPLLAYCTLPAVCLLTGKFIMPSISTFASLFFIALFMSIFATGILEMRWSGVSIEEWWRNEQFWVIGGVSAHLFAVVQGLLKVLAGIDTNFTVTSKATGDEDDEFAELYAFKWTTLLIPPTTLLIINIIGVVAGISDAINNGYQSWGPLFGKLFFAFWVIVHLYPFLKGLMGRQNRTPTIVVIWSVLLASIFSLLWVRIDPFIVRTKGPDVRQCGINC

SEQ ID NO: 5239 - DNA, 1362 bp, Sorghum bicolor
  misc_feature: Ceres ANNOT ID no. 6042255
  misc_feature: Encodes the peptide sequence at SEQ ID NO 5240
atggccgttgaggtcgtcacctccgagctggtggcgccgagcgagaccacgccgcggcgcgcgctctggctgtccaacctcgacctcgccgcgcggaacggctacaccccgacggtctacttcttccgccgccgctgtccccagccccaggacggcagcggcggcgacgacgacgaccgggctcctcagcagccgagcccggacttcttctcggccgacgtgctgcgtgcggcgctggccgccgcgctggtccagttctacccgtttgccggccgcctacgcgcgggccgcgacgacgacgggcgcgccgagatcgactgcaacgccgcgggcgcgctcttcgtcgtcgcgcgttccgccgccgcgctcgaggacttcgacggcttcgcgccgtccaaggccatgaacgacacgttcgtgccgaaatacgactccacggccggccccgacgcaccgttgctcctgcttcaggtcaccttcttcaggtgcggcggcgtgacgctcggcacggccatgcaccccttcgtcatcgacggccgcagcgccttccacttcatccggacgtgggccagcatcgcccgtggagacaccgccgccgccgccgtgcccccgtcgcttgaccgcacgcccctccgggcgcgcccactgccgacggtcctcttcgaccacacctacgagtacggcggccgcacctccaggccaccgacgacaggaggcaacaacaaggcggcggagtacgccagcgcgatcctccgcgtgaccggcgcgcaggccgccgcgctccgtgcccgcgcgggcgcggtgtccaccttccgcgcgctggtggcgcacgtctggcggtgcgcgtgcgcggcgcgcgcgctggctcccgacgccgagtcccggctctacacgatggtggacatgcgcgcccgcctgtcgccgccgctgccggacgccttcttcggcaacgcggtggcgcgcacctccgtgtccgccgtcgtcggcgacctcctggccaacccgctgggtttcggcgcgcgtcggctccgcgcggcgacggggcacggggacgagtacgcgcggtcgctgctggactacctggagacggccgacctggcggcgctgccgcgcggtggactcgccggcacggacctgcgcgtgatcagctggctggggatgccgtcctacgacgcggacttcgggtggggagagccggcgctgctggcgccggcgctcatgtactacccggggttcgtgtacctgttgaactgccccggcaacggcaagggcggcggtgtcgcggtggccgtcgcgctggagcccgaacgcatggagcggttcaaggagctcttcttcgaggagctggccgcgctggagtga

SEQ ID NO: 5240 - protein, 453 aa, Sorghum bicolor
  misc_feature: Ceres ANNOT ID no. 6042255
  misc_feature (1)..(449): Pfam Id: Transferase Pfam Desc: Transferase family
  misc_feature (66)..(447): NCBI GI: 82568711 NCBI Desc: alcohol acyl-transferase [prunus mume]
  misc_feature (66)..(447): NCBI GI: 133873117 NCBI Desc: hydroxycinnamoyl-coa shikimate/quinate hydroxycinnamoyltransferase [coffea arabica]
  misc_feature (66)..(447): NCBI GI: 116486991 NCBI Desc: hydroxycinnamoyl transferase [coffea arabica]
  misc_feature (66)..(447): NCBI GI: 134035932 NCBI Desc: hydroxycinnamoyl-coa shikimate/quinate hydroxycinnamoyltransferase [coffea canephora]
  misc_feature (66)..(447): NCBI GI: 6469032 NCBI Desc: n-hydroxycinnamoyl/benzoyltransferase [ipomoea batatas]
  misc_feature: Useful for making plants with altered Lignin content
  misc_feature: Useful for making plants with altered cell wall content and/or composition
  misc_feature: Functional homolog of the protein sequence given in SEQ ID NO 12900
MAVEVVTSELVAPSETTPRRALWLSNLDLAARNGYTPTVYFFRRRCPQPQDGSGGDDDDRAPQQPSPDFFSADVLRAALAAALVQFYPFAGRLRAGRDDDGRAEIDCNAAGALFVVARSAAALEDFDGFAPSKAMNDTFVPKYDSTAGPDAPLLLLQVTFFRCGGVTLGTAMHPFVIDGRSAFHFIRTWASIARGDTAAAAVPPSLDRTPLRARPLPTVLFDHTYEYGGRTSRPPTTGGNNKAAEYASAILRVTGAQAAALRARAGAVSTFRALVAHVWRCACAARALAPDAESRLYTMVDMRARLSPPLPDAFFGNAVARTSVSAVVGDLLANPLGFGARRLRAATGHGDEYARSLLDYLETADLAALPRGGLAGTDLRVISWLGMPSYDADFGWGEPALLAPALMYYPGFVYLLNCPGNGKGGGVAVAVALEPERMERFKELFFEELAALE

SEQ ID NO: 5241 - DNA, 2484 bp, Sorghum bicolor
  misc_feature: Ceres ANNOT ID no. 6042265
  misc_feature: Encodes the peptide sequence at SEQ ID NO 5242
atgggctctcagctagagggagacgccaccgccgccatcgccgccgatgaggtcgtctacctccacggcgtcctggaagcgacagtgttcgaggccgagcacctccacaacgccatccacggccggatcatggaggccacggagaagatgcaggagtccctaggcgtgcactgcctccagcacagccggctctacgtcgacgtcgacgtcggcgcggcgcgggtggcgcgcacccgggaggtggagttccaccccacccgcccggcctggaaccagtcgttccgcctgcactgcgcctaccccgccgcggcggtcaccttcacggtcaagaaccagcacctcatcggcgcgggcgtcctcggcgccgggtccgtgcccgccgcgcgcgtcgcctccggacagccgctggagtgctggctcgacctccgcggcggcgagcacgcccacgagacgcacacgccgagcctccgcgtccgcctgcacttctttgacgtggagcgtgacccgtcctggggcgccggcgtccgcctccccgaattcgcgggcgtcaagccggcgtttttcccggagcggaccaactgcagcgtcacgctgtaccagaacgcgcacctgtccgacgcgttcgacccgggggtccgcctcgacggcgggctggcgtaccggccggcgcggctgtgggaggacctgttcgccgccatccgcgacgcgcggcggttcgtgtacgtcgccgggtggtcggtgaacacggagatcacgctggtgcgcgacgcgggccgtcgcgcggcggtccccgaaggcgccgagggcgtcacgctgggcgagctgctgaagcggaaggccgacgaaggggtggccgtgctggtgatgccgtggcaggacaacacgtccgtgtcgttcctcggcaacgccggcctgatgaagacgcacgacgaggagacccgtaggttcttcgagggcaccaacgtgaggtgcttcctctgcccgcgcaacgccgacgcgtcgctgaccatggtgcagcacgtcgagaccagcgccgagttcacgcaccaccagaagaccgtcacgctcgacgcagccacgccgggcaccgacgaacgccacgtcgtcagcttcatcggcggcatagacctctgcgacggcaggtacgacgacgagaaccacacgctgttcagggacctcgacacgacgtacctccacgacttcatgcagaacaactacaagcactcctccctgcggcgcggcggcccgcgggagccgtggcacgacgtgcactgcagactggaaggtcccgcggcgtgggacgtgctcgccaacttcgagcagcggtggaggaagcaggcgccggaggacatgcgcggctgcctgctcgacctgagcccggcgacgttccccgaccccgtcagcaacgacccgtggaacgtgcaggtgttccggtccatcgacgacgcgtcggtcgtggggttcccctccgacccggccgaggccgccgccatggggctggcgagcggcaaggacgtcacggtggaccgcagcatacagatcggctacgtggaggccgtccggcgcgcgcggcggttcatctacatcgagaaccagtacttcctcggcgggtgcgcgtcgtgggcggaggacagggacgccgggtgcctgaacctggtgcccgtcgagatcgcgctcaaggtcgccgccaagatccggcgcggcgagcggttcgcagtgtacgtcgtgacgccgatgtggcccgagggcgtgccggcgggtgaggccgtgcaggccatcctgctctggaacaggcgcaccgtggaaatgatgtacggtgtcgtcgccaaggccatcgacgacgccgggttgcgcggccaggcgcacccctgcgactacctcaacttcttctgcctcggcaaccgggaggcgccgctccccggcgagtactccccgccggagacgccggaggaggacacggactactggcgcgcgcaggtgaaccgccgcggccccatctacgtgcacgccaagctcatgatcgtcgacgacgagtatgtcatggtcggctcggcgaacctgaacgagcggtcgctggccggcaaccgggacagcgagatcgcgcaggggagctaccaaccggcgcacctgaacgggccgtgccggcgggcgcgagggcaggtgcacgggttcaggatgtcgctgtggcacgagcatttcatcatgggccgccatgccagtgaggacgctgacgacggagacttgttcctggagccagagagcttggagtgcgtacgcgccgtgcggcgagcggcggagaggctgtgggatgcgtacacgcaggacagagtggaggacctgccggggcacctgctcccgttcccgatcaccgtgtcggaggtcggcgaggtggatgacctgccggccgacgggtgcttcccggacacgagggcgccggtgagggggaggaaagcggtgaagctgccggacatcctgacaacctga

SEQ ID NO: 5242 - protein, 827 aa, Sorghum bicolor
  misc_feature: Ceres ANNOT ID no. 6042265
  misc_feature (345)..(381): Pfam Id: PLDc Pfam Desc: Phospholipase D Active site motif
  misc_feature (664)..(691): Pfam Id: PLDc Pfam Desc: Phospholipase D Active site motif
  misc_feature (14)..(827): NCBI GI: 50726111 NCBI Desc: phospholipase d lambda [oryza sativa (japonica cultivar-group)]
  misc_feature (14)..(827): NCBI GI: 18765902 NCBI Desc: phospholipase d lambda [oryza sativa]
  misc_feature (19)..(827): NCBI GI: 87162936 NCBI Desc: c2; peptidase, cysteine peptidase active site [medicago truncatula]
  misc_feature (19)..(827): NCBI GI: 92895915 NCBI Desc: c2; peptidase, cysteine peptidase active site [medicago truncatula]
  misc_feature (19)..(827): NCBI GI: 1020409 NCBI Desc: phospholipase d [zea mays]
  misc_feature (19)..(827): SWISSPROT Homolog: EC 3.1.4.4 Phospholipase D alpha 1
MGSQLEGDATAAIAADEVVYLHGVLEATVFEAEHLHNAIHGRIMEATEKMQESLGVHCLQHSRLYVDVDVGAARVARTREVEFHPTRPAWNQSFRLHCAYPAAAVTFTVKNQHLIGAGVLGAGSVPAARVASGQPLECWLDLRGGEHAHETHTPSLRVRLHFFDVERDPSWGAGVRLPEFAGVKPAFFPERTNCSVTLYQNAHLSDAFDPGVRLDGGLAYRPARLWEDLFAAIRDARRFVYVAGWSVNTEITLVRDAGRRAAVPEGAEGVTLGELLKRKADEGVAVLVMPWQDNTSVSFLGNAGLMKTHDEETRRFFEGTNVRCFLCPRNADASLTMVQHVETSAEFTHHQKTVTLDAATPGTDERHVVSFIGGIDLCDGRYDDENHTLFRDLDTTYLHDFMQNNYKHSSLRRGGPREPWHDVHCRLEGPAAWDVLANFEQRWRKQAPEDMRGCLLDLSPATFPDPVSNDPWNVQVFRSIDDASVVGFPSDPAEAAAMGLASGKDVTVDRSIQIGYVEAVRRARRFIYIENQYFLGGCASWAEDRDAGCLNLVPVEIALKVAAKIRRGERFAVYVVTPMWPEGVPAGEAVQAILLWNRRTVEMMYGVVAKAIDDAGLRGQAHPCDYLNFFCLGNREAPLPGEYSPPETPEEDTDYWRAQVNRRGPIYVHAKLMIVDDEYVMVGSANLNERSLAGNRDSEIAQGSYQPAHLNGPCRRARGQVHGFRMSLWHEHFIMGRHASEDADDGDLFLEPESLECVRAVRRAAERLWDAYTQDRVEDLPGHLLPFPITVSEVGEVDDLPADGCFPDTRAPVRGRKAVKLPDILTT

SEQ ID NO: 5243 - DNA, 225 bp, Sorghum bicolor
  misc_feature: Ceres ANNOT ID no. 6042270
  misc_feature: Encodes the peptide sequence at SEQ ID NO 5244
atggggaacactgcatctgtgcaaactgaggcttcagattcagcgcagcaacctgccacaacagcttctgcacctgagacgaagccgaaaaagaagatctgttgcgcttgcccagatacaaaaaagctgagagacgactgcatcgtgcagaatggtgaggatgcctgtggaaagttcatcgaagctcacctgcaatgcctgagagccgaagggttcagtgtctga

SEQ ID NO: 5244 - protein, 74 aa, Sorghum bicolor
  misc_feature: Ceres ANNOT ID no. 6042270
  misc_feature (11)..(74): Pfam Id: COX17 Pfam Desc: Cytochrome C oxidase copper chaperone (COX17)
  misc_feature (1)..(74): NCBI GI: 50725970 NCBI Desc: copper chaperone cox17-1-like protein [oryza sativa (japonica cultivar-group)]
  misc_feature (10)..(74): NCBI GI: 14794886 NCBI Desc: copper chaperone cox17-2 [arabidopsis thaliana]
  misc_feature (10)..(74): NCBI GI: 88010824 NCBI Desc: at1g53030 [arabidopsis thaliana]
  misc_feature (1)..(74): NCBI GI: 94469318 NCBI Desc: mitochondrial cytochrome c oxidase assembly protein/cu2+ chaperone cox17 [aedes aegypti]
  misc_feature (1)..(74): NCBI GI: 24642093 NCBI Desc: cg9065-pa [drosophila melanogaster]
  misc_feature: Useful for making plants with modulated drought sensitivity
  misc_feature: Functional homolog of the protein sequence given in SEQ ID NO 13423
  misc_feature: Useful for making plants with modulated water use efficiency
  misc_feature: Functional homolog of the protein sequence given in SEQ ID NO 13907
  misc_feature: Useful for making plants with modulated drought sensitivity
  misc_feature: Functional homolog of the protein sequence given in SEQ ID NO 13423
MGNTASVQTEASDSAQQPATTASAPETKPKKKICCACPDTKKLRDDCIVQNGEDACGKFIEAHLQCLRAEGFSV

SEQ ID NO: 5245 - DNA, 1473 bp, Sorghum bicolor
  misc_feature: Ceres ANNOT ID no. 6042320
  misc_feature: Encodes the peptide sequence at SEQ ID NO 5246
atggtggcaaggtgcgcgtacgccgacgccggcgggttgttccgcatctggccgatcttctccgccgccgcgctgcggaggaaggtgctcgaggttctcacgtgcggcgggggcggtgccggcggcgatggaggaggcggctcctcctgccgtggacggtcggcgtaccggtcgccgcagcggatgccgaggccgaggccgcggtcggacaggctcgcggagctgctcagggccgaggagcagccgtccgaatgcagcgacgaggctgaggccgccgaggcggcggacgtcgcggcggccaggaaggtgcaggcgttcgaggagctcaagggcgtggtcggggcgctccaggacggcggttgcatgtcccgcgtcgacgcggccaaggccgtgcggaagaaggccaaagacgacgccggtgccagggagatgctcgcgatgctcggcgccatcccgccgcttgtcgcgatgctcgacgagggcggagaggatatcacgaccgctgcgctgtacgcgctgctaaacttggggatcggcaatgacacgaacaaggcggcgatcgtgcaagccggtgccgtgcacaagatgctccgcattgcggagggcggcggcgcgtccggcgcgctgacggaggccgtggtcgccaacttcctctgcctcagcgcactcgacgccaacaagcccgtcatcggcgcgtccggggccgcgccgttcctcgtgcgcgcgttccaggccgccgcgtgctgctccaccgagcaggcgcgccacgacgcgctgcgcgcgctcctgaacctctccatcgcgcccgccaacgcgccgcacctgctggcggccgggctcgcgccggcgctggtggcggccgtgggggacgccgcagcccccgtgacggaccgcgcgctcgccgtgctctgcaacctcgtggcggcctgccccgagggccgccgcgccgtgagccgcgcccccgacgcggtgccgtccctcgtcgacgtgctcaactgggccgacgagcccgggtgccaggagaaggcggcctacgtgctcatggtcctggcgcaccgtagctacggtgaccgtgcggccatggtcgaggccggcgcctcgtccgcgctcctggagctgacgctcgtcggcacggcgctcgcgcagaagcgcgcgtccaggatcctggagatcctccgcgccgacaagggcaagcaggtcgcggacgacgcctcaggcgtcgtggcgacggtgtcggcgccgcaggagcgcaggtgccgcggggacggggaggagtcggtggacggggagttcgccgacgccggcatgagcgcagagaagcgcgccgtgcggcagctggttcagcagagcctgcagagcaacatgcgccgcatcgtccggcgcgcgcggctgcagcaggacttcgctccggcatcgaccgagagcctcaaggcgctcactgcctcctccacctccaagagcctgccgttctag

SEQ ID NO: 5246 - protein, 490 aa, Sorghum bicolor
  misc_feature: Ceres ANNOT ID no. 6042320
  misc_feature (138)..(178): Pfam Id: Arm Pfam Desc: Armadillo/beta-catenin-like repeat
  misc_feature (1)..(490): NCBI GI: 50253016 NCBI Desc: arm repeat-containing protein-like [oryza sativa (japonica cultivar-group)]
  misc_feature (20)..(490): NCBI GI: 92869639 NCBI Desc: imp dehydrogenase/gmp reductase [medicago truncatula]
  misc_feature (45)..(401): NCBI GI: 22136270 NCBI Desc: arm repeat containing protein homolog [arabidopsis thaliana]
  misc_feature (109)..(462): NCBI GI: 30678850 NCBI Desc: armadillo/beta-catenin repeat family protein [arabidopsis thaliana]
  misc_feature (87)..(396): NCBI GI: 34393717 NCBI Desc: arm repeat containing protein homolog-like [oryza sativa (japonica cultivar-group)]
  misc_feature: The sequence is a functional homolog of SEQ ID NO. 309 in the 11/188,298 US application
MVARCAYADAGGLFRIWPIFSAAALRRKVLEVLTCGGGGAGGDGGGGSSCRGRSAYRSPQRMPRPRPRSDRLAELLRAEEQPSECSDEAEAAEAADVAAARKVQAFEELKGVVGALQDGGCMSRVDAAKAVRKKAKDDAGAREMLAMLGAIPPLVAMLDEGGEDITTAALYALLNLGIGNDTNKAAIVQAGAVHKMLRIAEGGGASGALTEAVVANFLCLSALDANKPVIGASGAAPFLVRAFQAAACCSTEQARHDALRALLNLSIAPANAPHLLAAGLAPALVAAVGDAAAPVTDRALAVLCNLVAACPEGRRAVSRAPDAVPSLVDVLNWADEPGCQEKAAYVLMVLAHRSYGDRAAMVEAGASSALLELTLVGTALAQKRASRILEILRADKGKQVADDASGVVATVSAPQERRCRGDGEESVDGEFADAGMSAEKRAVRQLVQQSLQSNMRRIVRRARLQQDFAPASTESLKALTASSTSKSLPF

SEQ ID NO: 5247 - DNA, 840 bp, Sorghum bicolor
  misc_feature: Ceres ANNOT ID no. 6042321
  misc_feature: Encodes the peptide sequence at SEQ ID NO 5248
atggcgacacctgccgcagagaagccggaagatgtagagatccgcgaggtttgggcggacaacctcgaggctgagttcgccgtgatccgcgacatcgtcgacgactacccctatgtggccatggacacggagttccctggcgttgtgtgccgcccgctcggcacttacaagacggcggccgagttcaactacgccacactcaaggcgaacgttgacatgttgaagcttattcagctcgggctcaccttctccgacgagcatggtgggctgccggcgctcggcgcagacggccgaccctgtgtgtggcagttcaattttcgaggctttgaccctcggaccgatgtggctgcatctgactccatcgatctgctgcgccgcagtggtattgacttctctcgccatgctgctgatggagctgacgcccgccgctttgctgagctgctcatgtcctccggcgtagtattgaattcagatgtgcactgggtgacttttcatagtggctacgactttggctacctgctcaagctactcaccggcacaaatctgcctgatacaatgtcaggattcttcgatctcatcaagatttactttcctgttatctacgacatcaaacatttgatgaggttctgcaatagcctccatggagggctgaacaagcttgctgagctgcttgacgtcgcaagggttggaatctgccaccaggcagggtctgattcgcttctgacagcgctgtccttcaagaagcttaaagaggcatacttcaacgggttaactgagaaatatgctggtgtgttgtatgggcttggctttgagggtggagagaccacctctgctcactga

SEQ ID NO: 5248 - protein, 279 aa, Sorghum bicolor
  misc_feature: Ceres ANNOT ID no. 6042321
  misc_feature (15)..(248): Pfam Id: CAF1 Pfam Desc: CAF1 family ribonuclease
  misc_feature (7)..(276): NCBI GI: 92884888 NCBI Desc: polynucleotidyl transferase, ribonuclease h fold [medicago truncatula]
  misc_feature (10)..(279): NCBI GI: 115449215 NCBI Desc: os02g0796300 [oryza sativa (japonica cultivar-group)]
  misc_feature (5)..(271): NCBI GI: 145342468 NCBI Desc: polya tail-shortening ribonuclease, probable [ostreococcus lucimarinus cce9901]
  misc_feature (12)..(268): NCBI GI: 110293351 NCBI Desc: ccr4 associated factor 1-related protein [capsicum annuum]
  misc_feature (10)..(269): NCBI GI: 108874495 NCBI Desc: ccr4-associated factor [aedes aegypti]
MATPAAEKPEDVEIREVWADNLEAEFAVIRDIVDDYPYVAMDTEFPGVVCRPLGTYKTAAEFNYATLKANVDMLKLIQLGLTFSDEHGGLPALGADGRPCVWQFNFRGFDPRTDVAASDSIDLLRRSGIDFSRHAADGADARRFAELLMSSGVVLNSDVHWVTFHSGYDFGYLLKLLTGTNLPDTMSGFFDLIKIYFPVIYDIKHLMRFCNSLHGGLNKLAELLDVARVGICHQAGSDSLLTALSFKKLKEAYFNGLTEKYAGVLYGLGFEGGETTSAH

SEQ ID NO: 5249 - DNA, 657 bp, Sorghum bicolor
  misc_feature: Ceres ANNOT ID no. 6042323
  misc_feature: Encodes the peptide sequence at SEQ ID NO 5250
atggaggcgtcttcctgggacgcccttcgcaagcaggcaaggaggttggaagctcagttagatgaccaaatgattgcataccgtaaattggtttctatgaaatcagatggttcagagaatgatatcgagtctgatatagaaagatcactgaagcagttacagcaagtaaattcgcaaatgcaaacttgggtatcgtcaggaggttcagaagttctttctcatactctgactcgtcatatggagattttgcaagaccttactcaggaattctatcggcttcgatcaagtctcagggcgaaacaacaacatgcttctctccttgacttgagagattttgacagagcaaagtttgatgttgaagatccatcagactcagctgatcaagcccttctcagggaacaagctgcaattggcaggagtactggacagatggataacgtgatatcacaagctcaagcaacactaggttctctcatgactcaacggtcaacattcggtggcatcactacaaagataagcaacgtcagcagtcggcttccaacaattaaccacgtcctctcgtccatcagaaggaagaaatccatggacactatcattctttcgctcgttgcatctgtctgcgcatttctcatcttcatctactggctgtcgaagtag

SEQ ID NO: 5250 - protein, 218 aa, Sorghum bicolor
  misc_feature: Ceres ANNOT ID no. 6042323
  misc_feature (46)..(196): Pfam Id: V-SNARE Pfam Desc: Vesicle transport v-SNARE protein
  misc_feature (45)..(214): NCBI GI: 119571616 NCBI Desc: golgi snap receptor complex member 1, isoform cra_c [homo sapiens]
  misc_feature (45)..(214): NCBI GI: 55770858 NCBI Desc: golgi snap receptor complex member 1 isoform 2 [homo sapiens]
  misc_feature (45)..(214): NCBI GI: 1912453 NCBI Desc: v-snare
  misc_feature (45)..(214): NCBI GI: 62859931 NCBI Desc: gosr1 [xenopus tropicalis]
  misc_feature (45)..(214): NCBI GI: 117558481 NCBI Desc: golgi snap receptor complex member 1 [rattus norvegicus]
MEASSWDALRKQARRLEAQLDDQMIAYRKLVSMKSDGSENDIESDIERSLKQLQQVNSQMQTWVSSGGSEVLSHTLTRHMEILQDLTQEFYRLRSSLRAKQQHASLLDLRDFDRAKFDVEDPSDSADQALLREQAAIGRSTGQMDNVISQAQATLGSLMTQRSTFGGITTKISNVSSRLPTINHVLSSIRRKKSMDTIILSLVASVCAFLIFIYWLSK

SEQ ID NO: 5251 - DNA, 1590 bp, Sorghum bicolor
  misc_feature: Ceres ANNOT ID no. 6042331
  misc_feature: Encodes the peptide sequence at SEQ ID NO 5252
atgaccttgtctgggatggctgttgctttcaaagcaagtacgagttctaccacacagcaacattggccgagtccaacaaaggaccggtgccaatatggtttcactcagttaagcaggcaaaagtacaggaaaaaatttgcagcactgcatgtgacagctacatcaggaaagctagacctagatttcactgacccttcttggaaccaaaagtaccaggaagactggaacaggcgttttagtttgccacacatcactgatatatatgatttggagccaagaagaactacattctctttgaagaaaaacagaattcccctgggtgatggtgatggctcatcagctgatatgtggaacggttatgtaaataagagtgatagagcccttctgaaggtgataaagtatgcctctcctacttctgctggagctttgtgcattgatcctgattgtagctgggtggaacactgggttcatcgtgcaggtcctcgtaaggagatatattacgaacctgaagaagtaaaggctgccattgttacctgtggagggctctgccctggtttaaatgatgtcattagacagatagtatttaccttggagatttatggggtgaagaatattgttggaatcccatttggttatcgtggattttttgagaaaggcttaaaagaaatgtcgctttcacgtgacgtggtggaaaacataaatctttctggaggaagtttcctaggagtctctcgtggaggagctaaaactagtgaaattgtagatagtatacaggccagaagaattgacatgctgtttgtaattggtggaaatggtagccatgcaggagctaatgctattcatgaggagtgtcgaaagagaaaactgaaagtttcagttgtagcagttccaaagaccattgataatgatatactttttatggataagacgtttggttttgatacagctgtggaagaagctcagcgtgctatcaattctgcctatatagaggcacgtagtgcataccatggaattgggttggtaaaattaatgggaagaagtagtggattcatagccatgcatgcttctctttccagtggacagattgatgtctgcctaatacctgaggtatccttcacactcgatggagaacatggtgtcttgcgacaccttgagcatttacttaatacaaagggattttgtgtggtttgtgttgctgaaggtgcagggcaggatttactgcaaaaatcaaatgcaactgatgcttcaggaaatgtgatacttagtgactttggtgtccacatgcagcagaagatcaagaagcatttcaaggacatcggtgttccggctgatctaaaatacattgatccaacatatatggttcgggcctgtcgggcaaatgcatctgatgctattctctgcaccgtacttgggcaaaatgctgtccatggagcatttgctgggttcagtggcatcacgtcaggtgtttgcaacacacattatgtgtaccttcccatcacagaggtcattacaacaccaaagcacgttaaccccaacagcagaatgtggcaccgctgcctcacatccactggccagccagacttccattga

SEQ ID NO: 5252 - protein, 529 aa, Sorghum bicolor
  misc_feature: Ceres ANNOT ID no. 6042331
  misc_feature (173)..(480): Pfam Id: PFK Pfam Desc: Phosphofructokinase
  misc_feature (1)..(529): NCBI GI: 115479163 NCBI Desc: os09g0415800 [oryza sativa (japonica cultivar-group)]
  misc_feature (37)..(528): NCBI GI: 90654902 NCBI Desc: atp-utilizing phosphofructokinase [spinacia oleracea]
  misc_feature (130)..(362): NCBI GI: 115476600 NCBI Desc: os08g0439000 [oryza sativa (japonica cultivar-group)]
  misc_feature (158)..(528): NCBI GI: 19699124 NCBI Desc: at4g26270/t25k17_80 [arabidopsis thaliana]
  misc_feature (156)..(528): NCBI GI: 10176767 NCBI Desc: pyrophosphate-dependent phosphofructo-1-kinase-like protein [arabidopsis thaliana]
MTLSGMAVAFKASTSSTTQQHWPSPTKDRCQYGFTQLSRQKYRKKFAALHVTATSGKLDLDFTDPSWNQKYQEDWNRRFSLPHITDIYDLEPRRTTFSLKKNRIPLGDGDGSSADMWNGYVNKSDRALLKVIKYASPTSAGALCIDPDCSWVEHWVHRAGPRKEIYYEPEEVKAAIVTCGGLCPGLNDVIRQIVFTLEIYGVKNIVGIPFGYRGFFEKGLKEMSLSRDVVENINLSGGSFLGVSRGGAKTSEIVDSIQARRIDMLFVIGGNGSHAGANAIHEECRKRKLKVSVVAVPKTIDNDILFMDKTFGFDTAVEEAQRAINSAYIEARSAYHGIGLVKLMGRSSGFIAMHASLSSGQIDVCLIPEVSFTLDGEHGVLRHLEHLLNTKGFCVVCVAEGAGQDLLQKSNATDASGNVILSDFGVHMQQKIKKHFKDIGVPADLKYIDPTYMVRACRANASDAILCTVLGQNAVHGAFAGFSGITSGVCNTHYVYLPITEVITTPKHVNPNSRMWHRCLTSTGQPDFH

SEQ ID NO: 5253 - DNA, 1857 bp, Sorghum bicolor
  misc_feature: Ceres ANNOT ID no. 6042332
  misc_feature: Encodes the peptide sequence at SEQ ID NO 5254
  misc_feature: Down-regulated in shoot tissues in response to salicylic acid treatment
atggctttgaaggcgagctccggcgaaaaccggacaaggagcacggtgttcctgtgcatagtgattggcatgtgctgcttcttctacatcctcggggcgtggcagaagagcgggttcggcaagggggacagcatcgcgctggaggtcacgaagcgcaccgactgcaccgtcttgcccaaccttagcttcgacacccaccattctaaacctgccagtgacagcagctctagcgatcttgttgtttcgccggcgaagaagttcaagccgtgcgctgatcgctacacggattacaccccctgccaagaccagaacagggcgatgaagttccctcgggacaacatgaactacagagagcggcactgcccggcgcagaaggagaagctgcactgtcttatcccacccccaaagggttatgtggctccgttcccgtggcccaagagcagggactatgtcccttttgcgaattgcccgtataagagcttgacggtcgagaaagccatccagaactgggttcagtatgagggtaacgtgttcagattccctggtggagggacacaattcccacaaggagcagataagtatattgatcagcttgcatcagtcattccgatcgccaatggaactgtcaggactgcgcttgacactggttgcggggtggctagctggggagcttatttgttgaagaggaatgtcttggccatgtcgtttgcgccaagagattcacacgaggcacaagtgcagtttgctctggagagaggtgtcccagctgttattggtgtccttggtacaataaaacttccctatccatcgagggcctttgacatggcccattgttccaggtgcttgattccatggggagcaaacgatggaatgtacatgatggaagttgatagggttctaaggcctggtggctactgggtgctgtctggtcctccaattaattggaaggtgaactacaagggttggcaacgcacaaagaaggatcttgaagcagagcagaacagaatagaggaaattgctgatcttctatgttgggaaaaggtctcagagaagggtgagatggcaatatggaggaaaagggtgaatactgagtcttgcccttctaggcaagaagaatcaactgtgcagatgtgtgaatcaacaaacccagatgatgtctggtacaagaagatgaaggcctgtgtgacaccccttccagatgtaaaagatgaaagtgaagtagctggaggagcaatcaaacccttcccagccaggctcaatgcagttcctccaagaattgctaatggtttgatcccaggggtttcgtctcaggcctttcagaaagacaataaaatgtggaagaagcatgtgaaggcttacagcagtgtgaacaaatatctgcttactggtagatacaggaatattatggacatgaatgcaggattcgggggattcgctgcagcaatagagtccccaaaatcttgggtgatgaatgttgtgccgaccatcgcaaagatgcccaccctgggggctgtgtatgagcgaggattgatcggcatatatcatgactggtgtgaagctttctctacttatccaaggacatatgatcttatccatgctagcggtcttttcaccttgtataaaaacaagtgcagcatggaagatattctcctggagatggaccgcatcttgaggcctgaaggtgctgtcataatacgggatgatgttgacatcctgactaaggtgaacagcctcgctctgggtatgaggtggaacacgaagatggttgatcacgaggatggccccctcgtgcgtgagaagatcttatatgctgtgaagcagtactgggttggtgggaatcagacagctgtagcttga

SEQ ID NO: 5254 - protein, 618 aa, Sorghum bicolor
  misc_feature: Ceres ANNOT ID no. 6042332
  misc_feature (213)..(308): Pfam Id: Methyltransf_11 Pfam Desc: Methyltransferase domain
  misc_feature (1)..(616): NCBI GI: 51469000 NCBI Desc: ankyrin protein kinase-like [poa pratensis]
  misc_feature (1)..(616): NCBI GI: 23308473 NCBI Desc: at1g26850/t2p11_4 [arabidopsis thaliana]
  misc_feature (4)..(614): NCBI GI: 115483554 NCBI Desc: os10g0569300 [oryza sativa (japonica cultivar-group)]
  misc_feature (8)..(613): NCBI GI: 15294146 NCBI Desc: at4g18030/t6k21_210 [arabidopsis thaliana]
  misc_feature (1)..(586): NCBI GI: 4262174
  misc_feature: Useful for making plants with altered cell wall content and/or composition
  misc_feature: Functional homolog of the protein sequence encoded by LOCUS at4g18030
  misc_feature: Useful for making plants with altered cell wall content and/or composition
  misc_feature: Functional homolog of the protein sequence given in SEQ ID NO 13686
  misc_feature: The sequence is a functional homolog of SEQ ID NO 758 in the 10/412,699 US patent application
  misc_feature: The sequence is a functional homolog of SEQ ID NO 2740 in the 10/374,780 US patent application
  misc_feature: The sequence is a functional homolog of SEQ ID NO 388 in the 10/225,066 US patent application
  misc_feature: The sequence is a functional homolog of SEQ ID NO 2432 in the 10/374,780 US patent application
  misc_feature: The sequence is a functional homolog of SEQ ID NO 558 in the 10/412,699 US patent application
  misc_feature: The sequence is a functional homolog of SEQ ID NO 730 in the 10/225,066 US patent application
  misc_feature: The sequence is a functional homolog of SEQ ID NO 1593 in the 11/479,226 US patent application
  misc_feature: The sequence is a functional homolog of SEQ ID NO 560 in the 10/412,699 US patent application
  misc_feature: Down-regulated in shoot tissues in response to salicylic acid treatment
MALKASSGENRTRSTVFLCIVIGMCCFFYILGAWQKSGFGKGDSIALEVTKRTDCTVLPNLSFDTHHSKPASDSSSSDLVVSPAKKFKPCADRYTDYTPCQDQNRAMKFPRDNMNYRERHCPAQKEKLHCLIPPPKGYVAPFPWPKSRDYVPFANCPYKSLTVEKAIQNWVQYEGNVFRFPGGGTQFPQGADKYIDQLASVIPIANGTVRTALDTGCGVASWGAYLLKRNVLAMSFAPRDSHEAQVQFALERGVPAVIGVLGTIKLPYPSRAFDMAHCSRCLIPWGANDGMYMMEVDRVLRPGGYWVLSGPPINWKVNYKGWQRTKKDLEAEQNRIEEIADLLCWEKVSEKGEMAIWRKRVNTESCPSRQEESTVQMCESTNPDDVWYKKMKACVTPLPDVKDESEVAGGAIKPFPARLNAVPPRIANGLIPGVSSQAFQKDNKMWKKHVKAYSSVNKYLLTGRYRNIMDMNAGFGGFAAAIESPKSWVMNVVPTIAKMPTLGAVYERGLIGIYHDWCEAFSTYPRTYDLIHASGLFTLYKNKCSMEDILLEMDRILRPEGAVIIRDDVDILTKVNSLALGMRWNTKMVDHEDGPLVREKILYAVKQYWVGGNQTAVA

SEQ ID NO: 5255 - DNA, 348 bp, Sorghum bicolor
  misc_feature: Ceres ANNOT ID no. 6042333
  misc_feature: Encodes the peptide sequence at SEQ ID NO 5256
atggcgacgatggccggcaggctgctgctcctcctcctcctcgccgttggtggccttcttgccgtctccatggccgagcacgaggtgctggccaaggggagtgacgagcatgacgacaatgtgtaccaagtgagcaagggaggacagggcagcctcaaaagctaccagtgctcgccgcagtgctcccggcggtgcggcaacacgcggtacaagaagccgtgcctcttcttctgcaacaagtgctgcaacacgtgcctgtgcgtgccgtcgggctactacggcaacaagggcgagtgcccctgctacaacaactggaagaccaagcgcgggggaccaaagtgcccgtga

SEQ ID NO: 5256 - protein, 115 aa, Sorghum bicolor
  misc_feature: Ceres ANNOT ID no. 6042333
  misc_feature (1)..(115): Pfam Id: GASA Pfam Desc: Gibberellin regulated protein
  misc_feature (8)..(115): NCBI GI: 140070355 NCBI Desc: gibberellin regulated protein [medicago truncatula]
  misc_feature (9)..(115): NCBI GI: 110648737 NCBI Desc: gasa [fagus sylvatica]
  misc_feature (12)..(115): NCBI GI: 92876699 NCBI Desc: gibberellin regulated protein [medicago truncatula]
  misc_feature (7)..(115): NCBI GI: 56236466 NCBI Desc: gip1-like protein [populus tomentosa]
  misc_feature (4)..(115): NCBI GI: 16516821 NCBI Desc: gibberellin induced protein 3 [petunia x hybrida]
  misc_feature: Useful for making plants with altered alkaloid content
  misc_feature: Useful for making plants with modulated nitrogen use efficiency
  misc_feature: Functional homolog of the protein sequence given in SEQ ID NO 12973
  misc_feature: Useful for making plants with altered alkaloid content
  misc_feature: Useful for making plants with modulated nitrogen use efficiency
  misc_feature: Functional homolog of the protein sequence given in SEQ ID NO 12973
  misc_feature: Useful for making plants with modulated oxidative stress sensitivity
  misc_feature: Functional homolog of the protein sequence given in SEQ ID NO 13910
  misc_feature: The sequence is a functional homolog of SEQ ID NO. 529 in the 11/188,298 US application
MATMAGRLLLLLLLAVGGLLAVSMAEHEVLAKGSDEHDDNVYQVSKGGQGSLKSYQCSPQCSRRCGNTRYKKPCLFFCNKCCNTCLCVPSGYYGNKGECPCYNNWKTKRGGPKCP

SEQ ID NO: 5257 - DNA, 270 bp, Sorghum bicolor
  misc_feature: Ceres ANNOT ID no. 6042336
  misc_feature: Encodes the peptide sequence at SEQ ID NO 5258
atgaagaggctgttgatcatgcgaaggtgtgagccgatcgtgcggttcacgtgctgcagcgtgcactacagggagtgccgtcggaaccatgcggcgagcactggaggctacgccatcgatggatgccgggagttcatcgctgaaggggaggagagcaccagtggtgctctcaagtgcgcggcctgcggttgccaccgcagcttccaccgcagggttcaggtctatgaggttgcatgggattacggatccgacacgtcgtcaaccgagtag

SEQ ID NO: 5258 - protein, 89 aa, Sorghum bicolor
  misc_feature: Ceres ANNOT ID no. 6042336
  misc_feature (18)..(77): Pfam Id: ZF-HD_dimer Pfam Desc: ZF-HD protein dimerisation region
  misc_feature (21)..(76): NCBI GI: 115476594 NCBI Desc: os08g0438100 [oryza sativa (japonica cultivar-group)]
  misc_feature (16)..(89): NCBI GI: 118621155 NCBI Desc: mini zinc finger protein [solanum lycopersicum]
  misc_feature (2)..(81): NCBI GI: 78098986 NCBI Desc: mini zinc finger 3 [arabidopsis thaliana]
  misc_feature (2)..(74): NCBI GI: 92890768 NCBI Desc: zf-hd homeobox protein cys/his-rich dimerisation region [medicago truncatula]
  misc_feature (23)..(71): NCBI GI: 70727923 NCBI Desc: zinc finger homeodomain protein 1 [physcomitrella patens]
  misc_feature: The sequence is a functional homolog of SEQ ID NO 64 in the 10/714,887 US patent application
  misc_feature: The sequence is a functional homolog of SEQ ID NO 64 in the 11/435,388 US patent application
  misc_feature: Useful for biocontainment applications
  misc_feature: Useful for making plants with modulated biomass
  misc_feature: Useful for making plants with modulated flowering time
  misc_feature: Functional homolog of the protein sequence given in SEQ ID NO 13913
  misc_feature: Useful for making plants with modulated low light sensitivity
  misc_feature: Functional homolog of the protein sequence given in SEQ ID NO 13756
  misc_feature: The sequence is a functional homolog of SEQ ID NO 60 in the 10/714,887 US patent application
  misc_feature: The sequence is a functional homolog of SEQ ID NO 60 in the 11/435,388 US patent application
  misc_feature: The sequence is a functional homolog of SEQ ID NO 108 in the 10/714,887 US patent application
  misc_feature: The sequence is a functional homolog of SEQ ID NO 108 in the 11/435,388 US patent application
  misc_feature: The sequence is a functional homolog of SEQ ID NO 110 in the 10/714,887 US patent application
  misc_feature: The sequence is a functional homolog of SEQ ID NO 110 in the 11/435,388 US patent application
  misc_feature: The sequence is a functional homolog of SEQ ID NO 112 in the 10/714,887 US patent application
  misc_feature: The sequence is a functional homolog of SEQ ID NO 112 in the 11/435,388 US patent application
  misc_feature: The sequence is a functional homolog of SEQ ID NO 14 in the 10/714,887 US patent application
  misc_feature: The sequence is a functional homolog of SEQ ID NO 14 in the 11/435,388 US patent application
  misc_feature: The sequence is a functional homolog of SEQ ID NO 626 in the 10/666,642 US patent application
  misc_feature: The sequence is a functional homolog of SEQ ID NO 106 in the 10/714,887 US patent application
  misc_feature: The sequence is a functional homolog of SEQ ID NO 106 in the 11/435,388 US patent application
  misc_feature: The sequence is a functional homolog of SEQ ID NO 104 in the 10/714,887 US patent application
  misc_feature: The sequence is a functional homolog of SEQ ID NO 104 in the 11/435,388 US patent application
  misc_feature: The sequence is a functional homolog of SEQ ID NO 66 in the 10/714,887 US patent application
  misc_feature: The sequence is a functional homolog of SEQ ID NO 66 in the 11/435,388 US patent application
  misc_feature: The sequence is a functional homolog of SEQ ID NO 62 in the 10/714,887 US patent application
  misc_feature: The sequence is a functional homolog of SEQ ID NO 62 in the 11/435,388 US patent application
  misc_feature: The sequence is a functional homolog of SEQ ID NO 624 in the 10/666,642 US patent application
  misc_feature: The sequence is a functional homolog of SEQ ID NO 118 in the 10/714,887 US patent application
  misc_feature: The sequence is a functional homolog of SEQ ID NO 118 in the 11/435,388 US patent application
  misc_feature: The sequence is a functional homolog of SEQ ID NO 116 in the 10/714,887 US patent application
  misc_feature: The sequence is a functional homolog of SEQ ID NO 116 in the 11/435,388 US patent application
  misc_feature: The sequence is a functional homolog of SEQ ID NO 58 in the 10/714,887 US patent application
  misc_feature: The sequence is a functional homolog of SEQ ID NO 58 in the 11/435,388 US patent application
  misc_feature: The sequence is a functional homolog of SEQ ID NO 622 in the 10/666,642 US patent application
  misc_feature: The sequence is a functional homolog of SEQ ID NO 52 in the 10/714,887 US patent application
  misc_feature: The sequence is a functional homolog of SEQ ID NO 52 in the 11/435,388 US patent application
  misc_feature: The sequence is a functional homolog of SEQ ID NO 620 in the 10/666,642 US patent application
  misc_feature: The sequence is a functional homolog of SEQ ID NO 628 in the 10/666,642 US patent application
  misc_feature: The sequence is a functional homolog of SEQ ID NO 68 in the 10/714,887 US patent application
  misc_feature: The sequence is a functional homolog of SEQ ID NO 68 in the 11/435,388 US patent application
  misc_feature: The sequence is a functional homolog of SEQ ID NO 1554 in the 10/666,642 US patent application
  misc_feature: The sequence is a functional homolog of SEQ ID NO 44 in the 10/714,887 US patent application
  misc_feature: The sequence is a functional homolog of SEQ ID NO 44 in the 11/435,388 US patent application
  misc_feature: The sequence is a functional homolog of SEQ ID NO 102 in the 10/714,887 US patent application
  misc_feature: The sequence is a functional homolog of SEQ ID NO 102 in the 11/435,388 US patent application
  misc_feature: The sequence is a functional homolog of SEQ ID NO 120 in the 10/714,887 US patent application
  misc_feature: The sequence is a functional homolog of SEQ ID NO 120 in the 11/435,388 US patent application
  misc_feature: The sequence is a functional homolog of SEQ ID NO 54 in the 10/714,887 US patent application
  misc_feature: The sequence is a functional homolog of SEQ ID NO 54 in the 11/435,388 US patent application
  misc_feature: The sequence is a functional homolog of SEQ ID NO 114 in the 10/714,887 US patent application
  misc_feature: The sequence is a functional homolog of SEQ ID NO 114 in the 11/435,388 US patent application
  misc_feature: The sequence is a functional homolog of SEQ ID NO 50 in the 10/714,887 US patent application
  misc_feature: The sequence is a functional homolog of SEQ ID NO 50 in the 11/435,388 US patent application
  misc_feature: The sequence is a functional homolog of SEQ ID NO 618 in the 10/666,642 US patent application
  misc_feature: The sequence is a functional homolog of SEQ ID NO 128 in the 10/714,887 US patent application
  misc_feature: The sequence is a functional homolog of SEQ ID NO 128 in the 11/435,388 US patent application
  misc_feature: The sequence is a functional homolog of SEQ ID NO 46 in the 10/714,887 US patent application
  misc_feature: The sequence is a functional homolog of SEQ ID NO 46 in the 11/435,388 US patent application
  misc_feature: The sequence is a functional homolog of SEQ ID NO 616 in the 10/666,642 US patent application
  misc_feature: The sequence is a functional homolog of SEQ ID NO 48 in the 10/714,887 US patent application
  misc_feature: The sequence is a functional homolog of SEQ ID NO 48 in the 11/435,388 US patent application
  misc_feature: The sequence is a functional homolog of SEQ ID NO 122 in the 10/714,887 US patent application
  misc_feature: The sequence is a functional homolog of SEQ ID NO 122 in the 11/435,388 US patent application
  misc_feature: The sequence is a functional homolog of SEQ ID NO 126 in the 10/714,887 US patent application
  misc_feature: The sequence is a functional homolog of SEQ ID NO 126 in the 11/435,388 US patent application
  misc_feature: The sequence is a functional homolog of SEQ ID NO 56 in the 10/714,887 US patent application
  misc_feature: The sequence is a functional homolog of SEQ ID NO 56 in the 11/435,388 US patent application
  misc_feature: The sequence is a functional homolog of SEQ ID NO 124 in the 10/714,887 US patent application
  misc_feature: The sequence is a functional homolog of SEQ ID NO 124 in the 11/435,388 US patent application
MKRLLIMRRCEPIVRFTCCSVHYRECRRNHAASTGGYAIDGCREFIAEGEESTSGALKCAACGCHRSFHRRVQVYEVAWDYGSDTSSTE

SEQ ID NO: 5259 - DNA, 1041 bp, Sorghum bicolor
  misc_feature: Ceres ANNOT ID no. 6042356
  misc_feature: Encodes the peptide sequence at SEQ ID NO 5260
atgtttccgatggcgtcttcctcactatcgccgccgccgctctcacttatcctcctccggccgctcccgtgcagacccgtcctcctctcgaggcaaaggaagccatttccaactgtccgcgtagaagcaaggcctgagcagcggttgcagcggcggccggtgaccggccggtggaggaggggcggaggcttcgcgtgtttctcctacaatgccaataacaagacgcccccgccatcagataagagttcagacaagtgggcgatccttcgccgatgggatgtgccatgggagtggcaaaccgttgtgctcagcatggtaggctgtggagtaagctttgttctgacaggattggttgagcaatcggctttgcaatacctgggatttaaagctgtggaggcaactatagatgagaaggcagaaatactcttttttgggcaactgagcgtgacagtagtagtccttggcgttatatttagcatcaccaacacttttcgaccattcccagatgatatgtttcgttatgatattaaagaaccattcaagctgcagaatggatggcttttgtgggctggagttggcctctttggagcaataatttctattgctttagccggagctgctatgacttatctgaatggtgaaactccagagagagagactgattcactagtccttttgttgcccctgattggctcatccactaccagcactgcctttttggtgggaatcactggagttctagcaccacttctcgaggagactctgtttcgaggatttctaatggtgtccttgactaagtggtttcctactccattttgtgtacttgtgagtgctgctgtatttgcccttgctcatctgactcctggacaatttccacagctgtttatacttggtgttgcattgggtttttcatatgctcagacccgcaatcttctaactccgatcacaatacatgcattttggaactcaggagtaatacttctgctaacctttcttcagctgcaaggatatgatctcaaggagctcttgggagcatcgtga

SEQ ID NO: 5260 - protein, 346 aa, Sorghum bicolor
  misc_feature: Ceres ANNOT ID no. 6042356
  misc_feature (240)..(329): Pfam Id: Abi Pfam Desc: CAAX amino terminal protease family
  misc_feature (57)..(346): NCBI GI: 30683693 NCBI Desc: caax amino terminal protease family protein [arabidopsis thaliana]
  misc_feature (111)..(346): NCBI GI: 42571465 NCBI Desc: caax amino terminal protease family protein [arabidopsis thaliana]
  misc_feature (219)..(346): NCBI GI: 115479137 NCBI Desc: os09g0413200 [oryza sativa (japonica cultivar-group)]
  misc_feature (199)..(346): NCBI GI: 115476584 NCBI Desc: os08g0436600 [oryza sativa (japonica cultivar-group)]
  misc_feature (92)..(332): NCBI GI: 75907768 NCBI Desc: abortive infection protein [anabaena variabilis atcc 29413]
MFPMASSSLSPPPLSLILLRPLPCRPVLLSRQRKPFPTVRVEARPEQRLQRRPVTGRWRRGGGFACFSYNANNKTPPPSDKSSDKWAILRRWDVPWEWQTVVLSMVGCGVSFVLTGLVEQSALQYLGFKAVEATIDEKAEILFFGQLSVTVVVLGVIFSITNTFRPFPDDMFRYDIKEPFKLQNGWLLWAGVGLFGAIISIALAGAAMTYLNGETPERETDSLVLLLPLIGSSTTSTAFLVGITGVLAPLLEETLFRGFLMVSLTKWFPTPFCVLVSAAVFALAHLTPGQFPQLFILGVALGFSYAQTRNLLTPITIHAFWNSGVILLLTFLQLQGYDLKELLGAS

SEQ ID NO: 5261 - DNA, 840 bp, Sorghum bicolor
  misc_feature: Ceres ANNOT ID no. 6042358
  misc_feature: Encodes the peptide sequence at SEQ ID NO 5262
atgaaggaacatctaatgctcaatattgatgacctaagcattcctgagcctaatgaggtcatgggagcagtcaagaataaatcatctggggaaaccattgcacgtctaccctccaaggctcatgccattgtagcaatgggagaaagcatggtttctgaagaggaacctcttctgcaagtggtggagtgtcgcatttgtcaggaggaagatagtataaaaaatctagagagcccatgtgcttgcactggcagtctaaagtatgctcatcgggtttgtgtgcaacgatggtgcaatgagaaaggagatgtaatatgtgagatatgtcatgagccttatgaacatgggtacactgcacctcccagagctcatcctgatgaaactaccattgatataagtggtgggtggaccattactggtaccgcatttgacttgcgtgatcctaggatacttgcagtggcacaaaaccacatcatggaagctgaatatgatgattattctgccacaaatgccagcactgctgccttctgccgttctgctgctcttgttttaatggctctcttattgttgagacacgcactgactctaactgatgaagatgacgacgacacttcagcgatgttttcactttttctactgcgtgctgctggtttcctccttcctttctacattatggcttgggcaattagtatcttgcagcgccgcagacagagacaggaggcagctgctcttgctgcaacggaggtggcattcatcctgcagtcggggcaaggaaggggagtgcacttcaccatcgcaccggactcccctgccacaccacagcatgaaccaccgcaaccataa

SEQ ID NO: 5262 - protein, 279 aa, Sorghum bicolor
  misc_feature: Ceres ANNOT ID no. 6042358
  misc_feature (63)..(108): Pfam Id: zf-C3HC4 Pfam Desc: Zinc finger, C3HC4 type (RING finger)
  misc_feature (1)..(276): NCBI GI: 42408883 NCBI Desc: zinc finger protein-like [oryza sativa (japonica cultivar-group)]
  misc_feature (1)..(238): NCBI GI: 30692888 NCBI Desc: zinc finger (c3hc4-type ring finger) family protein [arabidopsis thaliana]
  misc_feature (47)..(260): NCBI GI: 15223693 NCBI Desc: zinc finger (c3hc4-type ring finger) family protein [arabidopsis thaliana]
  misc_feature (47)..(260): NCBI GI: 7262667 NCBI Desc: contains similarity to pit1 from arabidopsis thaliana gbaf130849
  misc_feature (1)..(209): NCBI GI: 30692886 NCBI Desc: zinc finger (c3hc4-type ring finger) family protein [arabidopsis thaliana]
  misc_feature: Useful for making plants with altered lignin content
  misc_feature: Functional homolog of the protein sequence given in SEQ ID NO 12907
MKEHLMLNIDDLSIPEPNEVMGAVKNKSSGETIARLPSKAHAIVAMGESMVSEEEPLLQVVECRICQEEDSIKNLESPCACTGSLKYAHRVCVQRWCNEKGDVICEICHEPYEHGYTAPPRAHPDETTIDISGGWTITGTAFDLRDPRILAVAQNHIMEAEYDDYSATNASTAAFCRSAALVLMALLLLRHALTLTDEDDDDTSAMFSLFLLRAAGFLLPFYIMAWAISILQRRRQRQEAAALAATEVAFILQSGQGRGVHFTIAPDSPATPQHEPPQP

SEQ ID NO: 5263 - DNA, 462 bp, Sorghum bicolor
  misc_feature: Ceres ANNOT ID no. 6042372
  misc_feature: Encodes the peptide sequence at SEQ ID NO 5264
atggggaaggactccaagccgaaggacgccaaggggaaggacgccaaggggaagggcaagcaggcggccggctcctccggcggtgacgacggcggcggcaagggaggcaagggcaagggcggcaagtccgctgacggactcggcacctgcacctacgtcaaagctaggcacgtattgtgtgagaagcagggaaagatcaatgaagcttataagaagttgcaggatggatggctggacaatggggacaaagtccctcctgctgagtttgctaaggtagcacaagagtattctgaatgcccatcagggaagaaaggtggagatcttggttggtttccgcgtggcaagatggctggccctttccaggaggttgctttcaacacacctgtgggagcttgtagcgcaccattcaagtccacgtatgctgggtatcactttatcctctgcgaaggaaggaagaactga

SEQ ID NO: 5264 - protein, 153 aa, Sorghum bicolor
  misc_feature: Ceres ANNOT ID no. 6042372
  misc_feature (57)..(150): Pfam Id: Rotamase Pfam Desc: PPIC-type PPIASE domain
  misc_feature (20)..(152): NCBI GI: 89892051 NCBI Desc: peptidyl-prolyl cis-trans isomerase [trypanosoma cruzi]
  misc_feature (18)..(152): NCBI GI: 47683021 NCBI Desc: pin4 protein [homo sapiens]
  misc_feature (18)..(152): NCBI GI: 30584149 NCBI Desc: homo sapiens protein (peptidyl-prolyl cis/trans isomerase) nima-interacting, 4 (parvulin) [synthetic construct]
  misc_feature (18)..(152): NCBI GI: 85567709 NCBI Desc: protein (peptidyl-prolyl cis/trans isomerase) nima-interacting, 4 (parvulin) [homo sapiens]
  misc_feature (18)..(152): NCBI GI: 4689436 NCBI Desc: peptidyl-prolyl cis-trans isomerase epvh [homo sapiens]
MGKDSKPKDAKGKDAKGKGKQAAGSSGGDDGGGKGGKGKGGKSADGLGTCTYVKARHVLCEKQGKINEAYKKLQDGWLDNGDKVPPAEFAKVAQEYSECPSGKKGGDLGWFPRGKMAGPFQEVAFNTPVGACSAPFKSTYAGYHFILCEGRKN

SEQ ID NO: 5265 - DNA, 1473 bp, Sorghum bicolor
  misc_feature: Ceres ANNOT ID no. 6042373
  misc_feature: Encodes the peptide sequence at SEQ ID NO 5266
atggccacgctccaccaccacctcctacccctgcagcgtctgcccaactccccccgccaaccgcctcctcgcctccgcctccccacgaagccatcgaggccccacagtcggctgctcccccgcgcggcagccagcacagccgcgacgacagtgaccgcgctggaggacttccggcggtggctcgcctctcacagcgtgggcgacggaggaaaaacctttccagccgccgtgccggagggcctcggcctcgtggcggcgcgggatctgccccgcggggaggtggtcgcggaggtgcccaagaagctctggatggacgccgacgccgtcgcggcctccgacatcggccgcgcctgcggcggcggcggcgggggcctccggccctgggtcgccgtcgcgctgctgcttctcagtgaggtcgcgcgcggggcggactcgccgtgggcgccctacctggccatcctcccgcgccagaccgactccaccatcttctggtctgaagaagagctccttgagatacaagggacacagttgctaagcaccacagtgggtgtgaaagagtatgtgcaaagcgagtttgatagtgttcaagcagagatcataagcagaaacaaggacctcttccctggtagcataacatttgatgatttcctttgggcatttggaatactaagatcaagggtgtttccagagctccgtggagataagcttgctctcgtaccatttgctgatttggttaatcacagtcctgatatcacctcagaaggatcaagttgggagatcaaaggaaagggtctttttggtagagaacccatgttctccttgcggacaccagtggatgttaaatctggacaacagatatatatccagtacgatctggacaagagtaatgctgaactggcacttgactatgggtttgtggaatcaaatccatcaagggattcatatactgtgaccctggagatttctgaatccgatccattttatggagataagcttgacattgcagagttaaacgaactgggggaaactgcatattttgatataatcctcgatgaaccccttcctcctcaaatgctcccttacctgcgattactttgcattggcggaacagatgcatttatcttggaagcactcttcaggaattcagtttggggccaccttgaactgccattgagtcctgacaatgaggaatcaatatgtcaggtcatgcgagatgcctgcaaatcagcccttgctgcctatcataccacaatagaagaggatgaagaactatcagaaagagagaatttgcagccaagacttacaattgcaattggagtaagggctggtgaaaagaaagtactccagcacattgataatatttttaaacagagggagcaggaattagatggcctagagtactaccaggaaagaagactcaaggatcttggtttagtcagtgacaatggtgaaattattttttgggagtcctag

SEQ ID NO: 5266 - protein, 490 aa, Sorghum bicolor
  misc_feature: Ceres ANNOT ID no. 6042373
  misc_feature (56)..(298): Pfam Id: SET Pfam Desc: SET domain
  misc_feature (321)..(448): Pfam Id: Rubis-subs-bind Pfam Desc: Rubisco LSMT substrate-binding
  misc_feature (54)..(489): NCBI GI: 1731477 NCBI Desc: ribulose-1,5 bisphosphate carboxylase/oxygenase large subunit n-methyltransferase
  misc_feature (50)..(488): NCBI GI: 3403236 NCBI Desc: ribulose-1,5-bisphosphate carboxylase/oxygenase small subunit n-methyltransferase i [spinacia oleracea]
  misc_feature (32)..(490): NCBI GI: 8778402 NCBI Desc: f16a14.25 [arabidopsis thaliana]
  misc_feature (50)..(488): NCBI GI: 3403238 NCBI Desc: ribulose-1,5-bisphosphate carboxylase/oxygenase small subunit n-methyltransferase ii [spinacia oleracea]
  misc_feature (42)..(486): NCBI GI: 508551 NCBI Desc: ribulose-1,5 bisphosphate carboxylase large subunit n-methyltransferase
  misc_feature (54)..(489): SWISSPROT Homolog: EC 2.1.1.127 Ribulose-1,5 bisphosphate carboxylase/oxygenase large subunit N-methyltransferase,chloroplast precursor
MATLHHHLLPLQRLPNSPRQPPPRLRLPTKPSRPHSRLLPRAAASTAATTVTALEDFRRWLASHSVGDGGKTFPAAVPEGLGLVAARDLPRGEVVAEVPKKLWMDADAVAASDIGRACGGGGGGLRPWVAVALLLLSEVARGADSPWAPYLAILPRQTDSTIFWSEEELLEIQGTQLLSTTVGVKEYVQSEFDSVQAEIISRNKDLFPGSITFDDFLWAFGILRSRVFPELRGDKLALVPFADLVNHSPDITSEGSSWEIKGKGLFGREPMFSLRTPVDVKSGQQIYIQYDLDKSNAELALDYGFVESNPSRDSYTVTLEISESDPFYGDKLDIAELNELGETAYFDIILDEPLPPQMLPYLRLLCIGGTDAFILEALFRNSVWGHLELPLSPDNEESICQVMRDACKSALAAYHTTIEEDEELSERENLQPRLTIAIGVRAGEKKVLQHIDNIFKQREQELDGLEYYQERRLKDLGLVSDNGEIIFWES

SEQ ID NO: 5267 - DNA, 627 bp, Sorghum bicolor
  misc_feature: Ceres ANNOT ID no. 6042413
  misc_feature: Encodes the peptide sequence at SEQ ID NO 5268
atggctgctacacacctcgacgctgagttgcagcacaatgagatacgtcctctcttgtcgaacagagctgatggaaacaacaacatgagccccatgcaaaaagcaataggccaaacataccagagcactgcccacctcgccaaactccttccttctggcaccgttctttcttttcagatcctggctcccaccctggcaaaacaaggccactgcagtgacatgaaccggatgatgacaggagggctcgtggtgctctgtgcgttgtcctgctttgttctcagcttcacagatagcttcagggatgaggaagggaaggtacgatacgggtttgccacattcaggggattgtgggtcattgatggtggggctcctcttgaaccacttgcagcagcaggattcaggatgcggtttatagactttgtacatgccattgtttcagcaataatttttgtagcaattgcactgtttgaccaaaatgtggtgtcttgcttctatccaacaccatccgaggatacaaagcaacttctcacagcattgccagttgccattggagtcattggaagcatgttgtttgttagcttccctaccactcgtcacagcattggctccacactctcttcgcaataa

SEQ ID NO: 5268 - protein, 208 aa, Sorghum bicolor
  misc_feature: Ceres ANNOT ID no. 6042413
  misc_feature (34)..(202): NCBI GI: 72384432 NCBI Desc: 52o08_3 [brassica rapa subsp. pekinensis]
  misc_feature (43)..(202): NCBI GI: 115441457 NCBI Desc: os01g0882400 [oryza sativa (japonica cultivar-group)]
  misc_feature (36)..(204): NCBI GI: 15528693 NCBI Desc: p0560b06.26 [oryza sativa (japonica cultivar-group)]
  misc_feature (36)..(204): NCBI GI: 115436576 NCBI Desc: os01g0368700 [oryza sativa (japonica cultivar-group)]
  misc_feature (148)..(206): NCBI GI: 115465445 NCBI Desc: os05g0562800 [oryza sativa (japonica cultivar-group)]
MAATHLDAELQHNEIRPLLSNRADGNNNMSPMQKAIGQTYQSTAHLAKLLPSGTVLSFQILAPTLAKQGHCSDMNRMMTGGLVVLCALSCFVLSFTDSFRDEEGKVRYGFATFRGLWVIDGGAPLEPLAAAGFRMRFIDFVHAIVSAIIFVAIALFDQNVVSCFYPTPSEDTKQLLTALPVAIGVIGSMLFVSFPTTRHSIGSTLSSQ

SEQ ID NO: 5269 - DNA, 507 bp, Sorghum bicolor
  misc_feature: Ceres ANNOT ID no. 6042426
  misc_feature: Encodes the peptide sequence at SEQ ID NO 5270
atgtaccaggccatcccctacagcagcgcccggccgtggctgatgccgccagcggctgaggcggcagccgtcgtcgccgtgaagccggagccggtggtggtgacgacgacgaccgtcgtcgcggaggctgcggctgcggcggaggtggagagcgcccggcccggcgccgcggctggcgctggcgctggggccggggacgacgacggcggcaaggcggaagtcggaagggccgtggcggagagcccggtgctggtggtggggcggcgcgggtgctgcctgagccacgtggtgaagcggctgctgcaggggctcggcgtgaacccggccgtgcacgaggtcgccgacgagtccgcgctcgccggggtcgtcccggccgccgacgccgccgcgctgcccgctgtgttcgtcgggggaaagctcctgggcgggctcgaccggctcatggccgtccacatctccggcgagctcgtgcccatcctcaagaaggccggtgccctctggctctga

SEQ ID NO: 5270 - protein, 168 aa, Sorghum bicolor
  misc_feature: Ceres ANNOT ID no. 6042426
  misc_feature (83)..(141): Pfam Id: Glutaredoxin Pfam Desc: Glutaredoxin
  misc_feature (27)..(168): NCBI GI: 56202242 NCBI Desc: glutaredoxin-like [oryza sativa (japonica cultivar-group)]
  misc_feature (27)..(168): NCBI GI: 75321443 NCBI Desc: monothiol glutaredoxin-s5
  misc_feature (51)..(168): NCBI GI: 122064228 NCBI Desc: monothiol glutaredoxin-s9
  misc_feature (71)..(168): NCBI GI: 124360754 NCBI Desc: thioredoxin fold [medicago truncatula]
  misc_feature (44)..(168): NCBI GI: 21740746 NCBI Desc: osjnba0072k14.2 [oryza sativa (japonica cultivar-group)]
  misc_feature: The sequence is a functional homolog of SEQ ID NO. 382 in the 11/188,298 US application
MYQAIPYSSARPWLMPPAAEAAAVVAVKPEPVVVTTTTVVAEAAAAAEVESARPGAAAGAGAGAGDDDGGKAEVGRAVAESPVLVVGRRGCCLSHVVKRLLQGLGVNPAVHEVADESALAGVVPAADAAALPAVFVGGKLLGGLDRLMAVHISGELVPILKKAGALWL

SEQ ID NO: 5271 - DNA, 867 bp, Sorghum bicolor
  misc_feature: Ceres ANNOT ID no. 6042427
  misc_feature: Encodes the peptide sequence at SEQ ID NO 5272
atggcggaacacttggcttcaatatttggtacagagaaagatagggtcaactgcccattttacttcaagattggggcttgtcgtcatggagatcgttgctcacgtctccataacaggccaaccatatcaccaactcttgtcctcgttaacatgtatcagcgccctgacatgatcacccctggggtcgatgctcaaggtcagccaattgatccccgcaagatgcaagagcattttgaagatttttacgaggatatctatgaggaactaagcaagtttggtgagatcgagaatctcaatgtctgtgataaccttgctgatcacatgattggtaatgtctatgtccagttcagggaggaagatcaggcagctgctgcacatacagcccttcagggccgtttttactctggccgaccaattgttgttgacttctcccctgtgactgatttccgcgaagcgacctgccggcaatatgaggagaacagctgtaatcgcggtggatattgcaatttcatgcatgtgaagaagatcggtagggatctgaggaaaaaaatgtttgggcattacaagaggccatacaggggaaggagccgtagccctagtccacatcacaggagagagcgccgggaccgagatgattaccgtggcgcaggtggtggcggaggtcgtggccgtgatgattaccgtggtggtggtggtgggcgcaggggtggaggcagcaggcatgaaaggtatgacgatggagggaggcgcaggcatggtggcagcccccctcccaggagggcgaggagccctgtcagggagagcagtgaggagcgcagggctaagattgagcagtggaaccgtgaaagggatgaaaagcaagggtga

SEQ ID NO: 5272 - protein, 288 aa, Sorghum bicolor
  misc_feature: Ceres ANNOT ID no. 6042427
  misc_feature (13)..(39): Pfam Id: zf-CCCH Pfam Desc: Zinc finger C-x8-C-x5-C-x3-H type (and similar)
  misc_feature (149)..(174): Pfam Id: zf-CCCH Pfam Desc: Zinc finger C-x8-C-x5-C-x3-H type (and similar)
  misc_feature (1)..(286): NCBI GI: 3850816 NCBI Desc: u2 snrnp auxiliary factor, small subunit [oryza sativa]
  misc_feature (1)..(285): NCBI GI: 15723293 NCBI Desc: u2 auxiliary factor small subunit [arabidopsis thaliana]
  misc_feature (1)..(287): NCBI GI: 3850818 NCBI Desc: u2 snrnp auxiliary factor, small subunit [oryza sativa]
  misc_feature (1)..(287): NCBI GI: 15723291 NCBI Desc: u2 auxiliary factor small subunit [arabidopsis thaliana]
  misc_feature (1)..(288): NCBI GI: 68036691 NCBI Desc: u2af small subunit [triticum aestivum]
MAEHLASIFGTEKDRVNCPFYFKIGACRHGDRCSRLHNRPTISPTLVLVNMYQRPDMITPGVDAQGQPIDPRKMQEHFEDFYEDIYEELSKFGEIENLNVCDNLADHMIGNVYVQFREEDQAAAAHTALQGRFYSGRPIVVDFSPVTDFREATCRQYEENSCNRGGYCNFMHVKKIGRDLRKKMFGHYKRPYRGRSRSPSPHHRRERRDRDDYRGAGGGGGRGRDDYRGGGGGRRGGGSRHERYDDGGRRRHGGSPPPRRARSPVRESSEERRAKIEQWNRERDEKQG

SEQ ID NO: 5273 - DNA, 1563 bp, Sorghum bicolor
  misc_feature: Ceres ANNOT ID no. 6042428
  misc_feature: Encodes the peptide sequence at SEQ ID NO 5274
atggcatttagaaatatggtttgcactccccaagtcattgatcttacgtcagagagagggcaagctcaaggaggcaatggtagtgagatacctgagcaaggtgcacaacatgctgtcagagttgtaggaaatggaacaaatgttggtctctctggtgtgcgaagttactatgatgtgagcataaatcatcaccatcagcctgttcataacccacccccaaatttaggtgttgattctggttttgtcttcgcatcaaatatgtacaatccctgcatgtcatcaacatcaatcaacagacatgtttctcatgctcagagctttggatcagggaatcaaacattgcctctaaaccaagttccaggaagtatggatgagagtagcagaaatgacagtgttggtgaaagtgctagagaccatattaaaaggaaaaatgctgcagttgctggaagctatccttttgttaatggatttgcaagctcaagctcatcttctcatgcacctcagaatcctatgcttaggccttgggacccttcttttgaatcaacagtttcttctaatgttgcaccgttcaacccatcagaatatcatggacacagcagttggccgtccttagaaggatcttccatagctggaactaatggattcaactcaatggctgttcatccagaatcagtacagcgtgggaactatacatttccatccaatcacattggccattcatggatgccccatgctactaatggtattgctgatggagttccccagtgggaatatgttaatgcaactactaatattcaaggcagatttgcccattcaggagccacagaaattgcaaatggaggctttcaggaatatcagaatggcccttcaactgtttctcggggaccagtaccttatttccaccagcatgcgatgcatggcatgcaagctcataatctgcttgatcctactcaaatgcaagttccttaccaacaatgccacaataacggtgtcttgcatggtggtgttaattaccctggaaaccgtctccacttaggtccgcgaattccagttctcttctccagtcctgaacgtacttttggacctccacagcatccattcctggcaaatccagttaaccaccgcaacataaggattctaccacccgagcatgccacaataatggatttttcgagattgtatgaagtgtcaaatactgtagatgagcatagagatatgcgtctagacatagacagcatgacgtatgaggagcttttagcattagaagagcagattggagatgtcaatactggcctgacaaaaagtcacattgtagataaattgaggactagcctatatgttccaggaacatcaagcatgcctgatcagccatctaaatcttctctagagaatgatgcttgcataatatgccaggaggagtaccaggctagagactgcgttggcacccttgactgtggtcacaggtaccacgcagagtgcgtgaagcagtggctgatggtgaagaacttgtgccccatctgcaagacaacagcattgtctgccaacagaagacaaggaaaatga

SEQ ID NO: 5274 - protein, 520 aa, Sorghum bicolor
  misc_feature: Ceres ANNOT ID no. 6042428
  misc_feature (467)..(507): Pfam Id: zf-C3HC4 Pfam Desc: Zinc finger, C3HC4 type (RING finger)
  misc_feature (1)..(519): NCBI GI: 56202173 NCBI Desc: ring-finger protein-like [oryza sativa (japonica cultivar-group)]
  misc_feature (100)..(518): NCBI GI: 8777490 NCBI Desc: ring-finger protein (c-terminal)-like [arabidopsis thaliana]
  misc_feature (100)..(518): NCBI GI: 23506055 NCBI Desc: at3g15070/k15m2_22 [arabidopsis thaliana]
  misc_feature (330)..(514): NCBI GI: 118621153 NCBI Desc: ring-finger domain protein [zinnia elegans]
  misc_feature (120)..(518): NCBI GI: 79319806 NCBI Desc: protein binding / ubiquitin-protein ligase/ zinc ion binding [arabidopsis thaliana]
  misc_feature: The sequence is a functional homolog of SEQ ID NO. 271 in the 11/188,298 US application
  misc_feature: The sequence is a functional homolog of SEQ ID NO. 329 in the 11/188,298 US application
  misc_feature: The sequence is a functional homolog of SEQ ID NO. 424 in the 11/188,298 US application
MAFRNMVCTPQVIDLTSERGQAQGGNGSEIPEQGAQHAVRVVGNGTNVGLSGVRSYYDVSINHHHQPVHNPPPNLGVDSGFVFASNMYNPCMSSTSINRHVSHAQSFGSGNQTLPLNQVPGSMDESSRNDSVGESARDHIKRKNAAVAGSYPFVNGFASSSSSSHAPQNPMLRPWDPSFESTVSSNVAPFNPSEYHGHSSWPSLEGSSIAGTNGFNSMAVHPESVQRGNYTFPSNHIGHSWMPHATNGIADGVPQWEYVNATTNIQGRFAHSGATEIANGGFQEYQNGPSTVSRGPVPYFHQHAMHGMQAHNLLDPTQMQVPYQQCHNNGVLHGGVNYPGNRLHLGPRIPVLFSSPERTFGPPQHPFLANPVNHRNIRILPPEHATIMDFSRLYEVSNTVDEHRDMRLDIDSMTYEELLALEEQIGDVNTGLTKSHIVDKLRTSLYVPGTSSMPDQPSKSSLENDACIICQEEYQARDCVGTLDCGHRYHAECVKQWLMVKNLCPICKTTALSANRRQGK

SEQ ID NO: 5275 - DNA, 378 bp, Sorghum bicolor
  misc_feature: Ceres ANNOT ID no. 6042444
  misc_feature: Encodes the peptide sequence at SEQ ID NO 5276
atgaagacgaggtcgcagacggcgccgaagcctctcaagacggtggcgatggctcccagaccgagcagccccaagcggaagtcgaggcccaagccggcggggaagggcgaccgccgcgcacccaagaagccgcccaccgccttcttctacttcatggaggattttcggaaggtttataagcaagaaaaaccaagtgtaaaatcaatgcaggaaatagggaaggcatgcggcgaaaaatggaatacaatggcatttgaggaaaaggtcaagtattatgatatagctactgagaaacgtgcagaatttgagaaggcgatgattgaatataacaagaaaaagaaaaacggagaaatgtctgaggaatcagattacgactag

SEQ ID NO: 5276 - protein, 125 aa, Sorghum bicolor
  misc_feature: Ceres ANNOT ID no. 6042444
  misc_feature (41)..(110): Pfam Id: HMG_box Pfam Desc: HMG (high mobility group) box
  misc_feature (1)..(125): NCBI GI: 56202161 NCBI Desc: hmg protein-like [oryza sativa (japonica cultivar-group)]
  misc_feature (1)..(125): NCBI GI: 115439039 NCBI Desc: os01g0666200 [oryza sativa (japonica cultivar-group)]
  misc_feature (18)..(123): NCBI GI: 42572635 NCBI Desc: high mobility group protein alpha (hmgalpha) / hmg protein alpha [arabidopsis thaliana]
  misc_feature (2)..(123): NCBI GI: 47027098 NCBI Desc: hmg transcription factor [hyacinthus orientalis]
  misc_feature (4)..(123): NCBI GI: 729737 NCBI Desc: hmg1/2-like protein
  misc_feature: The sequence is a functional homolog of SEQ ID NO 58 in the 10/666,642US patent application
  misc_feature: The sequence is a functional homolog of SEQ ID NO 586 in the 10/666,642US patent application
  misc_feature: Useful for making plants with altered alkaloid content
  misc_feature: Useful for making plants with modulated growth and phenotype characteristics
  misc_feature: GREAT-hit functional homolog of the protein sequence given in SEQ ID NO 13223
  misc_feature: The sequence is a functional homolog of SEQ ID NO 58 in the 20070033671 US patent application
  misc_feature: The sequence is a functional homolog of SEQ ID NO 586 in the 20070033671 US patent application
  misc_feature: Useful for making plants with altered alkaloid content
  misc_feature: Functional homolog of the protein sequence given in SEQ ID NO 13223
  misc_feature: The sequence is a functional homolog of SEQ ID NO 586 in the 10/666,642 US patent application
MKTRSQTAPKPLKTVAMAPRPSSPKRKSRPKPAGKGDRRAPKKPPTAFFYFMEDFRKVYKQEKPSVKSMQEIGKACGEKWNTMAFEEKVKYYDIATEKRAEFEKAMIEYNKKKKNGEMSEESDYD

SEQ ID NO: 5277 - DNA, 1320 bp, Sorghum bicolor
  misc_feature: Ceres ANNOT ID no. 6042456
  misc_feature: Encodes the peptide sequence at SEQ ID NO 5278
  misc_feature: Up-regulated in root tissues in response to salicylic acid treatment
  misc_feature: Up-regulated in shoot tissues in response to salicylic acid treatment
atgcctgcactgagaatgaagaggatgtttgatgttgatgattttgctaatgagttcaacaccaggaacgtgaaatccgttaaagtttcacacttttatgtcagtggattggagcagtcagctgtgttgaattcgtcagataatcctcatgatgagtcagatccaaccattcaacttgctgaccaggatattagggcaacggaaccttctggcttgcatgatccgatcggaggacaatccatgctcaaggatttaacatccgatgaagtgatagattcaccaaattcagaggttgattcctctgctaattatgatgacaacaaatctgtgttatatgcagtgaattatgttggcaaagagtttgcagatgatgatgtagattcttcagcccagaatttgtgtgttgttagtgatcatgagacaagctggggttcgaatcagtgttgcagactgctggatatttatagtccagatgatgatttcccgtacttgttggataatccacctgatcttctgcctagttatattggattgtgtgatgaatttgtatcaattgatgcattgatgaacatgagtagcagatgtggagcattcccacttattgagagtgccacggaagccagtgttgattataagccatgttcatctgaggtggatttgtgctttaattctgaggtattagagtggctcaaccctcatctgttggaggaggatttaccagatcttgttgattttgctgagttaaattcaaatgctgctcctgcaaaaaaagagcaatggaccaggaaggtcactcttgtgcttgatttggatgaaacccttgttcattcaactatggagcattgtgatgacgctgatttcacatttcctgtgttctatgatatgaaagagcatgtggtatatgtgaaaaagaggccacatgtccacatgttcctccaaaggatggttgaaatgtttgaggtagtgatatttacagccagtcaaagtgtttacgcagaccagttgcttgacatgctggatccagagaaaaaacttttctccaagcgtttcttccgggaatcatgtttgttcacagacaatggctacacaaaagatctgactgttgttggagtcgaccttgccaaggttgtcataattgacaacactccacaggttttccagctgcaagtgaacaatggtataccaatagagagttggtatagtaaccccttggacgaggctttacctcaattgatcccattcttagagacccttgctgtagctgatgatgtccggcctatcattgccaagaagtttggcaacataatagatagttgctaa

SEQ ID NO: 5278 - protein, 439 aa, Sorghum bicolor
  misc_feature: Ceres ANNOT ID no. 6042456
  misc_feature (254)..(430): Pfam Id: NIF Pfam Desc: NLI interacting factor-like phosphatase
  misc_feature (1)..(434): NCBI GI: 115439031 NCBI Desc: os01g0665300 [oryza sativa (japonica cultivar-group)]
  misc_feature (1)..(434): NCBI GI: 37538062 NCBI Desc: ctd-phosphatase-like protein [hordeum vulgare subsp. vulgare]
  misc_feature (171)..(434): NCBI GI: 140055915 NCBI Desc: nli interacting factor [medicago truncatula]
  misc_feature (62)..(437): NCBI GI: 115438721 NCBI Desc: os01g0629400 [oryza sativa (japonica cultivar-group)]
  misc_feature (228)..(432): NCBI GI: 6841354 NCBI Desc: hspc058 [homo sapiens]
  misc_feature: Up-regulated in root tissues in response to salicylic acid treatment
  misc_feature: Up-regulated in shoot tissues in response to salicylic acid treatment
  misc_feature: The sequence is a functional homolog of SEQ ID NO. 347 in the 11/188,298 US application
MPALRMKRMFDVDDFANEFNTRNVKSVKVSHFYVSGLEQSAVLNSSDNPHDESDPTIQLADQDIRATEPSGLHDPIGGQSMLKDLTSDEVIDSPNSEVDSSANYDDNKSVLYAVNYVGKEFADDDVDSSAQNLCVVSDHETSWGSNQCCRLLDIYSPDDDFPYLLDNPPDLLPSYIGLCDEFVSIDALMNMSSRCGAFPLIESATEASVDYKPCSSEVDLCFNSEVLEWLNPHLLEEDLPDLVDFAELNSNAAPAKKEQWTRKVTLVLDLDETLVHSTMEHCDDADFTFPVFYDMKEHVVYVKKRPHVHMFLQRMVEMFEVVIFTASQSVYADQLLDMLDPEKKLFSKRFFRESCLFTDNGYTKDLTVVGVDLAKVVIIDNTPQVFQLQVNNGIPIESWYSNPLDEALPQLIPFLETLAVADDVRPIIAKKFGNIIDSC

SEQ ID NO: 5279 - DNA, 885 bp, Sorghum bicolor
  misc_feature: Ceres ANNOT ID no. 6042492
  misc_feature: Encodes the peptide sequence at SEQ ID NO 5280
atgcaggcccccgcgcgctcctccgctccatcctcgccgctcgtctcctccgcgccaccgctacctccacggccacaacgcgtcgccgccccctccctccgccgccgtgatctcctccttctcccggcggcgctgaccctcccgatggcggcgcccgcctccttgcctgcgtcggcgcgcgggctgttccggatgcccccgccgcggctggcgaaccgctactttctggtgcgcgcgggcgagtccgtgtacgaaggtcagggcctcctccgtaccaacccggtcgccaagacctccgtcgacagcggcctctcccccgtggggctccgccagacggcgcgcgccgcgctcgagctccagcgcctcggcgcgtgcgaggacgactgctggatatggccgtccatcacgcagcgcgcgtaccaggcggccgagatcattgccgcggccaacgggatcaaccgcagtcgcatcgtgccggagtacagcttcttggatgcacgcggattgggtgcgtttgagtggaagagcttagacaccttgcccgaggtgtatgcgtcagataacatttctccagacatgaagcctcctcctatcagtgatggtactccaaatgagagcgttgcagacgtatttgttcgggtgacacagctcatgtcaatactagagacccagtactcaggggaaactgttgtcattgtttcaccagattctgacaacttgtcaattcttcaagctggattgattgggcttgaccttcggaggcatagcagcttattttttcagcccggtgaggtccgtccagttgatccctcaagcatacctgaatacaagcaacctccttctactgtttttaagtgtgcaaatccgccaagttgtaaagattag

SEQ ID NO: 5280 - protein, 294 aa, Sorghum bicolor
  misc_feature: Ceres ANNOT ID no. 6042492
  misc_feature (73)..(242): Pfam Id: PGAM Pfam Desc: Phosphoglycerate mutase family
  misc_feature (1)..(293): NCBI GI: 115438993 NCBI Desc: os01g0660900 [oryza sativa (japonica cultivar-group)]
  misc_feature (66)..(247): NCBI GI: 116308905 NCBI Desc: h0515c11.13 [oryza sativa (indica cultivar-group)]
  misc_feature (66)..(247): NCBI GI: 38344128 NCBI Desc: osjnbb0072n21.7 [oryza sativa (japonica cultivar-group)]
  misc_feature (104)..(268): NCBI GI: 118047243 NCBI Desc: phosphoglycerate mutase [chloroflexus aggregans dsm 9485]
  misc_feature (70)..(252): NCBI GI: 114844483 NCBI Desc: phosphoglycerate mutase [thermoanaerobacter ethanolicus x514]
MQAPARSSAPSSPLVSSAPPLPPRPQRVAAPSLRRRDLLLLPAALTLPMAAPASLPASARGLFRMPPPRLANRYFLVRAGESVYEGQGLLRTNPVAKTSVDSGLSPVGLRQTARAALELQRLGACEDDCWIWPSITQRAYQAAEIIAAANGINRSRIVPEYSFLDARGLGAFEWKSLDTLPEVYASDNISPDMKPPPISDGTPNESVADVFVRVTQLMSILETQYSGETVVIVSPDSDNLSILQAGLIGLDLRRHSSLFFQPGEVRPVDPSSIPEYKQPPSTVFKCANPPSCKD

SEQ ID NO: 5281 - DNA, 681 bp, Sorghum bicolor
  misc_feature: Ceres ANNOT ID no. 6042498
  misc_feature: Encodes the peptide sequence at SEQ ID NO 5282
atgacgacgggcacatacgacaccgacgtcgtcatggacgacggcactgtgatccggacaaccatcacgtcctccggcgacgccgtcaaccttttcctccgagaggtccgcaagcaggcaggccatggccatcctccccacatcgtcggcctcgacaccgagtggcgcatagtccacgacgaggacggccgccgcaagaaccgaatggccgtcctgcagctctgcgtgggccaccgctgcctcgtctaccagatcttccacgccgactacgtcccggacgccctgagagacttcctcgcgtgtccggaccaccgcttcctcggcgtggcggtcgacggcgacgtcaagcggctgtccgaggactgcggccttgtggtcgccgacgcggcggacctgaggcacgtcgcggcggaggtgctcgcccggcccgagctccggactgcgtcgctcaagacgctcacccgcgaggtcatgggcgtgctcatcgacaagcccaagtcggtgacgatgagcaagtgggacgcgcggcgcctgtccgtgaagcaggtccagtatgcctgcgtcgacgcgttcgtatcctacgagattggccggctgctgctcaccggtcagtgcgcggaacatgcggcgacaggtgaaatgatctcaccgttcattgcctccgtggttccggtggcttga

SEQ ID NO: 5282 - protein, 226 aa, Sorghum bicolor
  misc_feature: Ceres ANNOT ID no. 6042498
  misc_feature (19)..(204): Pfam Id: 3_5_exonuc Pfam Desc: 3'-5' exonuclease
  misc_feature (3)..(205): NCBI GI: 116309147 NCBI Desc: osigba0101a01.4 [oryza sativa (indica cultivar-group)]
  misc_feature (3)..(205): NCBI GI: 38344132 NCBI Desc: osjnbb0072n21.11 [oryza sativa (japonica cultivar-group)]
  misc_feature (4)..(198): NCBI GI: 115439803 NCBI Desc: os01g0737600 [oryza sativa (japonica cultivar-group)]
  misc_feature (4)..(200): NCBI GI: 115439805 NCBI Desc: os01g0737700 [oryza sativa (japonica cultivar-group)]
  misc_feature (18)..(187): NCBI GI: 115436114 NCBI Desc: os01g0299700 [oryza sativa (japonica cultivar-group)]
MTTGTYDTDVVMDDGTVIRTTITSSGDAVNLFLREVRKQAGHGHPPHIVGLDTEWRIVHDEDGRRKNRMAVLQLCVGHRCLVYQIFHADYVPDALRDFLACPDHRFLGVAVDGDVKRLSEDCGLVVADAADLRHVAAEVLARPELRTASLKTLTREVMGVLIDKPKSVTMSKWDARRLSVKQVQYACVDAFVSYEIGRLLLTGQCAEHAATGEMISPFIASVVPVA

SEQ ID NO: 5283 - DNA, 888 bp, Sorghum bicolor
  misc_feature: Ceres ANNOT ID no. 6042507
  misc_feature: Encodes the peptide sequence at SEQ ID NO 5284
atggcgactaatctcaagtgggctcctgttctggcccttctcctcgttgctgccatggttggcagcaccagtgctggcaatatcgccgtgtactggggccagaacggcaacgaaggcaccctagcggacacctgcaactccgggctgtacgcctacgtcatcctggcgttcctcacgaccttcggcaacggacagaccccggtcctgaacctcgccgggcactgtgacccgggctccggcggctgcacgggcctgagcagcgacatccagacctgccagtcgcagggcatcaaggtgctcctctccatcggcggcgccaccggcagctacggcctgtcgtccaccgacgacgccaacagcgtggccgactacctgtggaacagctacctgggcggcagcgacggctcgacacgcccgctgggcgccgccgtgctcgacggcgtcgacttcgacatcgagaacgggcagtcggcgcactacgacgacctggcgaccgcgctcaagggcaaagggagcgtgctgctgtcggcggcgccgcagtgcccgtacccggacgcgtcgctgggagccgcgctgcagacggggcagttcgacaacgtgtggatccagttctacaacaaccccgggtgcgcgtacgccaacggcgacgacaccaacctggtgaacgcctggagcacgtggaccagcagcgtcacggcggggagcttctacctcggcctgccggcgtcgacccaggccgccggcagcgggtacatcgaacccggcacgctgacgggcacggtgctccccgctatcaagggcgttggcaagtacggcggcatcatggtgtggaaccgcttctacgatgtgcagaacaactacagcgcccaggtgaaggacagcgtctga

SEQ ID NO: 5284 - protein, 295 aa, Sorghum bicolor
  misc_feature: Ceres ANNOT ID no. 6042507
  misc_feature (26)..(282): Pfam Id: Glyco_hydro_18 Pfam Desc: Glycosyl hydrolases family 18
  misc_feature (1)..(295): NCBI GI: 7687414 NCBI Desc: prm 3 [zea mays]
  misc_feature (9)..(295): NCBI GI: 104768287 NCBI Desc: acid chitinase [nepenthes rafflesiana]
  misc_feature (1)..(295): NCBI GI: 106647236 NCBI Desc: class iii chitinase [panax ginseng]
  misc_feature (1)..(295): NCBI GI: 10880383 NCBI Desc: chitinase [vitis vinifera]
  misc_feature (14)..(295): NCBI GI: 33562677 NCBI Desc: class iii chitinase [medicago truncatula]
  misc_feature (1)..(295): SWISSPROT Homolog: EC 3.2.1.14 Acidic endochitinase precursor
  misc_feature: Useful for making plants with altered cell wall content and/or composition
  misc_feature: Functional homolog of the protein sequence encoded by LOCUS at5g24090
  misc_feature: Useful for making plants with altered carbohydrate content
  misc_feature: Functional homolog of the protein sequence given in SEQ ID NO 13911
  misc_feature: Useful for making plants with altered cell wall content and/or composition
  misc_feature: Functional homolog of the protein sequence given in SEQ ID NO 13912
MATNLKWAPVLALLLVAAMVGSTSAGNIAVYWGQNGNEGTLADTCNSGLYAYVILAFLTTFGNGQTPVLNLAGHCDPGSGGCTGLSSDIQTCQSQGIKVLLSIGGATGSYGLSSTDDANSVADYLWNSYLGGSDGSTRPLGAAVLDGVDFDIENGQSAHYDDLATALKGKGSVLLSAAPQCPYPDASLGAALQTGQFDNVWIQFYNNPGCAYANGDDTNLVNAWSTWTSSVTAGSFYLGLPASTQAAGSGYIEPGTLTGTVLPAIKGVGKYGGIMVWNRFYDVQNNYSAQVKDSV

SEQ ID NO: 5285 - DNA, 1248 bp, Sorghum bicolor
  misc_feature: Ceres ANNOT ID no. 6042509
  misc_feature: Encodes the peptide sequence at SEQ ID NO 5286
atggtcatctctctgtctgcttgtttgatgatccatctcatggaagaccattcatcgtgggactacctaccagttgatcacattagaattcctgcattcaactctggagttgtttctgaagctagcaatggaggcaacgacttctcagtatcattggatgccgtcgttcctgatgatatcctggagaggattttcacattcttgcctatagcaagcatgatgagggcaacagcagtgtgcaagagatggcatggcattatctattcaagcagagttgtgtggacccacatgctgcctcaacggccatggtacttcatgttcacctctaatgaaactgctgctggttatgcttttgaccccatcctccgcaagtggtatgatttagagcttccttatattgacaagagcagctgttttgtctcttcttcttgtggcctagtttgcttcatggacaatgacaacaggaacaccatttctgtgtctaaccctataacaaaaagctgcaggaggcttttagagcctccgggtgaaacattgccagactacagtaccattgccatgaaggtggatcggctgtctcataagtactccgttacattggcaaaatctaagcagattcctgaagattttgtccgatgggacttttcagtatacaagtacgactcttcgagtggtacatgggcaacttctgtgagtgaagtgttcattggttggagaggaggtgatgatagtgtcatatgtgacggtgtcctgtactgcttgattcattccactggtgttcttggcaatgtcaacccccgtcatggccttatcatgtatgaccttgctggtgaaccatctgagacttcgttaatgcaaacgtcaatctcagtaccttgttctctcacatgtggccgtttggtaaacttaaaggagaagctggttttggttggtggaattgcaaaacacaacagacctgatatcattaaaggaataggaatatgggagctccatgagaaacagtggcatgaggtagctcggatgccccacaagttcttccaaggatttggtgaactcgatgatgttttcgcctgcagcggtatagatgaccttgtctacatacaaagctatggtgcaactgctttgcttgtttttgacatgatgcaaaagcaatggaagtggtccttgaaatgccctgtgagcaaaagatttcctctccagcttttcactggcttttgctttgaaccccggcttgatatcgcagcttag

SEQ ID NO: 5286 - protein, 415 aa, Sorghum bicolor
  misc_feature: Ceres ANNOT ID no. 6042509
  misc_feature (294)..(342): Pfam Id: Kelch_2 Pfam Desc: Kelch motif
  misc_feature (51)..(98): Pfam Id: F-box Pfam Desc: F-box domain
  misc_feature (7)..(413): NCBI GI: 55773953 NCBI Desc: fimbriata-like [oryza sativa (japonica cultivar-group)]
  misc_feature (20)..(415): NCBI GI: 115445403 NCBI Desc: os02g0260200 [oryza sativa (japonica cultivar-group)]
  misc_feature (79)..(410): NCBI GI: 74483458 NCBI Desc: f-box family protein [zea mays]
  misc_feature (56)..(411): NCBI GI: 28624856 NCBI Desc: proliferating floral organs protein [lotus japonicus]
  misc_feature (56)..(413): NCBI GI: 547307 NCBI Desc: fimbriata [antirrhinum majus]
  misc_feature: The sequence is a functional homolog of SEQ ID NO. 456 in the 11/188,298 US application
MVISLSACLMIHLMEDHSSWDYLPVDHIRIPAFNSGVVSEASNGGNDFSVSLDAVVPDDILERIFTFLPIASMMRATAVCKRWHGIIYSSRVVWTHMLPQRPWYFMFTSNETAAGYAFDPILRKWYDLELPYIDKSSCFVSSSCGLVCFMDNDNRNTISVSNPITKSCRRLLEPPGETLPDYSTIAMKVDRLSHKYSVTLAKSKQIPEDFVRWDFSVYKYDSSSGTWATSVSEVFIGWRGGDDSVICDGVLYCLIHSTGVLGNVNPRHGLIMYDLAGEPSETSLMQTSISVPCSLTCGRLVNLKEKLVLVGGIAKHNRPDIIKGIGIWELHEKQWHEVARMPHKFFQGFGELDDVFACSGIDDLVYIQSYGATALLVFDMMQKQWKWSLKCPVSKRFPLQLFTGFCFEPRLDIAA

SEQ ID NO: 5287 - DNA, 855 bp, Sorghum bicolor
  misc_feature: Ceres ANNOT ID no. 6042510
  misc_feature: Encodes the peptide sequence at SEQ ID NO 5288
atggaggcgccggacgaggaggcagggctgggactccctgagggcgagcggctgctggaggtggccctcatctccgcgcaggggctcaagcagccccactcgggcctgccgcggcggaggctgcacgcgtacgccgtggcctgggtcgacgcggggcacaagctccagacccgcgccgacgacgcgggcggcctcgacccggcgtggcacgcccgcctcctcttccgtgtgcgcgaggcctcgctcgccgacgactcgcgcgccgccgtctccgtcgagatctacgcggccgccgcgggcacttggcacttcggcggggactcgctcgtcggctcggcgcgcttcctccttggcgaccaccgcctcctgtcccgccccgtcggctccccctccatgttcgccgtcggcgtgcgccgcccctccggcagggtccacggcctcctcaacgtggccgtcagcctcgtcgcggtgccaccgtccccggccgcctgccacgccctccgcctctcgccggccgtctccctcagcggcctctccgtggcgcccaccccaaaccgcgtgctccgcgtcctcaaccgcacgcacccgacacctccaccgtccccgaggcttcttacgcccaagaagcagccgatggtggtcaagaccaacaataaggtcgcggacgacggcagcgatgaggaaggggccgaggaagacgcgagggggatgggcggggtcgtcttctgcgggccctgcgtcttaccattaccaaggaagatacacacgagcccctcagacgagaacctgcaggccttcgctaacatcatctctggtggcgggctcaggcattgccggcagagccctcatttttga

SEQ ID NO: 5288 - protein, 284 aa, Sorghum bicolor
  misc_feature: Ceres ANNOT ID no. 6042510
  misc_feature (17)..(191): NCBI GI: 47847879 NCBI Desc: c2 domain-containing protein-like [oryza sativa (japonica cultivar-group)]
  misc_feature (17)..(155): NCBI GI: 92895942 NCBI Desc: c2 calcium/lipid-binding region, calb [medicago truncatula]
  misc_feature (17)..(155): NCBI GI: 140049100 NCBI Desc: c2 [medicago truncatula]
  misc_feature (17)..(155): NCBI GI: 140056582 NCBI Desc: c2 [medicago truncatula]
  misc_feature (17)..(155): NCBI GI: 2494130 NCBI Desc: contains similarity to glycine src2 (gbab000130). [arabidopsis thaliana]
MEAPDEEAGLGLPEGERLLEVALISAQGLKQPHSGLPRRRLHAYAVAWVDAGHKLQTRADDAGGLDPAWHARLLFRVREASLADDSRAAVSVEIYAAAAGTWHFGGDSLVGSARFLLGDHRLLSRPVGSPSMFAVGVRRPSGRVHGLLNVAVSLVAVPPSPAACHALRLSPAVSLSGLSVAPTPNRVLRVLNRTHPTPPPSPRLLTPKKQPMVVKTNNKVADDGSDEEGAEEDARGMGGVVFCGPCVLPLPRKIHTSPSDENLQAFANIISGGGLRHCRQSPHF

SEQ ID NO: 5289 - DNA, 1101 bp, Sorghum bicolor
  misc_feature: Ceres ANNOT ID no. 6042513
  misc_feature: Encodes the peptide sequence at SEQ ID NO 5290
atggggcatgatgaagctgtagttactcagaattcagtaaaagcaccgtcaccacccaaggatcagccagctatttatccatgccttgattggtctactatgcaggcatattatggccaaggggtcttaccaccagcattctttaaccctggaattgcacctggtcatgtccctccaccatatgtgtggtgtccacagaatatgccaccagctgcctttggaaaaccatatgctgcaatatatccacatgctggtggcttcctgcatcccttcatgcccctaatggtaaacccattgagtgcagagccagctaagtctgcgaacagcaaggataatagtttaaataagaaactgaaggaaattgatggaactgctgtttcaagtggtaacagtgaaaaaacaagtggggattacagcctagaaggatccagcgatggaaacaacccaaaggtgagcggaacgccaaagaaaaggagctttgatgataggactacatcagaaacatgtggagtttcagcaactaatgataaaccaggagaatcaggaagattagcaactttgcccaatgtgcacattccagatgcaacgatgaaaccaagtgtgagcaccggtagtgacttcaaagttagtggtgcgacatcaaccgaatggccagctaaggacgacaaggaatcaaagcgtgaaaggaggaagcagtcaaatagggaatctgcccgacgctcaaggctgaggaagcaggctgagactgaagaactggctagaaaagtagagttactgaccgcagagaacacatcactccgaaacgaaatcagcaagctaacggatagctcccagaaactaaggatggagaatgcggctctgatggagaaactagcgggaggtacatcagaccaagcacaagaagcgtccgcaggccaccagacgacggccaccgcgccaccaccgtcggctcgcgtcgtcaagaacttcctctcgatgatggacgtcgaaggcccatcgagaggtggcggcagccggcgcacggagcacggtgcgcccaggctccgccagctcctgagctcaggaggccctctggcggctgacgccgtggccgcgagctga

SEQ ID NO: 5290 - protein, 366 aa, Sorghum bicolor
  misc_feature: Ceres ANNOT ID no. 6042513
  misc_feature (1)..(152): Pfam Id: MFMR Pfam Desc: G-box binding protein MFMR
  misc_feature (222)..(285): Pfam Id: bZIP_1 Pfam Desc: bZIP transcription factor
  misc_feature (222)..(276): Pfam Id: bZIP_2 Pfam Desc: Basic region leucine zipper
  misc_feature (1)..(366): NCBI GI: 56418455 NCBI Desc: abre-binding factor bz-1 [zea mays]
  misc_feature (1)..(365): NCBI GI: 49345143 NCBI Desc: salt-stress inducible bzip protein [oryza sativa (indica cultivar-group)]
  misc_feature (1)..(365): NCBI GI: 33465887 NCBI Desc: g-box binding protein [oryza sativa (japonica cultivar-group)]
  misc_feature (1)..(365): NCBI GI: 1147632 NCBI Desc: osbz8
  misc_feature (1)..(366): NCBI GI: 498643 NCBI Desc: g-box binding factor 1
  misc_feature: The sequence is a functional homolog of SEQ ID NO 110 in the 10/374,780US patent application
  misc_feature: The sequence is a functional homolog of SEQ ID NO 1104 in the 10/225,066US patent application
  misc_feature: The sequence is a functional homolog of SEQ ID NO 1108 in the 10/225,066US patent application
  misc_feature: The sequence is a functional homolog of SEQ ID NO 12 in the 10/412,699US patent application
  misc_feature: The sequence is a functional homolog of SEQ ID NO 1225 in the 10/412,699US patent application
  misc_feature: The sequence is a functional homolog of SEQ ID NO 159 in the 11/479,226US patent application
  misc_feature: The sequence is a functional homolog of SEQ ID NO 2 in the 10/374,780US patent application
  misc_feature: The sequence is a functional homolog of SEQ ID NO 2218 in the 10/374,780US patent application
  misc_feature: The sequence is a functional homolog of SEQ ID NO 36 in the 10/412,699US patent application
  misc_feature: The sequence is a functional homolog of SEQ ID NO 362 in the 10/412,699US patent application
  misc_feature: The sequence is a functional homolog of SEQ ID NO 464 in the 11/435,388US patent application
  misc_feature: The sequence is a functional homolog of SEQ ID NO 466 in the 11/435,388US patent application
  misc_feature: The sequence is a functional homolog of SEQ ID NO 492 in the 10/225,066US patent application
  misc_feature: The sequence is a functional homolog of SEQ ID NO 847 in the 11/479,226US patent application
  misc_feature: The sequence is a functional homolog of SEQ ID NO 910 in the 10/374,780US patent application
  misc_feature: The sequence is a functional homolog of SEQ ID NO 911 in the 10/374,780US patent application
  misc_feature: The sequence is a functional homolog of SEQ ID NO 912 in the 10/374,780US patent application
  misc_feature: The sequence is a functional homolog of SEQ ID NO 913 in the 10/374,780US patent application
  misc_feature: The sequence is a functional homolog of SEQ ID NO 922 in the 10/374,780US patent application
  misc_feature: Useful for making plants with modulated growth and phenotype characteristics
  misc_feature: The sequence is a functional homolog of SEQ ID NO 12 in the 20040045049 US patent application
  misc_feature: The sequence is a functional homolog of SEQ ID NO 1225 in the 20040045049 US patent application
  misc_feature: The sequence is a functional homolog of SEQ ID NO 36 in the 20040045049 US patent application
  misc_feature: The sequence is a functional homolog of SEQ ID NO 362 in the 20040045049 US patent application
  misc_feature: The sequence is a functional homolog of SEQ ID NO 910 in the 20060162006 US patent application
  misc_feature: The sequence is a functional homolog of SEQ ID NO 911 in the 20060162006 US patent application
  misc_feature: The sequence is a functional homolog of SEQ ID NO 912 in the 20060162006 US patent application
  misc_feature: The sequence is a functional homolog of SEQ ID NO. 512 in the 11/188,298 US application
  misc_feature: The sequence is a functional homolog of SEQ ID NO. 392 in the 11/188,298 US application
  misc_feature: The sequence is a functional homolog of SEQ ID NO. 337 in the 11/188,298 US application
MGHDEAVVTQNSVKAPSPPKDQPAIYPCLDWSTMQAYYGQGVLPPAFFNPGIAPGHVPPPYVWCPQNMPPAAFGKPYAAIYPHAGGFLHPFMPLMVNPLSAEPAKSANSKDNSLNKKLKEIDGTAVSSGNSEKTSGDYSLEGSSDGNNPKVSGTPKKRSFDDRTTSETCGVSATNDKPGESGRLATLPNVHIPDATMKPSVSTGSDFKVSGATSTEWPAKDDKESKRERRKQSNRESARRSRLRKQAETEELARKVELLTAENTSLRNEISKLTDSSQKLRMENAALMEKLAGGTSDQAQEASAGHQTTATAPPPSARVVKNFLSMMDVEGPSRGGGSRRTEHGAPRLRQLLSSGGPLAADAVAAS

SEQ ID NO: 5291 - DNA, 951 bp, Sorghum bicolor
  misc_feature: Ceres ANNOT ID no. 6042514
  misc_feature: Encodes the peptide sequence at SEQ ID NO 5292
atgagcatgggccattgctccgagcagcggacggggttcgaggtcaccaaggactggaacggcgccgaccaggtcgcgatccggtccccgcggggggcttccgtccgggtctgcctgcacggcgggcaggtcgtctcgtggaggaaccaccgcggcgaggagctcctcttcagcagtagcaaggcaatcttcaagccgcccaaagcgacgcgtggtggcattccaatatgcttcccccagtttggaaactgtggaacactggagcaacatggatttgcaaggaacaagatatggacaatagatgatgaggctccaccactaaattctggtgataacaacaacaacaaagcttctgttgaccttctgctaaagccatctgaagatgacctgaagtgctggccacactgtttcgagttacgtctcagagtttctctttcaatggatggagacctttcactgatatcacgggttaggaatgttaacgggaagccattcagttttgcatttgcttatcatacacacctttctgtttctgacatcagtgaagtgaggatagaaggtctggagacccttgattatcttgacaaccttagccagcgggaacgttttactgaacagggagatgctataacatttgaatcagaggttgatcgagtctatgttggctgcccaggcgtaatagctgttcttgaccatgaaaagaaacgcacattcatcatccgaaaagaaggccttcctgatattgttgtgtggaacccctgggaaaagaagtccaagacgatgacagacttcggcgacgacgagtacaagcagatgctgtgcgtggatgcggccgcggtcgagaggaccatcacgctgaagcccggcgaggagtggacggggaagctggagctctccgccgtggcgtcgaccaactgcagcgaccacctggatcacccgggcaggctgtag

SEQ ID NO: 5292 - protein, 316 aa, Sorghum bicolor
  misc_feature: Ceres ANNOT ID no. 6042514
  misc_feature (23)..(299): Pfam Id: Aldose_epim Pfam Desc: Aldose 1-epimerase
  misc_feature (1)..(313): NCBI GI: 115438971 NCBI Desc: os01g0658700 [oryza sativa (japonica cultivar-group)]
  misc_feature (3)..(310): NCBI GI: 144922979 NCBI Desc: galactose mutarotase-like [medicago truncatula]
  misc_feature (11)..(316): NCBI GI: 124360080 NCBI Desc: galactose mutarotase-like [medicago truncatula]
  misc_feature (9)..(316): NCBI GI: 38344152 NCBI Desc: osjnba0041a02.19 [oryza sativa (japonica cultivar-group)]
  misc_feature (9)..(316): NCBI GI: 116309662 NCBI Desc: osigba0118p15.1 [oryza sativa (indica cultivar-group)]
MSMGHCSEQRTGFEVTKDWNGADQVAIRSPRGASVRVCLHGGQVVSWRNHRGEELLFSSSKAIFKPPKATRGGIPICFPQFGNCGTLEQHGFARNKIWTIDDEAPPLNSGDNNNNKASVDLLLKPSEDDLKCWPHCFELRLRVSLSMDGDLSLISRVRNVNGKPFSFAFAYHTHLSVSDISEVRIEGLETLDYLDNLSQRERFTEQGDAITFESEVDRVYVGCPGVIAVLDHEKKRTFIIRKEGLPDIVVWNPWEKKSKTMTDFGDDEYKQMLCVDAAAVERTITLKPGEEWTGKLELSAVASTNCSDHLDHPGRL

SEQ ID NO: 5293 - DNA, 534 bp, Sorghum bicolor
  misc_feature: Ceres ANNOT ID no. 6042517
  misc_feature: Encodes the peptide sequence at SEQ ID NO 5294
atgcagaggctgggggatttcaggctccctcccttctttaactacccgccttacttcactttgcagcctgtgcgtgaaacgcgggaaaagcaagtgcagttatggaaagatctgatactcgattactgtagaagtcagaagatacatacaatatccctggaagaagatttccccttgttctccaatccaaagatagagagatctcttagccatgaagcaaaggaagtgttccttgcagctctcgtcagtgaaggtcgtgcagagtggatggacaaaggtcacaagaagtgcctaattctttggctaaggattcaggattgggccaatttcatattaaactttgtaaaggataacgggttggaagtaatgactatcgaagaaatacgatctggaattgatacacgtggaactgaacttgagggaattgatcgtggtgttctcatgcgggctctgcggcagttggagcaaaagggaaaagcagctatcttcaaaggcacctcggccgatgatgaaggtgtaaaattttcggtgtaa

SEQ ID NO: 5294 - protein, 177 aa, Sorghum bicolor
  misc_feature: Ceres ANNOT ID no. 6042517
  misc_feature (7)..(176): Pfam Id: ESCRT-II Pfam Desc: ESCRT-II complex subunit
  misc_feature (7)..(175): NCBI GI: 50927462 NCBI Desc: mgc86224 protein [xenopus laevis]
  misc_feature (7)..(175): NCBI GI: 62859513 NCBI Desc: loc548832 [xenopus tropicalis]
  misc_feature (7)..(175): NCBI GI: 45709514 NCBI Desc: loc407684 protein [danio rerio]
  misc_feature (7)..(175): NCBI GI: 73920458 NCBI Desc: vacuolar protein sorting protein 25
  misc_feature (7)..(175): NCBI GI: 73920461 NCBI Desc: vacuolar protein sorting protein 25 (ell-associated protein of 20 kda)
MQRLGDFRLPPFFNYPPYFTLQPVRETREKQVQLWKDLILDYCRSQKIHTISLEEDFPLFSNPKIERSLSHEAKEVFLAALVSEGRAEWMDKGHKKCLILWLRIQDWANFILNFVKDNGLEVMTIEEIRSGIDTRGTELEGIDRGVLMRALRQLEQKGKAAIFKGTSADDEGVKFSV

SEQ ID NO: 5295 - DNA, 1944 bp, Sorghum bicolor
  misc_feature: Ceres ANNOT ID no. 6042557
  misc_feature: Encodes the peptide sequence at SEQ ID NO 5296
atgcctctcgcggcggctgccgcggccgttgccgcctgtccttccccgatcggcctcacccgccctttgtgccgtatcgaggcgcatccgcggcgccggcggaggttccggtcggaggcaagctcatcggcgtccgctcccgcgccggccgcggtggatgagggaggcggagcggggccgtgccccgtggtcaggttcgacatggctgatttcaccgtcgccgaccgcgtcaacgtcgggctccatggacggtcggatgagatgatcttcgaggccacggtgtgcgatccgagcagcgagctgtatgggtcaacggtggtgctgcggcagctgaagagtttgcaggcgaagcgcagggggcgtcgcgctctcgaggtgctgaagaagctggctcgtcgccaaatgatgtaccactcctacgcacttcaggtccatggttacattgctccgtgcaatgccgtggaggaggaagatgtcccgttagtattggttcatgggtatcatgggagtcattccctgcgtcactggttgcaactctcagattggctcccaaccttagaagcaacattagcattggacgaagaacaagtcaggagggtaggagatgactctgttggaggaccagctgtaacccggcagctgcgtctaatcaggatattgatgagagaccttttgattggtgtaaattatctacatagccatgggctggcacatactgagcttagattagagaacgttcacgtgagcccaatagacaagcatgttaaagtcggtattcttggaaatgctgctgattttcatgacaatgatcctagcagtagtacaacagcaattaacaatgacaggcggaaaatgatgatagcctttgatatgagatgtgttggcttcatcatggcaaagatggttttgagagagctaatggattcttcaactttctttaaattcaaatcattcctgacaaagggaaatgacccatcctgtttgcgtgagttcctattaccaactctctgccaaaattctacatctgggaatattggtttacagatgctagataggcagtggggtgctggttggaatcttttagccttattgctggcaacaaaaccggaggaaaggataagttgtgttgatgcattgcggcacccattcctttgtgggccaaaatggcgtataaatccatcagcaaatctcatacgttggagcttgggatcaactgctgtccgcatggctgaagattatatctatggacatcatcagcgtagacgcttagcatattttgttgaattgatggaggttctaaaccctaacttaagaacacagaattggattcacctcctacctggtcgttggcgtctcttgtactgcactggaagacacattggcctaacacttcgccagccttcccctagagtcctcatcagtgatgtgtaccttacagttagttcagagtcagtcgatccagtcttctctctgacctctgatactggtttcagaattatgccagaatctaattggcctcacgacaaatctggcactgaaggacttctgtttgtcaccacatcagcaaggatagctgctgggaggatttatattaaggaacaggacagtgaagagagtagggtcacatcttctagatcttctaggagatatcttcatggtaaatggggaaaagtttcacaaatgaaggagctgccatctagtctcccaactgtaagcattgctgctatggatgaaatcgacgtatcgatgagctgcgactcgagtttgaatgtcaattctgcacaaaacgtactgcaagagatccgtacacagaccccaccggaaatgttcgatttgacaaagattgtttgtgggacatacattgatgcgagactgatgattcttcgtggtgttaacgggtcggctctgctcttcactagagcaaatccaacgagtgacccctga

SEQ ID NO: 5296 - protein, 647 aa, Sorghum bicolor
  misc_feature: Ceres ANNOT ID no. 6042557
  misc_feature (91)..(384): Pfam Id: Pkinase Pfam Desc: Protein kinase domain
  misc_feature (63)..(646): NCBI GI: 92871973 NCBI Desc: proteinase inhibitor i4, serpin; protein kinase [medicago truncatula]
  misc_feature (289)..(384): NCBI GI: 62901028 NCBI Desc: serine/threonine-protein kinase stt7, chloroplast precursor
  misc_feature (289)..(383): NCBI GI: 145343649 NCBI Desc: chloroplast thylakoid protein kinase stn7, probable [ostreococcus lucimarinus cce9901]
MPLAAAAAAVAACPSPIGLTRPLCRIEAHPRRRRRFRSEASSSASAPAPAAVDEGGGAGPCPVVRFDMADFTVADRVNVGLHGRSDEMIFEATVCDPSSELYGSTVVLRQLKSLQAKRRGRRALEVLKKLARRQMMYHSYALQVHGYIAPCNAVEEEDVPLVLVHGYHGSHSLRHWLQLSDWLPTLEATLALDEEQVRRVGDDSVGGPAVTRQLRLIRILMRDLLIGVNYLHSHGLAHTELRLENVHVSPIDKHVKVGILGNAADFHDNDPSSSTTAINNDRRKMMIAFDMRCVGFIMAKMVLRELMDSSTFFKFKSFLTKGNDPSCLREFLLPTLCQNSTSGNIGLQMLDRQWGAGWNLLALLLATKPEERISCVDALRHPFLCGPKWRINPSANLIRWSLGSTAVRMAEDYIYGHHQRRRLAYFVELMEVLNPNLRTQNWIHLLPGRWRLLYCTGRHIGLTLRQPSPRVLISDVYLTVSSESVDPVFSLTSDTGFRIMPESNWPHDKSGTEGLLFVTTSARIAAGRIYIKEQDSEESRVTSSRSSRRYLHGKWGKVSQMKELPSSLPTVSIAAMDEIDVSMSCDSSLNVNSAQNVLQEIRTQTPPEMFDLTKIVCGTYIDARLMILRGVNGSALLFTRANPTSDP

SEQ ID NO: 5297 - DNA, 1239 bp, Sorghum bicolor
  misc_feature: Ceres ANNOT ID no. 6042563
  misc_feature: Encodes the peptide sequence at SEQ ID NO 5298
atggcgttcgagaagatcaaggtctccaaccccatcgtcgagatggacggtgatgagatgaccagggtattctggcagtctatcaaggacaagcttatttttccatttcttgatctggacatcaagtactatgatttggggatactgcatcgggatgcaactgatgacaaggtcacagtggaggctgcagaggctactctcaagtacaatgtggctattaagtgtgcgaccatcactccagatgaaactcgggttaaggagttcaacctgaagcacatgtggaagagcccaaatggcacaattaggaacattataaacggcactgtgttcagagagccgattatatgcaaaaatgtgccaaggcttgttccaggatggactaagcccatctgcattggaaggcatgccttcggtgatcagtaccgtgctactgatgcagttctgaaggggcctgggaagctgaagctagtttttgagggaaaagaagaacagattgatctggaggtgttcaacttcactggtgctggaggagttgccttgtctatgtacaacactgatgagtcaattcgagcttttgccgaggcttctatgacaactgcttatgagaagaaatggccactctaccttagcaccaaaaacacaatcctgaaaaaatacgatggcaggtttaaggacattttccaggaggtctatgaagctggctggaaatcaaaatttgaggctgctggaatatggtatgagcatcgtcttattgatgacatggttgcgtatgcgcttaagagtgaaggaggctatgtgtgggcttgcaagaattacgatggagatgtgcagagtgatttcttagctcaaggttttggctctttgggtttgatgacatcagtgttggtgtgccctgatggaaaaaccattgaagctgaagctgcccacggcacagttacccgtcatttccgtgttcaccagaaaggaggtgaaaccagtacgaacagcattgcttcaatctttgcatggacaagaggacttgcacacagggcaaagctggatgacaatgctaggctactcgacttcgctctcaaactcgaggctgcttgcgtcggaactgtggagtctgggaagatgactaaagatcttgcacttcttgttcatgggtccgccagcgtcacaagaagccattacctgaacactgaagagttcatcgatgcagttgctactgagctccgatcaagattgggagccaattga

SEQ ID NO: 5298 - protein, 412 aa, Sorghum bicolor
  misc_feature: Ceres ANNOT ID no. 6042563
  misc_feature (7)..(401): Pfam Id: Iso_dh Pfam Desc: Isocitrate/isopropylmalate dehydrogenase
  misc_feature (1)..(412): NCBI GI: 5007084 NCBI Desc: nadp-specific isocitrate dehydrogenase [oryza sativa]
  misc_feature (1)..(412): NCBI GI: 5007086 NCBI Desc: nadp-specific isocitrate dehydrogenase [oryza sativa]
  misc_feature (1)..(412): NCBI GI: 2623962 NCBI Desc: isocitrate dehydrogenase (nadp+) [apium graveolens]
  misc_feature (1)..(412): NCBI GI: 3811007 NCBI Desc: nadp specific isocitrate dehydrogenase [daucus carota]
  misc_feature (1)..(409): NCBI GI: 15982950 NCBI Desc: nadp-dependent isocitrate dehydrogenase [prunus persica]
  misc_feature (2)..(411): SWISSPROT Homolog: EC 1.1.1.42 Isocitrate dehydrogenase [NADP]
  misc_feature: The sequence is a functional homolog of SEQ ID NO. 301 in the 11/188,298 US application
  misc_feature: The sequence is a functional homolog of SEQ ID NO. 317 in the 11/188,298 US application
MAFEKIKVSNPIVEMDGDEMTRVFWQSIKDKLIFPFLDLDIKYYDLGILHRDATDDKVTVEAAEATLKYNVAIKCATITPDETRVKEFNLKHMWKSPNGTIRNIINGTVFREPIICKNVPRLVPGWTKPICIGRHAFGDQYRATDAVLKGPGKLKLVFEGKEEQIDLEVFNFTGAGGVALSMYNTDESIRAFAEASMTTAYEKKWPLYLSTKNTILKKYDGRFKDIFQEVYEAGWKSKFEAAGIWYEHRLIDDMVAYALKSEGGYVWACKNYDGDVQSDFLAQGFGSLGLMTSVLVCPDGKTIEAEAAHGTVTRHFRVHQKGGETSTNSIASIFAWTRGLAHRAKLDDNARLLDFALKLEAACVGTVESGKMTKDLALLVHGSASVTRSHYLNTEEFIDAVATELRSRLGAN

SEQ ID NO: 5299 - DNA, 2379 bp, Sorghum bicolor
  misc_feature: Ceres ANNOT ID no. 6042566
  misc_feature: Encodes the peptide sequence at SEQ ID NO 5300
atggccgcctccgcctccgcctccccgccgcgccaccgccacagccaccgcgatgaagtctccccgcgccgccgcaagcgccgcgcgtccccgtctccgtccccaccccgctcaccatctcccggcgtcgacgcggaccgccgtcgcagatctagggcttcgccgcccgattccgaccaccgcggccgccgccgcgacgccaagccctcggaggagaagaacggccacgccaagcccggaagggatgaggacggcgacaaccaccctccccggcgcgacagggtttcagatggggaggatggtttccaacgccggaggatgcgcgatagggtttccggcgatgagaaggaggaaggccgtcggcacaggcgtgctagggatgcggatgacgcgcctgactaccgccgtggcaagcgagaccgggagagggacagccggtgccaccgccgccggagccctagctcggagtcagggtcctcacccgacgaccgtcgacaccgccgccggcgccgagacgagggctccaggcggcgggatgaccgcaggcgaagggaggacgacggagacgagcgccggagaagccctgtgaagagggagccgaccccgccactgcctccaccaccaccactgcttccggagatgatccctggccgcacaggtgggatctacattccgcctttccgcatggcgcagatgatgcgtgatgtagaggacaagtcgagcccagagtatcagcgcctcacctgggatgctctcaagaagagcatcaatgggttggtgaataaggtgaatgcgaccaatatcaagaatatagtgccggagctcttcgcagagaaccttgttcgtgggcgggggctcttctgtcagtcttgcatcaagtcacagatggcctcacctgggttcaccgatgtatttgctgcgctagttgcggttgtgaataccaagttccctgagattgggcggttgcttcttgttcgtgttgtgctccagctcaagagggcatataagcgaaatgacaagcctcaattgcttgcggcaaccaaattcattgcgcacttggtaaatcaggtggtggcacatgagcttgtggcgctggagcttcttactgtactcctggaaaatccaactgatgatagtgttgaggtcgctgtggggtttgtcaaagagtgtggggcaatgctgcaggacttgtctcctcaagggcttcatgctatttttgaaagatttcgaggcattctacatgaaggagaaatagacaagagagtgcagtttcttattgaaggcctttttgcaattagaaaggctaaattccagggtttcccagccatccgtccagagctggatctagtggagcaggaggaccagtttacacatgagatatcccttgaagatgacctagaccctgagaccaatctaaatgttttcagggcaaaccccaattttgttgaagatgagaaggcatatgagaatctaaagagaagcatcctgggagcagagtcttctgaagatgaagaaggatcagatgctgcttctgatgatgatgaagatgaggaagaatccgatgaagaggatgaggaacaaatggagataagggatagaacagagacgaatcttgtgaaccttagaagaacaatatatttgactattatgtccagtgttgattttgaagaagctgggcacaagcttatgaaaattaagcttgagcctggtcaagagatggagctgtgcattatgcttcttgagtgttgcagtcaggagagaacatatcttcgttattatgggctgctaggacagcgattttgcatgatcaataaagtgtaccaagagaactttgaaaaatgctttgtgcaacaatattcgatgattcatcgtcttgaaacaaacaagttgaggaatgttgccaagttctttgcacatttgttggggactgatgcgctcccttggcatgttttggcttacatcaggttgacagaggaagacacgacatcatcttctcgaatttttataaaaattctattccaagaattatcggagcacctgggcatacgcctactcaatgagaggctgaatgatcctaacatgcaaggttccttcgaatctatcttcccaaaggatcatccaaagaatacaaggttctcaatcaatttcttcacgtccattggtcttggtggtataacggaaagcctgagggagtacttgaagaacatgccgcgcctaataatgcagcagcagaagccggaatcatcgcagtcagaatcaggtggatctgaatctggttcagaatgctctagctcagggtctagttctgagtctgagtcagaatcaagctctgatgagagtgacaggaggcggagtaagaagaggaggaagaggacttga

SEQ ID NO: 5300 - protein, 792 aa, Sorghum bicolor
  misc_feature: Ceres ANNOT ID no. 6042566
  misc_feature (253)..(436): Pfam Id: MIF4G Pfam Desc: MIF4G domain
  misc_feature (541)..(647): Pfam Id: MA3 Pfam Desc: MA3 domain
  misc_feature (43)..(790): NCBI GI: 22654971 NCBI Desc: at1g80930/f23a5_23 [arabidopsis thaliana]
  misc_feature (82)..(790): NCBI GI: 108884014 NCBI Desc: cell cycle control protein cwf22 [aedes aegypti]
  misc_feature (93)..(791): NCBI GI: 116123363 NCBI Desc: ensangp00000007281 [anopheles gambiae str. pest]
  misc_feature (107)..(792): NCBI GI: 123233660 NCBI Desc: novel protein [mus musculus]
  misc_feature (112)..(792): NCBI GI: 123233657 NCBI Desc: novel protein [mus musculus]
MAASASASPPRHRHSHRDEVSPRRRKRRASPSPSPPRSPSPGVDADRRRRSRASPPDSDHRGRRRDAKPSEEKNGHAKPGRDEDGDNHPPRRDRVSDGEDGFQRRRMRDRVSGDEKEEGRRHRRARDADDAPDYRRGKRDRERDSRCHRRRSPSSESGSSPDDRRHRRRRRDEGSRRRDDRRRREDDGDERRRSPVKREPTPPLPPPPPLLPEMIPGRTGGIYIPPFRMAQMMRDVEDKSSPEYQRLTWDALKKSINGLVNKVNATNIKNIVPELFAENLVRGRGLFCQSCIKSQMASPGFTDVFAALVAVVNTKFPEIGRLLLVRVVLQLKRAYKRNDKPQLLAATKFIAHLVNQVVAHELVALELLTVLLENPTDDSVEVAVGFVKECGAMLQDLSPQGLHAIFERFRGILHEGEIDKRVQFLIEGLFAIRKAKFQGFPAIRPELDLVEQEDQFTHEISLEDDLDPETNLNVFRANPNFVEDEKAYENLKRSILGAESSEDEEGSDAASDDDEDEEESDEEDEEQMEIRDRTETNLVNLRRTIYLTIMSSVDFEEAGHKLMKIKLEPGQEMELCIMLLECCSQERTYLRYYGLLGQRFCMINKVYQENFEKCFVQQYSMIHRLETNKLRNVAKFFAHLLGTDALPWHVLAYIRLTEEDTTSSSRIFIKILFQELSEHLGIRLLNERLNDPNMQGSFESIFPKDHPKNTRFSINFFTSIGLGGITESLREYLKNMPRLIMQQQKPESSQSESGGSESGSECSSSGSSSESESESSSDESDRRRSKKRRKRT

SEQ ID NO: 5301 - DNA, 1809 bp, Sorghum bicolor
  misc_feature: Ceres ANNOT ID no. 6042570
  misc_feature: Encodes the peptide sequence at SEQ ID NO 5302
atgaagtacgtgctggtgaccggaggggtggtgagcggcctcggcaagggcgtgacggccagcagcatcggcgtcgtgctcaaggcctgcggcctccgcgtcaccaccatcaagattgatccatacctcaacactgatgctggaaccatgtctccattcgagcatggggaggtgtttgttttggacgatggtggagaggtggacttggaccttggaaactacgagcgttttctggatatcaaattgacccgtgacaacaatataaccacaggaaagatctatcaggctgtcattaacaaagaaaggagaggtgactacctaggaaaaaccgtccaggttgtgccacatattacagatgaaatacaagattggattgaacgtgttgcaatggttccagtcgacggcaaagaaggacctcctgatgtttgtgtcattgaacttgggggcactataggggatattgagtccatgcctttcattgaagcattaggtcaattttcataccgtgttggacctggaaacttctgtctcgttcatgtcagtcttgttccagttctaaatgtagtcggtgaacagaaaactaagcctacacagcatagtgttcgagggcttagaggacttgggctggcaccggatattttagcatgtcgcagtaccgagccattggaggaacatgtgaaggtcaagctttcacaattttgtcatgttccgatctcaaatatagtgaacctccatgacgtgacaaacatttggcacatccccttgttgctaagggaccagaaggcccatgaagctattctgaaagttttagagcttcagtatgatggaaaagtacctcgggaacctgagttagcgaagtggactaaaagagccactaagttcgacaaattgaagactccggtcaagattgccatggttggaaaatacactggcctgtcggattcctacctgtctgtcataaaggctcttttgcatgcatcagttgctatggaaagaaaacttgtagtcgagtgggttccttcctgcgatcttgaagattcttcagctaaagagacccctgaagcccataaaaaagcatggaaattgctgaagggtgcagatggtgtactcgttcctggaggatttggagataggggagtccagggcaaaattcttgccgcaaaatatgcacgtgaaaacaatgttccttatctcggcatttgcttgggaatgcaaattgcagtgattgagtttgcccgttcggttatgaaactacgaggtgccaatagcacggaattcgatccagctacaacatcaccctgtgtcattttcatgccagagggctcaaaaacccaaatgggagcgacaatgaggcttggatcgaggagaacctatttccatgtcaatggatgcaaatctgcaaagctgtatggcaatgccagctctgtagatgaaagacaccgccacagatacgaggtgaaccctgatatggtcccggactttgagagggccgggcttcaatttgtgggcaaagatgaaagtggaaaacgcatggggataattgagcttccctctcacaagttcttcatcggtgcacaattccatcctgaattcaagtcgagaccaggaaagccatctccgcttttcttagggctgatagccgcggcatctggacagctagaacctttgcttcaacgcagcaatctgacaacaaaagcatgtcctatcagtaaaatcccgaaactgaaattatacccaactggacctgtgaatccattgaacagcttggtaaatgggtactacccaaatggcactggcattcacacctag

SEQ ID NO: 5302 - protein, 602 aa, Sorghum bicolor
  misc_feature: Ceres ANNOT ID no. 6042570
  misc_feature (1)..(287): Pfam Id: CTP_synth_N Pfam Desc: CTP synthase N-terminus
  misc_feature (311)..(548): Pfam Id: GATase Pfam Desc: Glutamine amidotransferase class-I
  misc_feature (1)..(601): NCBI GI: 115438602 NCBI Desc: os01g0616900 [oryza sativa (japonica cultivar-group)]
  misc_feature (1)..(601): NCBI GI: 124360185 NCBI Desc: glutamine amidotransferase, class i, active site [medicago truncatula]
  misc_feature (301)..(602): NCBI GI: 4926827 NCBI Desc: t17h7.12 [arabidopsis thaliana]
  misc_feature (1)..(544): NCBI GI: 7268827 NCBI Desc: ctp synthase like protein [arabidopsis thaliana]
  misc_feature (1)..(554): NCBI GI: 92877256 NCBI Desc: ctp synthase [medicago truncatula]
  misc_feature (1)..(559): SWISSPROT Homolog: EC 6.3.4.2 CTP synthase 1
MKYVLVTGGVVSGLGKGVTASSIGVVLKACGLRVTTIKIDPYLNTDAGTMSPFEHGEVFVLDDGGEVDLDLGNYERFLDIKLTRDNNITTGKIYQAVINKERRGDYLGKTVQVVPHITDEIQDWIERVAMVPVDGKEGPPDVCVIELGGTIGDIESMPFIEALGQFSYRVGPGNFCLVHVSLVPVLNVVGEQKTKPTQHSVRGLRGLGLAPDILACRSTEPLEEHVKVKLSQFCHVPISNIVNLHDVTNIWHIPLLLRDQKAHEAILKVLELQYDGKVPREPELAKWTKRATKFDKLKTPVKIAMVGKYTGLSDSYLSVIKALLHASVAMERKLVVEWVPSCDLEDSSAKETPEAHKKAWKLLKGADGVLVPGGFGDRGVQGKILAAKYARENNVPYLGICLGMQIAVIEFARSVMKLRGANSTEFDPATTSPCVIFMPEGSKTQMGATMRLGSRRTYFHVNGCKSAKLYGNASSVDERHRHRYEVNPDMVPDFERAGLQFVGKDESGKRMGIIELPSHKFFIGAQFHPEFKSRPGKPSPLFLGLIAAASGQLEPLLQRSNLTTKACPISKIPKLKLYPTGPVNPLNSLVNGYYPNGTGIHT

SEQ ID NO: 5303 - DNA, 4098 bp, Sorghum bicolor
  misc_feature: Ceres ANNOT ID no. 6042581
  misc_feature: Encodes the peptide sequence at SEQ ID NO 5304
  misc_feature: Down-regulated in shoot tissues in response to aminocyclopropane carboxylic treatment
  misc_feature: Up-regulated in shoot tissues in response to methyl jasmonate treatment
  misc_feature: Up-regulated in root tissues in response to methyl jasmonate treatment
  misc_feature: Down-regulated in shoot tissues in response to salicylic acid treatment
atgctccgcctgcgggcgttccggccgacgagcgacaaggtcgtgaagatccagctccaccccactcacccctggctcgtcaccgccgacgccaacgaccgcgtctccgtctgggactgggagcaccgccaggtgatctatgagctgaaggcaggtggcgttgatgagcgtcgcttggttggagcgaagcttgagaaactcgctgagggagatgattcaaagggaaagcccaccgaggtttccttttatgatgatgatgttcgcttttggcaacattggcgcaattgctctgctgctgctgaggccccaactgcagtcaatcagcaatcttccacgttcagtgcacctgcaccctcaacacgaggaaggcactttgttgtcatttgttgtgagaacaaagtcatatttttagatttggtgactatgcggggccgtgatgttcctaaacaggagcttgataataggtcacttctttgtatggagttcctctctaggtcatcttctagcgatgctcctcttgtggcctttgggtcatctgatggtgtcatcagggttctttcgatgttgacatggaagcttgtgcggaggtatacgggtggacataaaggagcaatagcctgcttaatgacgtacatgtctgcagctggtgaggtacatttagtttctggtggcagcgatggcctgctgatattatggagcgctgatcatatccatgactcacgtgagcttgtgcctaaaattagtatgaaggcccatgatggaggtgtagttgcagttgaactttcaagggtgatggggagtgctccacagctcattacaataggggctgataaaactttagccatatgggatactgttactttcaaggaaataaggcgcattaaaccagtgcctaaacttgcttgtcatagtgttgcatcgtggtgtcatccccgtgcaccaaaccttgatattctaacttgtgtcaaggactcccatatttgggccatagagcacccaacttattctgctttaacaagaccgctctgcgaattgtcatcactagttcctccacaggttcttgcacagcataagaaactgagggtttattgcatggtggcacaccccttgcagccacatcttgttgctactggaactaatattggtatcatattaagcgagtttgatccaagagcacttccagctattgctcctttaccaacaccaacaggcaacaaggaacattctgctgtttacatagttgaaagagaacttaagttactgaatttccaattgtcaaacacagcgaatccatcccttgggaatgctggtgttgcatctgatgcaggaagatcaaggaatgattcaatagaacagttgatagtaaagcagaccaagaagcatatcagtactcctgctccccacgattcctattcggtcctttccgttagcagttctgggaagtatgttgcaattgtatggccagatatcccttcttttgctgtatacaaagcaagtgattggtcagttgttgattcaggcacagggaagctttttgcctgggacacctgtcgagacagatatgctttagtagagagtgcattggccccaagaatgccacttgttgtgaaaggtggttcttctaaaaaggcaaaagaagcagcagcagctgcagctcaagcagcagctgcggcagctagtgctgcttctgccgccacagtgcaagtgcgtatcttattagatgatggaacagcacatgttttgcagagatcgattgatggtcgtagtgaaccggttattggactgcatggtggtgctttacttggcgtcacataccgcacatctcgtagaatcagtcctttgacagcaacagctatatcaactgttcaatcgatgcccttatcaggttttggtggaagtggatcatcttttgcatctgatgatccattttcctctaaggaagggcctccacaaaatttccaactgtacagctgggagacctatcagcctgtaagcggcctgcttgcacaacctgagtggaccgtgtgggaccaaactgttgagtattgcgcatttgcttatcagcagtatatagtaatttcttccttgcggccccaatttaggtaccttggcgatgtctcaattccctttgcaactggtgccgtttggcatagaaggcagttatttgtggctacaccaacaacaattgagtgtgtctttgttgatgctggagtagcagctattgacattgaaacaaaaaggagaaaagaagaaatgaaagcaagagaagctcagagtcgggcagttgaagagcatggagatttggctcttattactgttgaagctccccaggttactgtgagtgaaaaagtatcattgaggccaccaatgttgcaggttgttcgtttagcctcctttcagcactctccatcgataccaccatttatagtgccaaagcaatccaagttcgatggagatgattcagtgtttcagaaagaactagatgacagaagatatgctgaagttgctgttgctggaggaggggtgtctgttgcagtaactcgcttccctcctgaacagaagagacctattggacctcttgttgtggttggtgtaagagatggagttctctggcttgttgacaggtatatgtgtgcacatgccttgtcactcagccatcctggtataagatgtcgttgccttgcagcatatggggaccctggcaacgagactggccgagagcatcacgatgacctggctcagtttatgctgggtatgggctatgccactgaagctcttcatttgcctggaatatctaagagactggagtttgaccttgcaatgcagagcaatgacctgaaaagagcacttgcttgtctattgacaatgagcaatagccgagatgtgggacaagaaacagctgctgctgatgccactgacgttacacagattcttaatttggcggtagctaagcaagctaagcaggaaagtcttgcagatgccgtgcagggaatagtgaaatttgtcaaggagttttttgaccttatcgatgcagcagatgccactgggcaatctgacattgctcgtgaagttttaaagagattagcggctgcagcttctgtaaagggtgccctccatggacagatgctacgaggcctggcacttcgtcttgcaaaccatggggagcttactagattgtcgggtttggtaagcaatttgatcacagctggccatggacgcgaagcagcatttgctgctgcagttctgggagataatgccctaatggagaaagcatggcaggacacaggaatgctggctgaagctgttttacatgctcaagcccatggtcgtccatcattaaggaacttggttataacatggaacaagatgctacagaaggaactggatcacacaccaactgtaaaaaccgatgccgccgcagcattcttggcttctcttgaggatccaaagctcacaagcttgggggaaactgagaaaaagcctcccattgaaatacttcctcctgggatgcctcctctatctgcacctccaatcgtgattaaaaaggctggagcaaaacctggcctccctaatgcagcaaaggcctcaaatggccctataggtgctccgatggttcaaggtgctcccatggctcaaggtactcctggggcacaaggggtccccatgaaccaagttactccatcacagggcagcgacgaggcaaagccatcagatgctacagtggcagatgcagctgccgcgacttcagaaggcactgcagctcccccagctgcagaaggtacagcagctcccagcagtgaggaacctaacgcagcagcacctggcaatgaggaaggcacagcacatccagtcaacgaggaagccacagcagctggagttccagatgcagcaggcagccctgatgtgcctgctccggctgctcctgctcctgctcctgctactgtagctgtagctgataccagtagctcggatgcacctgctgttactcccagtgaagttaccgtctccgccccctcaaccgaggcacctgagttgacggataagccatcttcaacagaggcatcgttgccacctccacccactgtttctggtgtataa

SEQ ID NO: 5304 - protein, 1365 aa, Sorghum bicolor
  misc_feature: Ceres ANNOT ID no. 6042581
  misc_feature (1)..(1365): NCBI GI: 55296497 NCBI Desc: wd-40 repeat family protein-like [oryza sativa (japonica cultivar-group)]
  misc_feature (138)..(1060): NCBI GI: 87240986 NCBI Desc: peptidase s8 and s53, subtilisin, kexin, sedolisin; wd40-like [medicago truncatula]
  misc_feature (464)..(876): NCBI GI: 71386145 NCBI Desc: wd-40 repeat family protein [medicago sativa]
  misc_feature (1)..(71): NCBI GI: 124359442 NCBI Desc: wd40-like [medicago truncatula]
  misc_feature (1110)..(1360): NCBI GI: 78101807 NCBI Desc: tpa: troponin h isoform 1 [apis mellifera]
  misc_feature: Down-regulated in shoot tissues in response to aminocyclopropane carboxylic treatment
  misc_feature: Up-regulated in shoot tissues in response to methyl jasmonate treatment
  misc_feature: Up-regulated in root tissues in response to methyl jasmonate treatment
  misc_feature: Down-regulated in shoot tissues in response to salicylic acid treatment
MLRLRAFRPTSDKVVKIQLHPTHPWLVTADANDRVSVWDWEHRQVIYELKAGGVDERRLVGAKLEKLAEGDDSKGKPTEVSFYDDDVRFWQHWRNCSAAAEAPTAVNQQSSTFSAPAPSTRGRHFVVICCENKVIFLDLVTMRGRDVPKQELDNRSLLCMEFLSRSSSSDAPLVAFGSSDGVIRVLSMLTWKLVRRYTGGHKGAIACLMTYMSAAGEVHLVSGGSDGLLILWSADHIHDSRELVPKISMKAHDGGVVAVELSRVMGSAPQLITIGADKTLAIWDTVTFKEIRRIKPVPKLACHSVASWCHPRAPNLDILTCVKDSHIWAIEHPTYSALTRPLCELSSLVPPQVLAQHKKLRVYCMVAHPLQPHLVATGTNIGIILSEFDPRALPAIAPLPTPTGNKEHSAVYIVERELKLLNFQLSNTANPSLGNAGVASDAGRSRNDSIEQLIVKQTKKHISTPAPHDSYSVLSVSSSGKYVAIVWPDIPSFAVYKASDWSVVDSGTGKLFAWDTCRDRYALVESALAPRMPLVVKGGSSKKAKEAAAAAAQAAAAAASAASAATVQVRILLDDGTAHVLQRSIDGRSEPVIGLHGGALLGVTYRTSRRISPLTATAISTVQSMPLSGFGGSGSSFASDDPFSSKEGPPQNFQLYSWETYQPVSGLLAQPEWTVWDQTVEYCAFAYQQYIVISSLRPQFRYLGDVSIPFATGAVWHRRQLFVATPTTIECVFVDAGVAAIDIETKRRKEEMKAREAQSRAVEEHGDLALITVEAPQVTVSEKVSLRPPMLQVVRLASFQHSPSIPPFIVPKQSKFDGDDSVFQKELDDRRYAEVAVAGGGVSVAVTRFPPEQKRPIGPLVVVGVRDGVLWLVDRYMCAHALSLSHPGIRCRCLAAYGDPGNETGREHHDDLAQFMLGMGYATEALHLPGISKRLEFDLAMQSNDLKRALACLLTMSNSRDVGQETAAADATDVTQILNLAVAKQAKQESLADAVQGIVKFVKEFFDLIDAADATGQSDIAREVLKRLAAAASVKGALHGQMLRGLALRLANHGELTRLSGLVSNLITAGHGREAAFAAAVLGDNALMEKAWQDTGMLAEAVLHAQAHGRPSLRNLVITWNKMLQKELDHTPTVKTDAAAAFLASLEDPKLTSLGETEKKPPIEILPPGMPPLSAPPIVIKKAGAKPGLPNAAKASNGPIGAPMVQGAPMAQGTPGAQGVPMNQVTPSQGSDEAKPSDATVADAAAATSEGTAAPPAAEGTAAPSSEEPNAAAPGNEEGTAHPVNEEATAAGVPDAAGSPDVPAPAAPAPAPATVAVADTSSSDAPAVTPSEVTVSAPSTEAPELTDKPSSTEASLPPPPTVSGV

SEQ ID NO: 5305 - DNA, 261 bp, Sorghum bicolor
  misc_feature: Ceres ANNOT ID no. 6042582
  misc_feature: Encodes the peptide sequence at SEQ ID NO 5306
atgtcgacgagagggggcggcgaggcgaggcaggcgacggtgaagatcatcgagacggtgcacgtggaggtggaccggtatagcttcaagtcgatcgtccagaggctcacggggagggacgcgctggtcggcgactactcggaagggcccgagcgtagatcaaatgaagaggcgcctcagcgcgctgctgctgggtatatgagcaaccaagcgagcaagcccttcgctgatcgccactcaagcaaagacgagagctgttga

SEQ ID NO: 5306 - protein, 86 aa, Sorghum bicolor
  misc_feature: Ceres ANNOT ID no. 6042582
  misc_feature (15)..(45): Pfam Id: VQ Pfam Desc: VQ motif
MSTRGGGEARQATVKIIETVHVEVDRYSFKSIVQRLTGRDALVGDYSEGPERRSNEEAPQRAAAGYMSNQASKPFADRHSSKDESC

SEQ ID NO: 5307 - DNA, 1503 bp, Sorghum bicolor
  misc_feature: Ceres ANNOT ID no. 6042583
  misc_feature: Encodes the peptide sequence at SEQ ID NO 5308
atggccctgctcacctccccgtcgaggccaaggaagcagcgctgccccttccccgcgatgctctccctctcgccgtccctcctctccctcatcctgctcctccccttcctctccctcctcctcctcaaccgctcctccttcccgggctcctcttgctccccggccctggcgggggccgcttcgcgccggggaagcgcggccggcttccagggggacctgcgcgacatcgagttctcgtggaaccacctgccgttctcggcgtccaggccgccccccgccaagctcaagatcgccgtcttctcccggaagtggcccgtggcctcagcgcctggaggcatggagcgtcacgcgcacacgctgcacacggcgctggccgcgcgaggccaccgcgtgcacgtgttcacctccccgccgccgcacaccgaggcggcgccctcggcccccgccgacggtcctcagctccacttcctggacggcgagccggggcaatggcgctgcgacgaggcgtggaagctctacgaggccgagggcgagaacgaccccttcgacgtcatccactccgagagcgtcgccgtgttccaccgctgggcgctgggcgtggacaagctggtggtgtcgtggcacggcatctcgctggaggccctgcactcgggcatcttccaggacctcgcccgcggcgaggaggaggcccggtcgccggcgctgaaccagagccttggccagtccgtgtaccgcgtgctctccgaggtgcgcttcttccggagctacgcgcaccaggtggccatcagcgactccacgggggagatgctccgcgacgtgtaccagatcccgtcccgccgcgtgcacgtcatcctcaacggcgtggacgaggcgcagttcgagccggacacgccgctggggcgcgcgttccgggaggaggtcggggtgcccaagggcgccgacctggtgctgggcgtgtcggggcggctggtcaaggacaagggccacccgctgctgtacgaggcattctccaagctggtgctgcgccacccgaacgtgtacctgctcatcgccgggaaggggccgtgggagaaccggtacatggacctgggacgcaacgccaaggtgctcggcgccgtgccgccggggaagctcaaggcgttctacaacgcgctggacgtgttcgtggacccgacgctgcggccgcaggggctggacctgacgctcatggaggcgatgcagtgcgggaagccggtggtggcgacgcggttcccgagcatcaagggcagcatcgtggtggacgacgagttcgggtacatgttcgcgcccaacgtggagtcgctgctggagagcctggaggccgtggtggcggagggcgcccggcgcgccgcgcgccgcggacgcgcgtgccgggagtacgccaagtccatgttcgcggcaaccaagatggcgctcgcgtacgagaggctcttcctctgcgtcaagaacgacaccttctgcgggtacccagccgagttcgattga

SEQ ID NO: 5308 - protein, 500 aa, Sorghum bicolor
  misc_feature: Ceres ANNOT ID no. 6042583
  misc_feature (301)..(466): Pfam Id: Glycos_transf_1 Pfam Desc: Glycosyl transferases group 1
  misc_feature (1)..(500): NCBI GI: 55297089 NCBI Desc: glycosyl transferase family 1 protein-like [oryza sativa (japonica cultivar-group)]
  misc_feature (26)..(496): NCBI GI: 18415319 NCBI Desc: glycosyl transferase family 1 protein [arabidopsis thaliana]
  misc_feature (224)..(493): NCBI GI: 10177634 NCBI Desc: glycosyl transferase-like [arabidopsis thaliana]
  misc_feature (224)..(493): NCBI GI: 42568648 NCBI Desc: glycosyl transferase family 1 protein [arabidopsis thaliana]
  misc_feature (154)..(344): NCBI GI: 42408896 NCBI Desc: glycosyltransferase family-like protein [oryza sativa (japonica cultivar-group)]
MALLTSPSRPRKQRCPFPAMLSLSPSLLSLILLLPFLSLLLLNRSSFPGSSCSPALAGAASRRGSAAGFQGDLRDIEFSWNHLPFSASRPPPAKLKIAVFSRKWPVASAPGGMERHAHTLHTALAARGHRVHVFTSPPPHTEAAPSAPADGPQLHFLDGEPGQWRCDEAWKLYEAEGENDPFDVIHSESVAVFHRWALGVDKLVVSWHGISLEALHSGIFQDLARGEEEARSPALNQSLGQSVYRVLSEVRFFRSYAHQVAISDSTGEMLRDVYQIPSRRVHVILNGVDEAQFEPDTPLGRAFREEVGVPKGADLVLGVSGRLVKDKGHPLLYEAFSKLVLRHPNVYLLIAGKGPWENRYMDLGRNAKVLGAVPPGKLKAFYNALDVFVDPTLRPQGLDLTLMEAMQCGKPVVATRFPSIKGSIVVDDEFGYMFAPNVESLLESLEAVVAEGARRAARRGRACREYAKSMFAATKMALAYERLFLCVKNDTFCGYPAEFD

SEQ ID NO: 5309 - DNA, 1197 bp, Sorghum bicolor
  misc_feature: Ceres ANNOT ID no. 6042593
  misc_feature: Encodes the peptide sequence at SEQ ID NO 5310
atggcggccaagcagcggcagcggcagcggcagctgcgcctcctgcctctcctcgccgcggccgtcgcgtggtcgctgctgcgcgcgtgcggcaccgccgccgaggtcacgggcacgggcacgctcggcctccggcatagcaagcccgcgcggcagcacaacggcacgcggcacgggggagggaaccagcgtggccgtggccgtggcggcgccgcccccggcaccggcatggcgtcgtgcaacctgttccagggcagctgggtgtacgacgacacgctgccgatgtacgacacggcggggtgccccttcgtggagccggagttcgactgccagaagtacggccgccccgacaagctgtacctcaagtaccggtggcgcccgacctcctgcgacctcccgaggttcgacgggcaggagtttctgaggcggtggaaggggaagaagatactgttcgtgggggactccatcagcctgaaccagtgggagtcgcttgcgtgcatgctgcacgccgccgcgccggcgtccaaggtcgcctacgccaggggcaaccccgtctccagcgtcacgttccaggactacggggtgtcggtggcctactaccggagcacctacctcgtggacatcgtcgaggagtccgtcggccgggtgctcaagctcgactccatcaccggcgacgcctggctcggcgccgacgtcctcgtcttcaacacttggcactggtggacgcacaccggcagggaccaaccgtgggactacgtccaagacggagggcaggtgatgaaggacatggaccggctcacggccttctccaaggggatgtccacatgggccaggtgggtcgactccaacgtcgacacctccaggaccaaggtctacttccagggcatctcgccgacccactacaacggagccgactggggcgagggctcgcggagctgcgcgcagcagacgcagccggtggccgggtcggcgtaccccgccggccccgtcccggcgcagggcgcggtgcgggccgcgctgggcggcatgtccaagccggtgtacctgctcgacgtcacgctgctgtcgcagctcaggcgggacggccacccctccgcctacagcggcggccacccgggcaacgactgcagccactggtgcctcgccggcgtgcccgacacgtggaaccagatcctctacgcctcgctcctggcatag

SEQ ID NO: 5310 - protein, 398 aa, Sorghum bicolor
  misc_feature: Ceres ANNOT ID no. 6042593
  misc_feature (1)..(398): NCBI GI: 19571145 NCBI Desc: lustrin a-like [oryza sativa (japonica cultivar-group)]
  misc_feature (80)..(328): NCBI GI: 115468370 NCBI Desc: os06g0531400 [oryza sativa (japonica cultivar-group)]
  misc_feature (250)..(397): NCBI GI: 53791963 NCBI Desc: lustrin a-like [oryza sativa (japonica cultivar-group)]
  misc_feature (77)..(367): NCBI GI: 51091192 NCBI Desc: lustrin a-like [oryza sativa (japonica cultivar-group)]
  misc_feature (94)..(397): NCBI GI: 116310768 NCBI Desc: osigba0101p20.4 [oryza sativa (indica cultivar-group)]
MAAKQRQRQRQLRLLPLLAAAVAWSLLRACGTAAEVTGTGTLGLRHSKPARQHNGTRHGGGNQRGRGRGGAAPGTGMASCNLFQGSWVYDDTLPMYDTAGCPFVEPEFDCQKYGRPDKLYLKYRWRPTSCDLPRFDGQEFLRRWKGKKILFVGDSISLNQWESLACMLHAAAPASKVAYARGNPVSSVTFQDYGVSVAYYRSTYLVDIVEESVGRVLKLDSITGDAWLGADVLVFNTWHWWTHTGRDQPWDYVQDGGQVMKDMDRLTAFSKGMSTWARWVDSNVDTSRTKVYFQGISPTHYNGADWGEGSRSCAQQTQPVAGSAYPAGPVPAQGAVRAALGGMSKPVYLLDVTLLSQLRRDGHPSAYSGGHPGNDCSHWCLAGVPDTWNQILYASLLA

SEQ ID NO: 5311 - DNA, 1176 bp, Sorghum bicolor
  misc_feature: Ceres ANNOT ID no. 6042601
  misc_feature: Encodes the peptide sequence at SEQ ID NO 5312
atgaccctcatgagcctgctgcggctaccgggggaacattgctccttgtcgccggcgacgctggcggcgtggtggtctcttttgctcctggctgtcatcggaagcagcggctcaccggtgctggcgggttgctacacgcgcatcttcagcttcggcgactcgctgacagacacaggaaactacgtccacctgacggccaccagccacagcccctacggcgcgccgccgtacgggaggacgttcttcggcaaacctactggccgcgccagcgacggacgcctcgtcatcgacttcatcgcggaagagttggggctggcgaaggtgacggcgatccaggcgggcacggcgccgggggacttccagagcggcgccaacttcgccatcatctcggccaccgccaacaacggctccttcttcgcgggcaacggcatggacatcaggcctttctcgctggacacgcagatgctgtggttcaggacccacctccgcgagctcgtgcaggcggcgtccccagcggcgcagcagaacggcagcgccgccgccgcgctgctgagcggcgcgctggtggcgctgggcgagatcggcggcaacgactacaacttcgccttctcccggggcgtgccgcgggacgaggtgcgccggttcgtgccggccgtggtggacaagctggcgggcgccatggaggagctcatcgcgctgggggcgcgcgccttcgtggtgcccgggaacctgcccttcggctgcacgccgctgtacctgcagcggttccgcgccaacggcgggtggtgggactacgacccggccacgggatgcctcgcctggttcaaccgcttcgcccagtaccacaaccgggtgctcaccgcccgcctcgacaagctccgccgcctgcacccggacgtcaccatcgtctacgccgactggtacgaggccaccatgagcatcttccaagcccccgggaagctagggttcacaaacgctctgcggacttgctgcgggaaccagaccgtgccgtgtggcatgccggggtgctccgtctgcaaggacccgtccacgttcgggtcctgggacgggacgcacccgacgcaggcggtgtacaaggtgatcgccgacggggtgctgcacgggccgtacgcgtcccctgttcctctcgccgagacttgccctcccaccacatga

SEQ ID NO: 5312 - protein, 391 aa, Sorghum bicolor
  misc_feature: Ceres ANNOT ID no. 6042601
  misc_feature (48)..(372): Pfam Id: Lipase_GDSL Pfam Desc: GDSL-like Lipase/Acylhydrolase
  misc_feature (34)..(389): NCBI GI: 54290849 NCBI Desc: lanatoside 15'-o-acetylesterase-like [oryza sativa (japonica cultivar-group)]
  misc_feature (27)..(387): NCBI GI: 20146423 NCBI Desc: lipase-like [oryza sativa (japonica cultivar-group)]
  misc_feature (25)..(387): NCBI GI: 10764858 NCBI Desc: f1k23.17 [arabidopsis thaliana]
  misc_feature (43)..(387): NCBI GI: 115473671 NCBI Desc: os07g0642200 [oryza sativa (japonica cultivar-group)]
  misc_feature (26)..(380): NCBI GI: 115435276 NCBI Desc: os01g0215700 [oryza sativa (japonica cultivar-group)]
MTLMSLLRLPGEHCSLSPATLAAWWSLLLLAVIGSSGSPVLAGCYTRIFSFGDSLTDTGNYVHLTATSHSPYGAPPYGRTFFGKPTGRASDGRLVIDFIAEELGLAKVTAIQAGTAPGDFQSGANFAIISATANNGSFFAGNGMDIRPFSLDTQMLWFRTHLRELVQAASPAAQQNGSAAAALLSGALVALGEIGGNDYNFAFSRGVPRDEVRRFVPAVVDKLAGAMEELIALGARAFVVPGNLPFGCTPLYLQRFRANGGWWDYDPATGCLAWFNRFAQYHNRVLTARLDKLRRLHPDVTIVYADWYEATMSIFQAPGKLGFTNALRTCCGNQTVPCGMPGCSVCKDPSTFGSWDGTHPTQAVYKVIADGVLHGPYASPVPLAETCPPTT

SEQ ID NO: 5313 - DNA, 1182 bp, Sorghum bicolor
  misc_feature: Ceres ANNOT ID no. 6042604
  misc_feature: Encodes the peptide sequence at SEQ ID NO 5314
atgagtcttataagagggatgggaaacattgccaaaagatggaaagaactcaatggcttgaattattggaagggcctggttgatcctctcgacctcgaccttcgtaggaatatcatcaactatggtgagctctcccaggcagcctatactgggctaaacagagagagaagatcaaggtatgctgggtcttgcctcttcaaccgcagagacttcctcagccgggtggatgtatcaaacccaaatttgtatgagattacaaagttcatatatgcaatgtgtactgtcagcttacctgatggattcatggttaagtctctttcaaaggcagcatggagcaggcagtcaaattggatgggatttgttgcagtagctacagacgagggtaaggaagtgcttgggaggcgggatgtggtggtggcatggcgtggcacaatacggatggtagagtggatggatgatcttgatatttccttggtgcctgcttcagaaatagttcttccaggcagcgcaactaacccctgtgtgcatggagggtggctttcagtctacacaagtgctgatccagggtcacaatacaacaaagagagtgcaagacatcaggtgttaaacgaggtcaaaaggatacaggatttgtacaagacagaggagacgagcatctccataacaggtcacagcctaggagcagcacttgccaccatcaatgcaattgacattgtctccaatggctacaacaggagctgccctgtgtccgcgtttgtatttggaagccccagagtcggtaaccctgattttcaggaagcatttgacagtgcagcagatctgagattgctccgagtccggaactctcctgatgtggtcccaaaatggccaaagctaggatacagtgatgtcggcacagagctaaggatcgacacaggagaatcaccctacctgaagtcccctggaaaccccttgacatggcatgacatggagtgctacatgcacggggttgcaggggctcaggggagcagtggagggttcgagttggctgttgatcgagacattgctttggtgaacaagcatgaagatgcactgaaaaatgagtttgctgtcccatcatcatggtgggtggtacagaacaaaggtatggtgaaaggcaaggatggccggtggcatctggcggaccatgaggatgatgactga

SEQ ID NO: 5314 - protein, 393 aa, Sorghum bicolor
  misc_feature: Ceres ANNOT ID no. 6042604
  misc_feature (138)..(294): Pfam Id: Lipase_3 Pfam Desc: Lipase (class 3)
  misc_feature (11)..(391): NCBI GI: 20146431 NCBI Desc: lipase-like [oryza sativa (japonica cultivar-group)]
  misc_feature (11)..(393): NCBI GI: 7268648 NCBI Desc: lipase-like protein [arabidopsis thaliana]
  misc_feature (200)..(393): NCBI GI: 55297551 NCBI Desc: lipase-like protein [oryza sativa (japonica cultivar-group)]
  misc_feature (10)..(392): NCBI GI: 15221426 NCBI Desc: lipase class 3 family protein [arabidopsis thaliana]
  misc_feature (10)..(392): NCBI GI: 21537306 NCBI Desc: lipase-like protein [arabidopsis thaliana]
MSLIRGMGNIAKRWKELNGLNYWKGLVDPLDLDLRRNIINYGELSQAAYTGLNRERRSRYAGSCLFNRRDFLSRVDVSNPNLYEITKFIYAMCTVSLPDGFMVKSLSKAAWSRQSNWMGFVAVATDEGKEVLGRRDVVVAWRGTIRMVEWMDDLDISLVPASEIVLPGSATNPCVHGGWLSVYTSADPGSQYNKESARHQVLNEVKRIQDLYKTEETSISITGHSLGAALATINAIDIVSNGYNRSCPVSAFVFGSPRVGNPDFQEAFDSAADLRLLRVRNSPDVVPKWPKLGYSDVGTELRIDTGESPYLKSPGNPLTWHDMECYMHGVAGAQGSSGGFELAVDRDIALVNKHEDALKNEFAVPSSWWVVQNKGMVKGKDGRWHLADHEDDD

SEQ ID NO: 5315 - DNA, 1200 bp, Sorghum bicolor
  misc_feature: Ceres ANNOT ID no. 6042612
  misc_feature: Encodes the peptide sequence at SEQ ID NO 5316
atggcgtcctctgcccccggcagaggaggaaggcagctgatcctaccggcggcggctgtggcgctgatggtaatagttggggcggagccggcggcggcgtgctacccgcgcgtgttcagcttcggggattcgctgaccgataccggaaacttcagattctactacggcaacaactccggcgagcccgcgctccggccaccctacggcgagaccttcttccgccgcgccacggggcgcttctccaacggccgcctcgtcctcgacttcatcgcggacacgatggggctcccgttcgtgcggccgtatctgagcggtcggcgcgcggaggacttcgcgtgcggtgccaacttcgccgtcggcggggccacggcgctcggcccggacttcttccgctccaggggtttcgacatcggcgacggacgggtgcacctaggcttgcagatgaagtggtttcacgatctgcttgagctcctctgccgcagcggccgctccggttgctcagacatgataagtcaatccctcttcatcgttggagaaattgggggcaatgactacaacctacctcttctctccagagtgccgattgaaaagattcgctcattcacaccaagtgtcgttgccaaaatttcttcaacaatcaccgaattgattgggctaggagccaagaatctggtagttcctgggaacctcccaattgggtgtgtcccaaaatatctgttgatattcaagagtgacgacaaagaagattatgagccagagacaggttgcctcaggtggatgaacgaattttcagagtaccacaacaagcttctcttggaggagctggagaagctgcgcaagcttaatcctggtgtgactattatctatgctgactattatggagctgcaatggaaattttccattcccctgaacgatttggtatcgaggaacctttggtggcttgctgcggtggagaaggaccctatggtgtgtccctttctacagcctgtggatatggagactacaaggtgtgtgataatccagacaagtatggctcgtgggatggtttccatccatcggaagctgcatacaaaggcattgcaatgggccttttgcgagggacatacacacaaccatctattgcttccaccaccagttcctgtccacagctcactgagctcggctcttctgttgaatacaaggtcctctacgatttatag

SEQ ID NO: 5316 - protein, 399 aa, Sorghum bicolor
  misc_feature: Ceres ANNOT ID no. 6042612
  misc_feature (38)..(364): Pfam Id: Lipase_GDSL Pfam Desc: GDSL-like Lipase/Acylhydrolase
  misc_feature (1)..(307): NCBI GI: 55297543 NCBI Desc: lipase-like [oryza sativa (japonica cultivar-group)]
  misc_feature (27)..(379): NCBI GI: 54290849 NCBI Desc: lanatoside 15'-o-acetylesterase-like [oryza sativa (japonica cultivar-group)]
  misc_feature (1)..(159): NCBI GI: 55297548 NCBI Desc: lipase-like [oryza sativa (japonica cultivar-group)]
  misc_feature (13)..(372): NCBI GI: 10764858 NCBI Desc: f1k23.17 [arabidopsis thaliana]
  misc_feature (94)..(228): NCBI GI: 115438881 NCBI Desc: os01g0649400 [oryza sativa (japonica cultivar-group)]
MASSAPGRGGRQLILPAAAVALMVIVGAEPAAACYPRVFSFGDSLTDTGNFRFYYGNNSGEPALRPPYGETFFRRATGRFSNGRLVLDFIADTMGLPFVRPYLSGRRAEDFACGANFAVGGATALGPDFFRSRGFDIGDGRVHLGLQMKWFHDLLELLCRSGRSGCSDMISQSLFIVGEIGGNDYNLPLLSRVPIEKIRSFTPSVVAKISSTITELIGLGAKNLVVPGNLPIGCVPKYLLIFKSDDKEDYEPETGCLRWMNEFSEYHNKLLLEELEKLRKLNPGVTIIYADYYGAAMEIFHSPERFGIEEPLVACCGGEGPYGVSLSTACGYGDYKVCDNPDKYGSWDGFHPSEAAYKGIAMGLLRGTYTQPSIASTTSSCPQLTELGSSVEYKVLYDL

SEQ ID NO: 5317 - DNA, 1200 bp, Sorghum bicolor
  misc_feature: Ceres ANNOT ID no. 6042613
  misc_feature: Encodes the peptide sequence at SEQ ID NO 5318
  misc_feature: Up-regulated in shoot tissues in response to methyl jasmonate treatment
atgccttcctcattccccgcgagaggaggacgagggctcctcctgccggcggcggttgtggtgctagtactattggatgcagtggcgccagcggcgggttgctatccgcgcgtgttcagcttcggggactcgctggcggacaccggcaactgcctcttcgtctacggcaacaactctggccaggccgggctccggccaccctacggcgagaccttcttccaccgcgccaccgggcgcgcctccaatggacgcctcgtcgtcgacttcatcgcggacgcgctgggcctcccgttcgtgcggccgtatctgagcggagggagcgcggaggacttcgcgtgcggggccaacttcgccgtgggcggcgccacggcgctcagcccggaagaaatccgcgcaaggggtttcgacaacatgggcaatcaagtggggctcgacatggagatggagtggtttcgcgacctgctccaccttctctgccccggcaacctcgctggttgctcagatatgatgaaccaatctctcttcttggttggagaaatcgggggtaatgactacaactttcctcttctttctggagttcccttggagaaaattcgcaccatgactccgagtgttgttgcgaaaatttcttctacgatcagcgaattgattcagctaggagccaagactcttatggttccaggaaacctccctattggatgtgtcccagactatctgatgatattcaagagtgataaggaagaggattatgaaccacagacaggttgtcttaggtggatgaacgagttctcacagtaccacaacaagcttctcgtggaggagcttaagaagcttcgcaagctccatcctggagtaaccatcatctatgcggattactatggagctgctatggagattttcctttcccctgaacaatatgggatcgaacatcccctagtggcttgctgtggtggagaaggaccctatggtgtgtccccaactataacatgtggattcggagaatataaactgtgcgataacccagaaaagtatggatcatgggatggcttccatccatcagaatctgcatacagggccattgctacgggcctgctactaggttcctacacaaggccgtcaattgcttccaccaccacttcatgtccacagcttatggagctcggctcttctgctgaatacaaacccctctacgacctgtaa

SEQ ID NO: 5318 - protein, 399 aa, Sorghum bicolor
  misc_feature: Ceres ANNOT ID no. 6042613
  misc_feature (38)..(364): Pfam Id: Lipase_GDSL Pfam Desc: GDSL-like Lipase/Acylhydrolase
  misc_feature (9)..(322): NCBI GI: 55297543 NCBI Desc: lipase-like [oryza sativa (japonica cultivar-group)]
  misc_feature (1)..(164): NCBI GI: 55297548 NCBI Desc: lipase-like [oryza sativa (japonica cultivar-group)]
  misc_feature (34)..(377): NCBI GI: 54290849 NCBI Desc: lanatoside 15'-o-acetylesterase-like [oryza sativa (japonica cultivar-group)]
  misc_feature (18)..(372): NCBI GI: 10764858 NCBI Desc: f1k23.17 [arabidopsis thaliana]
  misc_feature (19)..(374): NCBI GI: 20146423 NCBI Desc: lipase-like [oryza sativa (japonica cultivar-group)]
  misc_feature: Up-regulated in shoot tissues in response to methyl jasmonate treatment
MPSSFPARGGRGLLLPAAVVVLVLLDAVAPAAGCYPRVFSFGDSLADTGNCLFVYGNNSGQAGLRPPYGETFFHRATGRASNGRLVVDFIADALGLPFVRPYLSGGSAEDFACGANFAVGGATALSPEEIRARGFDNMGNQVGLDMEMEWFRDLLHLLCPGNLAGCSDMMNQSLFLVGEIGGNDYNFPLLSGVPLEKIRTMTPSVVAKISSTISELIQLGAKTLMVPGNLPIGCVPDYLMIFKSDKEEDYEPQTGCLRWMNEFSQYHNKLLVEELKKLRKLHPGVTIIYADYYGAAMEIFLSPEQYGIEHPLVACCGGEGPYGVSPTITCGFGEYKLCDNPEKYGSWDGFHPSESAYRAIATGLLLGSYTRPSIASTTTSCPQLMELGSSAEYKPLYDL

SEQ ID NO: 5319 - DNA, 1023 bp, Sorghum bicolor
  misc_feature: Ceres ANNOT ID no. 6042614
  misc_feature: Encodes the peptide sequence at SEQ ID NO 5320
atgaggccgtcgctgctgagatccacgtcccagctcctccgccgccggagctactcctccgcatccgggcagcctgagcggaaggtggccatcctcggcgcggcgggcggcatcgggcagccgctgtcgctgctcatgaagctcaacccactcgtctcgtcgctctcgctctacgatattgccggcaccccaggtgtcgcggccgacgtctcccacatcaactcccccgccctggtgaagggcttcatgggagaggaacagcttggggaagcgctagagggctccgacgtggtaatcatcccggctggcgtgccgaggaagcccggcatgaccagggacgacctcttcaatatcaacgctggcatcgttaagaacctcagcgccgccatcgccaagtactgccccaatgcccttgtcaacatgatcagcaaccctgtgaattcaactgtaccaattgctgctgaggttttcaagaaggctgggacatatgatgagaagaagttgtttggcgtgaccacccttgatgttgttcgcgccaagactttctatgccgggaaggctaatttaccagtaaccgatgtgaatgtccctgttgttggcggtcatgcgggtatcaccatcctgccattgttctcacaagccacccctgcaaccaactcattgtctgatgaagacatcaaggctctcaccaagaggacacaggatggtgggactgaagttgttgaggcaaaggctgggaagggctctgcaaccttgtccatggcgtatgctggcgctgtttttgcagatgcatgcttgaagggtctcaatggagttccggatatcgttgagtgctcttttgttcaatcaactgtaacagagcttccattctttgcgtccaaggtgaggcttgggaagaatggagttgaggaagtgcttgggttgggcgagctgtcggactttgagaaagaagggttggagaagctcaagagcgagctcaagtcttcaattgagaagggtatcaagtttgcaaatgagaactag

SEQ ID NO: 5320 - protein, 340 aa, Sorghum bicolor
  misc_feature: Ceres ANNOT ID no. 6042614
  misc_feature (172)..(337): Pfam Id: Ldh_1_C Pfam Desc: lactate/malate dehydrogenase, alpha/beta C-terminal domain
  misc_feature (27)..(170): Pfam Id: Ldh_1_N Pfam Desc: lactate/malate dehydrogenase, NAD binding domain
  misc_feature (1)..(338): NCBI GI: 19880701 NCBI Desc: malate dehydrogenase [oryza sativa]
  misc_feature (1)..(340): NCBI GI: 24638017 NCBI Desc: malate dehydrogenase, mitochondrial precursor
  misc_feature (1)..(340): NCBI GI: 126896 NCBI Desc: malate dehydrogenase, mitochondrial precursor
  misc_feature (8)..(340): NCBI GI: 7798706 NCBI Desc: malate dehydrogenase [vitis vinifera]
  misc_feature (1)..(339): NCBI GI: 5929964 NCBI Desc: malate dehydrogenase [glycine max]
  misc_feature (1)..(340): SWISSPROT Homolog: EC 1.1.1.37 Malate dehydrogenase, mitochondrial precursor
  misc_feature: The sequence is a functional homolog of SEQ ID NO. 341 in the 11/188,298 US application
MRPSLLRSTSQLLRRRSYSSASGQPERKVAILGAAGGIGQPLSLLMKLNPLVSSLSLYDIAGTPGVAADVSHINSPALVKGFMGEEQLGEALEGSDVVIIPAGVPRKPGMTRDDLFNINAGIVKNLSAAIAKYCPNALVNMISNPVNSTVPIAAEVFKKAGTYDEKKLFGVTTLDVVRAKTFYAGKANLPVTDVNVPVVGGHAGITILPLFSQATPATNSLSDEDIKALTKRTQDGGTEVVEAKAGKGSATLSMAYAGAVFADACLKGLNGVPDIVECSFVQSTVTELPFFASKVRLGKNGVEEVLGLGELSDFEKEGLEKLKSELKSSIEKGIKFANEN

SEQ ID NO: 5321 - DNA, 597 bp, Sorghum bicolor
  misc_feature: Ceres ANNOT ID no. 6042619
  misc_feature: Encodes the peptide sequence at SEQ ID NO 5322
atggaggagcagttcatcctccgcgtgcccccatccgtggcggagcggatcgagcgcctcatgaatgaatccgccgctgcctcctccaaccccgacgaggcctccctcgacctctcattctcagaggatggaagaaatggtacatttatgattggtaatgagagctttcctgcatctctcttggatctacctgctgtggtggagtcgtacaaaacatatgatgattctgtgctaattaaaactgctgatgttggtcagatgattatggtaagagaagaaaatgatcctgctccagaaggagttgaatacaagcatgggcttactcctccaatgagggatgcacgcaggcgacgtttccgcagagaaccagacttgaatgcagagctggttaaccaagttgagaagcatcttataaatatcatgcatggtgtatctgtcaatcaaaatgccagtgtgataggagctgaagaaggtggtgatcgtaagaaacctccagtagctcgtgcagccaccaagcagccagatgttcaagagcctgctgcgaatggagaggaagcagaacctgacaggagcgacactgatgagtcagagaactga

SEQ ID NO: 5322 - protein, 198 aa, Sorghum bicolor
  misc_feature: Ceres ANNOT ID no. 6042619
  misc_feature (1)..(157): Pfam Id: TAFII55_N Pfam Desc: TAFII55 protein conserved region
  misc_feature (3)..(198): NCBI GI: 140059085 NCBI Desc: tafii55 protein conserved region [medicago truncatula]
  misc_feature (1)..(151): NCBI GI: 79319993 NCBI Desc: transcription factor [arabidopsis thaliana]
  misc_feature (31)..(126): NCBI GI: 55296876 NCBI Desc: tata-binding protein-associated factor tafii55-like [oryza sativa (japonica cultivar-group)]
  misc_feature (1)..(96): NCBI GI: 17921978 NCBI Desc: taf7-like rna polymerase ii, tata box binding protein (tbp)-associated factor [mus musculus]
  misc_feature (1)..(96): NCBI GI: 123122983 NCBI Desc: taf7-like rna polymerase ii, tata box binding protein (tbp)-associated factor [mus musculus]
MEEQFILRVPPSVAERIERLMNESAAASSNPDEASLDLSFSEDGRNGTFMIGNESFPASLLDLPAVVESYKTYDDSVLIKTADVGQMIMVREENDPAPEGVEYKHGLTPPMRDARRRRFRREPDLNAELVNQVEKHLINIMHGVSVNQNASVIGAEEGGDRKKPPVARAATKQPDVQEPAANGEEAEPDRSDTDESEN

SEQ ID NO: 5323 - DNA, 2658 bp, Sorghum bicolor
  misc_feature: Ceres ANNOT ID no. 6042624
  misc_feature: Encodes the peptide sequence at SEQ ID NO 5324
atggcagggtggggatcgtccagggtggcggcgtgcgggccgtggggccgcggcgcggcgctggagagggagctgtcgcgggacggcagccactacagcatctccagcggcatcctgccgtcgctcggcgcgcggagcaaccgccgcgtcaagctcaggcccttcatcgtctcgccctacgaccgccgatacagatgctgggagacttttctcataattcttgtggtgtattctgcatgggtttccccatttgagtttggcttcattcggaaaccgacgggcgccctagctgcagtggacaatgtcgtgaatgcgttcttcgcagtggacatcatcctgaccttctttgtagcttacttggatagaatgacatacctgcttgaagatgatccgaaaaggatagcttggcggtatactaccagttggtttgtccttgacgtggcctccaccatcccaagtgaatttgctcggaggatactaccaccaaacctcaggtcatatggatttttcaacatgcttcgtctatggcgtctccgtagagtcagctctctctttgctagattggagaaagatagacatttcaattacttctgggttcgatgtgcaaagctcatatgtgtcacactttttgctgtccactgttcggcatgcttctactatcttctcgctgataggtatcctgtcccaacggatacgtggattggcaattcgatgccagattttcatcagcggggtttatggattcgctatgtaatatcagtatattggtcaatcactactcttaccactgtgggttatggtgatttgcacgcggagaacacaagggagatgatattcaacattttctacatgctattcaaccttggattgactgcctatttgattggtaacatgaccaatctggttgtccatggcaccagccgtactcgaaaatatagagatacaattcaagcagcaaccagctttgcactaaggaatcagttaccaagtcggctccaagatcagatgatctcccatcttagcttgaagttcaggacagattcagaaggtcttcaacaacaagagaccctcgatgcgcttcctaaggctataagatccagcatttctcagtatctgtttttcaatcttgtccaaaaggtctacttgtttgaaggggtgtccaatgacctgatttttcaactggtttctgagatgaaagctgaatattttccacctagggaagatgtgattctgcagaatgaagcacccacagacttttatattttagttactggtagcgcggagttggtagagttgcgaaatggcggagaacagatagctggagtggctaaggcaggagatgttgttggagaaattggggttctttgctataggccccaactattcacagttcgaacaaaatcattatgccagcttctgcgtatgaatcgcactgcctttctcagccttgttcaatccaatgttgcagatggaacaataataatgaacaaccttatgcagttactgaaagagcagaaagacaacagtgtaatggcgggtgttctgaaggagattgagaacatgctagcgcggggtcgtctggatttgccagttaccctctgctttgcagtaaataaaggagatgattttatgttacatcaacttttgaagcgtggtttggatccaaatgaatcagataacaatgggcatacagcactgcatatagctgcttccaaaggagacgaacaatgcgtcaagcttcttctagactacggagctgatccaaatgctagagattccgaaggaaaagtgcctctatgggaggctttatgtgaaaagcataatgcagtaatagagctgttagtagagagtggtgcagagctatcatctggagacacagccttgtatgcttgcatcgctgttgaggaaaatgatgctgagttgcttgagaacattatccgctatggtggcaacataaacagctcaacgaaagatggaaccacaccgctgcatcgtgcagtctgtgatggaaatgttcagatggttgagttgttgctggaacacggagctgacatcaacaagcaggacaacaatggctggtcagcaagagatctagctgatcagcaaggccatgatgacattcaggttctctttaaatcacgaaaagcacataggcagcatgcctcaaatggcagagtggcacctatgctgatagggaggttcaacagtgaaccctcaatgccaaatatgaaccatgaagacgccgaagtacgcagcaaagttgttccacagaagctcctcagaaagagggtcagtttccaaaattctcttttcggtgtcatttcttcatcccaggcccgccaggacacaggtggtctgctctcgaaaggccttgctggaacaggtggcccaagttgccatcacgactccctcatcagggtgacaatcagctgccctgagaaagggaatgctgcagggaagcttgtgcgcctaccacggtcgatgactgagcttctcgaactaggtgcaaagaagttcgacttcaagcctaccaaggtcctgacagttgggggtgctgagattgatgaggtggagcttatcagagacggtgatcatattgttctcgtcagtagtgactgggtgccagatgttgcacaaattagacctaacgatcaatga

SEQ ID NO: 5324 - protein, 885 aa, Sorghum bicolor
  misc_feature: Ceres ANNOT ID no. 6042624
  misc_feature (99)..(298): Pfam Id: Ion_trans Pfam Desc: Ion transport protein
  misc_feature (561)..(593): Pfam Id: Ank Pfam Desc: Ankyrin repeat
  misc_feature (658)..(690): Pfam Id: Ank Pfam Desc: Ankyrin repeat
  misc_feature (400)..(489): Pfam Id: cNMP_binding Pfam Desc: Cyclic nucleotide-binding domain
  misc_feature (207)..(304): Pfam Id: Ion_trans_2 Pfam Desc: Ion channel
  misc_feature (1)..(882): NCBI GI: 62242121 NCBI Desc: potassium uptake channel [zea mays]
  misc_feature (1)..(885): NCBI GI: 2104908 NCBI Desc: potassium channel [zea mays]
  misc_feature (5)..(873): NCBI GI: 84027755 NCBI Desc: potassium channel akt1 (osakt1)
  misc_feature (5)..(873): NCBI GI: 113533244 NCBI Desc: os01g0648000 [oryza sativa (japonica cultivar-group)]
  misc_feature (5)..(881): NCBI GI: 93138731 NCBI Desc: inwardly rectifying potassium channel akt1 [hordeum vulgare]
  misc_feature: The sequence is a functional homolog of SEQ ID NO 1838 in the 10/374,780US patent application
  misc_feature: Useful for making plants with modulated growth and phenotype characteristics
  misc_feature: The sequence is a functional homolog of SEQ ID NO 1838 in the 20060162006 US patent application
  misc_feature: The sequence is a functional homolog of SEQ ID NO 1838 in the 10/374,780 US patent application
  misc_feature: The sequence is a functional homolog of SEQ ID NO. 503 in the 11/188,298 US application
MAGWGSSRVAACGPWGRGAALERELSRDGSHYSISSGILPSLGARSNRRVKLRPFIVSPYDRRYRCWETFLIILVVYSAWVSPFEFGFIRKPTGALAAVDNVVNAFFAVDIILTFFVAYLDRMTYLLEDDPKRIAWRYTTSWFVLDVASTIPSEFARRILPPNLRSYGFFNMLRLWRLRRVSSLFARLEKDRHFNYFWVRCAKLICVTLFAVHCSACFYYLLADRYPVPTDTWIGNSMPDFHQRGLWIRYVISVYWSITTLTTVGYGDLHAENTREMIFNIFYMLFNLGLTAYLIGNMTNLVVHGTSRTRKYRDTIQAATSFALRNQLPSRLQDQMISHLSLKFRTDSEGLQQQETLDALPKAIRSSISQYLFFNLVQKVYLFEGVSNDLIFQLVSEMKAEYFPPREDVILQNEAPTDFYILVTGSAELVELRNGGEQIAGVAKAGDVVGEIGVLCYRPQLFTVRTKSLCQLLRMNRTAFLSLVQSNVADGTIIMNNLMQLLKEQKDNSVMAGVLKEIENMLARGRLDLPVTLCFAVNKGDDFMLHQLLKRGLDPNESDNNGHTALHIAASKGDEQCVKLLLDYGADPNARDSEGKVPLWEALCEKHNAVIELLVESGAELSSGDTALYACIAVEENDAELLENIIRYGGNINSSTKDGTTPLHRAVCDGNVQMVELLLEHGADINKQDNNGWSARDLADQQGHDDIQVLFKSRKAHRQHASNGRVAPMLIGRFNSEPSMPNMNHEDAEVRSKVVPQKLLRKRVSFQNSLFGVISSSQARQDTGGLLSKGLAGTGGPSCHHDSLIRVTISCPEKGNAAGKLVRLPRSMTELLELGAKKFDFKPTKVLTVGGAEIDEVELIRDGDHIVLVSSDWVPDVAQIRPNDQ

SEQ ID NO: 5325 - DNA, 1911 bp, Sorghum bicolor
  misc_feature: Ceres ANNOT ID no. 6042630
  misc_feature: Encodes the peptide sequence at SEQ ID NO 5326
atggagtcgcgcgccctcctgcacgcccggcccgccgccctccctccccgcgccggcctgcgcctccctctcccactcccgcgcccgcgggcagtctccctcacccccgccgccaagcccgcggcgctccagtccccgctcctcgcgtcgagaggccccttcctcccgcggcacgatgcggttctggggaatgggttcctgaagcggagagcggccagcgctggcggtgacgtgtccttccgcgcccaggcggcggcggcggtgccggcgccggcgccgcagccggaggagtccagtacaaagttcctcggcatcgacgtgaagacgctcaagaagatcgtgccgctggggctcatgttcttctgcatcctcttcaactacaccatcctgcgggacaccaaggacgtgctggtggtcaccgccaaggggagcagcgccgagatcatcccgttcctcaagacctgggtcaacctgcccatggccatcggattcatgctcctctacaccaagctctccaacgttctctcacgggaggcgctcttctacaccgtcatcttccccttcatcgccttcttcggcgccttcgccttcgtgctctacccgctcagggacgtcatccatcccaccgcgctcgcggacaagcttctcgccgcgctcggcccgagcttccttggccccgtcgcgatactgaggatttggagcttctgcttgttctatgttatggctgagctctggggcagcgtcgtcatctctgtgctcttctgggggtttgcgaatcagattaccacagttgatgaagcaaaggaattctacccgttatttggccttggggctaatattgcccttatcttttctgggcgtactgtgaagtatttctcaaatttgcgcaagacattgggtcctggaattgatggctgggaagtatctttgaaaggaatgatgagcatagtggtacttcttggactggtcataacttccatctattggggagtgaacaagtttgttttgaatgatccttcacttccaaagtctgatcgtaagaagaaaaaggaaaagcctaaacttggtatgaaagagagtctgaaggttctgctctcctcgaggtatgtgagggatctagccaccttagtggttgcttacggcattagtatcaatcttgtcgaagtcacatggaaatcaaaactcaaggcacagttccctagtccaaatgaatactcatctttcatgggtgatttctcgaccgcaactggaattgcaactttcacaatgatgctgttaggacgatatatactacgaaaatttggctggggtgtggctgcaatgatcacccccactgttctgttgctgactggtgccggattcttctctctgatcttgtttggacagccactgactcctatgcttgccacgatgggtatgacccctctactggcagccgtttatgtgggcgccatgcaaaacatatttagcaagagtgcaaagtacagtttatttgacccatgcaaggaaatggcttatattcctttggatgaagatatgaaggtaaaaggaaaagcggccattgatgttgtttgcaacccactgggcaaatccggtggtgcacttatccaacaattcatgatcctgacgtttggatccctggcaaattcaactccataccttggcggcatactgctggtcattgttctcgcgtggctaggcgcagcaaactcattggacaagcagttctcggccttggctaaggaagacctgaagaaggagaaggctgcccaagagaaagtagaaccctcgctacttaaggcgcctgcagaaggcactggtgatgtaccggtggagcagacaaatggatctgtgacgagccaagcaactggaacagagagctcaccgtcgaactcatcccccattcaatag

SEQ ID NO: 5326 - protein, 636 aa, Sorghum bicolor
  misc_feature: Ceres ANNOT ID no. 6042630
  misc_feature (78)..(576): Pfam Id: TLC Pfam Desc: TLC ATP/ADP transporter
  misc_feature (1)..(634): NCBI GI: 61971467 NCBI Desc: plastid atp/adp transporter [oryza sativa (japonica cultivar-group)]
  misc_feature (85)..(625): NCBI GI: 115444955 NCBI Desc: os02g0208100 [oryza sativa (japonica cultivar-group)]
  misc_feature (12)..(634): NCBI GI: 71068360 NCBI Desc: plastid atp/adp transport protein 2 [manihot esculenta]
  misc_feature (12)..(627): NCBI GI: 71068358 NCBI Desc: plastid atp/adp transport protein 1 [manihot esculenta]
  misc_feature (12)..(634): NCBI GI: 71068362 NCBI Desc: plastid atp/adp transport protein 2 [manihot esculenta]
  misc_feature: Useful for making plants with atered amino acid content
  misc_feature: Functional homolog of the protein sequence given in SEQ ID NO 13592
MESRALLHARPAALPPRAGLRLPLPLPRPRAVSLTPAAKPAALQSPLLASRGPFLPRHDAVLGNGFLKRRAASAGGDVSFRAQAAAAVPAPAPQPEESSTKFLGIDVKTLKKIVPLGLMFFCILFNYTILRDTKDVLVVTAKGSSAEIIPFLKTWVNLPMAIGFMLLYTKLSNVLSREALFYTVIFPFIAFFGAFAFVLYPLRDVIHPTALADKLLAALGPSFLGPVAILRIWSFCLFYVMAELWGSVVISVLFWGFANQITTVDEAKEFYPLFGLGANIALIFSGRTVKYFSNLRKTLGPGIDGWEVSLKGMMSIVVLLGLVITSIYWGVNKFVLNDPSLPKSDRKKKKEKPKLGMKESLKVLLSSRYVRDLATLVVAYGISINLVEVTWKSKLKAQFPSPNEYSSFMGDFSTATGIATFTMMLLGRYILRKFGWGVAAMITPTVLLLTGAGFFSLILFGQPLTPMLATMGMTPLLAAVYVGAMQNIFSKSAKYSLFDPCKEMAYIPLDEDMKVKGKAAIDVVCNPLGKSGGALIQQFMILTFGSLANSTPYLGGILLVIVLAWLGAANSLDKQFSALAKEDLKKEKAAQEKVEPSLLKAPAEGTGDVPVEQTNGSVTSQATGTESSPSNSSPIQ

SEQ ID NO: 5327 - DNA, 1395 bp, Sorghum bicolor
  misc_feature: Ceres ANNOT ID no. 6042636
  misc_feature: Encodes the peptide sequence at SEQ ID NO 5328
atggcgtccgccgccgcagacccgctcctccccggcgaggccagcggccgccgccgcctcgggttcctgccctcaagcatccgcctcaacacatccgtgtggtccgagctgggcggcgcggtgggcgacctgggcacctacatcccgatcgtgctcgcgctgtcgctggcgtcgcacctggacctcggcacgacgctcatcttcacggcgctctacaacttcgccacgggcctgctcttcggcatcccgatgcccgtgcagcccatgaagtcgatcgccgccgtcgcgctctcctccgcgcacctcaccgtcccgcagatcatggccgcggggctcgcggtcgccgccatcctgctgttcctcggcgccacgggcctcatgacgtgcatctaccgcctcctcccgctccccgtcgtgcgcggcgtccagctctcgcagggcctctccttcgccttcaccgccgtcaagtacgtccgctacgtccaggacttctcgcgctcctcctccgcctccaccgccgcggcgcgcccgctcctcggcctcgacggcctggtcctcgcgctcgccgcgctgctcttcatcatcctcgccacgggctccggcgacgacgaggacgtcgtcgcagtcgacgacggcacggtggtccgtcgccgccgccgctcctgcagccgcgtcccggcggcgctcatcgtgttcgcgctcgggctcgtgctctgcttcgtgcgtgacccgtcgattctgcgaggccttcgcttcgggccgtcgcctctgcggttcgtcgggatcacctgggacgatttcaagatcgggttctgggaaggtgccgtgccgcagcttcccctgtccgtgctcaactcggtcattgcggtgtgcaagctctcgtcggatctgttcccggaacgggccgagctttccccggcgcgggtgtcggtgagcgtcggcctcatgaatttcgtcggctgctggttcggcgccatgccgtgctgccacggcgcgggcgggctggcggggcagtaccggttcggcggccggagcggcgcgtccgtggtgttcctggccatcggcaagctggcgctggggctcgtgttcgggaactcgttcgtgacgatcctcgggcagttcccaatcgggatactgggcgtcatgctgctcttctccggtatcgagctcgccatggcgtcgcgcgacatggataccaaggaggagtccttcgtcatgcttatctgcgccggcgtctcgctcacgggctccagcgccgcgctgggtttcatctccgggattgttttgtacctgctgcttcgcctcagggacgtggattgccgagcactggtcggccgttggggctccggccggcggcaaaccgggaacaaagctggaggcgaccaagatgcttga

SEQ ID NO: 5328 - protein, 464 aa, Sorghum bicolor
  misc_feature: Ceres ANNOT ID no. 6042636
  misc_feature (8)..(443): NCBI GI: 110738373 NCBI Desc: sulfate transporter like protein [arabidopsis thaliana]
  misc_feature (34)..(436): NCBI GI: 145351471 NCBI Desc: sulp family transporter: sulfate [ostreococcus lucimarinus cce9901]
  misc_feature (36)..(434): NCBI GI: 51244140 NCBI Desc: probable sulfate permease (sulp) [desulfotalea psychrophila lsv54]
  misc_feature (224)..(432): NCBI GI: 114565910 NCBI Desc: sulfate permease (sulp) [syntrophomonas wolfei subsp. wolfei str. goettingen]
  misc_feature (189)..(436): NCBI GI: 126179826 NCBI Desc: sulphate transporter [methanoculleus marisnigri jr1]
MASAAADPLLPGEASGRRRLGFLPSSIRLNTSVWSELGGAVGDLGTYIPIVLALSLASHLDLGTTLIFTALYNFATGLLFGIPMPVQPMKSIAAVALSSAHLTVPQIMAAGLAVAAILLFLGATGLMTCIYRLLPLPVVRGVQLSQGLSFAFTAVKYVRYVQDFSRSSSASTAAARPLLGLDGLVLALAALLFIILATGSGDDEDVVAVDDGTVVRRRRRSCSRVPAALIVFALGLVLCFVRDPSILRGLRFGPSPLRFVGITWDDFKIGFWEGAVPQLPLSVLNSVIAVCKLSSDLFPERAELSPARVSVSVGLMNFVGCWFGAMPCCHGAGGLAGQYRFGGRSGASVVFLAIGKLALGLVFGNSFVTILGQFPIGILGVMLLFSGIELAMASRDMDTKEESFVMLICAGVSLTGSSAALGFISGIVLYLLLRLRDVDCRALVGRWGSGRRQTGNKAGGDQDA

SEQ ID NO: 5329 - DNA, 1203 bp, Sorghum bicolor
  misc_feature: Ceres ANNOT ID no. 6042648
  misc_feature: Encodes the peptide sequence at SEQ ID NO 5330
atggcgccgtccgccgcctgctccatggcctccgtctcccgggccctccgcccgcgaccgcgaccgcgcgccgccgtctgctcggctgctcgcctcgggtgcggattggggattgcctgctcgatgccaagtcacggaatggggaacgagaaacacgagctgggattggccgttgcgtctgcaccagctgcgactattaccccggttctcaggagccgacaaattttgtgcaaggcggaagctaatgtatctagtaatcttccggataccttgcctactggagtaagccagtatgaaaaaattgttgagctgctcaccactcttttccctgtctgggttacctggttggagactgaccttttcactatgggcttaggattcctaatgctgtcgatgggactaacattgacatttgaagattttcggagatgcttgaggaatccatggacagttggtgtggggtttcttgcacaatatttgatcaaacctatgcttggattttctattgcattggccttgaagctatcagctcctcttgcaactggtcttatcttggtctcatgttgccctggtggacaagcatcaaatgttgcaacttatatatccaagggaaatgttgcgctttcggttcttatgaccacttgttcaactgttggtgctatagtgatgacacccctcctgactaaactccttgctggccaactagttcctgttgatgcagcaggattggccatcagtactttccaggttgttttggtgccgactgttgttggagtattggcccatgaatattttcctaagtttactgagcacattatcactgtaacgcccctgattggtgtcctcctcaccactttgctttgcgcgagccctattggacaagtcgcagaagtgttgaaaactcaaggtggtcaacttattatccctgtcgctctacttcatgttgctgcatttgctcttgggtactggttatcaagattatctacctttggggaatcaacctctaggaccatcgcaatcgaatgtgggatgcagagttctgcacttggatttttacttgctcaaaagcatttcacaaatccacttgttgctgttccttcagctgtcagcgttgtgtgcatggctcttggagggagtgctcttgcagtttactggagaaacaaagggcttccaacggatgacaaagatgatttcaaggagtaa

SEQ ID NO: 5330 - protein, 400 aa, Sorghum bicolor
  misc_feature: Ceres ANNOT ID no. 6042648
  misc_feature (122)..(299): Pfam Id: SBF Pfam Desc: Sodium Bile acid symporter family
  misc_feature (6)..(400): NCBI GI: 55295966 NCBI Desc: na(+) dependent transporter-like [oryza sativa (japonica cultivar-group)]
  misc_feature (72)..(400): NCBI GI: 30683305 NCBI Desc: bile acid:sodium symporter family protein [arabidopsis thaliana]
  misc_feature (101)..(386): NCBI GI: 45655783 NCBI Desc: bile acid na+ symporter [leptospira interrogans serovar copenhageni str. fiocruz l1-130]
  misc_feature (110)..(386): NCBI GI: 145348219 NCBI Desc: bass family transporter: sodium ion/bile acid [ostreococcus lucimarinus cce9901]
  misc_feature (100)..(395): NCBI GI: 38346633 NCBI Desc: osjnba0072d21.3 [oryza sativa (japonica cultivar-group)]
MAPSAACSMASVSRALRPRPRPRAAVCSAARLGCGLGIACSMPSHGMGNEKHELGLAVASAPAATITPVLRSRQILCKAEANVSSNLPDTLPTGVSQYEKIVELLTTLFPVWVTWLETDLFTMGLGFLMLSMGLTLTFEDFRRCLRNPWTVGVGFLAQYLIKPMLGFSIALALKLSAPLATGLILVSCCPGGQASNVATYISKGNVALSVLMTTCSTVGAIVMTPLLTKLLAGQLVPVDAAGLAISTFQVVLVPTVVGVLAHEYFPKFTEHIITVTPLIGVLLTTLLCASPIGQVAEVLKTQGGQLIIPVALLHVAAFALGYWLSRLSTFGESTSRTIAIECGMQSSALGFLLAQKHFTNPLVAVPSAVSVVCMALGGSALAVYWRNKGLPTDDKDDFKE

SEQ ID NO: 5331 - DNA, 1050 bp, Sorghum bicolor
  misc_feature: Ceres ANNOT ID no. 6042650
  misc_feature: Encodes the peptide sequence at SEQ ID NO 5332
atgcaggaagctctcatctctccgggcaatgcctgccgctttcgctcagccttggagctgaagccgttcgccttcggggaccagcgcctcgcctcgccgccgggctacctcaacctcgccgccgtcggcggcggcgacgacgcgctgttccgctgctcgtcgccgttcagccccagcctcggcttctcctcgccgtcgccgctcgcgaccaccccctccgtctcgctctcgccgtcctcctccgcctcgctcgtcgacgactgcgacgacgccgcggccgccgacgtggacgccttcgccacgggccacaggctccagctcgcccgcctcgcgctgcagtaccaggaggtggccgaccgctacgagctctgcctcgcccgcctcgccgacgccgcggacgaggccgccgcgctccaccgcgagaacgccgagctccgcgtcgccaacgccgacctcacgcgccgcctcgcgctcctcagcggcatcggcaagcaggccgccgccgccgccatcgccgacgaggtctgccgcctccgcttcggggaccacaacaaggccgcggagtgcgctcccgagaagcccgccgccgtgctgcccaagagcatttccgtccgctccaacgactacctcaagatcaacaagcccaaacaggtgcaggcccccgccacgccggccgcaaacaaccgcaagcctcgcgcgtcgaacacgaccaacaacccaagctcggtgcagcgcgtgtacaagggcaatggcggcgacaagaaaggcgaggaacccaaggagccgccacacacggcggcggcggcggcggcggggcatgttcaagacggagcgtgcaacaagtgggagcagacgggggcgtgctcctacggcgaccagtgccagttcgctcacggcgtcgccgagctccgccccgtcatccgccacccgcgctacaagacccaggtctgccgcatggtgctcgccggcgaggtctgtccctacggccaccgctgccacttccgccacacgctcacccccatcgaacgcctcgacctgccccgaccttag

SEQ ID NO: 5332 - protein, 349 aa, Sorghum bicolor
  misc_feature: Ceres ANNOT ID no. 6042650
  misc_feature (274)..(300): Pfam Id: zf-CCCH Pfam Desc: Zinc finger C-x8-C-x5-C-x3-H type (and similar)
  misc_feature (312)..(338): Pfam Id: zf-CCCH Pfam Desc: Zinc finger C-x8-C-x5-C-x3-H type (and similar)
  misc_feature (2)..(344): NCBI GI: 115438841 NCBI Desc: os01g0645000 [oryza sativa (japonica cultivar-group)]
  misc_feature (198)..(344): NCBI GI: 91806051 NCBI Desc: zinc finger family protein [arabidopsis thaliana]
  misc_feature (218)..(336): NCBI GI: 116131343 NCBI Desc: ensangp00000012577 [anopheles gambiae str. pest]
  misc_feature (190)..(336): NCBI GI: 56122196 NCBI Desc: zfp36l3 [mus musculus]
  misc_feature (249)..(336): NCBI GI: 108882307 NCBI Desc: butyrate response factor 1 (tis11b protein) [aedes aegypti]
  misc_feature: Useful for making plants with altered Lignin content
  misc_feature: Useful for making plants with altered terpenoid content
  misc_feature: Functional homolog of the protein sequence given in SEQ ID NO 12987
  misc_feature: The sequence is a functional homolog of SEQ ID NO. 291 in the 11/188,298 US application
MQEALISPGNACRFRSALELKPFAFGDQRLASPPGYLNLAAVGGGDDALFRCSSPFSPSLGFSSPSPLATTPSVSLSPSSSASLVDDCDDAAAADVDAFATGHRLQLARLALQYQEVADRYELCLARLADAADEAAALHRENAELRVANADLTRRLALLSGIGKQAAAAAIADEVCRLRFGDHNKAAECAPEKPAAVLPKSISVRSNDYLKINKPKQVQAPATPAANNRKPRASNTTNNPSSVQRVYKGNGGDKKGEEPKEPPHTAAAAAAGHVQDGACNKWEQTGACSYGDQCQFAHGVAELRPVIRHPRYKTQVCRMVLAGEVCPYGHRCHFRHTLTPIERLDLPRP

SEQ ID NO: 5333 - DNA, 432 bp, Sorghum bicolor
  misc_feature: Ceres ANNOT ID no. 6042656
  misc_feature: Encodes the peptide sequence at SEQ ID NO 5334
atgggaggacgaagatcagtgctcttgctggcgatcatcatcgccatcgccgcggcggtggcgacgccagccgctggggcggtggagggggaggtgaagaagtgtggagggtgctctccctgcggcggcgccgactgcccggtgctgtacccgtcgccgccgccgcccgcgctgcctcccccgccgccgtactactactacagccctccgccgcccgcgacctaccccggggggtccgggtgcccgccgccgccgggcgcgtacatccagatcgggagcacgccgccgggcaagggcccgctgtacccgcaggacccggggttcatgcccaacagcgcgccgggccgcgccgcggcgccgccgccgctcacggtcgtcgtcgtcgtcgctgcgctcgcggcgttggcgtgcgcatgggccgccttcttgtga

SEQ ID NO: 5334 - protein, 143 aa, Sorghum bicolor
  misc_feature: Ceres ANNOT ID no. 6042656
  misc_feature (7)..(130): NCBI GI: 102424 NCBI Desc: collagen-related protein 1 precursor - hydra magnipapillata
  misc_feature (7)..(130): NCBI GI: 9447 NCBI Desc: mini-collagen [hydra sp.]
  misc_feature (47)..(122): NCBI GI: 169349 NCBI Desc: hydroxyproline-rich glycoprotein
  misc_feature (47)..(123): NCBI GI: 1345531 NCBI Desc: extensin (class i) [lycopersicon esculentum]
  misc_feature (47)..(122): NCBI GI: 791146 NCBI Desc: extensin-like protein [vigna unguiculata]
MGGRRSVLLLAIIIAIAAAVATPAAGAVEGEVKKCGGCSPCGGADCPVLYPSPPPPALPPPPPYYYYSPPPPATYPGGSGCPPPPGAYIQIGSTPPGKGPLYPQDPGFMPNSAPGRAAAPPPLTVVVVVAALAALACAWAAFL

SEQ ID NO: 5335 - DNA, 1218 bp, Sorghum bicolor
  misc_feature: Ceres ANNOT ID no. 6042687
  misc_feature: Encodes the peptide sequence at SEQ ID NO 5336
atgcgggcctccgtcgaggaggcgggcgcgctcctggcgcggaccgactcggccggccgccgccgccgccgctcctcgtcgccggtgcggaccgcgtccccgaggcccggtagccttaggcgccactcctcgtcgttccgcgaggacgtcgggcacgccgcctccgagacgtacctcgtctcgcgcctcaccttcaccctcctccagtacctcgggttaggttaccgatggatggcacaactcctttcactcacaatctacgcaattttacttatgccaggattcttacaagttggatattactatttcttttcgagccaggttcgtagaagtgtagtttatggagaccaacccagaaacaggttggatctatacataccagaagataatagtaggccctgcccagtgatggcctttgtaactggtggagcatggattattggttacaaagcatggggtgctcttctaggacgacgattggcagagcgaggaataatagttgcttgcattgattacagaaatttcccacaaggtacaataggcgacatggttcatgatgcttctcagggaatttcttttgtgtgcaacaacattgccagctacggaggagatcctaatcagatctacttgatgggacagtcagcaggtgcacatattgcagcctgtgccctcatggagcaagcagtaaaagaatccggtgggcatcctgtttcttggagtgttacccaaatcaaagcatacttcggtttatctggaggatacaacatgcataatttggtcgaccatttccatcagcgtggtctttatcgctcaatattcctcagcataatggaaggagaggaatcattgtcacgttattctcctgaaattgttgccaagacatcaagtgctgaaaccatagctcttctgcctcttattgttcttatgcatggaactgaagattattcaataccatcatctgccagtcaaacttttgttgacgtcctccagcaagctggtgctcaagcaaggttactattgtacgaagggaaaacacatacagatatctttttacaggaccctcttaggggtggaagagatccattggttgaagacgtgttgtctattattcatgctgatgatgcaattgcacgtcaaaagattgctttagcaccaactccaaagagattagtttatgagtggcaattaaagttggcccgccaaattagtccattctag

SEQ ID NO: 5336 - protein, 405 aa, Sorghum bicolor
  misc_feature: Ceres ANNOT ID no. 6042687
  misc_feature (137)..(351): Pfam Id: Abhydrolase_3 Pfam Desc: alpha/beta hydrolase fold
  misc_feature (3)..(321): NCBI GI: 55297181 NCBI Desc: carboxylesterase-like [oryza sativa (japonica cultivar-group)]
  misc_feature (146)..(405): NCBI GI: 9755631 NCBI Desc: carboxylesterase-like protein [arabidopsis thaliana]
  misc_feature (111)..(255): NCBI GI: 63258317 NCBI Desc: esterase/lipase/thioesterase family protein [pseudomonas syringae pv. syringae b728a]
  misc_feature (108)..(254): NCBI GI: 109896607 NCBI Desc: esterase/lipase/thioesterase family protein [pseudoalteromonas atlantica t6c]
  misc_feature (103)..(255): NCBI GI: 118748873 NCBI Desc: esterase/lipase/thioesterase family protein [marinomonas sp. mwyl1]
MRASVEEAGALLARTDSAGRRRRRSSSPVRTASPRPGSLRRHSSSFREDVGHAASETYLVSRLTFTLLQYLGLGYRWMAQLLSLTIYAILLMPGFLQVGYYYFFSSQVRRSVVYGDQPRNRLDLYIPEDNSRPCPVMAFVTGGAWIIGYKAWGALLGRRLAERGIIVACIDYRNFPQGTIGDMVHDASQGISFVCNNIASYGGDPNQIYLMGQSAGAHIAACALMEQAVKESGGHPVSWSVTQIKAYFGLSGGYNMHNLVDHFHQRGLYRSIFLSIMEGEESLSRYSPEIVAKTSSAETIALLPLIVLMHGTEDYSIPSSASQTFVDVLQQAGAQARLLLYEGKTHTDIFLQDPLRGGRDPLVEDVLSIIHADDAIARQKIALAPTPKRLVYEWQLKLARQISPF

SEQ ID NO: 5337 - DNA, 1539 bp, Sorghum bicolor
  misc_feature: Ceres ANNOT ID no. 6042706
  misc_feature: Encodes the peptide sequence at SEQ ID NO 5338
atggcctccgtctcccccgcggcggccgccgccgcggtctcgggctctcaccacggtcgactcctcctcccatcctccccgcgccgcctccccaggccccgcccgcgccctcgtccgcgcctccgcctcgccgcctgccacgccgacaccctcctcccttcctcatcatcggaggcccgcgcgccgccggcccccgcggtggacccttcctccgaatctgccaccgactgcttcgtcgactggctgcgtgcgcgcggccttcccccaggcaaagtggacatccgggagcggccagtgccctgcttgctcaacggcaaggacctgccgctgcgctacgtcgccgccggcgtcgaccttcaggccggggatgtcgcgttcgaggtgccaatgtcccttgtcgtcacgctggagcgggtgctcggggacgaatcaatcgctgagttgttaacaaacaacaagttatctgagctggcatgcttggcattgtatctcatgtatgagaaaaagcaaggaaaggattcattttggtacccctacattaaggaacttgaccgacatcgaggaagggggcagctagctgttgaatcaccacttctatggactgaaagtgaactggattaccttactggaagccccttgaaggatgaagttgttgctagagatgaggcaataaggagagagtataatgagcttgacacattgtggtttatggcaggttcactatttcagcaatatccttttgacatacctacagaggcttttccatttgaaatattcaagcaggcttttgtggcagtacagtcttgtgtggttcatttgcagaaagttagtttagctcgaaggttcgcgctagttcccttggggccaccactattgacttacaagagcaactgcaaagcgatgttgacagctgatggtgattctgttcgattggtggtggatcggccatataaagccggagaaccaataatcatctggtgtggaccccaaacgaactccaggcttgttctgaattatggttttgttgatgaagacaatccctttgatcgcatagcaattgaggcatctttaaattcagaagatcctcaataccaagaaaagagaatggttgctcagaggaatggaaagcttgctatccaaaattttaatgtctatgtaggtaaagagaaacaaactgttgcagaaatgctgccttatttgagattaggatacatatcagatccagatgaaatgcagtctatactctcatctgaaggggatacatgtccacttagcccatgtacagagcgagctgtacttgatcaacttgttggttacctggaatctcggttggctggttatccaacaactttggatgaagatgaagctatgttggcagatggcagtttggaaccaaagaaggaagttgctactaggcttgtaaggttagagaagaagatgatccatgcctgtctacaggccacaaatgagtttataaacgacttgccagaccacacagtatctccttgccctgctccatatgcccctgaactgaaatga

SEQ ID NO: 5338 - protein, 512 aa, Sorghum bicolor
  misc_feature: Ceres ANNOT ID no. 6042706
  misc_feature (357)..(481): Pfam Id: Rubis-subs-bind Pfam Desc: Rubisco LSMT substrate-binding
  misc_feature (94)..(334): Pfam Id: SET Pfam Desc: SET domain
  misc_feature (36)..(512): NCBI GI: 92872502 NCBI Desc: nuclear protein set [medicago truncatula]
  misc_feature (22)..(491): NCBI GI: 3403238 NCBI Desc: ribulose-1,5-bisphosphate carboxylase/oxygenase small subunit n-methyltransferase ii [spinacia oleracea]
  misc_feature (78)..(491): NCBI GI: 3403236 NCBI Desc: ribulose-1,5-bisphosphate carboxylase/oxygenase small subunit n-methyltransferase i [spinacia oleracea]
  misc_feature (118)..(494): NCBI GI: 8778402 NCBI Desc: f16a14.25 [arabidopsis thaliana]
  misc_feature (111)..(481): NCBI GI: 146162512 NCBI Desc: set domain containing protein [tetrahymena thermophila sb210]
  misc_feature: Useful for making plants with modulated UV sensitivity
  misc_feature: Useful for making plants with modulated biomass
  misc_feature: Useful for making plants with modulated drought sensitivity
  misc_feature: Useful for making plants with modulated heat sensitivity
  misc_feature: Useful for making plants with modulated low light sensitivity
  misc_feature: Useful for making plants with modulated oxidative stress sensitivity
  misc_feature: GREAT-hit functional homolog of the protein sequence given in SEQ ID NO 13434
  misc_feature: GREAT-hit functional homolog of the protein sequence given in SEQ ID NO 13472
  misc_feature: GREAT-hit functional homolog of the protein sequence given in SEQ ID NO 13475
  misc_feature: Useful for making plants with modulated UV sensitivity
  misc_feature: Useful for making plants with modulated low light sensitivity
  misc_feature: Useful for making plants with modulated oxidative stress sensitivity
  misc_feature: Functional homolog of the protein sequence given in SEQ ID NO 13475
MASVSPAAAAAAVSGSHHGRLLLPSSPRRLPRPRPRPRPRLRLAACHADTLLPSSSSEARAPPAPAVDPSSESATDCFVDWLRARGLPPGKVDIRERPVPCLLNGKDLPLRYVAAGVDLQAGDVAFEVPMSLVVTLERVLGDESIAELLTNNKLSELACLALYLMYEKKQGKDSFWYPYIKELDRHRGRGQLAVESPLLWTESELDYLTGSPLKDEVVARDEAIRREYNELDTLWFMAGSLFQQYPFDIPTEAFPFEIFKQAFVAVQSCVVHLQKVSLARRFALVPLGPPLLTYKSNCKAMLTADGDSVRLVVDRPYKAGEPIIIWCGPQTNSRLVLNYGFVDEDNPFDRIAIEASLNSEDPQYQEKRMVAQRNGKLAIQNFNVYVGKEKQTVAEMLPYLRLGYISDPDEMQSILSSEGDTCPLSPCTERAVLDQLVGYLESRLAGYPTTLDEDEAMLADGSLEPKKEVATRLVRLEKKMIHACLQATNEFINDLPDHTVSPCPAPYAPELK

SEQ ID NO: 5339 - DNA, 1428 bp, Sorghum bicolor
  misc_feature: Ceres ANNOT ID no. 6042707
  misc_feature: Encodes the peptide sequence at SEQ ID NO 5340
atggcagccgtcgcccccgtcgtctccgacctcgtcgacttcctcaacgtgtcgcccaccgcctttcacgccgttgacgaggcgaagcggcggctgaaggcggcggggttcgtgcagctctcggagcgggaggagtgggcggggctcgagcctgggcgcaagtacttcttcacacgcaaccattccaccatcgtcgctttcgccatcggcgcaaaatacgttgctggcaatgggtttcacatcatcggtgcacacactgacagcccttgcctcaagctcaaacctgtatccaaggtaaccaaaggaggttaccttgaggttggggttcaaacgtatggtggtggattgtggtacacatggttcgaccgtgatcttactgttgctggtagggtgattacaagggagaagaaggatggcgaggtctcttatgcacacaagcttgtacgggtacaagaaccaattatgaggatacctactttggctattcacctagacaggagtctcaactcagaaggtctcaaggttaacaatcagagtcatcttgttccagtgctggctacatgtatcaagaatgaaatgcagaaatttgtagcagaaaatggcccaaagcagacatccgaaaatgtgaacacaaagcatcatccattactattgcagttgattgctaaagaggctaactgtgagcctgatgagatatgtgactttgaactgcaactatgtgatactcaaccaagtgctgtagcaggtgccatgaaagagttcatcttttcaggaaggctcgacaatctttgcatgtcattttgttcactgaaggccctaatcgactccagttctgttgaacactctcttgaccatgaatctggtgtgcgaatggtagctctatttgaccatgaagaagttggttctgattctgctcagggagctggttcccctgccatgttggatgctttatcaagaatcactgggtcttttaactcttcaaattccaagttgctagaaaaggctattcagaggagctttctggtgtctgctgacatggcacatgctttacaccccaattatatggacaagcatgaggagaaccaccaaccaaaattgcatggaggacttgtaatcaagcataacgctaatcaacgatatgctacaaatgctgtgacagcatttattttccgagaaatcgctgagagacaccaactacctgtacaggattttgttgttcgcaatgacatggcttgtggttcaacaattggcccaatacttgctagtggtgttggtattcgcactgttgatattggagcaccccaattatcaatgcacagcatcagagaaatgtgtgccgttgacgatattagccatgcatatgagcatttcaaggcatattatgaagaatttactgaattggatagcaaggtcaaggtggattactaa

SEQ ID NO: 5340 - protein, 475 aa, Sorghum bicolor
  misc_feature: Ceres ANNOT ID no. 6042707
  misc_feature (14)..(461): Pfam Id: Peptidase_M18 Pfam Desc: Aminopeptidase I zinc metalloprotease (M18)
  misc_feature (7)..(474): NCBI GI: 21537290 NCBI Desc: aspartyl aminopeptidase-like protein [arabidopsis thaliana]
  misc_feature (2)..(474): NCBI GI: 18844846 NCBI Desc: aspartyl aminopeptidase-like protein [oryza sativa (japonica cultivar-group)]
  misc_feature (5)..(474): NCBI GI: 140052881 NCBI Desc: peptidase m18, aminopeptidase i [medicago truncatula]
  misc_feature (3)..(474): NCBI GI: 6912248 NCBI Desc: aspartyl aminopeptidase [homo sapiens]
  misc_feature (3)..(474): NCBI GI: 119591135 NCBI Desc: aspartyl aminopeptidase, isoform cra_b [homo sapiens]
  misc_feature (3)..(474): SWISSPROT Homolog: EC 3.4.11.21 Aspartyl aminopeptidase
MAAVAPVVSDLVDFLNVSPTAFHAVDEAKRRLKAAGFVQLSEREEWAGLEPGRKYFFTRNHSTIVAFAIGAKYVAGNGFHIIGAHTDSPCLKLKPVSKVTKGGYLEVGVQTYGGGLWYTWFDRDLTVAGRVITREKKDGEVSYAHKLVRVQEPIMRIPTLAIHLDRSLNSEGLKVNNQSHLVPVLATCIKNEMQKFVAENGPKQTSENVNTKHHPLLLQLIAKEANCEPDEICDFELQLCDTQPSAVAGAMKEFIFSGRLDNLCMSFCSLKALIDSSSVEHSLDHESGVRMVALFDHEEVGSDSAQGAGSPAMLDALSRITGSFNSSNSKLLEKAIQRSFLVSADMAHALHPNYMDKHEENHQPKLHGGLVIKHNANQRYATNAVTAFIFREIAERHQLPVQDFVVRNDMACGSTIGPILASGVGIRTVDIGAPQLSMHSIREMCAVDDISHAYEHFKAYYEEFTELDSKVKVDY

SEQ ID NO: 5341 - DNA, 726 bp, Sorghum bicolor
  misc_feature: Ceres ANNOT ID no. 6042708
  misc_feature: Encodes the peptide sequence at SEQ ID NO 5342
atggcggcgaatctagaggacgtgccttctctggatctgatgcacgaactgctccgccgcatgaagtgcagctccaagcccgacaagcatctcatccttatcggtccacctggctctggaaagggtactcagtctccccttattaaggatgaatattgcctgtgccatttagccactggtgatatgctgagggctgctgtggcggccaagacacctctaggtatcaaagctaaagaagctatggataagggggagcttgtttcagatggcttggttgtggggcttattgatgaagctatgaagaaaccctcatgccagaaaggtttcattcttgatggcttccctagaactgtcactcaagcacagaagctcgatgagatgttggcaaagcaaggtgctaatgttgacaaggtcctgaactttgcaattgatgatgctatattggaagaacggattactggtcgttggatccacccagccagtggtaggacttaccatacaaaatttgcacctccaaagtctccgggagttgatgatgtaactggagagccattgattcaaaggagagatgacacagccgaggttttgaagtcaaggcttgaagccttccacagacaaaccgagcctgtgattgactattactctaagaagggcttggtggcgaatctgcccgcagagaaaccaccaaaggaagtgactgctgaggtgctgaaagccctctcatga

SEQ ID NO: 5342 - protein, 241 aa, Sorghum bicolor
  misc_feature: Ceres ANNOT ID no. 6042708
  misc_feature (33)..(219): Pfam Id: ADK Pfam Desc: Adenylate kinase
  misc_feature (155)..(190): Pfam Id: ADK_lid Pfam Desc: Adenylate kinase, active site lid
  misc_feature (2)..(241): NCBI GI: 391879 NCBI Desc: adenylate kinase-b [oryza sativa]
  misc_feature (2)..(241): NCBI GI: 92873599 NCBI Desc: adenylate kinase [medicago truncatula]
  misc_feature (1)..(241): NCBI GI: 391877 NCBI Desc: adenylate kinase-a [oryza sativa]
  misc_feature (2)..(241): NCBI GI: 21554270 NCBI Desc: adenylate kinase [arabidopsis thaliana]
  misc_feature (2)..(241): NCBI GI: 3746809 NCBI Desc: adenylate kinase [arabidopsis thaliana]
  misc_feature (2)..(241): SWISSPROT Homolog: EC 2.7.4.3 Adenylate kinase B
MAANLEDVPSLDLMHELLRRMKCSSKPDKHLILIGPPGSGKGTQSPLIKDEYCLCHLATGDMLRAAVAAKTPLGIKAKEAMDKGELVSDGLVVGLIDEAMKKPSCQKGFILDGFPRTVTQAQKLDEMLAKQGANVDKVLNFAIDDAILEERITGRWIHPASGRTYHTKFAPPKSPGVDDVTGEPLIQRRDDTAEVLKSRLEAFHRQTEPVIDYYSKKGLVANLPAEKPPKEVTAEVLKALS

SEQ ID NO: 5343 - DNA, 795 bp, Sorghum bicolor
  misc_feature: Ceres ANNOT ID no. 6042719
  misc_feature: Encodes the peptide sequence at SEQ ID NO 5344
atggccgctggcctctgcccgcgcctccgcaccttattggcctcctctcgcccgctcctggccgcgcgctccggagcgctgcccctacccctgcgccgcgctggcccggccatgcccctcgtcgcacgcgcacgccgcggcttaggctcctccaccgccgcggacccgctcgccgaagacttcgccacggctactgacctccggttcgaatcgccactcgaggtagtcaaataccccgaccccatcctgcgcgcgcgcaacaagcgcatcaacgcgttcgatgccaacctccgcgccctggccgatgagatgttcgacgttatgtacaagaccgatggcattggtctctcagcaccacaagttggagtaaatgtgcagcttatggtattcaatcctgctggggtgaagggggaaggagaggagattgttcttgtcaacccagtggtatacaagtccgcgaaacgattgcttgtgtttgaagaagggtgcttatcgtttcctggaatatatggcaatgtgctgagaccagaaagcgtgaaaattgaagctcaagatgttacaggggctaagatcaaagtaaaattatctggtctacctgcaagagttttccagcatgagtttgatcatttgctggggattcttttctttgatagaatgacaatggatgttcttgaaaccgtacgtgaggaactgaagaacctagagaagaaatacgaggaaagaacaggactagcgagtcctgaaactgttgagaactacgagggtgcaaaagatgtctttagtttttcaagatga

SEQ ID NO: 5344 - protein, 264 aa, Sorghum bicolor
  misc_feature: Ceres ANNOT ID no. 6042719
  misc_feature (72)..(225): Pfam Id: Pep_deformylase Pfam Desc: Polypeptide deformylase
  misc_feature (109)..(264): NCBI GI: 55297586 NCBI Desc: peptide deformylase-like [oryza sativa (japonica cultivar-group)]
  misc_feature (36)..(264): NCBI GI: 17433052 NCBI Desc: peptide deformylase, chloroplast precursor (pdf) (polypeptide deformylase)
  misc_feature (39)..(264): NCBI GI: 11320966 NCBI Desc: peptide deformylase [arabidopsis thaliana]
  misc_feature (39)..(264): NCBI GI: 21553551 NCBI Desc: formylmethionine deformylase [arabidopsis thaliana]
  misc_feature (62)..(240): NCBI GI: 32307482 NCBI Desc: peptide deformylase [bigelowiella natans]
  misc_feature (36)..(264): SWISSPROT Homolog: EC 3.5.1.88 Peptide deformylase, chloroplast precursor
MAAGLCPRLRTLLASSRPLLAARSGALPLPLRRAGPAMPLVARARRGLGSSTAADPLAEDFATATDLRFESPLEVVKYPDPILRARNKRINAFDANLRALADEMFDVMYKTDGIGLSAPQVGVNVQLMVFNPAGVKGEGEEIVLVNPVVYKSAKRLLVFEEGCLSFPGIYGNVLRPESVKIEAQDVTGAKIKVKLSGLPARVFQHEFDHLLGILFFDRMTMDVLETVREELKNLEKKYEERTGLASPETVENYEGAKDVFSFSR

SEQ ID NO: 5345 - DNA, 1599 bp, Sorghum bicolor
  misc_feature: Ceres ANNOT ID no. 6042720
  misc_feature: Encodes the peptide sequence at SEQ ID NO 5346
atgaagctgagagcaaaaggcctcggcctcctgcttctccttgtcctgcttgctatttgctccaccattgaagtcagcgaggcgagaagaggcaagcattggcggtcgtcgaggagctcaccaggctcctctcagctcaagaaaggcaaaggaaagaagagcagctcccgccggcaacacggcagcaaccggccaagtccgaagccaccggtcagctccacgccaagctctggtgctggtaaaggaaatcagaatccataccaaccaagcccgaatgcccctccaagccctgccaatggcagtaggcattccactcccaagctgccgccgacttcaagctgtgggaagggtcatcaacagccatcgcagccgccaccagcaacctcgcagggtgcagtattcaatgtggttgattttggagccaagggtgacggagttacagatgatactaaggcttttgaaggagcgtgggctgctgcctgcaaccagggggcatctacagttctcgtaccaccagaactagagttccttgttgggccaatctcgttctctggaccttactgcaaaccgaatattgtctttcagctggaaggaacaatcctagctccaaccagtgctaaatcctggggttctggcttgctccagtggctggagttcaccaaactaaatggaatagttattcaagggaacggcattataaatgggagagggcaacagtggtggacctacttagacccagaggatgaggatgatgatgacacgtacgatgtggagtttgaaagaatgccacagattaaacctacagcattgaggttttatggtagtttcaacgttgtagtagctggtatcactattgtcaacagctcacagtgccatcttaagtttgacaactgtcaaggagtgatggtccatgacgtgactatatcctcccctgagaacagtctcaacactgacggaatacacctgcagaactccaaagatgtcagcattcatcatacaaacctggcttgtggtgacgactgcatctccatccagacaggatgcagcaacataaatatacacaacgtgaattgtggaccaggccatggaatcagcataggtggactaggtcgagacaacacaaaagcatgtgtatcaaatgttacagtaagagacgtcaacatgttcagaaccatgaatggtgtcagaatcaagacctggcagggtggtgtaggattggttcaagacataaggttctcaaatatacaagtctcagaggttcaaacacccattatcatagatcagttttattgtgacagaagcacttgcagaaatcaaacatcagcagtggcagtatcaggagttcaatatgagaatatcagaggaacatttacaatcaagcctgtccattttgcatgcagtgacagcttaccttgttcaggaatctctcttaccggtgtgcaactcagaccagtgcaagtaccccactaccacctgaataacccattctgctggcaagcttttggggagctctacactccaaccgtccctcccatagcttgcttgcagattggaaaacctgctggcaataacttacagtcatatgacgacatatgctga

SEQ ID NO: 5346 - protein, 532 aa, Sorghum bicolor
  misc_feature: Ceres ANNOT ID no. 6042720
  misc_feature (161)..(497): Pfam Id: Glyco_hydro_28 Pfam Desc: Glycosyl hydrolases family 28
  misc_feature (1)..(532): NCBI GI: 55297585 NCBI Desc: polygalacturonase pg1-like [oryza sativa (japonica cultivar-group)]
  misc_feature (196)..(532): NCBI GI: 55297593 NCBI Desc: polygalacturonase pg1-like [oryza sativa (japonica cultivar-group)]
  misc_feature (223)..(532): NCBI GI: 115465629 NCBI Desc: os05g0578600 [oryza sativa (japonica cultivar-group)]
  misc_feature (111)..(532): NCBI GI: 5669846 NCBI Desc: polygalacturonase pg1 [glycine max]
  misc_feature (134)..(521): NCBI GI: 5669848 NCBI Desc: polygalacturonase pg2 [glycine max]
  misc_feature: Useful for making plants with altered cell wall content and/or composition
  misc_feature: Functional homolog of the protein sequence encoded by LOCUS at1g10640
  misc_feature: Functional homolog of the protein sequence encoded by LOCUS at1g60590
  misc_feature: Functional homolog of the protein sequence encoded by LOCUS at3g26610
  misc_feature: Functional homolog of the protein sequence encoded by LOCUS at5g14650
  misc_feature: Useful for making plants with altered carbohydrate content
  misc_feature: Functional homolog of the protein sequence given in SEQ ID NO 13896
  misc_feature: Useful for making plants with altered cell wall content and/or composition
  misc_feature: Functional homolog of the protein sequence given in SEQ ID NO 13914
  misc_feature: The sequence is a functional homolog of SEQ ID NO. 450 in the 11/188,298 US application
MKLRAKGLGLLLLLVLLAICSTIEVSEARRGKHWRSSRSSPGSSQLKKGKGKKSSSRRQHGSNRPSPKPPVSSTPSSGAGKGNQNPYQPSPNAPPSPANGSRHSTPKLPPTSSCGKGHQQPSQPPPATSQGAVFNVVDFGAKGDGVTDDTKAFEGAWAAACNQGASTVLVPPELEFLVGPISFSGPYCKPNIVFQLEGTILAPTSAKSWGSGLLQWLEFTKLNGIVIQGNGIINGRGQQWWTYLDPEDEDDDDTYDVEFERMPQIKPTALRFYGSFNVVVAGITIVNSSQCHLKFDNCQGVMVHDVTISSPENSLNTDGIHLQNSKDVSIHHTNLACGDDCISIQTGCSNINIHNVNCGPGHGISIGGLGRDNTKACVSNVTVRDVNMFRTMNGVRIKTWQGGVGLVQDIRFSNIQVSEVQTPIIIDQFYCDRSTCRNQTSAVAVSGVQYENIRGTFTIKPVHFACSDSLPCSGISLTGVQLRPVQVPHYHLNNPFCWQAFGELYTPTVPPIACLQIGKPAGNNLQSYDDIC

SEQ ID NO: 5347 - DNA, 1242 bp, Sorghum bicolor
  misc_feature: Ceres ANNOT ID no. 6042749
  misc_feature: Encodes the peptide sequence at SEQ ID NO 5348
atggcgagagaagcagcgagcaaagccaccgcaagccgcggcagcggggcggaggcggaggcggaggcggcagcgggggagtactggagcgaagcgctcaagtcgttcctggaccacatccccgtctcctccgtcccgggcgcgctccaacccaccgcctccccagcggtggaggtcaagctcgacggctccgtcctgggcgccctcgacgccatgtacagcagcaacgccgcgggcgcggtgatcgtcgacgtggtgcagagcagcttcggcaagtacgtcgatcgcgatattggcttcgtcgagttctccagcctagtcctgtgggcgcttgaggaacttggcaaagtggaaagtgaaccaacagacggtacttctgacttcctctctagtctaaaacagcatcatcagattgcggaaacgaagatcgcctggttagcaaagctgttcttatgggagcccttcttccctgttcgaacccaagacacgctcttccacacgatgcttctcttttcgaaacaccacaggcttaacgtggcacctgtcgttgagtcgataaactcaagtgttattggatttgtcacgcagaatgcagtgatggagctgcttctccagtcaagtggccttgagtggcttgataaaattgcagacaagcagctttctgaatttaggtttgcaaatgtgaggaagcctgttttggtgtactcagatcaaactcttgctgatgggctgcatattctctcgaaggaaaaaatgggggttgcagtcattgacaggaaaaccagctgtctaattggatcaatacagtgcagcgatctctacctgtttctggatgatagctcccttttcagcaagcgaacgacaactactttggaagaattcatcgacctgaataacaaggccaacagcaaatgcagcactgctgaagattcatctccacctggtcagaacatcctcgccctcagaaacaggcagccaagtatggtgggcctaccagccaccaacctgaaatccgacaccctgaagcaagcgatggagaagctgacgacttcgaggagcagctgcagcttcatcgtcgacgagcaagggcacgtcgaaggggtggtgacgacaagggacatcatctccgtgttctccccgccgtgcatggattcgaggattgacgggggcacgttcttctcggctgcgctcgagcaggctggctgccgcgttgagaatgggcagatgattcagaactcctag

SEQ ID NO: 5348 - protein, 413 aa, Sorghum bicolor
  misc_feature: Ceres ANNOT ID no. 6042749
  misc_feature (225)..(379): Pfam Id: CBS Pfam Desc: CBS domain pair
  misc_feature (1)..(412): NCBI GI: 58199447 NCBI Desc: yz1 [zea luxurians]
  misc_feature (1)..(412): NCBI GI: 58199444 NCBI Desc: yz1 [zea mays subsp. mexicana]
  misc_feature (1)..(412): NCBI GI: 58199450 NCBI Desc: yz1 [zea mays subsp. parviglumis]
  misc_feature (1)..(412): NCBI GI: 20502802 NCBI Desc: yz1 [zea mays]
  misc_feature (1)..(412): NCBI GI: 20385028 NCBI Desc: yz1 [zea mays]
MAREAASKATASRGSGAEAEAEAAAGEYWSEALKSFLDHIPVSSVPGALQPTASPAVEVKLDGSVLGALDAMYSSNAAGAVIVDVVQSSFGKYVDRDIGFVEFSSLVLWALEELGKVESEPTDGTSDFLSSLKQHHQIAETKIAWLAKLFLWEPFFPVRTQDTLFHTMLLFSKHHRLNVAPVVESINSSVIGFVTQNAVMELLLQSSGLEWLDKIADKQLSEFRFANVRKPVLVYSDQTLADGLHILSKEKMGVAVIDRKTSCLIGSIQCSDLYLFLDDSSLFSKRTTTTLEEFIDLNNKANSKCSTAEDSSPPGQNILALRNRQPSMVGLPATNLKSDTLKQAMEKLTTSRSSCSFIVDEQGHVEGVVTTRDIISVFSPPCMDSRIDGGTFFSAALEQAGCRVENGQMIQNS

SEQ ID NO: 5349 - DNA, 240 bp, Sorghum bicolor
  misc_feature: Ceres ANNOT ID no. 6042834
  misc_feature: Encodes the peptide sequence at SEQ ID NO 5350
atggcgtcgcgtccgtcgctgaagtcgaagcccaagggcaagggcgggaagaagggcggcgccgccgacgaggacgccaccgcggcggcgaccacggtgcggctcgtgaaggagtggaccacgtggacgatgaagaaggccaaggtggtggcgcactacggcttcatcccgctcgtcatcgtcatcggcatgaactccgagcccaagccctccgtcttccagctcctctcccccgtctga

SEQ ID NO: 5350 - protein, 79 aa, Sorghum bicolor
  misc_feature: Ceres ANNOT ID no. 6042834
  misc_feature (37)..(76): Pfam Id: Tom7 Pfam Desc: TOM7 family
  misc_feature (1)..(79): NCBI GI: 50313239 NCBI Desc: tom7-like protein [triticum aestivum]
  misc_feature (10)..(79): NCBI GI: 3319774 NCBI Desc: tom7 protein [solanum tuberosum]
  misc_feature (1)..(79): NCBI GI: 13605535 NCBI Desc: at5g41690/mbk23_23 [arabidopsis thaliana]
  misc_feature (8)..(79): NCBI GI: 115465693 NCBI Desc: os05g0583400 [oryza sativa (japonica cultivar-group)]
  misc_feature (1)..(79): NCBI GI: 15222645 NCBI Desc: preprotein translocase-related [arabidopsis thaliana]
  misc_feature: The plant flowers significantly late compared to wild-type.
  misc_feature: Useful for making plants with modulated flowering time
  misc_feature: Functional homolog of the protein sequence given in SEQ ID NO 13540
  misc_feature: Useful for making plants with modulated flowering time
  misc_feature: Functional homolog of the protein sequence given in SEQ ID NO 13540
MASRPSLKSKPKGKGGKKGGAADEDATAAATTVRLVKEWTTWTMKKAKVVAHYGFIPLVIVIGMNSEPKPSVFQLLSPV

SEQ ID NO: 5351 - DNA, 1095 bp, Sorghum bicolor
  misc_feature: Ceres ANNOT ID no. 6042855
  misc_feature: Encodes the peptide sequence at SEQ ID NO 5352
atggccgcgtcggatctggagagcaaggccaaggaggccttcgtcgacgacgacttcgagctggccgccgagctctacacccaggccatcgacgcggggcccgccaccgccgaactctacgccgaccgcgcccaggcgcacatcaagctcggcaactacactgaggctgtggcggatgctaacaaagcaattgaacttgatcctacgatgcataaagcctactaccggaaaggtgctgcatgcattaagcttgaagaataccaaactgcaaaggctgctcttgagttgggttcttcctatgcatcaggcgattcaaggtttactcgtctattgaaagaatgtgaagagcgcattgctgaggaatctagccaggctccagcaaagaatgttgagcctcctgtggctgctgctgctgctactgttgaggacaaggaggatgtcgcaaatatggagaatacaccgccagtggtagaacccccaagcaaacctaaatacaggcatgactactacaacagtgccacagaagtggttttgacaatatttgctaagggtgttcccgctgatagtgtagtcattgattttggtgaacagatgttaagtgtgtccattgaagtccctggtgaagaaccataccattttcagccccgtctgtttgctaagattatccctgagaaatgcaaatatcaagtcttgtccaccaaggtcgaaatacgccttgcaaaagctgagcaggtgacatggacaaccctggattatagcggaagaccaaaggctgttccccagaagataagcacgccagctgaaacagccccaagaccttcatacccatcttcaaaggcaaaaaaagactgggataaactggaagctgaagtcaaaaaggaggagaaggaagaaaaacttgatggtgatgctgcattgaacaaattcttccgtgacatctacaaggatgctgatgaagatatgcggagggccatgatgaagtcattcgtggaatctaatggcactgttctctcaaccaattggaaagatgttggatcaaagaaggtggaagggagccctcctgatggtatggagctcaagaagtgggaatactaa

SEQ ID NO: 5352 - protein, 364 aa, Sorghum bicolor
  misc_feature: Ceres ANNOT ID no. 6042855
  misc_feature (281)..(362): Pfam Id: SGS Pfam Desc: SGS domain
  misc_feature (165)..(241): Pfam Id: CS Pfam Desc: CS domain
  misc_feature (37)..(70): Pfam Id: TPR_2 Pfam Desc: Tetratricopeptide repeat
  misc_feature (37)..(70): Pfam Id: TPR_1 Pfam Desc: Tetratricopeptide repeat
  misc_feature (2)..(364): NCBI GI: 115438681 NCBI Desc: os01g0624500 [oryza sativa (japonica cultivar-group)]
  misc_feature (2)..(364): NCBI GI: 6581058 NCBI Desc: sgt1 [oryza sativa]
  misc_feature (2)..(364): NCBI GI: 17017306 NCBI Desc: sgt1 [hordeum vulgare]
  misc_feature (2)..(364): NCBI GI: 126544454 NCBI Desc: sgt1-1 [triticum aestivum]
  misc_feature (2)..(364): NCBI GI: 126544456 NCBI Desc: sgt1-2 [triticum aestivum]
MAASDLESKAKEAFVDDDFELAAELYTQAIDAGPATAELYADRAQAHIKLGNYTEAVADANKAIELDPTMHKAYYRKGAACIKLEEYQTAKAALELGSSYASGDSRFTRLLKECEERIAEESSQAPAKNVEPPVAAAAATVEDKEDVANMENTPPVVEPPSKPKYRHDYYNSATEVVLTIFAKGVPADSVVIDFGEQMLSVSIEVPGEEPYHFQPRLFAKIIPEKCKYQVLSTKVEIRLAKAEQVTWTTLDYSGRPKAVPQKISTPAETAPRPSYPSSKAKKDWDKLEAEVKKEEKEEKLDGDAALNKFFRDIYKDADEDMRRAMMKSFVESNGTVLSTNWKDVGSKKVEGSPPDGMELKKWEY

SEQ ID NO: 5353 - DNA, 2358 bp, Sorghum bicolor
  misc_feature: Ceres ANNOT ID no. 6042862
  misc_feature: Encodes the peptide sequence at SEQ ID NO 5354
atggaggcatcatcttccttgtgctcccaagtttctggttttagtttgcccaagatatggctatgcctttttctggtacttgttcttcagaactgcagcccagcactttcagattcaccatatttggtgggtatggggagctatgacataacaggaccagcagcagatgttaacatgatgggatatgcaaattctgagcagatcgcatcaggaattcactttaggctaaaggctcgtgcgtttatcgttgctgagcctaatggcaagcgtgttgtgtttgtaaatcttgatgcttgcatggcatcacagattgttacaataaaggtgcttgaaaggctcaaaggaaggtatggagatctttataatgagaataatgtggctatcagtggaatccatacacatgctggtcctggtggttatctgcagtatgtagtttatattgtcacatcacttgggtttgttcgtcaatcatttgatgtgattgtcaatggaattgagcaatgcattgttgaggctcacaacaatctccatcctgggaaaatctatgtgaacaaaggtgacatccttgatgctggtgtgaatcgcagcccaagtgcatacctaaataaccctgctgaagagagaggcaagtataagtataatgttgatacagaaatgaccctcgtcaagtttgtagatgacgaatctggtccggttgggagtttcaattggtttgcaactcatggaacatctatgagtcgtacaaattctttgataagtggtgataacaaaggagcagctgcacgtttcatggaagattgggcagaacaaaatggcattccaaaacaggcagctcctgtaaatcatgatggtccggaatctttacacatggcctctggacttccgagaagagtctcttcaataattcctgaaccaaatgagataactgatgacttagtacaattggcgtcatcctacgaagcctcaggtggccgacgattatctggttcaagtatcaccaggcgcattagaagcgctcaacaaaacagacctaaatttgtttctgcattctgccagtcaaattgtggtgatgtcagtccaaatgtcctgggaactttctgtatagacactggccttccttgtgacttcaatcacagcacatgcaatgggaagaatgaactatgctatggacgaggaccaggatatcctgatgaatttgaaagtacccgtatcattggcaataggcagtttcaaaaggctgtagatctttttaattcagcttctgaagaaatacaaggcaaagttgagtttaggcatacttacctagatttctcgcaacttgaagtgaatattcctacaagtacaggaggtcagcaagttgtgaaaacatgcccagcagccatggggtttgcctttgccgctggaaccacagatggtcctggagcttttgacttcaaacaaggagatgccaagggaaatgctttctggaggttagtaagaaacttacttaaggaaccagggaaggagcaagttaaatgtcaagcaccaaaacctatcttgctagatactggtgaaatgaaggaaccatatgattgggcacctgcaattcttccaattcagatcataagaattggccagctggttatcttgtgtgtccctggagaattcacaacaatggctggcaggaggctacgtgatgctgtcaaaactgtacttgcaagtgacaacagtggtgaatttaataatattcatgttgttcttgcggggctaacaaatacctattctcagtatattacaacttttgaagaatatcagatccaaagatacgagggagcatcaacgttgtatggcccccacaccttgagtgcctacattcaggagtttcagaaacttgctacagccatggttgcagacaaagaggtcccaacaaaatttcagcccccagatatgttggacaagcaaataggactcctcccaggtgttgtgtttgactccacacctcatggggtgaagtttggagatgtcagttcagatgttccagcaagctcaactttcagtaagggcagtattgtgaatgctacattctattcagcctgcccaaggaatgaccttctcacagatggtacattcgcacttgttgagaagctggagggtaccgacaactgggttcctgcctatgatgacgacgactggtcactacgcttcaagtggtcaagaccttcaaagttgagttcaagaagctttgcaacgctggaatggaccattcctgaagatgccccatcgggtgtttatagattgaggcattttggtgcctccaaaccactgattgggtccatcaaccattttacagggacctctcgggctttcgcagtgcgttag

SEQ ID NO: 5354 - protein, 785 aa, Sorghum bicolor
  misc_feature: Ceres ANNOT ID no. 6042862
  misc_feature (40)..(785): Pfam Id: Ceramidase_alk Pfam Desc: Neutral/alkaline non-lysosomal ceramidase
  misc_feature (1)..(785): NCBI GI: 115438677 NCBI Desc: os01g0624000 [oryza sativa (japonica cultivar-group)]
  misc_feature (15)..(784): NCBI GI: 42569717 NCBI Desc: ceramidase family protein [arabidopsis thaliana]
  misc_feature (312)..(784): NCBI GI: 42571109 NCBI Desc: ceramidase family protein [arabidopsis thaliana]
  misc_feature (26)..(784): NCBI GI: 15222380 NCBI Desc: ceramidase family protein [arabidopsis thaliana]
  misc_feature (26)..(770): NCBI GI: 8778548 NCBI Desc: f22g5.28 [arabidopsis thaliana]
  misc_feature (15)..(784): SWISSPROT Homolog: EC 3.5.1.23 Neutral ceramidase precursor
MEASSSLCSQVSGFSLPKIWLCLFLVLVLQNCSPALSDSPYLVGMGSYDITGPAADVNMMGYANSEQIASGIHFRLKARAFIVAEPNGKRVVFVNLDACMASQIVTIKVLERLKGRYGDLYNENNVAISGIHTHAGPGGYLQYVVYIVTSLGFVRQSFDVIVNGIEQCIVEAHNNLHPGKIYVNKGDILDAGVNRSPSAYLNNPAEERGKYKYNVDTEMTLVKFVDDESGPVGSFNWFATHGTSMSRTNSLISGDNKGAAARFMEDWAEQNGIPKQAAPVNHDGPESLHMASGLPRRVSSIIPEPNEITDDLVQLASSYEASGGRRLSGSSITRRIRSAQQNRPKFVSAFCQSNCGDVSPNVLGTFCIDTGLPCDFNHSTCNGKNELCYGRGPGYPDEFESTRIIGNRQFQKAVDLFNSASEEIQGKVEFRHTYLDFSQLEVNIPTSTGGQQVVKTCPAAMGFAFAAGTTDGPGAFDFKQGDAKGNAFWRLVRNLLKEPGKEQVKCQAPKPILLDTGEMKEPYDWAPAILPIQIIRIGQLVILCVPGEFTTMAGRRLRDAVKTVLASDNSGEFNNIHVVLAGLTNTYSQYITTFEEYQIQRYEGASTLYGPHTLSAYIQEFQKLATAMVADKEVPTKFQPPDMLDKQIGLLPGVVFDSTPHGVKFGDVSSDVPASSTFSKGSIVNATFYSACPRNDLLTDGTFALVEKLEGTDNWVPAYDDDDWSLRFKWSRPSKLSSRSFATLEWTIPEDAPSGVYRLRHFGASKPLIGSINHFTGTSRAFAVR

SEQ ID NO: 5355 - DNA, 1215 bp, Sorghum bicolor
  misc_feature: Ceres ANNOT ID no. 6042866
  misc_feature: Encodes the peptide sequence at SEQ ID NO 5356
atggctcgctccaacgcttactccctagtgctgctgctgctctattgctacgtttcgtcaggtgcagctgaagcggcggcgtacaatgtcgccggtttcggagcgaagcctggcggccggacggactcgtccggcgcgttcgccagtgcctggtccgccgcttgccgatcacaggagccggccaccgtgtacgtgccgaacgggcacttcctgctcagccgtgcggccttcaccggcccatgctccagcagcagggtgacgcttcaggtcgatggtacgcttgttgcgccatcaggctacaccagccgtggcggcagctctggcggggacgacgacggctggatcgtgttcgaccacgtcgacggcctcaccgtgtcgggcggcaccgtcgacggccgcggcgaggcgctgtgggcgtgcaaggcagccgggcacagcggctgccccagcggagcgacatcgctgaaggtgctgaactcgagggacgtggtgatcagcggcctgacctcggtcgacagcgagctgtaccacgtcgtgatcaacggctgcgagggcgtcacggtgcaggacgtacagatcgtcgcgccgggaagcagccccaacacggacgggatccacgtgcagggctcgtcccaggtcacggtcacccggaccggcatccagaccggggacgactgcgtctcggtcggccccggcaccagcaacctgcgcgtcgagcacgtcagctgcggcccgggccatggcataagcatagggagcctggggaaggagagcgaggagagtggcgtggagaacgtgacggtgacgggggccgccttcgtcggcaccgagaacgggctgcggatcaagacgtgggcgcgggccaaggtggagggcgcgtacgtgcgcggcgtcgccttcgagcacgcgctcatgcacgacgtgcgcaaccccatcatcatcgaccagagctactgccccaaccacggccgcggcgcgggctgcccccatcagagctcggccgtgaagatcagcgacgtgaggtacacggacatccaggggacgtcggcgtccaaggtggcggtgaagttcgactgcagcgcgagcaacccgtgcagcgggatcggcctcaaggacatcaagctcaccttggacggcggaaagccggcagaggcgacctgccagcacgcggacggcagggcttccggcgaagtcgagcctccaagttgcctgtag

SEQ ID NO: 5356 - protein, 404 aa, Sorghum bicolor
  misc_feature: Ceres ANNOT ID no. 6042866
  misc_feature (55)..(403): Pfam Id: Glyco_hydro_28 Pfam Desc: Glycosyl hydrolases family 28
  misc_feature (1)..(404): NCBI GI: 115438675 NCBI Desc: os01g0623600 [oryza sativa (japonica cultivar-group)]
  misc_feature (3)..(404): NCBI GI: 87242603 NCBI Desc: polygalacturonase [prunus domestica subsp. insititia]
  misc_feature (3)..(404): NCBI GI: 3747093 NCBI Desc: endopolygalacturonase [prunus persica]
  misc_feature (11)..(403): NCBI GI: 51507375 NCBI Desc: polygalacturonase [pyrus communis]
  misc_feature (3)..(404): NCBI GI: 85680276 NCBI Desc: endo-polygalacturonase [prunus persica]
  misc_feature (3)..(404): SWISSPROT Homolog: EC 3.2.1.15 Polygalacturonase precursor
  misc_feature: Useful for making plants with altered cell wall content and/or composition
  misc_feature: Functional homolog of the protein sequence encoded by LOCUS at1g05650
  misc_feature: Functional homolog of the protein sequence encoded by LOCUS at1g05660
  misc_feature: Functional homolog of the protein sequence encoded by LOCUS at1g65570
  misc_feature: Functional homolog of the protein sequence encoded by LOCUS at1g80140
  misc_feature: Functional homolog of the protein sequence encoded by LOCUS at2g43860
  misc_feature: GREAT-hit functional homolog of the protein sequence encoded by LOCUS at2g43870
  misc_feature: Functional homolog of the protein sequence encoded by LOCUS at2g43890
  misc_feature: GREAT-hit functional homolog of the protein sequence encoded by LOCUS at3g59850
  misc_feature: Useful for making plants with altered cell wall content and/or composition
  misc_feature: Functional homolog of the protein sequence given in SEQ ID NO 13915
MARSNAYSLVLLLLYCYVSSGAAEAAAYNVAGFGAKPGGRTDSSGAFASAWSAACRSQEPATVYVPNGHFLLSRAAFTGPCSSSRVTLQVDGTLVAPSGYTSRGGSSGGDDDGWIVFDHVDGLTVSGGTVDGRGEALWACKAAGHSGCPSGATSLKVLNSRDVVISGLTSVDSELYHVVINGCEGVTVQDVQIVAPGSSPNTDGIHVQGSSQVTVTRTGIQTGDDCVSVGPGTSNLRVEHVSCGPGHGISIGSLGKESEESGVENVTVTGAAFVGTENGLRIKTWARAKVEGAYVRGVAFEHALMHDVRNPIIIDQSYCPNHGRGAGCPHQSSAVKISDVRYTDIQGTSASKVAVKFDCSASNPCSGIGLKDIKLTLDGGKPAEATCQHADGRASGEVEPPSCL

SEQ ID NO: 5357 - DNA, 2475 bp, Sorghum bicolor
  misc_feature: Ceres ANNOT ID no. 6042868
  misc_feature: Encodes the peptide sequence at SEQ ID NO 5358
atggagaataatagtagcaatagtagcttgtttgtgtccgcaataggcataggtgtaggattgggtgtcggccttggcctggcatcgacacaactcatggcatcttcaccaagagggggtaggaccttgggtggtggtgcaacaactacagaaatcgaatcagagcttcgatgcctccttgtcgatgggcaagagaccaaaatttccttttcaaacttcccatattatctcagcgaggaaacgaggctagcactcatgagcgcagcatttccctacctgagtcaaactattctgccaaagaacattgaagtattcaaggactcaagccgcaccatactactttgcggtcaatcagagacatgcctgcagtcacttgctaaggccattgcgaaccaattcaatgcacgtttgttaccactggatatgtttgagttctcgcatcagatccaacagaaatatggtggctcaagcaatgcacaggttcctataagatccaaaactatgtcagctttggaaaaagtgtatgattttgttggatcattaaggatattttgcaagaaggatgagtcagcaggatcagtggatcatgtaaagagtaatcatgatttaaacacaagatgtgttcattgtaagaacatgaagtcagttggggaatacacaaccttattatctaatgaaaaaaacaaagactcagaatccaatgatgatgacgacgacgacgacgacgatgatgatgatgatgatgatgatgatgatgatgatgatgatgatggtagtggtggttttggtgttccagtatggaacttggatgtggaaattctcttacagtgcctttacaagatcattgtttcggcttctgcatgtagccctgttattctttatatcagggatgttgatattatccttcgtagttcaccgagagcattttgtatgttccagaagatgttgaacaaacaatttggaagagttttgataatcggttcgcacttccttgatgataatcaagatagtgatgacattaataaggatctgactaatctattcccatacatcctggagaccaagccacccaatgaagaggctcatcttcagagatggacaagacaaatgcgaaatgatatgataaaagctcgggatgaaatccttaaacatcaaattgtagggggtttgtcatcatataatttggagtgtgatgatttgagttctatctccctacatgattatgtagaaattgcaagttacctagaggatattttagccccagcagtctcataccatttgatgaatacccaggaccctaagtacagaaatggaaggcttattctatcttcaacgagaatttttcaagaaagtaaccttgagaaagattcggttgaaacgaaagacgactcaaaggtcactaaatacaatgaatatgagaagcagataagagaattagtcatccctgccagtgaaataggagtgacatttgatgatattggagcactagctgatatcaaagaatcaatttgggagcttgtcatgcttccacttcaacggcctgatctcttcagtggtggtctattaaaaccatgtcggggaattctattgtttggaccacctggaacgggtaaaactatgcttgctaaagctatagccaatgaagctggtgctagcttcatgaacatttcaatgtccaccatcatgtcaaaatggtgtggagaggccgagaagagcatccaagcattgttcagtttagctgccaaaattgcaccagccatcattttcatggacgaggtagacagcttgctagggacacgtgaacgttcaaatgaaaatgaggtatcaaggaggatcaagaatgaattcatgatgcattgggatggagtcttgtccaaaccaagtgaaaacattcttgtcctcgctgcaacaaaccgaccttttgaccttgacaatgcaatcatcaggcggtttgagcacaggataatggttggtctccctactcttaagagtagagagctaattttgcacaagttgctttccaaagaaaacattgaaggtatagacttcaaggaacttggcaaaatgactgatggatatagcggtagtgatctaaagaatctttgtgtggcggccgcttatcgtcctattcgagagctacttcaaaaagaaaaacaaatggagaaggacaagaaggaaaaggaagtgaaagggaataatgtgcatgttgagaacccacaaaatgaagaaagcaagaaggaaaagtcaaaagataggaaagacatggaagccatttcagaggaggaggacgaggatgaaatcaatgaggcaatcacccttaggccattaaccatggaggacctgaagcaggccaaagatgaagtctctgcaagctttgctagtgatggtgtaatcatgaatgagatcaagcaatggaatgagctatatggaaaaagtgggtcaaggaataggcaaaagctaacatacttcctgtag

SEQ ID NO: 5358 - protein, 824 aa, Sorghum bicolor
  misc_feature: Ceres ANNOT ID no. 6042868
  misc_feature (527)..(711): Pfam Id: AAA Pfam Desc: ATPase family associated with various cellular activities(AAA)
  misc_feature (470)..(824): NCBI GI: 92870453 NCBI Desc: aaa atpase, central region; dead/deah box helicase, n-terminal [medicago truncatula]
  misc_feature (443)..(824): NCBI GI: 6692099 NCBI Desc: f22c12.12 [arabidopsis thaliana]
  misc_feature (443)..(783): NCBI GI: 30696968 NCBI Desc: aaa-type atpase family protein [arabidopsis thaliana]
  misc_feature (443)..(783): NCBI GI: 30102500 NCBI Desc: at1g64110/f22c12_22 [arabidopsis thaliana]
  misc_feature (443)..(718): NCBI GI: 17065032 NCBI Desc: similar to homeobox protein [arabidopsis thaliana]
  misc_feature: The sequence is a functional homolog of SEQ ID NO. 471 in the 11/188,298 US application
  misc_feature: The sequence is a functional homolog of SEQ ID NO. 462 in the 11/188,298 US application
MENNSSNSSLFVSAIGIGVGLGVGLGLASTQLMASSPRGGRTLGGGATTTEIESELRCLLVDGQETKISFSNFPYYLSEETRLALMSAAFPYLSQTILPKNIEVFKDSSRTILLCGQSETCLQSLAKAIANQFNARLLPLDMFEFSHQIQQKYGGSSNAQVPIRSKTMSALEKVYDFVGSLRIFCKKDESAGSVDHVKSNHDLNTRCVHCKNMKSVGEYTTLLSNEKNKDSESNDDDDDDDDDDDDDDDDDDDDDDDGSGGFGVPVWNLDVEILLQCLYKIIVSASACSPVILYIRDVDIILRSSPRAFCMFQKMLNKQFGRVLIIGSHFLDDNQDSDDINKDLTNLFPYILETKPPNEEAHLQRWTRQMRNDMIKARDEILKHQIVGGLSSYNLECDDLSSISLHDYVEIASYLEDILAPAVSYHLMNTQDPKYRNGRLILSSTRIFQESNLEKDSVETKDDSKVTKYNEYEKQIRELVIPASEIGVTFDDIGALADIKESIWELVMLPLQRPDLFSGGLLKPCRGILLFGPPGTGKTMLAKAIANEAGASFMNISMSTIMSKWCGEAEKSIQALFSLAAKIAPAIIFMDEVDSLLGTRERSNENEVSRRIKNEFMMHWDGVLSKPSENILVLAATNRPFDLDNAIIRRFEHRIMVGLPTLKSRELILHKLLSKENIEGIDFKELGKMTDGYSGSDLKNLCVAAAYRPIRELLQKEKQMEKDKKEKEVKGNNVHVENPQNEESKKEKSKDRKDMEAISEEEDEDEINEAITLRPLTMEDLKQAKDEVSASFASDGVIMNEIKQWNELYGKSGSRNRQKLTYFL

SEQ ID NO: 5359 - DNA, 1215 bp, Sorghum bicolor
  misc_feature: Ceres ANNOT ID no. 6042888
  misc_feature: Encodes the peptide sequence at SEQ ID NO 5360
atgatgcctccgacggccaccgcgacggccgtcttcctctccgcggcgcccccctctttctcaacccgccgtcggcgcagccgccttcctgccatctccgcatccctttcgccgtcctcctcctcttcctcctccgaggagccgctgctggtgcgcgcggcgcggggcgaggacgggctcccgcgcccgcccgcgtggatgatgcggcaggcggggcggtacatggcggagtaccaggcgctggccaagcgccacccctcgttccgggagcgctccgagaacacggacctcatcgtcgagatcacgctgcagccgtggcgtgccttcgcgcccgacggcgtcatcctgttctcggacatactcacgcccctgccggccatcggggtgcccttcgatatctccgactccaaggggcccgtgatccaatccccagtgcggtccgaagagcaggtgagggagctcgtccccatcgaccttgatatgctccagttcgtcggggagtcgctaaagattctgcgaaatgagattgatggaaaagctgctttgctaggatttgtgggggccccatggacaattgcaacttacgttgttgaaggggggatgaccaacacatacacaaatataaagagcatgtgccatacagctccagatgtcttgaggagtcttctttctcaccttgcacaagcgatatctgactatatcatttaccaagttaactctggggcccagtgtatacagatatttgattcatggggtggacaacttccacctcatgtgtgggagcagtggtcaaaaccatatatcaaacagattgtgagtaggattaagaaagagtgccctcatgtaccccttgtgttgtatataaatggaaatggaggtttacttgagcgcatgaaggacacaggagttgatgttattgggcttgactggacagtggacatgtctgatggaaggaggcgccttggtaatggaattagtgtacaagggaatgtggatccagcatttctgttctcaccattaccagtactgactgatgaaattcatagggttgtgaaatcagctggtccaaaaggtcatatacttaacctgggccatggtgtacttcagaaaacacctgaagaagctgtagcacatttctttgatgtcacaaggagcttgagatatgacacccttttccaaggttctgttgccgaagaactgcagcctgttgcttga

SEQ ID NO: 5360 - protein, 404 aa, Sorghum bicolor
  misc_feature: Ceres ANNOT ID no. 6042888
  misc_feature (45)..(386): Pfam Id: URO-D Pfam Desc: Uroporphyrinogen decarboxylase (URO-D)
  misc_feature (30)..(397): NCBI GI: 140038632 NCBI Desc: uroporphyrinogen decarboxylase (uro-d) [medicago truncatula]
  misc_feature (31)..(402): NCBI GI: 16323119 NCBI Desc: at3g14930/k15m2_7 [arabidopsis thaliana]
  misc_feature (42)..(388): NCBI GI: 144924281 NCBI Desc: uroporphyrinogen decarboxylase (uro-d) [medicago truncatula]
  misc_feature (42)..(396): NCBI GI: 119485171 NCBI Desc: uroporphyrinogen decarboxylase [lyngbya sp. pcc 8106]
  misc_feature (45)..(386): NCBI GI: 113475390 NCBI Desc: uroporphyrinogen decarboxylase [trichodesmium erythraeum ims101]
  misc_feature (6)..(388): SWISSPROT Homolog: EC 4.1.1.37 Uroporphyrinogen decarboxylase, chloroplast precursor
MMPPTATATAVFLSAAPPSFSTRRRRSRLPAISASLSPSSSSSSSEEPLLVRAARGEDGLPRPPAWMMRQAGRYMAEYQALAKRHPSFRERSENTDLIVEITLQPWRAFAPDGVILFSDILTPLPAIGVPFDISDSKGPVIQSPVRSEEQVRELVPIDLDMLQFVGESLKILRNEIDGKAALLGFVGAPWTIATYVVEGGMTNTYTNIKSMCHTAPDVLRSLLSHLAQAISDYIIYQVNSGAQCIQIFDSWGGQLPPHVWEQWSKPYIKQIVSRIKKECPHVPLVLYINGNGGLLERMKDTGVDVIGLDWTVDMSDGRRRLGNGISVQGNVDPAFLFSPLPVLTDEIHRVVKSAGPKGHILNLGHGVLQKTPEEAVAHFFDVTRSLRYDTLFQGSVAEELQPVA

SEQ ID NO: 5361 - DNA, 1749 bp, Sorghum bicolor
  misc_feature: Ceres ANNOT ID no. 6042910
  misc_feature: Encodes the peptide sequence at SEQ ID NO 5362
atgacaatctgcagtagtgaagaaatcattgatgagtttgagttgctaacgcgtgatgctaaacgcgtgcagcaggatacattgagaaagattcttgaactgaatggtgatgctgagtatctgaatcgcttcaatcttggaaggagaacagattcaaagagctttaaatcctgcattcctctatgtgtgcatagtgacatagagtcctacatccagaggatagccgatggagatgactcactggtgctaactgggaagcccatcacttccctctccgtaagttctggtacgacgcagggaaaacccaagtttttgccattcaatgatgaattgcttgagagtacagttcaaatattccgaacctcatatgcttttagaaatcgtgaatatcctattggcaatggaaaagccttgcagtttgtttatgggagcaagcaagtcttcacccaagggggcattcttgctacaactgcgacaacaaatttgtacaggagtcggcgtttcaaggaagcaatgaaggatatcatgtctcagtgctgcagtcctgatgaagtcatctttggtcctgacttccatcagtctttgtactgccatctattatgcgggttaatctactcagatgaagttcagtttgttttctcgccatttgcacacagcctcgtccatgcatttcacaccctcgaggaggtatgggaagatctatgtgctgatataagagatggtgttctctcaaagagagtcaccacaccttctatccgccaagctgtttcaaaaatcttgaggccgaatcctgagcttgctagctcgatttacattaagtgccagaatctgagtaattggtatggggtaattccaacactatggccaaatgccaagtacatctatggcattatgacagggtccatggagccatacctaaagaaactgagacattatgctggtcacttaccactgatgagtgctgactatggtgcatctgaaggatgggttggttctaatgtaaacccaaccctgccgcctgaggaggtgacatatgctgttcttccgaatattgcttattttgagttcattcctctggaaaaaacgaaaggcgacgaaatggagaacagttcctctattcactacatagagtcagagcctgttggcctaactgaagttgaggttggcaaaatctacgaagttgtaataacaaattttgcaggtctataccgatacagactgggagatattgtggagatagcgggcttccataactcgacaccagagctccagttcatctgccgcagaagtctagtcctcagcatcaacatcgacaagaacacagagaaagacctgcagctagccgtcgaagaggcggagaagctcttggccgcggagaaggtggaggtggtggacttcacgagcctcgtggacagatcgagcgacccagggcactacgtcatcttctgggagctgagctccgacagcgccagcgaagatgtcctgatcggctgcgccaacagcatggacctggcctttgtggacgccgggtacgtcgggtcgaggaagatcaagaccatcggcgccctcgagctccgggtgctccggaagggaaccttcgggcaggtcatggaccactacctgagcctcggcggcgccgtcagccagttcaagacgccgcggttcgtgagccagtccaacagcaaggtgctgcagatactgagcaggaacgtcacccagtgctacttcagcactgcatatgggctctga

SEQ ID NO: 5362 - protein, 582 aa, Sorghum bicolor
  misc_feature: Ceres ANNOT ID no. 6042910
  misc_feature (8)..(566): Pfam Id: GH3 Pfam Desc: GH3 auxin-responsive promoter
  misc_feature (1)..(581): NCBI GI: 75123648 NCBI Desc: probable indole-3-acetic acid-amido synthetase gh3.5 (auxin-responsive gh3-like protein 5) (osgh3-5)
  misc_feature (7)..(580): NCBI GI: 86212374 NCBI Desc: jasmonic acid-amino acid-conjugating enzyme [nicotiana attenuata]
  misc_feature (74)..(580): NCBI GI: 145331421 NCBI Desc: jar1 (jasmonate resistant 1) [arabidopsis thaliana]
  misc_feature (5)..(428): NCBI GI: 82592859 NCBI Desc: probable indole-3-acetic acid-amido synthetase gh3.3 (auxin-responsive gh3-like protein 3) (osgh3-3)
  misc_feature (5)..(428): NCBI GI: 113531961 NCBI Desc: os01g0221100 [oryza sativa (japonica cultivar-group)]
  misc_feature: Useful for making plants with modulated light quality sensitivity
  misc_feature: Functional homolog of the protein sequence given in SEQ ID NO 13895
MTICSSEEIIDEFELLTRDAKRVQQDTLRKILELNGDAEYLNRFNLGRRTDSKSFKSCIPLCVHSDIESYIQRIADGDDSLVLTGKPITSLSVSSGTTQGKPKFLPFNDELLESTVQIFRTSYAFRNREYPIGNGKALQFVYGSKQVFTQGGILATTATTNLYRSRRFKEAMKDIMSQCCSPDEVIFGPDFHQSLYCHLLCGLIYSDEVQFVFSPFAHSLVHAFHTLEEVWEDLCADIRDGVLSKRVTTPSIRQAVSKILRPNPELASSIYIKCQNLSNWYGVIPTLWPNAKYIYGIMTGSMEPYLKKLRHYAGHLPLMSADYGASEGWVGSNVNPTLPPEEVTYAVLPNIAYFEFIPLEKTKGDEMENSSSIHYIESEPVGLTEVEVGKIYEVVITNFAGLYRYRLGDIVEIAGFHNSTPELQFICRRSLVLSINIDKNTEKDLQLAVEEAEKLLAAEKVEVVDFTSLVDRSSDPGHYVIFWELSSDSASEDVLIGCANSMDLAFVDAGYVGSRKIKTIGALELRVLRKGTFGQVMDHYLSLGGAVSQFKTPRFVSQSNSKVLQILSRNVTQCYFSTAYGL

SEQ ID NO: 5363 - DNA, 975 bp, Sorghum bicolor
  misc_feature: Ceres ANNOT ID no. 6042919
  misc_feature: Encodes the peptide sequence at SEQ ID NO 5364
atgacgacggagcggcaggtggcggagctgggtcccgggacggcgtgctgcggctggaactactgcggccgccgcctcgccgctggcgccgtcgacggctccgtctccgtctatgactcccagccgtccccctcgttcaagtggcaggcccatgagcaagccattgtgaatgtcgtctggcttcctccagagtatggggatgctatagcttgtgcttgtgctgatgggacactgtctttgtgggaggaggttgctgctgacgatcaacttccaacctggagaaagtgtaaaatctttgaggatggcaactctcatatactaaatgtacattttggattgcatctgggaagtctgaaaatggttactgcatactccgatggccaagtcaaggtctacgagctcttggattcattggaattagacaagtggcagcttcaggcagagttccaaaacattactgatccaatctccagatttggaaaacttgcatgcacttctgcatcgatagcatggaatccaagaagaggtggaagccaacaagctagttttgcaattggcttcaattcagattcacctcatttcaactcttgtaagatttgggagtttgaagaagcacatcagcgctggcttccacttgttgagctaggttcacctgaggataagggagatagagtgtgtgctgtagcatgggctcctaacattggcagaccatacgagattatcgcagttgcaacctgcaaaggaattgcaatctggcatataggtttgaacactgacgctgatagcggacctacgacacggaacgttgctttacttaacggccatgatggcgaggtttggcaactggaatgggacatgggcggtatgacactcgcatcaaccggaggagacggcatggttaagctatggcaggctaatttggatggagtttggcatgagcaggctgttcttgactgcagtggatcacgtgtctag

SEQ ID NO: 5364 - protein, 324 aa, Sorghum bicolor
  misc_feature: Ceres ANNOT ID no. 6042919
  misc_feature (42)..(82): Pfam Id: WD40 Pfam Desc: WD domain, G-beta repeat
  misc_feature (266)..(304): Pfam Id: WD40 Pfam Desc: WD domain, G-beta repeat
  misc_feature (4)..(322): NCBI GI: 54290874 NCBI Desc: sec13 protein homolog ygl100w-like [oryza sativa (japonica cultivar-group)]
  misc_feature (5)..(318): NCBI GI: 21593083 NCBI Desc: seh1-like protein [arabidopsis thaliana]
  misc_feature (5)..(318): NCBI GI: 12584926 NCBI Desc: seh1-like protein [arabidopsis thaliana]
  misc_feature (19)..(324): NCBI GI: 49118559 NCBI Desc: mgc82845 protein [xenopus laevis]
  misc_feature (19)..(324): NCBI GI: 12239336 NCBI Desc: sec13-like protein [homo sapiens]
MTTERQVAELGPGTACCGWNYCGRRLAAGAVDGSVSVYDSQPSPSFKWQAHEQAIVNVVWLPPEYGDAIACACADGTLSLWEEVAADDQLPTWRKCKIFEDGNSHILNVHFGLHLGSLKMVTAYSDGQVKVYELLDSLELDKWQLQAEFQNITDPISRFGKLACTSASIAWNPRRGGSQQASFAIGFNSDSPHFNSCKIWEFEEAHQRWLPLVELGSPEDKGDRVCAVAWAPNIGRPYEIIAVATCKGIAIWHIGLNTDADSGPTTRNVALLNGHDGEVWQLEWDMGGMTLASTGGDGMVKLWQANLDGVWHEQAVLDCSGSRV

SEQ ID NO: 5365 - DNA, 237 bp, Sorghum bicolor
  misc_feature: Ceres ANNOT ID no. 6042920
  misc_feature: Encodes the peptide sequence at SEQ ID NO 5366
atggatagcagcagcggcagccaggacaagaaatccaaaggcaatgatcgccgtgaagcaaaagaagctaatggcactgcacagcattttgttgatttcacggaagcagaggaagatcttgtttccagaatgcacaggcttgtggggaacaggtgggagattatagcagggagaatcccaggaaggacagcagaagaggtagagatgttctggtccaaaaaacaccaggaaagatga

SEQ ID NO: 5366 - protein, 78 aa, Sorghum bicolor
  misc_feature: Ceres ANNOT ID no. 6042920
  misc_feature (30)..(75): Pfam Id: Myb_DNA-binding Pfam Desc: Myb-like DNA-binding domain
  misc_feature (1)..(77): NCBI GI: 26516846 NCBI Desc: triptychon [arabidopsis thaliana]
  misc_feature (10)..(75): NCBI GI: 42572793 NCBI Desc: myb family transcription factor [arabidopsis thaliana]
  misc_feature (30)..(77): NCBI GI: 1946374 NCBI Desc: myb-like protein isolog [arabidopsis thaliana]
  misc_feature (31)..(74): NCBI GI: 110931776 NCBI Desc: myb transcription factor myb172 [glycine max]
  misc_feature (31)..(74): NCBI GI: 110931738 NCBI Desc: myb transcription factor myb73 [glycine max]
  misc_feature: The plant is abnormally small.
  misc_feature: The sequence is a functional homolog of SEQ ID NO 10 in the 10/412,699US patent application
  misc_feature: The sequence is a functional homolog of SEQ ID NO 104 in the 10/412,699US patent application
  misc_feature: The sequence is a functional homolog of SEQ ID NO 1049 in the 10/412,699US patent application
  misc_feature: The sequence is a functional homolog of SEQ ID NO 1050 in the 10/412,699US patent application
  misc_feature: The sequence is a functional homolog of SEQ ID NO 1064 in the 10/666,642US patent application
  misc_feature: The sequence is a functional homolog of SEQ ID NO 1065 in the 10/666,642US patent application
  misc_feature: The sequence is a functional homolog of SEQ ID NO 1071 in the 11/479,226US patent application
  misc_feature: The sequence is a functional homolog of SEQ ID NO 1081 in the 10/374,780US patent application
  misc_feature: The sequence is a functional homolog of SEQ ID NO 1082 in the 10/374,780US patent application
  misc_feature: The sequence is a functional homolog of SEQ ID NO 1083 in the 10/374,780US patent application
  misc_feature: The sequence is a functional homolog of SEQ ID NO 1084 in the 10/374,780US patent application
  misc_feature: The sequence is a functional homolog of SEQ ID NO 1085 in the 10/374,780US patent application
  misc_feature: The sequence is a functional homolog of SEQ ID NO 1086 in the 10/374,780US patent application
  misc_feature: The sequence is a functional homolog of SEQ ID NO 1087 in the 10/374,780US patent application
  misc_feature: The sequence is a functional homolog of SEQ ID NO 1088 in the 10/374,780US patent application
  misc_feature: The sequence is a functional homolog of SEQ ID NO 1089 in the 10/374,780US patent application
  misc_feature: The sequence is a functional homolog of SEQ ID NO 1090 in the 10/374,780US patent application
  misc_feature: The sequence is a functional homolog of SEQ ID NO 124 in the 11/479,226US patent application
  misc_feature: The sequence is a functional homolog of SEQ ID NO 1378 in the 10/666,642US patent application
  misc_feature: The sequence is a functional homolog of SEQ ID NO 1408 in the 10/666,642US patent application
  misc_feature: The sequence is a functional homolog of SEQ ID NO 142 in the 10/412,699US patent application
  misc_feature: The sequence is a functional homolog of SEQ ID NO 148 in the 10/374,780US patent application
  misc_feature: The sequence is a functional homolog of SEQ ID NO 1528 in the 10/666,642US patent application
  misc_feature: The sequence is a functional homolog of SEQ ID NO 1750 in the 10/412,699US patent application
  misc_feature: The sequence is a functional homolog of SEQ ID NO 18 in the 10/412,699US patent application
  misc_feature: The sequence is a functional homolog of SEQ ID NO 1808 in the 10/412,699US patent application
  misc_feature: The sequence is a functional homolog of SEQ ID NO 1932 in the 10/412,699US patent application
  misc_feature: The sequence is a functional homolog of SEQ ID NO 2131 in the 10/666,642US patent application
  misc_feature: The sequence is a functional homolog of SEQ ID NO 2133 in the 10/666,642US patent application
  misc_feature: The sequence is a functional homolog of SEQ ID NO 2147 in the 10/666,642US patent application
  misc_feature: The sequence is a functional homolog of SEQ ID NO 2157 in the 10/666,642US patent application
  misc_feature: The sequence is a functional homolog of SEQ ID NO 2159 in the 10/666,642US patent application
  misc_feature: The sequence is a functional homolog of SEQ ID NO 2161 in the 10/666,642US patent application
  misc_feature: The sequence is a functional homolog of SEQ ID NO 2163 in the 10/666,642US patent application
  misc_feature: The sequence is a functional homolog of SEQ ID NO 2165 in the 10/666,642US patent application
  misc_feature: The sequence is a functional homolog of SEQ ID NO 2167 in the 10/666,642US patent application
  misc_feature: The sequence is a functional homolog of SEQ ID NO 2169 in the 10/666,642US patent application
  misc_feature: The sequence is a functional homolog of SEQ ID NO 2192 in the 10/374,780US patent application
  misc_feature: The sequence is a functional homolog of SEQ ID NO 2252 in the 10/374,780US patent application
  misc_feature: The sequence is a functional homolog of SEQ ID NO 234 in the 10/714,887US patent application
  misc_feature: The sequence is a functional homolog of SEQ ID NO 234 in the 11/435,388US patent application
  misc_feature: The sequence is a functional homolog of SEQ ID NO 251 in the 11/479,226US patent application
  misc_feature: The sequence is a functional homolog of SEQ ID NO 286 in the 10/714,887US patent application
  misc_feature: The sequence is a functional homolog of SEQ ID NO 286 in the 11/435,388US patent application
  misc_feature: The sequence is a functional homolog of SEQ ID NO 288 in the 10/714,887US patent application
  misc_feature: The sequence is a functional homolog of SEQ ID NO 324 in the 11/435,388US patent application
  misc_feature: The sequence is a functional homolog of SEQ ID NO 326 in the 10/714,887US patent application
  misc_feature: The sequence is a functional homolog of SEQ ID NO 326 in the 11/435,388US patent application
  misc_feature: The sequence is a functional homolog of SEQ ID NO 328 in the 10/714,887US patent application
  misc_feature: The sequence is a functional homolog of SEQ ID NO 328 in the 11/435,388US patent application
  misc_feature: The sequence is a functional homolog of SEQ ID NO 330 in the 10/714,887US patent application
  misc_feature: The sequence is a functional homolog of SEQ ID NO 333 in the 11/479,226US patent application
  misc_feature: The sequence is a functional homolog of SEQ ID NO 360 in the 11/435,388US patent application
  misc_feature: The sequence is a functional homolog of SEQ ID NO 362 in the 10/714,887US patent application
  misc_feature: The sequence is a functional homolog of SEQ ID NO 370 in the 11/435,388US patent application
  misc_feature: The sequence is a functional homolog of SEQ ID NO 372 in the 10/714,887US patent application
  misc_feature: The sequence is a functional homolog of SEQ ID NO 372 in the 11/435,388US patent application
  misc_feature: The sequence is a functional homolog of SEQ ID NO 374 in the 10/714,887US patent application
  misc_feature: The sequence is a functional homolog of SEQ ID NO 374 in the 11/435,388US patent application
  misc_feature: The sequence is a functional homolog of SEQ ID NO 376 in the 10/714,887US patent application
  misc_feature: The sequence is a functional homolog of SEQ ID NO 376 in the 11/435,388US patent application
  misc_feature: The sequence is a functional homolog of SEQ ID NO 378 in the 10/714,887US patent application
  misc_feature: The sequence is a functional homolog of SEQ ID NO 378 in the 11/435,388US patent application
  misc_feature: The sequence is a functional homolog of SEQ ID NO 38 in the 10/374,780US patent application
  misc_feature: The sequence is a functional homolog of SEQ ID NO 380 in the 10/714,887US patent application
  misc_feature: The sequence is a functional homolog of SEQ ID NO 380 in the 11/435,388US patent application
  misc_feature: The sequence is a functional homolog of SEQ ID NO 382 in the 10/714,887US patent application
  misc_feature: The sequence is a functional homolog of SEQ ID NO 382 in the 11/435,388US patent application
  misc_feature: The sequence is a functional homolog of SEQ ID NO 384 in the 10/714,887US patent application
  misc_feature: The sequence is a functional homolog of SEQ ID NO 42 in the 10/225,068US patent application
  misc_feature: The sequence is a functional homolog of SEQ ID NO 468 in the 10/412,699US patent application
  misc_feature: The sequence is a functional homolog of SEQ ID NO 508 in the 10/666,642US patent application
  misc_feature: The sequence is a functional homolog of SEQ ID NO 54 in the 10/225,068US patent application
  misc_feature: The sequence is a functional homolog of SEQ ID NO 558 in the 10/374,780US patent application
  misc_feature: The sequence is a functional homolog of SEQ ID NO 559 in the 10/374,780US patent application
  misc_feature: The sequence is a functional homolog of SEQ ID NO 586 in the 10/225,066US patent application
  misc_feature: The sequence is a functional homolog of SEQ ID NO 682 in the 10/225,066US patent application
  misc_feature: The sequence is a functional homolog of SEQ ID NO 758 in the 10/225,066US patent application
  misc_feature: The sequence is a functional homolog of SEQ ID NO 960 in the 10/412,699US patent application
  misc_feature: Useful for making plants with altered Lignin content
  misc_feature: Useful for making plants with altered terpenoid content
  misc_feature: Useful for making plants with modulated biomass
  misc_feature: Useful for making plants with modulated growth and phenotype characteristics
  misc_feature: Useful for making plants with modulated nitrogen use efficiency
  misc_feature: Functional homolog of the protein sequence given in SEQ ID NO 13006
  misc_feature: Functional homolog of the protein sequence given in SEQ ID NO 13034
  misc_feature: The sequence is a functional homolog of SEQ ID NO 10 in the 20040045049 US patent application
  misc_feature: The sequence is a functional homolog of SEQ ID NO 104 in the 20040045049 US patent application
  misc_feature: The sequence is a functional homolog of SEQ ID NO 1049 in the 20040045049 US patent application
  misc_feature: The sequence is a functional homolog of SEQ ID NO 1050 in the 20040045049 US patent application
  misc_feature: The sequence is a functional homolog of SEQ ID NO 142 in the 20040045049 US patent application
  misc_feature: The sequence is a functional homolog of SEQ ID NO 18 in the 20040045049 US patent application
  misc_feature: The sequence is a functional homolog of SEQ ID NO 1808 in the 20040045049 US patent application
  misc_feature: The sequence is a functional homolog of SEQ ID NO 1932 in the 20040045049 US patent application
  misc_feature: The sequence is a functional homolog of SEQ ID NO 328 in the 20060015972 US patent application
  misc_feature: The sequence is a functional homolog of SEQ ID NO 362 in the 20060015972 US patent application
  misc_feature: The sequence is a functional homolog of SEQ ID NO 374 in the 20060015972 US patent application
  misc_feature: The sequence is a functional homolog of SEQ ID NO 376 in the 20060015972 US patent application
  misc_feature: The sequence is a functional homolog of SEQ ID NO 380 in the 20060015972 US patent application
  misc_feature: The sequence is a functional homolog of SEQ ID NO 382 in the 20060015972 US patent application
  misc_feature: The sequence is a functional homolog of SEQ ID NO 384 in the 20060015972 US patent application
  misc_feature: The sequence is a functional homolog of SEQ ID NO 1081 in the 20060162006 US patent application
  misc_feature: The sequence is a functional homolog of SEQ ID NO 1090 in the 20060162006 US patent application
  misc_feature: Functional homolog of the protein sequence given in SEQ ID NO 13560
  misc_feature: The sequence is a functional homolog of SEQ ID NO 1089 in the 10/374,780 US patent application
  misc_feature: The sequence is a functional homolog of SEQ ID NO 2147 in the 10/666,642 US patent application
  misc_feature: The sequence is a functional homolog of SEQ ID NO 2157 in the 10/666,642 US patent application
  misc_feature: The sequence is a functional homolog of SEQ ID NO 360 in the 11/435,388 US patent application
  misc_feature: The sequence is a functional homolog of SEQ ID NO 362 in the 10/714,887 US patent application
  misc_feature: The sequence is a functional homolog of SEQ ID NO 370 in the 11/435,388 US patent application
  misc_feature: The sequence is a functional homolog of SEQ ID NO 372 in the 10/714,887 US patent application
  misc_feature: The sequence is a functional homolog of SEQ ID NO 1090 in the 10/374,780 US patent application
  misc_feature: The sequence is a functional homolog of SEQ ID NO 1082 in the 10/374,780 US patent application
  misc_feature: The sequence is a functional homolog of SEQ ID NO 2131 in the 10/666,642 US patent application
  misc_feature: The sequence is a functional homolog of SEQ ID NO 326 in the 11/435,388 US patent application
  misc_feature: The sequence is a functional homolog of SEQ ID NO 328 in the 10/714,887 US patent application
  misc_feature: The sequence is a functional homolog of SEQ ID NO 1050 in the 10/412,699 US patent application
  misc_feature: The sequence is a functional homolog of SEQ ID NO 1065 in the 10/666,642 US patent application
  misc_feature: The sequence is a functional homolog of SEQ ID NO 2133 in the 10/666,642 US patent application
  misc_feature: The sequence is a functional homolog of SEQ ID NO 328 in the 11/435,388 US patent application
  misc_feature: The sequence is a functional homolog of SEQ ID NO 330 in the 10/714,887 US patent application
  misc_feature: The sequence is a functional homolog of SEQ ID NO 559 in the 10/374,780 US patent application
  misc_feature: The sequence is a functional homolog of SEQ ID NO 1049 in the 10/412,699 US patent application
  misc_feature: The sequence is a functional homolog of SEQ ID NO 1064 in the 10/666,642 US patent application
  misc_feature: The sequence is a functional homolog of SEQ ID NO 558 in the 10/374,780 US patent application
  misc_feature: The sequence is a functional homolog of SEQ ID NO 1081 in the 10/374,780 US patent application
  misc_feature: The sequence is a functional homolog of SEQ ID NO 1071 in the 11/479,226 US patent application
  misc_feature: The sequence is a functional homolog of SEQ ID NO 1408 in the 10/666,642 US patent application
  misc_feature: The sequence is a functional homolog of SEQ ID NO 148 in the 10/374,780 US patent application
  misc_feature: The sequence is a functional homolog of SEQ ID NO 1808 in the 10/412,699 US patent application
  misc_feature: The sequence is a functional homolog of SEQ ID NO 234 in the 10/714,887 US patent application
  misc_feature: The sequence is a functional homolog of SEQ ID NO 234 in the 11/435,388 US patent application
  misc_feature: The sequence is a functional homolog of SEQ ID NO 286 in the 10/714,887 US patent application
  misc_feature: The sequence is a functional homolog of SEQ ID NO 42 in the 10/225,068 US patent application
  misc_feature: The sequence is a functional homolog of SEQ ID NO 468 in the 10/412,699 US patent application
  misc_feature: The sequence is a functional homolog of SEQ ID NO 758 in the 10/225,066 US patent application
  misc_feature: Useful for making plants with altered lignin content
  misc_feature: Useful for making plants with altered terpenoid content
  misc_feature: Useful for making plants with modulated nitrogen use efficiency
  misc_feature: Functional homolog of the protein sequence given in SEQ ID NO 13034
  misc_feature: The sequence is a functional homolog of SEQ ID NO 1087 in the 10/374,780 US patent application
  misc_feature: The sequence is a functional homolog of SEQ ID NO 2165 in the 10/666,642 US patent application
  misc_feature: The sequence is a functional homolog of SEQ ID NO 378 in the 11/435,388 US patent application
  misc_feature: The sequence is a functional homolog of SEQ ID NO 380 in the 10/714,887 US patent application
  misc_feature: The sequence is a functional homolog of SEQ ID NO 1088 in the 10/374,780 US patent application
  misc_feature: The sequence is a functional homolog of SEQ ID NO 2167 in the 10/666,642 US patent application
  misc_feature: The sequence is a functional homolog of SEQ ID NO 380 in the 11/435,388 US patent application
  misc_feature: The sequence is a functional homolog of SEQ ID NO 382 in the 10/714,887 US patent application
  misc_feature: The sequence is a functional homolog of SEQ ID NO 1083 in the 10/374,780 US patent application
  misc_feature: The sequence is a functional homolog of SEQ ID NO 2159 in the 10/666,642 US patent application
  misc_feature: The sequence is a functional homolog of SEQ ID NO 372 in the 11/435,388 US patent application
  misc_feature: The sequence is a functional homolog of SEQ ID NO 374 in the 10/714,887 US patent application
  misc_feature: The sequence is a functional homolog of SEQ ID NO 1085 in the 10/374,780 US patent application
  misc_feature: The sequence is a functional homolog of SEQ ID NO 1086 in the 10/374,780 US patent application
  misc_feature: The sequence is a functional homolog of SEQ ID NO 2161 in the 10/666,642 US patent application
  misc_feature: The sequence is a functional homolog of SEQ ID NO 2163 in the 10/666,642 US patent application
  misc_feature: The sequence is a functional homolog of SEQ ID NO 374 in the 11/435,388 US patent application
  misc_feature: The sequence is a functional homolog of SEQ ID NO 376 in the 10/714,887 US patent application
  misc_feature: The sequence is a functional homolog of SEQ ID NO 376 in the 11/435,388 US patent application
  misc_feature: The sequence is a functional homolog of SEQ ID NO 378 in the 10/714,887 US patent application
  misc_feature: The sequence is a functional homolog of SEQ ID NO 1916 in the 10/412,699 US patent application
  misc_feature: The sequence is a functional homolog of SEQ ID NO 2176 in the 10/374,780 US patent application
  misc_feature: The sequence is a functional homolog of SEQ ID NO 1914 in the 10/412,699 US patent application
  misc_feature: The sequence is a functional homolog of SEQ ID NO 2174 in the 10/374,780 US patent application
  misc_feature: The sequence is a functional homolog of SEQ ID NO 956 in the 10/225,066 US patent application
  misc_feature: The sequence is a functional homolog of SEQ ID NO 124 in the 10/412,699 US patent application
  misc_feature: The sequence is a functional homolog of SEQ ID NO 1742 in the 10/412,699 US patent application
  misc_feature: The sequence is a functional homolog of SEQ ID NO 1966 in the 10/374,780 US patent application
  misc_feature: The sequence is a functional homolog of SEQ ID NO 299 in the 11/479,226 US patent application
  misc_feature: The sequence is a functional homolog of SEQ ID NO 1056 in the 11/479,226 US patent application
  misc_feature: The sequence is a functional homolog of SEQ ID NO 144 in the 10/374,780 US patent application
  misc_feature: The sequence is a functional homolog of SEQ ID NO 458 in the 10/412,699 US patent application
  misc_feature: The sequence is a functional homolog of SEQ ID NO 756 in the 10/225,066 US patent application
  misc_feature: The sequence is a functional homolog of SEQ ID NO 1688 in the 11/479,226 US patent application
  misc_feature: The sequence is a functional homolog of SEQ ID NO 1852 in the 10/412,699 US patent application
  misc_feature: The sequence is a functional homolog of SEQ ID NO 2094 in the 10/374,780 US patent application
  misc_feature: Useful for making plants with enhanced nutritional value
  misc_feature: Useful for making plants with modulated heat sensitivity
  misc_feature: Functional homolog of the protein sequence given in SEQ ID NO 13689
  misc_feature: The sequence is a functional homolog of SEQ ID NO 170 in the 10/412,699 US patent application
  misc_feature: The sequence is a functional homolog of SEQ ID NO 1756 in the 10/412,699 US patent application
  misc_feature: The sequence is a functional homolog of SEQ ID NO 1980 in the 10/374,780 US patent application
  misc_feature: The sequence is a functional homolog of SEQ ID NO 750 in the 10/225,066 US patent application
  misc_feature: The sequence is a functional homolog of SEQ ID NO 1015 in the 11/479,226 US patent application
  misc_feature: The sequence is a functional homolog of SEQ ID NO 138 in the 10/374,780 US patent application
  misc_feature: The sequence is a functional homolog of SEQ ID NO 436 in the 10/412,699 US patent application
  misc_feature: The sequence is a functional homolog of SEQ ID NO 60 in the 11/375,241 US patent application
  misc_feature: The sequence is a functional homolog of SEQ ID NO 292 in the 11/479,226 US patent application
  misc_feature: The sequence is a functional homolog of SEQ ID NO 446 in the 10/412,699 US patent application
  misc_feature: The sequence is a functional homolog of SEQ ID NO. 395 in the 11/188,298 US application
MDSSSGSQDKKSKGNDRREAKEANGTAQHFVDFTEAEEDLVSRMHRLVGNRWEIIAGRIPGRTAEEVEMFWSKKHQER

SEQ ID NO: 5367 - DNA, 1767 bp, Sorghum bicolor
  misc_feature: Ceres ANNOT ID no. 6042931
  misc_feature: Encodes the peptide sequence at SEQ ID NO 5368
  misc_feature: Down-regulated in shoot tissues in response to aminocyclopropane carboxylic treatment
  misc_feature: Down-regulated in shoot tissues in response to salicylic acid treatment
atggccagcggcgacctcctcctcctccgcgcccacgccggcgccccggtcctagcgagggccttcgccggccgcctcctggtcccggcgaggcgccgctgcgggctcgtctcgcctctggccgccgcttccaaggtcggcatcgccgacgttgttggagttggacgacgggtcaggccgggcggcgccgaccagaagaggcggcgcagggacgcggaggaggggttcgggttctccggggtggccacgaggagggaacttgtcgacgacgaggaggacgaggaagatgaggctcttaagttgggagtggagaagaatggtggcgagacgggaggtgtggatggctcctacctcagtgagacacggtttgatcaatgtgctatttcccctttatcgttgaaagctgtcaaagatgctggatatgaaaggatgactgaggtgcaggcggcaactctgcccataattcttcaaggcaaggatgttcttgcaaaggcaaagacaggaactgggaaaacagttgcttttttgcttccagcgattgaggttctctccactctacctcgtgagcggaatcagttacggccacctataaatttgctggtgatgtgccctactagggagcttgcgaaccaagtggctgttgaggccaggaagcttctcaggtatcatcgctcgttgggtgtgcaggttgtaattggtggcacacgattaactcaagaacaacgaagcatgcaagctaacccatgtcagattcttgttgctacaccaggaaggctgaaggatcatcttgagaacacacctgggttttctagcaggctcaagggtgtgaaggttcttgttcttgatgaagctgatcgcctgttggatatgggatttagaagagatattgagaaaataattgcttcaattcctagagaacggcaaacactgttgttttctgctactgttccagaagaggtccgccaaatttctcatgtggcaatgaagaaagattataggttcgttaacactgttaaagagggtgatgaggagacacatgcacaggtgagccagatgtacatggttgcaccactggacttgcatttttctatcctatatgatgtattgaagaagcacgtcgcagaagatgcagactacaaagttattatattctgtactactgcaatggtcaccaaacttgtggctgaagttctctcccagctgaaactgaatataagagagatccattccagaaagtcacagtctgcaagaaccaaggtctcagatgaattcaggaaatcaaaaggtttgatactggtcagttcggacgtatctgcccgcggtgttgactatcctgatgtcactcttgtaatacaggttggaattcctgcagatagagaacagtacatacatagactaggccggactggacggaaaggcaaggaagggcaaggactcctactattggcaccttgggaaaaatattttcttggtactgttaaggatttgtcaatagcagagtctgcagtacctccagttgattctagtgttgagacagaagtcaaaaacgcggtcagaaaagtagagatgaagagcaaagaatgtgcctatcaagcatggttagggtactacaactcaaacaagaccattggtcgagacaagtccagacttgctcaccttgcagaagagttcagccaaagcatgggtctggctgttcctccagccatacctagaaacattcttcgcaagatgggtcttaacaatgtccctgggcttcgctcatcataa

SEQ ID NO: 5368 - protein, 588 aa, Sorghum bicolor
  misc_feature: Ceres ANNOT ID no. 6042931
  misc_feature (145)..(323): Pfam Id: DEAD Pfam Desc: DEAD/DEAH box helicase
  misc_feature (397)..(473): Pfam Id: Helicase_C Pfam Desc: Helicase conserved C-terminal domain
  misc_feature (65)..(587): NCBI GI: 54290855 NCBI Desc: myc-regulated dead/h box 18 rna helicase-like [oryza sativa (japonica cultivar-group)]
  misc_feature (65)..(587): NCBI GI: 122228652 NCBI Desc: dead-box atp-dependent rna helicase 26
  misc_feature (53)..(587): NCBI GI: 9759355 NCBI Desc: rna helicase-like protein [arabidopsis thaliana]
  misc_feature (53)..(587): NCBI GI: 30682500 NCBI Desc: dead box rna helicase (rh26) [arabidopsis thaliana]
  misc_feature (89)..(587): NCBI GI: 109893656 NCBI Desc: dead-box atp-dependent rna helicase 31
  misc_feature: Down-regulated in shoot tissues in response to aminocyclopropane carboxylic treatment
  misc_feature: Down-regulated in shoot tissues in response to salicylic acid treatment
MASGDLLLLRAHAGAPVLARAFAGRLLVPARRRCGLVSPLAAASKVGIADVVGVGRRVRPGGADQKRRRRDAEEGFGFSGVATRRELVDDEEDEEDEALKLGVEKNGGETGGVDGSYLSETRFDQCAISPLSLKAVKDAGYERMTEVQAATLPIILQGKDVLAKAKTGTGKTVAFLLPAIEVLSTLPRERNQLRPPINLLVMCPTRELANQVAVEARKLLRYHRSLGVQVVIGGTRLTQEQRSMQANPCQILVATPGRLKDHLENTPGFSSRLKGVKVLVLDEADRLLDMGFRRDIEKIIASIPRERQTLLFSATVPEEVRQISHVAMKKDYRFVNTVKEGDEETHAQVSQMYMVAPLDLHFSILYDVLKKHVAEDADYKVIIFCTTAMVTKLVAEVLSQLKLNIREIHSRKSQSARTKVSDEFRKSKGLILVSSDVSARGVDYPDVTLVIQVGIPADREQYIHRLGRTGRKGKEGQGLLLLAPWEKYFLGTVKDLSIAESAVPPVDSSVETEVKNAVRKVEMKSKECAYQAWLGYYNSNKTIGRDKSRLAHLAEEFSQSMGLAVPPAIPRNILRKMGLNNVPGLRSS

SEQ ID NO: 5369 - DNA, 1827 bp, Sorghum bicolor
  misc_feature: Ceres ANNOT ID no. 6042932
  misc_feature: Encodes the peptide sequence at SEQ ID NO 5370
atgccaacgacgcacgcgctccgcctctgcccgctgctctccaccgtccgatccacaccgccgcgggccactgccgcagcccgccagggcgcctcgccagcgctcctcgtcgcccgctgctcctccgccgggacgccgtcagccgcccaggcgctcaagatcaactcgatcccgaccaagccagttgaggggcagaagacggggactagtggcctgaggaaaaaggtgaaagtgttccagcaggagaactaccttgctaattggattcaggctctattcaattccttgccccctgaagattatgtgggtgcaacccttgtacttgggggtgatggccggtactttaataaggaggctgctcagatcatcattaagattgcagctggaaatggagttcagaagatcattgtcggcagggatggtctactgtcaactcctgctgtatctgcagtaattcgtaaaagagaagccaatggtggcttcatcatgagtgcaagccataatccaggtggacctgacaatgactggggtattaagtttaactacagcagtggacagccagcaccggagacgattactgatcaaatttatgggaacacactttcaatttctgaaataaaaacagcagggattcctgatactgatctatcctctgttggagttgtaagctatggagatttcaccatagaagtgatagatcctgtttcagattacctggaactaatggagaatgtgtttgacttccaacttattaaggatttgctttctcggcctgatttcaggttcatattcgatgcgatgcatgcagttactggtgcgtatgcaggacctatttttgttgagaaacttggagctgatccggactgcatattaaatggggtgcctcttgaagattttggaaatggccatccagatccaaatctaacttacgctaaggagcttgtttttaccatgtttggaacccatgcacctgactttggtgcagcaagtgatggcgatggtgatcggaacatgattcttgggaaaaggttctttattaccccatcagactctgttgcaataattgcagcaaatgcacaggcagcaattccttatttccagtttggtacaaaaggactcgcgagatcaatgccaaccagtggtgctcttgatcgtgttgccaagaaattgaatgttccattctttgaggttccaacaggctggaaattttttggcaacctaatggatgcaggaaaattgtctatttgtggagaggaaagttttgggactggatctgatcacattagagagaaggatggcatctgggctgttctggcttggctttccatacttgcacaccggaacaaggataagaaggtcggagagagattagtgtcggtggaagatattgctatggagcactggaaaacctatggcaggaatttcttttctagatatgattatgaggagtgtgaatcacaaagtgcaaacaagatgatggatcaccttaaagatgttattgcaaatagcaagcctggagagaaatatggagattacaccctccaatttgctgatgatttcagctatactgatcctgtagacggtagtacggtatcaaaacaaggacttcgatttgttttcactgatggatctaggattatcttccggctttcgggaaccggatctgctggagctactatccgcctctacatagaacaatttgaatctgatatctcaaagcatagtctcgatgctcaaacagctctgaagcctttaatagacctggctttgtctgtttcaaagctcaaggacttcacaggaagagacaaacctactgtcataacataa

SEQ ID NO: 5370 - protein, 608 aa, Sorghum bicolor
  misc_feature: Ceres ANNOT ID no. 6042932
  misc_feature (64)..(207): Pfam Id: PGM_PMM_I Pfam Desc: Phosphoglucomutase/phosphomannomutase, alpha/beta/alphadomain I
  misc_feature (347)..(471): Pfam Id: PGM_PMM_III Pfam Desc: Phosphoglucomutase/phosphomannomutase, alpha/beta/alphadomain III
  misc_feature (236)..(345): Pfam Id: PGM_PMM_II Pfam Desc: Phosphoglucomutase/phosphomannomutase, alpha/beta/alphadomain II
  misc_feature (500)..(597): Pfam Id: PGM_PMM_IV Pfam Desc: Phosphoglucomutase/phosphomannomutase, C-terminal domain
  misc_feature (38)..(608): NCBI GI: 6272283 NCBI Desc: plastidial phosphoglucomutase [pisum sativum]
  misc_feature (36)..(608): NCBI GI: 22136446 NCBI Desc: phosphoglucomutase [arabidopsis thaliana]
  misc_feature (36)..(608): NCBI GI: 6686811 NCBI Desc: phosphoglucomutase [arabidopsis thaliana]
  misc_feature (33)..(608): NCBI GI: 8250622 NCBI Desc: plastidic phosphoglucomutase [solanum tuberosum]
  misc_feature (38)..(608): NCBI GI: 6272125 NCBI Desc: plastidial phosphoglucomutase [brassica napus]
  misc_feature (38)..(608): SWISSPROT Homolog: EC 5.4.2.2 Phosphoglucomutase, chloroplast precursor
MPTTHALRLCPLLSTVRSTPPRATAAARQGASPALLVARCSSAGTPSAAQALKINSIPTKPVEGQKTGTSGLRKKVKVFQQENYLANWIQALFNSLPPEDYVGATLVLGGDGRYFNKEAAQIIIKIAAGNGVQKIIVGRDGLLSTPAVSAVIRKREANGGFIMSASHNPGGPDNDWGIKFNYSSGQPAPETITDQIYGNTLSISEIKTAGIPDTDLSSVGVVSYGDFTIEVIDPVSDYLELMENVFDFQLIKDLLSRPDFRFIFDAMHAVTGAYAGPIFVEKLGADPDCILNGVPLEDFGNGHPDPNLTYAKELVFTMFGTHAPDFGAASDGDGDRNMILGKRFFITPSDSVAIIAANAQAAIPYFQFGTKGLARSMPTSGALDRVAKKLNVPFFEVPTGWKFFGNLMDAGKLSICGEESFGTGSDHIREKDGIWAVLAWLSILAHRNKDKKVGERLVSVEDIAMEHWKTYGRNFFSRYDYEECESQSANKMMDHLKDVIANSKPGEKYGDYTLQFADDFSYTDPVDGSTVSKQGLRFVFTDGSRIIFRLSGTGSAGATIRLYIEQFESDISKHSLDAQTALKPLIDLALSVSKLKDFTGRDKPTVIT

SEQ ID NO: 5371 - DNA, 1035 bp, Sorghum bicolor
  misc_feature: Ceres ANNOT ID no. 6042942
  misc_feature: Encodes the peptide sequence at SEQ ID NO 5372
atggctaaccaagcccctccggttccccgcgtcaagcttggcacccagggattcgaggtgtccaagctggggttcggctgcatggggctgacgggcgcgtacaactccccgctggacgacgaggccggcatcgccgtcatcacgcacgctttcagccgcgggatcaccttcttcgacacctccaatgtatacggccccctcaccaacgaaatcctcctcggcaaggcgctgaagcagctgccgcgggagcaggtgcaggtggccaccaagttcgggatactgcgtgacgagagcggcaaccggaccgtgtgcggacggccggagtacgttcgcgcctgctgcgaggccagcctgcgccgcctcgacatcgactgcatcgacctctactaccagcaccgcattgacaccacaattcccatcgaggagacgattggcgagctcaagaagttggtggaggaggggaaggtcaagtacatcggattgtcagaggcgagcccggacaccattaggcgtgcacacgctgtgcacccgatcaccgccgtgcagatggagtggtctctctggtctcgcgacattgagcctgaaattgtgccgctgtgcagagaattgggcattggaattgtaccatacagtcctcttggccgtgggtttttcggtggaagaggagtgaaagaacaagtgtccgctgaatctgttctgcatgggatcccaaggtttgctcctgaaaatttggagaagaacaagcaaatttatctgcgaatggaagaactggccaataagcaccagtgcagccctactcagctagctttagcatgggttctgcatcaaggaaatgatgtggttcctataccagggacaaccaaaatcaagaatctagattccaacattgactccttgaaggtgaaactgacagacgaagatctgaaagaaatgggcagccagatacgtgaagaagatgtggctggtgggagacaattcgcttcctttgaacatgccacctggaagtatgctgatacacccaagaagcagagctaa

SEQ ID NO: 5372 - protein, 344 aa, Sorghum bicolor
  misc_feature: Ceres ANNOT ID no. 6042942
  misc_feature (14)..(316): Pfam Id: Aldo_ket_red Pfam Desc: Aldo/keto reductase family
  misc_feature (8)..(344): NCBI GI: 78708648 NCBI Desc: oxidoreductase, aldo/keto reductase family [oryza sativa (japonica cultivar-group)]
  misc_feature (8)..(340): NCBI GI: 59896631 NCBI Desc: perakine reductase [rauvolfia serpentina]
  misc_feature (1)..(344): NCBI GI: 62526573 NCBI Desc: aldo/keto reductase akr [manihot esculenta]
  misc_feature (8)..(344): NCBI GI: 2462762 NCBI Desc: highly similar to auxin-induced protein (aldo/keto reductase family) [arabidopsis thaliana]
  misc_feature (8)..(344): NCBI GI: 124360844 NCBI Desc: aldo/keto reductase [medicago truncatula]
MANQAPPVPRVKLGTQGFEVSKLGFGCMGLTGAYNSPLDDEAGIAVITHAFSRGITFFDTSNVYGPLTNEILLGKALKQLPREQVQVATKFGILRDESGNRTVCGRPEYVRACCEASLRRLDIDCIDLYYQHRIDTTIPIEETIGELKKLVEEGKVKYIGLSEASPDTIRRAHAVHPITAVQMEWSLWSRDIEPEIVPLCRELGIGIVPYSPLGRGFFGGRGVKEQVSAESVLHGIPRFAPENLEKNKQIYLRMEELANKHQCSPTQLALAWVLHQGNDVVPIPGTTKIKNLDSNIDSLKVKLTDEDLKEMGSQIREEDVAGGRQFASFEHATWKYADTPKKQS

SEQ ID NO: 5373 - DNA, 1677 bp, Sorghum bicolor
  misc_feature: Ceres ANNOT ID no. 6042949
  misc_feature: Encodes the peptide sequence at SEQ ID NO 5374
atggcaatcgagtgcctcgtgctaggggcggggcaggaggtggggaaaagctgcgtggtggtgaccatcggcgggaagcgcgtcatgttcgactgcggcatgcacatgggctaccacgaccaccgccactacccggactttgcgcgcgcgctcgctgcctggggagcgcccgacttcaccaccgccatctcctgcgtcgtcatcacgcatttccacttggatcatatcggggcgctgccctacttcactgagatctgcgggtaccacggccccatctacatgacgtatcctacaaaggctttagctccatttatgctcgaggactatcggaaagtaacgatggatcagagaggggaggaagagcaatatagctatgaagatattcttaggtgtatgaagaaagtcataccaatggacttgaagcagactattcaagtagataaagacctagtgatccgtgcctattatgctggacatgttataggggctgccatgatttatgcaaaagttggggatgctgctatggtttacaccggggattacaatatgacaccagatagacatcttggggccgcacaaattgatcacctgaagttggatctcttgataacagaatcaacatatgctaaaactatacgtgactcaaagcatgcccgagagagggagttcttaaaagcggtacataaatgtgtttctggtggaggtaaagttctaattccaacgtttgctctgggaagagctcaggaactatgcatgttactggatgactattgggagaggatggacttgaaagttcctatttatttttcagctggtttaaccattcaagctaacgtgtactacaaaatgttgatcggatggactagccaaaagatcaaggacagccatgcagtgcataacccctttgacttcaagcatgtttgccactttgagcgttccttcattaacaaccctggtccctgtgtactttttgcaacacctggtatgattagtgggggattttctcttgaggcgtttaagaaatgggcaccatcagagaagaatctgattacacttcccggatattgtgtttctggaaccattggtcataagttaatgtgtgggaaacctacaaggattgattacaaggacattcatattgatgtcagatgtcagattcatcagctagcattcagtcctcatacagactccaaagggattatggatctgacagaattcctgtcacccaaacatgtaattctcgttcatggtgaaaagcctcagatggcttttctgaaggagaggatcgaatctgaattggggatgccttgctattacccagggaataatgaatccgtctccattccgacaacccagaaccttaaaatgagtgccacagaaaggttcattacaagctgtgctgtggagcaaggtaaacgtagcctgcacaagcggaacctgatttgtggtacaggtttgtcagaagtgattggcagcgatgaggaggcggcggagggcattcttctgatggagaaacacaagtctccgaaaattctttgtgaggatgagctccttgaagtgctgggcatggagcagcatcttgtccagtttgaaccaatggtctccagaattgtagctgatgttgaatcggagttgcagcgggctaaggcagcggatttagatagcgatgggaaatga

SEQ ID NO: 5374 - protein, 558 aa, Sorghum bicolor
  misc_feature: Ceres ANNOT ID no. 6042949
  misc_feature (15)..(242): Pfam Id: Lactamase_B Pfam Desc: Metallo-beta-lactamase superfamily
  misc_feature (378)..(420): Pfam Id: RMMBL Pfam Desc: RNA-metabolising metallo-beta-lactamase
  misc_feature (7)..(481): NCBI GI: 46360445 NCBI Desc: act11d09.9 [cucumis melo]
  misc_feature (1)..(528): NCBI GI: 27372065 NCBI Desc: feg protein [arabidopsis thaliana]
  misc_feature (8)..(454): NCBI GI: 118572558 NCBI Desc: integrator complex subunit 11 (int11) (cpsf3l-like protein)
  misc_feature (8)..(484): NCBI GI: 15029864 NCBI Desc: similar to human flj20542 protein [mus musculus]
  misc_feature (8)..(454): NCBI GI: 56204955 NCBI Desc: novel protein [homo sapiens]
MAIECLVLGAGQEVGKSCVVVTIGGKRVMFDCGMHMGYHDHRHYPDFARALAAWGAPDFTTAISCVVITHFHLDHIGALPYFTEICGYHGPIYMTYPTKALAPFMLEDYRKVTMDQRGEEEQYSYEDILRCMKKVIPMDLKQTIQVDKDLVIRAYYAGHVIGAAMIYAKVGDAAMVYTGDYNMTPDRHLGAAQIDHLKLDLLITESTYAKTIRDSKHAREREFLKAVHKCVSGGGKVLIPTFALGRAQELCMLLDDYWERMDLKVPIYFSAGLTIQANVYYKMLIGWTSQKIKDSHAVHNPFDFKHVCHFERSFINNPGPCVLFATPGMISGGFSLEAFKKWAPSEKNLITLPGYCVSGTIGHKLMCGKPTRIDYKDIHIDVRCQIHQLAFSPHTDSKGIMDLTEFLSPKHVILVHGEKPQMAFLKERIESELGMPCYYPGNNESVSIPTTQNLKMSATERFITSCAVEQGKRSLHKRNLICGTGLSEVIGSDEEAAEGILLMEKHKSPKILCEDELLEVLGMEQHLVQFEPMVSRIVADVESELQRAKAADLDSDGK

SEQ ID NO: 5375 - DNA, 1050 bp, Sorghum bicolor
  misc_feature: Ceres ANNOT ID no. 6042952
  misc_feature: Encodes the peptide sequence at SEQ ID NO 5376
atggaggaggagcaagcagcagccatccaggtggtggttccccgagtcaagctcggcgcccagggattagaggtgtccaagctgggtttcgggtgcttcggcctcaccggcgcttacggatcggcggcgctcgacgacgaggcggcggccgcagtcatcgcgcacgccttccgtcgcggggtcaccttcttcgacacctccgacatctacgggcctctcaccaacgagatcctgctcgggaagcagctcaagcagctgccgcgggagcaggtgcaggtggccaccaagttcgggcttgcgcgggacgacgccagcggcgcctggaccgtctgcggccggcccgagtacgtgcgcgcctgctgcgaggccagcctccgccgccttggcgtccactgcatcgacctctactacctgcaccgcgtcgacaccaccgtccccatcgaggacacgattggcgagctcaagaaactggtggaggaggggaaggtcaagtacatcggattgtcagaggcgagcccggacaccattaggcgtgcgcatgctgtgcacccgatcaccgcggtgcagatggagtggtcgctctggtctcgcgacatcgagcccgagattgtgccgctctgcagagaattggacattggaattgttccttacagcccgattggcaaagggtttttcggcggacgaggagtcacggaacaagtgtccgctgcatctaatctgcgaaggcacccaaggttttcagcagaaaatttggagaagaacaaacaaatttatctgaaaatggaagagctggccaacaaacaccggtgcagccctgctcagctagctctagcttgggttctgcatcaaggggacgatgtgattcctataccaggaacaaccaagatcaagaatcttgatgccaacattgactccttgaaggtgaagttaacggacgatgatctgaaagaaatcagcagcgagatacgcgaagaagatgttgctggtgcgagacagaacacttcttttgggcctactaattggaactatgcagatacaccaaggaaatag

SEQ ID NO: 5376 - protein, 349 aa, Sorghum bicolor
  misc_feature: Ceres ANNOT ID no. 6042952
  misc_feature (19)..(323): Pfam Id: Aldo_ket_red Pfam Desc: Aldo/keto reductase family
  misc_feature (11)..(347): NCBI GI: 78708648 NCBI Desc: oxidoreductase, aldo/keto reductase family [oryza sativa (japonica cultivar-group)]
  misc_feature (13)..(347): NCBI GI: 59896631 NCBI Desc: perakine reductase [rauvolfia serpentina]
  misc_feature (13)..(347): NCBI GI: 2462762 NCBI Desc: highly similar to auxin-induced protein (aldo/keto reductase family) [arabidopsis thaliana]
  misc_feature (13)..(347): NCBI GI: 62526573 NCBI Desc: aldo/keto reductase akr [manihot esculenta]
  misc_feature (13)..(347): NCBI GI: 6562980 NCBI Desc: auxin-induced atb2 [arabidopsis thaliana]
MEEEQAAAIQVVVPRVKLGAQGLEVSKLGFGCFGLTGAYGSAALDDEAAAAVIAHAFRRGVTFFDTSDIYGPLTNEILLGKQLKQLPREQVQVATKFGLARDDASGAWTVCGRPEYVRACCEASLRRLGVHCIDLYYLHRVDTTVPIEDTIGELKKLVEEGKVKYIGLSEASPDTIRRAHAVHPITAVQMEWSLWSRDIEPEIVPLCRELDIGIVPYSPIGKGFFGGRGVTEQVSAASNLRRHPRFSAENLEKNKQIYLKMEELANKHRCSPAQLALAWVLHQGDDVIPIPGTTKIKNLDANIDSLKVKLTDDDLKEISSEIREEDVAGARQNTSFGPTNWNYADTPRK

SEQ ID NO: 5377 - DNA, 1050 bp, Sorghum bicolor; identical to SEQ ID NO: 5375
  misc_feature: Ceres ANNOT ID no. 6042955
  misc_feature: Encodes the peptide sequence at SEQ ID NO 5378

SEQ ID NO: 5378 - protein, 349 aa, Sorghum bicolor; identical to SEQ ID NO: 5376
  misc_feature: Ceres ANNOT ID no. 6042955
  misc_feature (19)..(323): Pfam Id: Aldo_ket_red Pfam Desc: Aldo/keto reductase family
  misc_feature (11)..(347): NCBI GI: 78708648 NCBI Desc: oxidoreductase, aldo/keto reductase family [oryza sativa (japonica cultivar-group)]
  misc_feature (13)..(347): NCBI GI: 59896631 NCBI Desc: perakine reductase [rauvolfia serpentina]
  misc_feature (13)..(347): NCBI GI: 2462762 NCBI Desc: highly similar to auxin-induced protein (aldo/keto reductase family) [arabidopsis thaliana]
  misc_feature (13)..(347): NCBI GI: 62526573 NCBI Desc: aldo/keto reductase akr [manihot esculenta]
  misc_feature (13)..(347): NCBI GI: 6562980 NCBI Desc: auxin-induced atb2 [arabidopsis thaliana]

SEQ ID NO: 5379 - DNA, 2727 bp, Sorghum bicolor
  misc_feature: Ceres ANNOT ID no. 6042961
  misc_feature: Encodes the peptide sequence at SEQ ID NO 5380
  misc_feature: Up-regulated in shoot tissues in response to salicylic acid treatment
atggggtcctcgctcccgcccaaggaggccaacctcttcaaagtcatcgtcaaatcctatgagactaagcaatataagaaagggcttaaggctgcagattctatattaaaaaagtttccagagcatggtgaaacactatcaatgaaaggtttgacgctaaactgcatggaccgaaaatctgaagcgtatgagcttgttcgccgaggcctcaagaatgatctgaagagtcatgtctgttggcatgtctatggtttgctttatcggtcagatagagaatacagagaagctataaaatgttacagaaatgcattgaggattgatccagataacatagaaattcttcgtgacttgtctcttctccaggcacagatgagggacttgtctggctttgttgagactaggcaacaacttttgtcgttaaagccaaatcatcgcatgaactggattggttttgcggtcgctcatcatttgaattctaattcttctaaggcaatagaagtattggaggcatacgagggaacactggaagatgattatcctccagagaatgagcgatatgaacatagtgaaatgctgctgtataagatatcactgtttgaagaatgtgggatgctagacagagcccttgaggaaatgcagaagaaggagagcaaaattgttgacaagctatcattcaaagaacaaatggcatccgtcttgttcaaacttggccgctttgatgaatctgagagcatatacagatctttgctttttatgaatcctgataactacaaatacttcattgctgtccaaaagtgccttggcctatactctgataatggtcaatattctgctgatgatgttgagcgcttaagtgcattatacaactcacttaaagaaaagtatgcttggtcatctgctgttaagcgtatccctcttgattttctggaaggtgagaagttcaaggaggcagcagacaactatgtcagacctctattaacaaagggtgtgccctcactattttctgatttaagcccactgtatgaacatcctggcaaggcaaacatactggagcaattatttcttaaaatagaagattcaattaggacttttggatgctttcctggatgtccacagaaggagcctccttccacactgttgtggactctgtttttgatttctcagcactatgacagaagagggcaatatgacattgctttaaataaaatcaatgaggctatctcacatacaccgactgtcatcgatttatattcagtaaaggggaagatattgcaacatgctggaaatttcacagcagcagctgcattagcagatgaagctaggtccatggatcttgctgatcgttatttaaacagcgagtgtgttatgcagatgcttcaggctgaccaggttggccttgctgagaagactgctgtcttgtttacaaaagatggtgatcaacacaataatctccatgacatgcagtgcatgtggtatgagcttgcttctggggagagctattaccgtcaaggtgatcttggccgggccctaaaaaatttcttggcagttgaaaagcattacgctgatatgactgaagatcaatttgacttccattcgtattgcttgcggaaaatgacacttagagcatatgtttctatgctgaagtttcaagatcgtttgcatgctcatgaatacttccacaaggctgctgctggagctatccggtgctatatgaaactacatgattctccaacaaaatcttctacggaggagaatgatgagatgtcaaaactgccacctgctcagaggaagaagttgaggcaaaagcagaagaaagcagaagcgcgtgctaaaagggaggctgaagagaaacaggaggatgaaacagcttcatctaacagttcaaaatctggaaagaaacaacatgcaagaccagttgatctggatccacatggtgaaaaattaatccagattgaaaaccctcttgcagaagctacgaaatacttgaagcttctgcagaataactcgtcagactcattagagacccatatactttcatttgagctaagcatgagaaagcaaaaggttttacttgctttccaggcagttaaacagctcattaaattggacgaggataatccagacagtcaccgctgtttgataaaattcttccacaagataaacagtcttcctggaccagtgactgattcagagaagctaatttggaatgttttggaagctgaaagacctgacatgaggcaattacatggaaagtcccttgttgaagtaaacagaagtttccttgaaaaacacaatgcatccttgatgcaccgagcagctggtgctgaaatgatgtatctcttggagccagataagaagatggaggcaattaaattaattgaagactcaacaaatattacatcgtcagggcatagtgtgcttggtcctgtaaaagaatggcaaattcaagattgtatcgatgttcataaattgctggagacagtctttggtgatcacgatgttgcaaataggtggaaggcacggtgtgcggaatatttcccctactcgacatactttgaaggcatcaagagcgctatttcagcctatgctgttgaccatagtctcgagagctcaccagaaaatggaattgcttcaaaccctcagctgaaatcaaaagagggagaacaaggcagtttgaacgggactgtgcatattgtggatgatttgagcagcctaagcattcggtaa

SEQ ID NO: 5380 - protein, 908 aa, Sorghum bicolor
  misc_feature: Ceres ANNOT ID no. 6042961
  misc_feature (77)..(110): Pfam Id: TPR_2 Pfam Desc: Tetratricopeptide repeat
  misc_feature (77)..(110): Pfam Id: TPR_1 Pfam Desc: Tetratricopeptide repeat
  misc_feature (1)..(908): NCBI GI: 54290419 NCBI Desc: acetyltransferase 1-like [oryza sativa (japonica cultivar-group)]
  misc_feature (4)..(792): NCBI GI: 37362296 NCBI Desc: transcriptional coactivator tubedown-100 [danio rerio]
  misc_feature (4)..(818): NCBI GI: 22035307 NCBI Desc: transcriptional coactivator tubedown-100 [homo sapiens]
  misc_feature (4)..(792): NCBI GI: 55777299 NCBI Desc: nmda receptor-regulated gene 1 [danio rerio]
  misc_feature (4)..(792): NCBI GI: 28195005 NCBI Desc: n-terminal aceyltransferase 1 [mus musculus]
  misc_feature: Up-regulated in shoot tissues in response to salicylic acid treatment
MGSSLPPKEANLFKVIVKSYETKQYKKGLKAADSILKKFPEHGETLSMKGLTLNCMDRKSEAYELVRRGLKNDLKSHVCWHVYGLLYRSDREYREAIKCYRNALRIDPDNIEILRDLSLLQAQMRDLSGFVETRQQLLSLKPNHRMNWIGFAVAHHLNSNSSKAIEVLEAYEGTLEDDYPPENERYEHSEMLLYKISLFEECGMLDRALEEMQKKESKIVDKLSFKEQMASVLFKLGRFDESESIYRSLLFMNPDNYKYFIAVQKCLGLYSDNGQYSADDVERLSALYNSLKEKYAWSSAVKRIPLDFLEGEKFKEAADNYVRPLLTKGVPSLFSDLSPLYEHPGKANILEQLFLKIEDSIRTFGCFPGCPQKEPPSTLLWTLFLISQHYDRRGQYDIALNKINEAISHTPTVIDLYSVKGKILQHAGNFTAAAALADEARSMDLADRYLNSECVMQMLQADQVGLAEKTAVLFTKDGDQHNNLHDMQCMWYELASGESYYRQGDLGRALKNFLAVEKHYADMTEDQFDFHSYCLRKMTLRAYVSMLKFQDRLHAHEYFHKAAAGAIRCYMKLHDSPTKSSTEENDEMSKLPPAQRKKLRQKQKKAEARAKREAEEKQEDETASSNSSKSGKKQHARPVDLDPHGEKLIQIENPLAEATKYLKLLQNNSSDSLETHILSFELSMRKQKVLLAFQAVKQLIKLDEDNPDSHRCLIKFFHKINSLPGPVTDSEKLIWNVLEAERPDMRQLHGKSLVEVNRSFLEKHNASLMHRAAGAEMMYLLEPDKKMEAIKLIEDSTNITSSGHSVLGPVKEWQIQDCIDVHKLLETVFGDHDVANRWKARCAEYFPYSTYFEGIKSAISAYAVDHSLESSPENGIASNPQLKSKEGEQGSLNGTVHIVDDLSSLSIR

SEQ ID NO: 5381 - DNA, 1827 bp, Sorghum bicolor
  misc_feature: Ceres ANNOT ID no. 6042965
  misc_feature: Encodes the peptide sequence at SEQ ID NO 5382
atgaagtacgtccttgtcaccggcggggtggtgagcggcctgggcaagggcgtcacggccagcagcatcggcgtcatcctcaaggcgtgcggcctccgcattacgtccattaagatcgatccttaccttaacaccgatgctggaactatgtctccattcgaacatggtgaagtgttcgtgctggatgatggtggcgaggtggacttggatcttggtaactacgagaggtttctggacattaaacttactcgggacaataatataaccaccggaaagatctatcagtctgtaattgacaaggagaggaaaggggaatacttgggaaagactgtccaggttgtgccacacatcacaaatgccatacaggagtggatcgagcgtgttgctatgataccagttgatggcaaggagggacctgctgatgtctgtgtgatagaactggggggcactataggtgatattgaatccatgccatttattgaagctttgggccagttctcttatcgtgttggtcctggcaacttctgcctggtgcacgtcagtctagttccagttttgaatgttgttggtgaacagaaaacaaagccaacccagcatagtgtacgtggtttgaggggactcgggctcaccccaaatattttagcttgccgcagtactaaggaattagaggataatgtgaaggagaaactctcccagttttgccatgtgccggcagcaaatattatctctttgtatgatgtttccaatatctggcgcattcctttgttgctacgggaccaaaaagctcatgaggctattcttaaagttctgaacctggaaagggtggatagcattgctcgagagccaaagttagacgaatgggttgcaagagctgctatatttgatacccttcatgacactgtgaggattgctatggttgggaagtacactggcttatcagattcatacctgtctgtgttgaaagccctcttgcatgcatctgttgattgccgcaggaagcttgttgttgattgggttgcttcaacggatcttgaggactccacggcagttgaggcacctgatgcatataaaacagcgtgggatttgttgaagggggcagatggaattttggtacctggtggctttggtgacagaggtgttcaagggaaaattttggctgctaagtatgcccgtgaaaagaatgtcccatatcttggtatatgtcttgggatgcagattgctgtggtggagtatgctcgtcatgtcatgaatctcaccgatgcaaacagcactgaatttgatccaaataccaagaccccttgtgttatttttatgcctgagggttccaaaacacatatgggtgcgacaatgcgcttaggatcaaggaggacatttttcaagattgctgattgcaagtcttctaaattgtatggcaatgtcacttatgttgatgaaaggcatcgccacagatatgaggtgaaccctgatatggttccagagttcgaaaatgctggacttcagtttgttggcaaagatgatactggaaggaggatggagattattgaaatacccaaccaccgatattttgttggtgcacaattccatcctgagttcaagtcaagaccttcaaaaccttcgcccctatttgtgggactaattgcggctgcatctgggcagttggatagggtgctgcaagactgctgcaatggtcatgttatttcagctaagcatgttctgagcaatggctcatatacacccacagtacaccaaaatgggcacccaaagaagctcgccaatggtctctcaaacggaacatactatgccaatggcaatggtgtgcatgcttag

SEQ ID NO: 5382 - protein, 608 aa, Sorghum bicolor
  misc_feature: Ceres ANNOT ID no. 6042965
  misc_feature (1)..(287): Pfam Id: CTP_synth_N Pfam Desc: CTP synthase N-terminus
  misc_feature (311)..(548): Pfam Id: GATase Pfam Desc: Glutamine amidotransferase class-I
  misc_feature (1)..(608): NCBI GI: 115438602 NCBI Desc: os01g0616900 [oryza sativa (japonica cultivar-group)]
  misc_feature (1)..(607): NCBI GI: 124360185 NCBI Desc: glutamine amidotransferase, class i, active site [medicago truncatula]
  misc_feature (301)..(607): NCBI GI: 4926827 NCBI Desc: t17h7.12 [arabidopsis thaliana]
  misc_feature (1)..(544): NCBI GI: 7268827 NCBI Desc: ctp synthase like protein [arabidopsis thaliana]
  misc_feature (1)..(554): NCBI GI: 92877256 NCBI Desc: ctp synthase [medicago truncatula]
  misc_feature (1)..(579): SWISSPROT Homolog: EC 6.3.4.2 CTP synthase 1
MKYVLVTGGVVSGLGKGVTASSIGVILKACGLRITSIKIDPYLNTDAGTMSPFEHGEVFVLDDGGEVDLDLGNYERFLDIKLTRDNNITTGKIYQSVIDKERKGEYLGKTVQVVPHITNAIQEWIERVAMIPVDGKEGPADVCVIELGGTIGDIESMPFIEALGQFSYRVGPGNFCLVHVSLVPVLNVVGEQKTKPTQHSVRGLRGLGLTPNILACRSTKELEDNVKEKLSQFCHVPAANIISLYDVSNIWRIPLLLRDQKAHEAILKVLNLERVDSIAREPKLDEWVARAAIFDTLHDTVRIAMVGKYTGLSDSYLSVLKALLHASVDCRRKLVVDWVASTDLEDSTAVEAPDAYKTAWDLLKGADGILVPGGFGDRGVQGKILAAKYAREKNVPYLGICLGMQIAVVEYARHVMNLTDANSTEFDPNTKTPCVIFMPEGSKTHMGATMRLGSRRTFFKIADCKSSKLYGNVTYVDERHRHRYEVNPDMVPEFENAGLQFVGKDDTGRRMEIIEIPNHRYFVGAQFHPEFKSRPSKPSPLFVGLIAAASGQLDRVLQDCCNGHVISAKHVLSNGSYTPTVHQNGHPKKLANGLSNGTYYANGNGVHA

SEQ ID NO: 5383 - DNA, 1050 bp, Sorghum bicolor
  misc_feature: Ceres ANNOT ID no. 6042970
  misc_feature: Encodes the peptide sequence at SEQ ID NO 5384
atggccggcaagatgaaggagttagacggcgccagccctgctaagatcttcatcggcgggctctccaaggacacaagcatgagtacattcaaagaacatttcgggaaatatggggatataattgatgctgtcattatgaaggaccgctacactcaaaagcccagaggctttggctttattacctttgctgatcccgctgttgttgacagagtgattgaggatgagcatgttatcaatggaaagctggttgaaattaaaagaacgatccctaagggagctgctcccttgaaagatttcaagacgaagaagatttttgttggtggattaccctcagctctaaaagaagatgaattcaaggaatttttttccaagtttggaaaggttgtggagcatgaaatcatccgtgaccatacaaccaatcggtcacgtggatttggttttatagtctttgatgcagaaaaaacagtagatgatttattagctaagaaaggcaatatgattgatctaaatggttctcaggtggagatcaagaaggcagaaccaaagaaaccctctaaccaaccacctcgttcacttgatagcgaacctaggggccgtccatatgcagacagttatgatggatttggcagctcttacaattatggtggtagttttggtccttatagatcacctggaagttttggcgctaggcctggaggttacaatagtgcttctggtcctggtgattatggtagcggctatgctacttatggtggagcattagtaggataccgtggagagccatccctttattctagtcgctatggtagcacttacggaagcagctttggtggcgggtatggtggtggcagttatgcgggtggattagctggtgcatatgggcgtgaggctgggggctatggtggttctagctatggtcctagttatgattcttcaggggctaatactggtgctgggtttggcaccggtggactctatggtgctaggacaggctatggtagcactggtggcagtggtgctgctggtcgttaccatccatatggaagatag

SEQ ID NO: 5384 - protein, 349 aa, Sorghum bicolor
  misc_feature: Ceres ANNOT ID no. 6042970
  misc_feature (16)..(85): Pfam Id: RRM_1 Pfam Desc: RNA recognition motif. (a.k.a. RRM, RBD, or RNP domain)
  misc_feature (104)..(176): Pfam Id: RRM_1 Pfam Desc: RNA recognition motif. (a.k.a. RRM, RBD, or RNP domain)
  misc_feature (3)..(349): NCBI GI: 42409159 NCBI Desc: rna recognition motif (rrm)-containing protein-like [oryza sativa (japonica cultivar-group)]
  misc_feature (40)..(349): NCBI GI: 115468588 NCBI Desc: os06g0566100 [oryza sativa (japonica cultivar-group)]
  misc_feature (11)..(307): NCBI GI: 15220810 NCBI Desc: rna recognition motif (rrm)-containing protein [arabidopsis thaliana]
  misc_feature (15)..(307): NCBI GI: 8778468 NCBI Desc: f1l3.34 [arabidopsis thaliana]
  misc_feature (100)..(342): NCBI GI: 79325275 NCBI Desc: rna binding / nucleic acid binding [arabidopsis thaliana]
  misc_feature: The sequence is a functional homolog of SEQ ID NO 1039 in the 10/374,780US patent application
  misc_feature: The sequence is a functional homolog of SEQ ID NO 849 in the 10/666,642US patent application
  misc_feature: Useful for making plants with modulated growth and phenotype characteristics
  misc_feature: The sequence is a functional homolog of SEQ ID NO 1039 in the 20060162006 US patent application
  misc_feature: The sequence is a functional homolog of SEQ ID NO. 339 in the 11/188,298 US application
  misc_feature: The sequence is a functional homolog of SEQ ID NO. 458 in the 11/188,298 US application
MAGKMKELDGASPAKIFIGGLSKDTSMSTFKEHFGKYGDIIDAVIMKDRYTQKPRGFGFITFADPAVVDRVIEDEHVINGKLVEIKRTIPKGAAPLKDFKTKKIFVGGLPSALKEDEFKEFFSKFGKVVEHEIIRDHTTNRSRGFGFIVFDAEKTVDDLLAKKGNMIDLNGSQVEIKKAEPKKPSNQPPRSLDSEPRGRPYADSYDGFGSSYNYGGSFGPYRSPGSFGARPGGYNSASGPGDYGSGYATYGGALVGYRGEPSLYSSRYGSTYGSSFGGGYGGGSYAGGLAGAYGREAGGYGGSSYGPSYDSSGANTGAGFGTGGLYGARTGYGSTGGSGAAGRYHPYGR

SEQ ID NO: 5385 - DNA, 1215 bp, Sorghum bicolor
  misc_feature: Ceres ANNOT ID no. 6042998
  misc_feature: Encodes the peptide sequence at SEQ ID NO 5386
atggcatttccgtcgcgggcggctctgctcttcgcgggggtgctcttagtggtgttggcggcggcgccggcggcggaagcgggagcgggaggagggagcgtctgcttcgaccgggtgttcagtttcggggactcgctcacggataccggcaacttcctgctctccgtgcccgacgacttcccggaccccgcgcggaacctcccctacggacagaccttcttcggccgcccctccggccgctactccgatggtcgcaacctgctcgacttcttcgcggaggcatttgggatgccatatgtgccaccgtaccttggcggcggtgacttccagaatggtgcaaactttgcagtcggcggggcaactgccctcaatggctcgttcttccgtgaacgtggcgtggagcctacatggacacctcactcccttgatgagcagatgcaatggttcaagaagcttctcccatccattgcatcgtctgagacagagcaaaaggaaataatgtccaagtcacttttctttgtgggagaggttggtggaaatgattacaaccatttaatcgttaggcagaaatctcttgatgagctacatgaagttgttcctaatgttgttggtgccataagctcggccatcgtggatcttataaatcttggagcaaagaagttagttgttccagggaacttcccaatagggtgtgtcccattatatcttgcaatctttcagagccaaaaggaggattactacgaggaacaaacaggctgcattaagtggcttaatgaatttgctgagtaccacaataggatgcttcaggaggagttggagaaactcaggaatcttcaccctgatgtgaccatcatttatgctgattattatggcgctgcactgaacatattccgtgccccactccagtttggcttcacagtcccactgaattcgtgttgtggaagtgatgctccgtacaactgttccccttcaatattgtgcgggcgtcctggatctacagtgtgccctgacccatcaaaatacatctcatgggatggtctacacttcactgaggcgagttacaaagttgtcattcaaggagtactcggagggtatgccaaacctcctctttcagaaacctgcaggggtgcggaattcaaagtttctcaacttcaccaatgtacagataatccaacaaacactgtatcatacgatgctttgagctcttttatttga

SEQ ID NO: 5386 - protein, 404 aa, Sorghum bicolor
  misc_feature: Ceres ANNOT ID no. 6042998
  misc_feature (39)..(361): Pfam Id: Lipase_GDSL Pfam Desc: GDSL-like Lipase/Acylhydrolase
  misc_feature (1)..(370): NCBI GI: 54290849 NCBI Desc: lanatoside 15'-o-acetylesterase-like [oryza sativa (japonica cultivar-group)]
  misc_feature (36)..(388): NCBI GI: 10764858 NCBI Desc: f1k23.17 [arabidopsis thaliana]
  misc_feature (5)..(370): NCBI GI: 115435276 NCBI Desc: os01g0215700 [oryza sativa (japonica cultivar-group)]
  misc_feature (5)..(319): NCBI GI: 55297543 NCBI Desc: lipase-like [oryza sativa (japonica cultivar-group)]
  misc_feature (36)..(377): NCBI GI: 61971497 NCBI Desc: lipase 2 [brassica napus]
MAFPSRAALLFAGVLLVVLAAAPAAEAGAGGGSVCFDRVFSFGDSLTDTGNFLLSVPDDFPDPARNLPYGQTFFGRPSGRYSDGRNLLDFFAEAFGMPYVPPYLGGGDFQNGANFAVGGATALNGSFFRERGVEPTWTPHSLDEQMQWFKKLLPSIASSETEQKEIMSKSLFFVGEVGGNDYNHLIVRQKSLDELHEVVPNVVGAISSAIVDLINLGAKKLVVPGNFPIGCVPLYLAIFQSQKEDYYEEQTGCIKWLNEFAEYHNRMLQEELEKLRNLHPDVTIIYADYYGAALNIFRAPLQFGFTVPLNSCCGSDAPYNCSPSILCGRPGSTVCPDPSKYISWDGLHFTEASYKVVIQGVLGGYAKPPLSETCRGAEFKVSQLHQCTDNPTNTVSYDALSSFI

SEQ ID NO: 5387 - DNA, 945 bp, Sorghum bicolor
  misc_feature: Ceres ANNOT ID no. 6043008
  misc_feature: Encodes the peptide sequence at SEQ ID NO 5388
  misc_feature: Up-regulated in shoot tissues in response to salicylic acid treatment
atgccgaaggacaggagctcccgcgtttcctcttatgagagccgtcgggctcgtgcctccccatacttctcagcgtctcatggacagagcagttcttctcgccggtccgaagagtctcctgcggctgcagcagcggcagcagcgaagcaagctgcagagtgggaggatgttcggtgcccagtctgcatggatcacccgcacaatgctgtcctgctggtctgctcgtcgcatgagaagggctgccgccccttcatgtgtgacaccagctcgcggcactccaattgctacgaccagtaccgaaaggcctccaaggattcctccaaggattcagggacagagtgcagtgagtgccagcagcaggttcagctctcctgcccactgtgccgtgggccagtcagcgattgcatcaaggactatgatgcgcgaaagtacatgaacaccaaggtccgatcgtgcaccatggagtcgtgtgagttcaggggcgcctaccaggagctgaggaagcatgctagggtggagcatccagcagcgaggccaatggaggtagaccctgaacggcagcgggattggcgccggatggagcagcagcgggaccttggggacttgatgagcatgctgcgttcagggttcagcagcaatattgaggaagacggtgctggacttggggctattgaagaaggggaagaggaagctgaaaggactccaaccgccataacaatggtcttcatcatgccatctagaggctcgatcatgcagtacttaacagaacgcagtagggcgatcattctggtcagtcggaggcgagcaagcagtggcagtggtgacgctgaagccacagcaccagatggcgaggaaggtgatgaccctatgccatcggccgaggcatctgctggttcacagcatgcttctgaagaagaggaggctgacggtgaccccgcgcaatga

SEQ ID NO: 5388 - protein, 314 aa, Sorghum bicolor
  misc_feature: Ceres ANNOT ID no. 6043008
  misc_feature (1)..(313): NCBI GI: 115438510 NCBI Desc: os01g0612600 [oryza sativa (japonica cultivar-group)]
  misc_feature (117)..(286): NCBI GI: 92895183 NCBI Desc: traf-like [medicago truncatula]
  misc_feature (104)..(243): NCBI GI: 38346521 NCBI Desc: osjnba0027h09.16 [oryza sativa (japonica cultivar-group)]
  misc_feature (104)..(243): NCBI GI: 116317899 NCBI Desc: osigba0131j24.4 [oryza sativa (indica cultivar-group)]
  misc_feature (109)..(208): NCBI GI: 82568695 NCBI Desc: pm27 [prunus mume]
  misc_feature: The sequence is a functional homolog of SEQ ID NO 2652 in the 10/374,780US patent application
  misc_feature: The sequence is a functional homolog of SEQ ID NO 322 in the 10/225,066US patent application
  misc_feature: The sequence is a functional homolog of SEQ ID NO 354 in the 10/666,642US patent application
  misc_feature: Useful for making plants with modulated growth and phenotype characteristics
  misc_feature: The sequence is a functional homolog of SEQ ID NO 322 in the 20050160493 US patent application
  misc_feature: The sequence is a functional homolog of SEQ ID NO 354 in the 20070033671 US patent application
  misc_feature: Up-regulated in shoot tissues in response to salicylic acid treatment
MPKDRSSRVSSYESRRARASPYFSASHGQSSSSRRSEESPAAAAAAAAKQAAEWEDVRCPVCMDHPHNAVLLVCSSHEKGCRPFMCDTSSRHSNCYDQYRKASKDSSKDSGTECSECQQQVQLSCPLCRGPVSDCIKDYDARKYMNTKVRSCTMESCEFRGAYQELRKHARVEHPAARPMEVDPERQRDWRRMEQQRDLGDLMSMLRSGFSSNIEEDGAGLGAIEEGEEEAERTPTAITMVFIMPSRGSIMQYLTERSRAIILVSRRRASSGSGDAEATAPDGEEGDDPMPSAEASAGSQHASEEEEADGDPAQ

SEQ ID NO: 5389 - DNA, 498 bp, Sorghum bicolor
  misc_feature: Ceres ANNOT ID no. 6043010
  misc_feature: Encodes the peptide sequence at SEQ ID NO 5390
atgtggcgccgcctgcacaccctagcccccgccttgcgcagggcaaccgccgccgctgccggggcccccgcggcgcccgcctcctctgcagcccgcgccgcgccgctctcctcggcggccgccgccttccgccgcaccagcccgctcctctcagaggacaagccggcgaaggtggaggacgtcatgcccatcgccacggggctcgagcgggaggagctggaggccgagctccaggggaagaagcggtttgacatggatccaccggtcggtcccttcggtaccaaggaggcaccagctgtcatcgagtcctactataacaagcggatagtcggttgccctggtggtgagggagaggatgaacatgatgttgtatggttctggttgaaaaaagatgagcctcatgagtgtccagtctgctcgcaatactttgtgcttaaggtcatcggtgatggtggagatcctgatggtcatgacgatgaagatgatggacatcactaa

SEQ ID NO: 5390 - protein, 165 aa, Sorghum bicolor
  misc_feature: Ceres ANNOT ID no. 6043010
  misc_feature (53)..(151): Pfam Id: COX5B Pfam Desc: Cytochrome c oxidase subunit Vb
  misc_feature (1)..(165): NCBI GI: 82623399 NCBI Desc: cytochrome c oxidase family protein-like [solanum tuberosum]
  misc_feature (1)..(165): NCBI GI: 145332591 NCBI Desc: cytochrome c oxidase family protein [arabidopsis thaliana]
  misc_feature (1)..(165): NCBI GI: 106879617 NCBI Desc: cytochrome c oxidase subunit 5b [plantago major]
  misc_feature (1)..(165): NCBI GI: 113734315 NCBI Desc: cytochrome c oxidase subunit vb [pisum sativum]
  misc_feature (1)..(165): NCBI GI: 113734309 NCBI Desc: cytochrome c oxidase subunit vb [pisum sativum]
MWRRLHTLAPALRRATAAAAGAPAAPASSAARAAPLSSAAAAFRRTSPLLSEDKPAKVEDVMPIATGLEREELEAELQGKKRFDMDPPVGPFGTKEAPAVIESYYNKRIVGCPGGEGEDEHDVVWFWLKKDEPHECPVCSQYFVLKVIGDGGDPDGHDDEDDGHH

SEQ ID NO: 5391 - DNA, 1146 bp, Sorghum bicolor
  misc_feature: Ceres ANNOT ID no. 6043020
  misc_feature: Encodes the peptide sequence at SEQ ID NO 5392
atggatctcatcattactgtgtccaaggtcattgtatgcaaaggagcagaccacggttgtaaacattacaagacatgttttctatttatttatagcacatatactttgctaagtgttaaccatgtgcgtcaaccgatgcgcgcgatggcgcgcgcattgcactggtacaatggcctcttcgtgttcggagattcattcgccgacacagggaactcccccaagtcggatctgagtgaagtgactcgccaatggtacaaaccctatggctcctcccatggttttctccgtgatccaaccggccgcttctccaacagcttggttcagtctgatttcatcgcaaagattcttgggcgctccgaagctcctctgacctacaggcgcacgaaggccggctacccggacaagttcggcgtcaacttcgccgtgggcggcgccggcgtcttcgaggtgccgcgcgaggcgccgacgctcgccagacagatcgacgacttcgagaagatgctcgacgacgacaggaccatcgggaaatggcagctcaggcagtccgtcgcgctggtcgccatctccggcaacgactacgcgcgcgtcgccgccaacacgagcagcgacggcgccgacatcaccggattcgtcgggaacgtgacggacgagatcgccaggggcgtggaccggctgcggaagctcggggtcaccaaggtcctcgtcaacaccctgcacccgctcgcctgcacgccgtggcagtccaggccgtccaactacaccaagtgcgtcggccgcggcaacatggccgccgacttgcacaacgaccacctccgggacaagctgcggaacgctaccgccagcgacagcgtctacctcctcgacctcaaccgggccttcaccaccatcatcagtccatccgatactgacaccgtcccgcaggtggcgaagcagttcaaggagaagctgaggccgtgctgcgagagctgcgatcccaatggctactgcgggcaggtggacaaggatggcggcgcgcagtacagcgtctgctccaacccggagaagcacttcttctgggacgacgtgcacccgacgcaggcaggctgggaggccgtcatggagcagctcgaacgggacatcaaggatttcctccacatttcctactag

SEQ ID NO: 5392 - protein, 381 aa, Sorghum bicolor
  misc_feature: Ceres ANNOT ID no. 6043020
  misc_feature (59)..(369): Pfam Id: Lipase_GDSL Pfam Desc: GDSL-like Lipase/Acylhydrolase
  misc_feature (59)..(377): NCBI GI: 52077212 NCBI Desc: gdsl-lipase -like [oryza sativa (japonica cultivar-group)]
  misc_feature (59)..(377): NCBI GI: 115480743 NCBI Desc: os09g0567800 [oryza sativa (japonica cultivar-group)]
  misc_feature (59)..(372): NCBI GI: 145330374 NCBI Desc: hydrolase, acting on ester bonds [arabidopsis thaliana]
  misc_feature (59)..(376): NCBI GI: 92886160 NCBI Desc: lipolytic enzyme, g-d-s-l [medicago truncatula]
  misc_feature (27)..(359): NCBI GI: 140067125 NCBI Desc: lipolytic enzyme, g-d-s-l [medicago truncatula]
MDLIITVSKVIVCKGADHGCKHYKTCFLFIYSTYTLLSVNHVRQPMRAMARALHWYNGLFVFGDSFADTGNSPKSDLSEVTRQWYKPYGSSHGFLRDPTGRFSNSLVQSDFIAKILGRSEAPLTYRRTKAGYPDKFGVNFAVGGAGVFEVPREAPTLARQIDDFEKMLDDDRTIGKWQLRQSVALVAISGNDYARVAANTSSDGADITGFVGNVTDEIARGVDRLRKLGVTKVLVNTLHPLACTPWQSRPSNYTKCVGRGNMAADLHNDHLRDKLRNATASDSVYLLDLNRAFTTIISPSDTDTVPQVAKQFKEKLRPCCESCDPNGYCGQVDKDGGAQYSVCSNPEKHFFWDDVHPTQAGWEAVMEQLERDIKDFLHISY

SEQ ID NO: 5393 - DNA, 876 bp, Sorghum bicolor
  misc_feature: Ceres ANNOT ID no. 6043031
  misc_feature: Encodes the peptide sequence at SEQ ID NO 5394
atgatgtccggcggtgggtactccgccctcgacgaccccaaggcctccggatccgtcccggcggccacggggacagatccgccggccatcaggttcgccgactccaacctccagaccttcccgccgtccgaggccaggggcaagatcgctggcgcctaccgcccacccaccgacgccgacgacaccttctcgtcaaagggcggaggagccggaagcggtggcagaggcagcagcgccgggtcagatgatgctgcgcagggcggctggttccgcatgttctccgtggcggcttacaagccctacttcgacgttgacacttccgacgttgtcgagaggatctgggagtccgtcttccccttccgcggcacatttaccgagaagacctccgagaaccctgatctgtatgggccattttggacatgcaccaccctgatttttgttgctgcatctattgctacttttgtcacctacctatcccacaaatggcacaagaaggaatggaactatgatatcaacttggttacctggtctgctggcttattctatggctacgtgacgtttgttcctcttcttttatatgttattctcaaatacttctcagcacctgctggtcttgtgcaattgtggtgcctatatggatactccctgttcatcttcattccagcatcgcttctgtctattgtgccaatagaaatattcagatgggtgattgctggcgttgctggtttcatgtctgctaccttcgttgctgtaaatctccgtgcgcacattgtaaattctggcgagcgatggttcctgatcgttgcagggatattcttgttgcagttggggcttgctgttttgctgaaactctatttcttcacgataactgtatag

SEQ ID NO: 5394 - protein, 291 aa, Sorghum bicolor
  misc_feature: Ceres ANNOT ID no. 6043031
  misc_feature (102)..(267): Pfam Id: Yip1 Pfam Desc: Yip1 domain
  misc_feature (1)..(291): NCBI GI: 30690667 NCBI Desc: integral membrane yip1 family protein [arabidopsis thaliana]
  misc_feature (1)..(291): NCBI GI: 38604050 NCBI Desc: at5g27490 [arabidopsis thaliana]
  misc_feature (80)..(287): NCBI GI: 145330697 NCBI Desc: integral membrane yip1 family protein [arabidopsis thaliana]
  misc_feature (71)..(287): NCBI GI: 54642745 NCBI Desc: ga18325-pa [drosophila pseudoobscura]
  misc_feature (60)..(287): NCBI GI: 18859855 NCBI Desc: cg4645-pa [drosophila melanogaster]
MMSGGGYSALDDPKASGSVPAATGTDPPAIRFADSNLQTFPPSEARGKIAGAYRPPTDADDTFSSKGGGAGSGGRGSSAGSDDAAQGGWFRMFSVAAYKPYFDVDTSDVVERIWESVFPFRGTFTEKTSENPDLYGPFWTCTTLIFVAASIATFVTYLSHKWHKKEWNYDINLVTWSAGLFYGYVTFVPLLLYVILKYFSAPAGLVQLWCLYGYSLFIFIPASLLSIVPIEIFRWVIAGVAGFMSATFVAVNLRAHIVNSGERWFLIVAGIFLLQLGLAVLLKLYFFTITV

SEQ ID NO: 5395 - DNA, 531 bp, Sorghum bicolor
  misc_feature: Ceres ANNOT ID no. 6043052
  misc_feature: Encodes the peptide sequence at SEQ ID NO 5396
atgtcgtcggactcctcgtcgtgggcgcgcgccctggttcagatctcgccctacaccttctccgccatcggcatcgccgtctccatcggcgtctccgtcctcggtgccgcatggggtatcttcattacggggagcagcctcatcggggccgccatcaaggcccccaggatcacatctaagaacctcatcagtgtcatcttctgtgaggctgttgcaatttatggtgtaatcgtggcaatcatcctccagacaaagcttgaaagtgtgccaacatctcaaatgtatgctccggagtctcttcgagctggctatgcaatctttgcatctggccttatcgtcggctttgctaatcttgtttgcggggtatgcgtggggataattggaagcagctgcgcactgtctgatgctcagaactcatcactctttgtaaagatcttggtgattgagatctttggcagtgctctgggactgttcggagtaattgtgggtatcattatgtcagctcaagcgacatggccagcaaaagcttga

SEQ ID NO: 5396 - protein, 176 aa, Sorghum bicolor
  misc_feature: Ceres ANNOT ID no. 6043052
  misc_feature (20)..(85): Pfam Id: ATP-synt_C Pfam Desc: ATP synthase subunit C
  misc_feature (104)..(169): Pfam Id: ATP-synt_C Pfam Desc: ATP synthase subunit C
  misc_feature (1)..(175): NCBI GI: 29423617 NCBI Desc: vacuolar membrane atpase subunit c'' [citrus limon]
  misc_feature (1)..(175): NCBI GI: 38640797 NCBI Desc: v-atpase subunit c'' proteolipid [xerophyta viscosa]
  misc_feature (8)..(172): NCBI GI: 145340827 NCBI Desc: f-atpase family transporter: protons (vacuolar) [ostreococcus lucimarinus cce9901]
  misc_feature (2)..(170): NCBI GI: 126275804 NCBI Desc: vacuolar atpase v0 domain subunit c [pichia stipitis cbs 6054]
  misc_feature (2)..(170): NCBI GI: 146450960 NCBI Desc: vacuolar atp synthase subunit c'' [lodderomyces elongisporus nrrl yb-4239]
  misc_feature (7)..(171): SWISSPROT Homolog: EC 3.6.3.14 Vacuolar ATP synthase subunit c''
MSSDSSSWARALVQISPYTFSAIGIAVSIGVSVLGAAWGIFITGSSLIGAAIKAPRITSKNLISVIFCEAVAIYGVIVAIILQTKLESVPTSQMYAPESLRAGYAIFASGLIVGFANLVCGVCVGIIGSSCALSDAQNSSLFVKILVIEIFGSALGLFGVIVGIIMSAQATWPAKA

SEQ ID NO: 5397 - DNA, 543 bp, Sorghum bicolor
  misc_feature: Ceres ANNOT ID no. 6043108
  misc_feature: Encodes the peptide sequence at SEQ ID NO 5398
atgcagccgcaggcacagtcgtactacgcggtgctcggcgtgcagccgggcgccaccgccgccgagatccgcgccgcgtaccaccgcctcgccatgaggtggcacccggacaagatcgccggcggccgcgtggatgcggcgcgcgcggaggaggccaagatcaggttccagcagatacacgaggcgtaccaagtgctgtcggatgacaagaggagggcgctgtacgacgccggcatgtacgacccgctcgacgacgaccaggaggacgttgagggattccacgacttcgttcaggagatggtctcgctcatggccaccgtggggagagaggagccagtgtacagcttggccgatctgcagtccatgctggacgggatgatcaaggatttcaccgcgccaccacaacctgagccccgtgtcttctacaccggtggggcatcgggcaaaccgagcagcaaagagcagagtactgcttcgtcacgcatgcatccccaggggttcggtgacgcggcgtgcttcagccggacggctttctcacgatga

SEQ ID NO: 5398 - protein, 180 aa, Sorghum bicolor
  misc_feature: Ceres ANNOT ID no. 6043108
  misc_feature (7)..(76): Pfam Id: DnaJ Pfam Desc: DnaJ domain
  misc_feature (7)..(129): NCBI GI: 1350548 NCBI Desc: heat shock-like protein [picea glauca]
  misc_feature (8)..(161): NCBI GI: 23428796 NCBI Desc: dnaj-like protein [glycine max]
  misc_feature (3)..(111): NCBI GI: 2689720 NCBI Desc: dnaj homologue [arabidopsis thaliana]
  misc_feature (2)..(111): NCBI GI: 92897598 NCBI Desc: heat shock protein dnaj [medicago truncatula]
  misc_feature (6)..(143): NCBI GI: 62900234 NCBI Desc: chaperone protein dnaj
MQPQAQSYYAVLGVQPGATAAEIRAAYHRLAMRWHPDKIAGGRVDAARAEEAKIRFQQIHEAYQVLSDDKRRALYDAGMYDPLDDDQEDVEGFHDFVQEMVSLMATVGREEPVYSLADLQSMLDGMIKDFTAPPQPEPRVFYTGGASGKPSSKEQSTASSRMHPQGFGDAACFSRTAFSR

SEQ ID NO: 5399 - DNA, 2340 bp, Sorghum bicolor
  misc_feature: Ceres ANNOT ID no. 6043131
  misc_feature: Encodes the peptide sequence at SEQ ID NO 5400
atgccggtcgtgacacggtcgcgggtttccgctgcccgcggcgacggcgcgggcgcgctgccgtggggctcggcgtcggcggcgccggctccgaggcacgtcgcgagccagagccaccacaaccaccacgggctcaaggagaagctgcgcgcgctcacccaggactacgagcagcagaagcagaagcagctgctcgccgcgtcgcagggcggaggggccgccgcgcggcagctccgccaaagcatccggtgcctcaacgcggcccaggtggccaacgacgagaacgccgaggaggaagacgaggaggacggcggcagggtggccaagcgccgctacgacgccttcggtctggtccccgaggccgcggtgctgagggagaacgtggcgcctccgcaggcgcgagcgccgtccaacgacagccacgctgtcgtgctcgcgcggcaggcgaaggacaacgtggtgggccgcggcgccaacgccatgtcctgccccaccaagaagacggtgccggcgctcccggtgcttccggtgccaacggcgaggaaactctctctgggaggggctgtgggcggcaagctgaaggccgccggggaggtcggggccggcactgccgagaccgtggagagccggatcctcgtgttcgtgaggctgcgtccgatgtcgaggaaggagaaggaggccgggtcgaggagttgcgtcaagatcgtcaacaggaaggaggtgtccctcacggagttcgcctcagagaacgactatctccggttgaagcgtgtgcgcgattcccaattctgcttcgattcggttttccctgattcgacgacgcaggcagaagtctacagcacatcaacagcagaccttgtggagggtgttctgcaaggtaggaatgggacagtgttctgctatggagctacaggggctggtaagacctacaccatgcttgggacaatggaaaaccctggcgtaatggtgcttgcaataaatgatctgttctccaaggtgacgcagcggaactattcaattaagttgtcatacctcgaaatatacaatgagacagtgagggatttgctgtctcctggtagcccccttaacctgagagaagataagcagcagggaactgttgcagctggtcttacccaaagaagtgtatactccacagacgaggttatggaattacttcagaaaggcaacaagaatcgaacaactgaaccaactcgagtaaacgagacctcatcacgttctcatgcggtactgcaggttgttgtagaatacagatccttggatggaactaacctaaaacgagtcggaaaactatctctcattgatcttgctggatctgaaagagccctggcaacagatcaacgcacactgaggtcgattgaaggagcaaacattaaccgctctcttcttgcactcagcagttgcatcaatgcccttgtggagggtaagaagcacataccatatcgcaattccaagctaacccaactccttaaggactcacttggaggatcctgcaacaccgtcatgattgccaacattagcccctctcatctttcctttggcgagacacagaacacgcttcattgggctgatcgtgccaaggaaataaaaacaaagacccaaactactgcaaacgaggaggttctggatcaaccagattctgaaactgctgtgcttgtactggagcttcagagggaaaactgtgtgctgagggagcagctggcgaagcaacaacagaaattactgattgccgaggctcagttacttgcttcaaaaaccttgccacaacaatctcctgctcgctcttctcatgtttcaactccaggctcaactcaaagaaagaccagacgatctatcgtggctgggaactacttcaacactacagactccaagaggcctacaaccgacaacgcacaggtcagggagttacagaggaaagtgaagacattggagtctgagatggataagatgaaaaaggagcacatattgcagctaaagcagaaggacgagttcatccgtggcttgatcaacaggaaggctcctaacaactgtgaagaggcaacagttgatagaagagttgtcacgagggcgagcctgcgaaaggcacagagagatgcatcagctacaggcgagctgaaaagccccagccaccggtttacatcaccagcaccaacggcaaagaagcgtactttctgggacatcggaggcaacagcccttcagttcttgctgccaatggaagaaagactcgaagccatgtagcaacagagacaccgaagaaaggttcttccaagctgcttcagccaggatttgcacggcaaatatcgagccatcgaaacatttaa

SEQ ID NO: 5400 - protein, 779 aa, Sorghum bicolor
  misc_feature: Ceres ANNOT ID no. 6043131
  misc_feature (216)..(536): Pfam Id: Kinesin Pfam Desc: Kinesin motor domain
  misc_feature (11)..(776): NCBI GI: 115438358 NCBI Desc: os01g0605500 [oryza sativa (japonica cultivar-group)]
  misc_feature (99)..(755): NCBI GI: 140049267 NCBI Desc: kinesin, motor region [medicago truncatula]
  misc_feature (169)..(766): NCBI GI: 15221800 NCBI Desc: kinesin motor protein-related [arabidopsis thaliana]
  misc_feature (203)..(579): NCBI GI: 126215730 NCBI Desc: kinesin-like protein kif19
  misc_feature (213)..(585): NCBI GI: 83286639 NCBI Desc: kinesin [plasmodium yoelii yoelii str. 17xnl]
MPVVTRSRVSAARGDGAGALPWGSASAAPAPRHVASQSHHNHHGLKEKLRALTQDYEQQKQKQLLAASQGGGAAARQLRQSIRCLNAAQVANDENAEEEDEEDGGRVAKRRYDAFGLVPEAAVLRENVAPPQARAPSNDSHAVVLARQAKDNVVGRGANAMSCPTKKTVPALPVLPVPTARKLSLGGAVGGKLKAAGEVGAGTAETVESRILVFVRLRPMSRKEKEAGSRSCVKIVNRKEVSLTEFASENDYLRLKRVRDSQFCFDSVFPDSTTQAEVYSTSTADLVEGVLQGRNGTVFCYGATGAGKTYTMLGTMENPGVMVLAINDLFSKVTQRNYSIKLSYLEIYNETVRDLLSPGSPLNLREDKQQGTVAAGLTQRSVYSTDEVMELLQKGNKNRTTEPTRVNETSSRSHAVLQVVVEYRSLDGTNLKRVGKLSLIDLAGSERALATDQRTLRSIEGANINRSLLALSSCINALVEGKKHIPYRNSKLTQLLKDSLGGSCNTVMIANISPSHLSFGETQNTLHWADRAKEIKTKTQTTANEEVLDQPDSETAVLVLELQRENCVLREQLAKQQQKLLIAEAQLLASKTLPQQSPARSSHVSTPGSTQRKTRRSIVAGNYFNTTDSKRPTTDNAQVRELQRKVKTLESEMDKMKKEHILQLKQKDEFIRGLINRKAPNNCEEATVDRRVVTRASLRKAQRDASATGELKSPSHRFTSPAPTAKKRTFWDIGGNSPSVLAANGRKTRSHVATETPKKGSSKLLQPGFARQISSHRNI

SEQ ID NO: 5401 - DNA, 798 bp, Sorghum bicolor
  misc_feature: Ceres ANNOT ID no. 6043221
  misc_feature: Encodes the peptide sequence at SEQ ID NO 5402
atggccggcgccaccatggctctcacctcccgcgcgctcgtcggcaagccggcgaccaccagcaccagggacgtcttcggcgagggccgcatcaccatgcgcaagactgctgccaagcccaagccagcggcgtccggcagcccctggtacggggccgaccgcgtcctgtacctgggtccgttctccggcgagcccccaagctacctgaccggcgagttccccggcgactacggctgggacactgccgggctgtctgcggaccccgagaccttcgccaagaaccgcgagctggaggtgatccactgccgctgggccatgctcggcgcgctcgggtgcgtgttcccggagctgctcgcccgcaacggcgtcaagttcggcgaggccgtgtggttcaaggcgggctcccagatcttcagcgagggcgggctggactacctcggcaacccgagcttgatccacgcgcagagcatcctggccatctgggcgtgccaggtggtgctcatgggcgccgtcgaggggtaccgcgtcgccggtggcccgctcggagaggtggtcgatcctctgtaccctggcggcagcttcgacccgcttgggctcgccgacgacccggaggcgttcgcggagctgaaggtgaaggagatcaagaacggccgcctcgccatgttctccatgttcggcttcttcgtgcaggctatcgtcaccggcaagggtccccttgagaacctcgccgaccacctcgccgaccctgtcaacaacaacgcctgggcgtacgccaccaacttcgtccccggcaagtga

SEQ ID NO: 5402 - protein, 265 aa, Sorghum bicolor
  misc_feature: Ceres ANNOT ID no. 6043221
  misc_feature (64)..(232): Pfam Id: Chloroa_b-bind Pfam Desc: Chlorophyll A-B binding protein
  misc_feature (1)..(265): NCBI GI: 82654918 NCBI Desc: chlorophyll a-b binding protein 2, chloroplast precursor (lhcii type i cab-2) (lhcp)
  misc_feature (1)..(265): NCBI GI: 82654917 NCBI Desc: chlorophyll a-b binding protein 1, chloroplast precursor (lhcii type i cab-1) (lhcp)
  misc_feature (1)..(265): NCBI GI: 20182 NCBI Desc: chlorophyll a/b-binding preprotein (aa -28 to 235) [oryza sativa]
  misc_feature (1)..(265): NCBI GI: 3036955 NCBI Desc: light harvesting chlorophyll a/b-binding protein [nicotiana sylvestris]
  misc_feature (1)..(265): NCBI GI: 115825 NCBI Desc: chlorophyll a-b binding protein 3c, chloroplast precursor (lhcii type i cab-3c) (lhcp)
MAGATMALTSRALVGKPATTSTRDVFGEGRITMRKTAAKPKPAASGSPWYGADRVLYLGPFSGEPPSYLTGEFPGDYGWDTAGLSADPETFAKNRELEVIHCRWAMLGALGCVFPELLARNGVKFGEAVWFKAGSQIFSEGGLDYLGNPSLIHAQSILAIWACQVVLMGAVEGYRVAGGPLGEVVDPLYPGGSFDPLGLADDPEAFAELKVKEIKNGRLAMFSMFGFFVQAIVTGKGPLENLADHLADPVNNNAWAYATNFVPGK

SEQ ID NO: 5403 - DNA, 801 bp, Sorghum bicolor
  misc_feature: Ceres ANNOT ID no. 6043227
  misc_feature: Encodes the peptide sequence at SEQ ID NO 5404
atggccgccgccgccaccatggctctgacctcccgcgcgctcgtcggcaagccggcgaccaccagcaccagggacgtcttcggcgagggccgcatcaccatgcgcaagactgctgccaagcccaagccagcggcgtccggcagcccctggtacggggccgaccgcgtcctgtacctgggtccgttctccggcgagcccccaagctacctgaccggcgagttccccggcgactacggctgggacaccgccgggttgtccgcggaccccgagaccttcgccaagaaccgcgagctggaggtgatccactgccgctgggccatgctcggcgcgctcgggtgcgtgtttccggagctcctcgcccgcaacggcgtcaagttcggcgaggccgtgtggttcaaggccggttcacagatcttcagcgagggcgggctggactacctcggcaacccgagcctgatccacgcgcagagcatcctggccatctgggcgtgccaggtggtgctcatgggcgccgtcgaggggtaccgcgtcgccggtggcccgctcggggaggtggtcgacccgctgtaccctggcggcagcttcgacccgctcgggctcgccgacgacccggaggcgttcgcggagctgaaggtgaaggagatcaagaacggccgtctcgccatgttctccatgttcggcttcttcgtgcaggccatcgtcaccggcaagggtcccctcgagaacctcgcggaccacctggccgaccccgtcaacaacaacgcctgggcctatgccaccaacttcgtccccggcaagtga

SEQ ID NO: 5404 - protein, 266 aa, Sorghum bicolor
  misc_feature: Ceres ANNOT ID no. 6043227
  misc_feature (65)..(233): Pfam Id: Chloroa_b-bind Pfam Desc: Chlorophyll A-B binding protein
  misc_feature (3)..(266): NCBI GI: 82654918 NCBI Desc: chlorophyll a-b binding protein 2, chloroplast precursor (lhcii type i cab-2) (lhcp)
  misc_feature (3)..(266): NCBI GI: 82654917 NCBI Desc: chlorophyll a-b binding protein 1, chloroplast precursor (lhcii type i cab-1) (lhcp)
  misc_feature (3)..(266): NCBI GI: 20182 NCBI Desc: chlorophyll a/b-binding preprotein (aa -28 to 235) [oryza sativa]
  misc_feature (3)..(266): NCBI GI: 3036955 NCBI Desc: light harvesting chlorophyll a/b-binding protein [nicotiana sylvestris]
  misc_feature (3)..(266): NCBI GI: 22228 NCBI Desc: chlorophyll a/b binding protein precursor [zea mays]
MAAAATMALTSRALVGKPATTSTRDVFGEGRITMRKTAAKPKPAASGSPWYGADRVLYLGPFSGEPPSYLTGEFPGDYGWDTAGLSADPETFAKNRELEVIHCRWAMLGALGCVFPELLARNGVKFGEAVWFKAGSQIFSEGGLDYLGNPSLIHAQSILAIWACQVVLMGAVEGYRVAGGPLGEVVDPLYPGGSFDPLGLADDPEAFAELKVKEIKNGRLAMFSMFGFFVQAIVTGKGPLENLADHLADPVNNNAWAYATNFVPGK

SEQ ID NO: 5405 - DNA, 1545 bp, Sorghum bicolor
  misc_feature: Ceres ANNOT ID no. 6043239
  misc_feature: Encodes the peptide sequence at SEQ ID NO 5406
atgaacggcgctgcggcaccggagcgctcgccctcagcctcgcccccgcttccggcccaggcgcaggcacaggcgccgccctcgccctctccgacgcagccgctcgagtggaggttctcccaggtgttcggcgagcgcagcgccggggaggaagtccaggatgttgacatcatctcagcaatagagttcaataaatcaggacatcatcttgcaactggagacagaggtggacgagttgttttatttgaaaggaccgatgtcaaagatcatgcctgtagaaaagatgctgagaaagctgattattctatcagcaggcatcccgaatttcgctacaaaactgagtttcaaagccatgaaccagagtttgattaccttaagagcttggaaattgaagagaagattaaccaaataaagtggtgtcaagcagcaaatggtgcattgtttcttctatccacaaatgacaaaacaataaagttttggaaggtccaagaaaagaaggtaaaaaaggtatctgagatgaatttggaccgttcagctgctcctgcaaatggtagtcctggtggtgtgggctatctgagcccatctctctcaaatggcaatgctctaaaacctggcgggtttcctttgcttcgcctgcctgtggttacaagccaagaaacaagtcttgccgcgagctgccgaagagtatatgctcatgcacatgactaccatataaattctatatcaaataacagtgatggtgagacatttatatcagctgatgatttgcggataaatctctggaatttggaaatcagcaatcaaagtttcaatattattgatgttaagcctacaaacatggaagatctcactgaggtgataacatctgctgaattccaccctactcattgcaatacattagcgtatagtagctctaagggctccattcgacttgttgatctgcggcaatcagccctttgtgacactcattcccaaatctttgagcagcatgaggccccaggttcaagatcatttttcacagagattatagcttcaatttcggacataaagttttcgaaggatgggagacatattctcagtcgcgactacatgactctgaagctttgggatgttaagatgaattctggtccagttgcaacattccaggttcatgagtatctgaggcctaagttatgtgatttatatgaaaatgactcaattttcgacaaatttgagtgttgtcaaagtggtgatggattaagagtagcaactggttcctacagcaacatttttcgtgtgtttggttgtggtactggtagcagtgaggcaacaacacttgaagcaacccgaaaccctacaaggaggcagctccagaatccaactagggctaccagatccctaagtactctgacaagggcagttagacgaggtggagaaagcactggaatagatgccaatggaaattcctatgatctgagcacaaagttgctccatttggcttggcacccatctgaaaacctaattgcgtgtgctgcagccaatagcttgtacatgtactatgcataa

SEQ ID NO: 5406 - protein, 514 aa, Sorghum bicolor
  misc_feature: Ceres ANNOT ID no. 6043239
  misc_feature (1)..(514): NCBI GI: 115438232 NCBI Desc: os01g0600200 [oryza sativa (japonica cultivar-group)]
  misc_feature (9)..(514): NCBI GI: 75325493 NCBI Desc: serine/threonine protein phosphatase 2a 55 kda regulatory subunit b beta isoform (pp2a, subunit b, beta isoform)
  misc_feature (9)..(514): NCBI GI: 3421415 NCBI Desc: protein phosphatase 2a 55 kda b regulatory subunit [oryza sativa]
  misc_feature (9)..(514): NCBI GI: 3421413 NCBI Desc: protein phosphatase 2a 55 kda b regulatory subunit [oryza sativa]
  misc_feature (25)..(514): NCBI GI: 25084199 NCBI Desc: type 2a protein serine/threonine phosphatase 55kda b regulatory subunit [arabidopsis thaliana]
MNGAAAPERSPSASPPLPAQAQAQAPPSPSPTQPLEWRFSQVFGERSAGEEVQDVDIISAIEFNKSGHHLATGDRGGRVVLFERTDVKDHACRKDAEKADYSISRHPEFRYKTEFQSHEPEFDYLKSLEIEEKINQIKWCQAANGALFLLSTNDKTIKFWKVQEKKVKKVSEMNLDRSAAPANGSPGGVGYLSPSLSNGNALKPGGFPLLRLPVVTSQETSLAASCRRVYAHAHDYHINSISNNSDGETFISADDLRINLWNLEISNQSFNIIDVKPTNMEDLTEVITSAEFHPTHCNTLAYSSSKGSIRLVDLRQSALCDTHSQIFEQHEAPGSRSFFTEIIASISDIKFSKDGRHILSRDYMTLKLWDVKMNSGPVATFQVHEYLRPKLCDLYENDSIFDKFECCQSGDGLRVATGSYSNIFRVFGCGTGSSEATTLEATRNPTRRQLQNPTRATRSLSTLTRAVRRGGESTGIDANGNSYDLSTKLLHLAWHPSENLIACAAANSLYMYYA

SEQ ID NO: 5407 - DNA, 1518 bp, Sorghum bicolor
  misc_feature: Ceres ANNOT ID no. 6043372
  misc_feature: Encodes the peptide sequence at SEQ ID NO 5408
atggccagcagagcgagacccacagcgacggcgccttcggcgagcacgcgcggtgcagcctgggaagaacgcggcgcgagaaccaaactcctcattaccgtgattgtctgcgcaggcaagacgttcgagacccgggaccctcgcaccggcgaggtgatcgccaccgtcgccgagggagacaaggccgacgtcgacctcgccgtcaaggccgcccgggaggccttcgacaacgggccctggcccaggatgacgggctacgagcgtgggcggatcctgcacaagttcgcggacttgatcgacgagcacgtggaggagctggcgatgctggacacggtggacgccggcaagctcttcctcgtcggcaaggtccgtgacatccccggcgcggcgcacctgctgcggtactacgcgggcgccgccgacaagatccacggcgagacgctgaagatggcgcagcggatgcacgggtacacgctcaaggagcccgtgggcgtggtgggccacatcgtgccgtggaactaccccagcaccatgttcttcttcaaggtcggcccggcgctcgccgccgggtgcaccgtcgtcgtcaagcccgccgagcagacgccgctgtcggcgctcttctacgcgcacctcgcaagggaggccggcgtccccgacggcgtgctcaacgtcgtccccgggttcggtcccacggccggcgccgctgtcgcctcgcacatggacgtcgacaaggtcagcttcacgggttccacggaggtcggacgcgtcgtcatgaaggccgccgccgagagcaacctcaagcccgtctcgctcgagctcggtggcaagtctccggtcatcgtcttcgacgacgccgatctcgacatggccgtcaacctcgtcaacctcgccacctacaccaacaagggcgagatctgcgtcgccggcacacgcatctacgtgcaggaagggatctacgacgcgttcgtggagaaggccgccgagctcgccaagaaatcggtggtcggagacccgttcaacccgcgtgtcaatcaaggccctcaggttgacaaggaccagtaccagaaggttctcaagtacattgatatgggaaagcgcgaaggcgccacgctggtcaccggagggaagccctgcggcgacaagggatactacatcgagcctaccatcttcacggacgtcaaggacaacatgacgatcgcgcaagacgaaatctttgggccggtgatggcgctcatgaaattcaagacggttgaggaggtgattcagaaagcgaacaacacccggtacggcctagcagctggaattgtgaccaagaacatcgacatcgccaacacggtatcgcggtccatccgtgcaggtgccatctggatcaactgctacttcgcattcgaccccgacgcgccattcggggggtacaagatgagcggatttggcaaggacatgggcatggacgccctggagaagtacttgcagaccaagaccgtggtcactcctctatacaacacgccctggctctga

SEQ ID NO: 5408 - protein, 505 aa, Sorghum bicolor
  misc_feature: Ceres ANNOT ID no. 6043372
  misc_feature (35)..(495): Pfam Id: Aldedh Pfam Desc: Aldehyde dehydrogenase family
  misc_feature (28)..(505): NCBI GI: 19850241 NCBI Desc: cytosolic aldehyde dehydrogenase rf2c [zea mays]
  misc_feature (28)..(505): NCBI GI: 19850243 NCBI Desc: cytosolic aldehyde dehydrogenase rf2c [zea mays]
  misc_feature (28)..(505): NCBI GI: 144228161 NCBI Desc: cytosolic aldehyde dehydrogenase [leymus chinensis]
  misc_feature (28)..(504): NCBI GI: 19850247 NCBI Desc: cytosolic aldehyde dehydrogenase rf2d [zea mays]
  misc_feature (40)..(504): NCBI GI: 19850245 NCBI Desc: cytosolic aldehyde dehydrogenase rf2d [zea mays]
  misc_feature (28)..(505): SWISSPROT Homolog: EC 1.2.1.3 Aldehyde dehydrogenase 2C4, cytosolic
  misc_feature (38)..(495): SWISSPROT Homolog: EC 1.2.1.36 Retinal dehydrogenase 1
  misc_feature (38)..(499): SWISSPROT Homolog: EC 1.2.1.5 Aldehyde dehydrogenase 1A3
  misc_feature: Useful for making plants with altered carbohydrate content
  misc_feature: Functional homolog of the protein sequence given in SEQ ID NO 13916
  misc_feature: The sequence is a functional homolog of SEQ ID NO. 428 in the 11/188,298 US application
  misc_feature: The sequence is a functional homolog of SEQ ID NO. 304 in the 11/188,298 US application
  misc_feature: The sequence is a functional homolog of SEQ ID NO. 475 in the 11/188,298 US application
  misc_feature: The sequence is a functional homolog of SEQ ID NO. 437 in the 11/188,298 US application
  misc_feature: The sequence is a functional homolog of SEQ ID NO. 477 in the 11/188,298 US application
  misc_feature: The sequence is a functional homolog of SEQ ID NO. 537 in the 11/188,298 US application
  misc_feature: The sequence is a functional homolog of SEQ ID NO. 442 in the 11/188,298 US application
  misc_feature: The sequence is a functional homolog of SEQ ID NO. 435 in the 11/188,298 US application
MASRARPTATAPSASTRGAAWEERGARTKLLITVIVCAGKTFETRDPRTGEVIATVAEGDKADVDLAVKAAREAFDNGPWPRMTGYERGRILHKFADLIDEHVEELAMLDTVDAGKLFLVGKVRDIPGAAHLLRYYAGAADKIHGETLKMAQRMHGYTLKEPVGVVGHIVPWNYPSTMFFFKVGPALAAGCTVVVKPAEQTPLSALFYAHLAREAGVPDGVLNVVPGFGPTAGAAVASHMDVDKVSFTGSTEVGRVVMKAAAESNLKPVSLELGGKSPVIVFDDADLDMAVNLVNLATYTNKGEICVAGTRIYVQEGIYDAFVEKAAELAKKSVVGDPFNPRVNQGPQVDKDQYQKVLKYIDMGKREGATLVTGGKPCGDKGYYIEPTIFTDVKDNMTIAQDEIFGPVMALMKFKTVEEVIQKANNTRYGLAAGIVTKNIDIANTVSRSIRAGAIWINCYFAFDPDAPFGGYKMSGFGKDMGMDALEKYLQTKTVVTPLYNTPWL

SEQ ID NO: 5409 - DNA, 756 bp, Sorghum bicolor
  misc_feature: Ceres ANNOT ID no. 6043396
  misc_feature: Encodes the peptide sequence at SEQ ID NO 5410
atggaaatggacgccgctgtggccgcgaagagcggcggagtgaccggggtcgtcgcggcggcggccgcgcaggccgggatgaacggcggcgagaggcggtcccggttccagcgcatctgcgtctactgcggcagcgccaagggccgcaagcccagctaccaggacgccgccgtcgagctcggcaacgagctggtggagaggggcatagacctggtctacgggggaggttccatcggcctcatggggctggtctctcatgccgttcatgatggaggtcgccatgtgattggggtcatcccaaaatccttgatgcccagagaggtaactggggaacctgttggggaagtaagggcggtctctggcatgcatgagaggaaggccgagatggctcggtttgctgatgccttcatagcattacctggtggctacggaactctggaagagctacttgaggtcatcacctgggcgcaactaggaatccataagaagccagttgggcttctgaacgtggatggattctacgacccgttgctgtccttcatcgacatggctgtgaacgaaggattcatcaaggaggacgctcggcgcatcatcatctcagctcccacggcgaaggagcttgttctgaagcttgaggagtatgttccggagtacgaggtcggtttggtgtgggaggatcagatgccggctgctgtggccgccacggccgcgcatgggttcgccccggagctggagcccgggatcgcctcctcctga

SEQ ID NO: 5410 - protein, 251 aa, Sorghum bicolor
  misc_feature: Ceres ANNOT ID no. 6043396
  misc_feature (81)..(214): Pfam Id: Lysine_decarbox Pfam Desc: Possible lysine decarboxylase
  misc_feature (21)..(251): NCBI GI: 115465783 NCBI Desc: os05g0591600 [oryza sativa (japonica cultivar-group)]
  misc_feature (31)..(236): NCBI GI: 79507209 NCBI Desc: carboxy-lyase [arabidopsis thaliana]
  misc_feature (32)..(227): NCBI GI: 73536067 NCBI Desc: chain b, x-ray structure of a lysine decarboxylase-like protein from arabidopsis thaliana gene at2g37210
  misc_feature (31)..(219): NCBI GI: 19548083 NCBI Desc: t3b23.2/t3b23.2 [arabidopsis thaliana]
  misc_feature (33)..(219): NCBI GI: 32487858 NCBI Desc: osjnbb0061c13.8 [oryza sativa (japonica cultivar-group)]
MEMDAAVAAKSGGVTGVVAAAAAQAGMNGGERRSRFQRICVYCGSAKGRKPSYQDAAVELGNELVERGIDLVYGGGSIGLMGLVSHAVHDGGRHVIGVIPKSLMPREVTGEPVGEVRAVSGMHERKAEMARFADAFIALPGGYGTLEELLEVITWAQLGIHKKPVGLLNVDGFYDPLLSFIDMAVNEGFIKEDARRIIISAPTAKELVLKLEEYVPEYEVGLVWEDQMPAAVAATAAHGFAPELEPGIASS

SEQ ID NO: 5411 - DNA, 828 bp, Sorghum bicolor
  misc_feature: Ceres ANNOT ID no. 6043424
  misc_feature: Encodes the peptide sequence at SEQ ID NO 5412
atggcacccggcctctacaccgacatcggcaagaagaccagagatctgctgtacaaggactacaacacgcaccagaagttctccctcaccacctgctcgccccatggcgtcgcaatcacagccgcaggaacaaggaaaaatgagtccatctttggcgagcttcacacacagattaagaacaagaaattgacggttgatatcaaagcgaactcagaatcagatctgttgacaacaatcactgttgatgagcttggcactccagggctcaaatcaattctcagtttggttgttccggaccagaggtcagggaagtttgaactccaatacctacatgaatacgctggtgtgaatgcaagcatcgggcttaatcccaaccctatggttaacatttctggtgtctttggaagcaaagcactctcagttggcgttgatgtttcatttgatacggcaactagtaatttcaccaagtacaatgctgctctgagcctcaccagtccagatcttattgcttcccttcatttgaataaccatggtgataccctggttgggtcctactaccacttggtaaagcatcattcaggcactgctgttggagctgagctgtctcacagcatctcaagaaatgagagcacactaatctttgggtctcagcactcactggatccccacacgactgtcaaggcacgtttcaacaactatggcatggccagtgcccttgtccagcatgaatggcgtcccaagtcattcatcaccatctctggtgaggtcgacaccaaggccattgaaaagagtacgaaagttggcctgtccttggtgctcaaacactga

SEQ ID NO: 5412 - protein, 275 aa, Sorghum bicolor
  misc_feature: Ceres ANNOT ID no. 6043424
  misc_feature (2)..(268): Pfam Id: Porin_3 Pfam Desc: Eukaryotic porin
  misc_feature (1)..(275): NCBI GI: 313136 NCBI Desc: porin [zea mays]
  misc_feature (1)..(274): NCBI GI: 558652 NCBI Desc: voltage dependent anion channel (vdac) [triticum aestivum]
  misc_feature (1)..(274): NCBI GI: 5929928 NCBI Desc: voltage-dependent anion channel protein 1a [zea mays]
  misc_feature (1)..(274): NCBI GI: 5929930 NCBI Desc: voltage-dependent anion channel protein 1b [zea mays]
  misc_feature (1)..(274): NCBI GI: 7339529 NCBI Desc: voltage-dependent anion channel [oryza sativa]
  misc_feature: Useful for making plants with modulated drought sensitivity
  misc_feature: Functional homolog of the protein sequence given in SEQ ID NO 13169
  misc_feature: Useful for making plants with modulated drought sensitivity
  misc_feature: Functional homolog of the protein sequence given in SEQ ID NO 13169
MAPGLYTDIGKKTRDLLYKDYNTHQKFSLTTCSPHGVAITAAGTRKNESIFGELHTQIKNKKLTVDIKANSESDLLTTITVDELGTPGLKSILSLVVPDQRSGKFELQYLHEYAGVNASIGLNPNPMVNISGVFGSKALSVGVDVSFDTATSNFTKYNAALSLTSPDLIASLHLNNHGDTLVGSYYHLVKHHSGTAVGAELSHSISRNESTLIFGSQHSLDPHTTVKARFNNYGMASALVQHEWRPKSFITISGEVDTKAIEKSTKVGLSLVLKH

SEQ ID NO: 5413 - DNA, 816 bp, Sorghum bicolor
  misc_feature: Ceres ANNOT ID no. 6043425
  misc_feature: Encodes the peptide sequence at SEQ ID NO 5414
atggcgagcatacaagccccggcggcggccgataacgtggaccccatctacgagtggctcgacgacggtgccagctacctcctccgcctcgacctcccagggttcccgaaggaggactttcgggtgcacgtggacggcgagggccggctcaccgtcatcggccaccgcaagcccacgcccggcggcggcgacggcaaggcgctgcggctccacaagacgttccagctgcccaatacggccaacctgcacaccatcaccggccgcttcgacagcaacgtgctcacgctcaccgtgcccaagctgcccgccgtcgccggtgctgccgcccccgcaccgcaggccatggaggaggcgcgagtcgccggcgataaggccgctgatcaggaggacaagcaggcgcaggaaacgggtgagcgggtggccaaggcggcggaggagaggacgacgagcttgacggccagaagcaaagaggccgaagacgtgaagaaggccaagcccacggcggcggcggcgccgccgcagccgagcgagaagtcgaggggagatcatcaggatgatgacaaggcgagggctgaccacagggagaaggtctcccgcgaggccacgcgcaggatcgaggcagcgcgggcgagggtggctgaggccaaggccaaggcggagcgggagaggcagtgcgagcactggaaggagcgcgccatggaggaggggatgaagttggcggatgcggtcagcaagaagaaggaggtgatcgccacggccgtcgccgccttcacgcttggcgtcttcgtctccagtaggctcttctccaggaattaa

SEQ ID NO: 5414 - protein, 271 aa, Sorghum bicolor
  misc_feature: Ceres ANNOT ID no. 6043425
  misc_feature (18)..(114): Pfam Id: HSP20 Pfam Desc: Hsp20/alpha crystallin family
  misc_feature (4)..(100): NCBI GI: 140039776 NCBI Desc: heat shock protein hsp20 [medicago truncatula]
  misc_feature (1)..(225): NCBI GI: 15242107 NCBI Desc: heat shock family protein [arabidopsis thaliana]
  misc_feature (104)..(253): NCBI GI: 67158813 NCBI Desc: tonb, c-terminal [azotobacter vinelandii avop]
  misc_feature (44)..(248): NCBI GI: 29427438 NCBI Desc: translation initiation factor if-2
  misc_feature (44)..(248): NCBI GI: 37680892 NCBI Desc: translation initiation factor 2 [vibrio vulnificus yj016]
  misc_feature: The sequence is a functional homolog of SEQ ID NO. 374 in the 11/188,298 US application
MASIQAPAAADNVDPIYEWLDDGASYLLRLDLPGFPKEDFRVHVDGEGRLTVIGHRKPTPGGGDGKALRLHKTFQLPNTANLHTITGRFDSNVLTLTVPKLPAVAGAAAPAPQAMEEARVAGDKAADQEDKQAQETGERVAKAAEERTTSLTARSKEAEDVKKAKPTAAAAPPQPSEKSRGDHQDDDKARADHREKVSREATRRIEAARARVAEAKAKAERERQCEHWKERAMEEGMKLADAVSKKKEVIATAVAAFTLGVFVSSRLFSRN

SEQ ID NO: 5415 - DNA, 1359 bp, Sorghum bicolor
  misc_feature: Ceres ANNOT ID no. 6043435
  misc_feature: Encodes the peptide sequence at SEQ ID NO 5416
atggcgtcgctgccgccgggggccggtcttactgactatgagcgccgccgcgaggagaacatccgccgcaacgaagccatcctcgccaccctccgccgcaaggccaccgagctctctgcctccttcagcgccaccgcttcatcctccaagcgccccaagaaggagcagccccgcgcgagaacggccagccccgtcgtcctccgccgctccttgcgcacccgcggcatcccccccgccgagtcctccgcttgtgccggcgctgacacctcccgggccacgccaccgtccccgacgaagccccgcaccacacggttctcatcctccctcgcctccgccctgcgagacgccaccgctgcagagccctcgccatcgctcgagagcgggatctgcgcagctgacgggttcgacgccagtagggagctggtgctccggcccgtggacgtgaggaaggtggtgccgggccggatattgtcggtgcggatcctgccgctgtccgaccggactgtggtggtcgccgggaacgtgcacgggcatgttgggttctgggatgtagatcgtctcgtggaggaggatgaggatggcgatggtgtagacggggtgttcgagtattttccccacagggggcctgtagggggcattgtgatgcaccctgccacgccgcagaagatttacagctctagttatcatggtgaaatttgtttcatggatgttgagaaagagaactttaatacgatccacttgtgtgcctatcccattttctcgctttgtcaagcaccaaatagtcccagctctctgtactttgccgagggaaatgaattaaaactttttgatgaaaggacgggtaaggtaccaactacatggagtttacatgatcatagaatcaactcaatagattttcgtccagagaatccatatatatttgccacaagctcgacagatcgaacagtttgcatatgggacatgagaaggatgaaaaagaagggtcctgagagcttgaaagttttggaatacaacaaagccgttcagtcagcttatttctcacccagtggcaatatgcttgcaacaaccagccttgatgacactgtccgaattttcaacacggataactttgatgactcatgtattcttaagcatgataacaggacaggcagatggctatccacattcaagtatgatgacttccacaccttgtcgcattctttattttatcagaagagcctctcggcttcatacatggcatttcttgagagtgaacacatgacagccatcccatgccggtttacgctgcacccgtgcaaagttggccatctggctggtgcaagctctagtggtaaggtgttcctctggacgagagcctga

SEQ ID NO: 5416 - protein, 452 aa, Sorghum bicolor
  misc_feature: Ceres ANNOT ID no. 6043435
  misc_feature (281)..(320): Pfam Id: WD40 Pfam Desc: WD domain, G-beta repeat
  misc_feature (329)..(366): Pfam Id: WD40 Pfam Desc: WD domain, G-beta repeat
  misc_feature (1)..(452): NCBI GI: 37806417 NCBI Desc: transducin / wd-40 repeat protein-like [oryza sativa (japonica cultivar-group)]
  misc_feature (72)..(452): NCBI GI: 38175727 NCBI Desc: transducin / wd-40 repeat protein-like [oryza sativa (japonica cultivar-group)]
  misc_feature (72)..(452): NCBI GI: 115475706 NCBI Desc: os08g0285200 [oryza sativa (japonica cultivar-group)]
  misc_feature (141)..(450): NCBI GI: 6503282 NCBI Desc: contains similarity to gbaf092102 g-protein beta subunit git5p from schizosaccharomyces pombe and contains 2 pf00400wd domain, g-beta repeat domains. [arabidopsis thaliana]
  misc_feature (8)..(449): NCBI GI: 133777670 NCBI Desc: wd repeat domain 76 [mus musculus]
MASLPPGAGLTDYERRREENIRRNEAILATLRRKATELSASFSATASSSKRPKKEQPRARTASPVVLRRSLRTRGIPPAESSACAGADTSRATPPSPTKPRTTRFSSSLASALRDATAAEPSPSLESGICAADGFDASRELVLRPVDVRKVVPGRILSVRILPLSDRTVVVAGNVHGHVGFWDVDRLVEEDEDGDGVDGVFEYFPHRGPVGGIVMHPATPQKIYSSSYHGEICFMDVEKENFNTIHLCAYPIFSLCQAPNSPSSLYFAEGNELKLFDERTGKVPTTWSLHDHRINSIDFRPENPYIFATSSTDRTVCIWDMRRMKKKGPESLKVLEYNKAVQSAYFSPSGNMLATTSLDDTVRIFNTDNFDDSCILKHDNRTGRWLSTFKYDDFHTLSHSLFYQKSLSASYMAFLESEHMTAIPCRFTLHPCKVGHLAGASSSGKVFLWTRA

SEQ ID NO: 5417 - DNA, 1356 bp, Sorghum bicolor
  misc_feature: Ceres ANNOT ID no. 6043469
  misc_feature: Encodes the peptide sequence at SEQ ID NO 5418
atggaacagcctgaggagaaccctgaattcccaagctgtgatgcctactttcaagctatccagtccaagaagaagttgccactgtctttgcaagaatcgctaactgctgcctttgcccagattcccgtctcatccttccctgaggttccaactggtcgagtcattgaaattcccggtgatacttctgttcttgacgctgtaaggactctctctgaacagaacataagggcagcaccagtgctcaatccagaacctggggctcctactgattggcaggggaggtaccttggtgtcatcgattactcagcaatcatccgttgggtactagaaaatgctgagcttgccggtgttgcactctcggctgcatcagcaactgctgccggagttggcatgggtgctgttggtgcggttggggtggcagctttgggtgcaactggcccagctgctgtagctggcttaactgcagccgcaattggggccgctgttgctggtggattaactgctgaaaagggtgtggcgaaggatgggctaactgctgcagatcatttaggggaggatttctatgaagttttgcttcagcaggaacctttcagatcaacaacagttcgatcaattgtagagtcatatcactggtctcctttcgtccccattacactggacacttccatgctgactgtacttctgttgctctctaagtacagattgagaaatgtccctgtgattgagcccgaaaaacctatcatcaagaacttcattactcagactggtgttctcaaagggctgcagcaatgtaaaggaagggactggtttgactacatttctgcacttcctctttcagacttaggacttccatttatgtccattgatgaggttatcaccgtcaacagtgatgatctaatcttagaagctttcaagtgcatgaaggataacaagattggtggtgtaccagtagtagaaggccccaaaagaaaacttgttggcagtgttagcataagggacatccgctttctgttgcttagacccaatttattttcaaatttcaggcaacttacggtcattgaattcatgaagactctaggctccactcttcctgattcagggaacaattgcctggtgaagccaccacccacctgcactcctgacgcttcccttggtagtgttattgacagcattgcatcaagaataacccacaggatatatgtagtggatgttgaccttgaggttgttggtgttgtgactctgcgtgatgtgatctcgtgttttatccacgagccacccggttattgcgacagctatttgacttcagcaatggagaagcttgacggtaaaggagtcggatcagtggagaaacgttga

SEQ ID NO: 5418 - protein, 451 aa, Sorghum bicolor
  misc_feature: Ceres ANNOT ID no. 6043469
  misc_feature (48)..(262): Pfam Id: CBS Pfam Desc: CBS domain pair
  misc_feature (285)..(422): Pfam Id: CBS Pfam Desc: CBS domain pair
  misc_feature (1)..(449): NCBI GI: 115437980 NCBI Desc: os01g0586600 [oryza sativa (japonica cultivar-group)]
  misc_feature (2)..(440): NCBI GI: 92867066 NCBI Desc: cbs [medicago truncatula]
  misc_feature (1)..(440): NCBI GI: 145327199 NCBI Desc: cbs domain-containing protein [arabidopsis thaliana]
  misc_feature (147)..(437): NCBI GI: 32364482 NCBI Desc: akin gamma [medicago truncatula]
  misc_feature (131)..(428): NCBI GI: 38346640 NCBI Desc: osjnba0072d21.10 [oryza sativa (japonica cultivar-group)]
MEQPEENPEFPSCDAYFQAIQSKKKLPLSLQESLTAAFAQIPVSSFPEVPTGRVIEIPGDTSVLDAVRTLSEQNIRAAPVLNPEPGAPTDWQGRYLGVIDYSAIIRWVLENAELAGVALSAASATAAGVGMGAVGAVGVAALGATGPAAVAGLTAAAIGAAVAGGLTAEKGVAKDGLTAADHLGEDFYEVLLQQEPFRSTTVRSIVESYHWSPFVPITLDTSMLTVLLLLSKYRLRNVPVIEPEKPIIKNFITQTGVLKGLQQCKGRDWFDYISALPLSDLGLPFMSIDEVITVNSDDLILEAFKCMKDNKIGGVPVVEGPKRKLVGSVSIRDIRFLLLRPNLFSNFRQLTVIEFMKTLGSTLPDSGNNCLVKPPPTCTPDASLGSVIDSIASRITHRIYVVDVDLEVVGVVTLRDVISCFIHEPPGYCDSYLTSAMEKLDGKGVGSVEKR

SEQ ID NO: 5419 - DNA, 2328 bp, Sorghum bicolor
  misc_feature: Ceres ANNOT ID no. 6043477
  misc_feature: Encodes the peptide sequence at SEQ ID NO 5420
atgttctggcgcatgaccggcctctccgcggcctcgcccgtggatacaattctggacaaagaaaattttacattggaagaacttcttgacgaggatgaaattattcaggagtgcaaagcactgaactcgcgactcataaacttcttacgtgacaaggcccaggtggaacagttgcttcgttatgttgtggaagaagttccagaggatgctgaaaggaagcgctctttcaagttcccttttattgcttgcgaaatatttacttgcgaaatcgatgtcattttgaggaccctagtagaggatgaagagctaatggacttgcttttctcatttgtgaaacctgatcatccgcatagtacattattgtctggttacttcagtaaggtggtaatatgtttgatgctgcggaagactgctccacttatgagttatgttcaggggcatccagagatagttgtccagcttgttgacctgattggcatcacatcgatcatggaggtgctgatacgactgattggtgctgatgaggccatatattcaaactatggtgatacgttacagtggttagaaaatacagatgtccttgaaatgattgcagataagtttagctcatcggattctcctgaagttcatgccaatgctgcggaaattctatgtgcagttactcggtgtgcacctccatctcttgctgcgaaaatatgcagtccaagttttgttgggaggttgttccatcatgctcttgaagaatcaagacccaaatctgttctggttcattcactgtcagtgtgcatatctttgctggatccgaaaagactagcatcagcttcgtatcaagcattcagaagcaacttaactcatggggcattggtcacggccagtccagagacagttgacggcaacttgctgaagttattggacacttcggctgctgaaagcgtgttgccaacaacttatggatgtttacgcccacctcttgggaaacatcgtctgaagattgtagaattcatctctgtgctgcttacaattggaagtgagactgctgaaaaagagctaattaggcagtcagcaataaagcgctcgattgatttattctttgagtatccatataacaactttttgcaccatcatgttgagaatataatcgtttcttgccttgagggtaaaagacctgaagttgttgatcatgttcttcatgaatgtgatattgttggtaaaattcttgtttcagaaaggctttcatctttgtcgattgagtctaatgggcctactgttccctctgaagggaaaacacctccaagaattggaaatgttggtcacatgacgagaatagccaataagcttattcagttgggcaacagtaacaacacaatccaggctcacttatgggaaaataatgagtgggttgaatggcaaacaaatgtgctggtcaaacgcaatgaagtggagaatgtttatcattgggcttgtgggcgcccgacatcattacatgaccgtggtagggacagtgatgatgatgacttccgggacagggattacgatgtggcagctcttgctaataatttaagtcaggcatttcgttatgggatatacagcaatgatgacattgaagaggcacaaggatcacttgaacgagatgatgaggatgtgtattttgatgatgaatcagctgaggtggtgatatcttctttgcgactgggagatgaccaggacggctccctctttacaaattcaaactggttcacatttgatggagagagaggcattgatgaccgtacatctgcctctgttccttcatcatcacccaattctgaggagatttcaccagagaccgaggaagctgatgatggtaaagtaattggcactgaggatgaaatggaaacagtatatcttggaaatggtagtgctgaggaggtaaaagatgtagcagaatgtactgaacaggcaaactgttgtactgaggatgagcgattgaaaaatacagaagggatggagcggcatccagatgcttcaaataatgataccgacatatgcacaaatgaggctgcctctgctgcagcagaatcttcagccccatcggttgagaaagcggcagaaaaaacagtagatgaaccattggaggcagaaagaacagtggatgaaccggcagaatcatctttggacagttctgtctctgtagctttgccagctcctgttaatggtagtgagcctgccaactcggaagcttcttccgaacaagttgcccatgacactgatgtgcagcaaccagtcaaggaagcccctgccgaggatgttgatgcaaagaaaactgatggagccaaagcaagcgagtga

SEQ ID NO: 5420 - protein, 775 aa, Sorghum bicolor
  misc_feature: Ceres ANNOT ID no. 6043477
  misc_feature (129)..(483): Pfam Id: SAPS Pfam Desc: SIT4 phosphatase-associated protein
  misc_feature (1)..(766): NCBI GI: 116309949 NCBI Desc: h0714h04.7 [oryza sativa (indica cultivar-group)]
  misc_feature (1)..(766): NCBI GI: 38344337 NCBI Desc: osjnba0058k23.19 [oryza sativa (japonica cultivar-group)]
  misc_feature (1)..(621): NCBI GI: 115460612 NCBI Desc: os04g0620400 [oryza sativa (japonica cultivar-group)]
  misc_feature (1)..(775): NCBI GI: 42562411 NCBI Desc: sit4 phosphatase-associated family protein [arabidopsis thaliana]
  misc_feature (143)..(775): NCBI GI: 6634768 NCBI Desc: contains similarity to gbd21822 orf from lilium longiflorum. ests gbt03978, gbr89954, gbai995107, gbt20998, gbr65384 come from this gene. [arabidopsis thaliana]
MFWRMTGLSAASPVDTILDKENFTLEELLDEDEIIQECKALNSRLINFLRDKAQVEQLLRYVVEEVPEDAERKRSFKFPFIACEIFTCEIDVILRTLVEDEELMDLLFSFVKPDHPHSTLLSGYFSKVVICLMLRKTAPLMSYVQGHPEIVVQLVDLIGITSIMEVLIRLIGADEAIYSNYGDTLQWLENTDVLEMIADKFSSSDSPEVHANAAEILCAVTRCAPPSLAAKICSPSFVGRLFHHALEESRPKSVLVHSLSVCISLLDPKRLASASYQAFRSNLTHGALVTASPETVDGNLLKLLDTSAAESVLPTTYGCLRPPLGKHRLKIVEFISVLLTIGSETAEKELIRQSAIKRSIDLFFEYPYNNFLHHHVENIIVSCLEGKRPEVVDHVLHECDIVGKILVSERLSSLSIESNGPTVPSEGKTPPRIGNVGHMTRIANKLIQLGNSNNTIQAHLWENNEWVEWQTNVLVKRNEVENVYHWACGRPTSLHDRGRDSDDDDFRDRDYDVAALANNLSQAFRYGIYSNDDIEEAQGSLERDDEDVYFDDESAEVVISSLRLGDDQDGSLFTNSNWFTFDGERGIDDRTSASVPSSSPNSEEISPETEEADDGKVIGTEDEMETVYLGNGSAEEVKDVAECTEQANCCTEDERLKNTEGMERHPDASNNDTDICTNEAASAAAESSAPSVEKAAEKTVDEPLEAERTVDEPAESSLDSSVSVALPAPVNGSEPANSEASSEQVAHDTDVQQPVKEAPAEDVDAKKTDGAKASE

SEQ ID NO: 5421 - DNA, 2109 bp, Sorghum bicolor
  misc_feature: Ceres ANNOT ID no. 6043478
  misc_feature: Encodes the peptide sequence at SEQ ID NO 5422
  misc_feature: Up-regulated in shoot tissues in response to salicylic acid treatment
atgggttgctccaactctaaagtggacaatgaggagcccgtgaggcgctccaaggacaggaagcagctcatgaagcagcttgtgcgccgccgtcctgagcttgcagctgcgcacattgcatacctgcacgccctccgcaacacaggagccactctccggcaatttgtggagctggagtctgcactgtcacagcagcctcctgaaggccttgcggcgccgccctcgcctgctccacagccgccgccgcgaccaccacctcctgaaccctcagtcacatcctcattgccaccctcgccacgccccccgccgcctctcccttttagtccaataaccaccataaggaagatggagaagagagatgatgagctgccaccaccacctctggttttgagtccaataagattaagaaagagggatgatgagctccatgggggtgattttactgatgatgatgatgacaccgacagctgctcaactcctctaccaccacccctgccacccggcatagattgggaggaattggatccctacaatgtgcgccccttgagtttcccatctccatttgctgataggaacgataaagaagtggcttcacaggttaccatggacaatgatcctgaggtagacacagaatttgatggagaggaggatgcaagtgtgcttggcattgatgatggcattgtggacagggtccatgtgaatccagccaagggtagggctctgggtgatgtcaactcttcaatggtgagcagggtgacaaaggattcagactctatggcggtgccttggaggagtaagaagtcacttgttgagattgttaaggagattgatgagtacttcttgaaagcagcagcaagtgggaaagacgttgtgattcttttggactctgctggtgggcggcctgatgccttagagatagaggcaaagaaaggtgcgggaaaaaattccaaatctgcgaaggttttctccacgctttcttggagctggtcttttaaatctcagcaggctaacagcgaatcctcagttctgaattctagtgattcctctggatatggttaccatggcaagacgctggagaagctttatgatgaggagcaaaaactctacaagttaatcaaggatgaagaatttgcaaggcttcagtataagaaacatgtctcagtgctacaaaagctagaatcaggggaacatgatagactgcatgcagaaagagtacgggatgctattgaagaactgcagactcggataatctcattggaggaagctgtgagtttggcgtgtttttccatatcaaatctcagagatgaggaattatatcctcagattattgaactatctgctgggcttgtgcatatgtggagaaacatgtacgagtgccatcaggtccagaaccatattgcccagcaagttagtctccttggcaacatacctgggagtgaaccaacaagtgacactcattgccaggcaacatctcagctggaaattgaggtgtctggatggcacaatgccttctgcaatctcatcacattgcagcgtgaatacattagcatccttaaccaatggattggtctcacagactgccttccagatgatggtggcttaatgagaagttcatctggaatacgtagcctctctgaggaactccagcgtgctcttgacaggctaccagagaagatagcagctgaagcaataatgacctttatgtcaatcatacactctatagttgtacagcagagtcaggagcgccaactaaagaagaagtcagataacatggatagcaagttccagacccagttagagaaacacagtgaaaatgcaatgcaaaattcagcccagcctccaaataagaatcactattcagtatcaaagaatgaaacgaaactggatgcatttagaaagcaggttgaggaggaaaaggccagatacctaacctctgtgagagtaagccgagccatgacactgaacaatctgcagacaagccttccaaatgtgttccatgctctggtgggcttctcaggaatgtgtgtgcaggcatttgaaggtatcagcagatgcagtgaagttgctgttattcactccggagcggcttcacctgctatttgctcgtga

SEQ ID NO: 5422 - protein, 702 aa, Sorghum bicolor
  misc_feature: Ceres ANNOT ID no. 6043478
  misc_feature (1)..(702): NCBI GI: 115437972 NCBI Desc: os01g0585600 [oryza sativa (japonica cultivar-group)]
  misc_feature (351)..(682): NCBI GI: 115480411 NCBI Desc: os09g0538700 [oryza sativa (japonica cultivar-group)]
  misc_feature (186)..(686): NCBI GI: 62321728 NCBI Desc: bzip-like protein [arabidopsis thaliana]
  misc_feature (267)..(619): NCBI GI: 13124871 NCBI Desc: bzip [oryza sativa]
  misc_feature (267)..(619): NCBI GI: 19031022 NCBI Desc: bzip protein [oryza sativa]
  misc_feature: The sequence is a functional homolog of SEQ ID NO 10 in the 10/225,066US patent application
  misc_feature: The sequence is a functional homolog of SEQ ID NO 1084 in the 10/225,066US patent application
  misc_feature: The sequence is a functional homolog of SEQ ID NO 136 in the 11/375,241US patent application
  misc_feature: The sequence is a functional homolog of SEQ ID NO 1873 in the 11/479,226US patent application
  misc_feature: The sequence is a functional homolog of SEQ ID NO 2530 in the 10/374,780US patent application
  misc_feature: The sequence is a functional homolog of SEQ ID NO 304 in the 10/374,780US patent application
  misc_feature: The sequence is a functional homolog of SEQ ID NO 838 in the 10/225,066US patent application
  misc_feature: Useful for making plants with modulated growth and phenotype characteristics
  misc_feature: The sequence is a functional homolog of SEQ ID NO 10 in the 20050160493 US patent application
  misc_feature: The sequence is a functional homolog of SEQ ID NO 1084 in the 20050160493 US patent application
  misc_feature: Up-regulated in shoot tissues in response to salicylic acid treatment
MGCSNSKVDNEEPVRRSKDRKQLMKQLVRRRPELAAAHIAYLHALRNTGATLRQFVELESALSQQPPEGLAAPPSPAPQPPPRPPPPEPSVTSSLPPSPRPPPPLPFSPITTIRKMEKRDDELPPPPLVLSPIRLRKRDDELHGGDFTDDDDDTDSCSTPLPPPLPPGIDWEELDPYNVRPLSFPSPFADRNDKEVASQVTMDNDPEVDTEFDGEEDASVLGIDDGIVDRVHVNPAKGRALGDVNSSMVSRVTKDSDSMAVPWRSKKSLVEIVKEIDEYFLKAAASGKDVVILLDSAGGRPDALEIEAKKGAGKNSKSAKVFSTLSWSWSFKSQQANSESSVLNSSDSSGYGYHGKTLEKLYDEEQKLYKLIKDEEFARLQYKKHVSVLQKLESGEHDRLHAERVRDAIEELQTRIISLEEAVSLACFSISNLRDEELYPQIIELSAGLVHMWRNMYECHQVQNHIAQQVSLLGNIPGSEPTSDTHCQATSQLEIEVSGWHNAFCNLITLQREYISILNQWIGLTDCLPDDGGLMRSSSGIRSLSEELQRALDRLPEKIAAEAIMTFMSIIHSIVVQQSQERQLKKKSDNMDSKFQTQLEKHSENAMQNSAQPPNKNHYSVSKNETKLDAFRKQVEEEKARYLTSVRVSRAMTLNNLQTSLPNVFHALVGFSGMCVQAFEGISRCSEVAVIHSGAASPAICS

SEQ ID NO: 5423 - DNA, 1287 bp, Sorghum bicolor
  misc_feature: Ceres ANNOT ID no. 6043488
  misc_feature: Encodes the peptide sequence at SEQ ID NO 5424
atggaggacaacggcggcggcgaggtggcttggcgtttcggggcggccaacccatcgctggaggcggccagcgcgctgagcatccgcgcgctggttcatcggctttatggctgcgtggaccggaacgacccgaggccgctcgcgccgctcggccacggtgacccctcgccgttcgcgtgcttccgcgcagccgccgcggctgaagaggccgtcgccgctgccgccacctctgggaagtacaatagttaccccaccgccgccggcctcaccgaggcgtgcagcgctgtggctgcatacctatctcgatacctcccctacgagctgtcgacaggcgacattgtccttaccgcgggctgcaaccatgccatcgagatcatgatggctgtccttgccatgccgggcgcaaatgtattgctgccacggccaggatacccaatgtacgaagcacgcgcagcgttgggtgggctagagttcaggcactacaatcttcttccggacaaaggatgggaggttgacattgaaggtgtggaggcccttgctgatgagaacaccgttgccattgttatggtcaacccgaataacccttgtgggtccgtctactcctatgagcacctgaccaagattgcagagacagcaagaaagctcgggataatggtaatctgtgatgaaatttacgagcattgcacatttggaagcaagcccttcgtgcccatgggtgtgtttggtgagatagctcctgtggtgacgctgggcggcatatccaagaggtggatggtgcctggttggcggcttggttggattgcaatgactgatccaaagggaatcctcaggaagaagaagattcttgagtccatcattatctaccgtggcatctcagtagacccagcagcaattattcagggagctataccccaaatcattgcaaacacggatgatgttttcttcacaaatgctatgaacacgatgagagaggccgcagagatatgctaccagaggctaaagtgcatggagtgcatcacttgtcctcataagccagagggatccatgtttgtcatggtagagctggatatctcatatttcaatggcatcgacgacgatattgacttctgcaccaagttggccaaagaggagtgtgttgtgatctgcccaggcagtgggcttgggatgaagaactggctccgtgtaaccttcgcggtagatcctcctctgttggaggatgggatggagaggctcaagtctttctgcctgaggcatgcaaaacccactagaaatcatgccacctcatga

SEQ ID NO: 5424 - protein, 428 aa, Sorghum bicolor
  misc_feature: Ceres ANNOT ID no. 6043488
  misc_feature (45)..(411): Pfam Id: Aminotran_1_2 Pfam Desc: Aminotransferase class I and II
  misc_feature (112)..(358): Pfam Id: Beta_elim_lyase Pfam Desc: Beta-eliminating lyase
  misc_feature (198)..(421): NCBI GI: 115485877 NCBI Desc: os11g0552000 [oryza sativa (japonica cultivar-group)]
  misc_feature (9)..(420): NCBI GI: 6469087 NCBI Desc: nicotianamine aminotransferase b [hordeum vulgare subsp. vulgare]
  misc_feature (9)..(420): NCBI GI: 6469089 NCBI Desc: nicotianamine aminotransferase [hordeum vulgare subsp. vulgare]
  misc_feature (9)..(420): NCBI GI: 6498122 NCBI Desc: nicotianamine aminotransferase a [hordeum vulgare subsp. vulgare]
  misc_feature (9)..(420): NCBI GI: 6469090 NCBI Desc: nicotianamine aminotransferase [hordeum vulgare subsp. vulgare]
  misc_feature: The sequence is a functional homolog of SEQ ID NO. 526 in the 11/188,298 US application
  misc_feature: The sequence is a functional homolog of SEQ ID NO. 286 in the 11/188,298 US application
  misc_feature: The sequence is a functional homolog of SEQ ID NO. 527 in the 11/188,298 US application
MEDNGGGEVAWRFGAANPSLEAASALSIRALVHRLYGCVDRNDPRPLAPLGHGDPSPFACFRAAAAAEEAVAAAATSGKYNSYPTAAGLTEACSAVAAYLSRYLPYELSTGDIVLTAGCNHAIEIMMAVLAMPGANVLLPRPGYPMYEARAALGGLEFRHYNLLPDKGWEVDIEGVEALADENTVAIVMVNPNNPCGSVYSYEHLTKIAETARKLGIMVICDEIYEHCTFGSKPFVPMGVFGEIAPVVTLGGISKRWMVPGWRLGWIAMTDPKGILRKKKILESIIIYRGISVDPAAIIQGAIPQIIANTDDVFFTNAMNTMREAAEICYQRLKCMECITCPHKPEGSMFVMVELDISYFNGIDDDIDFCTKLAKEECVVICPGSGLGMKNWLRVTFAVDPPLLEDGMERLKSFCLRHAKPTRNHATS

SEQ ID NO: 5425 - DNA, 1434 bp, Sorghum bicolor
  misc_feature: Ceres ANNOT ID no. 6043504
  misc_feature: Encodes the peptide sequence at SEQ ID NO 5426
atggccccgcctccgcctcggcttgccgccctcatcctcctagccgcgctgctgctgctgctgctggcagccggcgccgcggcaaccggcgtcttccaggtgcgccgcaagtttcccgccggagttggagggggcgccagcgccaacatcagcgctcttcgtgtccacgacggtcgccgccatggccgcctcctcgcagctgctgaccttccactcggcggtctcggcctcccaactgacaccgggctctacttcacggagatcaagctcgggacgccgcccaagcgctattacgtccaggtcgatactggcagcgacatcctctgggttaactgcatctcctgcgaaaaatgcccccgcaagagcggactcgggttagacttgacgttctatgaccccaaggcgtcctcgagcgggagcacggtgtcctgcgatcagggattctgtgcggccacctatgggggaaagctgccggggtgcaccgccaatgtgccctgcgagtacagcgtcatgtacggtgatggtagctcaacgactgggttcttcgttaccgatgcgctgcagtttgatcaggtgactggggatgggcagacacagcctggcaatgccactgtcacgttcgggtgtggtgctcagcaaggtggggatttgggaagctccaaccaagcccttgatggaattctaggttttggtcaggcaaatacgtcaatgttatcacagctagctgctgctggtaaagtgaagaagatatttgctcattgcctggataccataaaaggtggtggaatttttgctattggaaatgtggttcagccgcactacaatgtgaaccttaagtcaattgatgttggtggcactacattacagctcccagctcatgtttttgaaacaggagagagaaagggcaccataatcgacagtggtactaccttaacataccttccagaattggttttcaaagaagtaatggccgcgatatttaacaagcatcaagatatagtcttccataatgttcaagattttatgtgtttccaatatcctggaagtgtagatgatggattcccgaccatcaccttccattttgaggatgatcttgcactgcatgtgtatccacatgagtactttttcccaaatgggaatgacatgtactgtgtgggattccaaaatggcgcattacaatcaaaagatggaaaggacattgtgcttatgggagaccttgtactttcaaacaagttggttatctatgacttggaaaatcaggtcattgggtggactgactacaactgttcgtcgagcattaaaattgaggacgacaagacaggcacaccatacactgtcaattcacatgacatctcctctggatggaaataccactggcacaagtccctggttctgttgttggtaacaatggtgtgcggcaatttaatacgctaa

SEQ ID NO: 5426 - protein, 477 aa, Sorghum bicolor
  misc_feature: Ceres ANNOT ID no. 6043504
  misc_feature (83)..(427): Pfam Id: Asp Pfam Desc: Eukaryotic aspartyl protease
  misc_feature (3)..(476): NCBI GI: 38344991 NCBI Desc: osjnba0008a08.5 [oryza sativa (japonica cultivar-group)]
  misc_feature (3)..(476): NCBI GI: 116309515 NCBI Desc: osigba0137o04.7 [oryza sativa (indica cultivar-group)]
  misc_feature (19)..(470): NCBI GI: 18390579 NCBI Desc: aspartyl protease family protein [arabidopsis thaliana]
  misc_feature (6)..(476): NCBI GI: 115457772 NCBI Desc: os04g0334700 [oryza sativa (japonica cultivar-group)]
  misc_feature (73)..(348): NCBI GI: 115457778 NCBI Desc: os04g0337000 [oryza sativa (japonica cultivar-group)]
MAPPPPRLAALILLAALLLLLLAAGAAATGVFQVRRKFPAGVGGGASANISALRVHDGRRHGRLLAAADLPLGGLGLPTDTGLYFTEIKLGTPPKRYYVQVDTGSDILWVNCISCEKCPRKSGLGLDLTFYDPKASSSGSTVSCDQGFCAATYGGKLPGCTANVPCEYSVMYGDGSSTTGFFVTDALQFDQVTGDGQTQPGNATVTFGCGAQQGGDLGSSNQALDGILGFGQANTSMLSQLAAAGKVKKIFAHCLDTIKGGGIFAIGNVVQPHYNVNLKSIDVGGTTLQLPAHVFETGERKGTIIDSGTTLTYLPELVFKEVMAAIFNKHQDIVFHNVQDFMCFQYPGSVDDGFPTITFHFEDDLALHVYPHEYFFPNGNDMYCVGFQNGALQSKDGKDIVLMGDLVLSNKLVIYDLENQVIGWTDYNCSSSIKIEDDKTGTPYTVNSHDISSGWKYHWHKSLVLLLVTMVCGNLIR

SEQ ID NO: 5427 - DNA, 2307 bp, Sorghum bicolor
  misc_feature: Ceres ANNOT ID no. 6043527
  misc_feature: Encodes the peptide sequence at SEQ ID NO 5428
atggatggagatcatatgaggcaagccaccgccgccgccgccgccgtggtcaccgtcacacaggcggcgcgcgcgcaggacagccccgcgcggcgcctgatcgcctggctgcggcttctcttccgggcgttcgtccataggtacgccaagctcgcgagctgggacgcggcggggcgccccgtgttcgtcatcctcgccgtcttcttcctccacaggagcctccgccgccggtacctgtcatggaaggagtcgtcggggctgcggctgatggccgccgccgtcaccgtgcaggcgaccgtcagggcgatggcggcgcggcgcgagctctctgtccggaagcagaccagagctgccacacgcatccaggcgcaatggcgtgcgcacagggcggtgtggagctacctgacgacgaagagagccgccctcatctgccaacgtgcttggaggcaaaccattgcaaccaaggagaagctcagacaggaaaatcttgagagggaaatgctggatgagatgtgcaggctgcgtgagatggtggacgtgctccagcaggctgtcaacgatgccgagacgagggccactaacgagagtgaggcggcgaaggatgcgatagcgcaattggaagcagcctcggtggcgatggctgaggacactgagaaggtcaaggcgttgaatgccgaagttgaccgcctgaaggatttgctgggagctgaaatgagtgaaacttttgcggtgaagaagtcgcttgctgaagctgaattgaggaatgagaagctggcccggctgcttggagttgaggaagttaagaacaaacggcttcaagattccctgaaaaggatggaggagaaggcttctaatctagatgaggaaaacagaatgcttcgacaggctgtggcgtcaaaccctggtattgtcaagtcgccatcaagtgaataccatgaagcacctggtattcaggcaactccagataatgagaaattagcaaatggtacagtgaagcccataatagtggacagggaggcaaatatccatgagaagagtgctgaacaacctacctcaaatggtcatgaagctgagaagcaacagcaagaacttctaatcaagtgtctatctgaagatctgggtttctcgatcggtaggccaattgctgcatacctcatatacaggtgtctagttcattggagatcattcgaagaagaacggaccgtggtctttgaccggattattcagaagatcactgctgcccttgaggcacgagacaacaacgagacactagcatattggctgtccaattcatgcacgcttctggttcttcttcaaaggacactgaaaatcaacggggtggctgctttggctcgtcagaggcgaagagcatcacctcttaaggtgccacaggaaaacaaagatcctagccatcctgaccgtccagtttctgacggagggttgatcaatggactagctgaagtttaccaggttgaggccaagtatccagctattgcattcaagcagcagctcactgcattgttggagaaggtttatgggatgatccggcataatctgaagaaggagctgtcgccacttctcggcctttgtattcaggcaccacgtacatttgttgtcagtcccagaggatcatgttcccaaggaacagatttggcacaacaagcttcgatggcacattggcagagcatcatcaaaattctcacaaattctctgaatgttctgaaatcaaattatgtgcctccattcctgatttgcaagctgttcacgcaagtcttttcatttatcaatgttcaactttttaacagtcttttgctacggcgtgagtgctgctcattcagtaatggagagtatgtcaaggctgggttggatgagttagagcattggtgtttttggttgactgaagagtatgcaggatctgcatgggatgagttgaagcatatcaggcaagcagtaaccctcttgatacttgaagaaaagcatagccggggtctcacagagatcacagacgacttctgcccagcgctgagcatgcagcaactgtaccggatcagtacgatgtactgcgacgacaagtatggaaccctgggcattccatcagaagtcatctcgagcatgcgaatcaagatgatcgagggctcgagcactccatcggcgcacgacgacatcaactcgttcctgctagacgatgacttcagcataccgttctccgtcgatgacttcacgaagcttatagtgcacgtcgacgtagcggacatggacctgccaccactgattcaggagagcaacggctccaaactgggacactga

SEQ ID NO: 5428 - protein, 768 aa, Sorghum bicolor
  misc_feature: Ceres ANNOT ID no. 6043527
  misc_feature (586)..(693): Pfam Id: DIL Pfam Desc: DIL domain
  misc_feature (1)..(764): NCBI GI: 53793465 NCBI Desc: myosin heavy chain-like [oryza sativa (japonica cultivar-group)]
  misc_feature (1)..(676): NCBI GI: 115437940 NCBI Desc: os01g0584200 [oryza sativa (japonica cultivar-group)]
  misc_feature (89)..(768): NCBI GI: 4733891 NCBI Desc: unconventional myosin heavy chain [zea mays]
  misc_feature (89)..(762): NCBI GI: 56201391 NCBI Desc: myosin xi [nicotiana tabacum]
  misc_feature (74)..(762): NCBI GI: 2444180 NCBI Desc: unconventional myosin [helianthus annuus]
MDGDHMRQATAAAAAVVTVTQAARAQDSPARRLIAWLRLLFRAFVHRYAKLASWDAAGRPVFVILAVFFLHRSLRRRYLSWKESSGLRLMAAAVTVQATVRAMAARRELSVRKQTRAATRIQAQWRAHRAVWSYLTTKRAALICQRAWRQTIATKEKLRQENLEREMLDEMCRLREMVDVLQQAVNDAETRATNESEAAKDAIAQLEAASVAMAEDTEKVKALNAEVDRLKDLLGAEMSETFAVKKSLAEAELRNEKLARLLGVEEVKNKRLQDSLKRMEEKASNLDEENRMLRQAVASNPGIVKSPSSEYHEAPGIQATPDNEKLANGTVKPIIVDREANIHEKSAEQPTSNGHEAEKQQQELLIKCLSEDLGFSIGRPIAAYLIYRCLVHWRSFEEERTVVFDRIIQKITAALEARDNNETLAYWLSNSCTLLVLLQRTLKINGVAALARQRRRASPLKVPQENKDPSHPDRPVSDGGLINGLAEVYQVEAKYPAIAFKQQLTALLEKVYGMIRHNLKKELSPLLGLCIQAPRTFVVSPRGSCSQGTDLAQQASMAHWQSIIKILTNSLNVLKSNYVPPFLICKLFTQVFSFINVQLFNSLLLRRECCSFSNGEYVKAGLDELEHWCFWLTEEYAGSAWDELKHIRQAVTLLILEEKHSRGLTEITDDFCPALSMQQLYRISTMYCDDKYGTLGIPSEVISSMRIKMIEGSSTPSAHDDINSFLLDDDFSIPFSVDDFTKLIVHVDVADMDLPPLIQESNGSKLGH

SEQ ID NO: 5429 - DNA, 1542 bp, Sorghum bicolor
  misc_feature: Ceres ANNOT ID no. 6043541
  misc_feature: Encodes the peptide sequence at SEQ ID NO 5430
atgtcgtcggtgtacgtgcttgagcccccgacgaaggggaaggtggtggtgcagacgacggctggtccgctcgacatcgagctgtggcccaaggaggcccccaaggcggcgcgcaacttcgtgcagctctgcctcgagggctactacgacggcaccatcttccaccgcgtcatcaaggacttcctcgttcagggcggcgaccccaccggctccggcactgggggtgagagcatctatggggcgccatttgctgatgagttccactcgcggctgaggtttaaccacagaggtttagtggcttgtgccaatgctggcacacctcattctaacggaagccagttctttatcacccttgaccgctgtgattggcttgataagaagaacaccatctttgggaaggttactggtgattctattttcaaccttctttccttggctgacgtggagactgataaggatgatcgacctgtgtacccgcagaaaattctttcagtcgaggttctctgggacccatttgaggatattgttccgaggcaacttaagaaggctgagtctgttgccaaggctgatactgaggtgaaacctaagaagaaggcagttaagcaacttaacgtcctctcttttggtgatgaagtagaagaggaggagaatgaggcagctgcctctgttcaggccaaaataaaaagtattcatgatgtgttggatgatcctcgctttcttaaaggggaaccagaggatgtacagttgtccaaggagcaagaggagcagaaaaaggatactgttcaatctgtcagggatgctttgatctcaaagaaagttgaatcaagagagcaacatcatgatccagtgtctgatgattatcctgaagacgagaatgaagaggattttgacaacaggatgcgctcacaaatccttaaaaaacgtagagagcttggtgatgtccctcgtgaaccctccagagcagataaaccacaccataaggataaggaactatcagaccacaggtccaatatccaacataggagggacaatgatgaggacgatgatcaggagcatgagctacaaaaggctaaaaaactatccttgaagaaaaaaggtgctggctcagaagcgagtgcggagaggatgtccaaagcagatgctaatttgcagctactaaatccggctgaacaagggagacatttgcaaaaacagaaaaaacgtcgactccaaggccgcgaagatgagactctagcgaagttacagaagttcaagtcttctttcctcagtaagaatcttgctaccaatcatgtcaaagaaaagaacccttctactgacaaggtggaaaaggaagatgaagaggatgatgactacaaagggtggcacacaaaccgactgtctttcttacccagttcttccaaggatggaatggcaaggaaagacgatccagatgactatgtagtggtagacccacttctggagaaaggaaaagaaaaattcaacaagatgcaagcaaagcttaaacggagagagcgcgaatgggcaggcagatctctcacctga

SEQ ID NO: 5430 - protein, 513 aa, Sorghum bicolor
  misc_feature: Ceres ANNOT ID no. 6043541
  misc_feature (14)..(168): Pfam Id: Pro_isomerase Pfam Desc: Cyclophilin type peptidyl-prolyl cis-trans isomerase/CLD
  misc_feature (1)..(512): NCBI GI: 45680878 NCBI Desc: multidomain cyclophilin type peptidyl-prolyl cis-trans isomerase [arabidopsis thaliana]
  misc_feature (1)..(323): NCBI GI: 53793437 NCBI Desc: peptidyl prolyl cis trans isomerase-like [oryza sativa (japonica cultivar-group)]
  misc_feature (1)..(251): NCBI GI: 110742797 NCBI Desc: cyclophilin [arabidopsis thaliana]
  misc_feature (1)..(379): NCBI GI: 49258028 NCBI Desc: mgc84139 protein [xenopus laevis]
  misc_feature (1)..(371): NCBI GI: 41055448 NCBI Desc: similar to serologically defined colon cancer antigen 10 [danio rerio]
  misc_feature (8)..(163): SWISSPROT Homolog: EC 5.2.1.8 Peptidyl-prolyl cis-trans isomerase-like 1
MSSVYVLEPPTKGKVVVQTTAGPLDIELWPKEAPKAARNFVQLCLEGYYDGTIFHRVIKDFLVQGGDPTGSGTGGESIYGAPFADEFHSRLRFNHRGLVACANAGTPHSNGSQFFITLDRCDWLDKKNTIFGKVTGDSIFNLLSLADVETDKDDRPVYPQKILSVEVLWDPFEDIVPRQLKKAESVAKADTEVKPKKKAVKQLNVLSFGDEVEEEENEAAASVQAKIKSIHDVLDDPRFLKGEPEDVQLSKEQEEQKKDTVQSVRDALISKKVESREQHHDPVSDDYPEDENEEDFDNRMRSQILKKRRELGDVPREPSRADKPHHKDKELSDHRSNIQHRRDNDEDDDQEHELQKAKKLSLKKKGAGSEASAERMSKADANLQLLNPAEQGRHLQKQKKRRLQGREDETLAKLQKFKSSFLSKNLATNHVKEKNPSTDKVEKEDEEDDDYKGWHTNRLSFLPSSSKDGMARKDDPDDYVVVDPLLEKGKEKFNKMQAKLKRREREWAGRSLT

SEQ ID NO: 5431 - DNA, 1602 bp, Sorghum bicolor
  misc_feature: Ceres ANNOT ID no. 6043556
  misc_feature: Encodes the peptide sequence at SEQ ID NO 5432
atgggcctctcgggcgcgacgatctccgcgccgctcggctgccgtgggctgcggcgcggggcggtcggcggaggtaaggcgcggaaggcggaggcggagaggtggcggcgggcgggctggagccgacgcgtgggcggaccgaaggtgacgtgcgtggccaccgagaagcacgacgagacggcggcggtcggcgtggagttcgcggacgaggaggactaccgcaagggcggcggcggcgagctgctttacgtgcaaatgcaggccaccaagcccatggaaagccagtccaggatcgcttccaagctattgcccatatctgatgaaaacacagtacttgatttggttatcattggttgtggtcctgctggtctttctctagcctcagagtcagctaagaaaggtctcaccgtaggtctcattgggcctgaccttccattcacaaataactatggtgtgtgggaggatgaatttaaagatcttggtctagcgagttgtatcgagcacgtctggaaggatactattgtctacctagacaataacaagcccatactgattggccgttcttatggcagggtgcaccgtgacttgctccatgaggagctactgagaagatgctatgaagctggcgtgacatacctgaactccaaagtggacaagatcatagaatctccagatggacacagagtagtctgttgtgataagggtcgtgagataatttgcaggcttgccattgttgcttcgggggcagcatctggtaggcttctagagtatgaggttgggggtcctcgtgtttgcgtgcagactgcatacggagtagaagttgaggtggaaaataatccatatgatcccagcttaatggttttcatggactacagagattgtttcaaagaggaattctcacacactgaacaagaaaatcccactttcctgtatgctatgcccatgtcatccacacgagttttctttgaggaaacatgcttagcttctaaagatgctatgtcctttgatctacttaagaagaggctgatgtatcggttgaatgcaatgggagttcgtatcctgaaaatttatgaggaggaatggtcctacattcctgttggagggtccttaccaaacacagatcagaaaaatcttgcatttggtgctgcagcaagtatggtgcatcctgcaacggggtactcagtggttagatctttgtctgaggctccaagatatgcttctgtgatatccgacatcttaaataaccgagttcctgcagaatatttgcttggaaattctcaaaattacagtccatcaatgcttgcatggagaacactatggcctcaagaaaggaaacgtcagcgatccttcttccttttcggattagcgttgataatccaactgaataatgaaggcatacaaacattctttgaagcctttttcagggtgccgaaatggatgtggcggggatttcttggctcaaccctttcatcggtcgatctcatactattttcattctacatgtttgcaatagctccaaatcaattgcgaatgaacctcgtcagacatctcctctctgacccgactggctcaaccatgatcaagacctacctgaccttataa

SEQ ID NO: 5432 - protein, 533 aa, Sorghum bicolor
  misc_feature: Ceres ANNOT ID no. 6043556
  misc_feature (113)..(511): Pfam Id: Lycopene_cycl Pfam Desc: Lycopene cyclase protein
  misc_feature (113)..(398): Pfam Id: DAO Pfam Desc: FAD dependent oxidoreductase
  misc_feature (12)..(533): NCBI GI: 92109236 NCBI Desc: lycopene epsilon-cyclase [citrus unshiu]
  misc_feature (41)..(533): NCBI GI: 18419661 NCBI Desc: lycopene epsilon-cyclase [spinacia oleracea]
  misc_feature (67)..(531): NCBI GI: 12746307 NCBI Desc: lycopene epsilon-cyclase [adonis palaestina]
  misc_feature (67)..(531): NCBI GI: 12746309 NCBI Desc: lycopene epsilon-cyclase [adonis palaestina]
  misc_feature (51)..(532): NCBI GI: 3005983 NCBI Desc: lycopene epsilon-cyclase [lycopersicon esculentum]
  misc_feature: Useful for making plants with altered lutein content
  misc_feature: Useful for making plants with altered lycopene content
  misc_feature: Useful for making plants with modulated biomass
  misc_feature: Useful for making plants with modulated heat sensitivity
  misc_feature: GREAT-hit functional homolog of the protein sequence given in SEQ ID NO 13434
  misc_feature: GREAT-hit functional homolog of the protein sequence given in SEQ ID NO 13469
  misc_feature: Useful for making plants with altered lutein content
  misc_feature: Useful for making plants with altered lycopene content
  misc_feature: Functional homolog of the protein sequence given in SEQ ID NO 13469
MGLSGATISAPLGCRGLRRGAVGGGKARKAEAERWRRAGWSRRVGGPKVTCVATEKHDETAAVGVEFADEEDYRKGGGGELLYVQMQATKPMESQSRIASKLLPISDENTVLDLVIIGCGPAGLSLASESAKKGLTVGLIGPDLPFTNNYGVWEDEFKDLGLASCIEHVWKDTIVYLDNNKPILIGRSYGRVHRDLLHEELLRRCYEAGVTYLNSKVDKIIESPDGHRVVCCDKGREIICRLAIVASGAASGRLLEYEVGGPRVCVQTAYGVEVEVENNPYDPSLMVFMDYRDCFKEEFSHTEQENPTFLYAMPMSSTRVFFEETCLASKDAMSFDLLKKRLMYRLNAMGVRILKIYEEEWSYIPVGGSLPNTDQKNLAFGAAASMVHPATGYSVVRSLSEAPRYASVISDILNNRVPAEYLLGNSQNYSPSMLAWRTLWPQERKRQRSFFLFGLALIIQLNNEGIQTFFEAFFRVPKWMWRGFLGSTLSSVDLILFSFYMFAIAPNQLRMNLVRHLLSDPTGSTMIKTYLTL

SEQ ID NO: 5433 - DNA, 624 bp, Sorghum bicolor
  misc_feature: Ceres ANNOT ID no. 6043569
  misc_feature: Encodes the peptide sequence at SEQ ID NO 5434
atggtgtcgctgaagctgcagaagcgcctcgccgcgagcgtcctcaagtgcggcaaaggcaaagtctggcttgaccccaatgaagtcagcgagatctccatggccaactcccgccagaacatccggaagttggttaaggatgggtttatcatcaagaagccccagaagatccactcaagatcccgtgcaagaagggcacatgaggccaagcagaagggaaggcactctggatatggcaagcgcaggggtaccagggaggctaggctccccaccaagattctgtggatgaggaggatgcgtgttctgaggcgcctgctccgcaagtaccgtgaggccaagaagattgacaagcacatgtatcatgacatgtacatgaaggtcaagggtaacatgttcaagaacaagagggtgcttatggagagtatccacaagtccaaggctgagaagctcagagagaagacactttctgatcagtttgaggccaagcgtgcaaagagcaaggcgagccgcgagaggaagattgctaggagggaggagaggttggcacagggcccgagagaaccaacagcaccagtctcagccactgctccatctgctggggcaccaaagaaagcaaagaagtga

SEQ ID NO: 5434 - protein, 207 aa, Sorghum bicolor
  misc_feature: Ceres ANNOT ID no. 6043569
  misc_feature (2)..(149): Pfam Id: Ribosomal_L19e Pfam Desc: Ribosomal protein L19e
  misc_feature (1)..(200): NCBI GI: 32401377 NCBI Desc: ribosomal protein l19 [triticum aestivum]
  misc_feature (1)..(196): NCBI GI: 47026900 NCBI Desc: ribosomal protein l19 [hyacinthus orientalis]
  misc_feature (1)..(207): NCBI GI: 92878290 NCBI Desc: ribosomal protein l19e [medicago truncatula]
  misc_feature (1)..(201): NCBI GI: 40287526 NCBI Desc: 60s ribosomal protein l19 [capsicum annuum]
  misc_feature (1)..(202): NCBI GI: 83284003 NCBI Desc: 60s ribosomal protein l19-like protein [solanum tuberosum]
MVSLKLQKRLAASVLKCGKGKVWLDPNEVSEISMANSRQNIRKLVKDGFIIKKPQKIHSRSRARRAHEAKQKGRHSGYGKRRGTREARLPTKILWMRRMRVLRRLLRKYREAKKIDKHMYHDMYMKVKGNMFKNKRVLMESIHKSKAEKLREKTLSDQFEAKRAKSKASRERKIARREERLAQGPREPTAPVSATAPSAGAPKKAKK

SEQ ID NO: 5435 - DNA, 900 bp, Sorghum bicolor
  misc_feature: Ceres ANNOT ID no. 6043573
  misc_feature: Encodes the peptide sequence at SEQ ID NO 5436
atgccacgagccaccgaggcggcaccaccgccgcaggctttccagtgcaccccagggcgccacccggtcgccatggaatcccgcttcggcttccgctactcctccggcgacgtgcggtccgggagctcgctgtcgcttggggagcgcctctgcgcggtcttcttccccttcatcgccatcgccgaggccgttttcttcgccttcaccgactgcctcgcggacctctgccccggctccgactcctcggcctccggcgcgggcgcgtcctcctccgacgccaagaacagtcggaccaaccaccaccaccaccaccactacagacctttcctacgccgcgccgctgcgggtggatggacctccctcaacctccgccagctcgcacgcctcgccgacgagtccggatgcttctccgtcaacgaggtcgaggcgctcttcgagctctacaagaagatcagctgctccatcatcaacgacggcctcatccacaaggtttttgatttgtttgatgagaagaaaaatggtgtgatcgagtttgatgagtttattcatgctctaagtgtcttccatcccttggcaccaatggaagacaagattgattttgcattcaggttgtatgacttgaggcaaactgggtttattgaacgtgaagaggttaagcaaatggtaattgctattttgatggaatctgatgtgaaattatcagatgacctacttgaggccattatagacaagacatttgaagatgctgatgccgataaggatggaaaaataaatcaagaagagtggaaggaatttgtgttacgccaccctaacctgttgaagaacatgacactgccttatctgagggacgtcacaaccgttttccctagtttcgtcttcaacacagcagtggaagattaa

SEQ ID NO: 5436 - protein, 299 aa, Sorghum bicolor
  misc_feature: Ceres ANNOT ID no. 6043573
  misc_feature (160)..(188): Pfam Id: efhand Pfam Desc: EF hand
  misc_feature (241)..(269): Pfam Id: efhand Pfam Desc: EF hand
  misc_feature (25)..(299): NCBI GI: 76577803 NCBI Desc: calcineurin b-like protein 9 [oryza sativa (japonica cultivar-group)]
  misc_feature (161)..(299): NCBI GI: 133925831 NCBI Desc: calcineurin b-like protein 10 [populus trichocarpa]
  misc_feature (161)..(299): NCBI GI: 114786420 NCBI Desc: calcineurin b-like protein 10 [populus euphratica]
  misc_feature (158)..(299): NCBI GI: 133925825 NCBI Desc: calcineurin b-like protein 6 [populus trichocarpa]
  misc_feature (161)..(299): NCBI GI: 56785307 NCBI Desc: calcineurin b-like [oryza sativa (japonica cultivar-group)]
  misc_feature: Useful for making plants with modulated water use efficiency
  misc_feature: Functional homolog of the protein sequence given in SEQ ID NO 13666
  misc_feature: The sequence is a functional homolog of SEQ ID NO 2 in US patent 7250555
MPRATEAAPPPQAFQCTPGRHPVAMESRFGFRYSSGDVRSGSSLSLGERLCAVFFPFIAIAEAVFFAFTDCLADLCPGSDSSASGAGASSSDAKNSRTNHHHHHHYRPFLRRAAAGGWTSLNLRQLARLADESGCFSVNEVEALFELYKKISCSIINDGLIHKVFDLFDEKKNGVIEFDEFIHALSVFHPLAPMEDKIDFAFRLYDLRQTGFIEREEVKQMVIAILMESDVKLSDDLLEAIIDKTFEDADADKDGKINQEEWKEFVLRHPNLLKNMTLPYLRDVTTVFPSFVFNTAVED

SEQ ID NO: 5437 - DNA, 1140 bp, Sorghum bicolor
  misc_feature: Ceres ANNOT ID no. 6043579
  misc_feature: Encodes the peptide sequence at SEQ ID NO 5438
atggcctggggtcaaggtgctaagaggtccatactagggcttctctttcgtgctcagcagcaaactgctcggccatactcttcttcagcattccagactcatcaattgagcactcatgttccccaagatggcgtgtttcttaggagattcagctctgaggtgtcttcttcagagcaaatgaaccttataaagcaactcagacaaaggacgagtgctccaatcaaagatgtcaaggcctccctagttgcctgcaactgggatattgatgctgcgcagaaggacctaaggaagagaggtgttgctcttgctgcaaaaaagtcttcacgcactgctgctgaaggtttgctagctatcgcacaagatgacaaaagggctgctgtagttgagcttaactgtgaaactgatttcgtggcaagaaatgatgttttccagtacctggcttcatcattggcaaagatggctttatctgctcagggtcccggtgaattgttcatgccttttggtcctgaacttttagagaacatgtctatcaatcttgatcatccgaacctcagcggggaaacaactgtccaaaatgctgttacagaagttgctgccatggttggggagaatgtgaaactcagaagaggcttcatgctgtccacaactgcacatggtgttgtttcatcttatatgcatacctgtccccagccaggtatgggtcggattgctggattggtcacactagaagcagaagatagcattactctccttgatgctgtcaaaagtgttgggtcatctattgcgatgcagattgttgcaacaaagccattattcttatcaaaagaactggtttctgcttccgctctagaaaatgagcgtgaaatacttcgaacacaggccgaaagttcagggaaatcccaaatggctatggataaaatggtggaaggccgattgaggaagtactttgaagaagttgtgctcatggagcaaaaatatgttttaaatgacaacacaaacgtgaagaccgtgctgaatgacttgtcgaaagaggttggttctaaagtaacaatcggtaacttcatcagaatggaggttggagaagggattgagagaactgaagccgctgatggttcagaggttgctgctggggctatgtag

SEQ ID NO: 5438 - protein, 379 aa, Sorghum bicolor
  misc_feature: Ceres ANNOT ID no. 6043579
  misc_feature (111)..(361): Pfam Id: EF_TS Pfam Desc: Elongation factor TS
  misc_feature (58)..(95): Pfam Id: UBA Pfam Desc: UBA/TS-N domain
  misc_feature (34)..(378): NCBI GI: 5669636 NCBI Desc: ethylene-responsive elongation factor ef-ts precursor [lycopersicon esculentum]
  misc_feature (44)..(370): NCBI GI: 3600047 NCBI Desc: similar to elongation factor ef-ts [arabidopsis thaliana]
  misc_feature (183)..(378): NCBI GI: 25299526 NCBI Desc: protein translation elongation factor ts (ef-ts) [imported] - brucella melitensis (strain 16m)
  misc_feature (183)..(378): NCBI GI: 109827126 NCBI Desc: elongation factor ts (ef-ts)
  misc_feature (183)..(378): NCBI GI: 17987107 NCBI Desc: protein translation elongation factor ts (ef-ts) [brucella melitensis 16m]
MAWGQGAKRSILGLLFRAQQQTARPYSSSAFQTHQLSTHVPQDGVFLRRFSSEVSSSEQMNLIKQLRQRTSAPIKDVKASLVACNWDIDAAQKDLRKRGVALAAKKSSRTAAEGLLAIAQDDKRAAVVELNCETDFVARNDVFQYLASSLAKMALSAQGPGELFMPFGPELLENMSINLDHPNLSGETTVQNAVTEVAAMVGENVKLRRGFMLSTTAHGVVSSYMHTCPQPGMGRIAGLVTLEAEDSITLLDAVKSVGSSIAMQIVATKPLFLSKELVSASALENEREILRTQAESSGKSQMAMDKMVEGRLRKYFEEVVLMEQKYVLNDNTNVKTVLNDLSKEVGSKVTIGNFIRMEVGEGIERTEAADGSEVAAGAM

SEQ ID NO: 5439 - DNA, 2427 bp, Sorghum bicolor
  misc_feature: Ceres ANNOT ID no. 6043594
  misc_feature: Encodes the peptide sequence at SEQ ID NO 5440
atgggggatgcgtgtttctcaacacagctaattgatggagatggggtcttcaacgtctccggattggagaacttcatgaaggatgtcagattgggtgaatgtgggctctcctatgctgttgtatcaataatgggcccgcagagtagtgggaaaagtacacttttgaatcatctttttgggaccaattttagggagatggatgccttcagaggaaggtcacagactaccaaaggtatatggttagcgaaggcccagaatattgaaccgtgcacccttgtaatggatttggaaggaactgatggaagagagaggggagaggatgacacagcatttgagaagcaaagtgcattgtttgctttggccgtttcggacattgtgttgattaatatgtggtgccatgacattggcagagaacaggctgcaaacaagcctcttttgaagactgttttccaggtcatgatgaggttgttcagtccccgcaaaacaacattgttgtttgttattcgtgacaaatcaaggacacccttagaaaatcttgaaccaattctaagggaagacattcagaagatatgggattctgttccaaagccccatgcccataaagaaactccacttagtgaatttttcgatgtacaagttgtggcactgtcgagttatgaagaaaaagaagagttattcaaacagcaggtttctgatttaagagataggtttcagcattctattgctcctggcggacttgctggggatcgtcgtggtgttgtcccagcttcaggtttctcatttagttcccaggaattttggaaagtcattaaggagaacaaagaccttgatctgcctgctcataaagttatggtggctactgtacgttgtgaggaaattggtaatgagaaagttgccagttttacagctgatgaggaatggcaacaatttgaggaggctgttcaacatgactttgttcctggatttgggaagaagctcagcagccttcttgatagatgtttatcagagtatgacatggaggctatttattttgatgaaggtgtcagaagctctaaaagacaacaacttgagtctaaactcttacagcttgtcaatcctgcctatcaatctcttctaggtcacttacggactagaactttagaagcatttaaggagtcctttgacaaggccctagaaaaggagggatttgctgttgcagctcgcaattgtagtcaaactttcttggagaagtttgaaaaaggatctgaagatgctgctattcaacaagtgaattgggacacctcaaaagtgaaggataagcttagacgtgacattgaggctcatatagcttcagttcgagctactaaattatctgaactttgtgccaaatatgaggcacaacttaccaaagctctggcggaaccagttgaatctcttctagattcagccagtgaagatacgtggccagctattagaaagcttcttcaacgcgagacaaaaactgctgtttcaggtcttgaatctgctgtgtcagcttttgaactcgatgaagcaagtgagaaagagctgcttgtgaagctggagaagcatggaaggagtgttgttgagtcaaaggcaaaagaagaagctggaagggttttgatccgcatgaaggacaggttctcaacactgttcagccgagatgctgactctatgcccagggtttggacaggaaaggaggacataaaagctataacaaaaaccgctcgttcagcctccatgaagttgctttctacaatggctgcaattcggttggaggaagatggtgataacattgagaacactctctcccttgctcttgttgacaccaaaaaacctgggactacagataggagtatccaaatttctgatccacttgcctccagctcatgggaaacggttgccgaggagaagactttaattacccctgtgcagtgtaaaaatttgtggaggcagttcaaagctgaaactgaatatacagtcactcaagccatagctgctcaggaagcaaataagaggaacaacaactggctgccgcctccatgggcacttgctgcaatggctatccttggattcaacgagtttatgacattactgaggaatccgctttacctgtttgccatatttgtgatttatcttgttggaaaagccatttgggtgcagtcagaaattggcagggaattccaacacggatttcttcctgccatcctttcactgtcgacgaaatttgttcccactgtaatgaacatcttgaagagattagccgacgctggtcaagaacctgcagcagccccagacaggcaaagagagctggagctccaaccaaaatccaccaggaacggttcatacagcaatgtgacatcggcagggtcatccagcgtaacgacttcggagattggacccgaatattcaagcccggtggcgcaatga

SEQ ID NO: 5440 - protein, 808 aa, Sorghum bicolor
  misc_feature: Ceres ANNOT ID no. 6043594
  misc_feature (44)..(785): Pfam Id: RHD3 Pfam Desc: Root hair defective 3 GTP-binding protein (RHD3)
  misc_feature (3)..(807): NCBI GI: 115437816 NCBI Desc: os01g0575000 [oryza sativa (japonica cultivar-group)]
  misc_feature (3)..(808): NCBI GI: 47934042 NCBI Desc: root hair defective 3 gtp-binding protein [triticum aestivum]
  misc_feature (44)..(779): NCBI GI: 15219333 NCBI Desc: root hair defective 3 gtp-binding (rhd3) family protein [arabidopsis thaliana]
  misc_feature (3)..(805): NCBI GI: 9759601 NCBI Desc: gtp-binding protein-like; root hair defective 3 protein-like [arabidopsis thaliana]
  misc_feature (71)..(791): NCBI GI: 42572425 NCBI Desc: root hair defective 3 (rhd3) [arabidopsis thaliana]
MGDACFSTQLIDGDGVFNVSGLENFMKDVRLGECGLSYAVVSIMGPQSSGKSTLLNHLFGTNFREMDAFRGRSQTTKGIWLAKAQNIEPCTLVMDLEGTDGRERGEDDTAFEKQSALFALAVSDIVLINMWCHDIGREQAANKPLLKTVFQVMMRLFSPRKTTLLFVIRDKSRTPLENLEPILREDIQKIWDSVPKPHAHKETPLSEFFDVQVVALSSYEEKEELFKQQVSDLRDRFQHSIAPGGLAGDRRGVVPASGFSFSSQEFWKVIKENKDLDLPAHKVMVATVRCEEIGNEKVASFTADEEWQQFEEAVQHDFVPGFGKKLSSLLDRCLSEYDMEAIYFDEGVRSSKRQQLESKLLQLVNPAYQSLLGHLRTRTLEAFKESFDKALEKEGFAVAARNCSQTFLEKFEKGSEDAAIQQVNWDTSKVKDKLRRDIEAHIASVRATKLSELCAKYEAQLTKALAEPVESLLDSASEDTWPAIRKLLQRETKTAVSGLESAVSAFELDEASEKELLVKLEKHGRSVVESKAKEEAGRVLIRMKDRFSTLFSRDADSMPRVWTGKEDIKAITKTARSASMKLLSTMAAIRLEEDGDNIENTLSLALVDTKKPGTTDRSIQISDPLASSSWETVAEEKTLITPVQCKNLWRQFKAETEYTVTQAIAAQEANKRNNNWLPPPWALAAMAILGFNEFMTLLRNPLYLFAIFVIYLVGKAIWVQSEIGREFQHGFLPAILSLSTKFVPTVMNILKRLADAGQEPAAAPDRQRELELQPKSTRNGSYSNVTSAGSSSVTTSEIGPEYSSPVAQ

SEQ ID NO: 5441 - DNA, 939 bp, Sorghum bicolor
  misc_feature: Ceres ANNOT ID no. 6043601
  misc_feature: Encodes the peptide sequence at SEQ ID NO 5442
atgggcgaccgggcgtacgcgccggccgcgaagccggttcccgtgcgcgccaccaacggcaccgcgaacggcggcggcggcggtcccccgcgtcccgcgccgccgtccatgctgcccggcggtcgcgtgccccctccgccgatgtaccgtccgaagcccgcgcagtcgcgccctccggcgcgccgcccccgccggagcgcccgcgggtggtgctgcgcgtgctgcctgtggctgacgctggtgctggtgggcctggtgttcctgggcgccatcgcggcgggggtgttctacgtggtgtaccgcccgcgcccgcccagcttcgcggtgacgtcgctgcgcctggcggcgctgaacgtgtcggactcggacgcgctcacctcccgcatcgagttcacggtgacggcgcggaaccccaacgacaagatcgccttccgctacggcgacatcgcggcgtccttcgcctccgacgacggcgccgacgtgggcgacggcgtggtcccgggcttcctccacccggcgggcaacaccaccgtcgtccgcgccgcggcctccaccgcgtcgtccaccatcgaccccgtccaggcggcggcgctcagatccagaaagtcccacgtcatggccgcgcagatggacgccaaggtcggcttccagatcgggcggttcaagtccaagagcatcaacgtgcgcgtcacctgcgcgggggtctccgtggggctcgccaagccgcctcccgccgccgcgcccgcgcccgcgccggacgcggagccgaccgtcgtggtcgccgcggcgccggcgcccgcccgaggccgtgggcgtgggcggtcgccgcggtcggtcgtacggacgtcgtcctccagcgccagcggcggcggagggaagatgacgccgacggacgcaaagtgtaaggtccgcatcaagatctggatttggtcgttttga

SEQ ID NO: 5442 - protein, 312 aa, Sorghum bicolor
  misc_feature: Ceres ANNOT ID no. 6043601
  misc_feature (97)..(232): Pfam Id: Hin1 Pfam Desc: Harpin-induced protein 1 (Hin1)
  misc_feature (1)..(237): NCBI GI: 124360377 NCBI Desc: harpin-induced 1 [medicago truncatula]
  misc_feature (8)..(247): NCBI GI: 92898246 NCBI Desc: heavy metal transport/detoxification protein; harpin-induced 1 [medicago truncatula]
  misc_feature (3)..(237): NCBI GI: 11762174 NCBI Desc: at1g17620 [arabidopsis thaliana]
  misc_feature (101)..(312): NCBI GI: 115462555 NCBI Desc: os05g0199100 [oryza sativa (japonica cultivar-group)]
  misc_feature (7)..(234): NCBI GI: 115445411 NCBI Desc: os02g0261000 [oryza sativa (japonica cultivar-group)]
MGDRAYAPAAKPVPVRATNGTANGGGGGPPRPAPPSMLPGGRVPPPPMYRPKPAQSRPPARRPRRSARGWCCACCLWLTLVLVGLVFLGAIAAGVFYVVYRPRPPSFAVTSLRLAALNVSDSDALTSRIEFTVTARNPNDKIAFRYGDIAASFASDDGADVGDGVVPGFLHPAGNTTVVRAAASTASSTIDPVQAAALRSRKSHVMAAQMDAKVGFQIGRFKSKSINVRVTCAGVSVGLAKPPPAAAPAPAPDAEPTVVVAAAPAPARGRGRGRSPRSVVRTSSSSASGGGGKMTPTDAKCKVRIKIWIWSF

SEQ ID NO: 5443 - DNA, 2133 bp, Sorghum bicolor
  misc_feature: Ceres ANNOT ID no. 6043604
  misc_feature: Encodes the peptide sequence at SEQ ID NO 5444
atggcgtggcggcgcgtcctcacccagattgcaaggcatcgaccaacaaaagcaatctacaatgaactagttgcttcctcccctttgggcactcttcgaagtgacatcactgcaggtgccagaattaaaaatttacaagagaggaaccagtcaagttacattggtagccttgcacgccgggtgcgagatctagaatcaccaagtgaaacttctctacttaaagagatttacagaagtgacccagagcgtgtcatacaaatatttgaaagccaaccttctttacattctaatccagcagcactttcagagtatgtgaaagctcttgtaagggttgataggctggacgagagtgccttgcttaaaacactgcagagaggtgctgcttcctcgacaaggggggaagaaagctttggtagcattcctgcattaattggtgctggtcaagtgacaaaagatggagctcttggcactgcaaatgcacctattcacatggtcacagcagaaacaggacaatttaaggatcagctttggcgtaccttccgaagcattgcactaactttccttcttatttcgggcatcggtgctctcattgaggatagaggaatcagcaaaggacttggtctgaatgaagaggttcaaccaagcatggagtctactacaaaattcagtgatgtaaagggtgttgatgaagcaaaatctgaacttgaagaaatagttcattatcttcgagatcccaagcgcttcacacgtcttggtggaaaacttccgaaaggtgtcttgcttgttggccctcctggcactgggaaaaccatgctagctagggctattgctggtgaagctggtgttcctttcttctcttgcagtggaagcgagtttgaggagatgtttgtgggagttggagctcggagagtgcgagacctttttgctgcagcaaaaaagcgatctccttgcatcatatttattgacgaaatagatgcaattggtgggagccggaatcctaaggatcaacagtatatgaagatgaccttgaaccagctgcttgttgagttggatggctttaagcagaatgaggggataattgtcattgctgcaaccaactttcctgagtcactagataaagccctagtcagacctgggcgttttgaccgtcatattgttgttcccaacccagatgttgaagggcgacgtcaaattctagaatcccatatgtcaaagatcttgaaaagtgatgatgtggacttaatgatcattgctagaggaacaccgggattctctggtgcagaccttgctaacttggtaaatgttgctgctcttaaggctgccatggatggtgcaaaagctgtcacaatgaatgaccttgagtatgcaaaggaccgaatcatgatgggtagtgagcggaagtcggcagttatctctgacgaatgcaggaagttgacagcataccatgagggagggcatgcccttgttgctatccacactgaaggagctcaccccgtccacaaggctaccatcgtacccaggggcatggctctaggaatggtggcccaactccctgacaaagaccagactagtgtgtcaaggaaacagatgctagcaaaattggatgtatgcatgggaggccgtgtggcagaagagcttatatttggggatactgaggtgacatctggtgcatcctcagacttccagcaagcaactgcaatggcaagagcaatggttactaaatatggcatgagcaagcaggtcggccttgtctcttataactatgaggacgatggaaagagcctgagctcagaaactagacttgtgattgagcaggaggtgaagaatttcttggagaatgcatataataatgcgaagaccattcttacaaaacacaataaagagctacatgctctagccaacgcacttcttgagcatgagaccctcacaggagcccagataacgaacatattggcccaggtacataacaaacagcaacaggagcatactatcgaagcaccgcagaagaccccagccgcaccagcttcccccgcatcaccagctgcatcagctgctgcagcagcagctgcagccgccgccgcagcacagcaggcggcagccaaagctaagggggtggctggtatgggatcttag

SEQ ID NO: 5444 - protein, 710 aa, Sorghum bicolor
  misc_feature: Ceres ANNOT ID no. 6043604
  misc_feature (449)..(650): Pfam Id: Peptidase_M41 Pfam Desc: Peptidase family M41
  misc_feature (258)..(442): Pfam Id: AAA Pfam Desc: ATPase family associated with various cellular activities(AAA)
  misc_feature (258)..(389): Pfam Id: AAA_5 Pfam Desc: ATPase family associated with various cellular activities(AAA)
  misc_feature (1)..(710): NCBI GI: 47969542 NCBI Desc: ftsh-like protease [pisum sativum]
  misc_feature (1)..(710): NCBI GI: 92898245 NCBI Desc: dna repair protein rada; peptidase m41, ftsh [medicago truncatula]
  misc_feature (1)..(706): NCBI GI: 92898241 NCBI Desc: aaa atpase; peptidase m41, ftsh [medicago truncatula]
  misc_feature (65)..(661): NCBI GI: 50892959 NCBI Desc: ftsh-like protease [pisum sativum]
  misc_feature (62)..(650): NCBI GI: 531752 NCBI Desc: yta11 [saccharomyces cerevisiae]
  misc_feature: The sequence is a functional homolog of SEQ ID NO. 462 in the 11/188,298 US application
  misc_feature: The sequence is a functional homolog of SEQ ID NO. 471 in the 11/188,298 US application
MAWRRVLTQIARHRPTKAIYNELVASSPLGTLRSDITAGARIKNLQERNQSSYIGSLARRVRDLESPSETSLLKEIYRSDPERVIQIFESQPSLHSNPAALSEYVKALVRVDRLDESALLKTLQRGAASSTRGEESFGSIPALIGAGQVTKDGALGTANAPIHMVTAETGQFKDQLWRTFRSIALTFLLISGIGALIEDRGISKGLGLNEEVQPSMESTTKFSDVKGVDEAKSELEEIVHYLRDPKRFTRLGGKLPKGVLLVGPPGTGKTMLARAIAGEAGVPFFSCSGSEFEEMFVGVGARRVRDLFAAAKKRSPCIIFIDEIDAIGGSRNPKDQQYMKMTLNQLLVELDGFKQNEGIIVIAATNFPESLDKALVRPGRFDRHIVVPNPDVEGRRQILESHMSKILKSDDVDLMIIARGTPGFSGADLANLVNVAALKAAMDGAKAVTMNDLEYAKDRIMMGSERKSAVISDECRKLTAYHEGGHALVAIHTEGAHPVHKATIVPRGMALGMVAQLPDKDQTSVSRKQMLAKLDVCMGGRVAEELIFGDTEVTSGASSDFQQATAMARAMVTKYGMSKQVGLVSYNYEDDGKSLSSETRLVIEQEVKNFLENAYNNAKTILTKHNKELHALANALLEHETLTGAQITNILAQVHNKQQQEHTIEAPQKTPAAPASPASPAASAAAAAAAAAAAAQQAAAKAKGVAGMGS

SEQ ID NO: 5445 - DNA, 1179 bp, Sorghum bicolor
  misc_feature: Ceres ANNOT ID no. 6043615
  misc_feature: Encodes the peptide sequence at SEQ ID NO 5446
atggcgccggcgtcggcagcggcctcggcggtgcggaagtctccggtcaccgttctcctcctctacgtagcgtgcgccttcatcctgctgctgctcctcgcctcctactcgcccggcctccagccccaccacgcccacggccgcagcctccaccgccgcctcaagctccacccaaagagctacccatcatccggcgctgcctccggtgggaacggggggcaacaggagacgcaccaccatgcggcctccttcgacccgaccatcgccgagctggagcgccggctggacgacaaggagtgggagcgcgagcactacagcctcctccacggcgccgagccggatgaccacatgaaggagtgggaggagttcctcaaggatgaggaggacttcatcaacgacgacgagcgattcaacgtcgccgaccgcatccgcgagctcttccccaagattgacgtcgccccgcaggacggattcgtctccctcgacgagctcaccacctggaacctccagcaggccagggccgaccagcaccatcgctccgctagggagatggagctctacaacaaggacggcgatgggatagtctcattcgaggccttcaatgcgctgcgccaagaatcccatggagagggcaatatgctggggttccaatggtggaaggaggagcatttcaatgcctcagatgcaaacgctgatggcttccttgataaagatgagttcaatgatttccttaatccaagtgattcggataatcccaaaatcatcaatttgctctgcagacaagaaataaggcagagggataaagatggtgacggaaagttaaactttgaagaatactttagtgcgctaaatgaccatatacatggttatgatgatgagaatgcagatatttcccatattgggaacgtaacagttgcgaaggatcggttttccaaacttgacaaagataatgatgggtttatttcggagcatgaactagagcctgttcttgataagctctatctttccgagcgctattattctagacagcaagccatccatgctatttcagaggcagacaaagatcatgatgggaggctaactttggaagagatgattgagaacccctatgcattttatggcagtgtttaccttagcgatgacgacgacgaagactacttccacgatgaatttcgctga

SEQ ID NO: 5446 - protein, 392 aa, Sorghum bicolor
  misc_feature: Ceres ANNOT ID no. 6043615
  misc_feature (305)..(333): Pfam Id: efhand Pfam Desc: EF hand
  misc_feature (164)..(392): NCBI GI: 115437796 NCBI Desc: os01g0572700 [oryza sativa (japonica cultivar-group)]
  misc_feature (184)..(392): NCBI GI: 52076360 NCBI Desc: calcium binding protein-like [oryza sativa (japonica cultivar-group)]
  misc_feature (113)..(392): NCBI GI: 46806523 NCBI Desc: calcium-binding ef hand family protein-like [oryza sativa (japonica cultivar-group)]
  misc_feature (107)..(392): NCBI GI: 38345557 NCBI Desc: osjnba0032f06.6 [oryza sativa (japonica cultivar-group)]
  misc_feature (107)..(392): NCBI GI: 115461380 NCBI Desc: os04g0681500 [oryza sativa (japonica cultivar-group)]
MAPASAAASAVRKSPVTVLLLYVACAFILLLLLASYSPGLQPHHAHGRSLHRRLKLHPKSYPSSGAASGGNGGQQETHHHAASFDPTIAELERRLDDKEWEREHYSLLHGAEPDDHMKEWEEFLKDEEDFINDDERFNVADRIRELFPKIDVAPQDGFVSLDELTTWNLQQARADQHHRSAREMELYNKDGDGIVSFEAFNALRQESHGEGNMLGFQWWKEEHFNASDANADGFLDKDEFNDFLNPSDSDNPKIINLLCRQEIRQRDKDGDGKLNFEEYFSALNDHIHGYDDENADISHIGNVTVAKDRFSKLDKDNDGFISEHELEPVLDKLYLSERYYSRQQAIHAISEADKDHDGRLTLEEMIENPYAFYGSVYLSDDDDEDYFHDEFR

SEQ ID NO: 5447 - DNA, 2070 bp, Sorghum bicolor
  misc_feature: Ceres ANNOT ID no. 6043618
  misc_feature: Encodes the peptide sequence at SEQ ID NO 5448
atggaggatgccctcgcgccgccgtctgtggcgccgaccccctccgccctcgctgccgctgccgtcttcactcgccggcggtcacacctcgacagcgcctccttccgcacgctctcccgcctcttctcccactgcctccacatcaaccagtcgccctgcggcatagcgccgcccgagcccgagcccgtcgccgcggaccctgtcggtggggactccgacgattccccagaaagacctaatggcgccgattgtgatcggctgaaggatgtggaaatcgaggcggcggatgcgggaggcctttcgctctacggggccgtctatcaaccggccgcggcgaaccctaccctcgacctgggtgagtctgaggcgctgaagcacgagggtgcggacgcggtacttgtcgtagaaagcacctcgggtatgaccagagccgaggtggaagaatcagcagcacttgtcgtagaaagcacctcgtgtaagaccagcgctgaggtggaggagtcagcagttgtagctggactggtggcggtggaggacttatctttgaagtcggtggagtctctcttggggacgaaagtcgatgaatcggtagaggtagcagtgggtgatgatgaaggccgtcttctgcttgaagcgatgatgacagactttacagggttgattgatgatgttgatgctggagtgatatcagcacagagttgtgcagtttctgcaggtgacctgcagaatagcaaggcatctgaggagtcgaaacagttggatggtgggattgaagagggagaaccacttagaaactgtgatcatgagcagaacggtggtggtggtttcgaggaaggagagattgagggcgagtttcaggattttggttcagaagaatctgtagattccgagcatggagatgaagatggtgaagatgagaaattggaaggcaattccatcagtagaggctcagggccagataaaacttgtgatcatggcacacagtttgggaatttgcactcaacacctgaaatcggaaatgatgatcttatactgaatagggatgctattgtcagaggtgatgcacaaatacctgttaccagggctcaagctgtcacttatgatgatgttgtggattggaatgagaatccgctgcctgacaatgaggctcccaaccctgggaagaagagaaaacgcactcagacagaacagaggaaggccaaaaagacgaaaaataaaagaatcaaccgggcactgcaacagatagctgatggagttagaagaccaaaacttactcgtgttataaagccaaaaaaaccttgctacttctatgaccatgggaagtgccagcagggcaataattgcaagtattcccatgattttacaccttcaacaaaatctaagccctgcacacattttgcatgtggttcttgtttgaaaggagaagggtgtccatatgaccatgagttgtcaaagtacgaatgccataactataaaaacaatggcatgtgtgccagaggtgataaatgcaaattctctcatgtgatgcgaactacagaaggtactcccacacaagatgcaaagacttctgatgtttcactggcatatgagaaaacaaacctcagggagcatacaagaagccagaagaacacaacagttcacaatggtgctcctagtagttctatccttagaaacctcactggtgtctccagcaaatctcagaatgtttctaatcgtattccaaagggcgtgcagtttcgtccctttggtaaaggtcaatcgaatttgagcagcctgcacctggatgctttgtccatggagaagcaaaggaatgcaaatggtactcagcataacctcggaggacatgaagcagaaaggcaaaaaattgtgaagcaaaattaccagaaacctaatctactgctagaagataagaattcatcgaaagaagctactaggcatccatgttcagacctgaaaaaaactactttacctgttgattctattgcaacacctggatcaatacatactcagcatgaagtctcagaggcttctaggattttgcaggagttcttgtttggtgctggcagttag

SEQ ID NO: 5448 - protein, 689 aa, Sorghum bicolor
  misc_feature: Ceres ANNOT ID no. 6043618
  misc_feature (484)..(509): Pfam Id: zf-CCCH Pfam Desc: Zinc finger C-x8-C-x5-C-x3-H type (and similar)
  misc_feature (2)..(689): NCBI GI: 52076312 NCBI Desc: zinc finger (ccch-type) protein-like [oryza sativa (japonica cultivar-group)]
  misc_feature (2)..(586): NCBI GI: 115437784 NCBI Desc: os01g0572100 [oryza sativa (japonica cultivar-group)]
  misc_feature (434)..(513): NCBI GI: 66357760 NCBI Desc: ccch rna binding domain involved in rna metabolism, transcripts identified by est [cryptosporidium parvum]
  misc_feature (434)..(513): NCBI GI: 46227182 NCBI Desc: ccch rna binding domain involved in rna metabolism, transcripts identified by est [cryptosporidium parvum]
  misc_feature (429)..(556): NCBI GI: 27696591 NCBI Desc: zinc finger ccch type domain containing 6 [mus musculus]
MEDALAPPSVAPTPSALAAAAVFTRRRSHLDSASFRTLSRLFSHCLHINQSPCGIAPPEPEPVAADPVGGDSDDSPERPNGADCDRLKDVEIEAADAGGLSLYGAVYQPAAANPTLDLGESEALKHEGADAVLVVESTSGMTRAEVEESAALVVESTSCKTSAEVEESAVVAGLVAVEDLSLKSVESLLGTKVDESVEVAVGDDEGRLLLEAMMTDFTGLIDDVDAGVISAQSCAVSAGDLQNSKASEESKQLDGGIEEGEPLRNCDHEQNGGGGFEEGEIEGEFQDFGSEESVDSEHGDEDGEDEKLEGNSISRGSGPDKTCDHGTQFGNLHSTPEIGNDDLILNRDAIVRGDAQIPVTRAQAVTYDDVVDWNENPLPDNEAPNPGKKRKRTQTEQRKAKKTKNKRINRALQQIADGVRRPKLTRVIKPKKPCYFYDHGKCQQGNNCKYSHDFTPSTKSKPCTHFACGSCLKGEGCPYDHELSKYECHNYKNNGMCARGDKCKFSHVMRTTEGTPTQDAKTSDVSLAYEKTNLREHTRSQKNTTVHNGAPSSSILRNLTGVSSKSQNVSNRIPKGVQFRPFGKGQSNLSSLHLDALSMEKQRNANGTQHNLGGHEAERQKIVKQNYQKPNLLLEDKNSSKEATRHPCSDLKKTTLPVDSIATPGSIHTQHEVSEASRILQEFLFGAGS

SEQ ID NO: 5449 - DNA, 1413 bp, Sorghum bicolor
  misc_feature: Ceres ANNOT ID no. 6043650
  misc_feature: Encodes the peptide sequence at SEQ ID NO 5450
atggagccgcgcgtggccaacaagttccgcctcgggcgcaagctcgggagcggatccttcggggagatcttccttggtactcacgtgcagaccaacgagcaggtcgcgattaagctggaaaatatgaagacaaaacatcctcagttgctgtatgaggcaaagctgtataggatacttcagggtggaactggaattccaaacatcaagtggtttggtgtcgagggtgactacaatgttcttgttatggacctcttgggtccaagccttgaagagcttttcagcttttgcaacagaaaactgtccctgaagacagttttgatgcttgctgatcagttgatcaaccggatcgagtatgttcatatgaagtccttcttacatcgagatattaagccagacaatttcctcatgggccttggcaagagaatgaatcaggcatacgtgattgattttggattggcaaagaaatacagggacagtacaaaccagcacattccatacagagagaacaaaaatttgactgggacagcacgatatgcaagtgtaaacactcatctcggaattgaacaaagcaggagggatgacatggaatcacttggatatgtactcatgtacttcttaagaggaagtcttccttggcaaggtctaaaagctgggaccaagaaacagaagtatgagaaaatcagtgaaaggaagatcgctacttcagttgaggttctctgtcgtggataccctcctgaatttcaacgctacttccatcactgccgtgcgttacgctttgatgatgcgcctgactatcaatacctgaagaaaatgttcagagacctttttattcgagagggatttcagtttgattatgtttttgactggaccattcttaagtaccagcaatcgcaaatgaccattccaccgcgtgctatggctgcagcaacggatcaaagctccaggatggcttcaatggcaaataataatggactgtcagccactgaagagggaaagagaagtgggtggtcagatgatcccttgcgacgccaggttccacctgcaggaataaatgcaggcagcttggcaaagcagaaatctccagttagacaagaagtgtccacatcaaaagatgctgtgttcgccagttcatctattttgggtcggtcaagcggatcgttgaggcgtcctgctgttcctagcagccgagttccaacgagtgaagctttactacgcagtcgtacaccagatggaagcccagggtctttccaaagaaatgctcctacacataggacctcacagacccatgagtacttggaccgctccggagtttcgttgtctggcaggctcatgcccaacaccaagcattatgagtccactctaaggagcatccaaggcctaaatgttgatgccaatgataggatccactactag

SEQ ID NO: 5450 - protein, 470 aa, Sorghum bicolor
  misc_feature: Ceres ANNOT ID no. 6043650
  misc_feature (9)..(272): Pfam Id: Pkinase Pfam Desc: Protein kinase domain
  misc_feature (9)..(272): Pfam Id: Pkinase_Tyr Pfam Desc: Protein tyrosine kinase
  misc_feature (1)..(469): NCBI GI: 121501708 NCBI Desc: casein kinase [beta vulgaris]
  misc_feature (1)..(470): NCBI GI: 92873006 NCBI Desc: protein kinase [medicago truncatula]
  misc_feature (1)..(465): NCBI GI: 124361134 NCBI Desc: protein kinase [medicago truncatula]
  misc_feature (1)..(385): NCBI GI: 549973 NCBI Desc: casein kinase i-like protein; similar to the rat delta isoform of casein kinase i, swiss-prot accession number q06486
  misc_feature (40)..(461): NCBI GI: 6635385 NCBI Desc: casein kinase i-like protein [brassica oleracea]
  misc_feature (1)..(450): SWISSPROT Homolog: EC 2.7.11.1 Casein kinase I isoform delta-like
  misc_feature: The sequence is a functional homolog of SEQ ID NO 32 in US patent 7179962
  misc_feature: The sequence is a functional homolog of SEQ ID NO. 310 in the 11/188,298 US application
  misc_feature: The sequence is a functional homolog of SEQ ID NO. 311 in the 11/188,298 US application
  misc_feature: The sequence is a functional homolog of SEQ ID NO. 464 in the 11/188,298 US application
  misc_feature: The sequence is a functional homolog of SEQ ID NO. 498 in the 11/188,298 US application
  misc_feature: The sequence is a functional homolog of SEQ ID NO. 332 in the 11/188,298 US application
  misc_feature: The sequence is a functional homolog of SEQ ID NO. 312 in the 11/188,298 US application
  misc_feature: The sequence is a functional homolog of SEQ ID NO. 358 in the 11/188,298 US application
  misc_feature: The sequence is a functional homolog of SEQ ID NO. 399 in the 11/188,298 US application
  misc_feature: The sequence is a functional homolog of SEQ ID NO. 520 in the 11/188,298 US application
  misc_feature: The sequence is a functional homolog of SEQ ID NO. 323 in the 11/188,298 US application
  misc_feature: The sequence is a functional homolog of SEQ ID NO. 340 in the 11/188,298 US application
  misc_feature: The sequence is a functional homolog of SEQ ID NO. 495 in the 11/188,298 US application
  misc_feature: The sequence is a functional homolog of SEQ ID NO. 366 in the 11/188,298 US application
  misc_feature: The sequence is a functional homolog of SEQ ID NO. 446 in the 11/188,298 US application
  misc_feature: The sequence is a functional homolog of SEQ ID NO. 441 in the 11/188,298 US application
MEPRVANKFRLGRKLGSGSFGEIFLGTHVQTNEQVAIKLENMKTKHPQLLYEAKLYRILQGGTGIPNIKWFGVEGDYNVLVMDLLGPSLEELFSFCNRKLSLKTVLMLADQLINRIEYVHMKSFLHRDIKPDNFLMGLGKRMNQAYVIDFGLAKKYRDSTNQHIPYRENKNLTGTARYASVNTHLGIEQSRRDDMESLGYVLMYFLRGSLPWQGLKAGTKKQKYEKISERKIATSVEVLCRGYPPEFQRYFHHCRALRFDDAPDYQYLKKMFRDLFIREGFQFDYVFDWTILKYQQSQMTIPPRAMAAATDQSSRMASMANNNGLSATEEGKRSGWSDDPLRRQVPPAGINAGSLAKQKSPVRQEVSTSKDAVFASSSILGRSSGSLRRPAVPSSRVPTSEALLRSRTPDGSPGSFQRNAPTHRTSQTHEYLDRSGVSLSGRLMPNTKHYESTLRSIQGLNVDANDRIHY

SEQ ID NO: 5451 - DNA, 492 bp, Sorghum bicolor; identical to SEQ ID NO: 35
  misc_feature: Ceres ANNOT ID no. 6043675
  misc_feature: Encodes the peptide sequence at SEQ ID NO 5452

SEQ ID NO: 5452 - protein, 163 aa, Sorghum bicolor; identical to SEQ ID NO: 36
  misc_feature: Ceres ANNOT ID no. 6043675
  misc_feature (49)..(71): Pfam Id: zf-C2H2 Pfam Desc: Zinc finger, C2H2 type
  misc_feature (8)..(153): NCBI GI: 62865694 NCBI Desc: ramosa1 c2h2 zinc-finger transcription factor [sorghum bicolor]
  misc_feature (1)..(163): NCBI GI: 62865696 NCBI Desc: ramosa1 c2h2 zinc-finger transcription factor [miscanthus sinensis]
  misc_feature (1)..(163): NCBI GI: 62865692 NCBI Desc: ramosa1 c2h2 zinc-finger transcription factor [tripsacum dactyloides]
  misc_feature (1)..(163): NCBI GI: 64175646 NCBI Desc: ramosa 1 [zea mays]
  misc_feature (1)..(163): NCBI GI: 64175632 NCBI Desc: ramosa 1 [zea mays]
  misc_feature: The plant is abnormally small.
  misc_feature: The plant produces a reduced number of seeds.
  misc_feature: The sequence is a functional homolog of SEQ ID NO 836 in the 11/435,388US patent application
  misc_feature: Useful for biocontainment applications
  misc_feature: Useful for making plants with modulated biomass
  misc_feature: Useful for making plants with modulated growth and phenotype characteristics
  misc_feature: Functional homolog of the protein sequence given in SEQ ID NO 12998
  misc_feature: Functional homolog of the protein sequence given in SEQ ID NO 13411
  misc_feature: The sequence is a functional homolog of SEQ ID NO 836 in the 20060272060 US patent application
  misc_feature: Functional homolog of the protein sequence given in SEQ ID NO 13581
  misc_feature: The sequence is a functional homolog of SEQ ID NO. 457 in the 11/188,298 US application

SEQ ID NO: 5453 - DNA, 1107 bp, Sorghum bicolor
  misc_feature: Ceres ANNOT ID no. 6043699
  misc_feature: Encodes the peptide sequence at SEQ ID NO 5454
atgagcagcagtcatctttccatttcagcgcccgtcgttatcatcatcgtctctgttgtgctcctgctcaattctcatgtagggtcgtgcagctgctacaagcgaatcttcggcttcggcgacggcaccatggacaccgggaatttcgtgcacatgcttgggaaggcaccgtctaggctcaaggagctcccctacggcaagacgtttttcaagaatgcaaccgggcgcatgtcggatggccgtgtcctcattgatttctatgctgaagcgctccagttgccactgataccaccgattttaccggagaaggactatgggcagtttccatatggtgccaactttgcggtgatgggtgccactgttctagaggcaccattgtacccagggagcagcctctttagtctaggtgtgcaaacggattggtttgatgaaatggtgtaccttagagccactggagatgatgcccggaaacattttctaagagattctgatctcatcctgatgggcgagattggcagcaacgactacttcgcatatttcagtgtcggtaataaacctcacggcaacgcagctgacgaatacattacaaatgtcatgacgtacattatgcatttcgtggaggagcttattctcgataggggtgcgaaagtgtttgtgatccccaacaattttcctgtcgggtgttgggcgtcgtatctgagcaggttccacagcgacaacccagaggactatgatgagcacaagtgccttaggtggttaaacaacttcacccaaaaacacaacgaaaggcttcgttgggaagtcaataggctccgcaacttttacccccatgtgaagctaatttacgctgactactatggcgccaccatggatttcatcaagaatccaagcaaatttggtatagatgatcctgtagtcgcatgctgcgggggcgatggcccataccacaccagcatggagtgcaatagcacggcaaagatttggggtgacccaggccgctttgccaactgggatggcatgcacatgacagagaaggcatacaacatcatcgtgcaaggggtgataaatggaccgttcgctgatcctccgttcccgcagagttgctag

SEQ ID NO: 5454 - protein, 368 aa, Sorghum bicolor
  misc_feature: Ceres ANNOT ID no. 6043699
  misc_feature (36)..(354): Pfam Id: Lipase_GDSL Pfam Desc: GDSL-like Lipase/Acylhydrolase
  misc_feature (2)..(368): NCBI GI: 20146423 NCBI Desc: lipase-like [oryza sativa (japonica cultivar-group)]
  misc_feature (7)..(368): NCBI GI: 10764858 NCBI Desc: f1k23.17 [arabidopsis thaliana]
  misc_feature (1)..(368): NCBI GI: 61971497 NCBI Desc: lipase 2 [brassica napus]
  misc_feature (29)..(368): NCBI GI: 62084739 NCBI Desc: lipase 2 [brassica napus]
  misc_feature (32)..(353): NCBI GI: 54290849 NCBI Desc: lanatoside 15'-o-acetylesterase-like [oryza sativa (japonica cultivar-group)]
MSSSHLSISAPVVIIIVSVVLLLNSHVGSCSCYKRIFGFGDGTMDTGNFVHMLGKAPSRLKELPYGKTFFKNATGRMSDGRVLIDFYAEALQLPLIPPILPEKDYGQFPYGANFAVMGATVLEAPLYPGSSLFSLGVQTDWFDEMVYLRATGDDARKHFLRDSDLILMGEIGSNDYFAYFSVGNKPHGNAADEYITNVMTYIMHFVEELILDRGAKVFVIPNNFPVGCWASYLSRFHSDNPEDYDEHKCLRWLNNFTQKHNERLRWEVNRLRNFYPHVKLIYADYYGATMDFIKNPSKFGIDDPVVACCGGDGPYHTSMECNSTAKIWGDPGRFANWDGMHMTEKAYNIIVQGVINGPFADPPFPQSC

SEQ ID NO: 5455 - DNA, 1107 bp, Sorghum bicolor
  misc_feature: Ceres ANNOT ID no. 6043701
  misc_feature: Encodes the peptide sequence at SEQ ID NO 5456
atgagcagcagtcatctttccatttcagcgcccgccgttatcatcatcgtctctattgtgctcctgctcaattctcatgtagggtcgtgcagctgctacaagcgaatcttcggcttcggcgacggcaccatggacaccggcaatttcgtgcacatgcttgggaaggcaccgtctaggctcaaggagctcccctacggcaagacgtttttcaagaatgcaaccggccgcatgtcggatggtcgtgtcctcattgatttctatgcgcaagcgctccagttgccactgataccaccaattttacccgagaaggactctggacagtttccacatggtgccaactttgcggtgatgggtgccacagctctaggcgcgccgttgtacccagggagcagtctctggtgtctaggtgtgcaaatgggttggtttgatgaaatggtgtaccttagagctactggagatgatgccaggaaacattttctaggcgattctgatctcgtcctcatgggtgagattggcggcaatgactacttcgcatatttcaatgccggtaataaaccgaacggcaacgcagctgacgaacagattacagatgtcctcacatacattatgcatttcgtggaggagcttattctcgatagtggtgcgaaagtgttcgtgatccccaacaattttcctgtcgggtgttgggcgtcgtatctgagcaggttccacagtgacaacccagaggactacgacgagcacaagtgccttagatggttaaacaacttcacccaaaaacacaacgaaaggcttcgttgggaagtcaataggctccgcaacttttacccccatgtgaagctaatttatgctgactactatggcgctgccatggaattcatcaagaatccaggcaaatttggtatagatgatcctatagtcgcatgctgcgggggcgatggcccataccacaccagcatggagtgcaatagcacgacaaagatttggggtgacccaggccgctttgccaactgggatggcatgcacatgacagagaaggcatacaacatcatcgtgcaaggggtgataaatggaccgttcgctgatcctccattcccgcggagttgctag

SEQ ID NO: 5456 - protein, 368 aa, Sorghum bicolor
  misc_feature: Ceres ANNOT ID no. 6043701
  misc_feature (36)..(354): Pfam Id: Lipase_GDSL Pfam Desc: GDSL-like Lipase/Acylhydrolase
  misc_feature (2)..(368): NCBI GI: 20146423 NCBI Desc: lipase-like [oryza sativa (japonica cultivar-group)]
  misc_feature (7)..(368): NCBI GI: 10764858 NCBI Desc: f1k23.17 [arabidopsis thaliana]
  misc_feature (1)..(368): NCBI GI: 61971497 NCBI Desc: lipase 2 [brassica napus]
  misc_feature (29)..(368): NCBI GI: 62084739 NCBI Desc: lipase 2 [brassica napus]
  misc_feature (32)..(353): NCBI GI: 54290849 NCBI Desc: lanatoside 15'-o-acetylesterase-like [oryza sativa (japonica cultivar-group)]
MSSSHLSISAPAVIIIVSIVLLLNSHVGSCSCYKRIFGFGDGTMDTGNFVHMLGKAPSRLKELPYGKTFFKNATGRMSDGRVLIDFYAQALQLPLIPPILPEKDSGQFPHGANFAVMGATALGAPLYPGSSLWCLGVQMGWFDEMVYLRATGDDARKHFLGDSDLVLMGEIGGNDYFAYFNAGNKPNGNAADEQITDVLTYIMHFVEELILDSGAKVFVIPNNFPVGCWASYLSRFHSDNPEDYDEHKCLRWLNNFTQKHNERLRWEVNRLRNFYPHVKLIYADYYGAAMEFIKNPGKFGIDDPIVACCGGDGPYHTSMECNSTTKIWGDPGRFANWDGMHMTEKAYNIIVQGVINGPFADPPFPRSC

SEQ ID NO: 5457 - DNA, 1155 bp, Sorghum bicolor
  misc_feature: Ceres ANNOT ID no. 6043714
  misc_feature: Encodes the peptide sequence at SEQ ID NO 5458
atgtcgagcctcgaggagccactcggtctcggagacctgcccaagttgagtattaacagactcgggaggttcttgtcgccgacagctcgcaggtcatcaccgtccgatgaccacagcactggaaaatacagcaactcctgcaatggtagccccttccatggcaattcctatccctggcatccgcaatgccgtcaggccgattcgtcatgtgatgcggtggagcttagagatcttcctcggaaggttatgtgggaactgccaaggtttgtgaagatagttgaggttggaccacgggatggcctgcaaaatgaaaagggcaatgttccaacatccgtaaagatccaactgatacacaagttagtcggtgcaggtctgtcagttgttgaagccacaagttttgtatccccaaaatgggtgccgcagctagctgatgcaaaggaggtcctcaaaggtatccagcaggagccaggcgtacggtatccggtgttaacccctaacctcagaggatttgaggctgctattgcagctggtgcaaaagaaattgcggtttttgcatcggcctctgaatccttctctaagtcgaacattaactgtaccattgaggaaagccttgttcggtaccgtggtgttacagcggctgccaagaaacatggactaactatccgggggtatgtttcatgcgtgattggttgccctgttgaaggcacaattaatccgccgaaggtcgcatatgtagctaaggagctttataacatgggctgctcggagatctcacttggcgacacaactggtgttgggacaccgggtagcgtggttgctatgcttcaagctgtcatggcgtttgttccagtagacaagattgctgttcattttcatgatacatatgggcaagcccttgccaacatcctagtctcccttcaaatggggatcaacgtagtggactcatcagtgtcaggccttggaggttgtccatatgcaaagggcgccactggcaatgttgccacagaggatgttgtgtacatgctccatggcctaggtatagagaccaacgtcgacctcaacaagctcatggaggctggtgattacatttccaaggaattgggaaggccactgggttccaagactgcgactgctctgcgcaagctaactacctga

SEQ ID NO: 5458 - protein, 384 aa, Sorghum bicolor
  misc_feature: Ceres ANNOT ID no. 6043714
  misc_feature (98)..(369): Pfam Id: HMGL-like Pfam Desc: HMGL-like
  misc_feature (42)..(384): NCBI GI: 124360527 NCBI Desc: pyruvate carboxyltransferase [medicago truncatula]
  misc_feature (53)..(384): NCBI GI: 115435876 NCBI Desc: os01g0269000 [oryza sativa (japonica cultivar-group)]
  misc_feature (86)..(382): NCBI GI: 41055014 NCBI Desc: similar to 3-hydroxymethyl-3-methylglutaryl-coenzyme a lyase (hydroxymethylglutaricaciduria) [danio rerio]
  misc_feature (90)..(382): NCBI GI: 19526275 NCBI Desc: hydroxymethylglutaryl-coa lyase [takifugu rubripes]
  misc_feature (75)..(382): NCBI GI: 13242293 NCBI Desc: 3-hydroxy-3-methylglutaryl coa lyase [rattus norvegicus]
  misc_feature (75)..(382): SWISSPROT Homolog: EC 4.1.3.4 Hydroxymethylglutaryl-CoA lyase, mitochondrial precursor
MSSLEEPLGLGDLPKLSINRLGRFLSPTARRSSPSDDHSTGKYSNSCNGSPFHGNSYPWHPQCRQADSSCDAVELRDLPRKVMWELPRFVKIVEVGPRDGLQNEKGNVPTSVKIQLIHKLVGAGLSVVEATSFVSPKWVPQLADAKEVLKGIQQEPGVRYPVLTPNLRGFEAAIAAGAKEIAVFASASESFSKSNINCTIEESLVRYRGVTAAAKKHGLTIRGYVSCVIGCPVEGTINPPKVAYVAKELYNMGCSEISLGDTTGVGTPGSVVAMLQAVMAFVPVDKIAVHFHDTYGQALANILVSLQMGINVVDSSVSGLGGCPYAKGATGNVATEDVVYMLHGLGIETNVDLNKLMEAGDYISKELGRPLGSKTATALRKLTT

SEQ ID NO: 5459 - DNA, 1065 bp, Sorghum bicolor
  misc_feature: Ceres ANNOT ID no. 6043722
  misc_feature: Encodes the peptide sequence at SEQ ID NO 5460
atgccgcacctcgtccgcgagcggctctacttcggcgacatcaaagacgccatcgccgccctcacggagtcgtcccccacgccgcacttcacccacgtcctctccgtggtcagctccgcctccatctccttcatcaccgactgccgcccaggcccctcgattcccaccgaggaggtccgccgcgtcgtcgccggcgagaagggcgcgccgccgaccgcagccgtggcccccgggacgctgatgcgggtggtggagcgcgcgggccaggggctgcgggtcacgcgcatggccgtgccgctgcgggacaccgaggaggaggacctgctcgaccgcctcgagccctgccttgatttcatcgatgagggcaggaaggtcgggaatgtgctcgtacattgctttgctggggtgtcgaggagtgcttccatcattgttgcttaccttatgagatcagaacagaaatctcttgaagatgcattagaagctttgaaggagatttcagagtcggcatgcccgaacgatggctttcttgaccagctgaaattatttgaagaaatgggcttcaaagttgacacttcaagtcctttgtacaagaaattccgcttaaaagtgttaggtcaatcctacaaatttggggagaaaataagcagctatatgtttgaagatgaccctggcctttctccacagtctggctcttgtcaagattcttcaaaggttgagcaacgtaaaacagcttaccgctgcaggaaatgcaggagagttattgctgtagaggacaatgttgtaagtcatgttcctggtgagggtgaatcttgctttgattggaaccgaaggaagagtggtcatccatacaacaacaaagaacaagattgctcatctttgttcgttgaacctctgaaatggatgactccagtagaagacggtgctttggaaggaaagctatcatgcatccactgcggagctcggttgggatacttcaactgggcaggaatacagtgcaactgtggcagctgggttactcctgccttccaaattgttaagagcaaagttgatatcagcaccatctag

SEQ ID NO: 5460 - protein, 354 aa, Sorghum bicolor
  misc_feature: Ceres ANNOT ID no. 6043722
  misc_feature (58)..(185): Pfam Id: DSPc Pfam Desc: Dual specificity phosphatase, catalytic domain
  misc_feature (1)..(354): NCBI GI: 87241169 NCBI Desc: dual specificity protein phosphatase [medicago truncatula]
  misc_feature (86)..(350): NCBI GI: 60656185 NCBI Desc: dual specificity phosphatase 12 [synthetic construct]
  misc_feature (86)..(350): NCBI GI: 30582105 NCBI Desc: dual specificity phosphatase 12 [homo sapiens]
  misc_feature (86)..(350): NCBI GI: 119611098 NCBI Desc: dual specificity phosphatase 12 [homo sapiens]
  misc_feature (87)..(354): NCBI GI: 11560052 NCBI Desc: glucokinase-associated dual specificity phosphatase [rattus norvegicus]
  misc_feature: The plant is abnormally small.
  misc_feature: Useful for making plants with modulated biomass
  misc_feature: GREAT-hit functional homolog of the protein sequence given in SEQ ID NO 13059
  misc_feature: Useful for making plants with modulated biomass
  misc_feature: Functional homolog of the protein sequence given in SEQ ID NO 13059
MPHLVRERLYFGDIKDAIAALTESSPTPHFTHVLSVVSSASISFITDCRPGPSIPTEEVRRVVAGEKGAPPTAAVAPGTLMRVVERAGQGLRVTRMAVPLRDTEEEDLLDRLEPCLDFIDEGRKVGNVLVHCFAGVSRSASIIVAYLMRSEQKSLEDALEALKEISESACPNDGFLDQLKLFEEMGFKVDTSSPLYKKFRLKVLGQSYKFGEKISSYMFEDDPGLSPQSGSCQDSSKVEQRKTAYRCRKCRRVIAVEDNVVSHVPGEGESCFDWNRRKSGHPYNNKEQDCSSLFVEPLKWMTPVEDGALEGKLSCIHCGARLGYFNWAGIQCNCGSWVTPAFQIVKSKVDISTI

SEQ ID NO: 5461 - DNA, 1410 bp, Sorghum bicolor
  misc_feature: Ceres ANNOT ID no. 6043723
  misc_feature: Encodes the peptide sequence at SEQ ID NO 5462
atggagaccagcggtgcggccgccgtcgccgccaccgaggtgggctggtacgtgctcggcccgaaccaggagagcgtcggaccctacgcgctcgctgagcttcaagaacattttgcaaacggttatctcaatgagagcacgatgctctgggcagaagggaggaaggaatggatgccactctcgtccatccctgagttacaatctgcagtcacatcaaaggatcaatctaaacaagatgctccagatgttgatgatgattttgagaaatttcagaaggaggttaccgaagccgaggcagatgtggaccagcaagatgatgagcggccagcaaccccgccggatggggaggaagaatttactgatgatgatggcaccatttacaaatgggaccgtactttgagggcatgggttcctcaaaatgatgcatctggtagcaaggaaaattatgctgttgaagagatgacttttgcacttgaggaagaagtatttcaggcaccagatatcctgggtccttctgcactagaagaaatcaacactctatctgaaagcaaaaacaagggatcagataaagcagaaacaagaggagacaagaagcggaaatcttctgagaagccagctgagaaaaaggaagctaacaaacctccagaaagttggtttgatctcaaagtcaacacacatgtctatgtaactggtttgcctgatgatgtcacggctgaggagattgtggaggtattttccaagtgtggaataataaaggaggacccagagactaaaaagccacgggtgaagatctatactgataaggaaaccggcaggaagaagggtgatgcgttggtgacatatttcaaggagccttctgtagctttagcggttcaattgttggatgggacatcattccgtcctggtgttaagattcctatgtctgtaagtccagccaaatttgagcagaaaggtgatgttttcatttcaaagaaaactgacaagcaaaagaaaaggaagatcaaaaaggtcgaagacaaaatgcttggatggggtgggcatgatgataagaagctgatgattcctactacagtaattttacggcacatgttcactcctgcagaattgagagctgatgaagagcttctttctgagcttgagactgatgttagagaggaatgcatcaagttcggtccagtggataatgtcaaggtttgtgaaaatcatccacaaggtgttgtattggtgaaattcaaagataggaaagatgctgccaaatgcatagagaagatgaatggcagatggtttgctgggcggcaaatccatgcgagcgaagatgatggctctgttaaccatactcttatccgtgactacgatgcagaggtgtcaagactggatcggtttggagaagagttagaagagtcaacatag

SEQ ID NO: 5462 - protein, 469 aa, Sorghum bicolor
  misc_feature: Ceres ANNOT ID no. 6043723
  misc_feature (227)..(307): Pfam Id: RRM_1 Pfam Desc: RNA recognition motif. (a.k.a. RRM, RBD, or RNP domain)
  misc_feature (380)..(436): Pfam Id: RRM_1 Pfam Desc: RNA recognition motif. (a.k.a. RRM, RBD, or RNP domain)
  misc_feature (103)..(460): NCBI GI: 33417205 NCBI Desc: similar to hiv tat specific factor 1 [danio rerio]
  misc_feature (50)..(466): NCBI GI: 70569833 NCBI Desc: ci-htatsf1 [ciona intestinalis]
  misc_feature (114)..(460): NCBI GI: 37590291 NCBI Desc: loc398736 protein [xenopus laevis]
  misc_feature (114)..(460): NCBI GI: 54038341 NCBI Desc: loc398736 protein [xenopus laevis]
  misc_feature (146)..(466): NCBI GI: 89309113 NCBI Desc: rna binding domain protein [tetrahymena thermophila sb210]
  misc_feature: Useful for making plants with altered terpenoid content
  misc_feature: GREAT-hit functional homolog of the protein sequence given in SEQ ID NO 13098
  misc_feature: Useful for making plants with altered terpenoid content
  misc_feature: Functional homolog of the protein sequence given in SEQ ID NO 13098
METSGAAAVAATEVGWYVLGPNQESVGPYALAELQEHFANGYLNESTMLWAEGRKEWMPLSSIPELQSAVTSKDQSKQDAPDVDDDFEKFQKEVTEAEADVDQQDDERPATPPDGEEEFTDDDGTIYKWDRTLRAWVPQNDASGSKENYAVEEMTFALEEEVFQAPDILGPSALEEINTLSESKNKGSDKAETRGDKKRKSSEKPAEKKEANKPPESWFDLKVNTHVYVTGLPDDVTAEEIVEVFSKCGIIKEDPETKKPRVKIYTDKETGRKKGDALVTYFKEPSVALAVQLLDGTSFRPGVKIPMSVSPAKFEQKGDVFISKKTDKQKKRKIKKVEDKMLGWGGHDDKKLMIPTTVILRHMFTPAELRADEELLSELETDVREECIKFGPVDNVKVCENHPQGVVLVKFKDRKDAAKCIEKMNGRWFAGRQIHASEDDGSVNHTLIRDYDAEVSRLDRFGEELEEST

SEQ ID NO: 5463 - DNA, 831 bp, Sorghum bicolor
  misc_feature: Ceres ANNOT ID no. 6043727
  misc_feature: Encodes the peptide sequence at SEQ ID NO 5464
atgacggcggaggggaagagcggggtgcggcggtggctcgtcgacatcagcagctggcgcccctcctccgcccagttcgacgctgcagccgccctcctgccgccgcacgagcgccccgccatctccaggttcgtgaaagaggacgacaggaagcgggcgctcgtcagtcgtctgctgcagtactcgctcgtgcaccatcttctccacatcccgttccaccagatcaacatatgccgcacagccgaggggaaaccgtacctaaagaataattgttcagacttcccgaacttcaacttcagcacctcgcaccagggagactatgtcggcattgcatcagaacagctttaccttgttggccttgatattgtatctgtttccgagccccatggagaaaccgccaccgagtttgtcagcaacttctcgtcgtacctcactgaccatgagtggaactgcatcgttggtgctggcactcccagggatgtgctgacagagttctacaggtattggtgtctcaaagaagcatttgtcaaagccgtaggtgctggcattgggtttgggttgcgtcgacttgaattccaccatgaagactggactaacatttccatttgtattgatggtgaagtgtctaagaaatggagattctggcttttcaaacttgatgaaacacacttggcatctatagcaaaagggcatccagaggatggtataaacagcttcaagaaaacattgtccaatgtgattattgcagagaaacagttatcttctgcactatatagtccagaagaagcttttactttgcgtacagtggaacagcttacacaatcatcatag

SEQ ID NO: 5464 - protein, 276 aa, Sorghum bicolor
  misc_feature: Ceres ANNOT ID no. 6043727
  misc_feature (118)..(188): Pfam Id: ACPS Pfam Desc: 4'-phosphopantetheinyl transferase superfamily
  misc_feature (11)..(274): NCBI GI: 115484057 NCBI Desc: os11g0136500 [oryza sativa (japonica cultivar-group)]
  misc_feature (8)..(235): NCBI GI: 81170356 NCBI Desc: l-aminoadipate-semialdehyde dehydrogenase-phosphopantetheinyl transferase (4'-phosphopantetheinyl transferase) (alpha-aminoadipic
  misc_feature (8)..(235): NCBI GI: 81170356 (continued) semialdehyde dehydrogenase-phosphopantetheinyl transferase) (aasd-ppt) (lys5 ortholog)
  misc_feature (8)..(235): NCBI GI: 9295190 NCBI Desc: hah-p [homo sapiens]
  misc_feature (8)..(235): NCBI GI: 82408245 NCBI Desc: chain a, structure of aminoadipate-semialdehyde dehydrogenase- phosphopantetheinyl transferase in complex with coenzyme a
  misc_feature (8)..(235): NCBI GI: 93279131 NCBI Desc: chain a, structure of aminoadipate-semialdehyde dehydrogenase- phosphopantetheinyl transferase in complex with cytosolic acyl carrier protein and coenzyme a
MTAEGKSGVRRWLVDISSWRPSSAQFDAAAALLPPHERPAISRFVKEDDRKRALVSRLLQYSLVHHLLHIPFHQINICRTAEGKPYLKNNCSDFPNFNFSTSHQGDYVGIASEQLYLVGLDIVSVSEPHGETATEFVSNFSSYLTDHEWNCIVGAGTPRDVLTEFYRYWCLKEAFVKAVGAGIGFGLRRLEFHHEDWTNISICIDGEVSKKWRFWLFKLDETHLASIAKGHPEDGINSFKKTLSNVIIAEKQLSSALYSPEEAFTLRTVEQLTQSS

SEQ ID NO: 5465 - DNA, 1425 bp, Sorghum bicolor
  misc_feature: Ceres ANNOT ID no. 6043731
  misc_feature: Encodes the peptide sequence at SEQ ID NO 5466
atggagagcggcgtcacgtcgccattgctgccgcaggaggagaaggtgtaccaccggggctgccctggctgtgcaaacgaccggaggaaggagctccaggagggcttgccgtacaaggagttcttgtacgtctggatcatctgcctcgccacttctctaccggtgtcatcattattccccttcttgtatttcatgataagagacttgcatgttgcaaaaagaacagaagacattggattctatgccggatttgtgggtgcttcatttatgcttggtagatgcttgacttcaactgtgtggggaatagcagcagatcgggtcatattcaatactttatttggtcttagtactaattattggatggcaatagctacaagatttctccttggtgctttaaatggtttgcttgggccaattaaggcttactctatcgaagtttgcagacctgaacatgaagcattgggaatatcacttgtcggcacagcttggggaataggtctgatcattgggcctgctttaggaggctaccttgcactgcctgcagaaaaatttccaaaagtattttcgcctgactcattcttcgggaggttcccgtactttttgccatgcttatgcacctcactctttgctactgttgttcttgtgagctgcatatggatgccggagacattacacaagcacaaagttcaccagaatgaaagtaaaaatgatgaagctttggaggcccaccagagtgactacaaagagaaggatgaacaaatttcaagtttggatggcaagaagagtttattcaagaattggccctttatgtcatccttaattacttattgtatattttcctttcatgatatggcttattcagaggtgttctctttatggactgaaagtgataagaagtatggtgggctcagtttatcgtctgaggctgtaggtcaagtgctctcaattacaggtgtcagtcttcttatatatcaactcactgtatatcctcgtactaataaaattcttggacctatcaagacgtctcgagttgcagctactctgtgcatacttattctctttgggtatccctacatgacatatctgtcaggaactggactatccatcattttgaatattgcatcgatcttgaaaatcaatcttgctgctaccatcatttcgagcagtttcatccttcagaataatgctgtgcctcaagaccaaagaggagctgcaaatggactgtcagtcacagtaatgtccctattcaaggcaattgctcctgcaattgcaggcactgtgttttcttgggcacaagcacggcagcatactttcttctttccaggtgatcagatggtgttttttcttctgaatgtcatcgagtttcttggaattatgctcacattcaagcccttcatggccgcaccagagtccagagcagcataa

SEQ ID NO: 5466 - protein, 474 aa, Sorghum bicolor
  misc_feature: Ceres ANNOT ID no. 6043731
  misc_feature (44)..(421): Pfam Id: MFS_1 Pfam Desc: Major Facilitator Superfamily
  misc_feature (2)..(470): NCBI GI: 77548534 NCBI Desc: major facilitator superfamily protein [oryza sativa (japonica cultivar-group)]
  misc_feature (22)..(470): NCBI GI: 115487198 NCBI Desc: os12g0133100 [oryza sativa (japonica cultivar-group)]
  misc_feature (11)..(470): NCBI GI: 23452823 NCBI Desc: major facilitator superfamily antiporter [oryza sativa (japonica cultivar-group)]
  misc_feature (7)..(469): NCBI GI: 77548523 NCBI Desc: major facilitator superfamily [oryza sativa (japonica cultivar-group)]
  misc_feature (139)..(469): NCBI GI: 115484055 NCBI Desc: os11g0136400 [oryza sativa (japonica cultivar-group)]
  misc_feature: The plant flowers significantly late compared to wild-type.
  misc_feature: Useful for making plants with modulated flowering time
  misc_feature: Functional homolog of the protein sequence given in SEQ ID NO 12969
  misc_feature: Useful for making plants with modulated flowering time
  misc_feature: Functional homolog of the protein sequence given in SEQ ID NO 12969
MESGVTSPLLPQEEKVYHRGCPGCANDRRKELQEGLPYKEFLYVWIICLATSLPVSSLFPFLYFMIRDLHVAKRTEDIGFYAGFVGASFMLGRCLTSTVWGIAADRVIFNTLFGLSTNYWMAIATRFLLGALNGLLGPIKAYSIEVCRPEHEALGISLVGTAWGIGLIIGPALGGYLALPAEKFPKVFSPDSFFGRFPYFLPCLCTSLFATVVLVSCIWMPETLHKHKVHQNESKNDEALEAHQSDYKEKDEQISSLDGKKSLFKNWPFMSSLITYCIFSFHDMAYSEVFSLWTESDKKYGGLSLSSEAVGQVLSITGVSLLIYQLTVYPRTNKILGPIKTSRVAATLCILILFGYPYMTYLSGTGLSIILNIASILKINLAATIISSSFILQNNAVPQDQRGAANGLSVTVMSLFKAIAPAIAGTVFSWAQARQHTFFFPGDQMVFFLLNVIEFLGIMLTFKPFMAAPESRAA

SEQ ID NO: 5467 - DNA, 1572 bp, Sorghum bicolor
  misc_feature: Ceres ANNOT ID no. 6043733
  misc_feature: Encodes the peptide sequence at SEQ ID NO 5468
atgggtcggggcgactcggcggcggcggagcagcaggcgtcgtcgacggcgccgttgctggagaagacgtcgtcggccgcggcggaggagtcggaggcggcgtcggcgccggcggaggctggcggcgggtactactactactactacgtggacgggtgccccgggtgcgccgtggagcggcacaaggcggcgaacccggggatcccctacgccaacttcatctacgtctggatcgtcaccctctgcacagctttaccgatatcatcgctgtttcccttcttgtattttatgataagagatctggggattgctaaaagaacagaagatatcgggttctacgctggtttcgtaggtgcctcatttatgtttggtagatgcttgacttcgacagcctggggaatagcggcagaccgtattgggaggaaacctgttgtcatgtttggcatttcctctgtggttgtgttcaatacattgtttggtctgagtgtcaactattggatggcaataactacgcgatttctgcttggtgctttaaatggtttacttggaccaataaaggcttatgccattgaagtttgccgacctgaacatgaagcgttagcactatcacttgtcagcacagcatggggaataggtctcattattggtcctgctcttggaggttatcttgcactgcctgcagaaaattttccaactgtcttttcaactgactcaatctttggaaggttcccatatttcttaccatgcttatgcacgtcaatctttgctgctgttgttctcataagctgcatatggatgccggagactttgcacaagcacaaagttcatgaaaatagaagtcagaacattgaagctttggaggcccatctgattgattcaaaagaaaaggttgaagaaagtggtagtttagatactaagaagagcctattcaggaattggccattgatgtcatcaataattgtctattgcatcttctccttccatgacatggcttacacagaggtgttctctctatgggctgaaagtgacaagaagtatggtggactgagtttatcatctgaggatgttggtcaagttcttgcaatcacaggtgccagtcttcttgtatatcaactctttctatatcctagtatcaataaggttcttgggcctatcaaatcttctcgaattgcagctatcctgtgcatacctatcctctttgcctacccctacatgacatacctgtcagaccctggattatcaatcattttgaatattgcgtcagtgataaagaataatcttgctattcaagttaccatcattacaggcactttcatccttcaaaataatgctgtgcctcaggaccaaagaggagctgcaaatggactgtccatgacagggatgtcctttttcaaggcacttgctccagcaggagctggcattgtgttctcatgggcacagaaacgccagcatgccttcttcttcccaggtgatcagatggtattcttcctcctgaacgttgtcgagctggttgggcttctcctcacattcaaaccctttctggaagtaccagagcaatttgagagcagataa

SEQ ID NO: 5468 - protein, 523 aa, Sorghum bicolor
  misc_feature: Ceres ANNOT ID no. 6043733
  misc_feature (76)..(469): Pfam Id: MFS_1 Pfam Desc: Major Facilitator Superfamily
  misc_feature (54)..(522): NCBI GI: 115487198 NCBI Desc: os12g0133100 [oryza sativa (japonica cultivar-group)]
  misc_feature (29)..(522): NCBI GI: 77548534 NCBI Desc: major facilitator superfamily protein [oryza sativa (japonica cultivar-group)]
  misc_feature (49)..(521): NCBI GI: 23452823 NCBI Desc: major facilitator superfamily antiporter [oryza sativa (japonica cultivar-group)]
  misc_feature (49)..(517): NCBI GI: 77548523 NCBI Desc: major facilitator superfamily [oryza sativa (japonica cultivar-group)]
  misc_feature (51)..(519): NCBI GI: 20857393 NCBI Desc: at5g13750/mxe10_2 [arabidopsis thaliana]
  misc_feature: The plant flowers significantly late compared to wild-type.
  misc_feature: Useful for making plants with modulated flowering time
  misc_feature: GREAT-hit functional homolog of the protein sequence given in SEQ ID NO 12969
  misc_feature: Useful for making plants with modulated flowering time
  misc_feature: Functional homolog of the protein sequence given in SEQ ID NO 12969
MGRGDSAAAEQQASSTAPLLEKTSSAAAEESEAASAPAEAGGGYYYYYYVDGCPGCAVERHKAANPGIPYANFIYVWIVTLCTALPISSLFPFLYFMIRDLGIAKRTEDIGFYAGFVGASFMFGRCLTSTAWGIAADRIGRKPVVMFGISSVVVFNTLFGLSVNYWMAITTRFLLGALNGLLGPIKAYAIEVCRPEHEALALSLVSTAWGIGLIIGPALGGYLALPAENFPTVFSTDSIFGRFPYFLPCLCTSIFAAVVLISCIWMPETLHKHKVHENRSQNIEALEAHLIDSKEKVEESGSLDTKKSLFRNWPLMSSIIVYCIFSFHDMAYTEVFSLWAESDKKYGGLSLSSEDVGQVLAITGASLLVYQLFLYPSINKVLGPIKSSRIAAILCIPILFAYPYMTYLSDPGLSIILNIASVIKNNLAIQVTIITGTFILQNNAVPQDQRGAANGLSMTGMSFFKALAPAGAGIVFSWAQKRQHAFFFPGDQMVFFLLNVVELVGLLLTFKPFLEVPEQFESR

SEQ ID NO: 5469 - DNA, 543 bp, Sorghum bicolor
  misc_feature: Ceres ANNOT ID no. 6043739
  misc_feature: Encodes the peptide sequence at SEQ ID NO 5470
atggaggaggtggagcagacgctgaccaagaaacagatcgaggagttccgggaggcgttcagcctcttcgacaaagatggcgacgggacgatcacgaccaaggagctgggcacggtgatgcggtcgctggggcagagcccgacggaggaggagctgcaggggatggtggacgaggtggacgcggacggcagcggcgccatcgacttccaggagttcctcaccctgctggcgcgccagatgcaggaggccagcggcgccgacgaggacgagctccgggaggccttccgcgtgttcgaccaggaccagaacggcttcatctcccgcgacgagctccgccacgtcctccagaacctcggcgagaaactctccgacgaggagctcgccgagatgctccgtgaggccgacgccgacggcgacgggcagatcaactacaacgagttcaccaaggtcatgctcgccaaacgaaggaaccaggagctggaagaccatgggagtgagtcaagtcactccaagagactctgcccctcctgtacaatcctctga

SEQ ID NO: 5470 - protein, 180 aa, Sorghum bicolor
  misc_feature: Ceres ANNOT ID no. 6043739
  misc_feature (15)..(43): Pfam Id: efhand Pfam Desc: EF hand
  misc_feature (51)..(79): Pfam Id: efhand Pfam Desc: EF hand
  misc_feature (90)..(118): Pfam Id: efhand Pfam Desc: EF hand
  misc_feature (126)..(154): Pfam Id: efhand Pfam Desc: EF hand
  misc_feature (8)..(162): NCBI GI: 115492 NCBI Desc: calmodulin-related protein
  misc_feature (8)..(160): NCBI GI: 30683369 NCBI Desc: calmodulin-2/3/5 (cam5) (tch1) [arabidopsis thaliana]
  misc_feature (8)..(154): NCBI GI: 8131969 NCBI Desc: calmodulin [brassica napus]
  misc_feature (8)..(154): NCBI GI: 60650570 NCBI Desc: calmodulin [aegiceras corniculatum]
  misc_feature (8)..(154): NCBI GI: 110532561 NCBI Desc: calmodulin [aegiceras corniculatum]
MEEVEQTLTKKQIEEFREAFSLFDKDGDGTITTKELGTVMRSLGQSPTEEELQGMVDEVDADGSGAIDFQEFLTLLARQMQEASGADEDELREAFRVFDQDQNGFISRDELRHVLQNLGEKLSDEELAEMLREADADGDGQINYNEFTKVMLAKRRNQELEDHGSESSHSKRLCPSCTIL

SEQ ID NO: 5471 - DNA, 588 bp, Sorghum bicolor
  misc_feature: Ceres ANNOT ID no. 6043760
  misc_feature: Encodes the peptide sequence at SEQ ID NO 5472
atggccatggcagcaaccccaaccgcgactgccagcatcttgctcttggctctcttcctcgccggcgctcacgcggagccggccgagctcccatgcgcgctccccgcgtgcaagacggtgggcggcggcagccagttcttcgacgtgcagttctgcttggcggcactcggctccgacggccggagcatcagccactgcatggactaccaggtctactccgtcatcgctgccgacctcctcgcagccaacgtcaccgccacggcggccaagatcgacggcctgctccaggggagcggcggcggcggcggcggagacgacgccgccgccacggcgcgctgcctccggtcgtgccaggcgctgtacggcggcacggtgcggaggcagcccggctgcgcggccgccgtcaggggcgtcaggaagggcgaggccacgacgtgcctggaggaagccgccgccgcggccaagcagtgcgaggacgggttccagagcagcaaggtggcgtcgccggtgacggcggagaaccagaacgcgttcatgctcgccaagctcgccgtcgcgctgctccgcgaggtctatgctaataaatga

SEQ ID NO: 5472 - protein, 195 aa, Sorghum bicolor
  misc_feature: Ceres ANNOT ID no. 6043760
  misc_feature (12)..(187): NCBI GI: 83722842 NCBI Desc: pme/invertase inhibitor-like protein [musa acuminata]
  misc_feature (14)..(194): NCBI GI: 1616628 NCBI Desc: sts15 [solanum tuberosum]
  misc_feature (14)..(185): NCBI GI: 115443647 NCBI Desc: os02g0103300 [oryza sativa (japonica cultivar-group)]
MAMAATPTATASILLLALFLAGAHAEPAELPCALPACKTVGGGSQFFDVQFCLAALGSDGRSISHCMDYQVYSVIAADLLAANVTATAAKIDGLLQGSGGGGGGDDAAATARCLRSCQALYGGTVRRQPGCAAAVRGVRKGEATTCLEEAAAAAKQCEDGFQSSKVASPVTAENQNAFMLAKLAVALLREVYANK

SEQ ID NO: 5473 - DNA, 1944 bp, Sorghum bicolor
  misc_feature: Ceres ANNOT ID no. 6043761
  misc_feature: Encodes the peptide sequence at SEQ ID NO 5474
atgggtaccggcaaggacgcagcccctcgcgccatcctctgcttcttgtttctgttctgcttaggctgcaaatgcctggcatcagagttggaggccacccagacggcgaccctcacggtcgatgcctcgccgcagcttgctcggaagatccctgatacactatttgggatcttctttgaggagatcaaccatgcaggagctggtggcatatgggctgaacttgttagtaacagagggtttgaagctggaggcctccatactccatcaaacattgacccatggtccatcattggagatgactcttctatatatgtggagactgatcggacatcatgtttcagtcgaaacatcattgctctgaggatggaggtcctttgcgataactgtcctactggtggtgttggtatttacaacccagggttctggggcatgaacatagaagatggaaaggcctacaatcttgttatgtatgttaagtcaccagaaacaaccgacttgatagtttcactaacaagctctgatgggttgcaaaatctggcttcagctacaataacagtttccggcgaatcaaattggacaaaagtggagcaaaagttggttgctaaaggaaccaatagaacctcaaggcttcaaataacaactaacaagaaaggagttgtttggtttgatcaagtatcactcatgcctgaagacacatacaagggacatggctttcgcacagaacttatatccatgattttggatttaaaaccacgattcttgagatttcctggaggttgctttgtagaaggtgagtggttaagaaatgcctttaggtggagagaatctattggtccatgggaagagagacctggacacttcggggatgtttggcattactggactgatgatggccttggatactatgaatttcttcagaaagttccctcttgtaactcaggagtcagccacaatgatgaagttgatactgctgctattgctccttttgtaaaggatgtattggacagcatagaatttgcaagggggagtgcaaattcaacatggggctctgttagggctgcaatggggcaccctgaaccattcccagtgaaatatgttgcgattggaaatgaagattgtgggaaaaaattttaccgcggtaactacctgaagttctacaatgctataagacaggcctacccagacattcaaatgatttcaaactgcgatggttcatctacaccacttgatcatcctgctgatttgtacgacttccatgtctatactgattctaagactttgttcaacatgaagagtacatttgacagaacatctcgcagtggacccaaggcttttgtgagtgagtacgctgtttggagaggtgatgcaggtagaggaagtcttcttgcttcattggcagaagctgctttccttactggactggagaagaatagtgacattgtttacatggcgagttatgcaccactgttcgtaaataacaatgaccaaacgtggaacccagacgctatcgtcttcaactcctggcagcattacggcactcctagttactggatgcagacgcttttccgtgagtctagtggtgctatgttacatccaactacaatcagctccagctactctggttcgctcgcagcgtctgcgattacctggcaggactcagagaacagcttccttagagtcataaactttgggtcagatgctgtgaccctgacaatctccacgactggactccaggccagtatcaacgctctgggatcaaccgccactgttctcacatcagcaaacgtgatggatgaaaattccttcagtaacccaaccaaggttgtgccggtgaagagcgatatgagcaatgctgcagagcagatgcaggtcacgttggctcctcactccttcagctcgttcgatctcgccctggctcagtccaaacttgtcgccgagatgtga

SEQ ID NO: 5474 - protein, 647 aa, Sorghum bicolor
  misc_feature: Ceres ANNOT ID no. 6043761
  misc_feature (447)..(630): Pfam Id: Alpha-L-AF_C Pfam Desc: Alpha-L-arabinofuranosidase C-terminus
  misc_feature (72)..(230): Pfam Id: CBM_4_9 Pfam Desc: Carbohydrate binding domain
  misc_feature (1)..(647): NCBI GI: 13398414 NCBI Desc: arabinoxylan arabinofuranohydrolase isoenzyme axah-ii [hordeum vulgare]
  misc_feature (10)..(647): NCBI GI: 13398412 NCBI Desc: arabinoxylan arabinofuranohydrolase isoenzyme axah-i [hordeum vulgare]
  misc_feature (1)..(645): NCBI GI: 116310992 NCBI Desc: osigba0138e08-osigba0161l23.8 [oryza sativa (indica cultivar-group)]
  misc_feature (1)..(645): NCBI GI: 38347003 NCBI Desc: osjnbb0058j09.4 [oryza sativa (japonica cultivar-group)]
  misc_feature (14)..(647): NCBI GI: 77548573 NCBI Desc: arabinoxylan arabinofuranohydrolase isoenzyme axah-ii [oryza sativa (japonica cultivar-group)]
  misc_feature: Useful for making plants with altered cell wall content and/or composition
  misc_feature: GREAT-hit functional homolog of the protein sequence encoded by LOCUS at3g10740
  misc_feature: Functional homolog of the protein sequence encoded by LOCUS at5g26120
  misc_feature: Useful for making plants with altered carbohydrate content
  misc_feature: Functional homolog of the protein sequence given in SEQ ID NO 13917
  misc_feature: Useful for making plants with altered cell wall content and/or composition
  misc_feature: Functional homolog of the protein sequence given in SEQ ID NO 13604
MGTGKDAAPRAILCFLFLFCLGCKCLASELEATQTATLTVDASPQLARKIPDTLFGIFFEEINHAGAGGIWAELVSNRGFEAGGLHTPSNIDPWSIIGDDSSIYVETDRTSCFSRNIIALRMEVLCDNCPTGGVGIYNPGFWGMNIEDGKAYNLVMYVKSPETTDLIVSLTSSDGLQNLASATITVSGESNWTKVEQKLVAKGTNRTSRLQITTNKKGVVWFDQVSLMPEDTYKGHGFRTELISMILDLKPRFLRFPGGCFVEGEWLRNAFRWRESIGPWEERPGHFGDVWHYWTDDGLGYYEFLQKVPSCNSGVSHNDEVDTAAIAPFVKDVLDSIEFARGSANSTWGSVRAAMGHPEPFPVKYVAIGNEDCGKKFYRGNYLKFYNAIRQAYPDIQMISNCDGSSTPLDHPADLYDFHVYTDSKTLFNMKSTFDRTSRSGPKAFVSEYAVWRGDAGRGSLLASLAEAAFLTGLEKNSDIVYMASYAPLFVNNNDQTWNPDAIVFNSWQHYGTPSYWMQTLFRESSGAMLHPTTISSSYSGSLAASAITWQDSENSFLRVINFGSDAVTLTISTTGLQASINALGSTATVLTSANVMDENSFSNPTKVVPVKSDMSNAAEQMQVTLAPHSFSSFDLALAQSKLVAEM

SEQ ID NO: 5475 - DNA, 1071 bp, Sorghum bicolor
  misc_feature: Ceres ANNOT ID no. 6043771
  misc_feature: Encodes the peptide sequence at SEQ ID NO 5476
atggcgccgctatcgtggcggcaccacaccctgctgcaggcgctgctcacgcggggcccgctctcggaccgcgacttccgcgccgtcttcgccgccgtctccggcaagaaacccgctacccatcagcagctgttcaatgatacacttctcaagctcaacaaggagttagcatacctgcagtttgagttgcgagcatgcatgaaccagtatgatggagtggtgtactatggagtagtaaataacattgtcgatgacgaatcaaagctcggaacaaagtattctgtgccacaagttgcatactacaaagggctgttagaagcatttattcaggaagctggaaatgatgggagcataaccagtattgatgctctccatgtgcggcttgacaaccaggtcataattttagatggaggttcacatgacagccaatctcgccttccatcttgcattacggacttcaaactgagccagaaagagaaaactattgatgaactggtatgggatcgatggctatcatacacctccacaggcaagattggtctaggcatcagatcatttcttgatcttcgaggctggttccgtgcgaatgatatcccattgtgcgttgtctgcaatgaagcttgtatcaaggctacaagttgccctaatgagggatgcaacataagaattcatgagtactgtttgaagaagaaattctcccagcgaaaggcttcaagagcctgtcctggctgtggcactgaatggccccgtcaggaaggcgaagtcgatggtgacgatgatgcaaacgagcctggtgaagatggaactgcatcagccaaccgttctttgaggaagagacgcaagggagtgaaagctgaactggtggaggatcgttcttcgaggaagagacgcaagggagtgaaagctgaactggtggaagatattcacaatgcagggccattaacggcggcggttcctaggaggtcgaggagcatgagaagagtgaaagccgaagcagtcgaagccactcaagaggtgttgtctgcagggccttccaaggcggccagagcttccaaaggaaggaagaagtga

SEQ ID NO: 5476 - protein, 356 aa, Sorghum bicolor
  misc_feature: Ceres ANNOT ID no. 6043771
  misc_feature (6)..(189): Pfam Id: SMC_Nse1 Pfam Desc: Nse1 non-SMC component of SMC5-6 complex
  misc_feature (201)..(244): Pfam Id: zf-RING-like Pfam Desc: RING-like domain
  misc_feature (1)..(325): NCBI GI: 115487130 NCBI Desc: os12g0127100 [oryza sativa (japonica cultivar-group)]
  misc_feature (132)..(294): NCBI GI: 37805211 NCBI Desc: mgc68739 protein [xenopus laevis]
  misc_feature (157)..(280): NCBI GI: 39644580 NCBI Desc: non-smc (structural maintenance of chromosomes) element 1 protein [homo sapiens]
  misc_feature (157)..(280): NCBI GI: 122064620 NCBI Desc: non-structural maintenance of chromosomes element 1 homolog (non-smc element 1 homolog)
  misc_feature (157)..(280): NCBI GI: 94721324 NCBI Desc: non-smc element 1 homolog [homo sapiens]
MAPLSWRHHTLLQALLTRGPLSDRDFRAVFAAVSGKKPATHQQLFNDTLLKLNKELAYLQFELRACMNQYDGVVYYGVVNNIVDDESKLGTKYSVPQVAYYKGLLEAFIQEAGNDGSITSIDALHVRLDNQVIILDGGSHDSQSRLPSCITDFKLSQKEKTIDELVWDRWLSYTSTGKIGLGIRSFLDLRGWFRANDIPLCVVCNEACIKATSCPNEGCNIRIHEYCLKKKFSQRKASRACPGCGTEWPRQEGEVDGDDDANEPGEDGTASANRSLRKRRKGVKAELVEDRSSRKRRKGVKAELVEDIHNAGPLTAAVPRRSRSMRRVKAEAVEATQEVLSAGPSKAARASKGRKK

SEQ ID NO: 5477 - DNA, 1128 bp, Sorghum bicolor
  misc_feature: Ceres ANNOT ID no. 6043784
  misc_feature: Encodes the peptide sequence at SEQ ID NO 5478
atggcgctcctcctcctcgtcctgctctgcttcgccggtggcgcgggcgcggccgccgaaccgcctcgctccccggccaccgcgctcttcgttctgggcgactccacggtcggctgcgcggcgacggcgagcggcaggattctgccgctgaacctgaccaccaccgccgccgcgctgccgtcctcgctctcgggcggcccgtgcctcttcttccccgcgtcccggcgccggctcccggacctcctcgcggccaggatgggcctcccatcgccgcccccgatctccgcgctcaacggcaccgcgtccgaagccgcgcggggcgtcaacttcggcggcggcggtgggcagctgttgttctacggcggcggcgagggcgggtcgtcaccgtggtcgtcggtattccgcttgggctccgtcgggcagcaggtccgcctcgcctccgagacgctgcagctgctgcagctcgaggccgccgcgccgggggagggggagtcgtccgccgcggtgttcgtcctgtcgttcggcgccgacgcctacgcgcgcctgctcgcgcgggggaacgccgaggccgacgccgccgcgcccaaagcacggccgccgcgggagctgtacgaggccggcgtgcggagggtggcggtgatgggggtgccgccgctgggttgcgcgccgcgcgtcatgtgggagcagatccccgcccgcgacggcggcggctgcgtggaggaggcgaacgagctcatcgaagcgtacaacggcaggctcgcggcgaggctggacgacctgcggccgctgctgaccggcgccgaccttgtgttctgcgacgtgtacaaggggatgatggagatcatctccaatcccgccacctacggattggaggagacgagggaggcgtgctgcgggctgggccccttgagggccacggtggggtgcgtcagcaaggagatggcgtgcggcacgccggagcgccacgtgtggtgggacctctacacccccacggaggccgccgacgacctcgtcgccaactggtcctggacgtcgtcgtcgtcggactccggcgccggcgccacgagcatctgccgccccatctctctgcagcagctggctgctgggtcgccgccggcggaggtgtag

SEQ ID NO: 5478 - protein, 375 aa, Sorghum bicolor
  misc_feature: Ceres ANNOT ID no. 6043784
  misc_feature (29)..(342): Pfam Id: Lipase_GDSL Pfam Desc: GDSL-like Lipase/Acylhydrolase
  misc_feature (214)..(366): NCBI GI: 115483965 NCBI Desc: os11g0129500 [oryza sativa (japonica cultivar-group)]
  misc_feature (22)..(366): NCBI GI: 18413404 NCBI Desc: gdsl-motif lipase/hydrolase family protein [arabidopsis thaliana]
  misc_feature (22)..(366): NCBI GI: 3513738 NCBI Desc: similar to the gdsl family of lipolytic enzymes [arabidopsis thaliana]
  misc_feature (6)..(367): NCBI GI: 9759340 NCBI Desc: gdsl-motif lipase/acylhydrolase-like protein [arabidopsis thaliana]
  misc_feature (3)..(332): NCBI GI: 15054386 NCBI Desc: family ii lipase exl3 [arabidopsis thaliana]
MALLLLVLLCFAGGAGAAAEPPRSPATALFVLGDSTVGCAATASGRILPLNLTTTAAALPSSLSGGPCLFFPASRRRLPDLLAARMGLPSPPPISALNGTASEAARGVNFGGGGGQLLFYGGGEGGSSPWSSVFRLGSVGQQVRLASETLQLLQLEAAAPGEGESSAAVFVLSFGADAYARLLARGNAEADAAAPKARPPRELYEAGVRRVAVMGVPPLGCAPRVMWEQIPARDGGGCVEEANELIEAYNGRLAARLDDLRPLLTGADLVFCDVYKGMMEIISNPATYGLEETREACCGLGPLRATVGCVSKEMACGTPERHVWWDLYTPTEAADDLVANWSWTSSSSDSGAGATSICRPISLQQLAAGSPPAEV

SEQ ID NO: 5479 - DNA, 1857 bp, Sorghum bicolor
  misc_feature: Ceres ANNOT ID no. 6043786
  misc_feature: Encodes the peptide sequence at SEQ ID NO 5480
atggccaccgccgccaccgcggagcacgagaaggagctcctctcgtcggtagttgacgacatccgctcctactccgggtccgacccgctccgcccgtggctccgggggatgcggaagatggagcgggcgctgccgccggcgacgctgcgggagaagctgcccaggttcatgcagaagtgcgcgcagcagttccaggccgacgcgcgctaccgcgacgacccgcggtacctccgcgtctggatccagctgatggactatgtgacggatgcgaaaccattgctcaagaagatggagcggaatagaataggcctcaagagagcttcattctatatggcttatgctctttattatgagaagcacaggaggttcaatgacgcggagaagatgtattgtttgggaatccagaaccttgcagagcctattggagagttgcaaaaggcacatgaacagtttcttcttcgcatagaatcatacaagaggaggaaagataaactgcaggaaagaatgcctaggaaagctgagtcaagtgctacagtgatgaaccaagttgaaggtgaaagcagaaactgtaaagaactgaaatccaatacaatgcaaaagtcaagaagcaattccaatccctcagtaggttgttatcctccattagggcctgctaaagtgggtatgctatgcagaggcaactcaggagctaaaaagaatttgccccgttgtaatagtgatgatactgtagttgtacggtttgtaggctctgcattggttgggaagtcagaaactgaagatgcctgccatcatggtttagttgaaccaactataaacactaaggaggctatggatgccatcaatagcatgtttttggagccagtggaacctgagacaatgctcaagagacgaccaaaacctaagaaaccaaattatgatcagcaggcaagtgcatttggtatctttgttgatgaagatgaacctagaggtaatccaaatgtgcttcacaacagcagcatgaaccaagaccatcagaaattcggtcagcaaacaggagggtttgtgatctttgttgatgaggatagtcctgatggcaacggccaaaatgtgaggcaaaacaagaactctaagaaggaaaacgtgaagttaaatcaggaaacaagtgcatttgaaatctttgttgatgaaaatgaggctaatggcagtgtccagaatgccacatgccacaggaagaataggtctcctccaagaccattatgtgactcatctaagcatcaaggcgaaagtggcttccagaagccatttgttggaggatttgcaatactgccagatggtgatgaagaacagtgtgagaaaagtgttgacagtatgaatatgaattctagaactgtgcagcctactaatgatcataatactttgctctgtccagttcgagatgattcaggaacaagatatcatgaaggttctcatcctgcgagttctgggcttggagaagacactgtcattcatagatttgttgggtccactattgatgatgagtctaaggtggaaaatgcatgccaccatgggttagtcgatccaactgttaatctaaaggaggctatggatgatataaataatatgtttgggagaccactgatcttcaagggtgacagaacaaagcggaaagtcaatgcactgttagatagaaaaacagctccagcttctggtttctccatattagctgatgatgacctaaaagataaccctaccagcaaagccgatcagaacaactcttgcaaaattgatgctgaggatggtctatttgagcccacaatcaccacccgtgacgtcatggcagagatcaatgatatgtttggaatgccactggatttctaa

SEQ ID NO: 5480 - protein, 618 aa, Sorghum bicolor
  misc_feature: Ceres ANNOT ID no. 6043786
  misc_feature (10)..(134): Pfam Id: Mad3_BUB1_I Pfam Desc: Mad3/BUB1 homology region 1
  misc_feature (8)..(618): NCBI GI: 115483953 NCBI Desc: os11g0128700 [oryza sativa (japonica cultivar-group)]
  misc_feature (17)..(209): NCBI GI: 92870356 NCBI Desc: cellular retinaldehyde-binding/triple function, c-terminal [medicago truncatula]
  misc_feature (20)..(155): NCBI GI: 21619502 NCBI Desc: budding uninhibited by benzimidazoles 1 homolog, beta [mus musculus]
  misc_feature (20)..(155): NCBI GI: 6753212 NCBI Desc: budding uninhibited by benzimidazoles 1 homolog, beta [mus musculus]
  misc_feature (20)..(155): NCBI GI: 123208858 NCBI Desc: budding uninhibited by benzimidazoles 1 homolog, beta (s. cerevisiae) [mus musculus]
MATAATAEHEKELLSSVVDDIRSYSGSDPLRPWLRGMRKMERALPPATLREKLPRFMQKCAQQFQADARYRDDPRYLRVWIQLMDYVTDAKPLLKKMERNRIGLKRASFYMAYALYYEKHRRFNDAEKMYCLGIQNLAEPIGELQKAHEQFLLRIESYKRRKDKLQERMPRKAESSATVMNQVEGESRNCKELKSNTMQKSRSNSNPSVGCYPPLGPAKVGMLCRGNSGAKKNLPRCNSDDTVVVRFVGSALVGKSETEDACHHGLVEPTINTKEAMDAINSMFLEPVEPETMLKRRPKPKKPNYDQQASAFGIFVDEDEPRGNPNVLHNSSMNQDHQKFGQQTGGFVIFVDEDSPDGNGQNVRQNKNSKKENVKLNQETSAFEIFVDENEANGSVQNATCHRKNRSPPRPLCDSSKHQGESGFQKPFVGGFAILPDGDEEQCEKSVDSMNMNSRTVQPTNDHNTLLCPVRDDSGTRYHEGSHPASSGLGEDTVIHRFVGSTIDDESKVENACHHGLVDPTVNLKEAMDDINNMFGRPLIFKGDRTKRKVNALLDRKTAPASGFSILADDDLKDNPTSKADQNNSCKIDAEDGLFEPTITTRDVMAEINDMFGMPLDF

SEQ ID NO: 5481 - DNA, 2181 bp, Sorghum bicolor
  misc_feature: Ceres ANNOT ID no. 6043789
  misc_feature: Encodes the peptide sequence at SEQ ID NO 5482
  misc_feature: Up-regulated in root tissues in response to salicylic acid treatment
  misc_feature: Up-regulated in shoot tissues in response to salicylic acid treatment
atgggcgaagttagtgatgataattccaacatgtcctttctaaaaagaatcgctacaagtgatgtaccgctgttgaaagagtatggtgtgaatggagtcgtcgtcgctctgcttctggctgtagttactcctatcttgctttccatgatgtttggcaagaagacaaagcaaagggcggtgcgagctgatgtgggtggagaggagggatttgccatgcggaacagtaggtttccctccttagttgcagtcccatgggagggcgccaccacaatggcagctctgttcgagatggccagcaaaaagtactctcgacggaggtgtcttggcacaaggaagctaattaagagggaatttatcgaatcttctgatggtaggaagtttgagaaactgcaccttggtgaatatgaatgggatacctacactgaggcatttaaccgcgcatgtaattttgcttctggacttatcaagatgggccatgacctagatagtcatgctgctatattctctgatacaagagctgagtggatcattgctgctcagggatgcttccgacaaaatttaactgtagtaacaatatatgcatctcttggtgaggatgcactggtgcattcactaaatgagacacaggtttcaactctgatatgtgattcgaagcaacttaagaagatacctgcaatcagctctaaattgcagagtcttaagcatattatctatattgaggatgaacctgttgaggctgagacactgaatcaagtgaagcatctgacaacattgtctttcactgaagtagaggagctaggcaagacatctcatgttgatgcaagattaccttcaagctctgatactgcagttatcatgtatacaagtggaagtactggtcttcccaagggtgtaatgatcacacatggcaacatggtggctacaactgcagcagtcatgacaatagtcccaaaccttggcaagaatgatgtttatctggcttaccttccattggctcatgtctttgaactagcagcagagactgtcatgttagcttctggtactgctattggatatggttcagcattgactatgactgatacatcaaacaagattaagaaggggacaaaaggagatgtttctgtactgaatcctactcttatgatttcagttcctgcaattttggatcgtatcagagatgcagtgtttaagaaagttggtgagaagggtggcctgacaaaaaagctgtttgattttgcatataagcgaaaccttgcagcaattgaggggagttggtttggatcttgggcaccggagaggatgatatgggataacattatttataaaccaataagggcaatgcttggaggacgtgtaagatttgttctttgtggtggtgcacctctatcaagtgacacgcagagatttatgaatatatgtctaggtgtcccagtgggtcaaggctatggattgactgaaacttgtgctggagcagctttcactgaatgggatgacacaagtgtgggtcgtgttggtccaccgcttccttgctcctatgtcaagcttgtttcgtgggaagaaggtggttataggatttctgattctccgatgcctagaggagaggtcgtggttggtggacacagcataacaaaaggttatttcaacaacgaagcaaagacgaatgaagtatacaaggttgatgagaggggcatacgctggttctacactggtgatattggtcagttccatcctgatgggtgccttgagattattgacaggaaaaaagatatagtaaagcttcagcatggagaatacgtgtctcttggcaaggttgaatcggctctagcaacaagcaattatgtggagaacatcatggtttatgccgatccatttcatagttattgtgttgccctggttgttccggcacaccaggccttggagaagtgggctcaaaattctgggataaactataaaggctttgaagagctttgccaaaatgatcaagcaaataaggaggttcagcaatcactatcaaaggccgcgaaagcagcgaggctcgagaaattcgaggtgccagcgaagatcatgctgttgcctgaaccgtggacaccggagtctgggctggtgacagcggcgcttaaactgaagagggagcagataaagaccaaattcaaagacgatttggacaagctctaccactga

SEQ ID NO: 5482 - protein, 726 aa, Sorghum bicolor
  misc_feature: Ceres ANNOT ID no. 6043789
  misc_feature (139)..(619): Pfam Id: AMP-binding Pfam Desc: AMP-binding enzyme
  misc_feature (27)..(725): NCBI GI: 15450593 NCBI Desc: t23o15.3/t23o15.3 [arabidopsis thaliana]
  misc_feature (41)..(725): NCBI GI: 12049721 NCBI Desc: long chain acyl-coa synthetase [brassica napus]
  misc_feature (44)..(725): NCBI GI: 62701932 NCBI Desc: probable acyl-coa synthetase, 62297-59022 [imported] - arabidopsis thaliana [oryza sativa (japonica cultivar-group)]
  misc_feature (192)..(725): NCBI GI: 140052256 NCBI Desc: amp-dependent synthetase and ligase; lipocalin [medicago truncatula]
  misc_feature (53)..(725): NCBI GI: 4165018 NCBI Desc: acyl-coa synthetase 3 [homo sapiens]
  misc_feature: Up-regulated in root tissues in response to salicylic acid treatment
  misc_feature: Up-regulated in shoot tissues in response to salicylic acid treatment
MGEVSDDNSNMSFLKRIATSDVPLLKEYGVNGVVVALLLAVVTPILLSMMFGKKTKQRAVRADVGGEEGFAMRNSRFPSLVAVPWEGATTMAALFEMASKKYSRRRCLGTRKLIKREFIESSDGRKFEKLHLGEYEWDTYTEAFNRACNFASGLIKMGHDLDSHAAIFSDTRAEWIIAAQGCFRQNLTVVTIYASLGEDALVHSLNETQVSTLICDSKQLKKIPAISSKLQSLKHIIYIEDEPVEAETLNQVKHLTTLSFTEVEELGKTSHVDARLPSSSDTAVIMYTSGSTGLPKGVMITHGNMVATTAAVMTIVPNLGKNDVYLAYLPLAHVFELAAETVMLASGTAIGYGSALTMTDTSNKIKKGTKGDVSVLNPTLMISVPAILDRIRDAVFKKVGEKGGLTKKLFDFAYKRNLAAIEGSWFGSWAPERMIWDNIIYKPIRAMLGGRVRFVLCGGAPLSSDTQRFMNICLGVPVGQGYGLTETCAGAAFTEWDDTSVGRVGPPLPCSYVKLVSWEEGGYRISDSPMPRGEVVVGGHSITKGYFNNEAKTNEVYKVDERGIRWFYTGDIGQFHPDGCLEIIDRKKDIVKLQHGEYVSLGKVESALATSNYVENIMVYADPFHSYCVALVVPAHQALEKWAQNSGINYKGFEELCQNDQANKEVQQSLSKAAKAARLEKFEVPAKIMLLPEPWTPESGLVTAALKLKREQIKTKFKDDLDKLYH

SEQ ID NO: 5483 - DNA, 894 bp, Sorghum bicolor
  misc_feature: Ceres ANNOT ID no. 6043792
  misc_feature: Encodes the peptide sequence at SEQ ID NO 5484
atgggcaggccaccgtgctgcgacaaggaagggatcaagaaggggccatggacgccggaggaggacatcatcctggtgtcctacatccaggagcacggcccgggcaactggcgctccgttcccatcaacacggggctcatgcgctgcagcaagagctgccgcctccggtggaccaactacctccgccccggcatccgccgcggcaacttcaccccgcacgaggaaggcatcatcgtccacctccagtccttgctcggcaacaggtgggccgccattgcttcttacctcccgcagagaaccgacaacgacatcaagaactactggaacacccacctcaagaagaaggacagctactacgcgcgcccatcaggaggagcaggctgctgcagcaacccagccgaggtcgcccagctcatcgcccggcgctcgccgttcgccgccgacggtggtggcgacagctcctcgtcgtcgtacgcctccagcatggacaacatatccaagctgctcaccggcttcatgaagcagcagcagagctccccgtcccccgacgccgccgcagctgccgacatcaagccctcctcggccgcccatgtcaacaaccaccatgctctgctgtcgtcgtcgtcgtcgttccatcacatgtccgccgccggcaccgggagtggtacgccacctgcagcagcctgcttcaacgacatgacgatgccgtcgccgccgcatgtgcagcagcaggcggcgctgatggggcatcacggcggctacgacgacgaccccaggcaggcgtccccgctgtctccgatcgagaagtggctgttcgaagaggccgccgagcaggtcggcgacctcatggatctgtccgaagactgctgctcatcagttccgatgatgttttag

SEQ ID NO: 5484 - protein, 297 aa, Sorghum bicolor
  misc_feature: Ceres ANNOT ID no. 6043792
  misc_feature (14)..(61): Pfam Id: Myb_DNA-binding Pfam Desc: Myb-like DNA-binding domain
  misc_feature (67)..(112): Pfam Id: Myb_DNA-binding Pfam Desc: Myb-like DNA-binding domain
  misc_feature (1)..(115): NCBI GI: 117957143 NCBI Desc: myb60-like protein [vitis vinifera]
  misc_feature (1)..(180): NCBI GI: 83638483 NCBI Desc: myb transcription factor [cucumis sativus]
  misc_feature (1)..(115): NCBI GI: 928930 NCBI Desc: cy13 [arabidopsis thaliana]
  misc_feature (1)..(115): NCBI GI: 87240347 NCBI Desc: homeodomain-related [medicago truncatula]
  misc_feature (1)..(286): NCBI GI: 9802570 NCBI Desc: f22o13.30 [arabidopsis thaliana]
  misc_feature: The sequence is a functional homolog of SEQ ID NO 743 in the 10/666,642 US patent application
  misc_feature: Useful for making plants with altered alkaloid content
  misc_feature: Useful for making plants with altered lignin content
  misc_feature: Useful for making plants with modulated nitrogen use efficiency
  misc_feature: Functional homolog of the protein sequence given in SEQ ID NO 13600
  misc_feature: The sequence is a functional homolog of SEQ ID NO 1069 in the 10/374,780 US patent application
  misc_feature: The sequence is a functional homolog of SEQ ID NO 988 in the 11/435,388 US patent application
  misc_feature: The sequence is a functional homolog of SEQ ID NO 1004 in the 11/435,388 US patent application
  misc_feature: The sequence is a functional homolog of SEQ ID NO 126 in the 10/412,699 US patent application
  misc_feature: The sequence is a functional homolog of SEQ ID NO 266 in the 10/374,780 US patent application
  misc_feature: The sequence is a functional homolog of SEQ ID NO 536 in the 11/435,388 US patent application
  misc_feature: The sequence is a functional homolog of SEQ ID NO 640 in the 10/225,066 US patent application
  misc_feature: The sequence is a functional homolog of SEQ ID NO 856 in the 10/412,699 US patent application
  misc_feature: The sequence is a functional homolog of SEQ ID NO 1056 in the 11/479,226 US patent application
  misc_feature: The sequence is a functional homolog of SEQ ID NO 144 in the 10/374,780 US patent application
  misc_feature: The sequence is a functional homolog of SEQ ID NO 458 in the 10/412,699 US patent application
  misc_feature: The sequence is a functional homolog of SEQ ID NO 756 in the 10/225,066 US patent application
  misc_feature: The sequence is a functional homolog of SEQ ID NO 1541 in the 10/374,780 US patent application
  misc_feature: The sequence is a functional homolog of SEQ ID NO 1635 in the 10/412,699 US patent application
  misc_feature: The sequence is a functional homolog of SEQ ID NO 1914 in the 10/412,699 US patent application
  misc_feature: The sequence is a functional homolog of SEQ ID NO 2174 in the 10/374,780 US patent application
  misc_feature: The sequence is a functional homolog of SEQ ID NO 956 in the 10/225,066 US patent application
  misc_feature: The sequence is a functional homolog of SEQ ID NO 1564 in the 10/374,780 US patent application
  misc_feature: The sequence is a functional homolog of SEQ ID NO 2 in the 10/225,068 US patent application
  misc_feature: The sequence is a functional homolog of SEQ ID NO 22 in the 10/225,068 US patent application
  misc_feature: The sequence is a functional homolog of SEQ ID NO 230 in the 10/225,066 US patent application
  misc_feature: The sequence is a functional homolog of SEQ ID NO 258 in the 10/374,780 US patent application
  misc_feature: The sequence is a functional homolog of SEQ ID NO 442 in the 11/435,388 US patent application
  misc_feature: The sequence is a functional homolog of SEQ ID NO 842 in the 10/412,699 US patent application
  misc_feature: The sequence is a functional homolog of SEQ ID NO 98 in the 11/375,241 US patent application
  misc_feature: The sequence is a functional homolog of SEQ ID NO 1625 in the 10/412,699 US patent application
  misc_feature: The sequence is a functional homolog of SEQ ID NO 978 in the 10/666,642 US patent application
  misc_feature: Useful for making plants with altered cell wall content and/or composition
  misc_feature: Functional homolog of the protein sequence given in SEQ ID NO 13602
  misc_feature: The sequence is a functional homolog of SEQ ID NO. 395 in the 11/188,298 US application
MGRPPCCDKEGIKKGPWTPEEDIILVSYIQEHGPGNWRSVPINTGLMRCSKSCRLRWTNYLRPGIRRGNFTPHEEGIIVHLQSLLGNRWAAIASYLPQRTDNDIKNYWNTHLKKKDSYYARPSGGAGCCSNPAEVAQLIARRSPFAADGGGDSSSSSYASSMDNISKLLTGFMKQQQSSPSPDAAAAADIKPSSAAHVNNHHALLSSSSSFHHMSAAGTGSGTPPAAACFNDMTMPSPPHVQQQAALMGHHGGYDDDPRQASPLSPIEKWLFEEAAEQVGDLMDLSEDCCSSVPMMF

SEQ ID NO: 5485 - DNA, 1863 bp, Sorghum bicolor
  misc_feature: Ceres ANNOT ID no. 6043793
  misc_feature: Encodes the peptide sequence at SEQ ID NO 5486
atggtgcgcgagctacgcgtcgacgccttctacgcgcgcctccgctcgacggcggcggcggcggcgggctcctcctcctcggcgccggtcctgatcctcccgtcggccgccgacgccgactcgctctgcacggtgcgggcgctggcgcacgtcctcgccgccgactccgtccgcttctccgtctaccccgtcgcttccgccgccgccgccagggcgctcctcgcctccttctcggcttccgcctccgcctcctcgccgctctgcctcgtcctcgtcaactggggcgcgcactgggacctggtgcgcgccgccgtcctgcccgacaccgctaccgccttcgtcgtcgactcccatcgccctgtacacctccacaacctctgcgcgcgcaacgaccgcgtcgtcgtcctcttcaccgccgacgacgagcaagccgccgacctctcctatgatttcgacctcgccgcgctcgccgacgcctctgaccttgccgccgagggcgacgccgacgccgaccccctccgcgccgcttccggctccgacgcttccgattatgaggactccgacgccgacgaggacgaggatgtcagcggcggcggcggcaggaggaagaggcgccggctgtccgacgacgccgacgccgacgccgactctgaccccgtgaggctgttcgggaggctgcggcgggagtactaccgcgtcggcacgttccacggcaagccgtcggggtgcctcatgtacgagctggcccacgcgctgcgccgcaacaccagcgagctgctctggctcgcctgcgtcgcgctcaccgaccagttcgtgcacgaccgcatcaccaacgagcggtaccaggcggcggtcatggagctggagcagcacgtcaacggctcgggcgccctcgacccgtcgggcgccggcgcggtcgtcacgctcaaggacggcaccaaggtccgcgcgcccgaggcgtcccgcatcgcctacgaggacgagccgcggctcatgctgctaagggagtggagcctcttcgactccatgctctgctcctcctacgtcgccaccaagctcaggacgtggaccgacaacggcctcaagaagctcaagctgctgctcgccaggatggggttcccgctcgctgactgtcagaagagctttcagtacatgagcatggaggtcaagcgcaagatgcgggacgagtttgaccgcttgctgcctgagtacggcctcacggagttctactaccggagcttcttgagggtgcacgggtacaggtccaaggtttccgctgcagacgttgtgtatggtgtcacggcgttgcttgaatcgctgaatgcagagtccaagggctcaaaggagtcttctgctgccgagcagttttgggctgcatactcagcattgtcgctgagcaatgtcgatcagttgcagaaagggatgcagtctgcgattgagattcagagggcgattttgaggcaaggaagctcggcgattactaagacagggtttatacggagtgccaagaagttccggtgggtcaagcttgatgaccctgtggacactagcaagctttgccacccacaggctcttaccaagttctgcttctttctgatggatgcactgaaggaaaggggtgcgaggatgaaaccgctaatctgtgcttgcttagcaaaggagcctgagaaggtactggttgttggcgtatgtggaaaaccaaggcttggggctgctcagggtaatgcctttggtaatgcattcagatcagcggcagaggagataggtgcagattatttccatgacatgtttgagtcatcatggattgttctggatgttgttgctgtcagttctttcatgattcggttaacggacaagttgtga

SEQ ID NO: 5486 - protein, 620 aa, Sorghum bicolor
  misc_feature: Ceres ANNOT ID no. 6043793
  misc_feature (29)..(621): Pfam Id: CDC45 Pfam Desc: CDC45-like protein
  misc_feature (1)..(620): NCBI GI: 77548491 NCBI Desc: cdc45-like protein [oryza sativa (japonica cultivar-group)]
  misc_feature (36)..(504): NCBI GI: 9967707 NCBI Desc: sna41 [schizosaccharomyces pombe]
  misc_feature (36)..(504): NCBI GI: 19115605 NCBI Desc: cdc45 related protein [schizosaccharomyces pombe]
  misc_feature (171)..(620): NCBI GI: 50603804 NCBI Desc: cdc45l-prov protein [xenopus laevis]
  misc_feature (171)..(620): NCBI GI: 49116014 NCBI Desc: loc398081 protein [xenopus laevis]
MVRELRVDAFYARLRSTAAAAAGSSSSAPVLILPSAADADSLCTVRALAHVLAADSVRFSVYPVASAAAARALLASFSASASASSPLCLVLVNWGAHWDLVRAAVLPDTATAFVVDSHRPVHLHNLCARNDRVVVLFTADDEQAADLSYDFDLAALADASDLAAEGDADADPLRAASGSDASDYEDSDADEDEDVSGGGGRRKRRRLSDDADADADSDPVRLFGRLRREYYRVGTFHGKPSGCLMYELAHALRRNTSELLWLACVALTDQFVHDRITNERYQAAVMELEQHVNGSGALDPSGAGAVVTLKDGTKVRAPEASRIAYEDEPRLMLLREWSLFDSMLCSSYVATKLRTWTDNGLKKLKLLLARMGFPLADCQKSFQYMSMEVKRKMRDEFDRLLPEYGLTEFYYRSFLRVHGYRSKVSAADVVYGVTALLESLNAESKGSKESSAAEQFWAAYSALSLSNVDQLQKGMQSAIEIQRAILRQGSSAITKTGFIRSAKKFRWVKLDDPVDTSKLCHPQALTKFCFFLMDALKERGARMKPLICACLAKEPEKVLVVGVCGKPRLGAAQGNAFGNAFRSAAEEIGADYFHDMFESSWIVLDVVAVSSFMIRLTDKL

SEQ ID NO: 5487 - DNA, 1407 bp, Sorghum bicolor
  misc_feature: Ceres ANNOT ID no. 6043828
  misc_feature: Encodes the peptide sequence at SEQ ID NO 5488
atggcacacttcgtcgtcggcatcgcggcgctgctcctgctgcagctgatgtcctcgtcgtcctaccccagcagcactgtccttgcagactccatgctcggccggaaagctggcatcgtcgtcgacgaggcggcggcgcccgagagttcaccgccggggatggggaggtacgccgtgatcttcaatgctggcagcacggggactcgtgtgcacgtcttcaggttcgacaggaagctcgagctcctcgagatcggcgacgaaggcatcgaggtgttcgctaaggtgaagcctgggctgagctcatacgctggacatccccaagaggcagcaaattccatactgcctcttcttgacaaggccaaaagtgttgtccctaaacagctgatgaaaaggaccccgcttagactcggagcaactgctgggttgagacttattggagaagagcaatcggaccagattcttgaagcggtcaggaaccttgtccacactaagaccaaatttcagaccaagcccgagtggatcaatgttattgagggatctcaagaaggatcatacctatgggttgctctgaattatctgttggataaattgggaggggactactcacagacagtagccgtggttgatatgggcggtggatcagtgcaaatagcctatgccatttctgcaaataccgctgcaaatgctccggtggcacctcatggggaagacccctatgttataagagagtatcttaaagggaaagattacaacatctatgctcacagttacttgcactatggtgcttttgcatcacgggcagagattttgaaggcaaagaatggaccattcagcagctgcatgttacgtggattcatcggtcaatacacctacaatgaggagcaatacgatgcaactgccgcaccagaaggagcagtctactacaaatgcagagaagagataggcaaagcactgaacctgaatgcgccatgtgaaacaaagaactgcacattcaatggcatatggaatggcggtggcggagcaggccaagacaacctctatgttgcatccagcttctactacgtggcctcagaggtcggcatcatagatggcaatgcaccaagcggagaaactacccctggcgcattcagagcttccgcggagagggtttgccagatgagtgttgaagaagccaaaattgaatatccaaacgtcaacgatgtcgatgtgccttacctatgcatggaccttgcctaccagtatactttgctagtagatggctttggtgtggaggcgaccaaggagatcaccgtggtggacaaggtgaagcatggagagtactatgtcgaagctgtgtggcctctagctctgctattaaggctgtgtcatccaaaaaatggcatcaaggtgcatgatatgttggtttga

SEQ ID NO: 5488 - protein, 468 aa, Sorghum bicolor
  misc_feature: Ceres ANNOT ID no. 6043828
  misc_feature (43)..(464): Pfam Id: GDA1_CD39 Pfam Desc: GDA1/CD39 (nucleoside phosphatase) family
  misc_feature (1)..(448): NCBI GI: 62732856 NCBI Desc: apyrase [oryza sativa (japonica cultivar-group)]
  misc_feature (95)..(448): NCBI GI: 62732863 NCBI Desc: s-type apyrase [oryza sativa (japonica cultivar-group)]
  misc_feature (95)..(422): NCBI GI: 115485341 NCBI Desc: os11g0440200 [oryza sativa (japonica cultivar-group)]
  misc_feature (57)..(448): NCBI GI: 11225137 NCBI Desc: apyrase gs52 [glycine soja]
  misc_feature (1)..(448): NCBI GI: 27804678 NCBI Desc: apyrase-like protein [medicago truncatula]
  misc_feature (57)..(463): SWISSPROT Homolog: EC 3.6.1.5 Apyrase precursor
MAHFVVGIAALLLLQLMSSSSYPSSTVLADSMLGRKAGIVVDEAAAPESSPPGMGRYAVIFNAGSTGTRVHVFRFDRKLELLEIGDEGIEVFAKVKPGLSSYAGHPQEAANSILPLLDKAKSVVPKQLMKRTPLRLGATAGLRLIGEEQSDQILEAVRNLVHTKTKFQTKPEWINVIEGSQEGSYLWVALNYLLDKLGGDYSQTVAVVDMGGGSVQIAYAISANTAANAPVAPHGEDPYVIREYLKGKDYNIYAHSYLHYGAFASRAEILKAKNGPFSSCMLRGFIGQYTYNEEQYDATAAPEGAVYYKCREEIGKALNLNAPCETKNCTFNGIWNGGGGAGQDNLYVASSFYYVASEVGIIDGNAPSGETTPGAFRASAERVCQMSVEEAKIEYPNVNDVDVPYLCMDLAYQYTLLVDGFGVEATKEITVVDKVKHGEYYVEAVWPLALLLRLCHPKNGIKVHDMLV

SEQ ID NO: 5489 - DNA, 1440 bp, Sorghum bicolor
  misc_feature: Ceres ANNOT ID no. 6043829
  misc_feature: Encodes the peptide sequence at SEQ ID NO 5490
atggctcgcgtcgccggcctttgtgagctgcttctcctcctgctcctcgccacggccacggcatcggccgccacacctcttggccggaagggcggccacgaagccgacgacgacggcgagctcgagttggcagcgaagaatgagaacgacggcgtcgtcgcagctgctggcagcaggacgtcggccgggaggtacgcggtgatcttcgacgctggaagcacggggagccgggtgcacgtcttcaagttcgacaagaagctccacctcgtccagatcggcgatgacatcgagttcttcgccaaggtaaagcctgggctaagctcatatgctggtcgacctcaagaggctgcaagctccctactccctcttcttgagcaagctgataagattgtccctcgccggcttcagaaaaataccccgcttaaacttggggcaactgctggtttgagattaattggagatgagaaggcagaagagattcttgaagcggtcagagatcttgtccacatcaagagcaaatttcagtacaaccccaaatatatcagtgttcttgagggatcccaagaagggtcttacctatgggttgctttgaattatctattaggtaagttgggcggggactactcgaaaacagttggtgtaattgatatggggggtggatcagtgcaaatggcctatgccatttccacagatgctgccgcaaatgccccagctgtgcctgatgggaaggatccatacattacaaaggagtacctcaaggggaaagattataacctttatgttcacagttacttgtactatggcgctttagccgctcgtgtggagatcctaaaggcaaagaatgggccatttagccattgtattttgcgtggattcagtggtaaatacacctacaacgggaaggaatatgatgcaacagcctcacctgaaggcgcggtgtatgacaagtgcagggaagagataatcaaggcacttaagttgaatgcaccatgtgaaagcaagaattgtacctttaacggcgtgtggaatggaggtggtggagctggccaagacaacctctatgttgcatcttttttctttgacaaagctacccagtttggcttcattgatagcaaggcacccagtgcaaagtccacccctgaggcgttcaaaggtgctgcagacaaggtttgctcactgagcgcccaagaagccaaagttatgtaccctaatgtccttgatgtgccatacatatgcatggatctcatctaccaatacacattgcttgtagatggctttggtttggctcctacgaaggagattacattggtggctagggtgaagtatggagagtactacattgaggcagcatggcctttgggtactgctattgaagctattgcacccaaaaagatgagacaagatctatactatcaaggtgaattgtttcctaatggctga

SEQ ID NO: 5490 - protein, 479 aa, Sorghum bicolor
  misc_feature: Ceres ANNOT ID no. 6043829
  misc_feature (52)..(472): Pfam Id: GDA1_CD39 Pfam Desc: GDA1/CD39 (nucleoside phosphatase) family
  misc_feature (1)..(467): NCBI GI: 62732856 NCBI Desc: apyrase [oryza sativa (japonica cultivar-group)]
  misc_feature (102)..(467): NCBI GI: 62732863 NCBI Desc: s-type apyrase [oryza sativa (japonica cultivar-group)]
  misc_feature (102)..(427): NCBI GI: 115485341 NCBI Desc: os11g0440200 [oryza sativa (japonica cultivar-group)]
  misc_feature (7)..(471): NCBI GI: 6006797 NCBI Desc: apyrase [dolichos biflorus]
  misc_feature (58)..(461): NCBI GI: 56692309 NCBI Desc: apyrase [vigna sinensis]
  misc_feature (65)..(471): SWISSPROT Homolog: EC 3.6.1.15 Nucleoside-triphosphatase
  misc_feature (41)..(461): SWISSPROT Homolog: EC 3.6.1.5 Apyrase precursor
MARVAGLCELLLLLLLATATASAATPLGRKGGHEADDDGELELAAKNENDGVVAAAGSRTSAGRYAVIFDAGSTGSRVHVFKFDKKLHLVQIGDDIEFFAKVKPGLSSYAGRPQEAASSLLPLLEQADKIVPRRLQKNTPLKLGATAGLRLIGDEKAEEILEAVRDLVHIKSKFQYNPKYISVLEGSQEGSYLWVALNYLLGKLGGDYSKTVGVIDMGGGSVQMAYAISTDAAANAPAVPDGKDPYITKEYLKGKDYNLYVHSYLYYGALAARVEILKAKNGPFSHCILRGFSGKYTYNGKEYDATASPEGAVYDKCREEIIKALKLNAPCESKNCTFNGVWNGGGGAGQDNLYVASFFFDKATQFGFIDSKAPSAKSTPEAFKGAADKVCSLSAQEAKVMYPNVLDVPYICMDLIYQYTLLVDGFGLAPTKEITLVARVKYGEYYIEAAWPLGTAIEAIAPKKMRQDLYYQGELFPNG

SEQ ID NO: 5491 - DNA, 1272 bp, Sorghum bicolor
  misc_feature: Ceres ANNOT ID no. 6043845
  misc_feature: Encodes the peptide sequence at SEQ ID NO 5492
atggacgcggggaatggctgcagcgcgcgggcgctagcggcgtgcgtgatcggcggcatcgtgctgggcgcctcggtgctggcgctgcacctcgcgggcgggcccgccgccatcccgcccttgcccctgccttccctcggcgcgctccgccgccgccgccgcaaccgccgccccgtgcgcgtctacatggacggctgcttcgacatgatgcactacggccactgcaacgcgctgcgccaggccagggcgctcggggacgagctcgtcgtcggcgtcatcagcgacgacgagatcaaggctaacaagggaccacccgtcacgccgctccacgagagaatgataatggtccgtgctgtgaaatgggtagatgatatcattccagatgcaccttatgccataactgaagaattcatgaacaagctattcaatgagtacaacatcgactacattatccatggggacgatccttgtttgctaccggatggtactgatgcatatgctcttgccaaaaaggctggtcgatacaagcagattaagaggactgagggagtgtcgaccacagacattgttggacggatgcttctttgtgttagagagagatcatctgatgcccataatcactcttcactacaaaggcagttcagtagtggacatggtcagaaagttgatgatactggatctggaactggaacaagagtatctcattttcttcccacatctaggcgaatagttcagttctcaaacagcaggggtccaggtccagattctcagatagtttacatagatggtgcttttgatctgttccatgctggacatgttgagatattacggcttgctcgagaacttggagatttcttgcttgtggggattcacacagatcagaccataagttcaactcgaggacggcaccgcccaatcatgaatctccatgagcgaagtttgagtgttttggcttgtcgttatgttgatgaggtgatcattggtgctccatgggacgtttcaaaagacatgattaccacattcaatatttcgttagttgttcatggaactattgctgaaaacatggactttgcagaggatgattcaaacccatatgctgttccaaaggctatgggcatttaccgccggctggagagtcccttggatatcacaacaagtactatcatcaggaggattgttgctaaccacgaagcttaccagaagcggaatgagaagaaggaagccagtgagaagaagtactatgagagtaaaagtttcgtcaatggggagtga

SEQ ID NO: 5492 - protein, 423 aa, Sorghum bicolor
  misc_feature: Ceres ANNOT ID no. 6043845
  misc_feature (62)..(192): Pfam Id: CTP_transf_2 Pfam Desc: Cytidylyltransferase
  misc_feature (260)..(392): Pfam Id: CTP_transf_2 Pfam Desc: Cytidylyltransferase
  misc_feature (1)..(423): NCBI GI: 28566182 NCBI Desc: phosphoethanolamine cytidylyltransferase [hordeum vulgare subsp. vulgare]
  misc_feature (16)..(423): NCBI GI: 140052750 NCBI Desc: cytidylyltransferase [medicago truncatula]
  misc_feature (17)..(423): NCBI GI: 78708489 NCBI Desc: phosphoethanolamine cytidylyltransferase [oryza sativa (japonica cultivar-group)]
  misc_feature (51)..(420): NCBI GI: 28932922 NCBI Desc: ctp:ethanolamine cytidylyltransferase [chlamydomonas reinhardtii]
  misc_feature (16)..(250): NCBI GI: 124360293 NCBI Desc: cytidylyltransferase [medicago truncatula]
MDAGNGCSARALAACVIGGIVLGASVLALHLAGGPAAIPPLPLPSLGALRRRRRNRRPVRVYMDGCFDMMHYGHCNALRQARALGDELVVGVISDDEIKANKGPPVTPLHERMIMVRAVKWVDDIIPDAPYAITEEFMNKLFNEYNIDYIIHGDDPCLLPDGTDAYALAKKAGRYKQIKRTEGVSTTDIVGRMLLCVRERSSDAHNHSSLQRQFSSGHGQKVDDTGSGTGTRVSHFLPTSRRIVQFSNSRGPGPDSQIVYIDGAFDLFHAGHVEILRLARELGDFLLVGIHTDQTISSTRGRHRPIMNLHERSLSVLACRYVDEVIIGAPWDVSKDMITTFNISLVVHGTIAENMDFAEDDSNPYAVPKAMGIYRRLESPLDITTSTIIRRIVANHEAYQKRNEKKEASEKKYYESKSFVNGE

SEQ ID NO: 5493 - DNA, 375 bp, Sorghum bicolor
  misc_feature: Ceres ANNOT ID no. 6043849
  misc_feature: Encodes the peptide sequence at SEQ ID NO 5494
atgatgaactctctcaccggcttcaccgccctatctgccggcctcctgctcatcttctcctcgtcctccttgctgctgcaagctcaaggcggcggcggcggcgtggagtcgtacgtgccggtgcgaagagtggtgtaccggtccatatcaccggcggcgatgtcgacagaagcagcggcgccgtacgaaccgttcgaggtgtgccggaggtgccggtgctgcgtgtcgccgtccattccgagcagctgcgtggacacgaactgctgctacgacatcaactgcaacctccccggcaagcccttcggcacctgcgccttccttccgaaaacctgcggctgcggcgccgcaaacaactgcagccagccggcgtcctga

SEQ ID NO: 5494 - protein, 124 aa, Sorghum bicolor
  misc_feature: Ceres ANNOT ID no. 6043849
  misc_feature: Useful for biocontainment applications
  misc_feature: Functional homolog of the protein sequence given in SEQ ID NO 12966
  misc_feature: Useful for biocontainment applications
  misc_feature: Functional homolog of the protein sequence given in SEQ ID NO 12966
MMNSLTGFTALSAGLLLIFSSSSLLLQAQGGGGGVESYVPVRRVVYRSISPAAMSTEAAAPYEPFEVCRRCRCCVSPSIPSSCVDTNCCYDINCNLPGKPFGTCAFLPKTCGCGAANNCSQPAS

SEQ ID NO: 5495 - DNA, 1560 bp, Sorghum bicolor
  misc_feature: Ceres ANNOT ID no. 6043868
  misc_feature: Encodes the peptide sequence at SEQ ID NO 5496
atgtctcaccagcaaaggcactacaacagctacgaactccaccccacccagccagatgtgcagtgcctggtctgcacgcggcctttcactctggacgctgaggtcaccgacagcttcgaagctctagccatatgcagggagtgcaagatgaccgtgctcactgacagcaacagcaacagggacgagactccgagaactaaccggcagagaagatggcaaaggcaaaggtccagcagggtgacagggcatgagcctcacacggaggaggatgcgttcccgcagcagttctcccagctgatcaacttggctagacagggtcatgaggcggatgctgattctccgacagttccgccgcgccagcacgcgtcttatagctctacgccgagccggtcccagagatggcacacttcggatgatgagagtgatggtctgagttatgctgattccgtgtttggtgaggttgagttcgagtcgaacatcagttttggtgacgagggtggggaatcggatacttctgttgatcgacacgccatgattgggagggaaattgtcattcagcttgagaatgagagctacatgaacacagatacagatattgatcctatgaatgctggaatttaccagtgggattcggatgatcctgaagacgatgatgaggatgagcagtcggaagagtctgatttggatgaaggagatgacaccatgcaggagcgccggcaggagtggcatgatattgccccaagtggattgaatgagcaggaagctgaaggcgctgcgtggacttggagaacagctggaagccaaggagtaaacaggactgatctgagagccgacattgaagggcgagcaatcaggagagtttttattgggaatcctggagattatgttgatgcaagacagtttgaaatgcttctcgagcagtttgctgaggataacaattccagaagaggagctccacctgcagcggcaactttcattgaaaatctttcatctgtggtcatctccaaaaggtatgagagaaatggcggtgtcacctgtccagtctgcaaagatgacatgcctatcaccactgtagcaaaacagctaccatgcatgcatctatatcatgcatcttgcatcttgccatggcttagttgtaggaatacatgcccagtttgccgttacgagcttcctacagatgacccagaatatgagaggtccaagcatgccacagtcaatgagggaggcatccatggggtggagcatatccatccgcaggaggctattgaagaaacttatgagcctggggttgatggaagttctaatacaggtggtgatacaatggaagagactaatacacgtgaacatgctgttcctactgcacagcagccaaatggagcacatgggcgtcatagatggctgtttattgcagcagctccagttgtaagtcttgtcagtttagctctagttttgtgcttcaccaaccctgctggcaatgttagaaggcaattgtgccgtagatcccaaactaccactacggcacatgtagacacaagaagaagttggtggtctatgttctaa

SEQ ID NO: 5496 - protein, 519 aa, Sorghum bicolor
  misc_feature: Ceres ANNOT ID no. 6043868
  misc_feature (346)..(386): Pfam Id: zf-C3HC4 Pfam Desc: Zinc finger, C3HC4 type (RING finger)
  misc_feature (137)..(410): NCBI GI: 23507797 NCBI Desc: at5g08140/t22d6_80 [arabidopsis thaliana]
  misc_feature (212)..(407): NCBI GI: 61211690 NCBI Desc: ubiquitin ligase protein cip8 (cop1-interacting protein 8)
  misc_feature (301)..(401): NCBI GI: 92889026 NCBI Desc: zinc finger, ring-type; ringv [medicago truncatula]
  misc_feature (290)..(442): NCBI GI: 23308365 NCBI Desc: at3g19950/mpn9_19 [arabidopsis thaliana]
  misc_feature (301)..(401): NCBI GI: 4651204 NCBI Desc: ring finger protein [cicer arietinum]
  misc_feature: Useful for making plants with altered Lignin content
  misc_feature: GREAT-hit functional homolog of the protein sequence given in SEQ ID NO 13327
  misc_feature: The sequence is a functional homolog of SEQ ID NO. 329 in the 11/188,298 US application
  misc_feature: The sequence is a functional homolog of SEQ ID NO. 271 in the 11/188,298 US application
  misc_feature: The sequence is a functional homolog of SEQ ID NO. 424 in the 11/188,298 US application
MSHQQRHYNSYELHPTQPDVQCLVCTRPFTLDAEVTDSFEALAICRECKMTVLTDSNSNRDETPRTNRQRRWQRQRSSRVTGHEPHTEEDAFPQQFSQLINLARQGHEADADSPTVPPRQHASYSSTPSRSQRWHTSDDESDGLSYADSVFGEVEFESNISFGDEGGESDTSVDRHAMIGREIVIQLENESYMNTDTDIDPMNAGIYQWDSDDPEDDDEDEQSEESDLDEGDDTMQERRQEWHDIAPSGLNEQEAEGAAWTWRTAGSQGVNRTDLRADIEGRAIRRVFIGNPGDYVDARQFEMLLEQFAEDNNSRRGAPPAAATFIENLSSVVISKRYERNGGVTCPVCKDDMPITTVAKQLPCMHLYHASCILPWLSCRNTCPVCRYELPTDDPEYERSKHATVNEGGIHGVEHIHPQEAIEETYEPGVDGSSNTGGDTMEETNTREHAVPTAQQPNGAHGRHRWLFIAAAPVVSLVSLALVLCFTNPAGNVRRQLCRRSQTTTTAHVDTRRSWWSMF

SEQ ID NO: 5497 - DNA, 966 bp, Sorghum bicolor
  misc_feature: Ceres ANNOT ID no. 6043873
  misc_feature: Encodes the peptide sequence at SEQ ID NO 5498
atggccatcttctcgatccgcgcatgcctcctccagctgctgctagtgctcttcttcttcttcgccgccacctcccccgcggcggcgcagtcgcggccgacgtcgccggccaggatcctcgacgcggcgctgcaggactacgcgtaccgggcgttcgcgcgcccgcgcaccggcattgtctacaacgccacgctcccgggcaacctcacgggcattgccgtctccgcggtgcgcctgcgcagcggcagcctccgccggaagggcttcgcgggctacttccagttcggcgtgcccacgggcgtcgtcgtgcagccgtacgtcgagcgggtggtgctcgtgtaccacgacctcggcaactggtccgactactactacccgctcccagggtacacctacctggcgccggtgctcggtctgctggtctacgacgccgccaacctgtccgccgtggggctgcaggagctcaacatcgtcgcgtcgggtggtccgatttccatcagcttcggtggcaatgtcagggcggtgccggcaggcagtgcggccccgaggtgtgtggtgttcgatttggatggcatgccgcagttccgggacctggtggccactgatatgtgctcgacgtatcaccaagggcatgtatcgatagtggtgaactccagtgggattgctcctgctccaccacctggcacaattcccccgccaattccgaccgcaggaggaaataagaagggaagctcaaaggcgtggaagattgccggcagtgtggttggggctgccatagcgttggggctcttggctgcgcttctgctgtgtctggtgaggcataaaagggataagaaacttcaggtgatggaacggaatgcggaggttggagagacattgcggatggcgcaggttgggcggacgcaagcaccggtggcattggggacacggacgcaaccggtgattgagaacgattacactgcatag

SEQ ID NO: 5498 - protein, 321 aa, Sorghum bicolor
  misc_feature: Ceres ANNOT ID no. 6043873
  misc_feature (11)..(318): NCBI GI: 115487034 NCBI Desc: os12g0117800 [oryza sativa (japonica cultivar-group)]
  misc_feature (5)..(181): NCBI GI: 38345868 NCBI Desc: osjnba0064m23.10 [oryza sativa (japonica cultivar-group)]
  misc_feature: Useful for making plants with modulated nitrogen use efficiency
  misc_feature: GREAT-hit functional homolog of the protein sequence encoded by LOCUS at3g08600
MAIFSIRACLLQLLLVLFFFFAATSPAAAQSRPTSPARILDAALQDYAYRAFARPRTGIVYNATLPGNLTGIAVSAVRLRSGSLRRKGFAGYFQFGVPTGVVVQPYVERVVLVYHDLGNWSDYYYPLPGYTYLAPVLGLLVYDAANLSAVGLQELNIVASGGPISISFGGNVRAVPAGSAAPRCVVFDLDGMPQFRDLVATDMCSTYHQGHVSIVVNSSGIAPAPPPGTIPPPIPTAGGNKKGSSKAWKIAGSVVGAAIALGLLAALLLCLVRHKRDKKLQVMERNAEVGETLRMAQVGRTQAPVALGTRTQPVIENDYTA

SEQ ID NO: 5499 - DNA, 1383 bp, Sorghum bicolor
  misc_feature: Ceres ANNOT ID no. 6043880
  misc_feature: Encodes the peptide sequence at SEQ ID NO 5500
atggcggcgacggcggcggcgcttcggtgctgctttcccggctcctccggtgtcggcagtggcttcgtgaaagccaaatcgtccaggcgaggctggtgcgcagcggccgtggcggcgccgtcgcgggaggcggagccggtttcgtcactggggcaccgtacccgcgtcgacttccccatccttcaccaggaattcgatggtgctaaattagtttacttcgacaacggtgcaacatcacagaaaccttatagtgtgatgagaacactagatgagtactaccgatcgtacaattcgaatgttcatcgtggtattcatgcactcagcgcgaaggctactcaagcatatgaggatgcaagaagaaaggttgcaaattttgtcaacgcagctgatagcagagagattattttcactcgaaatgctactgaagctatcaatctggtagcctattcatggggactatctaacttgaaagaaggagatgagattgtccttacagttgcggagcatcatagtgctattgttccatggcaatttgtttcccagaagactggtgccaccttgaagtatgttggattgactaaagaaaatgccccagacattgagcagttaaaaaggcttctgtcgaacaagacaaagatagttgttgttcatcatgtcgcaaatgttctaggttccatgcttcctattgaggagattgtaacatggtcaaacagagttggagctaaagtccttgtagatgcttgccaaagtgttccccacatgccagttgatgttcagaaacttggcgcagactttcttgtcgcatcctctcataagatgtgtggccctacaggcgtcggatttttgcatggtaaatttgagattttgtcatctatggagcctttcttaggtggtggcgaaatgattgcagatgtattccaagacaaatccacatacgctgagcctccctctagatttgaggctggaactcctgcaattggagaagctataggattgggagcggccattgattatttatcatgcattggcatggagcagatccatgaatatgagaaagagttggggacatatctgtatgaaagccttctttctgttccaaatgtccagatatatggtccagcaccttcccaaactgttcaccgtgctccgctgtgttctttcaatattgagaatgttcatcctacagatattgcagaaattcttgatctgcagcacggtgtagcaattcggtcagggcatcattgtgcacagattttgcataggacccttggtatcactgcaagtgctcgtgcaagtcttcacttctacaatacaaaagatgaagtggataccttcatcgatgcgcttaaagccactattgatttcctcacgtctaaatactag

SEQ ID NO: 5500 - protein, 460 aa, Sorghum bicolor
  misc_feature: Ceres ANNOT ID no. 6043880
  misc_feature (71)..(445): Pfam Id: Aminotran_5 Pfam Desc: Aminotransferase class-V
  misc_feature (23)..(458): NCBI GI: 92889688 NCBI Desc: aminotransferase, class v [medicago truncatula]
  misc_feature (135)..(460): NCBI GI: 115488206 NCBI Desc: os12g0287300 [oryza sativa (japonica cultivar-group)]
  misc_feature (12)..(351): NCBI GI: 6664318 NCBI Desc: t27g7.17 [arabidopsis thaliana]
  misc_feature (46)..(455): NCBI GI: 23129616 NCBI Desc: cog0520: selenocysteine lyase [nostoc punctiforme pcc 73102]
  misc_feature (46)..(455): NCBI GI: 75906652 NCBI Desc: cysteine desulphurases, sufs [anabaena variabilis atcc 29413]
MAATAAALRCCFPGSSGVGSGFVKAKSSRRGWCAAAVAAPSREAEPVSSLGHRTRVDFPILHQEFDGAKLVYFDNGATSQKPYSVMRTLDEYYRSYNSNVHRGIHALSAKATQAYEDARRKVANFVNAADSREIIFTRNATEAINLVAYSWGLSNLKEGDEIVLTVAEHHSAIVPWQFVSQKTGATLKYVGLTKENAPDIEQLKRLLSNKTKIVVVHHVANVLGSMLPIEEIVTWSNRVGAKVLVDACQSVPHMPVDVQKLGADFLVASSHKMCGPTGVGFLHGKFEILSSMEPFLGGGEMIADVFQDKSTYAEPPSRFEAGTPAIGEAIGLGAAIDYLSCIGMEQIHEYEKELGTYLYESLLSVPNVQIYGPAPSQTVHRAPLCSFNIENVHPTDIAEILDLQHGVAIRSGHHCAQILHRTLGITASARASLHFYNTKDEVDTFIDALKATIDFLTSKY

SEQ ID NO: 5501 - DNA, 756 bp, Sorghum bicolor
  misc_feature: Ceres ANNOT ID no. 6043882
  misc_feature: Encodes the peptide sequence at SEQ ID NO 5502
atggcagcaaaggagcactttgtgcttgttcatggtgaagggcatggagcctggtgttggttcaagctccgctggctccttgagggcgctggctaccgtgttacatgcattgaccttgccggaggtggcgtcgatcctactgatcccaacacaatccggtcgttcaagcagtatgacaagccgctcatagatctcatttcaaccttgccagagggggagaaggttattctagtcggacatggtgctggagggctgagtgtgatccatgcaatgcatgaattcgttgacaggatcagtcaatcattttttgtggcagctacaatgctaccatttggatttcaagctgatgaagataagaaagatggattaccaactttgcctgagaacgagattgagttgacacttggtgcaggagcagatgatcctccaacaaccattgccttgaggctagaattccagcgtgatcgactatcacaacaaagccctgaagaggaatcagtacttgcttcaatgctgatgcgtccgtggcctgcaacagctatcagtacagcaagcttcgaaggagatgatgagagattgaaccgaatcaaacgaattttcataaagacggagcgtgaccacatgctggatcctcaacagcaagattccatgatcaagaagtggccacctagtgaggttttggtcatagatacagatcacagtcccttcttctctgcaccagaacagctgtttaatttaatagtcaaatctctatga

SEQ ID NO: 5502 - protein, 251 aa, Sorghum bicolor
  misc_feature: Ceres ANNOT ID no. 6043882
  misc_feature (32)..(249): Pfam Id: Abhydrolase_1 Pfam Desc: alpha/beta hydrolase fold
  misc_feature (3)..(223): NCBI GI: 115487022 NCBI Desc: os12g0117200 [oryza sativa (japonica cultivar-group)]
  misc_feature (6)..(251): NCBI GI: 83699291 NCBI Desc: pheophorbidase [raphanus sativus]
  misc_feature (6)..(251): NCBI GI: 21593888 NCBI Desc: cyanohydrin lyase like protein [arabidopsis thaliana]
  misc_feature (2)..(249): NCBI GI: 42563068 NCBI Desc: hydrolase, alpha/beta fold family protein [arabidopsis thaliana]
  misc_feature (2)..(249): NCBI GI: 6730643 NCBI Desc: f4n2.19 [arabidopsis thaliana]
MAAKEHFVLVHGEGHGAWCWFKLRWLLEGAGYRVTCIDLAGGGVDPTDPNTIRSFKQYDKPLIDLISTLPEGEKVILVGHGAGGLSVIHAMHEFVDRISQSFFVAATMLPFGFQADEDKKDGLPTLPENEIELTLGAGADDPPTTIALRLEFQRDRLSQQSPEEESVLASMLMRPWPATAISTASFEGDDERLNRIKRIFIKTERDHMLDPQQQDSMIKKWPPSEVLVIDTDHSPFFSAPEQLFNLIVKSL

SEQ ID NO: 5503 - DNA, 795 bp, Sorghum bicolor
  misc_feature: Ceres ANNOT ID no. 6043883
  misc_feature: Encodes the peptide sequence at SEQ ID NO 5504
atggaggccagcggcgaggtttacaaggccaacaaggagcactttgtcctcgtgcacggcgccggccacggcgcctggtgctggttcaagctcgcgtgcctgctccggggctccggccaccgcgtctcctgcatcgaccacgccgggaccgccggcagcctcgtcgacccggacgacgtccggtcgttcgacaagtacgacgcgccgctcatggacttcatggccgccttgccggatgggcacaaggtaattttggtagggcatagcgcaggaggactgagcgtcacccatgcgatgcatttgttcagagacaagatcaagcaagccatcttcatagcagcaaccatgcttccgtttgggtaccaaacagagcaagatataaaagatggggcacctgatttatccgagtttggtgatgtgttcgacctgagattcggtctgggagatggctgccctccaacgagtgtggcgctgagagaggagcaccagcgcataatcctgtatcagcaatgctcccatgaggactccacacttgcatccattctgctgcgcccatggccagccgctctgagcactgcaaggttcggccatgtcgatgacggcgccgagagtgcagtgaatgcagtgcctcgggtgtacataaagacaaccaatgaccacatggtgaagcaggagcagcaggaggccatgatccgacgatggccgccgagagaggtggtggcgatggacactgaccacagccctttcttctctgcgccggagcgtctcttggagctgatcctcaagtcattgtaa

SEQ ID NO: 5504 - protein, 264 aa, Sorghum bicolor
  misc_feature: Ceres ANNOT ID no. 6043883
  misc_feature (40)..(262): Pfam Id: Abhydrolase_1 Pfam Desc: alpha/beta hydrolase fold
  misc_feature (12)..(238): NCBI GI: 115487022 NCBI Desc: os12g0117200 [oryza sativa (japonica cultivar-group)]
  misc_feature (14)..(264): NCBI GI: 83699291 NCBI Desc: pheophorbidase [raphanus sativus]
  misc_feature (14)..(264): NCBI GI: 21593888 NCBI Desc: cyanohydrin lyase like protein [arabidopsis thaliana]
  misc_feature (6)..(262): NCBI GI: 42562323 NCBI Desc: hydrolase, alpha/beta fold family protein [arabidopsis thaliana]
  misc_feature (9)..(261): NCBI GI: 56392765 NCBI Desc: methyl jasmonate esterase [solanum tuberosum]
MEASGEVYKANKEHFVLVHGAGHGAWCWFKLACLLRGSGHRVSCIDHAGTAGSLVDPDDVRSFDKYDAPLMDFMAALPDGHKVILVGHSAGGLSVTHAMHLFRDKIKQAIFIAATMLPFGYQTEQDIKDGAPDLSEFGDVFDLRFGLGDGCPPTSVALREEHQRIILYQQCSHEDSTLASILLRPWPAALSTARFGHVDDGAESAVNAVPRVYIKTTNDHMVKQEQQEAMIRRWPPREVVAMDTDHSPFFSAPERLLELILKSL

SEQ ID NO: 5505 - DNA, 1233 bp, Sorghum bicolor
  misc_feature: Ceres ANNOT ID no. 6043911
  misc_feature: Encodes the peptide sequence at SEQ ID NO 5506
  misc_feature: Down-regulated in shoot tissues in response to aminocyclopropane carboxylic treatment
atgagagaagttaccattgtggagaagtcaggctctacttcatcgagttcatctggaccttatgtttgtgcagatctcctggacagcctgcttcatgaaatcattgttcttatcaactcattccaggacttccttgcttttactggcacctgccactcttggcgtgcatcagtctcttccttcccgtctgtgtatgctttcaacttcccacctctccaccttgaaccagatggtccttgtgtccctccacatagcagaggtatcaagcccctccgtttgtctaactgcaaatggaagctcagtgaccttaccaagaaaaacttatcccttaaacgttcagtgcctgaaaacaccactccaaatgaaatgaactatctgggctgctcacatgggtatcttatctttacgtataaggtgcactgcctccttgtcgatgcatacactggtgccaaggtgatgccccccaaactcccatgcaacaacaatcttggttactggtctggcattggcatccttatggctccattaagttcacccaactcccgcctcctccttttctcaagggtctccatgtttgagtggcaggttggaacaaacttctggtcagagcatcctctttttcttgagcgtgaacgcatctatcaggttgtgtccttcaaaggtcatatccttgtcatagatgttcttatgaggctttacactatccaactaacacctcagttcagcatgaaagaagtagaagttacgtggaggttcctgcggaagctgcctcttaacccatggttggtggtctgtggtgacatgcttctcatgcttgatctcgcaattgcttctcttcgctcacctggcagctcctttagctttggcaggcccaatggcaccattaggttttttgaggtctttcgccttgacttctcagtgaagccagccaagtgggtacagatggagaagttggaaaaccatgcgctgtttcttagcctggacaggaggaaccctgcattttcttgcatgaaccccgagagatggggaggaaagagtaactgtgtttatgttgccaggctctttgatgatgctaatcaagaagacacatggactgcgctggaggttggtcattcagtgccccaccaccgcatagttgagaccatgatgtatggtatggcattcccaccagactatagtgaaatcggtagcctctggctgttccccagtctggtttatggcactacccagtga

SEQ ID NO: 5506 - protein, 410 aa, Sorghum bicolor
  misc_feature: Ceres ANNOT ID no. 6043911
  misc_feature (13)..(360): NCBI GI: 55295888 NCBI Desc: selenium-binding protein-like [oryza sativa (japonica cultivar-group)]
  misc_feature (94)..(410): NCBI GI: 55295904 NCBI Desc: selenium-binding protein-like [oryza sativa (japonica cultivar-group)]
  misc_feature (6)..(352): NCBI GI: 115465968 NCBI Desc: os06g0111200 [oryza sativa (japonica cultivar-group)]
  misc_feature (21)..(352): NCBI GI: 115465996 NCBI Desc: os06g0113500 [oryza sativa (japonica cultivar-group)]
  misc_feature (123)..(352): NCBI GI: 55295887 NCBI Desc: selenium-binding protein-like [oryza sativa (japonica cultivar-group)]
  misc_feature: Down-regulated in shoot tissues in response to aminocyclopropane carboxylic treatment
MREVTIVEKSGSTSSSSSGPYVCADLLDSLLHEIIVLINSFQDFLAFTGTCHSWRASVSSFPSVYAFNFPPLHLEPDGPCVPPHSRGIKPLRLSNCKWKLSDLTKKNLSLKRSVPENTTPNEMNYLGCSHGYLIFTYKVHCLLVDAYTGAKVMPPKLPCNNNLGYWSGIGILMAPLSSPNSRLLLFSRVSMFEWQVGTNFWSEHPLFLERERIYQVVSFKGHILVIDVLMRLYTIQLTPQFSMKEVEVTWRFLRKLPLNPWLVVCGDMLLMLDLAIASLRSPGSSFSFGRPNGTIRFFEVFRLDFSVKPAKWVQMEKLENHALFLSLDRRNPAFSCMNPERWGGKSNCVYVARLFDDANQEDTWTALEVGHSVPHHRIVETMMYGMAFPPDYSEIGSLWLFPSLVYGTTQ

SEQ ID NO: 5507 - DNA, 381 bp, Sorghum bicolor
  misc_feature: Ceres ANNOT ID no. 6043919
  misc_feature: Encodes the peptide sequence at SEQ ID NO 5508
atggtggtggcgacggccgtcgtggccgcggcggtgctgctgctagcggcagcaacctcctccgaggcgaccgtgacttgcggcctggtgagctccgccatcgggccgtgcatcccctacgcgcgtgcggcgtccggagcctcaaatcggccgcccagtaccaccgctgaccgccgcgccgcctgcaactgcctcaaggccgccgccgccagggtcagcggcctcatcgccggcaacgccgccagcatcccgaccaagtgcggcgtcagcatcccctacaccatcagcccgtccgtcgactgctccaggtctgcatctgcgtccccggccctacaccatcatgcatgcatatgtagtactgactggccggaatatttgtga

SEQ ID NO: 5508 - protein, 126 aa, Sorghum bicolor
  misc_feature: Ceres ANNOT ID no. 6043919
  misc_feature (27)..(101): Pfam Id: Tryp_alpha_amyl Pfam Desc: Protease inhibitor/seed storage/LTP family
  misc_feature (3)..(103): NCBI GI: 1498597 NCBI Desc: phospholipid transfer protein [zea mays]
  misc_feature (3)..(103): NCBI GI: 75994109 NCBI Desc: phospholipid transfer protein 2 [zea mays subsp. parviglumis]
  misc_feature (3)..(103): NCBI GI: 75994115 NCBI Desc: phospholipid transfer protein 2 [zea mays subsp. parviglumis]
  misc_feature (3)..(103): NCBI GI: 75994133 NCBI Desc: phospholipid transfer protein 2 [zea diploperennis]
  misc_feature (3)..(103): NCBI GI: 75994137 NCBI Desc: phospholipid transfer protein 2 [zea diploperennis]
MVVATAVVAAAVLLLAAATSSEATVTCGLVSSAIGPCIPYARAASGASNRPPSTTADRRAACNCLKAAAARVSGLIAGNAASIPTKCGVSIPYTISPSVDCSRSASASPALHHHACICSTDWPEYL

SEQ ID NO: 5509 - DNA, 2430 bp, Sorghum bicolor
  misc_feature: Ceres ANNOT ID no. 6043922
  misc_feature: Encodes the peptide sequence at SEQ ID NO 5510
atggtggacatcagcgagtgctcgccggtgccggagtccgtaccggcgcacccggacccggcgtccgtgtccccggacgcgtggcggcgcttcgagaccgccgcgctcgccgtggtcaacaagatccagcccaccgccgcctccgagcaactccgcgccgccgtcatcgagtacgtccagcgcctcttctggttccaagctcggtatcaggtctttccatttggatctgttccattgaaaacatatcttcctgatggagatattgacttgacattattcggccctgcgatttctgatgagaatctagcaaatgaagtatgtgctattctaaaatcggaagagcgaaggaaagattctgaatttgaagtcaaggatgtccattatgtccctgctgaggtcaagctggttaaatgtttggtacaaaacattgtcgtagacatctcagttaatcagattggtgggctgtgcacactatgttttcttgagaaggtcgatcaaaactttggtaagaatcacctgtttaagagaagcataatgcttgtcaaagactggtgctattacgaaagccgtattcttggtgcccatcatggtctaatatcaacatatgccttggagactttagttttatacattttccatatcttccacaagtctttggatggtccattggctgtcctctatagatttcttgactattatagtaaattcgattgggacaataaggggatcagcttgtttggacctgtttccttatcttcactacctgagctagttactgacccaccagatacccaagatgatgattttcttcaacgagaggagtttctaaaagaatgcacagagtcttttagtgttctccctagaaactccgagacaaatcctagagtattctcacgaagatttcttaatatagttgatccactaaagcagagtaataaccttggacgcagtgtcagtaaaggaaacttttaccggatacgcagcgcatttgattttggtgctcgtaagcttggcaagattcttcaagtgccttcttgtctcactgtcagtgaagtcaatcagtttttcaggaacactctaaagagaaaccgtactggtttaaggccagatgtttgggtgagctcttctgatcttgttacaaatgatcctgtatcatcagtcttagatgtggaaagagtcaacaaggttacgcccagcaattcctgcgatgttctgtctaatcagctcagtaacatcaacatttcagattccaacaatcatggcccagtaaagcaaaaagaatgtaactctatggctgaccacaaggagataaaatctgtttcttggggtttgctagatagtgatgccacgagtcacacagctactgattcagtaagtgtgaggggtggtgacgacttctctgaagcttcaccaacacctagtgaaacctggaccttgcaatcagaagccggcaagaaggttgatgttagaaatgacacaatcccatcataccatggggtttcagcaaagcagtttacaggcagatctcaccactatattgacgatacacaacctggaggtaccatcaatgacacagtgccaaatctcactggagatttcgatacaaatttgcataatcttctgtatgcacggggtttccatcaggacaatcctacgactcagttatactatccgatgcctatgccaccacccctgcaatatcagaacatgcacccatcaaatggccatggcagaaaaaatccgtatggatatgctggtaggaatggagttgtccctggtcctgtttatccacctggctattttgtgtataggccattgtatcaagcagatgatcatatggctatgagggctcgtggaacaggcacctactttcctgacccaaacttgcgcaaggaaagaccacctactggacgtggggagagaggaaggaatcattcccatcagaataattatcaaaagtttcaccaccatgcccgaccggatatgcctgtagatatgataccttttgatgaattgaggcatgagtcaccactgcagatatacgctcctagtgcaaatgatcatggaatcccatctccaatgaatataccaataccatcaccatcttcccagtctccaagggatcctttgaacgtaccaatgcattctccatcttcccaggttagaaaggataattttcatggcaatggttttatgctctcgcaagacagtaaacttgagtttgggaccttgggggcgttgccaagggaagttgcctccaaagaccatgctagcagaccaagttctgcctccaacaatcaaggttctgggcctgtgactgtgagccccatgtctgtggtgaaaaacactggaatgggttccaacggaatgaggaatgttcaagcataccgtctcaaggacagtggtgacttcccgccactatccagttga

SEQ ID NO: 5510 - protein, 809 aa, Sorghum bicolor
  misc_feature: Ceres ANNOT ID no. 6043922
  misc_feature (52)..(150): Pfam Id: NTP_transf_2 Pfam Desc: Nucleotidyltransferase domain
  misc_feature (3)..(371): NCBI GI: 79597803 NCBI Desc: nucleic acid binding [arabidopsis thaliana]
  misc_feature (26)..(509): NCBI GI: 115451487 NCBI Desc: os03g0210800 [oryza sativa (japonica cultivar-group)]
  misc_feature (42)..(245): NCBI GI: 94536834 NCBI Desc: pap associated domain containing 5 isoform a [homo sapiens]
  misc_feature (42)..(245): NCBI GI: 119603153 NCBI Desc: pap associated domain containing 5, isoform cra_a [homo sapiens]
  misc_feature (12)..(245): NCBI GI: 81175166 NCBI Desc: topoisomerase 1-related protein cid14 (caffeine-induced death protein 14)
MVDISECSPVPESVPAHPDPASVSPDAWRRFETAALAVVNKIQPTAASEQLRAAVIEYVQRLFWFQARYQVFPFGSVPLKTYLPDGDIDLTLFGPAISDENLANEVCAILKSEERRKDSEFEVKDVHYVPAEVKLVKCLVQNIVVDISVNQIGGLCTLCFLEKVDQNFGKNHLFKRSIMLVKDWCYYESRILGAHHGLISTYALETLVLYIFHIFHKSLDGPLAVLYRFLDYYSKFDWDNKGISLFGPVSLSSLPELVTDPPDTQDDDFLQREEFLKECTESFSVLPRNSETNPRVFSRRFLNIVDPLKQSNNLGRSVSKGNFYRIRSAFDFGARKLGKILQVPSCLTVSEVNQFFRNTLKRNRTGLRPDVWVSSSDLVTNDPVSSVLDVERVNKVTPSNSCDVLSNQLSNINISDSNNHGPVKQKECNSMADHKEIKSVSWGLLDSDATSHTATDSVSVRGGDDFSEASPTPSETWTLQSEAGKKVDVRNDTIPSYHGVSAKQFTGRSHHYIDDTQPGGTINDTVPNLTGDFDTNLHNLLYARGFHQDNPTTQLYYPMPMPPPLQYQNMHPSNGHGRKNPYGYAGRNGVVPGPVYPPGYFVYRPLYQADDHMAMRARGTGTYFPDPNLRKERPPTGRGERGRNHSHQNNYQKFHHHARPDMPVDMIPFDELRHESPLQIYAPSANDHGIPSPMNIPIPSPSSQSPRDPLNVPMHSPSSQVRKDNFHGNGFMLSQDSKLEFGTLGALPREVASKDHASRPSSASNNQGSGPVTVSPMSVVKNTGMGSNGMRNVQAYRLKDSGDFPPLSS

SEQ ID NO: 5511 - DNA, 300 bp, Sorghum bicolor
  misc_feature: Ceres ANNOT ID no. 6043936
  misc_feature: Encodes the peptide sequence at SEQ ID NO 5512
atgccttatacatacacgctgttgtgcttgtgccttgcaggagccgtgtgggcgacggcggtgggcgcgtcggtggcgtacagccggcgccgggccacgagcctgcgcctcatccacgctaggatgcacgcccaggcgctcacactcgccgtcctcggcggagccgcgctcgcgcaccactactacggcaactccggcagcagcagcgagaggcaggaggacctggactacggcttctactcccagctgccgcccgccaccgacgccgacggcaacgagaacgagcgctggagctggtag

SEQ ID NO: 5512 - protein, 99 aa, Sorghum bicolor
  misc_feature: Ceres ANNOT ID no. 6043936
  misc_feature (10)..(64): NCBI GI: 92881101 NCBI Desc: hypoxia induced protein conserved region [medicago truncatula]
  misc_feature (14)..(71): NCBI GI: 70609694 NCBI Desc: hypoxia-responsive family protein [citrus sinensis]
  misc_feature (14)..(74): NCBI GI: 92871677 NCBI Desc: hypoxia induced protein conserved region [medicago truncatula]
MPYTYTLLCLCLAGAVWATAVGASVAYSRRRATSLRLIHARMHAQALTLAVLGGAALAHHYYGNSGSSSERQEDLDYGFYSQLPPATDADGNENERWSW

SEQ ID NO: 5513 - DNA, 969 bp, Sorghum bicolor
  misc_feature: Ceres ANNOT ID no. 6043944
  misc_feature: Encodes the peptide sequence at SEQ ID NO 5514
atggccccagcatcagctgcaacaaaatgcagcagcagctgcagcgccagcggcctcgctctgctgttgctcctcgtgctaatggcggccggcacctcgtcggcgcagctgtccaccagcttctactcctcctcgtgccccggcgtgtacgactccgtcaagtcggcgatacaatccgccatcgccaccgagcagcgcatgggcgcctccatcgtccgcctcttcttccacgactgcttcgtccaaggctgcgacgcgtcgctgctgttggacgacacggccagctttcagggcgagaagatggcgacgcccaacaacggctccgtgcgaggcttcgaggtcatcgatgccgtcaagtccgccgtcgagaaggtgtgccccggcgtcgtctcctgtgctgacatcctcgccatcgctgctagggacagcgtcgtcatactgggtggtccaagctgggacgtcaaggtcgggcgcggcgccaacaacaacatcccgccgccgacgtcgggcctcgccaacctcacctcgctcttcgccgcgcagggcctctctcaaaaggacatggtcgcgctctctggagctcacaccattggccaagcacgttgcaccaacttcagagctcacgtatacaatgacactaacatcgatggcaccttcgcaagaacaaggcaatcaggctgccctagaacctcaggttcaggtgacaacaatttggcgcctctggaccttcaaaccccaaccgtctttgagaacaactactacaagaaccttgtttgcaagaaggggcttctacactccgaccaggagctcttcaatggcggagccaccgatgcgcaagttcaatcatacattagtagccagagcacattcttctcggattttgtgacaggcatgataaagatgggtgacatcacaccgttgaccggctccaatggacagatcaggaagaactgcagaatgattaactaa

SEQ ID NO: 5514 - protein, 322 aa, Sorghum bicolor
  misc_feature: Ceres ANNOT ID no. 6043944
  misc_feature (53)..(286): Pfam Id: peroxidase Pfam Desc: Peroxidase
  misc_feature (12)..(322): NCBI GI: 28400798 NCBI Desc: peroxidase [asparagus officinalis]
  misc_feature (21)..(322): NCBI GI: 5381253 NCBI Desc: peroxidase [nicotiana tabacum]
  misc_feature (31)..(322): NCBI GI: 28400796 NCBI Desc: peroxidase [asparagus officinalis]
  misc_feature (8)..(322): NCBI GI: 32351452 NCBI Desc: class iii peroxidase [gossypium hirsutum]
  misc_feature (19)..(322): NCBI GI: 28400794 NCBI Desc: peroxidase [asparagus officinalis]
  misc_feature (21)..(322): SWISSPROT Homolog: EC 1.11.1.7 Peroxidase 52 precursor
  misc_feature: Useful for making plants with altered cell wall content and/or composition
  misc_feature: Functional homolog of the protein sequence encoded by LOCUS at1g14550
  misc_feature: Functional homolog of the protein sequence encoded by LOCUS at1g68850
  misc_feature: GREAT-hit functional homolog of the protein sequence encoded by LOCUS at5g05340
  misc_feature: Functional homolog of the protein sequence encoded by LOCUS at5g58390
  misc_feature: Functional homolog of the protein sequence encoded by LOCUS at5g58400
  misc_feature: Useful for making plants with altered cell wall content and/or composition
  misc_feature: Functional homolog of the protein sequence given in SEQ ID NO 13605
  misc_feature: Useful for making plants with altered carbohydrate content
  misc_feature: Functional homolog of the protein sequence given in SEQ ID NO 13662
  misc_feature: Useful for making plants with modulated oxidative stress sensitivity
  misc_feature: Functional homolog of the protein sequence given in SEQ ID NO 13607
MAPASAATKCSSSCSASGLALLLLLVLMAAGTSSAQLSTSFYSSSCPGVYDSVKSAIQSAIATEQRMGASIVRLFFHDCFVQGCDASLLLDDTASFQGEKMATPNNGSVRGFEVIDAVKSAVEKVCPGVVSCADILAIAARDSVVILGGPSWDVKVGRGANNNIPPPTSGLANLTSLFAAQGLSQKDMVALSGAHTIGQARCTNFRAHVYNDTNIDGTFARTRQSGCPRTSGSGDNNLAPLDLQTPTVFENNYYKNLVCKKGLLHSDQELFNGGATDAQVQSYISSQSTFFSDFVTGMIKMGDITPLTGSNGQIRKNCRMIN

SEQ ID NO: 5515 - DNA, 330 bp, Sorghum bicolor
  misc_feature: Ceres ANNOT ID no. 6043960
  misc_feature: Encodes the peptide sequence at SEQ ID NO 5516
atggagaggattagctcgtccctgcagtcgtgggtggaggaacacaagctctcaaccatcggagccttgtgggcgacggcggtgggcgcgtcggtggcgtacagccggcgtcgggcgccggcgcgtgccacgagcctgcgcctcagccacgccaggatgcacgcccaggcgctcacactcgccgtcctcggcggagccgcgctcgcgcaccactactccggcagcagcgccgggaagcagcggcaggaggagctggactacggcttctactcccagctgccgccggccaccgacgccgacggcaacgagaacgagcgctggagctggtag

SEQ ID NO: 5516 - protein, 109 aa, Sorghum bicolor
  misc_feature: Ceres ANNOT ID no. 6043960
  misc_feature (7)..(72): NCBI GI: 92881101 NCBI Desc: hypoxia induced protein conserved region [medicago truncatula]
  misc_feature (7)..(81): NCBI GI: 92871677 NCBI Desc: hypoxia induced protein conserved region [medicago truncatula]
  misc_feature (7)..(79): NCBI GI: 70609694 NCBI Desc: hypoxia-responsive family protein [citrus sinensis]
  misc_feature (1)..(40): NCBI GI: 3282394 NCBI Desc: anaerobically inducible early gene 2 [oryza sativa]
MERISSSLQSWVEEHKLSTIGALWATAVGASVAYSRRRAPARATSLRLSHARMHAQALTLAVLGGAALAHHYSGSSAGKQRQEELDYGFYSQLPPATDADGNENERWSW

SEQ ID NO: 5517 - DNA, 834 bp, Sorghum bicolor
  misc_feature: Ceres ANNOT ID no. 6043961
  misc_feature: Encodes the peptide sequence at SEQ ID NO 5518
atggactgctgcatctgcagccccatggcagccgtgtacaggcttccgaggaacgccatctgtgctccctgccatgagggcgccaaggccatcatcggatttctgaacaaggatgatgagcatcagcatgaagaagagggcagcctgagccatggctctgtgctcaagtccagagggtctgtcaagcctaacagcccaaccaaggggatgagagacgcgtgggagcaggtgaaggagatgagaggcagggaggaggaggcccaccagagagccgccttcctggcgatggcgtggaaggagggagtccacaccgacatcgtcgtgaaaccaggcactgggcccccaattccggcccacaaagccatcctggccgcgaggtcggaggtgttccgccacatgctggccgccgacgagcgctgcaaggcccccgccggcgacgccatctccctcccggagctgacccacggcgagctcgacctcttcctcgccttcctctacaccggcgcgctggagaacaacaaggacgacgacggggatcatcagctgcacgcgctcctcgtggcggccgacaagtacgacgtgccgttcctgcggcgggcatgcgaggcgcggctggcggccgccgtggacgcctccaacgtgctgcggacgctggaggtcgccgacctgagctccagcgcggcgctcagggagcgcgccatggacacgctggtgcaccacgccgagcaggtggtgttctcgcccgagtacgacgacttcgccgtcaggaacgccgggctgtgcgtcgagatcacccgggcgctgctgggcaagatgaagaccgcaccgttgtag

SEQ ID NO: 5518 - protein, 277 aa, Sorghum bicolor
  misc_feature: Ceres ANNOT ID no. 6043961
  misc_feature (94)..(209): Pfam Id: BTB Pfam Desc: BTB/POZ domain
  misc_feature (1)..(273): NCBI GI: 92881102 NCBI Desc: btb/poz [medicago truncatula]
  misc_feature (86)..(273): NCBI GI: 8671833 NCBI Desc: contains similarity to the speckle-type poz protein from homo sapiens gbaj000644. it contains a btb/poz domain pf00651. [arabidopsis thaliana]
  misc_feature (84)..(273): NCBI GI: 92874921 NCBI Desc: btb/poz; traf-like [medicago truncatula]
  misc_feature (72)..(275): NCBI GI: 56381961 NCBI Desc: at4g08455 [arabidopsis thaliana]
  misc_feature (94)..(255): NCBI GI: 42408860 NCBI Desc: poz domain protein family-like [oryza sativa (japonica cultivar-group)]
MDCCICSPMAAVYRLPRNAICAPCHEGAKAIIGFLNKDDEHQHEEEGSLSHGSVLKSRGSVKPNSPTKGMRDAWEQVKEMRGREEEAHQRAAFLAMAWKEGVHTDIVVKPGTGPPIPAHKAILAARSEVFRHMLAADERCKAPAGDAISLPELTHGELDLFLAFLYTGALENNKDDDGDHQLHALLVAADKYDVPFLRRACEARLAAAVDASNVLRTLEVADLSSSAALRERAMDTLVHHAEQVVFSPEYDDFAVRNAGLCVEITRALLGKMKTAPL

SEQ ID NO: 5519 - DNA, 522 bp, Sorghum bicolor
  misc_feature: Ceres ANNOT ID no. 6043984
  misc_feature: Encodes the peptide sequence at SEQ ID NO 5520
atgtcaggaaaggagaagaaactactccagcttctgcgctccgtcacaaagtcaagtgcggcaaacgggacgtcaatcttagtagacgcgtcgaaatacatcaaggagctcaaggacaaagtggaagcagcctcatcatcacaagctgacactgacactagtagtgcttttggttcaggaagtgccatgccagcaacggtgagtgtctcagcagtggagctggataacagcagccgaagaagaggattcaggatcaacgtgtcgatggagaggagccggcctgggctgctggtgtccgtgctggaggccttggaggacctcggcctcgacgtcctggacgccgacgtctcctgcaccgacgacaccgccttccgcttccaagcgcttggcggatcatcaggccagggcctgcagcagcagcagcagcagcaggaggaggccggaggaagcgtggacgaacaaatggttcagcatgcggtcttgcaggccatcaccaaatgcatggacgatgacgatgagtag

SEQ ID NO: 5520 - protein, 173 aa, Sorghum bicolor
  misc_feature: Ceres ANNOT ID no. 6043984
  misc_feature (83)..(146): Pfam Id: ACT Pfam Desc: ACT domain
  misc_feature (89)..(169): NCBI GI: 115483803 NCBI Desc: os11g0111800 [oryza sativa (japonica cultivar-group)]
  misc_feature (1)..(81): NCBI GI: 115483801 NCBI Desc: os11g0111700 [oryza sativa (japonica cultivar-group)]
  misc_feature (57)..(141): NCBI GI: 75706692 NCBI Desc: inducer of cbf expression 2 [hordeum vulgare subsp. vulgare]
  misc_feature (57)..(141): NCBI GI: 74136905 NCBI Desc: inducer of cbf expression 2 [hordeum vulgare subsp. vulgare]
  misc_feature (57)..(141): NCBI GI: 75706690 NCBI Desc: inducer of cbf expression 2 [hordeum vulgare subsp. vulgare]
  misc_feature: The plant is abnormally small.
  misc_feature: Useful for making plants with modulated biomass
  misc_feature: Functional homolog of the protein sequence given in SEQ ID NO 13549
MSGKEKKLLQLLRSVTKSSAANGTSILVDASKYIKELKDKVEAASSSQADTDTSSAFGSGSAMPATVSVSAVELDNSSRRRGFRINVSMERSRPGLLVSVLEALEDLGLDVLDADVSCTDDTAFRFQALGGSSGQGLQQQQQQQEEAGGSVDEQMVQHAVLQAITKCMDDDDE

SEQ ID NO: 5521 - DNA, 2076 bp, Sorghum bicolor
  misc_feature: Ceres ANNOT ID no. 6044018
  misc_feature: Encodes the peptide sequence at SEQ ID NO 5522
atggcagcccaccagcagcagcagcaccggcaccccaagcgccgtcgcctcgcgctctccctctccccatcccccacccctgccgccgccgccgccgcgccgccgctcgactcgctggccgacgagctgctcttcctggtgctggaccgcgtggcccaggccgacccgcgggcgctcaagtccttcgctttggcctcgcgcgcctgccacgccgcggagtcccggcaccgccgcgtcgtccgcccgctccgcgcggacctcctccccgccgcgctggcgcggtacccgtgcgccacccgcctcgacctctccctctgcgcgcgcgtccccgacgccgccctcgcctccgccgtcgtctccggttcctcctccctccgcgccgtcgacctctcccgctcccgcgggttcggctcggcaggcgtggccgcgctcgccgcgtcgtgcccgggcctagccgacctcgacctctccaatggggtcgacctcggggacgccgcggccgccgaagtggcgcgggcgaagggcctccggaggctgtcgctggctaggtggaagccgctgaccgatatggggctcgggtgcgtcgccgtcggctgtatggagctcagggagctctcgctcaagtggtgccttggggtctcggatctggggatccagctcctcgcactcaagtgcaggaagctcaccagcctggatctctcctacaccatgatcacaaaggatagctttcctcccatcatgaagctacccaatcttcaagagttgacactggtggggtgtattggaattgatgatgacgcccttggcagccttcagaaagaatgcagtaaatcactacaggtgcttgatctgtctcactgtcagaatatcactgatgtgggagtttcatccatactgaagttggtacccaatctattcgaactggatctttcatactgctgtcctgtcaccccttctatggtgcgaagcttccagaagattcctaaactgcggaccctgaagctggaaggctgcaaattcatggttgatggactaaaagctattggaacctcatgtgtttctttaaaggagttaaacttgagcaagtgctctggaatgacggatacagaattctcttttgctatgtcaagactaaagaacctgctgaagctggacattacttgttgtcgaaatatcactgatgtttcactagcggccatgactagttcatgcacttccctcatctctctgaggatggagtcttgtagccgtgtttccagtggagcactccaactgatcgggaaacactgttctcacttggaacagctggaccttactgacagtgatttggatgacgaaggattgaaagctctttccagatgcggcaaactttcaagtctaaaaattggcatttgcttgaagataagtgatgaaggtcttacccacattggaaggtcctgcccaaatctccgcgacattgatttgtacaggtgtggaggcctcagtgatgatggaattattccaattgcgcagggttgtcccatgctagagtctatcaatctatcctactgtacagaaataacggaccgttcactgatttcactttcaaaatgcacaaagctgaatactctggagattcgtggctgccccatgattacatccactgggctctcagaaatagcaatggggtgcaggctactttccaagcttgatattaagaaatgctttgaggttaatgatgtgggaatgctttacctttcccagttctctcatagcctccgtgagataaacttgtcatactgttcagtcaccgatattgggcttctttccctttctagcatatctggcttgcagaacatgaccattgtccatttagcgggtataacgcctaatggcttgacagctactcttatggtttgtggttgtttgacgaaagtgaagcttcatgaagcattcaaatccatgatgccgcctcatatgataaaaaatgttgaggcacgcgggtgtgttttccagtggatcgataaaccattcaaggttgaagtggaaccttgtgatgtatggaagcaacagtcccaagatgtgcttgtacggtga

SEQ ID NO: 5522 - protein, 691 aa, Sorghum bicolor
  misc_feature: Ceres ANNOT ID no. 6044018
  misc_feature (39)..(666): NCBI GI: 92879669 NCBI Desc: leucine-rich repeat; leucine-rich repeat, cysteine-containing subtype [medicago truncatula]
  misc_feature (257)..(666): NCBI GI: 144923780 NCBI Desc: leucine-rich repeat; leucine-rich repeat, cysteine-containing [medicago truncatula]
  misc_feature (330)..(670): NCBI GI: 115488994 NCBI Desc: os12g0552700 [oryza sativa (japonica cultivar-group)]
  misc_feature (39)..(643): NCBI GI: 77552216 NCBI Desc: f-box protein family, atfbl4 [oryza sativa (japonica cultivar-group)]
  misc_feature (187)..(647): NCBI GI: 115486415 NCBI Desc: os11g0641200 [oryza sativa (japonica cultivar-group)]
MAAHQQQQHRHPKRRRLALSLSPSPTPAAAAAAPPLDSLADELLFLVLDRVAQADPRALKSFALASRACHAAESRHRRVVRPLRADLLPAALARYPCATRLDLSLCARVPDAALASAVVSGSSSLRAVDLSRSRGFGSAGVAALAASCPGLADLDLSNGVDLGDAAAAEVARAKGLRRLSLARWKPLTDMGLGCVAVGCMELRELSLKWCLGVSDLGIQLLALKCRKLTSLDLSYTMITKDSFPPIMKLPNLQELTLVGCIGIDDDALGSLQKECSKSLQVLDLSHCQNITDVGVSSILKLVPNLFELDLSYCCPVTPSMVRSFQKIPKLRTLKLEGCKFMVDGLKAIGTSCVSLKELNLSKCSGMTDTEFSFAMSRLKNLLKLDITCCRNITDVSLAAMTSSCTSLISLRMESCSRVSSGALQLIGKHCSHLEQLDLTDSDLDDEGLKALSRCGKLSSLKIGICLKISDEGLTHIGRSCPNLRDIDLYRCGGLSDDGIIPIAQGCPMLESINLSYCTEITDRSLISLSKCTKLNTLEIRGCPMITSTGLSEIAMGCRLLSKLDIKKCFEVNDVGMLYLSQFSHSLREINLSYCSVTDIGLLSLSSISGLQNMTIVHLAGITPNGLTATLMVCGCLTKVKLHEAFKSMMPPHMIKNVEARGCVFQWIDKPFKVEVEPCDVWKQQSQDVLVR

SEQ ID NO: 5523 - DNA, 237 bp, Sorghum bicolor
  misc_feature: Ceres ANNOT ID no. 6044037
  misc_feature: Encodes the peptide sequence at SEQ ID NO 5524
atggaggcgaaatatgttgttctatgcttcctcgtagtgcttgtcttacatggagatcctacttttgctgaaacttgcaggcaatttgttaaagtgcacccattctgctttaaggcttactgcaaggcaaattgttatttggagggaaaattctccgatggttcctatgcaaaggaatatcattgcttaggagatccaattcactccctatgcatttgcactttgtgcaaaaattag

SEQ ID NO: 5524 - protein, 78 aa, Sorghum bicolor
  misc_feature: Ceres ANNOT ID no. 6044037
  misc_feature: Useful for making plants with modulated salt sensitivity
  misc_feature: Functional homolog of the protein sequence given in SEQ ID NO 13500
  misc_feature: Useful for making plants with modulated salt sensitivity
  misc_feature: Functional homolog of the protein sequence given in SEQ ID NO 13500
MEAKYVVLCFLVVLVLHGDPTFAETCRQFVKVHPFCFKAYCKANCYLEGKFSDGSYAKEYHCLGDPIHSLCICTLCKN

SEQ ID NO: 5525 - DNA, 366 bp, Sorghum bicolor
  misc_feature: Ceres ANNOT ID no. 6044050
  misc_feature: Encodes the peptide sequence at SEQ ID NO 5526
atgccgtgcctgaacgtgtcgaccaacgtgaacctggagggggtggacacctccgccatcctcgccgaagcctccaagtccgtcgccgacatcatcggcaagccagaggcctatgtgatggttgttctcaaaggttcagttcctatggcatttggaggtacccaggagcctgcagcttacggtgagctcgtttccatcggaggcctgagccctaatgtgaataagaagcttagtgctggcattgcttctatcctggagtcaaagctgtctgttcccaagtcgcgcttctacctcaagttcaatgactcaaaggctaatcctgcacaagaaaatgctcaatgtttgcatgctttgcatcaagaatag

SEQ ID NO: 5526 - protein, 121 aa, Sorghum bicolor
  misc_feature: Ceres ANNOT ID no. 6044050
  misc_feature (2)..(116): Pfam Id: MIF Pfam Desc: Macrophage migration inhibitory factor (MIF)
  misc_feature (1)..(104): NCBI GI: 115486916 NCBI Desc: os12g0107500 [oryza sativa (japonica cultivar-group)]
  misc_feature (1)..(106): NCBI GI: 20148493 NCBI Desc: light-inducible protein atls1 [arabidopsis thaliana]
  misc_feature (1)..(106): NCBI GI: 5869758 NCBI Desc: at-ls1 product [arabidopsis thaliana]
  misc_feature (1)..(104): NCBI GI: 140041566 NCBI Desc: macrophage migration inhibitory factor [medicago truncatula]
  misc_feature (1)..(102): NCBI GI: 140041567 NCBI Desc: macrophage migration inhibitory factor [medicago truncatula]
MPCLNVSTNVNLEGVDTSAILAEASKSVADIIGKPEAYVMVVLKGSVPMAFGGTQEPAAYGELVSIGGLSPNVNKKLSAGIASILESKLSVPKSRFYLKFNDSKANPAQENAQCLHALHQE

SEQ ID NO: 5527 - DNA, 1647 bp, Sorghum bicolor
  misc_feature: Ceres ANNOT ID no. 6044051
  misc_feature: Encodes the peptide sequence at SEQ ID NO 5528
atggtgacctcgccgctggtgacggtgagggcggctgccttcgctctcaccctgaccccgtcatcacggctcagccgcgcctcctttcgcgcctgcctcgcacagcgtcgccgccgccgttggccccctcgatgtagcgggaagcaagctgccgtggtcgaggaggaaacaccatctccgcaggaggccaagaacggcgagggggaacaggggcgcgggccgcagggatggtttgctctggatacgatcgggctggacattctcagcatcgccctgcccgccgccctcgcgctcgccgccgaccccatcgcggcgctcgtcgacaccgccttcgtcggtcacataggttctgccgaacttgctgctgttggtgtatcaatttcagtgttcaatttggtgtcaaagctgtttaatgtgcccttgcttaacgtgaccacatcctttgttgctgagcagcaggcagtggatgatgattctgctgggtcaagagaaggatacgactttccaaggtctcctgaggagttgacccagaaaaggaagtttcttccagcagtatcaacatcactggctttagctgctggtattgggctgatggaaactgtggcactgaattttggatcaggaacactaatggacatgatcggcatacctattgattctccaatgcgaataccagctgagcaatttcttacatttagggcatatggtgctccaccgattgtgatagcacttgctgcacagggtgcatttcgtgggctcatggatacgaaaacacctttatatgctgtgggtgttggcaacctcataaacgtcatacttgacgccatacttgtttttccacttggtttaggagttagaggtgctgccttggcaacagtgacctcagagtatgtgattgcttgcatcctcctctggaagctgaatagtaaagtagtactcttttcccgaaatgtaattggtggtggaatcatacgttatctaaaatcaggtggacttctgattggcaggactattgcagtactcctgaccatgacactgtcgacatcgctggctgcaagacaagggcctgttccaatggccggccatcagttgtgcttgcaagtgtggctgacaatttctctgctcaatgatgcgctagctctggctgggcaggctctacttgcgagtgaatatgcaaaagggaattacaagcaggctcgtttggttttatacagagttctgcagattggaggtgtaactggaattgcactggctgtggttctgttctttgggtttgggtctttctctgtgctgttcacaaatgatcgggcagttttagacattgccaaatctggagtctggtttgtcactgtttctcagccaataaatgctattgcattcgtgatcgacgggctgtactatggcgtgtctgacttcgcctatgctgcatactctatgttctttgttggggctgtttcatcagcattcctacttgctgctgctcctaagcttggtcttggtggtgtttggtctggtctagttctttttatgagcttgagagcagcggctggattttggaggttagggagcaaaggtggaccatggaagcaaatctggttagggagcaaaggtggaccttgggaggctatctggtcagatagtgagtaa

SEQ ID NO: 5528 - protein, 548 aa, Sorghum bicolor
  misc_feature: Ceres ANNOT ID no. 6044051
  misc_feature (93)..(276): Pfam Id: MatE Pfam Desc: MatE
  misc_feature (333)..(490): Pfam Id: MatE Pfam Desc: MatE
  misc_feature (86)..(520): NCBI GI: 42567508 NCBI Desc: mate efflux protein-related [arabidopsis thaliana]
  misc_feature (178)..(528): NCBI GI: 42571819 NCBI Desc: mate efflux family protein [arabidopsis thaliana]
  misc_feature (178)..(528): NCBI GI: 42562670 NCBI Desc: mate efflux family protein [arabidopsis thaliana]
  misc_feature (171)..(528): NCBI GI: 115451571 NCBI Desc: os03g0216700 [oryza sativa (japonica cultivar-group)]
  misc_feature (170)..(529): NCBI GI: 92877171 NCBI Desc: multi antimicrobial extrusion protein mate [medicago truncatula]
MVTSPLVTVRAAAFALTLTPSSRLSRASFRACLAQRRRRRWPPRCSGKQAAVVEEETPSPQEAKNGEGEQGRGPQGWFALDTIGLDILSIALPAALALAADPIAALVDTAFVGHIGSAELAAVGVSISVFNLVSKLFNVPLLNVTTSFVAEQQAVDDDSAGSREGYDFPRSPEELTQKRKFLPAVSTSLALAAGIGLMETVALNFGSGTLMDMIGIPIDSPMRIPAEQFLTFRAYGAPPIVIALAAQGAFRGLMDTKTPLYAVGVGNLINVILDAILVFPLGLGVRGAALATVTSEYVIACILLWKLNSKVVLFSRNVIGGGIIRYLKSGGLLIGRTIAVLLTMTLSTSLAARQGPVPMAGHQLCLQVWLTISLLNDALALAGQALLASEYAKGNYKQARLVLYRVLQIGGVTGIALAVVLFFGFGSFSVLFTNDRAVLDIAKSGVWFVTVSQPINAIAFVIDGLYYGVSDFAYAAYSMFFVGAVSSAFLLAAAPKLGLGGVWSGLVLFMSLRAAAGFWRLGSKGGPWKQIWLGSKGGPWEAIWSDSE

SEQ ID NO: 5529 - DNA, 1545 bp, Sorghum bicolor
  misc_feature: Ceres ANNOT ID no. 6044071
  misc_feature: Encodes the peptide sequence at SEQ ID NO 5530
atggcagacaccgacccccctccctccgtcacccacgacgatgacgaggatgatgacgatgaagaattcgatgacgacctggatgacgaagccgacgacggcggcgaacccccggcgtcctcatccgaggcggctcgcctcgaggccgtgctccggcggctgacggcggacgaggtccggatccgggtgcaccaggtcacgatccggggctgcgaccgcacgcgccgcgccgcggtcgaggcggcggtcggcttggacctcgcgcgcgctgccactgtgcgggacctcgtgcgcgccgccgccgcggccggcgaccggctccgtcgcctcggcgccttcgacactgtctccatcaccctcgacgcggcgccgcctgggatccccggtagcgccgtcgtcgtcctcgttgacgtcgcggaggcccgaggtcgcgctgccggtgattttggcgtcttcgcccacacgcagactagatcatgctcacttgaaggttcagtgaagttgaagaacctatttggattctgtgagacctgggatgcatcaggcgctcttgaattagataagacagcagaactaagtgctggagtccaaatgcctagaatcggagcaataccaactccgctagtggctagaatatcatttctgtctgatgactggttaaagtcctcgctcaaagaacacctgatgggcgtttctgttggcttgctctccaccatgaaccacaaccttgcttacaatttgacatggagaaaattaactgatccaactcgcatgtcatccaattccgtacaggaggaattaggacatagccttttgtcctctataaagtacgcatacaaggttgaccaaagggactcaagcataagacctacacgtggatatgcttttctgtcgtcttctcaagttggaggccttgcaccagggagcaaatattcacgatttcttaggcaggaatttgatgttcgtgtggctttgcctctgggtgtgctgaatggcgctctcaatgccggagtggctgcgggagtcatccatccattggaaaggggatccacaggatctgtctcaccacttttagaaagattttacttgggtggtaataggcctcttgtatgccgcttgggtggaccatcttcactattaggcttcaaaacaagaggactgggggcaacagaatccagaacatatgaccccaataattctgacaatggcacttccagttctcctgagctaaatggacttggaggtgacatagcagtgacagcctttgccgacctgtcatttgatctgcctctgaagccgctcagggagctgggaattcatggccatgcctttgtctgtgctggaaatcttggtaaattaactgagtgtgatctaaggaagttccctgttactgacttcctacaaacattcagaagttctgcaggattcggcgtagttgtgccaaccagactgttccgcatagagatgaattactgctacatcctaaaacagcttgatcatgacaaggggaagacaggcatacagtttaacttttcatcgccctaa

SEQ ID NO: 5530 - protein, 514 aa, Sorghum bicolor
  misc_feature: Ceres ANNOT ID no. 6044071
  misc_feature (170)..(515): Pfam Id: Bac_surface_Ag Pfam Desc: Surface antigen
  misc_feature (1)..(514): NCBI GI: 115483753 NCBI Desc: os11g0106200 [oryza sativa (japonica cultivar-group)]
  misc_feature (158)..(514): NCBI GI: 144923817 NCBI Desc: bacterial surface antigen (d15) [medicago truncatula]
  misc_feature (25)..(365): NCBI GI: 38014784 NCBI Desc: mgc68698 protein [xenopus laevis]
  misc_feature (25)..(365): NCBI GI: 28436784 NCBI Desc: cgi-51-prov protein [xenopus laevis]
  misc_feature (63)..(365): NCBI GI: 38511778 NCBI Desc: cgi-51 protein [xenopus tropicalis]
MADTDPPPSVTHDDDEDDDDEEFDDDLDDEADDGGEPPASSSEAARLEAVLRRLTADEVRIRVHQVTIRGCDRTRRAAVEAAVGLDLARAATVRDLVRAAAAAGDRLRRLGAFDTVSITLDAAPPGIPGSAVVVLVDVAEARGRAAGDFGVFAHTQTRSCSLEGSVKLKNLFGFCETWDASGALELDKTAELSAGVQMPRIGAIPTPLVARISFLSDDWLKSSLKEHLMGVSVGLLSTMNHNLAYNLTWRKLTDPTRMSSNSVQEELGHSLLSSIKYAYKVDQRDSSIRPTRGYAFLSSSQVGGLAPGSKYSRFLRQEFDVRVALPLGVLNGALNAGVAAGVIHPLERGSTGSVSPLLERFYLGGNRPLVCRLGGPSSLLGFKTRGLGATESRTYDPNNSDNGTSSSPELNGLGGDIAVTAFADLSFDLPLKPLRELGIHGHAFVCAGNLGKLTECDLRKFPVTDFLQTFRSSAGFGVVVPTRLFRIEMNYCYILKQLDHDKGKTGIQFNFSSP

SEQ ID NO: 5531 - DNA, 1644 bp, Sorghum bicolor
  misc_feature: Ceres ANNOT ID no. 6044110
  misc_feature: Encodes the peptide sequence at SEQ ID NO 5532
atggccggcggcgacgacctggccgcactccacgagcaggtcgccctcgcatcctccgccgccatctccgcctccgatctcgacctcgcattccaactccaggtcgccgaggccatccaagcctcgctccgctcgcacaatgccgccgccccatcatcttcgtcgcaggccgcccccgtcctccccgtccccgagccctcctccgacgccgcctacgccttcgcggtccaggccgccgacctcacgcgcgccgagcaggaccgccgcgacgccgaggcctgccgcgccgcccaagcccgggtcgccgcctccgcccgcatcgccgcgcacgacgccctcttcgcccgcgacctcgccgccatccccgaggatcaatgggcccacgacggcgactacttcgagcgccccgtcgactcctcgccccgcccgctgttccgcgtcttctccaagggtatgccgagcagggacgtcgtgggcccgcggaaccgggatcccagcgtcgccgtgctcgcggtggctgtctccaggacgcagggtggggtggtgctcaggatacagaagccggtggagcgctttgtgggcggccgcatgattgtggaggtgatggcgctgatggagggcctcgacgccgccctgggattgggcatccgcagtgtcaccgtcgtcactggttaccgcccactctacaaccatatgcttggcatttggcgcccatctgggaagaagctggcagatatgatgaatcaggttctgtcagtccgaaagaagtttgatcaatgtgaagtctcacttgttgagccaagccaagtcagctatgtcgtaaaattagcaacagattcactaactgttcagatcgccaaagctcttgctgccaatgctagcaaggagaaaagagaaagctgcgccatctgcttggaagacactgacattaccaaaatccatgtggttgaaggttgtgcacaccacttctgcttctcgtgcatgaaggagcatgtgaaagttaagctgctcaatggaactctcccagcttgcccacaagagggatgcaccacaaagctaagtgtggagggttcaagggtatttctttcgccacggctgttagagatcatggtgcaacgcacgagggaaggacagatccctccaggccaaaagatttactgtccatatcccaagtgttcagccttgatgtccttgggggaagtgatccatccgatgcaagagtcctcctcaaggtacacagctgctgatgctgccacattgaggaagtgtgtgaaatgcagaggctccttttgcttgagctgtaaagtcccatggcatgatagcatgagttgctatgagtacaagatgaggtacccccacgctcgcccagaagatgcaaaattacagaacctggcaaggcagaggctgtggcgccaatgtgtgaaatgcaaacacatgatcgaacttgcagagggctgctaccacatgatctgcgtgtgcggctatgagttctgctacacatgtgggaaagagtggaagaataagaaagcaagctgctcctgcccgctgtgggatgaacgcaacatcatcagagaggaagacgatgatgactacgaggaagacgatgatgactacgaggaagacgatgatggtctttactactag

SEQ ID NO: 5532 - protein, 547 aa, Sorghum bicolor
  misc_feature: Ceres ANNOT ID no. 6044110
  misc_feature (372)..(444): Pfam Id: IBR Pfam Desc: IBR domain
  misc_feature (7)..(538): NCBI GI: 92880897 NCBI Desc: zinc finger, ring-type; zinc finger, c6hc-type [medicago truncatula]
  misc_feature (144)..(508): NCBI GI: 42569316 NCBI Desc: zinc finger protein-related [arabidopsis thaliana]
  misc_feature (249)..(543): NCBI GI: 91806936 NCBI Desc: zinc finger protein-like protein [arabidopsis thaliana]
  misc_feature (249)..(543): NCBI GI: 9757966 NCBI Desc: mutator-like transposase [arabidopsis thaliana]
  misc_feature (249)..(543): NCBI GI: 145358583 NCBI Desc: zinc ion binding [arabidopsis thaliana]
  misc_feature: The sequence is a functional homolog of SEQ ID NO 1727 in the 10/374,780US patent application
  misc_feature: Useful for making plants with modulated growth and phenotype characteristics
  misc_feature: The sequence is a functional homolog of SEQ ID NO 1727 in the 20060162006 US patent application
  misc_feature: The sequence is a functional homolog of SEQ ID NO. 493 in the 11/188,298 US application
MAGGDDLAALHEQVALASSAAISASDLDLAFQLQVAEAIQASLRSHNAAAPSSSSQAAPVLPVPEPSSDAAYAFAVQAADLTRAEQDRRDAEACRAAQARVAASARIAAHDALFARDLAAIPEDQWAHDGDYFERPVDSSPRPLFRVFSKGMPSRDVVGPRNRDPSVAVLAVAVSRTQGGVVLRIQKPVERFVGGRMIVEVMALMEGLDAALGLGIRSVTVVTGYRPLYNHMLGIWRPSGKKLADMMNQVLSVRKKFDQCEVSLVEPSQVSYVVKLATDSLTVQIAKALAANASKEKRESCAICLEDTDITKIHVVEGCAHHFCFSCMKEHVKVKLLNGTLPACPQEGCTTKLSVEGSRVFLSPRLLEIMVQRTREGQIPPGQKIYCPYPKCSALMSLGEVIHPMQESSSRYTAADAATLRKCVKCRGSFCLSCKVPWHDSMSCYEYKMRYPHARPEDAKLQNLARQRLWRQCVKCKHMIELAEGCYHMICVCGYEFCYTCGKEWKNKKASCSCPLWDERNIIREEDDDDYEEDDDDYEEDDDGLYY

SEQ ID NO: 5533 - DNA, 771 bp, Sorghum bicolor
  misc_feature: Ceres ANNOT ID no. 6044112
  misc_feature: Encodes the peptide sequence at SEQ ID NO 5534
atggacgagtgggttcaccaagccgaggtgtgggtgcgccaagccgagagctggatccgccagcagcctacggagcagatctatatcgccgccgcggtggttgccctcacaatcctgctgcttatcgtagcatcttgtctgaaatcctcgaagccaaatactatagtgctatccggccttagtggcagtggcaaaactactattttctaccagcttcgggatggatcatcacatcaaggaactgtgacttcaatggaagaaaacaatgacacatttgtactgcattcagagcaagaaaggaaaggcaaagtaaaacctgtgcatgttgttgatgtccctggccattcaaggctcaagcccaagcttgatgaagtcctgcctaaagcagctggggttgttttcattgttgacgctcaagatttcttgtctagcatgcaagctgctgcagagtacctgtatgacattctgacaaaggcaattgtagtgaagaaaaaggttcctgtgcttatattctgcaacaagacagataaagttacagcccactcaaaggagttcataaagaaacagttggagaaagaaataaacaagcttcgggaatcaaggaatgccatatcatcagctgacatctctgatgaagtccagctcggggtccctggagaggtattcaacttcagccagtgccagaacaaggtggctgttgctgagggtgccggttcgaccggtaatgtttcagctgtcgagcaattcatccgtgaacatgtgaaggcgtag

SEQ ID NO: 5534 - protein, 256 aa, Sorghum bicolor
  misc_feature: Ceres ANNOT ID no. 6044112
  misc_feature (39)..(209): Pfam Id: Arf Pfam Desc: ADP-ribosylation factor family
  misc_feature (53)..(176): Pfam Id: MMR_HSR1 Pfam Desc: GTPase of unknown function
  misc_feature (1)..(255): NCBI GI: 92887265 NCBI Desc: aaa atpase; small gtp-binding protein domain [medicago truncatula]
  misc_feature (8)..(255): NCBI GI: 110736264 NCBI Desc: signal recognition particle receptor beta subunit-like protein [arabidopsis thaliana]
  misc_feature (85)..(256): NCBI GI: 51090418 NCBI Desc: signal recognition particle receptor beta subunit-like [oryza sativa (japonica cultivar-group)]
  misc_feature (118)..(256): NCBI GI: 115468056 NCBI Desc: os06g0473100 [oryza sativa (japonica cultivar-group)]
  misc_feature (27)..(235): NCBI GI: 50540210 NCBI Desc: zgc:92746 [danio rerio]
  misc_feature: Useful for making plants with modulated cold sensitivity
  misc_feature: GREAT-hit functional homolog of the protein sequence given in SEQ ID NO 12929
  misc_feature: Useful for making plants with modulated cold sensitivity
  misc_feature: Functional homolog of the protein sequence given in SEQ ID NO 12929
MDEWVHQAEVWVRQAESWIRQQPTEQIYIAAAVVALTILLLIVASCLKSSKPNTIVLSGLSGSGKTTIFYQLRDGSSHQGTVTSMEENNDTFVLHSEQERKGKVKPVHVVDVPGHSRLKPKLDEVLPKAAGVVFIVDAQDFLSSMQAAAEYLYDILTKAIVVKKKVPVLIFCNKTDKVTAHSKEFIKKQLEKEINKLRESRNAISSADISDEVQLGVPGEVFNFSQCQNKVAVAEGAGSTGNVSAVEQFIREHVKA

SEQ ID NO: 5535 - DNA, 3255 bp, Sorghum bicolor
  misc_feature: Ceres ANNOT ID no. 6044116
  misc_feature: Encodes the peptide sequence at SEQ ID NO 5536
atgagtgacgatggcgaccgcacctgcccgctctgtgctgaggagatggacatcactgaccagcagctcaagccatgcaaatgcggctacgatatttgtgtttggtgctggcaccacatcatagacatggctgagaaggaggaaacagagggccgctgccctgcatgccgcacacgctatgacaaggataggattgtcaagatggctgccacttgtgacaggacagtggcagagaaaaatgtagagaagaagcacaagacccaaaaggttaagccaaaggcagcaccaccaccaacaacaatgtcaaccgtagaatctaagaagcatctggctagtgtcagggttatccagagaaatctggtgtacataattgggctccctgcgcatttatgcaacgagagcgtacttgagcgcagggaatactttggtcaatatgggaaagttttgaaggtttcagtttcccgtccaactgggcctccctcgcaggcatcagcaaacagcaatattagtgtgtatattacttatgcaaaagaagaagaggccatccggtgtattcaagctgtgcacaattttgtcttggaagggaaagtgttaagggcatgctttggtactacgaagtattgccatgcatggctgcgaaacatgacatgtgggaatccagattgtctctatttgcatgatgtaggcagtcaggaggatagttttacaaaagatgagatcatctcagcatatacgaggactagagtcccccagatggcatctagtgtttcacaaagacgcacaggcactgtgttgcctcctccaggagatgatttctcttacagtgcggtggtttcagccaagcatacattcaagaatggaacactcaataccaccaaccagcccagactttcacctccaaacagtagttctgggaggtccacacttccaccagctgcctcatgggggcagcgtgatttgactgccaggacaacagctactggggcgacatcatcacaatctcatacaaaacctaaatcagaatcacagagtaatccattttcaagttcttcagtaatttccagtacaaaaacaccctcttcgtggaatgatgatacaagtacagcaacaaaaatgtctgaaggacagcaagtgtcagaaaaagagtctaaaaccttgcagccgtataagcctggtatttcaaaggaaacacaagctctatcatcacttgagtcatcactggacatagatttctcgacaataccttcagcttggaatgacgatgacattgtagtatcagatgggatgtcaaaaggaagcgatgaaaatcaagttgcaaatgaaaatggcaagctaacccatccagcatctaagtcactggttttatctaagaaagacataacgatgaacaacattaccagcaaaagtccttcagatgtatcaagtctagcaatatctaaatcagatgtaagtacgagtgatggtgaccactcacttacaaatattactcctaaaagccttacttcaaatgccacagactgccaatctagtcatgctgctggggagaaaatattggaggacattgcatccaggaacactgaaatggagaagctatctgctcagatacgttcagtaaaattaggtggcaacaatgatattcagagtatggcaggaaatcagcaatcagattcagatgtaatgtcatgcacacctgttgatgtgcccatggatcagaattttgacaaagaccaatctcatctcaatcttaatgagctcttcttaccttcagaaaataaggatactattctttcttgtcaatatagttctgataagcgtctttcgagttcagagccgcaaaattgtagtgtggcttctttaaatgatacagtagattctacaatgctcactgacaaacttcagagtatactactggatggttcaaagcaaccatcatattcgtcatttgcccaatttcctagtacgttggatagttcattgtggaatgatacagaaagtaaccctgcattgacgattggcactagagcttccctgacagggttttcttcaataaataacacttatgtcttgccaaatggaggacaagatgggctagggactgtatatacacatggtaatgtttccggatatcctggaataggaagtcatcagcatacagcaatgggttcagatagtataggaggttttgacaagaccataagtgtaaataaggatgagagcagaataatttctgatatgttgtcgtcagagtttaatccatgggatgattcatattcgactgctaacaattttgttaggatgcttagggaatccgaaaataatgatgttcatttcactgcaccttcgtggaaatcagtaactgggagcaaagagtccagattttcatttgctagacaggataaccaaggaaacttgttagattcatctctcagaaactgtggtactggtactgagcagaatttcagtttgctgccccagaattctcgaggaaatatttaccagaatggccttgcattccaatctctagaaaatgatttttccaatagctactctcttggtgtattagatatggcaactgctggtacatcgaggtctaaaatatctgcacccccaggattttcagcaccagcaagagccccccctcctggattttcttctgcatttccatcgcaggatagtttgaaccccactcctgggatgggtctaatcagtcatatggctcaacataccaaggatactgttttgggtggcaacagtaatcattaccaatctcagtttggaaggcacgcaagtgatatggagtttgatgatcctgctatattggctgtgggcaaagggctgatgcctggaattggcgattcagggctggagatgaaaaattctcctgcttttcaagcacagttgcaaccagaaagaagcgatccaaggtttcagttacatgtacagccaaatgtgcagtctcatcaaaacctgagattcacagaccctatgcaggatggcttgaaccatatgaatgataattatctggcatccagatttttagctcagaaccatgatcctatatccccttatgcgcagattccgcaacaacccagaaactcgcagcttacaaatggtcactgggatgggtggagtgattcgagacaagggaataacaccgctatgtctggcatgtcgaggatgctatatccaagtgaagtgaacaagttgcacatgctgggttcaaatgatatctataacagagcctttggaatgtga

SEQ ID NO: 5536 - protein, 1084 aa, Sorghum bicolor
  misc_feature: Ceres ANNOT ID no. 6044116
  misc_feature (121)..(200): Pfam Id: RRM_1 Pfam Desc: RNA recognition motif. (a.k.a. RRM, RBD, or RNP domain)
  misc_feature (1)..(393): NCBI GI: 145359475 NCBI Desc: rna binding [arabidopsis thaliana]
  misc_feature (1)..(393): NCBI GI: 8885568 NCBI Desc: general negative transcription regulator-like [arabidopsis thaliana]
  misc_feature (1)..(644): NCBI GI: 79565326 NCBI Desc: nucleic acid binding / ubiquitin-protein ligase/ zinc ion binding [arabidopsis thaliana]
  misc_feature (16)..(503): NCBI GI: 140056836 NCBI Desc: rna-binding region rnp-1 (rna recognition motif) [medicago truncatula]
  misc_feature (1)..(407): NCBI GI: 28828505 NCBI Desc: similar to dictyostelium discoideum (slime mold). mkpa protein
MSDDGDRTCPLCAEEMDITDQQLKPCKCGYDICVWCWHHIIDMAEKEETEGRCPACRTRYDKDRIVKMAATCDRTVAEKNVEKKHKTQKVKPKAAPPPTTMSTVESKKHLASVRVIQRNLVYIIGLPAHLCNESVLERREYFGQYGKVLKVSVSRPTGPPSQASANSNISVYITYAKEEEAIRCIQAVHNFVLEGKVLRACFGTTKYCHAWLRNMTCGNPDCLYLHDVGSQEDSFTKDEIISAYTRTRVPQMASSVSQRRTGTVLPPPGDDFSYSAVVSAKHTFKNGTLNTTNQPRLSPPNSSSGRSTLPPAASWGQRDLTARTTATGATSSQSHTKPKSESQSNPFSSSSVISSTKTPSSWNDDTSTATKMSEGQQVSEKESKTLQPYKPGISKETQALSSLESSLDIDFSTIPSAWNDDDIVVSDGMSKGSDENQVANENGKLTHPASKSLVLSKKDITMNNITSKSPSDVSSLAISKSDVSTSDGDHSLTNITPKSLTSNATDCQSSHAAGEKILEDIASRNTEMEKLSAQIRSVKLGGNNDIQSMAGNQQSDSDVMSCTPVDVPMDQNFDKDQSHLNLNELFLPSENKDTILSCQYSSDKRLSSSEPQNCSVASLNDTVDSTMLTDKLQSILLDGSKQPSYSSFAQFPSTLDSSLWNDTESNPALTIGTRASLTGFSSINNTYVLPNGGQDGLGTVYTHGNVSGYPGIGSHQHTAMGSDSIGGFDKTISVNKDESRIISDMLSSEFNPWDDSYSTANNFVRMLRESENNDVHFTAPSWKSVTGSKESRFSFARQDNQGNLLDSSLRNCGTGTEQNFSLLPQNSRGNIYQNGLAFQSLENDFSNSYSLGVLDMATAGTSRSKISAPPGFSAPARAPPPGFSSAFPSQDSLNPTPGMGLISHMAQHTKDTVLGGNSNHYQSQFGRHASDMEFDDPAILAVGKGLMPGIGDSGLEMKNSPAFQAQLQPERSDPRFQLHVQPNVQSHQNLRFTDPMQDGLNHMNDNYLASRFLAQNHDPISPYAQIPQQPRNSQLTNGHWDGWSDSRQGNNTAMSGMSRMLYPSEVNKLHMLGSNDIYNRAFGM

SEQ ID NO: 5537 - DNA, 945 bp, Sorghum bicolor
  misc_feature: Ceres ANNOT ID no. 6044125
  misc_feature: Encodes the peptide sequence at SEQ ID NO 5538
atggggatcgcaaagagcaactctagtggattgcttgtggcttggaggatccccatcttgagagtggatgtgcggcacccggaatatgtattgaatgcacgaggaattaatctattcacatgccagtggagacctttgaactctgaaccaaaagccgtgatctttctatgccatggatatgccatggaatgcagtatttcaatgagaggcacaggtacaaggttggcgcaggctggatttgtagtgcatggaatggactatgaaggccatggaaagtcttctggacttcaaggatatattagtagttttgatgacattgtggtcgattgctctaagtactttgcaagtgtctgtgagaaagaagagtataagaaacaaaagagattcttacttggagaatccatggggggagcaatcgtgcttatgcttcatagaaaggaacctagcttttgggatggggccattttggttgctccaatgtgcaagatagtagaagatatgaagcctcatcccattgtgatttcaattttaagtaagctcagcaatgtgatccctacgtggagaataattcctaatgaagatatcatagatagggcaattaaaagcgaggagtggcgtgaagaggtaagaaataatcattattgctacaaaggaaagcctagggtaaagactggttatgaaattttcatggcaagcttggatattgaaagcaatcttgataaggttactctaccattcatcatagtccatggcggtgacgatgctgtaactgaccccacagtaagtgaggctctatatacattagcgaagagcaaggacaagacattgaagttgtaccctgggatgtgccatgctttgacttcaggagaacccaaggagaacattgatattgtgtttgcagacatcatcaaatggttgaatgagagggtaccgtcaatttcctag

SEQ ID NO: 5538 - protein, 314 aa, Sorghum bicolor
  misc_feature: Ceres ANNOT ID no. 6044125
  misc_feature (80)..(300): Pfam Id: Abhydrolase_1 Pfam Desc: alpha/beta hydrolase fold
  misc_feature (28)..(309): NCBI GI: 7019651 NCBI Desc: lipase-like protein [arabidopsis thaliana]
  misc_feature (29)..(309): NCBI GI: 92878320 NCBI Desc: alpha/beta hydrolase [medicago truncatula]
  misc_feature (28)..(309): NCBI GI: 30695682 NCBI Desc: esterase/lipase/thioesterase family protein [arabidopsis thaliana]
  misc_feature (28)..(313): NCBI GI: 7019652 NCBI Desc: lipase-like protein [arabidopsis thaliana]
  misc_feature (13)..(308): NCBI GI: 140063294 NCBI Desc: alpha/beta hydrolase [medicago truncatula]
MGIAKSNSSGLLVAWRIPILRVDVRHPEYVLNARGINLFTCQWRPLNSEPKAVIFLCHGYAMECSISMRGTGTRLAQAGFVVHGMDYEGHGKSSGLQGYISSFDDIVVDCSKYFASVCEKEEYKKQKRFLLGESMGGAIVLMLHRKEPSFWDGAILVAPMCKIVEDMKPHPIVISILSKLSNVIPTWRIIPNEDIIDRAIKSEEWREEVRNNHYCYKGKPRVKTGYEIFMASLDIESNLDKVTLPFIIVHGGDDAVTDPTVSEALYTLAKSKDKTLKLYPGMCHALTSGEPKENIDIVFADIIKWLNERVPSIS

SEQ ID NO: 5539 - DNA, 1050 bp, Sorghum bicolor
  misc_feature: Ceres ANNOT ID no. 6044127
  misc_feature: Encodes the peptide sequence at SEQ ID NO 5540
atggggaggagcagcagcagcagcggcggcggcggggcagatgatggcggcgaggtgctcctggaccacgagtacaaagaggagtacgtgaggaactcgcgggggatgaacctgttcgcatgcacatggctgcctgcaggcaagaggaagactccaaaggcgctcgtcttcctctgccatggctacgccgtggagtgcggggtgacgatgcgcggcaccggcgagcgcctggcgcgtgcgggctacgccgtgtacggcctggactacgagggccacggccgctccgacgggctgcagggctacgtgccggatttcgagttgctggtccaggactgcgacgagtacttcacctccgtggtgcggtcgcagtcaattgaggacaagggctgcaagctgcgccggttcctgctcggtgagtccatgggcggcgccgtcgctctccttctagacctcaggcggcccgagttctggaccggcgccgtgctggtggcgcccatgtgcaagatcgccgacgacatgcgtccccacccgctggtggtgaacatcctgagggccatgacctccatcgtcccgacctggaagatcgtgcccagcaacgacgtgatcgacgccgcctacaagacgcaggagaagagggacgagatccggggcaacccttactgctacaaggacaagcccagactcaagaccgcgtacgaactgctcaaggtcagcttggacctcgagcaaaacctcctacaccaggtgtcgttgccgttcctgatcgtacacggcggagcagacaaggtgacggacccgtcggtgagcgagctgctgtaccgatcggcagcgagccaggacaagaccctgaagctctacccgggcatgtggcacgccctcacctccggcgagtcgcccgacaacatccacaccgttttccaagacatcatcgcctggctcgaccacagatcatccgacgacacggatcagcaggagctgctgtcggaggtggagcagaaggctaggcacgacgaacaacatcaccagcagcaggatggcggcaacaaatag

SEQ ID NO: 5540 - protein, 349 aa, Sorghum bicolor
  misc_feature: Ceres ANNOT ID no. 6044127
  misc_feature (82)..(304): Pfam Id: Abhydrolase_1 Pfam Desc: alpha/beta hydrolase fold
  misc_feature (25)..(331): NCBI GI: 7019651 NCBI Desc: lipase-like protein [arabidopsis thaliana]
  misc_feature (24)..(319): NCBI GI: 30695682 NCBI Desc: esterase/lipase/thioesterase family protein [arabidopsis thaliana]
  misc_feature (21)..(317): NCBI GI: 92878320 NCBI Desc: alpha/beta hydrolase [medicago truncatula]
  misc_feature (25)..(316): NCBI GI: 7019652 NCBI Desc: lipase-like protein [arabidopsis thaliana]
  misc_feature (24)..(317): NCBI GI: 140063294 NCBI Desc: alpha/beta hydrolase [medicago truncatula]
MGRSSSSSGGGGADDGGEVLLDHEYKEEYVRNSRGMNLFACTWLPAGKRKTPKALVFLCHGYAVECGVTMRGTGERLARAGYAVYGLDYEGHGRSDGLQGYVPDFELLVQDCDEYFTSVVRSQSIEDKGCKLRRFLLGESMGGAVALLLDLRRPEFWTGAVLVAPMCKIADDMRPHPLVVNILRAMTSIVPTWKIVPSNDVIDAAYKTQEKRDEIRGNPYCYKDKPRLKTAYELLKVSLDLEQNLLHQVSLPFLIVHGGADKVTDPSVSELLYRSAASQDKTLKLYPGMWHALTSGESPDNIHTVFQDIIAWLDHRSSDDTDQQELLSEVEQKARHDEQHHQQQDGGNK

SEQ ID NO: 5541 - DNA, 3606 bp, Sorghum bicolor
  misc_feature: Ceres ANNOT ID no. 6045000
  misc_feature: Encodes the peptide sequence at SEQ ID NO 5542
  misc_feature: Up-regulated in shoot tissues in response to methyl jasmonate treatment
  misc_feature: Up-regulated in root tissues in response to methyl jasmonate treatment
atggcgccgagcaagaggctggagaagctcaagctcagcacattgttgactttcatgcgttgtcacaggagctctagtgatgatcactcacggattgggacagtcgggttctcccgagtcgtgtacgtcaacgagcctgataggcttcaagaggagggattcagttacccgacgaatgaagtgtcgacgacaaagtacactctggccaccttcctgcccaagtccctcttcgagcagttcaggagggtggccaatttctacttccttgtctctggtatccttgccttgactccactcgcaccttacactgcagtgagcgcacttgcaccgctctgtgtcgtgattgtagccaccatggcaaaagaaggggttgaggactggcggaggaaacaacaggatcacgagctcaataatcggatagtcaaagtgcataggggaaatggtcattttgaagagacaaaatggaagaatatcaaagttggagatgtaataaaggtggagaaggataatttctttcccgctgatatgattctactttcatctaactatccagatggaatctgttatgtagagaccatgaacctcgatggtgaaacaaatttgaaaattaaacaagctctcgaggtgacattggatttacaggaggacataaagttcagggaaatcagacaaacaattaaatgtgaagacccaaatgcgaacctctactcctttgtcggttcaatggaatggagaggccagcagtatcccctgtcacccctacagcttcttcttcgggactcaaaactacggaacacagactacatatatggggctgtcatcttcacaggtcatgatacaaaagtgatgcaaaatgcaaccgaaccaccatctaaaagaagtaaggttgagaagaaaatggataaaattatttaccttctgatgtcttctctactcatgattgcattacttggttctgtcttctttgggatctggaccaaagaggacctaagagatggtgagctcaaacggtggtatcttcggccagatgctactactgtattctatgatccaaagagagcagctctggcatctttctttcatttgttgacggccttgatgctgtacagctacttcatccccatttctttgtatatatccattgagatggtcaagatcttgcaagctgtattcatcaaccaggatattgaaatgtatcatgaagaatcagataagccaactcatgctcgtacttcgaatctgaatgaagaactagggatggttgatacaatactatccgataagactggaacattgacgtgcaacatgatggagttcatcaagtgttcaattgctggcactgcctatggtcagggtgtcactgaagttgagagagctatggctatgaggaaaggtgccaggttagatgatgacattgaaaaaggggaccacaaagacaaaaatttcaacaacagtccccatgttaaagggttcaatttcaaggatccacgaataatggatgggaattggattcatgagcctaacacagatatgataagagattttttccggctcctagccatctgccacacttgcattgctgaaatagacgaaaatgagaaggtttcatatgaagctgagtcccctgatgaagctgcatttgttattgcagcaagagaactagggtttgagttttacaagaggtcgctggcaactataattgttcgtgaacgggatccaagtcaaaatgttgttgagaaacgaaagtatgaactcctaaatatattggagttcagtagttcaaggaaacggatgtctgtgattgtcaaggaaccagagggaaggatattacttctcagcaagggcgcagacagtgtgatgttcagaaggctttcaccaaatggaagaaaatttgaagatgaaacaagaagacacataaatgagtattctgactctggtctaagaaccttggttctagcatatcgtgtcttagatgagagagagtacaaggaattcaatgaaaaattgaacgctgccaaagcatctttaagtgctgatagagatgaaaaaattgagcaggctgctgatagcattgaacgggacttgattcttcttggtgctactgcagttgaagataagctccagcaaggggtgcctgaatgcatagacaagcttgcacaagctggaattaagatatgggtcctgacaggtgacaagatggagacggctatcaatattgggtttgcatgtagcctgcttagacaaggcatgacacagataattgtcacactggaacaacctgacatcatcgcgttagagaaagatggtgacaaacaaaaaatttctaaggcatcaaagcaaaaggttatgggtcagatagaggatggaatcaaacaaattccaccttcaactcaaatcagcactgcatcattcgcactaatcattgatggtaaatcactaacttatgctttggaagatgatgtcaagttgaagttcttggatcttgctatcaagtgtgcatcagtaatatgttgccgatcttcaccaaaacagaaggcactggttacaagacttgttaaagaagtaacacataaagtgactttagcaataggtgatggggcaaatgatgttggcatgcttcaagaagctgacataggggttggcatcagtggtgctgaaggaatgcaggctgtcatggctagtgatgttgctgttgcgcaattccgcttcttggaacggctacttctggtgcatggacattggtgttaccggcgtatttcagtgatgatatgctatttcttctacaagaatgttacttttggtgtcactatctttctgtatgaagcatttgcatctttctccgggaagccagcttataatgattggttcttgtcactctataatgttttcttcacctcccttcctgtcattgctttgggggtatttgaccaggatgtgtctgccaggctgtgcatacagtatccacagctataccaagaaggagtgcagaatatattattcagttggcgtcggatacttggctggatgcttaatggtgttatgaatgctgtgttaatctttttcttctgcatcacttcctttgaggaccaggcgttccgtcaggatggtcaagttgcgggcttggatgctctaggtgtcgtcatgtacacttgtgttgtatgggttgtcaactgtcaaatggctctctctgtgaactacttcaccataatccagcacatattcatatggggcagcattgcagtatggtacctcttcctcttggtttatggtgccataaacccgaggttctcaactacagcctacatggtcttcatcgaacagctggccccagccctctcattttggttggtgacactttttgttgtgatggcaacacttgtcccctacttcagctatgccgcgatccagatccgttttttcccaatgttccacaacaagattcagtggaaacggtacttggggaaggctgaagatccagaagtggcaaggcagttgtcatcacgacaccggacgtcgtcgcagcagaggatggttggtatctctgctcgccgtgatggcaaggctatgcaaataacaaaggagacagagctagaagttcaggagtag

SEQ ID NO: 5542 - protein, 1201 aa, Sorghum bicolor
  misc_feature: Ceres ANNOT ID no. 6045000
  misc_feature (5)..(1191): NCBI GI: 5734708 NCBI Desc: similar to gbaf067820 atpase ii from homo sapiens and is a member of pf00122 e1-e2 atpases family. [arabidopsis thaliana]
  misc_feature (21)..(1199): NCBI GI: 92878535 NCBI Desc: atpase, e1-e2 type [medicago truncatula]
  misc_feature (3)..(1184): NCBI GI: 11994751 NCBI Desc: p-type transporting atpase [arabidopsis thaliana]
  misc_feature (6)..(1184): NCBI GI: 20466792 NCBI Desc: puative calcium-transporting atpase [arabidopsis thaliana]
  misc_feature (1)..(1157): NCBI GI: 11994492 NCBI Desc: p-type transporting atpase-like protein [arabidopsis thaliana]
  misc_feature: Up-regulated in shoot tissues in response to methyl jasmonate treatment
  misc_feature: Up-regulated in root tissues in response to methyl jasmonate treatment
MAPSKRLEKLKLSTLLTFMRCHRSSSDDHSRIGTVGFSRVVYVNEPDRLQEEGFSYPTNEVSTTKYTLATFLPKSLFEQFRRVANFYFLVSGILALTPLAPYTAVSALAPLCVVIVATMAKEGVEDWRRKQQDHELNNRIVKVHRGNGHFEETKWKNIKVGDVIKVEKDNFFPADMILLSSNYPDGICYVETMNLDGETNLKIKQALEVTLDLQEDIKFREIRQTIKCEDPNANLYSFVGSMEWRGQQYPLSPLQLLLRDSKLRNTDYIYGAVIFTGHDTKVMQNATEPPSKRSKVEKKMDKIIYLLMSSLLMIALLGSVFFGIWTKEDLRDGELKRWYLRPDATTVFYDPKRAALASFFHLLTALMLYSYFIPISLYISIEMVKILQAVFINQDIEMYHEESDKPTHARTSNLNEELGMVDTILSDKTGTLTCNMMEFIKCSIAGTAYGQGVTEVERAMAMRKGARLDDDIEKGDHKDKNFNNSPHVKGFNFKDPRIMDGNWIHEPNTDMIRDFFRLLAICHTCIAEIDENEKVSYEAESPDEAAFVIAARELGFEFYKRSLATIIVRERDPSQNVVEKRKYELLNILEFSSSRKRMSVIVKEPEGRILLLSKGADSVMFRRLSPNGRKFEDETRRHINEYSDSGLRTLVLAYRVLDEREYKEFNEKLNAAKASLSADRDEKIEQAADSIERDLILLGATAVEDKLQQGVPECIDKLAQAGIKIWVLTGDKMETAINIGFACSLLRQGMTQIIVTLEQPDIIALEKDGDKQKISKASKQKVMGQIEDGIKQIPPSTQISTASFALIIDGKSLTYALEDDVKLKFLDLAIKCASVICCRSSPKQKALVTRLVKEVTHKVTLAIGDGANDVGMLQEADIGVGISGAEGMQAVMASDVAVAQFRFLERLLLVHGHWCYRRISVMICYFFYKNVTFGVTIFLYEAFASFSGKPAYNDWFLSLYNVFFTSLPVIALGVFDQDVSARLCIQYPQLYQEGVQNILFSWRRILGWMLNGVMNAVLIFFFCITSFEDQAFRQDGQVAGLDALGVVMYTCVVWVVNCQMALSVNYFTIIQHIFIWGSIAVWYLFLLVYGAINPRFSTTAYMVFIEQLAPALSFWLVTLFVVMATLVPYFSYAAIQIRFFPMFHNKIQWKRYLGKAEDPEVARQLSSRHRTSSQQRMVGISARRDGKAMQITKETELEVQE

SEQ ID NO: 5543 - DNA, 2007 bp, Sorghum bicolor
  misc_feature: Ceres ANNOT ID no. 6045140
  misc_feature: Encodes the peptide sequence at SEQ ID NO 5544
atgcgcgaccccctcgccgccctccttcgcagcggcggccatcctcactccgcccacggcgtggccatcaagcttggctgcattgcctccacttttctctgcaacaatcttctgcatgcctacctcagccgctccgtccccgcgcatgcccgcaggctgttcgacgaaatgtcccgccgcaacctcgtgtcctggtccgtcgtcatctccggctccgcccgccacggcgtcctcgcggaggcgttcgcgttgttctcccacatgcttcacggtgcggggcagggaagctgggaccgtccggactcgttcatgctaggggccttggtcgccgggtgctcccgcgccagacacgtcgacgctggcgtgcaggtgcacgcttgcgtggccaagttcggcgtcgacgaggatgagagcgtcgcggcggcgttggtggacatgtatgccaagtgcgggtgggtggactcgtcatggcgggccttcacgctcgcaccgcagcggagcgtcctgagttggacgagcatgattgcctgtctggtcaaccaaggttcgtcaggttaccatgacgcagcaatgctgctgttcaagaaaatgctggcattaaaggtttggcctaccaatgtgacgttttcttgcatcctgaaggtgttcaatacgcctgatttgctatccgttggaatgcaaattcatggctgcttgctgaagatagggactgaggttgacactgctttggggagtgccttgatgacgatgtatggcagatgtggtggagttgatgagatagctaggttggcttgtcgtataaggcatgatgtgttttcacggacttccctgcttggagcttatgctcgtaatggatacaatgcagaggcaattggtgttttcaaggagatgatcttgacaaatatggcaattgatcagtcagctatgacttgtctgctgcaggtttgttcatctgttggacaactgagaatggttcgggaggtacattgttatgctttaaaaactttcttcaagttggatactttactactgaatgctatcatcactgtttatggcagatgtggtgataccactagtgctgaaactgtatttaacctaatggaggaacaggacatcatatcatggacggcattgttaacttgctacgctcagaatggtcttgatgaagaggtactcttgttctttagggaaatgctccggagagggttggggtctccagtattttgcatgactagtgtactacgagcctgttctagaacctcaaatctagctattggattgcaaatccattcgaggactgtgaagctaggtattgatgatgataattctgtagagaatgcactcgtaaccttgtatgctaattgtggaagtgtccaggttgccttgaagatatttaactcaatgagtaatagagacattgtcacttggaatgcattactcacaagtttttcacagcatggcaatgaggtggcagccattcagctttttgatctgatgcaagaagaagaggtctgtccagatgattacacttttgttggcctgctatcatcttgcagccgaatgggccttgtaaaagagggctgtgagtacttcaatgaaatgaaggcaaaatacaacttggagcccaagatggttcattatacctgcatggttgatctatttgcccgtgctggaagattttgtgatgcaatggacttcattgatgcaatgccttatgaaccagaccaaatattgtgggaagctttgctagcttcttgtaagattcacggaaatttggggttaggaagaatagcagctaagaaaattctggaaattacaccacatgattattcagcatacattacattatcaagcattcatgcttcagttgacatgtgggatgagaaatgctggaatcgcactgtattcgatacccagcaagcaagaaaggatactggaaggagttggattgatgcacaagaattatcagagaatatattggatacattacaaattggagtgatgtaa

SEQ ID NO: 5544 - protein, 668 aa, Sorghum bicolor
  misc_feature: Ceres ANNOT ID no. 6045140
  misc_feature (373)..(407): Pfam Id: PPR Pfam Desc: PPR repeat
  misc_feature (474)..(508): Pfam Id: PPR Pfam Desc: PPR repeat
  misc_feature (35)..(655): NCBI GI: 78183583 NCBI Desc: ppr1106-17 [physcomitrella patens]
  misc_feature (19)..(651): NCBI GI: 54695180 NCBI Desc: ppr986-12 [physcomitrella patens]
  misc_feature (19)..(655): NCBI GI: 115488988 NCBI Desc: os12g0552300 [oryza sativa (japonica cultivar-group)]
  misc_feature (19)..(653): NCBI GI: 42566761 NCBI Desc: pentatricopeptide (ppr) repeat-containing protein [arabidopsis thaliana]
  misc_feature (17)..(651): NCBI GI: 38347057 NCBI Desc: osjnba0060p14.4 [oryza sativa (japonica cultivar-group)]
MRDPLAALLRSGGHPHSAHGVAIKLGCIASTFLCNNLLHAYLSRSVPAHARRLFDEMSRRNLVSWSVVISGSARHGVLAEAFALFSHMLHGAGQGSWDRPDSFMLGALVAGCSRARHVDAGVQVHACVAKFGVDEDESVAAALVDMYAKCGWVDSSWRAFTLAPQRSVLSWTSMIACLVNQGSSGYHDAAMLLFKKMLALKVWPTNVTFSCILKVFNTPDLLSVGMQIHGCLLKIGTEVDTALGSALMTMYGRCGGVDEIARLACRIRHDVFSRTSLLGAYARNGYNAEAIGVFKEMILTNMAIDQSAMTCLLQVCSSVGQLRMVREVHCYALKTFFKLDTLLLNAIITVYGRCGDTTSAETVFNLMEEQDIISWTALLTCYAQNGLDEEVLLFFREMLRRGLGSPVFCMTSVLRACSRTSNLAIGLQIHSRTVKLGIDDDNSVENALVTLYANCGSVQVALKIFNSMSNRDIVTWNALLTSFSQHGNEVAAIQLFDLMQEEEVCPDDYTFVGLLSSCSRMGLVKEGCEYFNEMKAKYNLEPKMVHYTCMVDLFARAGRFCDAMDFIDAMPYEPDQILWEALLASCKIHGNLGLGRIAAKKILEITPHDYSAYITLSSIHASVDMWDEKCWNRTVFDTQQARKDTGRSWIDAQELSENILDTLQIGVM

SEQ ID NO: 5545 - DNA, 1965 bp, Sorghum bicolor
  misc_feature: Ceres ANNOT ID no. 6045327
  misc_feature: Encodes the peptide sequence at SEQ ID NO 5546
atggctgggtcggggaagactgttgtttggttcaggagagacctcaggatccacgataacccggccttggcagctgcggcgaaagagggctctgtcctccctctcttcatatggtgtcctgctgactacgagcagtattaccctggaaggtgctcccggtggtggctcaagcagtcccttgcccaccttgggaagtcactagagttgctcgggtgcccactcgtgctgatccgtgcggaggacagcactcttgcaactcttttggagtgcgtccattgcatcagtgccactagagtcgtttataatcgtctctacgaccctatttcacttgtgcttgacgacaaaatcaagaatgagctttcagcccatggcatatctgtccaaagtttcaatggtgatctactttacgagccgtgggatgtttatgatgagaatgggcaggcatttacatcctttaacaagtactgggagaaatgcatgaatgttcctattgagatatcacaatatcttgcacctacgaggctggtggcagcgccaggtctagcgaatgttcgctgttgttcaattgatgatctaggtcttgaatctagtaaggatgtggaatcaagcaatgctttgctaagcagggcctggtctcctggctggcgcaatgcagagaatatgcttgaggaatttttgtcatgtggtctcctagaatattcaaaacacggtatgaaggttgggggaactacaacgtcattattgtcaccatatctccatttcggggagttgagtgtaaggaaggtttatcaacttgttacaatgcatcatgtcaagtggcaaaatgaaggaaaatctgaagctgaggagagtgttcgattgttcctaagatcaattggttttcgggaatattcacggtacttatgttttaacttcccattcacgcacgagagatcatttctgggtaacttgaagcattatccctggctattggatgaggaccgtttcaaatcttggagacagggaatgactggatacccattagtagatgctggcatgagagaactctgggctactggttggacacataatcggataagagtgattgtttcaagtttcgctgtaaaatgtctacagataccctggatttggggaatgaagtacttttgggatgtgcttctggatgcagacctagaaagtgatattcttggttggcagtatatatctgggagtttgcctgatggacatgagctcagccgtcttgataatccagaggttcagggtcaaaagtacgatccagatggtgaatatgtaagaacttggattcctgaacttgctagaatgccaacagaatggatccattgtccatggagtgctcctaactctatattacaagttgctggagttgagttgggctttaactaccctaagcccatagtagaacttcatatggcgcgggaatgcttagatgacgccatctccacaatgtggcaactggacacagctgcaaaacttgctgcactagatggtgaagttgtggacgacaatctgaataatatcaggagttttgatatcccaaaggttgttttgaagaagaaattatctccaagcacttcatcgatgaacaaaagggtgctgtctactaatggcaagaacgaaaagtcacagcctactgaagtgaaggccccgtacaaacagattattcgagatgatatgatcaatgcctcaaacatggatgacaccggctctactgctaacttgcaagtgacaaggaaaagatctcgcagtgatagtgctttcaatgttccgtcatcttcatcctcactagtcatggaatcacggattcatgataatgacagttgttctgttcggtattcaggctacctccagcagacagcagacagggatgacactgataaggttgaagataacgacagtgaagatagtggtacgagcatctctaggccatccaagagacctgcttag

SEQ ID NO: 5546 - protein, 654 aa, Sorghum bicolor
  misc_feature: Ceres ANNOT ID no. 6045327
  misc_feature (212)..(490): Pfam Id: FAD_binding_7 Pfam Desc: FAD binding domain of DNA photolyase
  misc_feature (5)..(176): Pfam Id: DNA_photolyase Pfam Desc: DNA photolyase
  misc_feature (1)..(651): NCBI GI: 23954324 NCBI Desc: cryptochrome 2 [oryza sativa (indica cultivar-group)]
  misc_feature (1)..(651): NCBI GI: 40644276 NCBI Desc: cryptochrome 2 [oryza sativa (indica cultivar-group)]
  misc_feature (1)..(651): NCBI GI: 28372347 NCBI Desc: cryptochrome 2 [oryza sativa (japonica cultivar-group)]
  misc_feature (3)..(602): NCBI GI: 45935262 NCBI Desc: cryptochrome 2a apoprotein [pisum sativum]
  misc_feature (1)..(615): NCBI GI: 78217443 NCBI Desc: cryptochrome 2 [nicotiana sylvestris]
  misc_feature (1)..(487): SWISSPROT Homolog: EC 4.1.99.3 Deoxyribodipyrimidine photo-lyase
  misc_feature: Useful for making plants with modulated drought sensitivity
  misc_feature: Useful for making plants with modulated light quality response
  misc_feature: Useful for making plants with modulated seed size
  misc_feature: Useful for making plants with modulated nitrogen use efficiency
  misc_feature: GREAT-hit functional homolog of the protein sequence given in SEQ ID NO 13431
  misc_feature: GREAT-hit functional homolog of the protein sequence given in SEQ ID NO 13481
  misc_feature: GREAT-hit functional homolog of the protein sequence given in SEQ ID NO 13495
  misc_feature: GREAT-hit functional homolog of the protein sequence given in SEQ ID NO 13499
  misc_feature: Useful for making plants with modulated light quality response
  misc_feature: Useful for making plants with modulated light quality sensitivity
  misc_feature: Functional homolog of the protein sequence given in SEQ ID NO 13499
  misc_feature: Useful for making plants with modulated low light sensitivity
  misc_feature: Useful for making plants with modulated nitrogen use efficiency
  misc_feature: Functional homolog of the protein sequence given in SEQ ID NO 13918
MAGSGKTVVWFRRDLRIHDNPALAAAAKEGSVLPLFIWCPADYEQYYPGRCSRWWLKQSLAHLGKSLELLGCPLVLIRAEDSTLATLLECVHCISATRVVYNRLYDPISLVLDDKIKNELSAHGISVQSFNGDLLYEPWDVYDENGQAFTSFNKYWEKCMNVPIEISQYLAPTRLVAAPGLANVRCCSIDDLGLESSKDVESSNALLSRAWSPGWRNAENMLEEFLSCGLLEYSKHGMKVGGTTTSLLSPYLHFGELSVRKVYQLVTMHHVKWQNEGKSEAEESVRLFLRSIGFREYSRYLCFNFPFTHERSFLGNLKHYPWLLDEDRFKSWRQGMTGYPLVDAGMRELWATGWTHNRIRVIVSSFAVKCLQIPWIWGMKYFWDVLLDADLESDILGWQYISGSLPDGHELSRLDNPEVQGQKYDPDGEYVRTWIPELARMPTEWIHCPWSAPNSILQVAGVELGFNYPKPIVELHMARECLDDAISTMWQLDTAAKLAALDGEVVDDNLNNIRSFDIPKVVLKKKLSPSTSSMNKRVLSTNGKNEKSQPTEVKAPYKQIIRDDMINASNMDDTGSTANLQVTRKRSRSDSAFNVPSSSSSLVMESRIHDNDSCSVRYSGYLQQTADRDDTDKVEDNDSEDSGTSISRPSKRPA

SEQ ID NO: 5547 - DNA, 1656 bp, Sorghum bicolor
  misc_feature: Ceres ANNOT ID no. 6045650
  misc_feature: Encodes the peptide sequence at SEQ ID NO 5548
atggcgagcctccggctcgccgtcacccactgcccggctcttcctctcccgaccccccatagccaccttcgccgccgccaactgcaactccatccctaccccaatcccctctccctctcaccccgcatctcctcccacctctcacctatccctcgccgccacctgcccccgctcttcgcatccgcatcggcctctcaagcggaaaccaagccgccgccaccgccgacggaggcatcgggcggtgctaagccgctgcccctcctcatctcgcttgccgccggcctcgccgtccgcttcctcgtgccgcggccggccgaggtaactccggaagcatggcagctcctctccatcttcctctccaccatcgcggggctcgtcctcggcccgctccccgtcggtgcgtgggcgttcctcggcctcaccgccaccgtcgccacgcgcacgctccccttcaccgccgcgttcggggcgttcactaacgaggtcatctggctcatcgtcatctccttcttcttcgcgcgcggcttcgtcaagaccggcctcggcgaccgcgtcgccacctacttcgtcaaatggctggggcgcagcactttgggcctatcctatgggcttgccatcagcgaggctttcatctcgcctgccatgcctagcactacggccagggcaggaggggttttccttcccatcgtcaagtcgctgtcgctctcgtcgggaagcaagcccaacgacccatcggcgaagaaacttggctcttatcttgtgcagtcgcagctacaggcagctgccaactccagtgctctcttcttgacagcggctgcacagaacctgttgtgtctgaagttagcagaggagattggtgttaatatcggaaacccatggattacttggttcaaggttgctagcgtgccagcacttcttgggcttttagtgactccttatttgatttacaaaatattccccccagaaataaaggacactcctgaagccccagcattagctgccgagaagctaaagttaatgggtccggtaacaaaaaatgaatgggtcatgattgcaacgatgcttcttgcagtctcactatggatttttggggaagctattggcgtatccagcgttgttgctgcaatgattggactctcaatacttcttctgcttggagtgctgaactgggaggattgtttgaatgagaagtctgcatgggacacccttgcttggtttgctattttagttggtttggctgggcagcttactaacctcgggattgtgtcctggatgtcaaattgtgttgccaaggttcttcaatctttctcattgagctggcctgcagcatttggtgttcttcaggcctcatacttcttaattcactatatatttgcaagccaaacagcacatgttggagctttatactcggcatttcttgccatgcatttagcagctggtgtgccagctgtaatgtcggcacttgctttggcatacaatgcaaacctctttggagcactaacacactatagcagcgggcaatctgcagtatactttggagcggggtatgttgaccttccagatgtattcaagctgggttttataacagccgcactcaatgccgtagtctggggagttgctggtgcattctggtggaaatttttgggtctttattga

SEQ ID NO: 5548 - protein, 551 aa, Sorghum bicolor
  misc_feature: Ceres ANNOT ID no. 6045650
  misc_feature (81)..(551): Pfam Id: Na_sulph_symp Pfam Desc: Sodium:sulfate symporter transmembrane region
  misc_feature (1)..(551): NCBI GI: 40363465 NCBI Desc: plastidic general dicarboxylate transporter [zea mays]
  misc_feature (1)..(551): NCBI GI: 40363463 NCBI Desc: plastidic general dicarboxylate transporter [zea mays]
  misc_feature (4)..(551): NCBI GI: 40363461 NCBI Desc: plastidic general dicarboxylate transporter [zea mays]
  misc_feature (2)..(551): NCBI GI: 22121976 NCBI Desc: glutamate/malate translocator [sorghum bicolor]
  misc_feature (41)..(551): NCBI GI: 22121978 NCBI Desc: glutamate/malate translocator [flaveria bidentis]
MASLRLAVTHCPALPLPTPHSHLRRRQLQLHPYPNPLSLSPRISSHLSPIPRRHLPPLFASASASQAETKPPPPPTEASGGAKPLPLLISLAAGLAVRFLVPRPAEVTPEAWQLLSIFLSTIAGLVLGPLPVGAWAFLGLTATVATRTLPFTAAFGAFTNEVIWLIVISFFFARGFVKTGLGDRVATYFVKWLGRSTLGLSYGLAISEAFISPAMPSTTARAGGVFLPIVKSLSLSSGSKPNDPSAKKLGSYLVQSQLQAAANSSALFLTAAAQNLLCLKLAEEIGVNIGNPWITWFKVASVPALLGLLVTPYLIYKIFPPEIKDTPEAPALAAEKLKLMGPVTKNEWVMIATMLLAVSLWIFGEAIGVSSVVAAMIGLSILLLLGVLNWEDCLNEKSAWDTLAWFAILVGLAGQLTNLGIVSWMSNCVAKVLQSFSLSWPAAFGVLQASYFLIHYIFASQTAHVGALYSAFLAMHLAAGVPAVMSALALAYNANLFGALTHYSSGQSAVYFGAGYVDLPDVFKLGFITAALNAVVWGVAGAFWWKFLGLY

SEQ ID NO: 5549 - DNA, 1527 bp, Sorghum bicolor
  misc_feature: Ceres ANNOT ID no. 6045666
  misc_feature: Encodes the peptide sequence at SEQ ID NO 5550
atgccactcgcgccatcaacccccgcgctgccgcctaacccggccctcccctcgccgtgccgggggcaggggcggggccggcccggccgcggggcgctcctccgcgcccgcgccgtccgcgcggcgccgcggcccccgagccagtggtccgtcggcagctggcggggccgcccggcgctgcagcagcccgaatacccggacaaggcggacctgaacgaggtgctgcggacggtggaggcgttcccgcccatcgtgtttgccggcgaggcgcgcaccctcgaggagcgcctcgcggaggccgccgtcggcagagctttcctcctccagggcggtgactgcgctgagagcttcaaggagttcaacgccaacaatattagggacacctttcgcgtcctcctgcaaatgtctgttgtgctcatgttcggaggccagatgcctgtcgtcaaggtgggaagaatggcaggtcagtttgcaaagccaagatcagatggttttgaggagcgggatggagtgaagttgccaagctatagaggggacaatatcaatggggatgcatttgatgagaagtcaagattgccagatccacaccgcatgataagtgcctactcacagtctgcagcaacgctgaatctgctgcgggcgttcgcaactggaggttatgctgcaatgcagagggtaacacaatggaaccttgatttcacagagcatagtgaacaaggggataggtacatggaattggctcaccgagttgacgaagctttggggttcatgtcagctgctggactcactttagatcaccctataatgacgacaacagaattctggacgtcacatgagtgccttcttctgccttatgagcaagcgctcacccgtgaagactccaccagtggcctctattatgattgctctgctcacttcctatgggttggagagcgcactcgccagcttgatggtgctcatgtggagttccttcgaggcatcgccaaccctcttggtatcaaggttagtgacaagatggacccagcagaacttgtgcggttgattgatatattgaatcccgaaaacagggctgggagaataaccatcatcgcaagaatgggacctgaaaacatgagggtgaaacttccacacctgatacgcgccgtccgtggggccggccagatagtaacatgggtcactgacccaatgcatgggaacaccatgaaggccccttgcggactcaaaacccgctcatttgacagaattttggccgaggtgcgtgcgttctttgatgtccacgaacaagaagggagccaccctggaggagtgcatctagagatgactgggcaaaatgttacagagtgcattggagggtcacgtaccgtgacatttgatgatctgggctcacgctaccacacgcactgcgacccaaggctcaacgcctcacagtctctggagatggcattcattatcgcggagcgccttaggaaaaggaggattgcctcgtcgcctttgtacacgaaccagctgggttccattcgtctgtga

SEQ ID NO: 5550 - protein, 508 aa, Sorghum bicolor
  misc_feature: Ceres ANNOT ID no. 6045666
  misc_feature (48)..(485): Pfam Id: DAHP_synth_2 Pfam Desc: Class-II DAHP synthetase family
  misc_feature (2)..(495): NCBI GI: 2398679 NCBI Desc: 3-deoxy-d-arabino-heptulosonate 7-phosphate synthase [morinda citrifolia]
  misc_feature (2)..(503): NCBI GI: 110832750 NCBI Desc: phospho-2-dehydro-3-deoxyheptonate aldolase 1, chloroplast precursor (phospho-2-keto-3-deoxyheptonate aldolase 1) (dahp synthetase 1) (3-deoxy-d-arabino-heptulosonate
  misc_feature (2)..(503): NCBI GI: 110832750 (continued) 7-phosphate synthase 1)
  misc_feature (2)..(503): NCBI GI: 115453341 NCBI Desc: os03g0389700 [oryza sativa (japonica cultivar-group)]
  misc_feature (32)..(498): NCBI GI: 2352925 NCBI Desc: plastidic 3-deoxy-d-arabino-heptulosonate 7-phosphate synthase 2 [petroselinum crispum]
  misc_feature (27)..(495): NCBI GI: 584777 NCBI Desc: phospho-2-dehydro-3-deoxyheptonate aldolase 1, chloroplast precursor (phospho-2-keto-3-deoxyheptonate aldolase 1) (dahp synthetase 1) (3-deoxy-d-arabino-heptulosonate
  misc_feature (27)..(495): NCBI GI: 584777 (continued) 7-phosphate synthase 1)
  misc_feature (2)..(503): SWISSPROT Homolog: EC 2.5.1.54 Phospho-2-dehydro-3-deoxyheptonate aldolase 1, chloroplast precursor
MPLAPSTPALPPNPALPSPCRGQGRGRPGRGALLRARAVRAAPRPPSQWSVGSWRGRPALQQPEYPDKADLNEVLRTVEAFPPIVFAGEARTLEERLAEAAVGRAFLLQGGDCAESFKEFNANNIRDTFRVLLQMSVVLMFGGQMPVVKVGRMAGQFAKPRSDGFEERDGVKLPSYRGDNINGDAFDEKSRLPDPHRMISAYSQSAATLNLLRAFATGGYAAMQRVTQWNLDFTEHSEQGDRYMELAHRVDEALGFMSAAGLTLDHPIMTTTEFWTSHECLLLPYEQALTREDSTSGLYYDCSAHFLWVGERTRQLDGAHVEFLRGIANPLGIKVSDKMDPAELVRLIDILNPENRAGRITIIARMGPENMRVKLPHLIRAVRGAGQIVTWVTDPMHGNTMKAPCGLKTRSFDRILAEVRAFFDVHEQEGSHPGGVHLEMTGQNVTECIGGSRTVTFDDLGSRYHTHCDPRLNASQSLEMAFIIAERLRKRRIASSPLYTNQLGSIRL

SEQ ID NO: 5551 - DNA, 1011 bp, Sorghum bicolor
  misc_feature: Ceres ANNOT ID no. 6045671
  misc_feature: Encodes the peptide sequence at SEQ ID NO 5552
atgccgtccgggtggaggggcatcctgggtttcgactacggcatcgtgcaggcgccgctcggccccgacatctccggcccggatctcgtcgccgccgtcgccaacgccggcgccatcggcctcctccgcctccccgactggccggcgccggatcacgtcagagagctgatccgaaagaccaggagcctcacgtccaagccgttcggggcggccatcgtgctggccttcccgcacgaggacaaccttagggtcgtcctggaggagaagctcgccgtgctgcaggtctattggggggacttccccaaggagagcgtgcaacaggcgcatcgcgccggagttaaggtcttgcatcaggtcggcagccttgaggaggcagctaaagctaaagaagccggtgtagatggaatcattgttcagggacgtgaagcaggggggcatgtaattggccaggaaggactgtttccgcagttgccaagagtagccgatcttgtttcagactcgggcattccagttatcgcagctgggggaattgtagatggacgtggctatgttgccgcattggcacttggggcccaaggagtttgtttaggaactaggttccttgctaccgaggaaagctttgcgcatcctatttataaacaaaagttaattgagatgagtcgcacaggctacacaaatatttttggacgtgctagatggcctggtgctccacaacgtgtcctggaaacacccttctatgttgagtggaaggataatttcccagatcaggaaacagaggaaaatcatcccatcataggccactctatcatccatggtgtgcacaaggatattcgtcggtttgccggcactgttccaaacgccacggcaacaggagatatcaacatcatggccatgtacgcgggtcagggtgttgggctaatcaaggagatcgtaccagctgctgaagttgtcaaaagtctggtcgctgaagcaaaggaagtcattagagaaaagctttctggttaccagtaa

SEQ ID NO: 5552 - protein, 336 aa, Sorghum bicolor
  misc_feature: Ceres ANNOT ID no. 6045671
  misc_feature (2)..(323): Pfam Id: NPD Pfam Desc: 2-nitropropane dioxygenase
  misc_feature (4)..(278): NCBI GI: 115476982 NCBI Desc: os08g0485400 [oryza sativa (japonica cultivar-group)]
  misc_feature (50)..(333): NCBI GI: 21554163 NCBI Desc: 2-nitropropane dioxygenase-like protein [arabidopsis thaliana]
  misc_feature (4)..(198): NCBI GI: 42409409 NCBI Desc: 2-nitropropane dioxygenase-related protein-like [oryza sativa (japonica cultivar-group)]
  misc_feature (24)..(332): NCBI GI: 38505809 NCBI Desc: 2-nitropropane dioxygenase [synechocystis sp. pcc 6803]
  misc_feature (8)..(330): NCBI GI: 88863181 NCBI Desc: 2-nitropropane dioxygenase, npd [jannaschia sp. ccs1]
MPSGWRGILGFDYGIVQAPLGPDISGPDLVAAVANAGAIGLLRLPDWPAPDHVRELIRKTRSLTSKPFGAAIVLAFPHEDNLRVVLEEKLAVLQVYWGDFPKESVQQAHRAGVKVLHQVGSLEEAAKAKEAGVDGIIVQGREAGGHVIGQEGLFPQLPRVADLVSDSGIPVIAAGGIVDGRGYVAALALGAQGVCLGTRFLATEESFAHPIYKQKLIEMSRTGYTNIFGRARWPGAPQRVLETPFYVEWKDNFPDQETEENHPIIGHSIIHGVHKDIRRFAGTVPNATATGDINIMAMYAGQGVGLIKEIVPAAEVVKSLVAEAKEVIREKLSGYQ

SEQ ID NO: 5553 - DNA, 1119 bp, Sorghum bicolor
  misc_feature: Ceres ANNOT ID no. 6045831
  misc_feature: Encodes the peptide sequence at SEQ ID NO 5554
atgaagaaaccaaatccgatccttacggtgttgtctgcggcatcaatcggtttcttgatcggcgtctcttttcccttacgaatcgcaccaacggtggtattcccgttcagcctgggtgatggaaactgcatcgtcagcggcaggaacatacttgccagattttcaacacccttcggaaatagcacttctacagcagaggggactcctgtgctgcagcagtcaaatgccacttcggattcagagaagactgctccgctggaaaaaacaaaaccaaaaggcgcggagcggctaccaccaaacatcgttgttcgagagtctgatcttcacatgcgccggctttggggacacccgcgtgaggacaccccccctcgcaaatacctcctggtgctgacagtgggttacagcgatagagacaacgtcaatgcgatggttcacaagttctcagacaatttcgatgtgatgttgttccactacgacggtcggacgacagagtgggatgagttcgagtggtccaagcaagccattcatgtcagcgccaggaagcaggccaaatggtggtacgccaagaggttcatgcaccccagcatcgtggcgccctatgagtacgtcttcctgtgggaccacgacctcggagttgagaccttcgacgcggaggagtacatcaagattgtaaagaagcacgggctggagatttcgcagccgggcctggacatcgtcaggggggtcaagagctttgatatcaatgtcagaaggaacgacactgagatacacaccgggttcgtggaggtgatggctcccgtcttgaccagagaggcctggagttgcgtgtggcacatgatccagaacgacctggtacacggctggggtctcgactggaacttctggagatgcgtcgatgagcctgagcagcagatcggtgtggtcgacgcgcagtacgtggcgcatcacgaggggtttacgctcggaaacaaggacaacgacaccgtggatggaagccgccgcaaggtcaggctccggtcctcagctgagtttggcatgttgaaagccagattgtacaatgcggacagggcccaggccgcagctcttcttgcaaaatccaatgcagcgccaccgtcataa

SEQ ID NO: 5554 - protein, 372 aa, Sorghum bicolor
  misc_feature: Ceres ANNOT ID no. 6045831
  misc_feature (1)..(367): NCBI GI: 54291145 NCBI Desc: storage protein-like [oryza sativa (japonica cultivar-group)]
  misc_feature (86)..(367): NCBI GI: 54291144 NCBI Desc: storage protein-like [oryza sativa (japonica cultivar-group)]
  misc_feature (89)..(257): NCBI GI: 8778842 NCBI Desc: t6d22.12 [arabidopsis thaliana]
  misc_feature (2)..(257): NCBI GI: 23309021 NCBI Desc: at3g26440/f20c19_16 [arabidopsis thaliana]
  misc_feature (87)..(257): NCBI GI: 9743342 NCBI Desc: f21j9.23 [arabidopsis thaliana]
MKKPNPILTVLSAASIGFLIGVSFPLRIAPTVVFPFSLGDGNCIVSGRNILARFSTPFGNSTSTAEGTPVLQQSNATSDSEKTAPLEKTKPKGAERLPPNIVVRESDLHMRRLWGHPREDTPPRKYLLVLTVGYSDRDNVNAMVHKFSDNFDVMLFHYDGRTTEWDEFEWSKQAIHVSARKQAKWWYAKRFMHPSIVAPYEYVFLWDHDLGVETFDAEEYIKIVKKHGLEISQPGLDIVRGVKSFDINVRRNDTEIHTGFVEVMAPVLTREAWSCVWHMIQNDLVHGWGLDWNFWRCVDEPEQQIGVVDAQYVAHHEGFTLGNKDNDTVDGSRRKVRLRSSAEFGMLKARLYNADRAQAAALLAKSNAAPPS

SEQ ID NO: 5555 - DNA, 1116 bp, Sorghum bicolor
  misc_feature: Ceres ANNOT ID no. 6045863
  misc_feature: Encodes the peptide sequence at SEQ ID NO 5556
  misc_feature: Down-regulated in shoot tissues in response to salicylic acid treatment
atggctgcttctgcagctgctggtgtgcagatggtggctgcacgcccttgcatctcagcctcgcaaggaattcatgctgcaagggtagcggtttctaggactgactgcatgctcagtaccactgctacattccccaaaatcagttgctcctggcctctagattctaagcgcaatggtgttcttgtaagagcaatatcaggagagagtggccggcaggggcttcccattgatctcagaggtaaaagggcatttattgctggagttgctgatgataatggctatggatgggcaattgcaaaggcacttgctgcggctggtgctgaaattcttgttggtacatgggtgccggcacttaacatatttgagacaagtctgaggcgtggaaagtttgatgaatcacggaagctgccagatggatcccttatggatattgttaaagtctatccactcgatgctgtctacgattcccctgatgatgttcctgaagatgtcaaatcgaacaaaagatatgcagggtcatcaaactggacagtaaaggaagttgttgaatcagtgaagaatgattttggcagcattgacatactagtgcattctcttgctaatggcccagaagtaacgaagcctttgttggaaacatcaagaagaggctatcttgcggcaatttcagcatccagttactcctatgtttcattgcttcagcacttccttcctataatgaatcccggtggtgctagcatctctctaacatacattgcatctgaaagggcgattcctgggtatggtggtggcatgagttctgctaaagcagctcttgagagtgatacacgggtgcttgcttttgaagctggccgaaaaggcaaaatcagagttaacaccatatcagcaggccctcttgggagccgagctgctaaggcaattggatttattgagaagatgatagagtactcatatgttaattcaccattgcagaaggaactgttggctgatgaggtggggaacacggctgcattcctggtttcttcattggcttctgccatcactggctcaacggtttatgttgacaatggactcaatacaatggggattgcaattgacagccctaccataacgtcatag

SEQ ID NO: 5556 - protein, 371 aa, Sorghum bicolor
  misc_feature: Ceres ANNOT ID no. 6045863
  misc_feature (1)..(371): NCBI GI: 2653285 NCBI Desc: enoyl-acp reductase [oryza sativa (japonica cultivar-group)]
  misc_feature (1)..(367): NCBI GI: 14422255 NCBI Desc: enoyl-[acyl-carrier protein] reductase [brassica napus]
  misc_feature (1)..(367): NCBI GI: 7546501 NCBI Desc: enoyl-acyl carrier protein reductase [brassica napus]
  misc_feature (1)..(367): NCBI GI: 14422257 NCBI Desc: enoyl-[acyl-carrier protein] reductase [brassica napus]
  misc_feature (1)..(367): NCBI GI: 99805 NCBI Desc: enoyl-[acyl-carrier-protein] reductase (nadh2) (ec 1.3.1.9) precursor - rape
  misc_feature (1)..(367): SWISSPROT Homolog: EC 1.3.1.9 Enoyl-[acyl-carrier-protein] reductase [NADH], chloroplast precursor
  misc_feature: The sequence is a functional homolog of SEQ ID NO 2 in US patent 7141721
  misc_feature: Down-regulated in shoot tissues in response to salicylic acid treatment
MAASAAAGVQMVAARPCISASQGIHAARVAVSRTDCMLSTTATFPKISCSWPLDSKRNGVLVRAISGESGRQGLPIDLRGKRAFIAGVADDNGYGWAIAKALAAAGAEILVGTWVPALNIFETSLRRGKFDESRKLPDGSLMDIVKVYPLDAVYDSPDDVPEDVKSNKRYAGSSNWTVKEVVESVKNDFGSIDILVHSLANGPEVTKPLLETSRRGYLAAISASSYSYVSLLQHFLPIMNPGGASISLTYIASERAIPGYGGGMSSAKAALESDTRVLAFEAGRKGKIRVNTISAGPLGSRAAKAIGFIEKMIEYSYVNSPLQKELLADEVGNTAAFLVSSLASAITGSTVYVDNGLNTMGIAIDSPTITS

SEQ ID NO: 5557 - DNA, 1176 bp, Sorghum bicolor
  misc_feature: Ceres ANNOT ID no. 6045960
  misc_feature: Encodes the peptide sequence at SEQ ID NO 5558
atggaattgcggccgtggctgctcttagtggtcgtcgcgatcgtcgtgtcaatatctgcagacggggggaccgtcataaacgtcaagaactacggggcccatggcaatggcgccaatgacgattccaagccactgatggcggcgtggaaggcagcgtgcggatcagctggcgcggtgacgatggtcgtgacgccggggacgtactacatcggtccggtgcagttccacggcccctgcaaggcctccagcttgaccttccagctgcagggtagtacgctcaaggccgccacggacctgagcaagttcggcaacgactggatcgagttcgggtgggtgaacgggcttaccgtcacaggcggcaccattgacggccagggcgccgcctcgtggcccttcaacaagtgccccgtccgcaaggactgcaaagtcctgcccaccagcgtgctgttcgtgaacaaccagaacacagtggtgcgcgacgtgacgtcagtgaatcccaagttcttccacatggcgctgctgacggtcaagaacatccggatgagcgggctcaagatcagcgcgccgtccaacagtcccaacacggatggcatccacatcgagcgcagcagcggcatacaaatcacggacacgcgcatcagcacgggcgacgactgcatctccatcggtcagggcaacgacaacgtgcaaattgcccgcgtgcagtgcggccccggccacggcatgagtgtcggcagcttgggtcggtatgccagcgagggcgacgtcacacgggtccacgtccgcgacatgaccttcacgggcaccacgaacggcgttcgcatcaagacatgggagaactccccttccaaaagccacgccgcacacatggttttcgagaacatggtcatgaaggacgtccagaaccccattatcatcgaccagaagtactgcccctactacaactgcgagcacaagtacgtgtccggggtgactatccaggacattcagttcaagaacatcaagggcacggcggcgacccaggtggcggtgttactacggtgcggtgtgccgtgccagggtctggtgctgcaggacgtggaccttaggtacaaggggcagggtggtacattggccaagtgcgagaatgccaaggccaagtacgttggcaaccagtttcccaagccgtgcccgtag

SEQ ID NO: 5558 - protein, 391 aa, Sorghum bicolor
  misc_feature: Ceres ANNOT ID no. 6045960
  misc_feature (53)..(390): Pfam Id: Glyco_hydro_28 Pfam Desc: Glycosyl hydrolases family 28
  misc_feature (27)..(390): NCBI GI: 34223511 NCBI Desc: oil palm polygalacturonase allergen pest459 [elaeis guineensis]
  misc_feature (25)..(390): NCBI GI: 7268611 NCBI Desc: polygalacturonase-like protein [arabidopsis thaliana]
  misc_feature (46)..(390): NCBI GI: 2832691 NCBI Desc: polygalacturonase-like protein [arabidopsis thaliana]
  misc_feature (23)..(387): NCBI GI: 49523394 NCBI Desc: polygalacturonase [platanus x acerifolia]
  misc_feature (7)..(390): NCBI GI: 61393763 NCBI Desc: polygalacturonase [lilium longiflorum]
  misc_feature: Useful for making plants with altered cell wall content and/or composition
  misc_feature: GREAT-hit functional homolog of the protein sequence encoded by LOCUS at4g18180
MELRPWLLLVVVAIVVSISADGGTVINVKNYGAHGNGANDDSKPLMAAWKAACGSAGAVTMVVTPGTYYIGPVQFHGPCKASSLTFQLQGSTLKAATDLSKFGNDWIEFGWVNGLTVTGGTIDGQGAASWPFNKCPVRKDCKVLPTSVLFVNNQNTVVRDVTSVNPKFFHMALLTVKNIRMSGLKISAPSNSPNTDGIHIERSSGIQITDTRISTGDDCISIGQGNDNVQIARVQCGPGHGMSVGSLGRYASEGDVTRVHVRDMTFTGTTNGVRIKTWENSPSKSHAAHMVFENMVMKDVQNPIIIDQKYCPYYNCEHKYVSGVTIQDIQFKNIKGTAATQVAVLLRCGVPCQGLVLQDVDLRYKGQGGTLAKCENAKAKYVGNQFPKPCP

SEQ ID NO: 5559 - DNA, 1176 bp, Sorghum bicolor; identical to SEQ ID NO: 5557
  misc_feature: Ceres ANNOT ID no. 6045964
  misc_feature: Encodes the peptide sequence at SEQ ID NO 5560

SEQ ID NO: 5560 - protein, 391 aa, Sorghum bicolor; identical to SEQ ID NO: 5558
  misc_feature: Ceres ANNOT ID no. 6045964
  misc_feature (53)..(390): Pfam Id: Glyco_hydro_28 Pfam Desc: Glycosyl hydrolases family 28
  misc_feature (27)..(390): NCBI GI: 34223511 NCBI Desc: oil palm polygalacturonase allergen pest459 [elaeis guineensis]
  misc_feature (25)..(390): NCBI GI: 7268611 NCBI Desc: polygalacturonase-like protein [arabidopsis thaliana]
  misc_feature (46)..(390): NCBI GI: 2832691 NCBI Desc: polygalacturonase-like protein [arabidopsis thaliana]
  misc_feature (23)..(387): NCBI GI: 49523394 NCBI Desc: polygalacturonase [platanus x acerifolia]
  misc_feature (7)..(390): NCBI GI: 61393763 NCBI Desc: polygalacturonase [lilium longiflorum]
  misc_feature: Useful for making plants with altered cell wall content and/or composition
  misc_feature: GREAT-hit functional homolog of the protein sequence encoded by LOCUS at4g18180

SEQ ID NO: 5561 - DNA, 1239 bp, Sorghum bicolor
  misc_feature: Ceres ANNOT ID no. 6047071
  misc_feature: Encodes the peptide sequence at SEQ ID NO 5562
atggcaagtgaagcagcaccggcggcggcggcatccatcatctccaacaacaacccctgcttattcgctgctcctctcaccaaccaccagcagcagcagcagcagctggcactccctcctcccgccaagaagaagcgcagcctcccgggcacaccagaccctgacgcggaggtgatcgcgctctcgccgcggacgctgctggcgacgaaccggttcgtgtgcgagatctgcggcaaggggttccagcgcgaccagaacctgcagctgcaccggcgcggccacaacctcccctggaagctccggcagcgcagcggcaaggagccccggaagcgcgtgtacgtgtgcccggagaagacgtgcgtccaccacaacccgtcccgcgcgctgggcgacctcaccggcatcaagaagcacttctgccgcaagcacggcgagaagaagtggaagtgcgacaagtgcaacaagcgctacgccgtgcagtccgactggaaggcgcacgccaagacatgcggcaccagggagtacagatgcgactgcggcacgctattctcaaggcgggacagcttcatcacccaccgcgccttctgcgacgcgctcgccgaggagacggccaggctcaacgccgcctccagcgccggcgccgccacgtcctacctcttcgcgggctcgccgccggggctgcaccccaacatgatgctgccaccgctgggctggctgtgcgggaacggcagcaagctcgcgtcgtcgaacgccagcgagctgacgagcgccgccgctgcgtcggggaagcaggacacggacagcgtcttcagcgggcagcaccacgccaagcccacggcgccggccgccgacatgtccgcgacggcgctgctgcagaaggccgcgcagatgggtgctgtcacgtccgggtccggcaatgcgatgtcgatgccgccgggggccttggagccggccgatattggtcatcatcagtcgtcggacggtgctggaggtctgctgtttagcgcatcaagccagcagaacgctactaatctcaggctcaggggaacagatactacactaataatgagccacctcacagcggcggccgccgggaacatgccgtacgacgtgctctctgctgtgcgccatgccggcctcaaggatgctgccgtcgccgtcgggagggaggagaccagggatttcttgggcgttggcgtgcaagcgctgtgctcatcgtcgttgaatggctggatttag

SEQ ID NO: 5562 - protein, 412 aa, Sorghum bicolor
  misc_feature: Ceres ANNOT ID no. 6047071
  misc_feature (72)..(94): Pfam Id: zf-C2H2 Pfam Desc: Zinc finger, C2H2 type
  misc_feature (1)..(205): NCBI GI: 92870471 NCBI Desc: zinc finger, c2h2-type [medicago truncatula]
  misc_feature (30)..(206): NCBI GI: 55418546 NCBI Desc: indeterminate-related protein 1 [zea mays]
  misc_feature (24)..(217): NCBI GI: 140064565 NCBI Desc: zinc finger, c2h2-type [medicago truncatula]
  misc_feature (41)..(205): NCBI GI: 87162706 NCBI Desc: zinc finger, c2h2-type [medicago truncatula]
  misc_feature (34)..(210): NCBI GI: 23198204 NCBI Desc: zinc finger protein [arabidopsis thaliana]
  misc_feature: The plant is abnormally small.
  misc_feature: The sequence is a functional homolog of SEQ ID NO 1074 in the 10/666,642US patent application
  misc_feature: The sequence is a functional homolog of SEQ ID NO 1075 in the 10/666,642US patent application
  misc_feature: The sequence is a functional homolog of SEQ ID NO 1076 in the 10/666,642US patent application
  misc_feature: The sequence is a functional homolog of SEQ ID NO 1077 in the 10/666,642US patent application
  misc_feature: The sequence is a functional homolog of SEQ ID NO 1078 in the 10/666,642US patent application
  misc_feature: The sequence is a functional homolog of SEQ ID NO 1079 in the 10/666,642US patent application
  misc_feature: The sequence is a functional homolog of SEQ ID NO 1086 in the 10/666,642US patent application
  misc_feature: The sequence is a functional homolog of SEQ ID NO 1087 in the 10/666,642US patent application
  misc_feature: The sequence is a functional homolog of SEQ ID NO 1785 in the 10/374,780US patent application
  misc_feature: The sequence is a functional homolog of SEQ ID NO 214 in the 10/225,066US patent application
  misc_feature: The sequence is a functional homolog of SEQ ID NO 2450 in the 10/374,780US patent application
  misc_feature: The sequence is a functional homolog of SEQ ID NO 36 in the 10/666,642US patent application
  misc_feature: The sequence is a functional homolog of SEQ ID NO 60 in the 10/412,699US patent application
  misc_feature: The sequence is a functional homolog of SEQ ID NO 604 in the 10/412,699US patent application
  misc_feature: Useful for making plants with modulated biomass
  misc_feature: Useful for making plants with modulated growth and phenotype characteristics
  misc_feature: The sequence is a functional homolog of SEQ ID NO 60 in the 20040045049 US patent application
  misc_feature: The sequence is a functional homolog of SEQ ID NO 604 in the 20040045049 US patent application
  misc_feature: The sequence is a functional homolog of SEQ ID NO 1785 in the 20060162006 US patent application
  misc_feature: The sequence is a functional homolog of SEQ ID NO 1074 in the 20070033671 US patent application
  misc_feature: The sequence is a functional homolog of SEQ ID NO 1075 in the 20070033671 US patent application
  misc_feature: The sequence is a functional homolog of SEQ ID NO 1076 in the 20070033671 US patent application
  misc_feature: The sequence is a functional homolog of SEQ ID NO 1078 in the 20070033671 US patent application
  misc_feature: The sequence is a functional homolog of SEQ ID NO 1079 in the 20070033671 US patent application
  misc_feature: The sequence is a functional homolog of SEQ ID NO 1086 in the 20070033671 US patent application
  misc_feature: The sequence is a functional homolog of SEQ ID NO 1087 in the 20070033671 US patent application
  misc_feature: Functional homolog of the protein sequence given in SEQ ID NO 13571
  misc_feature: The sequence is a functional homolog of SEQ ID NO 1524 in the 10/666,642 US patent application
  misc_feature: The sequence is a functional homolog of SEQ ID NO 1087 in the 10/666,642 US patent application
  misc_feature: Useful for making plants with altered lignin content
  misc_feature: Functional homolog of the protein sequence given in SEQ ID NO 13275
  misc_feature: The sequence is a functional homolog of SEQ ID NO. 455 in the 11/188,298 US application
MASEAAPAAAASIISNNNPCLFAAPLTNHQQQQQQLALPPPAKKKRSLPGTPDPDAEVIALSPRTLLATNRFVCEICGKGFQRDQNLQLHRRGHNLPWKLRQRSGKEPRKRVYVCPEKTCVHHNPSRALGDLTGIKKHFCRKHGEKKWKCDKCNKRYAVQSDWKAHAKTCGTREYRCDCGTLFSRRDSFITHRAFCDALAEETARLNAASSAGAATSYLFAGSPPGLHPNMMLPPLGWLCGNGSKLASSNASELTSAAAASGKQDTDSVFSGQHHAKPTAPAADMSATALLQKAAQMGAVTSGSGNAMSMPPGALEPADIGHHQSSDGAGGLLFSASSQQNATNLRLRGTDTTLIMSHLTAAAAGNMPYDVLSAVRHAGLKDAAVAVGREETRDFLGVGVQALCSSSLNGWI

SEQ ID NO: 5563 - DNA, 423 bp, Sorghum bicolor
  misc_feature: Ceres ANNOT ID no. 6047172
  misc_feature: Encodes the peptide sequence at SEQ ID NO 5564
atgggtcgtctgttgctggtgagcctcccggcgacgggcgccatcatctaccgctgcaagcactgcgacacccacctcgcctacgacaccgacatcatcgcaaggacgttccgcgtgaacgtgaatgttggtagcaaggacgaccggatgatgacgacgggtctgcacaccgtctgcgacatcttctgcgtcgcctgcggagccatccttggctggaaatacctcgtcgccttcgacaagagccagaggtacaaggaaggcaagttcatcctcgacaggtccaccgccctcgccgctcgtggtgatgctgctcatgctcatgctcatgctgaccatgcccaccaccaccaccaccatgctcgcgtgacaagctctgctgacgacgacgatcccagcgatgacgaagatgaccaacacatgtga

SEQ ID NO: 5564 - protein, 140 aa, Sorghum bicolor
  misc_feature: Ceres ANNOT ID no. 6047172
  misc_feature (1)..(99): Pfam Id: Yippee Pfam Desc: Yippee putative zinc-binding protein
  misc_feature (1)..(101): NCBI GI: 106879157 NCBI Desc: at3g08990 [arabidopsis thaliana]
  misc_feature (1)..(93): NCBI GI: 5923664 NCBI Desc: yippee-like protein [arabidopsis thaliana]
  misc_feature (1)..(115): NCBI GI: 24745964 NCBI Desc: yippee-like protein [solanum tuberosum]
  misc_feature (1)..(93): NCBI GI: 145332026 NCBI Desc: yippee family protein [arabidopsis thaliana]
  misc_feature (1)..(93): NCBI GI: 42571143 NCBI Desc: yippee family protein [arabidopsis thaliana]
MGRLLLVSLPATGAIIYRCKHCDTHLAYDTDIIARTFRVNVNVGSKDDRMMTTGLHTVCDIFCVACGAILGWKYLVAFDKSQRYKEGKFILDRSTALAARGDAAHAHAHADHAHHHHHHARVTSSADDDDPSDDEDDQHM

SEQ ID NO: 5565 - DNA, 1731 bp, Sorghum bicolor
  misc_feature: Ceres ANNOT ID no. 6047183
  misc_feature: Encodes the peptide sequence at SEQ ID NO 5566
atggccgatccgtacggcgacggcaagggcccatcactcaagaaccagcagccgcgccccggcccccgtctcaagcccgccatcgagatggaggacctcatcaacctcctccacggatccgatccagtccgggtcgagctcacccgccttgagaacgagctgcagttcaaggagaaggagctgggcgatgcgcaggcggagatcaaggctctccgcctgtcggaccgcgcgcgcgagaaggccgtacaggatcttaccgaagaattggcaaaggtggatgagaagctgaagctcacagagtctctcctcgaaagcaaaaaccttgaagcaaagaagatcaacgacgaaaaaaaagcagcacttgccgcacagtttgcagctgaggcaaccttacgaagggttcatgcggcacagaaggacgatgacatgcctcctattgaggccattctcgcaccactggaagctgagctgaaactggcccgtcaagagattgcaaaattacaagatgacaacagggcattggatcgtcttacaaagtctaaggaagcagctctgcttgaagcggaaaggacggttcagatggcactggcaaaagcttctttggtggatgatctgcaaaacaaaaaccaagaattgatgaaacagattgagatatgccaggaagagaacaaaatcttggatagaatgcaccgccagaaagttgctgaggttgaaaagctcactcagactgtcagagaactagaagaatctgttcttgctggtggtgcagctgcaaatgctgtcagagactatcagcggaaagttcaggagatgaatgaggaaatgaaaactcttgatcgtgagctagctcgtgcaaaggtttcagcaaatagggttgctgttgtggtggcaaatgagtggaaagacggcaatgataaagtaatgcctgttaaacaatggctcgaggaacgaaggattctgcaaggagaaatgcagcaactccgggacaaacttgctattgcagaaagggctgcaagatcagaagctcaactgaaagagaagttccagctacgacttaaggtacttgaggaaggattgagaatgcctacatcgcgaaccaatgtcagtggcacacgccgccagtctattggtggtgctgatggtttgtctaaggccaatggcttcctgtccaaacgcccatcattccagatgagatcatcagtgtctaccacaacaactctagttaaccatgcaaaaggagcgtccaagtcatttgatggaggctgtagatcacttgaacgctataagggtcttgtaaatgggaacggtatgaacatatctaccgattccagtgaagataaggagtcaagcaactcagatgagaagtgtaatgagtttgcatctgctgagtcggaggactcggtgtcaggtgttctatatgatatgctgcaaaaggaggtcattgctctaaggaaggcatgccatgaaaaggatcaaagcctgaaagacaaggacgacgcagttgagatgttggcaaagaaagtagatactttgacaaaagctatggagtcagatgccaagaaatcgaggcgtgagttagctgctatggagaaggagttggcagctgtgcgcatggagaaagagcaggataacagagcgaaacgctttggtagttcaagtggttctggtagcagttcgcagctcccatctggcaggactttacctcggagtggctcatcgcgcaacatgtga

SEQ ID NO: 5566 - protein, 576 aa, Sorghum bicolor
  misc_feature: Ceres ANNOT ID no. 6047183
  misc_feature (201)..(532): Pfam Id: Myosin_HC-like Pfam Desc: Myosin II heavy chain-like
  misc_feature (5)..(541): NCBI GI: 23463063 NCBI Desc: at1g68060/t23k23_9 [arabidopsis thaliana]
  misc_feature (14)..(541): NCBI GI: 92891211 NCBI Desc: myosin ii heavy chain-like [medicago truncatula]
  misc_feature (1)..(541): NCBI GI: 52076974 NCBI Desc: myosin ii heavy chain-like [oryza sativa (japonica cultivar-group)]
  misc_feature (5)..(560): NCBI GI: 9945080 NCBI Desc: f5a9.19 [arabidopsis thaliana]
  misc_feature (41)..(541): NCBI GI: 2245081 NCBI Desc: myosin ii heavy chain like protein [arabidopsis thaliana]
MADPYGDGKGPSLKNQQPRPGPRLKPAIEMEDLINLLHGSDPVRVELTRLENELQFKEKELGDAQAEIKALRLSDRAREKAVQDLTEELAKVDEKLKLTESLLESKNLEAKKINDEKKAALAAQFAAEATLRRVHAAQKDDDMPPIEAILAPLEAELKLARQEIAKLQDDNRALDRLTKSKEAALLEAERTVQMALAKASLVDDLQNKNQELMKQIEICQEENKILDRMHRQKVAEVEKLTQTVRELEESVLAGGAAANAVRDYQRKVQEMNEEMKTLDRELARAKVSANRVAVVVANEWKDGNDKVMPVKQWLEERRILQGEMQQLRDKLAIAERAARSEAQLKEKFQLRLKVLEEGLRMPTSRTNVSGTRRQSIGGADGLSKANGFLSKRPSFQMRSSVSTTTTLVNHAKGASKSFDGGCRSLERYKGLVNGNGMNISTDSSEDKESSNSDEKCNEFASAESEDSVSGVLYDMLQKEVIALRKACHEKDQSLKDKDDAVEMLAKKVDTLTKAMESDAKKSRRELAAMEKELAAVRMEKEQDNRAKRFGSSSGSGSSSQLPSGRTLPRSGSSRNM

SEQ ID NO: 5567 - DNA, 3369 bp, Sorghum bicolor
  misc_feature: Ceres ANNOT ID no. 6047185
  misc_feature: Encodes the peptide sequence at SEQ ID NO 5568
atggggggcgatggtgttcctgagcctgacgacgcggtgctcttcgttggggtgtcgctggtgctgggcatcgcctcccgccacctcctccgcgggacccgcgtcccctacaccgtcgcccttctcgtcctcggagtcgcgcttgggtccctcgaatacggaacacaacatggtctaggcaaacttggagctggaattcgtatctgggctaacataaaccctgatcttctgctggctgtctttttacctgccctcctctttgaaagctccttctccatggaagtacaccaaataaagagatgtatggcacagatggtgttacttgctggaccaggtgtggtagtatcaacagttttacttggtgctgccgtaaagctcacttttccttacaactggagctggaaaacatcattgttgcttggcggactgcttagtgcaactgatccagttgctgtggttgcactgctaaaagaactcggagcaagtaaaaagcttagtacaatcattgagggtgaatccttaatgaatgatgggaccgctatcgttgtctatcagttattctatcgaatggtgcttggaagaacctttgatgctggctcaataataaagttcttgtctgaagtttcacttggagctgttgctctgggccttgcatttggaatcatgtcaatactgtggctaggctttatttttaatgatacaatcatagagattgcacttactcttgctgtcagctatatagctttcttcactgcgcaagactcactcgaggtctctggtgttttgaccgtcatgacactgggaatgttctatgcagcttttgcaaaaactgcttttaagggtgaaagtcagcaaagtttacaccatttctgtggggttgttattgcagatggcgttctacaaaataatgcccactttgagaggcacggcagttcatggggcttccttctgctgctctatgtctttgtacagatatctcgacttatagttgttggtgttttgtaccctttgttgcgtcagtttgggtatgggttggactggaaagaggccatgattcttgtttggtcagggctgcgaggggctgttgctctgtcactatcattatctgttaagcgtaccagcgatgcagttcaaccttaccttaaaccagaagttggaacaatgtttgtgttcttcactggtggcatcgtgtttctgacattgatttttaatggctcaaccacacaatttttgctacatatgctcagcatggacaaattgtcggccacaaagcttcgtatattgaaatatacaagatatgaaatgctaaacaaagcattagagtcttttggtgagctaagggatgacgaggaacttggacctgctgactggattactgtaaagaaatatatcacatgtttgaatgacctagacaatgagccagagcatccccatgatgtcagtggcaaagatgatcacatgcatatcatgaacttaacagatatccgagtgcggcttttgaatggtgtgcaagctgcttactggggaatgcttgaagaaggacgaataactcaagctacagcaaatattctgatgagatccgttgatgaagctatggatcttgtttccgaacaaaaattatgtgattggaaaggtttaaagtctaatgtccagttcccaaattactataggttccttcagatgagtaggttaccacgaaagcttgtcacatacttcacagtcgaaagattagagtctggatgttacatctgtgctgcatttcttcgtgctcacagaattgcaaggcgacagctacatgattttcttggcgatagtgaggttgcaagaactgttattgatgaaagtaacgctgagggagaggaagctagaaaattcttggaagatgttcgagttacattcccgcaggtgctacgagtgctaaagacacgacaagtcacatattctgtgctgacacacttgagtgagtatattcaaaacctccagaagactgggctgctggaagagaaggaaatggtccagttagatgatgctctgcagacagacttgaagaagttgcagaggaatccaccaatagtgaaaatgccaagagtcagtgaccttctgaacactcatcctttagttggcgcgctgcctgctgctgtgcgtgatcctttgctaagtaatacaaaggaaaccgtgcgaggacagggcacaaccctgtatagggaaggctccaggccaaccggtatatggcttgtttctattggtgtagtaaagtggacgagtcagagattaagcagaaggcattgcttagatccaattctatcacatggaagcactttgggactgtatgaggtgctgattggaaagccatatatctgtgacatgaccacggattcagtggcacactgtttcttcatcgaaactgaaaagatagaagagctgcgccattcagatccttcgattgaggttttcctgtggcaggaaagcgctctggttcttgccaggcttttgctccctcgcatattcgagaaaatgggaatgcatgagatgagggttctcattgctgaaaggtcgaccatgaacatatacatcaagggagaagacttggaagtggaggagaattgcattggcattttgctggaaggattcttgaagaccgacaacctgactctaatcacgcctccagcggtgcttctgccatccgatgctgacttgggtctcgagtcctcagactactgtcatactgcacctaggtatcaggtggaagctagagcacggatcatcttcttggaggaggcagaggcccatcttcatcgaagtgcgtcgcggctgctgctgccccaagggcaaggaggaggtcatgagccaacacggagcatgagcaaggagcacagcggcttgctcagctggcccgagagcttccggaggtcccgtggcaacctaggcctagcagctgagatgctgccgggcggcttgtcttccagggccctgcaactgagcatgtacggcagcatggtgatcctctcctccggccagggccactctcaccggcggcaggggcgtcatcgcgtgcaggcgacgacaacagaccagaagcaaagctcgtcctacccaaggatgccatccatatccaaagaacggcctctgctctccgtgcaatcagagggctccaacatgaagcgagtggcagctctacctctcagagacgacgctgctgaggttgaggctccggcagcccagcagcggcggcggcggaaggctatgcacttgcaggaggacaactcaagcgacgactccgccggcgaagaagtcattgtcagagttgactcgcccagcatgctctctttccgtcagtcagccgccgcacctccgccgcaggaccagtag

SEQ ID NO: 5568 - protein, 1122 aa, Sorghum bicolor
  misc_feature: Ceres ANNOT ID no. 6047185
  misc_feature (13)..(414): Pfam Id: Na_H_Exchanger Pfam Desc: Sodium/hydrogen exchanger family
  misc_feature (724)..(814): Pfam Id: cNMP_binding Pfam Desc: Cyclic nucleotide-binding domain
  misc_feature (8)..(1112): NCBI GI: 119359748 NCBI Desc: na+/h+ antiporter [phragmites australis]
  misc_feature (8)..(1112): NCBI GI: 119359750 NCBI Desc: na+/h+ antiporter [phragmites australis]
  misc_feature (8)..(1112): NCBI GI: 119359746 NCBI Desc: na+/h+ antiporter [phragmites australis]
  misc_feature (8)..(1116): NCBI GI: 115489826 NCBI Desc: os12g0641100 [oryza sativa (japonica cultivar-group)]
  misc_feature (9)..(1111): NCBI GI: 130917793 NCBI Desc: plasma membrane na+/h+ antiporter [puccinellia tenuiflora]
  misc_feature: Useful for making plants with modulated salt sensitivity
  misc_feature: GREAT-hit functional homolog of the protein sequence given in SEQ ID NO 13433
  misc_feature: Useful for making plants with modulated salt sensitivity
  misc_feature: Functional homolog of the protein sequence given in SEQ ID NO 13433
  misc_feature: The sequence is a functional homolog of SEQ ID NO. 319 in the 11/188,298 US application
MGGDGVPEPDDAVLFVGVSLVLGIASRHLLRGTRVPYTVALLVLGVALGSLEYGTQHGLGKLGAGIRIWANINPDLLLAVFLPALLFESSFSMEVHQIKRCMAQMVLLAGPGVVVSTVLLGAAVKLTFPYNWSWKTSLLLGGLLSATDPVAVVALLKELGASKKLSTIIEGESLMNDGTAIVVYQLFYRMVLGRTFDAGSIIKFLSEVSLGAVALGLAFGIMSILWLGFIFNDTIIEIALTLAVSYIAFFTAQDSLEVSGVLTVMTLGMFYAAFAKTAFKGESQQSLHHFCGVVIADGVLQNNAHFERHGSSWGFLLLLYVFVQISRLIVVGVLYPLLRQFGYGLDWKEAMILVWSGLRGAVALSLSLSVKRTSDAVQPYLKPEVGTMFVFFTGGIVFLTLIFNGSTTQFLLHMLSMDKLSATKLRILKYTRYEMLNKALESFGELRDDEELGPADWITVKKYITCLNDLDNEPEHPHDVSGKDDHMHIMNLTDIRVRLLNGVQAAYWGMLEEGRITQATANILMRSVDEAMDLVSEQKLCDWKGLKSNVQFPNYYRFLQMSRLPRKLVTYFTVERLESGCYICAAFLRAHRIARRQLHDFLGDSEVARTVIDESNAEGEEARKFLEDVRVTFPQVLRVLKTRQVTYSVLTHLSEYIQNLQKTGLLEEKEMVQLDDALQTDLKKLQRNPPIVKMPRVSDLLNTHPLVGALPAAVRDPLLSNTKETVRGQGTTLYREGSRPTGIWLVSIGVVKWTSQRLSRRHCLDPILSHGSTLGLYEVLIGKPYICDMTTDSVAHCFFIETEKIEELRHSDPSIEVFLWQESALVLARLLLPRIFEKMGMHEMRVLIAERSTMNIYIKGEDLEVEENCIGILLEGFLKTDNLTLITPPAVLLPSDADLGLESSDYCHTAPRYQVEARARIIFLEEAEAHLHRSASRLLLPQGQGGGHEPTRSMSKEHSGLLSWPESFRRSRGNLGLAAEMLPGGLSSRALQLSMYGSMVILSSGQGHSHRRQGRHRVQATTTDQKQSSSYPRMPSISKERPLLSVQSEGSNMKRVAALPLRDDAAEVEAPAAQQRRRRKAMHLQEDNSSDDSAGEEVIVRVDSPSMLSFRQSAAAPPPQDQ

SEQ ID NO: 5569 - DNA, 651 bp, Sorghum bicolor
  misc_feature: Ceres ANNOT ID no. 6047214
  misc_feature: Encodes the peptide sequence at SEQ ID NO 5570
atggccgcgtcgctactcgtgctcgccgtggcggtcctggttgccgttggccccggcggcatcgatgggggcgcagctgctcccgtggaggtggagggctccgaggtgacctacgggagtgtgatcaagctgatgcacgagaagacgaagcaccgtctgcactcgcatgatgtgccctatggctcaggcagcggtcagcagtctgtcaccggctttcctgaaggcgatgactcaaatagctactggatcataaggcctactccagattcatcgtctaagcaaggcgatgccatcgaaactggtggcatcatcaagttgcaacacatgaggacacggagatggttgcacagtcacttgcacgcttcaccgttatctggtaaccttgaggttagctgtttcggtggggatgaattgtcagatactggtgactattggaggctagaaattgaaggaggtggaaaagtatggaaaagggatcaaaaggtacgacttagacatgtcgacactggaggttatctgcatagtcacaacaagaagtacaatcgccttggtggtgggcagcaagaggtctgtggtgtccgagagaagcgagctgagaacatttggttggcagcagagggtgtttatctcccagttaccggaagcaagtga

SEQ ID NO: 5570 - protein, 216 aa, Sorghum bicolor
  misc_feature: Ceres ANNOT ID no. 6047214
  misc_feature (51)..(209): Pfam Id: MIR Pfam Desc: MIR domain
  misc_feature (1)..(216): NCBI GI: 92869637 NCBI Desc: mir [medicago truncatula]
  misc_feature (1)..(215): NCBI GI: 23505803 NCBI Desc: at2g25110/f13d4.70 [arabidopsis thaliana]
  misc_feature (1)..(216): NCBI GI: 37806069 NCBI Desc: stromal cell-derived factor 2-like protein [oryza sativa (japonica cultivar-group)]
  misc_feature (19)..(210): NCBI GI: 24644197 NCBI Desc: cg11999-pa [drosophila melanogaster]
  misc_feature (7)..(210): NCBI GI: 87248597 NCBI Desc: stromal cell-derived factor 2 precursor [bombyx mori]
MAASLLVLAVAVLVAVGPGGIDGGAAAPVEVEGSEVTYGSVIKLMHEKTKHRLHSHDVPYGSGSGQQSVTGFPEGDDSNSYWIIRPTPDSSSKQGDAIETGGIIKLQHMRTRRWLHSHLHASPLSGNLEVSCFGGDELSDTGDYWRLEIEGGGKVWKRDQKVRLRHVDTGGYLHSHNKKYNRLGGGQQEVCGVREKRAENIWLAAEGVYLPVTGSK

SEQ ID NO: 5571 - DNA, 1314 bp, Sorghum bicolor
  misc_feature: Ceres ANNOT ID no. 6047217
  misc_feature: Encodes the peptide sequence at SEQ ID NO 5572
atggcgacggcgagtggcgtctccgccggctccgtgctgcagctgccctccttgcgggtgccggccaagagatcgctgctgcctcggagaatagccgctggagctcccgcaggtactttttttgtgaagagagatgttgtatataacagaagaagctaccaccaattcttaccatggaagcaaagaggaggcttgcaagcagcagtacttccagttacatcaccactagtagatgatgagggggaaaggaagcaaatggctgaagattatgggttcacacaaattggagatgaactaccagataacattactcttaaagatgtcatggatactctacctaaagaggtatttgaaatcaatgacgtaaaagcttggacatcagttttgatatcagttacttcttatgcgctgggtttatttttcattgcaaagtctccatggtatcttcttcccttggcttgggcttggacaggcacagcagtgaccggggttagtcatgattgtgctcataaatcattttcaaggaataagttggttgaagatgttgttggaaccttggcttttatgccattgatatatccttatgaaccgtggagatttaagcatgaccgacatcatgccaagacaaacatgttgatagaagatactgcatggcaacctgtttggcaaaaggaaattgaatcatcaccttttctaaggaaggcgattgtttttggctatggccctatcaggccatggatgtctattgctcactggttgatttggcactttgatctaaaaaaatttagaccaaatgaagttccaagggttaagataagcttagcatgcgtgtttgcattcatggcgattggatggcctttgatcatcctcaaatcaggactagctggatggtttaagttctggttcatgccttggatgatgagcacttttacaatggtacatcacacagctcctcatataccattcaagtcatctgaagaatggaatgctgcacaagctcaattaaatggcacagttcattgtaactatcctcaatggatagagatcctttgccatgacataaatgtgcatgtcccacaccatatttctccaagaatcccaagttataaccttcgtgctgcttatgactccatcaaacagaactggggcaagtatgtcaatgaagccaactggaattggcgattgatgaagacgatactgactagatgccatgtgtacgacaaggagaggtactacgttccgttcgatgagctcgtgccggaggaatcccaaccaatcaaattccttaggaagttcatgcccgattatgcatga

SEQ ID NO: 5572 - protein, 437 aa, Sorghum bicolor
  misc_feature: Ceres ANNOT ID no. 6047217
  misc_feature (148)..(382): Pfam Id: FA_desaturase Pfam Desc: Fatty acid desaturase
  misc_feature (28)..(437): NCBI GI: 1345978 NCBI Desc: omega-6 fatty acid desaturase, chloroplast precursor
  misc_feature (28)..(437): NCBI GI: 49355354 NCBI Desc: omega-6 desaturase [brassica napus]
  misc_feature (28)..(437): NCBI GI: 49355339 NCBI Desc: omega-6 desaturase [brassica napus]
  misc_feature (8)..(437): NCBI GI: 92887188 NCBI Desc: fatty acid acyl-coa desaturase [medicago truncatula]
  misc_feature (27)..(436): NCBI GI: 114384177 NCBI Desc: omega-6 fatty acid desaturase [descurainia sophia]
MATASGVSAGSVLQLPSLRVPAKRSLLPRRIAAGAPAGTFFVKRDVVYNRRSYHQFLPWKQRGGLQAAVLPVTSPLVDDEGERKQMAEDYGFTQIGDELPDNITLKDVMDTLPKEVFEINDVKAWTSVLISVTSYALGLFFIAKSPWYLLPLAWAWTGTAVTGVSHDCAHKSFSRNKLVEDVVGTLAFMPLIYPYEPWRFKHDRHHAKTNMLIEDTAWQPVWQKEIESSPFLRKAIVFGYGPIRPWMSIAHWLIWHFDLKKFRPNEVPRVKISLACVFAFMAIGWPLIILKSGLAGWFKFWFMPWMMSTFTMVHHTAPHIPFKSSEEWNAAQAQLNGTVHCNYPQWIEILCHDINVHVPHHISPRIPSYNLRAAYDSIKQNWGKYVNEANWNWRLMKTILTRCHVYDKERYYVPFDELVPEESQPIKFLRKFMPDYA

SEQ ID NO: 5573 - DNA, 861 bp, Sorghum bicolor
  misc_feature: Ceres ANNOT ID no. 6047414
  misc_feature: Encodes the peptide sequence at SEQ ID NO 5574
atgagttctctgttgaagaccaggaatgaagggaagcaacaaaaacaggcgtctcctcaggaacaacagcgaaagatagacgaggtccgtgagctgctgggcgacctgccgacggagatgccgagcttcttatcggacggcaccatccgcaggtttctccgagcaaagaactggagcatggaacaagcgaccaaggctctcaaggaagctgtcaagtggaggcgtcagtacaagccagacaagatttgctgggaagacctcgctagcatggagaatgaggttcgaagagcgtatataccagactatcttgacaacaatgggagaactgtcttcgcaataatgacgtcaaaaaagagcttaacttcaacaaaggaacatataaaacaacttgtgtataaccttgagatcttggcattgagctcgaaagacgcacaagaaaagaacgttgtttggatttgtgatttccatggttggacactatcaactacaccattgtgggaaacccgagaatcgttgcacataattcaaaactattatccagggttgattggagcagcaattctctgtaatccgccaaagatatttgaatctttttggaagatagtaaaacacttcatcgagccaatgttgtacgacaaagtgaaatttgtttatagcaacaactcagatagccagaggatattggctgacatatttgacctggacaagttggagtttgcttttggaggaagaaacactgctagccttgatattacaaagtactctgaaagaatgagaagacgagatcagataaggggtgcttgcaaggacgcaagtggtaccatctcaccttccggacaaagaatacaatcgactacatga

SEQ ID NO: 5574 - protein, 286 aa, Sorghum bicolor
  misc_feature: Ceres ANNOT ID no. 6047414
  misc_feature (87)..(267): Pfam Id: CRAL_TRIO Pfam Desc: CRAL/TRIO domain
  misc_feature (13)..(82): Pfam Id: CRAL_TRIO_N Pfam Desc: CRAL/TRIO, N-terminus
  misc_feature (14)..(284): NCBI GI: 92893041 NCBI Desc: cellular retinaldehyde-binding/triple function, n-terminal [medicago truncatula]
  misc_feature (14)..(262): NCBI GI: 30687745 NCBI Desc: sec14 cytosolic factor family protein / phosphoglyceride transfer family protein [arabidopsis thaliana]
  misc_feature (8)..(265): NCBI GI: 83283975 NCBI Desc: transporter-like protein [solanum tuberosum]
  misc_feature (8)..(262): NCBI GI: 92868927 NCBI Desc: cellular retinaldehyde-binding/triple function, n-terminal [medicago truncatula]
  misc_feature (67)..(262): NCBI GI: 145334241 NCBI Desc: sec14 cytosolic factor family protein / phosphoglyceride transfer family protein [arabidopsis thaliana]
MSSLLKTRNEGKQQKQASPQEQQRKIDEVRELLGDLPTEMPSFLSDGTIRRFLRAKNWSMEQATKALKEAVKWRRQYKPDKICWEDLASMENEVRRAYIPDYLDNNGRTVFAIMTSKKSLTSTKEHIKQLVYNLEILALSSKDAQEKNVVWICDFHGWTLSTTPLWETRESLHIIQNYYPGLIGAAILCNPPKIFESFWKIVKHFIEPMLYDKVKFVYSNNSDSQRILADIFDLDKLEFAFGGRNTASLDITKYSERMRRRDQIRGACKDASGTISPSGQRIQSTT

SEQ ID NO: 5575 - DNA, 1431 bp, Sorghum bicolor
  misc_feature: Ceres ANNOT ID no. 6047645
  misc_feature: Encodes the peptide sequence at SEQ ID NO 5576
atgggtgacgaggcgtccccgacgacgccgccggcaccactgtatctcgatggctgtccggggtgcgccatggaacggaagaaggcgagcagcaagggcatcccctacaaggagttgttcttcgtcgccgtcaccaccattgcctctgctttgccaatatcgtccctgtttcccttcttatacttcatgattgaagatctgcacgtggccaaaacagaacaagatattggactgtatgctggttttcttggtgcatcttactttattggtcgattttttgcctcgctgttctggggtgtagtggctgatcgcattggaagaaagccaatcattatattttcagtcgcttcagtggtcatattcaacactctgtttggatttagtgtaaagtattggatggcaattaccacaagattgcttttaggtgctctcaatggcatgcttgcaccaataaaggcttactcaatagagatttgtcgaccggaacaccaagcgcttggattatcaattgtaagcactgcttggggcttgggtcttattgttggcccatccattggaggctacttggcacagcctgcacggcaatatccaaacatattctctgagaaatcagtttttgggaggttcccgtatctcctgccaaacctaagcatttccatcttttctgctgttgttctagtaagctgcatatggttaccggagacacttcatacgcacaagattatggacaatgaagcagaaatgtctggagattcaaggactctgcaaacagaagatatacatccagacaagagtctatataagaactggccattgatgtcttccatcagtgcatactgtgttttcacgcttcaagaaaccgcatacactgagatactttccttgtggaccgtaagtgacagaaagtatggtgggctaagcttttcttctaaggaaattggacaagttcttgcaattgcaggtgctggacttattgtgtatcaaatattcatctacagaccggtccacaaatatcttggaagtgtaaattcatgccgtgctgcatctgccctatccgtaccacttatcgctgcttttcccttcatgacacacctgtcaggactaaaacttggactagctctttattttgctactacgtttaaagctgctcttgggacaactacgctgacaagcacttcacttcttcagaactatgctgtgccacaacatcaaagaggcgccgcaaatggcatagcgacgactgcaatgtccttctttaaggctattggtccagcaggagcaggcgctttattctcatggacccaaaaacgacaagatgctgccttctttccaggggatcacatgttgttcttaattctgaatgtgctccaatgtattgggctggtgctgacctttaagccattcctagcagtaccgaaacaccttaagtga

SEQ ID NO: 5576 - protein, 476 aa, Sorghum bicolor
  misc_feature: Ceres ANNOT ID no. 6047645
  misc_feature (42)..(424): Pfam Id: MFS_1 Pfam Desc: Major Facilitator Superfamily
  misc_feature (44)..(475): Pfam Id: Sugar_tr Pfam Desc: Sugar (and other) transporter
  misc_feature (1)..(472): NCBI GI: 77548523 NCBI Desc: major facilitator superfamily [oryza sativa (japonica cultivar-group)]
  misc_feature (10)..(476): NCBI GI: 23452823 NCBI Desc: major facilitator superfamily antiporter [oryza sativa (japonica cultivar-group)]
  misc_feature (1)..(473): NCBI GI: 77548534 NCBI Desc: major facilitator superfamily protein [oryza sativa (japonica cultivar-group)]
  misc_feature (20)..(473): NCBI GI: 115487198 NCBI Desc: os12g0133100 [oryza sativa (japonica cultivar-group)]
  misc_feature (89)..(476): NCBI GI: 23452819 NCBI Desc: major facilitator superfamily antiporter [zea mays]
  misc_feature: Useful for making plants with modulated flowering time
  misc_feature: Functional homolog of the protein sequence given in SEQ ID NO 12969
MGDEASPTTPPAPLYLDGCPGCAMERKKASSKGIPYKELFFVAVTTIASALPISSLFPFLYFMIEDLHVAKTEQDIGLYAGFLGASYFIGRFFASLFWGVVADRIGRKPIIIFSVASVVIFNTLFGFSVKYWMAITTRLLLGALNGMLAPIKAYSIEICRPEHQALGLSIVSTAWGLGLIVGPSIGGYLAQPARQYPNIFSEKSVFGRFPYLLPNLSISIFSAVVLVSCIWLPETLHTHKIMDNEAEMSGDSRTLQTEDIHPDKSLYKNWPLMSSISAYCVFTLQETAYTEILSLWTVSDRKYGGLSFSSKEIGQVLAIAGAGLIVYQIFIYRPVHKYLGSVNSCRAASALSVPLIAAFPFMTHLSGLKLGLALYFATTFKAALGTTTLTSTSLLQNYAVPQHQRGAANGIATTAMSFFKAIGPAGAGALFSWTQKRQDAAFFPGDHMLFLILNVLQCIGLVLTFKPFLAVPKHLK

SEQ ID NO: 5577 - DNA, 810 bp, Sorghum bicolor
  misc_feature: Ceres ANNOT ID no. 6047686
  misc_feature: Encodes the peptide sequence at SEQ ID NO 5578
atggcctgccacaccgtcctcctcccacttcttctcttcctccctttcctcttggcaatggcagcaacggcagcggcggacaccgcccctactcctagcccaagcccaccaccaccggagctcaacctgacgagcatcctggaaaacggcgggcagtacacgacgctgctccgcctgctgaatgccacccggataaccgagcagatcaccagccagctcaagaactcgtacgacgggctcaccttcttcgcgcccaacgacaacgccttcaccaagctcaagcccggcacgctcaactccctcaccgaccaggagcagatccagctgctgctctaccacgtcctgccccgctactacagcctggccacgttccagacggccagcaacccgctgcacaccgaggcgtcgggccccggcggcatgtacagcgtcaacgtgagcaccagcacgacgagcccgctggtgaacgtctccacgggcgtcgtcgacgtgcccatcagcagcacgctgttcgcccatttcccgttcgccgtgtactccgtcgacgacgtgctgcagcccccgcagatgttcggcggttcccacaagcaggcttctgcgccggcgccggcaggacaggcggcggcggggcggcagaagggtggtgtccctaagagcgatgtggcagcggagccatcggaagcggtggaagagcagccagacggcagcacgaacgccgccgcggctggtggtagagggaccgcggtgtggatgacgacggccattgttttgggtggcatggcctttctcaatttacgacttagcgcgtga

SEQ ID NO: 5578 - protein, 269 aa, Sorghum bicolor
  misc_feature: Ceres ANNOT ID no. 6047686
  misc_feature (52)..(187): Pfam Id: Fasciclin Pfam Desc: Fasciclin domain
  misc_feature (17)..(243): NCBI GI: 56202243 NCBI Desc: arabinogalactan protein-like [oryza sativa (japonica cultivar-group)]
  misc_feature (17)..(243): NCBI GI: 115349912 NCBI Desc: fasciclin-like protein fla14 [triticum aestivum]
  misc_feature (22)..(243): NCBI GI: 607774 NCBI Desc: arabinogalactan-like protein
  misc_feature (11)..(229): NCBI GI: 92875493 NCBI Desc: beta-ig-h3/fasciclin [medicago truncatula]
  misc_feature (6)..(254): NCBI GI: 115349910 NCBI Desc: fasciclin-like protein fla13 [triticum aestivum]
  misc_feature: Useful for making plants with altered cell wall content and/or composition
  misc_feature: Functional homolog of the protein sequence encoded by LOCUS at2g20520
  misc_feature: Useful for making plants with altered carbohydrate content
  misc_feature: Functional homolog of the protein sequence given in SEQ ID NO 13919
  misc_feature: Useful for making plants with altered cell wall content and/or composition
  misc_feature: Functional homolog of the protein sequence given in SEQ ID NO 13920
MACHTVLLPLLLFLPFLLAMAATAAADTAPTPSPSPPPPELNLTSILENGGQYTTLLRLLNATRITEQITSQLKNSYDGLTFFAPNDNAFTKLKPGTLNSLTDQEQIQLLLYHVLPRYYSLATFQTASNPLHTEASGPGGMYSVNVSTSTTSPLVNVSTGVVDVPISSTLFAHFPFAVYSVDDVLQPPQMFGGSHKQASAPAPAGQAAAGRQKGGVPKSDVAAEPSEAVEEQPDGSTNAAAAGGRGTAVWMTTAIVLGGMAFLNLRLSA

SEQ ID NO: 5579 - DNA, 1158 bp, Sorghum bicolor
  misc_feature: Ceres ANNOT ID no. 6047730
  misc_feature: Encodes the peptide sequence at SEQ ID NO 5580
atgggaagcagtggagcagatacaccgtctaagacaaccaaggcatctgcccctcaggagcagcagccacctgctacctcaggtgctgcaacaccggctgtttatcctgattggtccagcttccaggcatatcctccaatcccaccacatgggttcttcccttcacctgtggcatcaagtccacagggtcatccttacatgtggggagctcagcctatgattccaccatatggaacaccaccgccaccatatgtcatgtaccctcctggagtatatgcccacccatctatgcccccgggtgcacatccatttactccttatgccattacttctccaaatggcaatgctgatgctactggaactactgctgcagctggtgatactgatggcaaaccctctgaaggcaaagataaaagtccaacaaagagatccaaaggaagtttgggcagcttgaacatgcttactggaaagaataccggtgaacatggtaagacctctggtgcatcggctaatggagccacttctcaaagtggcgaaagtggcagtgacagttcaagtgaagggagtgaagaaaattctcataatgattcacatcacaaggaaagtggacaggagcaagatggagatgttcgaagttcccagaatggtgcatcacgttcaccatctgagggaaaattgaaccaagctatgacaatcgtgcccatgccatcaagtggcccagtaactggtccaactacaaacctaaatattggaatggactattgggccaacacagcaagctctgctcctgcaattcatggcaaagtgaccccaacaacagttccaggggctgtggtcccagcagagcaatggatacaggatgaacgtgaactcaaaaggcaaagaagaaagcagtccaatagggagtctgcacgcagatctaggttgcgtaaacaggctgaatgtgaggagttggctcaacgtgcagatgttttaaagcaggaaaatgcttcacttagagatgaagtaaatcgtatcagaaaagagtatgaggaacttctatcaaagaataactcactaaaggaaaagcttgaaggcaaacaacacaaaactgatgaggcaggacttaacaacaagctgcaacattctggcgatgacagccagaaaaaaggaaactaa

SEQ ID NO: 5580 - protein, 385 aa, Sorghum bicolor
  misc_feature: Ceres ANNOT ID no. 6047730
  misc_feature (1)..(197): Pfam Id: MFMR Pfam Desc: G-box binding protein MFMR
  misc_feature (288)..(351): Pfam Id: bZIP_1 Pfam Desc: bZIP transcription factor
  misc_feature (288)..(342): Pfam Id: bZIP_2 Pfam Desc: Basic region leucine zipper
  misc_feature (1)..(286): NCBI GI: 77554088 NCBI Desc: g-box binding factor 1a [oryza sativa (japonica cultivar-group)]
  misc_feature (20)..(385): NCBI GI: 27469354 NCBI Desc: bzip transcription factor zip1 [hordeum vulgare subsp. vulgare]
  misc_feature (1)..(376): NCBI GI: 5381313 NCBI Desc: g-box binding protein 2 [catharanthus roseus]
  misc_feature (1)..(385): NCBI GI: 3336903 NCBI Desc: bzip dna-binding protein [petroselinum crispum]
  misc_feature (1)..(357): NCBI GI: 42570366 NCBI Desc: bzip transcription factor family protein [arabidopsis thaliana]
  misc_feature: The leaves start out wild-type green and gradually turn yellow-greenin color, while the cotyledons stay wild-type green.
  misc_feature: The sequence is a functional homolog of SEQ ID NO 1108 in the 10/225,066US patent application
  misc_feature: The sequence is a functional homolog of SEQ ID NO 12 in the 10/412,699US patent application
  misc_feature: The sequence is a functional homolog of SEQ ID NO 1225 in the 10/412,699US patent application
  misc_feature: The sequence is a functional homolog of SEQ ID NO 1477 in the 11/479,226US patent application
  misc_feature: The sequence is a functional homolog of SEQ ID NO 1762 in the 10/374,780US patent application
  misc_feature: The sequence is a functional homolog of SEQ ID NO 2 in the 10/374,780US patent application
  misc_feature: The sequence is a functional homolog of SEQ ID NO 464 in the 11/435,388US patent application
  misc_feature: The sequence is a functional homolog of SEQ ID NO 708 in the 10/412,699US patent application
  misc_feature: The sequence is a functional homolog of SEQ ID NO 839 in the 11/479,226US patent application
  misc_feature: The sequence is a functional homolog of SEQ ID NO 910 in the 10/374,780US patent application
  misc_feature: The sequence is a functional homolog of SEQ ID NO 911 in the 10/374,780US patent application
  misc_feature: The sequence is a functional homolog of SEQ ID NO 922 in the 10/374,780US patent application
  misc_feature: Useful for biocontainment applications
  misc_feature: Useful for making plants with altered Lignin content
  misc_feature: Useful for making plants with altered alkaloid content
  misc_feature: Useful for making plants with altered terpenoid content
  misc_feature: Useful for making plants with modulated growth and phenotype characteristics
  misc_feature: GREAT-hit functional homolog of the protein sequence given in SEQ ID NO 13330
  misc_feature: The sequence is a functional homolog of SEQ ID NO 12 in the 20040045049 US patent application
  misc_feature: The sequence is a functional homolog of SEQ ID NO 1225 in the 20040045049 US patent application
  misc_feature: The sequence is a functional homolog of SEQ ID NO 708 in the 20040045049 US patent application
  misc_feature: The sequence is a functional homolog of SEQ ID NO 1762 in the 20060162006 US patent application
  misc_feature: The sequence is a functional homolog of SEQ ID NO 910 in the 20060162006 US patent application
  misc_feature: The sequence is a functional homolog of SEQ ID NO 911 in the 20060162006 US patent application
  misc_feature: The sequence is a functional homolog of SEQ ID NO 839 in the 20070022495 US patent application
  misc_feature: The sequence is a functional homolog of SEQ ID NO. 512 in the 11/188,298 US application
  misc_feature: The sequence is a functional homolog of SEQ ID NO. 337 in the 11/188,298 US application
MGSSGADTPSKTTKASAPQEQQPPATSGAATPAVYPDWSSFQAYPPIPPHGFFPSPVASSPQGHPYMWGAQPMIPPYGTPPPPYVMYPPGVYAHPSMPPGAHPFTPYAITSPNGNADATGTTAAAGDTDGKPSEGKDKSPTKRSKGSLGSLNMLTGKNTGEHGKTSGASANGATSQSGESGSDSSSEGSEENSHNDSHHKESGQEQDGDVRSSQNGASRSPSEGKLNQAMTIVPMPSSGPVTGPTTNLNIGMDYWANTASSAPAIHGKVTPTTVPGAVVPAEQWIQDERELKRQRRKQSNRESARRSRLRKQAECEELAQRADVLKQENASLRDEVNRIRKEYEELLSKNNSLKEKLEGKQHKTDEAGLNNKLQHSGDDSQKKGN

SEQ ID NO: 5581 - DNA, 831 bp, Sorghum bicolor
  misc_feature: Ceres ANNOT ID no. 6047744
  misc_feature: Encodes the peptide sequence at SEQ ID NO 5582
atgctttgctgtgctggacacctggcgccccttctcctcttagcacttttctctgtctcatcccttctgtttgtcgacggatcccatcaagaccaggaattccgtgaagctgttggatccagaattcttcttcaaacaaatccagatgcacatgaggtgcattgctcaagggaaaggagccgtgcagcttgggaagctattgatgagtatttgatgcccttcgtggaaaaagagaaatatgagctcccaagcaaatgtagacttcgtcctgataatgacatgtttcgggagcaagagcaacataagatccattttgatattaatgagtggcattgtggcttttgcaagaaagctttccgagcagagaagttccttgatcaacattttgaaaatcggcacaagaatcttgtggataatagcgaaggaagatgcatggcagatctatgcggagcactccactgcgatctgatgatgcagttcaagaaaccaaaaagtaaatgcaatgccgctgcagctacaaggaatcgtcatctttgtgagagccttgccgacagttgctttcctgttaatcaaggtcttgctgccagccgtcttcatgaattcttcttgcgccaattttgtgatgcgcacacttgcaataagggaactaaacctttccccaaaggtggcaggaaacaaacaaacaggttttacttggctctctgcatcttgaccctcatacttttgcccctgttctacctcattgtgttcctgcaccagagggaaatgaggaaaggcacccaagatctaaaacggttttcaaaaattgggcagaagaaaaagccatcctag

SEQ ID NO: 5582 - protein, 276 aa, Sorghum bicolor
  misc_feature: Ceres ANNOT ID no. 6047744
  misc_feature (48)..(158): NCBI GI: 116123020 NCBI Desc: ensangp00000018263 [anopheles gambiae str. pest]
  misc_feature (55)..(156): NCBI GI: 19920466 NCBI Desc: cg4133-pa [drosophila melanogaster]
  misc_feature (52)..(156): NCBI GI: 54644755 NCBI Desc: ga17979-pa [drosophila pseudoobscura]
MLCCAGHLAPLLLLALFSVSSLLFVDGSHQDQEFREAVGSRILLQTNPDAHEVHCSRERSRAAWEAIDEYLMPFVEKEKYELPSKCRLRPDNDMFREQEQHKIHFDINEWHCGFCKKAFRAEKFLDQHFENRHKNLVDNSEGRCMADLCGALHCDLMMQFKKPKSKCNAAAATRNRHLCESLADSCFPVNQGLAASRLHEFFLRQFCDAHTCNKGTKPFPKGGRKQTNRFYLALCILTLILLPLFYLIVFLHQREMRKGTQDLKRFSKIGQKKKPS

SEQ ID NO: 5583 - DNA, 3021 bp, Sorghum bicolor
  misc_feature: Ceres ANNOT ID no. 6047806
  misc_feature: Encodes the peptide sequence at SEQ ID NO 5584
atgctgaccgtgctgaccccgtcacgcgcgtcccgcctgctccgcgtcttttctcatctcgaagctagggttttgcccgccgccgccatccgactctcctcctcggcatcgtcctcatcctcatcttccccagccgcatccgccgccccgcctccgatggatgcgccgtcggagtggacggcccggcgggtccgggagcagtacatcagcttcttcgtgtccaaggaacacacgaggtggccgtcgagtcccgtggtccccgtcgacgaccccacgctgctgttcgccaacgccgggatgaaccagtacaagccggtcttcctcggcacggctgcgccggactcgccgctcggccgcctgcgccgtgcctgcaacacccagaagtgcatccgcgccggcgggaagcacaacgacctcgacgacgtgggcaaggacacctaccaccataccttcttcgagatgctcgggaactggtccttcggggactacttcaaggaggaggccatcggatgggcctgggagcttctcacccaggtatataaattgcccactgatagagtttacgccacatactttggtggtgatgagaaatctggtcttgctgctgatgttgaatcgaagaacatttggttgaaatatctaccgaaagaaaaggttctgcctttcggctccaaggataacttttgggagatgggtgacactggtccttgtgggccatgtactgaaattcattttgatcgtattggcaaccgtgatgctgcttccttagttaacaatgatgatccaacttgtatcgagatatggaacctcgtattcattcagttcaatagggaggcagatggctcattgagacctttgccagcaaaacatgtggacactgggatgggctttgagcgtttaacttctatccttcagaataaaatgagcaactatgatacagatgtattcatgccaatatttgatgccattcaccaattggctggcgatggaattcagccatactctggtaaagtaggttctgatgatattggcaaagttgacatggcttacagagtagttgctgaccacataagaaccctttctttcgctatcgctgatggttctcaacctggtaatgagggaagagagtatgttctgaggcgcatacttaggcgagctgtccactttggccatcagaaattgaaggcaaagcaaggattttttagctcgcttgtaaatgtttttgtccaattgatgggtgatgtatttcctgagttaaaagacaatgaaaagaagatcaaagatattattagagatgaagaagaaagctttgagaacactctagcaaagggttatgaaaaatttaagaaagctgcagatgctgttaaggataatggtggaactgtacttagtggccaggatgcttttgttctttgggacacttacggttatccaattgatttgactgaggtcatggcaatcgactacgggctgactgttgataaggagggttttaatgcttctatggaagaagcgaggcaaaaagctagaaatgctcgtaacaagtctggaggaaagtctattgctttggatgcgaatgctacagcacatttgcgcaaacaggggcttgccagcacggatgataacccaaagtttctgtggcccaaggaacatgaaagtgtggtgaaggctatctatactggctcagaatacattactacagctactggtgatgaggactttggccttgtgctggaaagtacaagtttctatgccgaacagggtggccagatatttgacactgggagcattgaggggtcttttggaacttttaatgtgaataacgtccaagtgtttgctggctatgttctacatattggctcatttgcaaaaggttccaaggttttgtctcttggtgatagtgtgatatgcaaggttgattacaaccggcgcacactgattgctccaaaccatacgtgtactcacatgttgaactttgctctaagggaagtacttggtgatcatgttgaccagaagggttcaattgttctaccggagaagctgagatttgatttctctcatggaaaacctgtccagcctgaagatttgagaaaaatcgagtccatagtgaaccagcaaataaaggatgagctgggtgtatatgcacttgaaataaaactagaggatgcgaagcgcataaatggtcttcgtgctgtgtttggtgaaatctaccctgatccagtaagagttgtatcagttggtcgcaaagtggaagatctgcttgcagatcctgatagcaaagagtggttatccatatcgactgaactatgtggaggtacacatatcacaaacacaagagatgctaaagcattcgcactcttatctgaggagggtattgcaaaaggtgttaggaggataacagccgtgactgctggatgtgccacccaggctatggagttggcatcatctattgattctgatatcaatgaagcatctcagttggagggagctttgttggaaaagaaaattgcttccatcaagagtgggctggacgcagctgctatccctgctgcaaaaaaagctgatttgagaggcaaggtttcaaagttagaggatgaacttaggaaggcaaagaagaaaatgggtgagcaaaatatacaaaaggctgtgaagtctgcaatggacgccgcagaagctgctctttcaggaaataagctgttttgtgttactcatgtcgacgtgggtcttgataccacggctgtccgggaggcggttatcaaagtcatggacaagaagggtttgcctataatgttattcagcactgatgaggcatcaaacaaagctgttatctatgctggtgtgcctcccaatgctcctaacggcttcaaggtgttggactggctaacaccttcaattgcaccactcaagggaagagggggtggcggcaagaacggcatcgcccagggccagggaagtgacgcttctcagctcaaggaagcaatggcacttgcgaacagcattgcttcaatgaagctcagctga

SEQ ID NO: 5584 - protein, 1006 aa, Sorghum bicolor
  misc_feature: Ceres ANNOT ID no. 6047806
  misc_feature (63)..(643): Pfam Id: tRNA-synt_2c Pfam Desc: tRNA synthetases class II (A)
  misc_feature (741)..(800): Pfam Id: tRNA_SAD Pfam Desc: Threonyl and Alanyl tRNA synthetase second additional domain
  misc_feature (926)..(999): Pfam Id: DHHA1 Pfam Desc: DHHA1 domain
  misc_feature (9)..(1006): NCBI GI: 30694735 NCBI Desc: aminoacyl-trna synthetase family protein [arabidopsis thaliana]
  misc_feature (9)..(1006): NCBI GI: 1673365 NCBI Desc: mitochondrial trna-ala synthetase [arabidopsis thaliana]
  misc_feature (39)..(1006): NCBI GI: 421855 NCBI Desc: alanine-trna ligase (ec 6.1.1.7) - arabidopsis thaliana (fragment)
  misc_feature (52)..(1006): NCBI GI: 1673366 NCBI Desc: cytosolic trna-ala synthetase [arabidopsis thaliana]
  misc_feature (154)..(1006): NCBI GI: 92868089 NCBI Desc: phosphoesterase, dhha1 [medicago truncatula]
  misc_feature (9)..(1006): SWISSPROT Homolog: EC 6.1.1.7 Alanyl-tRNA synthetase, mitochondrial precursor
MLTVLTPSRASRLLRVFSHLEARVLPAAAIRLSSSASSSSSSSPAASAAPPPMDAPSEWTARRVREQYISFFVSKEHTRWPSSPVVPVDDPTLLFANAGMNQYKPVFLGTAAPDSPLGRLRRACNTQKCIRAGGKHNDLDDVGKDTYHHTFFEMLGNWSFGDYFKEEAIGWAWELLTQVYKLPTDRVYATYFGGDEKSGLAADVESKNIWLKYLPKEKVLPFGSKDNFWEMGDTGPCGPCTEIHFDRIGNRDAASLVNNDDPTCIEIWNLVFIQFNREADGSLRPLPAKHVDTGMGFERLTSILQNKMSNYDTDVFMPIFDAIHQLAGDGIQPYSGKVGSDDIGKVDMAYRVVADHIRTLSFAIADGSQPGNEGREYVLRRILRRAVHFGHQKLKAKQGFFSSLVNVFVQLMGDVFPELKDNEKKIKDIIRDEEESFENTLAKGYEKFKKAADAVKDNGGTVLSGQDAFVLWDTYGYPIDLTEVMAIDYGLTVDKEGFNASMEEARQKARNARNKSGGKSIALDANATAHLRKQGLASTDDNPKFLWPKEHESVVKAIYTGSEYITTATGDEDFGLVLESTSFYAEQGGQIFDTGSIEGSFGTFNVNNVQVFAGYVLHIGSFAKGSKVLSLGDSVICKVDYNRRTLIAPNHTCTHMLNFALREVLGDHVDQKGSIVLPEKLRFDFSHGKPVQPEDLRKIESIVNQQIKDELGVYALEIKLEDAKRINGLRAVFGEIYPDPVRVVSVGRKVEDLLADPDSKEWLSISTELCGGTHITNTRDAKAFALLSEEGIAKGVRRITAVTAGCATQAMELASSIDSDINEASQLEGALLEKKIASIKSGLDAAAIPAAKKADLRGKVSKLEDELRKAKKKMGEQNIQKAVKSAMDAAEAALSGNKLFCVTHVDVGLDTTAVREAVIKVMDKKGLPIMLFSTDEASNKAVIYAGVPPNAPNGFKVLDWLTPSIAPLKGRGGGGKNGIAQGQGSDASQLKEAMALANSIASMKLS

SEQ ID NO: 5585 - DNA, 312 bp, Sorghum bicolor
  misc_feature: Ceres ANNOT ID no. 6047831
  misc_feature: Encodes the peptide sequence at SEQ ID NO 5586
atggcatacaagaaagtagtgcttggtctctttaccctggccttgttcctcgtggcacattatgtggaggcggtggatgtgtgcacgacgaggaactggtatttctatggcccgtgcatgagcaacaagaattgcgcggcttcgtgcatccaacatggcattggcggcggtggctactgctccccctggagacgatgcaaatgtacacttcagtgtccttggagaaaaatgacgctagccgggatcgggttgacacatggccgggacaagccggaacccttggacaaacctagcatggaactattcaactga

SEQ ID NO: 5586 - protein, 103 aa, Sorghum bicolor
  misc_feature: Ceres ANNOT ID no. 6047831
  misc_feature (26)..(72): Pfam Id: Gamma-thionin Pfam Desc: Gamma-thionin family
  misc_feature (27)..(72): NCBI GI: 100843 NCBI Desc: gamma-purothionin - poulard wheat
  misc_feature (27)..(72): NCBI GI: 135782 NCBI Desc: gamma-1 purothionin
  misc_feature (27)..(72): NCBI GI: 100844 NCBI Desc: purothionin gamma - poulard wheat
  misc_feature (27)..(72): NCBI GI: 135784 NCBI Desc: gamma-2 purothionin
  misc_feature (27)..(72): NCBI GI: 135793 NCBI Desc: gamma hordothionin
MAYKKVVLGLFTLALFLVAHYVEAVDVCTTRNWYFYGPCMSNKNCAASCIQHGIGGGGYCSPWRRCKCTLQCPWRKMTLAGIGLTHGRDKPEPLDKPSMELFN

SEQ ID NO: 5587 - DNA, 1470 bp, Sorghum bicolor
  misc_feature: Ceres ANNOT ID no. 6048434
  misc_feature: Encodes the peptide sequence at SEQ ID NO 5588
atgccgcagatggacgggcccgctgatcagatcgccgccggctggttcgccgcggagccggctgccgagcggcccgtggcccttcccaggaccggctcgtccagtcgcctcaacgcgcaggcgccggagttcgtgccacgggggccgccgtcgccggcgccggcggttgtggtgccgcctccgccgcaggtgatccgcatgttcgccgcgcctcccccgcctccgcgggctgcctttttcgccgcgccgccgccccggccgttcgagtactacgcgcctgtggcgggacgcggcggatttgctgccaaggagcagcaggcgccggagcctgagccggaagcggagatgctcccgcccgccgcggtgaaggcggagccggtggtggatgggctcgacgacgaggtggtgcacaagatcaccaagcaggtggaatactattttagtgacatcaaccttgcaactacagaacatttgatgagattcattaccaaggatcctgagggatatgtgccaatatcagtaattgctggttttaagaaagtaaaagcttccgtgcataacaatgtgatgcttgctgcggctctccgaacctcatcaaaacttgttgtaagtgatgatggtaagagagtcaaacggcaggagccatttacagaatctgatttgcaggagctccagtcccggattgttgttgcagaaaatcttcctggtgatccctcctaccagaatcttaagaagatattttcagctgttggcagtgtgatttcaatccgaacttgctatcctcagactccaaatggcactggtcctgcaactaatagatctgccaagttagatatgctttttgctaacaagctgcacgctttcgtggagtacgaaactcctgaggatgctgagaaggcaattttggagcttaatgatgagaaaaactggagaaatgggcttagagttcgtttgctgaatacttgcacggtgaagggggcaggcaaaggcaaaaaaggtgtgcatgaaactgatggaaatggtgaggaggatgtctccacttcgaaccattcaaacgagaaattgtttgaagaatcctctcaactgttagatgtactgccagaacacttgtttgatgagaacttcaacgacaaagaagttcccaaacgcggcaaagggcgcggccgcggtggcagagggcgtgggcgtggcaaccatcaatataacaataaccagcaccaccagaacaaccagcagcactacaatcaccatggcaacaaccaccttggtgggaaccgtggcagcccccaccctgttggcactccaccgcataacctgataaccaagcccgagcagtacccgcagctgccgattggggccaacaagcttccaccaggcccccgcatgcctgatggcacccggggtttcaccatgggcagggggaagccacaagctgtgctacctggtttgtgtgctgttggtgagtcttga

SEQ ID NO: 5588 - protein, 489 aa, Sorghum bicolor
  misc_feature: Ceres ANNOT ID no. 6048434
  misc_feature (139)..(198): Pfam Id: La Pfam Desc: La domain
  misc_feature (32)..(49): Pfam Id: PAM2 Pfam Desc: Ataxin-2 C-terminal region
  misc_feature (18)..(477): NCBI GI: 62734646 NCBI Desc: at2g43970/f6e13.10 [oryza sativa (japonica cultivar-group)]
  misc_feature (146)..(477): NCBI GI: 115484947 NCBI Desc: os11g0248200 [oryza sativa (japonica cultivar-group)]
  misc_feature (130)..(479): NCBI GI: 30689565 NCBI Desc: la domain-containing protein [arabidopsis thaliana]
  misc_feature (159)..(479): NCBI GI: 15724224 NCBI Desc: at2g43970/f6e13.10 [arabidopsis thaliana]
  misc_feature (131)..(332): NCBI GI: 6449448 NCBI Desc: rna-binding protein homolog [brassica napus]
MPQMDGPADQIAAGWFAAEPAAERPVALPRTGSSSRLNAQAPEFVPRGPPSPAPAVVVPPPPQVIRMFAAPPPPPRAAFFAAPPPRPFEYYAPVAGRGGFAAKEQQAPEPEPEAEMLPPAAVKAEPVVDGLDDEVVHKITKQVEYYFSDINLATTEHLMRFITKDPEGYVPISVIAGFKKVKASVHNNVMLAAALRTSSKLVVSDDGKRVKRQEPFTESDLQELQSRIVVAENLPGDPSYQNLKKIFSAVGSVISIRTCYPQTPNGTGPATNRSAKLDMLFANKLHAFVEYETPEDAEKAILELNDEKNWRNGLRVRLLNTCTVKGAGKGKKGVHETDGNGEEDVSTSNHSNEKLFEESSQLLDVLPEHLFDENFNDKEVPKRGKGRGRGGRGRGRGNHQYNNNQHHQNNQQHYNHHGNNHLGGNRGSPHPVGTPPHNLITKPEQYPQLPIGANKLPPGPRMPDGTRGFTMGRGKPQAVLPGLCAVGES

SEQ ID NO: 5589 - DNA, 1143 bp, Sorghum bicolor
  misc_feature: Ceres ANNOT ID no. 6048464
  misc_feature: Encodes the peptide sequence at SEQ ID NO 5590
atgggtacaaatgatagagcggccatttctctagtattcttattccttgtgtgcatggctagccgctcatcctgcagcttgggtagctctgaagtgcagaggcgctcagtagtcccatcgatctacgtgtttggtgattcgttagtcgatgtcggaaataacaatttcctgccgccgcctgcgccccgtgcgctatctccgtacggcatcgacagcagcttgacagggcggttcacgaacggctacaaccttgccgatttagtcgcgcgacgtctggggttcacgaagagtccacctgcttacctctcgttgacaccatcatcaaaacttgacctactaacgtgccgagttggtgccagttacgcatctggcggatccggcattctcaacaccacgggaaatgggaccctcacaatgcaaaaacagatcatgttgttctccaaaactaaagcaaggatgtggtgtggccggaagctcaactatatgatatcaaagtcgttctttcttattagcgctggaggcaatgacttttctgccttcagtgaaatgggcatgagtccacaagatgccccagcctacatcagtagcatggtctcaacctatgtcgagcatatcaacgctttgtacacgttgggggcgcggagattggggatcctagacgtgccagcaatcggttgtactccaggttcgagagtccccatggccaacggcggatgcaacgacgccgccaattccatggcacagaacttcaacaaactcctaagggttgaggtggcaaaagccgttgaaacctccatgcccgacatgaaatactccatagcaagcacctacaattttctcactgacttgatggacaatcatctcgtggctggcatccgggtgatcgagagggcatgctgcggatcaggaaaattgaacgcggcagtaatgtgcagcaggccaaacacgacttattgtttggatcgcaatgactacatgttctgggacatgttgcatcctacacaggctacatatgaacgaggggtggtcgcaatcttctacggcccgcaggagtatgcggatcccatcaactttgcaggattggtcggcatcgccacagagataaatactactatggcccccggcgtctatgccgccatatga

SEQ ID NO: 5590 - protein, 380 aa, Sorghum bicolor
  misc_feature: Ceres ANNOT ID no. 6048464
  misc_feature (41)..(345): Pfam Id: Lipase_GDSL Pfam Desc: GDSL-like Lipase/Acylhydrolase
  misc_feature (28)..(358): NCBI GI: 54291019 NCBI Desc: gdsl-lipase-like [oryza sativa (japonica cultivar-group)]
  misc_feature (11)..(361): NCBI GI: 140066637 NCBI Desc: lipolytic enzyme, g-d-s-l [medicago truncatula]
  misc_feature (39)..(361): NCBI GI: 140066638 NCBI Desc: lipolytic enzyme, g-d-s-l [medicago truncatula]
  misc_feature (63)..(361): NCBI GI: 115470042 NCBI Desc: os06g0725200 [oryza sativa (japonica cultivar-group)]
  misc_feature (39)..(339): NCBI GI: 140071693 NCBI Desc: lipolytic enzyme, g-d-s-l [medicago truncatula]
MGTNDRAAISLVFLFLVCMASRSSCSLGSSEVQRRSVVPSIYVFGDSLVDVGNNNFLPPPAPRALSPYGIDSSLTGRFTNGYNLADLVARRLGFTKSPPAYLSLTPSSKLDLLTCRVGASYASGGSGILNTTGNGTLTMQKQIMLFSKTKARMWCGRKLNYMISKSFFLISAGGNDFSAFSEMGMSPQDAPAYISSMVSTYVEHINALYTLGARRLGILDVPAIGCTPGSRVPMANGGCNDAANSMAQNFNKLLRVEVAKAVETSMPDMKYSIASTYNFLTDLMDNHLVAGIRVIERACCGSGKLNAAVMCSRPNTTYCLDRNDYMFWDMLHPTQATYERGVVAIFYGPQEYADPINFAGLVGIATEINTTMAPGVYAAI

SEQ ID NO: 5591 - DNA, 159 bp, Sorghum bicolor; identical to SEQ ID NO: 7
  misc_feature: Ceres ANNOT ID no. 6048621
  misc_feature: Encodes the peptide sequence at SEQ ID NO 5592

SEQ ID NO: 5592 - protein, 52 aa, Sorghum bicolor; identical to SEQ ID NO: 8
  misc_feature: Ceres ANNOT ID no. 6048621
  misc_feature (11)..(47): Pfam Id: PSI_PsaJ Pfam Desc: Photosystem I reaction centre subunit IX / PsaJ
  misc_feature (11)..(52): NCBI GI: 75261486 NCBI Desc: photosystem i reaction center subunit ix (psi-j)
  misc_feature (11)..(52): NCBI GI: 60390388 NCBI Desc: photosystem i reaction center subunit ix (psi-j)
  misc_feature (11)..(52): NCBI GI: 902241 NCBI Desc: psaj [zea mays]
  misc_feature (11)..(52): NCBI GI: 14017591 NCBI Desc: photosystem i subunit ix [triticum aestivum]
  misc_feature (11)..(52): NCBI GI: 48478789 NCBI Desc: photosystem i subunit ix [saccharum hybrid cultivar sp-80-3280]

SEQ ID NO: 5593 - DNA, 549 bp, Sorghum bicolor
  misc_feature: Ceres ANNOT ID no. 6048637
  misc_feature: Encodes the peptide sequence at SEQ ID NO 5594
atgttccctatgctaactgggttcattagttatggtcaacaaacaatacgcgccgcaagatatattggtcaaggtttaataattaccctatcccacacaaatcgtttacctataacgattcactacccttatgaaaaatcaattacatcggagcgtttccgggggcgaatacactttgaatttgataaatgcattgcttgtgaagtatgtgttcgcgtatgcccgatagatctaccccttgtggattggaaatttgaaaaggatattaaaagaaaacaattgcttaattatagtattgatttcggagtttgtatattttgtggtaactgtgttgaatactgtcccacaaattgtttatcaatgactgaagaatatgaactttctacttatgatcgtcatgaattgaattacaatcaaattgctttgagtcggttaccaatctccataatgggagattacacaattcaaacaattaggaattcgcctcaaagtaaaatagacgaagaaaaatcttggaattcaagaacgattaggattactaggtattag

SEQ ID NO: 5594 - protein, 182 aa, Sorghum bicolor
  misc_feature: Ceres ANNOT ID no. 6048637
  misc_feature (57)..(80): Pfam Id: Fer4 Pfam Desc: 4Fe-4S binding domain
  misc_feature (97)..(120): Pfam Id: Fer4 Pfam Desc: 4Fe-4S binding domain
  misc_feature (1)..(177): NCBI GI: 75291234 NCBI Desc: nad(p)h-quinone oxidoreductase chain i, chloroplast (nad(p)h dehydrogenase, chain i) (nadh-plastoquinone oxidoreductase subunit i)
  misc_feature (1)..(177): NCBI GI: 48478735 NCBI Desc: nadh dehydrogenase subunit i [saccharum hybrid cultivar sp-80-3280]
  misc_feature (1)..(177): NCBI GI: 50812598 NCBI Desc: nadh dehydrogenase 18kd subunit [saccharum officinarum]
  misc_feature (1)..(177): NCBI GI: 118614546 NCBI Desc: nadh-plastoquinone oxidoreductase subunit i [sorghum bicolor]
  misc_feature (1)..(177): NCBI GI: 902288 NCBI Desc: nadh dehydrogenase subunit [zea mays]
MFPMLTGFISYGQQTIRAARYIGQGLIITLSHTNRLPITIHYPYEKSITSERFRGRIHFEFDKCIACEVCVRVCPIDLPLVDWKFEKDIKRKQLLNYSIDFGVCIFCGNCVEYCPTNCLSMTEEYELSTYDRHELNYNQIALSRLPISIMGDYTIQTIRNSPQSKIDEEKSWNSRTIRITRY

SEQ ID NO: 5595 - DNA, 1800 bp, Sorghum bicolor
  misc_feature: Ceres ANNOT ID no. 6048722
  misc_feature: Encodes the peptide sequence at SEQ ID NO 5596
atgccgctggcgatggacggcggcggcgggggcggcggacgagccctcgattgccgcagcttctggaaggccggcgcgtacgaggcccccactgcgccgaccagggagttccaagatgcgctggagacgggggacttcgaccgcgcgcgcgtgcaccccaagttcctccacaccaacgccacctcccacaagtgggccttcggagctatagctgaacttcttgacaatgcggtggatgagagaagcaatggtgccacgttcataaaagtggataaaagcatcaatttgaaagacaatagctcaatgatagttttccaagatgatggaggcggcatggatcctgaaggtgtccgtcgatgcatgagtttaggattctcaaccaagaaatctaagaccactattggccagtatggaaatggctttaagacaagcacaatgagacttggtgcagatgcaattgtttttactcgtgcaatccgtggaagtaatgttacattgagtataggtttgctctcctacacttttttgagaaagacaatgaaggatgacatagtcgtcccaatgcttgattttaagatccaagatggggacattgtaccgttggtgtatggttcacagggtgattgggatagtagtctgaagataatacttgattggtcccctttttcttcgaaggaagaacttctgcagcagtttcaggatgttggtagtcatggaactaaagtgatagtgtacaatttgtggatgaacgatgatggccttttggaacttgactttgaggatgatgatgaggacatattacttagagatcaaggtagtgcaagtggggggttctcaaagagtcaaaaagaaattgttatgcaacacatatcccacagactcagattttcattgcgagcttatacctccatcctttacctcaggaagttcgataatttccaaattatattaagaggaaaacctgttgagcagttatttatcactgaagaactaaagtttaagaaagtcgttacttacaaacctcaagctgcacatgattcccaagtggccccggtaaaaattgatgttggttttgcaaaggaggcccctattttgggcatttttgggatgaatgtgtaccacaaagatcgtcttataatgcctttctggaaggtccttcaagaaggatctagcagagggagaagtgtggttggtgtacttgaagcaaattttattgaaccagcacatgacaaacaagattttgagaggacaccattgtttattcggctagaagcaagacttagacaaattattattgatttttggaaagaacggtgccatttgattggttaccagccattagatccacagttaagatcccagtataaggccaccctcaaagattccggtggtcctggaactcaagttcaccataaagcttccagtgcccgaaggactggggggctttcgtcaaatttgctacccgatacatacgatgacataacaactgttgggttagcaaataatggttctcattcgcaatcgtctggccaagcacaagagaacaatatggagtcagaaggcttggatgaggatctggtggagattggctcctctggtgttctagatcctaattttattgagaagctgagtgaagaaaacattgctctgttttcaaggcgtgaagagcttcgacaacgagatacacagttgaagcagacgattggaggcctggagcatgaactggaggaaacaaaaaagaagtgtggtcagcttgctgctcagctcaaggcatggaagaaccagcagcatctcccctaa

SEQ ID NO: 5596 - protein, 599 aa, Sorghum bicolor
  misc_feature: Ceres ANNOT ID no. 6048722
  misc_feature (16)..(595): NCBI GI: 30690622 NCBI Desc: atp-binding region, atpase-like domain-containing protein [arabidopsis thaliana]
  misc_feature (10)..(594): NCBI GI: 42567122 NCBI Desc: atp-binding region, atpase-like domain-containing protein [arabidopsis thaliana]
  misc_feature (6)..(595): NCBI GI: 42567454 NCBI Desc: atp-binding region, atpase-like domain-containing protein [arabidopsis thaliana]
  misc_feature (19)..(232): NCBI GI: 92897221 NCBI Desc: atp-binding region, atpase-like [medicago truncatula]
  misc_feature (19)..(444): NCBI GI: 116309094 NCBI Desc: osigba0148d14.7 [oryza sativa (indica cultivar-group)]
MPLAMDGGGGGGGRALDCRSFWKAGAYEAPTAPTREFQDALETGDFDRARVHPKFLHTNATSHKWAFGAIAELLDNAVDERSNGATFIKVDKSINLKDNSSMIVFQDDGGGMDPEGVRRCMSLGFSTKKSKTTIGQYGNGFKTSTMRLGADAIVFTRAIRGSNVTLSIGLLSYTFLRKTMKDDIVVPMLDFKIQDGDIVPLVYGSQGDWDSSLKIILDWSPFSSKEELLQQFQDVGSHGTKVIVYNLWMNDDGLLELDFEDDDEDILLRDQGSASGGFSKSQKEIVMQHISHRLRFSLRAYTSILYLRKFDNFQIILRGKPVEQLFITEELKFKKVVTYKPQAAHDSQVAPVKIDVGFAKEAPILGIFGMNVYHKDRLIMPFWKVLQEGSSRGRSVVGVLEANFIEPAHDKQDFERTPLFIRLEARLRQIIIDFWKERCHLIGYQPLDPQLRSQYKATLKDSGGPGTQVHHKASSARRTGGLSSNLLPDTYDDITTVGLANNGSHSQSSGQAQENNMESEGLDEDLVEIGSSGVLDPNFIEKLSEENIALFSRREELRQRDTQLKQTIGGLEHELEETKKKCGQLAAQLKAWKNQQHLP

SEQ ID NO: 5597 - DNA, 1008 bp, Sorghum bicolor
  misc_feature: Ceres ANNOT ID no. 6048723
  misc_feature: Encodes the peptide sequence at SEQ ID NO 5598
atgcctcgagattcgcgcccactcgggatgcgcctcttcggcgtcaccatcgcgccggcgccggcgccggaggcggatccgccggaacgggatccgagtcccaacccgcccgtggcggccagggaggacgtgatgcgcaagtgcaagagcatgggcaacctcgccgctcttggcgctggcgcggacggtggaggaggtggcgcggacggcggaggcgccggcgacgggtacctctccgatggcgggctgatgcagtcgtccgggaagcggcggagggcgcaggagaggaagaaagctgttccttggactgaagaggagcatagaacatttcttgctggtcttgaaaagctagggaagggtgactggaggggcatagcgaaaaattttgttaccaccagaacaccaactcaagttgcaagtcatgctcagaaatattttcttagacaaactaatccaaacaagaagaagcgcagatctagtctttttgacatgatgccaagagagctgtcaccaacaccaaattgccccatattacctccatcaatggcaaaagtacatgacgtggtagctatgacgaaacagctccagaatagcaacttggaaggagcctcatcttccaacgccgctaatgtagcatctcaagttggaagagatctccccccagttccatcttttaaggcaacaaatatggattcaagtttcagcaaatttagccacatggagcgctactggagaactccctacccattcagaccaatttctagagcccccgaagggacgtcttcatcaactcctgttgctgccaatatagctgttccagcctctcaagctaacctgactgcatgtactagcacattcttgagccagcgaggtgatacttcatcattgcctccgaagggagatcctccatcagaggaggatttggaactgactgttgccccaccctcccaacaaaacatgaccaatatgtcttcccagaatgcggtaggcgtgattcaagtcatctaa

SEQ ID NO: 5598 - protein, 335 aa, Sorghum bicolor
  misc_feature: Ceres ANNOT ID no. 6048723
  misc_feature (99)..(146): Pfam Id: Myb_DNA-binding Pfam Desc: Myb-like DNA-binding domain
  misc_feature (1)..(318): NCBI GI: 115474799 NCBI Desc: os08g0151000 [oryza sativa (japonica cultivar-group)]
  misc_feature (38)..(201): NCBI GI: 89257523 NCBI Desc: myb family transcription factor [brassica oleracea]
  misc_feature (45)..(225): NCBI GI: 110224485 NCBI Desc: transcription factor mybs3 [hordeum vulgare subsp. vulgare]
  misc_feature (45)..(201): NCBI GI: 114432231 NCBI Desc: myb [brassica rapa subsp. pekinensis]
  misc_feature (44)..(319): NCBI GI: 71041110 NCBI Desc: mybr2 [malus x domestica]
  misc_feature: The sequence is a functional homolog of SEQ ID NO 1045 in the 11/479,226US patent application
  misc_feature: The sequence is a functional homolog of SEQ ID NO 452 in the 10/412,699US patent application
  misc_feature: Useful for making plants with modulated growth and phenotype characteristics
  misc_feature: The sequence is a functional homolog of SEQ ID NO 452 in the 20040045049 US patent application
  misc_feature: The sequence is a functional homolog of SEQ ID NO. 514 in the 11/188,298 US application
MPRDSRPLGMRLFGVTIAPAPAPEADPPERDPSPNPPVAAREDVMRKCKSMGNLAALGAGADGGGGGADGGGAGDGYLSDGGLMQSSGKRRRAQERKKAVPWTEEEHRTFLAGLEKLGKGDWRGIAKNFVTTRTPTQVASHAQKYFLRQTNPNKKKRRSSLFDMMPRELSPTPNCPILPPSMAKVHDVVAMTKQLQNSNLEGASSSNAANVASQVGRDLPPVPSFKATNMDSSFSKFSHMERYWRTPYPFRPISRAPEGTSSSTPVAANIAVPASQANLTACTSTFLSQRGDTSSLPPKGDPPSEEDLELTVAPPSQQNMTNMSSQNAVGVIQVI

SEQ ID NO: 5599 - DNA, 939 bp, Sorghum bicolor
  misc_feature: Ceres ANNOT ID no. 6050171
  misc_feature: Encodes the peptide sequence at SEQ ID NO 5600
atggcgaccggcgacggcgacgacgacgcccagcagcagcaagacggcgagcagccgccggtggtgctcatcacggggtgcgccaagggcgggatcgggtacgagtactgccaggcctttgcggggctaggctgccacgtggtggccaccgacatccccgaccgtgtccccagcctagccgccgacctcgcggacacgccgtccacggaagcactcccgctggacgtcacctccgacgcgagcgtctccgccgccgtcggcgccgtgctggcgcgtcacggccggatcgacgtgctggtcaacaacgccggggtcgggtgcacgggcccgctagcggagcttccgggcgccgcggtgtcccgcgcggtggacgtcaacttcctgggccaggtccgcacggtgcgcgccgtggcgccgcacatggcggcgcgcgggaccgggcgcgtcgtcaacgtgggcagcgtggtgggcaccgccgccacgccatgggcggcgccgtactgcgcgtccaaggccgccgtgcacgccgccaccgacgcgctgcggctcgagctccgccccttcggcgtgcacgtcgtcagggctgggacgcgccaacgccacccagctcgccgccgccgccgccggacagcaggaccatcagtggcggatgtaccggggcttcgcggcggcgatcgaggagcgtggacgggcgtcgcagacgagcaagcacgtcgcgcgacgggtcatgagcgcgcgaccgcccagggagatcgtctacggcaacatgacgctgctgttcgcggtgctcgccgcgtcgcctgcgtgggtgcgcgacgcattcttcgcgtggcgcttcgggctcaacaagaagccacggtagctagcgacttcagttcattagtagcgcgtcgtcttgcttgttgcgttttggccgatccattttctccactccactga

SEQ ID NO: 5600 - protein, 312 aa, Sorghum bicolor
  misc_feature: Ceres ANNOT ID no. 6050171
  misc_feature (20)..(186): Pfam Id: adh_short Pfam Desc: short chain dehydrogenase
  misc_feature (14)..(193): NCBI GI: 72384451 NCBI Desc: 52o08_21 [brassica rapa subsp. pekinensis]
  misc_feature (14)..(193): NCBI GI: 72255607 NCBI Desc: 117m18_6 [brassica rapa]
  misc_feature (14)..(193): NCBI GI: 30682984 NCBI Desc: short-chain dehydrogenase/reductase (sdr) family protein [arabidopsis thaliana]
  misc_feature (17)..(193): NCBI GI: 20466145 NCBI Desc: at5g10050/t31p16_40 [arabidopsis thaliana]
  misc_feature (16)..(193): NCBI GI: 116309996 NCBI Desc: h0523f07.11 [oryza sativa (indica cultivar-group)]
  misc_feature: The sequence is a functional homolog of SEQ ID NO. 389 in the 11/188,298 US application
MATGDGDDDAQQQQDGEQPPVVLITGCAKGGIGYEYCQAFAGLGCHVVATDIPDRVPSLAADLADTPSTEALPLDVTSDASVSAAVGAVLARHGRIDVLVNNAGVGCTGPLAELPGAAVSRAVDVNFLGQVRTVRAVAPHMAARGTGRVVNVGSVVGTAATPWAAPYCASKAAVHAATDALRLELRPFGVHVVRAGTRQRHPARRRRRRTAGPSVADVPGLRGGDRGAWTGVADEQARRATGHERATAQGDRLRQHDAAVRGARRVACVGARRILRVALRAQQEATVASDFSSLVARRLACCVLADPFSPLH

SEQ ID NO: 5601 - DNA, 1503 bp, Sorghum bicolor
  misc_feature: Ceres ANNOT ID no. 6050230
  misc_feature: Encodes the peptide sequence at SEQ ID NO 5602
atgccagggccaggctcagctccaacccaaacaccccctccagaacccaaacccaagcataaaggccgccgcctcgtcctcctcctagggccgcctctcgtcgccgtcgctgttgccctcctcttgggcgtatccacaaacccgttgccccgccgctttctccgccttcttcttgggacaaagccctccattctctcctcctcgtcacctcctgacgcagcttacgaggctgacgcggcaacaggcgcggtacgcgcaccatgtgttctatggatggccccattcgcctccggcggcgggtactgctccgaggcatggtcctacgtcgacgcgcttgacgcgcacgccgctgggaaaagtaacttcacgctcgcgatagcgcaccacggcgatctcgactcgccggagttctggctcggcctgcccgagcggtccaagcacctggcgtacagactcgcttccgagcggtgcgagcttgccagggccgtggtcgtctgccacagcgagcctggcgcttggtacccgccgatgtacgaggctctgccgtgccctcccaccgggtacgacgatcctgcgttcgtcattggacggacgatgttcgagaccgaccgcgtctgtccggagcatgtcaggaggtgcaaccagatggatgctgtctgggtgcctaccgatttccatgtctcaacctttgtgaagagcggtgtggatcccaccaaagttgtcaaggtcgtgcaggctgtggatgtcaatttctttgatccggccaagcatgtcgctcttgctttgccgattggtgtgtctgtcatggtgcctgatggttcaagatttggaaatggtgactctaaacacaaaggttttgtgtttcttagtgtgttcaaatgggaacagaggaagggctgggatgtgctgctgagaggattcctgcaggagttctctggagctgatgacgtcgtactctaccttctgatcaatgcctaccactctgacacaaacttcagtgagaaaatccgcaggtttgtggtagaatccagcattgaggagccaatggaaggatgggctgagatccgggtcatcgatgagcatgtccctcagtctgttcttccaagtctgtacaaaggtgcaaatgcatttgtgctgccaacccgtggtgagggctggggcagaccagtggtcgaagccatggccatggaactgcctgtgattgtgactaattggtcgggtccaacagagtatctgactgaggagaatgggtatccattggatgtagacaggctgactgaggtcacagaagggccattcaagggccacctatgtgctgagccatcaattgatcggctgagggatttaatgagacatgtcgttgacgatagagatgaggcaaggaataaagggaagaaggcaagggaggacatgatcgagaggttctctccagaagttgttgctaggattgttgctgaaaagattcaacaagtgcttacccacactcagttgacaaatgactag

SEQ ID NO: 5602 - protein, 500 aa, Sorghum bicolor
  misc_feature: Ceres ANNOT ID no. 6050230
  misc_feature (272)..(470): Pfam Id: Glycos_transf_1 Pfam Desc: Glycosyl transferases group 1
  misc_feature (4)..(495): NCBI GI: 50725077 NCBI Desc: glycosyl transferase family 1 protein-like [oryza sativa (japonica cultivar-group)]
  misc_feature (263)..(490): NCBI GI: 106892492 NCBI Desc: glycosyl transferase, group 1 [roseiflexus sp. rs-1]
  misc_feature (263)..(485): NCBI GI: 118064815 NCBI Desc: glycosyl transferase, group 1 [roseiflexus castenholzii dsm 13941]
  misc_feature (286)..(492): NCBI GI: 76258187 NCBI Desc: glycosyl transferase, group 1 [chloroflexus aurantiacus j-10-fl]
  misc_feature (192)..(467): NCBI GI: 76258183 NCBI Desc: glycosyl transferase, group 1 [chloroflexus aurantiacus j-10-fl]
MPGPGSAPTQTPPPEPKPKHKGRRLVLLLGPPLVAVAVALLLGVSTNPLPRRFLRLLLGTKPSILSSSSPPDAAYEADAATGAVRAPCVLWMAPFASGGGYCSEAWSYVDALDAHAAGKSNFTLAIAHHGDLDSPEFWLGLPERSKHLAYRLASERCELARAVVVCHSEPGAWYPPMYEALPCPPTGYDDPAFVIGRTMFETDRVCPEHVRRCNQMDAVWVPTDFHVSTFVKSGVDPTKVVKVVQAVDVNFFDPAKHVALALPIGVSVMVPDGSRFGNGDSKHKGFVFLSVFKWEQRKGWDVLLRGFLQEFSGADDVVLYLLINAYHSDTNFSEKIRRFVVESSIEEPMEGWAEIRVIDEHVPQSVLPSLYKGANAFVLPTRGEGWGRPVVEAMAMELPVIVTNWSGPTEYLTEENGYPLDVDRLTEVTEGPFKGHLCAEPSIDRLRDLMRHVVDDRDEARNKGKKAREDMIERFSPEVVARIVAEKIQQVLTHTQLTND

SEQ ID NO: 5603 - DNA, 234 bp, Sorghum bicolor
  misc_feature: Ceres ANNOT ID no. 6050458
  misc_feature: Encodes the peptide sequence at SEQ ID NO 5604
atgagtaacgcactggctacacaaaccgttgaagatagttctagacctaagccaaaacggactggcgcaggtagtttattgaaacccttgaattcggaatatgggaaagttgctccgggttgggggactactccttttatgggggtcgcaatggctttattcgcgatattcctatctataattttagaaatttataattcttctgttttactggacgaaattttaacgaattag

SEQ ID NO: 5604 - protein, 77 aa, Sorghum bicolor
  misc_feature: Ceres ANNOT ID no. 6050458
  misc_feature (20)..(71): Pfam Id: PsbH Pfam Desc: Photosystem II 10 kDa phosphoprotein
  misc_feature (5)..(77): NCBI GI: 75261481 NCBI Desc: photosystem ii reaction center h protein (photosystem ii 10 kda phosphoprotein) (psii-h)
  misc_feature (5)..(77): NCBI GI: 902250 NCBI Desc: psii 10kda phosphoprotein [zea mays]
  misc_feature (5)..(77): NCBI GI: 48478798 NCBI Desc: photosystem ii phosphoprotein [saccharum hybrid cultivar sp-80-3280]
  misc_feature (5)..(77): NCBI GI: 50812556 NCBI Desc: psii 10kd phosphoprotein [saccharum officinarum]
  misc_feature (5)..(77): NCBI GI: 118614520 NCBI Desc: photosystem ii phosphoprotein [sorghum bicolor]
MSNALATQTVEDSSRPKPKRTGAGSLLKPLNSEYGKVAPGWGTTPFMGVAMALFAIFLSIILEIYNSSVLLDEILTN

SEQ ID NO: 5605 - DNA, 576 bp, Sorghum bicolor
  misc_feature: Ceres ANNOT ID no. 6050668
  misc_feature: Encodes the peptide sequence at SEQ ID NO 5606
atggctgcggcgaacgcaggggacgtggatgtggtcgatttcgactccgacgacgacgacctcatggacgacgacgccctcgaggcctacccggcctccgcccctcgcctccgctccaccatcgcggccagcggagattcctccgctgccgcgcgcaagaccaaaggccgcggattccgcgaggagccttcctcctcgcggcccttagccggccgctccgacttcgactccctcggctccgactatggccctggacccctcactattgaggggtggattattttggtaactggcatccatgaagaagcacaggaggatgatctccataatgctttccgggaatttgggcaggtcaagaaccttcatttgaatttagatcgtcgtactgggtttgtcaaaggatatgctttggttgaatatgagagctttgatgaagcacaggctgcaattaaagcaatggatggaactgagcttgttacacagataataaatgttgactgggcatttagtagtggcccagttaagcgaagaaatgttcgctggagatcaaggagccctgtcaggagaagatactga

SEQ ID NO: 5606 - protein, 191 aa, Sorghum bicolor
  misc_feature: Ceres ANNOT ID no. 6050668
  misc_feature (94)..(165): Pfam Id: RRM_1 Pfam Desc: RNA recognition motif. (a.k.a. RRM, RBD, or RNP domain)
  misc_feature (1)..(191): NCBI GI: 115461997 NCBI Desc: os05g0140500 [oryza sativa (japonica cultivar-group)]
  misc_feature (2)..(191): NCBI GI: 68037220 NCBI Desc: mrna transport factor [triticum aestivum]
  misc_feature (6)..(191): NCBI GI: 30524687 NCBI Desc: salt tolerance protein 4 [beta vulgaris]
  misc_feature (2)..(191): NCBI GI: 82798422 NCBI Desc: y14 protein [taiwania cryptomerioides]
  misc_feature (51)..(190): NCBI GI: 7158824 NCBI Desc: rna binding motif protein 8 [homo sapiens]
  misc_feature: The sequence is a functional homolog of SEQ ID NO. 339 in the 11/188,298 US application
MAAANAGDVDVVDFDSDDDDLMDDDALEAYPASAPRLRSTIAASGDSSAAARKTKGRGFREEPSSSRPLAGRSDFDSLGSDYGPGPLTIEGWIILVTGIHEEAQEDDLHNAFREFGQVKNLHLNLDRRTGFVKGYALVEYESFDEAQAAIKAMDGTELVTQIINVDWAFSSGPVKRRNVRWRSRSPVRRRY

SEQ ID NO: 5607 - DNA, 1416 bp, Sorghum bicolor
  misc_feature: Ceres ANNOT ID no. 6051636
  misc_feature: Encodes the peptide sequence at SEQ ID NO 5608
atggtgcgggcgtgggggcggacggcgctgcctccgctcctcatcctcggcctcctccgcctgcacttctccccgctggtcgtcgcccaagaaggacaagaaaaagaccctgctactttgttcgcgcaagcctcagagatgatgaacctgaggaagtatgatggggcgcttggcctgctaaatgctgtgttggaagttgacccaaatcattctcaagcttacaggcaacgtgcatccgtgcttcgtcataaatgcagatacaaggaagctgagagtgactataccaaacacctggagctgaatcctgggtctgcttcagtggaaaaggaactatcccagcttcttcaggctcaaaattcattacaatctgcttatggccagttcgattctggtgacttttcaaaagttgtggaatacatgaacaaaattgtgctcgtcttttctccaggttgcttaaaggcaaagcttctcaaggctaaagcattgctagcactgaaagactactcaagcgttatttcagagaccggattcattctaaaggaagatgaagacaacttggatgcactgctattacgtggtcgcgcctactattaccttgctgatcatgatgtggcctccaggcactaccagaaagggctccgtcttgatccagagcattcagaattgaagaaagcatattttgggttaaaaaatcttttgaagaagaccaagagtgctgaagataatgctgccaagggtaaactacgtgtgtctgttgaggactacaagacagctctagcaatggatccagaccatactgcttataatgtgcatctttatcttgggttgtgtaaaactctggtcagacttgggagaagtaaggaggcaatcagcagctgtacagaagcactgagcatagacagtgaacttgttgacgcacttacacagagaggtgaagctaaacttctctcagaagattgggaaggagcggttcaggatctaaaagaggctgcccagaaatctccacaggacatgggtatccgtgaagcacttatgagagctgaaaagcatcttaagttgagcaaaagaaaagactggtataaaatccttggtgtttcaaagacagcatcagctgcggagataaaacgtgcctacaaaaagctggcgttgcagtggcatccagataaaaacgtggataaccgggaggaagcagaaaacatgtttcgagaaattgctgctgcttatgaggtgcttggtgatgaagacaaacgtgtaaggtatgaccgtggagaggatgtggaggagatgaatatgggaggcgggggtggcttcaatccttttgggggcggcggccagcagtacacgtttcatttcgacggtgggttccccggcggtggcttccctgggggtggaggctttcagttcaactttggataa

SEQ ID NO: 5608 - protein, 471 aa, Sorghum bicolor
  misc_feature: Ceres ANNOT ID no. 6051636
  misc_feature (358)..(421): Pfam Id: DnaJ Pfam Desc: DnaJ domain
  misc_feature (186)..(219): Pfam Id: TPR_2 Pfam Desc: Tetratricopeptide repeat
  misc_feature (71)..(104): Pfam Id: TPR_1 Pfam Desc: Tetratricopeptide repeat
  misc_feature (186)..(219): Pfam Id: TPR_1 Pfam Desc: Tetratricopeptide repeat
  misc_feature (38)..(470): NCBI GI: 140042787 NCBI Desc: heat shock protein dnaj, n-terminal [medicago truncatula]
  misc_feature (4)..(468): NCBI GI: 32395916 NCBI Desc: p58ipk [lycopersicon esculentum]
  misc_feature (4)..(468): NCBI GI: 32395918 NCBI Desc: p58ipk [nicotiana benthamiana]
  misc_feature (13)..(471): NCBI GI: 41107617 NCBI Desc: dnaj (hsp40) homolog, subfamily c, member 3 [danio rerio]
  misc_feature (13)..(471): NCBI GI: 29437212 NCBI Desc: dnaj (hsp40) homolog, subfamily c, member 3 [danio rerio]
MVRAWGRTALPPLLILGLLRLHFSPLVVAQEGQEKDPATLFAQASEMMNLRKYDGALGLLNAVLEVDPNHSQAYRQRASVLRHKCRYKEAESDYTKHLELNPGSASVEKELSQLLQAQNSLQSAYGQFDSGDFSKVVEYMNKIVLVFSPGCLKAKLLKAKALLALKDYSSVISETGFILKEDEDNLDALLLRGRAYYYLADHDVASRHYQKGLRLDPEHSELKKAYFGLKNLLKKTKSAEDNAAKGKLRVSVEDYKTALAMDPDHTAYNVHLYLGLCKTLVRLGRSKEAISSCTEALSIDSELVDALTQRGEAKLLSEDWEGAVQDLKEAAQKSPQDMGIREALMRAEKHLKLSKRKDWYKILGVSKTASAAEIKRAYKKLALQWHPDKNVDNREEAENMFREIAAAYEVLGDEDKRVRYDRGEDVEEMNMGGGGGFNPFGGGGQQYTFHFDGGFPGGGFPGGGGFQFNFG

SEQ ID NO: 5609 - DNA, 753 bp, Sorghum bicolor
  misc_feature: Ceres ANNOT ID no. 6051645
  misc_feature: Encodes the peptide sequence at SEQ ID NO 5610
atggcaagggaggactgcagctccggcgctgaaatggacgcgctcgtccgacgcctgaggctccaccggccgcccccttccccctacgaccccgagccagacgcggcccccgtccccgccaccgccggcgacggccagctgttccggccgcggagggccgccgtgctcgtctgcctcttccggggcgacggcggcgagctccgcgtcatcctcaccaaacgctcgtcctccctctccacccactccggtgaagtttcattgccgggaggaaaggtcgaggagggtgatgctgatgatgcagcaacagcattaagggagtcaaaggaggagattgggcttgatccagctctggttacagtggttgcctctcttgaacactttttgtccaagcacctgctggtagttgttcctgttgttggcatactattagacagacaagcatttaaacctgctcttaatattgctgaggtagacgaaatatttgatgtacccctggagatgttcctcaaggatgagaacaggacatctgaggagcgagaaaagatgggccaggcattcacagtccattacttcacttacgagaaaggaatccagaagtacttaatctggggtctgacagcccgcatcttgatccatgctgcttcagttgtataccagcgaccgccggactttacagagcgaagtgcacatttcaaattaccaaagttcacaaaggactgctcttcaatgctagcaggacctgctaaacactag

SEQ ID NO: 5610 - protein, 250 aa, Sorghum bicolor
  misc_feature: Ceres ANNOT ID no. 6051645
  misc_feature (51)..(189): Pfam Id: NUDIX Pfam Desc: NUDIX domain
  misc_feature (82)..(236): NCBI GI: 115476160 NCBI Desc: os08g0376200 [oryza sativa (japonica cultivar-group)]
  misc_feature (44)..(243): NCBI GI: 10764850 NCBI Desc: f1k23.5 [arabidopsis thaliana]
  misc_feature (39)..(218): NCBI GI: 63255228 NCBI Desc: nudix hydrolase [pseudomonas syringae pv. syringae b728a]
  misc_feature (39)..(218): NCBI GI: 28851910 NCBI Desc: mutt/nudix family protein [pseudomonas syringae pv. tomato str. dc3000]
  misc_feature (39)..(218): NCBI GI: 71737950 NCBI Desc: mutt/nudix family protein [pseudomonas syringae pv. phaseolicola 1448a]
MAREDCSSGAEMDALVRRLRLHRPPPSPYDPEPDAAPVPATAGDGQLFRPRRAAVLVCLFRGDGGELRVILTKRSSSLSTHSGEVSLPGGKVEEGDADDAATALRESKEEIGLDPALVTVVASLEHFLSKHLLVVVPVVGILLDRQAFKPALNIAEVDEIFDVPLEMFLKDENRTSEEREKMGQAFTVHYFTYEKGIQKYLIWGLTARILIHAASVVYQRPPDFTERSAHFKLPKFTKDCSSMLAGPAKH

SEQ ID NO: 5611 - DNA, 726 bp, Sorghum bicolor
  misc_feature: Ceres ANNOT ID no. 6051647
  misc_feature: Encodes the peptide sequence at SEQ ID NO 5612
atggaagaggaggtgggccccggcgcggacatggaggcgctcgtccgccgtctgaggctccaccgcccggccccctccccgtacgaactctcagccgcggtggcccctgcccctgctcctggcgccggcgagctgttccggccacggagggccgccgttctggtttgcctcttccggggcgcagccggagagctccgagtcatactcaccaagcgctcctcctcactctccacccactccggggaagttgcattaccaggtggaaaggccgaggaaggtgatgctgatgatgcagcaacagcattaagggagtcaaaagaggagattgggcttgatccagctctggtcacagtcgttacatcgcttgaacatgtcttgtccaaacatcttctggtagttgttcctattgttggcatactttcagacataaacacatttaagcctgttcctaatgctgctgaggtggacaaaatttttgatgtgcccctggagatgttcctcaaggatgagaaccggacatctaatgacctagaatggatggggcaggagtttacaatccatcacttcagttatgcgaaggagaacgagaagtacatgatttggggtctgacggctggcatcctgatccatgctgcttcagttgtttaccagcgaccaccagactttgcagagaaaagggcacagttcaacttgccaacgtacttcaatgccatggccagagcctga

SEQ ID NO: 5612 - protein, 241 aa, Sorghum bicolor
  misc_feature: Ceres ANNOT ID no. 6051647
  misc_feature (49)..(183): Pfam Id: NUDIX Pfam Desc: NUDIX domain
  misc_feature (37)..(232): NCBI GI: 10764850 NCBI Desc: f1k23.5 [arabidopsis thaliana]
  misc_feature (80)..(234): NCBI GI: 115476160 NCBI Desc: os08g0376200 [oryza sativa (japonica cultivar-group)]
  misc_feature (51)..(216): NCBI GI: 63255228 NCBI Desc: nudix hydrolase [pseudomonas syringae pv. syringae b728a]
  misc_feature (51)..(216): NCBI GI: 28851910 NCBI Desc: mutt/nudix family protein [pseudomonas syringae pv. tomato str. dc3000]
  misc_feature (51)..(216): NCBI GI: 71737950 NCBI Desc: mutt/nudix family protein [pseudomonas syringae pv. phaseolicola 1448a]
MEEEVGPGADMEALVRRLRLHRPAPSPYELSAAVAPAPAPGAGELFRPRRAAVLVCLFRGAAGELRVILTKRSSSLSTHSGEVALPGGKAEEGDADDAATALRESKEEIGLDPALVTVVTSLEHVLSKHLLVVVPIVGILSDINTFKPVPNAAEVDKIFDVPLEMFLKDENRTSNDLEWMGQEFTIHHFSYAKENEKYMIWGLTAGILIHAASVVYQRPPDFAEKRAQFNLPTYFNAMARA

SEQ ID NO: 5613 - DNA, 822 bp, Sorghum bicolor
  misc_feature: Ceres ANNOT ID no. 6051788
  misc_feature: Encodes the peptide sequence at SEQ ID NO 5614
atgaatcctcaaagccctaaaaccagtgctccttgcaccttgccagtggagccggctgctgctgttgttcccaacgaagcagtggcgaccgataaagctccgccgccgccaacggccaacacggtgataatccgggagcaggaccggctgatgcccgtggccaacgtgtcccgcatcatgcgccaagtgctgcctccctacgccaagatctccgacgacgccaaggaggtgatccaggagtgcgtgtccgagttcatcagcttcgtcaccggcgaggccaacgagcggtgccacaccgagcgccgcaagaccgtcgcctccgaggacatcgtgtgggccttgaaccgcctcggcttcgacgactacgtcgcgcccgtcggcaccttcctccagcgcatgcgcgagagcgaggccggcggcgaagagcgcggcccagggcgtggcggcggctcgcgccgcggctcgtccgtggtcacgctcacgctgccggtcaacggcggtgcgcagctgacgatgcaccaccctgccgccgtcagccggcatccgcaccaaggtgtgtcgcctgctgcaggttacgccgtccggcccgttccccgcccggcggcggttccatctgccaatggggcggtggcggcgccgcacttcggcggccggtcgtaccagatgtacggcggcaaccaccgccctgtggttccctgctaccacggaggaggaggagcggcgttcgtcgacgccggtggaagccaacacgttggattccacgacgacgaggctagctcttcgactgaaaatccaccggcggggcgtcctggctcgcactag

SEQ ID NO: 5614 - protein, 273 aa, Sorghum bicolor
  misc_feature: Ceres ANNOT ID no. 6051788
  misc_feature (49)..(114): Pfam Id: CBFD_NFYB_HMF Pfam Desc: Histone-like transcription factor (CBF/NF-Y) and archaealhistone
  misc_feature (16)..(268): NCBI GI: 55297240 NCBI Desc: hap3 transcriptional-activator [oryza sativa (japonica cultivar-group)]
  misc_feature (16)..(268): NCBI GI: 37542678 NCBI Desc: hap3 transcriptional-activator [oryza sativa]
  misc_feature (44)..(271): NCBI GI: 15321716 NCBI Desc: leafy cotyledon1 [zea mays]
  misc_feature (25)..(252): NCBI GI: 37542680 NCBI Desc: hap3 transcriptional-activator [oryza sativa (indica cultivar-group)]
  misc_feature (14)..(148): NCBI GI: 55859472 NCBI Desc: leafy cotyledon 1-like protein [helianthus annuus]
  misc_feature: The sequence is a functional homolog of SEQ ID NO 64 in the 10/675,852US patent application
  misc_feature: The sequence is a functional homolog of SEQ ID NO 66 in the 10/675,852US patent application
  misc_feature: Useful for making plants with modulated growth and phenotype characteristics
  misc_feature: The sequence is a functional homolog of SEQ ID NO 64 in the 20050086718 US patent application
  misc_feature: The sequence is a functional homolog of SEQ ID NO 66 in the 20050086718 US patent application
  misc_feature: The sequence is a functional homolog of SEQ ID NO 416 in the 11/435,388 US patent application
  misc_feature: The sequence is a functional homolog of SEQ ID NO 418 in the 10/714,887 US patent application
  misc_feature: The sequence is a functional homolog of SEQ ID NO 789 in the 10/374,780 US patent application
  misc_feature: The sequence is a functional homolog of SEQ ID NO 418 in the 11/435,388 US patent application
  misc_feature: The sequence is a functional homolog of SEQ ID NO 420 in the 10/714,887 US patent application
  misc_feature: The sequence is a functional homolog of SEQ ID NO 306 in the 11/435,388 US patent application
  misc_feature: The sequence is a functional homolog of SEQ ID NO 308 in the 10/714,887 US patent application
  misc_feature: The sequence is a functional homolog of SEQ ID NO 70 in the 10/675,852 US patent application
  misc_feature: The sequence is a functional homolog of SEQ ID NO 106 in the 10/666,642 US patent application
  misc_feature: The sequence is a functional homolog of SEQ ID NO 1784 in the 10/412,699 US patent application
  misc_feature: The sequence is a functional homolog of SEQ ID NO 2010 in the 10/374,780 US patent application
  misc_feature: The sequence is a functional homolog of SEQ ID NO 292 in the 11/435,388 US patent application
  misc_feature: The sequence is a functional homolog of SEQ ID NO 294 in the 10/714,887 US patent application
  misc_feature: The sequence is a functional homolog of SEQ ID NO 6 in the 10/675,852 US patent application
  misc_feature: The sequence is a functional homolog of SEQ ID NO 719 in the 11/479,226 US patent application
  misc_feature: The sequence is a functional homolog of SEQ ID NO 18 in the 10/675,852 US patent application
  misc_feature: The sequence is a functional homolog of SEQ ID NO 2183 in the 10/666,642 US patent application
  misc_feature: The sequence is a functional homolog of SEQ ID NO 406 in the 11/435,388 US patent application
  misc_feature: The sequence is a functional homolog of SEQ ID NO 408 in the 10/714,887 US patent application
  misc_feature: The sequence is a functional homolog of SEQ ID NO 798 in the 10/374,780 US patent application
  misc_feature: The sequence is a functional homolog of SEQ ID NO 34 in the 10/675,852 US patent application
  misc_feature: The sequence is a functional homolog of SEQ ID NO 807 in the 10/374,780 US patent application
  misc_feature: The sequence is a functional homolog of SEQ ID NO 22 in the 10/675,852 US patent application
  misc_feature: The sequence is a functional homolog of SEQ ID NO 2175 in the 10/666,642 US patent application
  misc_feature: The sequence is a functional homolog of SEQ ID NO 398 in the 11/435,388 US patent application
  misc_feature: The sequence is a functional homolog of SEQ ID NO 400 in the 10/714,887 US patent application
  misc_feature: The sequence is a functional homolog of SEQ ID NO 80 in the 10/675,852 US patent application
  misc_feature: The sequence is a functional homolog of SEQ ID NO 801 in the 10/374,780 US patent application
  misc_feature: The sequence is a functional homolog of SEQ ID NO 2171 in the 10/666,642 US patent application
  misc_feature: The sequence is a functional homolog of SEQ ID NO 2173 in the 10/666,642 US patent application
  misc_feature: The sequence is a functional homolog of SEQ ID NO 2185 in the 10/666,642 US patent application
  misc_feature: The sequence is a functional homolog of SEQ ID NO 24 in the 10/675,852 US patent application
  misc_feature: The sequence is a functional homolog of SEQ ID NO 394 in the 11/435,388 US patent application
  misc_feature: The sequence is a functional homolog of SEQ ID NO 396 in the 10/714,887 US patent application
  misc_feature: The sequence is a functional homolog of SEQ ID NO 396 in the 11/435,388 US patent application
  misc_feature: The sequence is a functional homolog of SEQ ID NO 398 in the 10/714,887 US patent application
  misc_feature: The sequence is a functional homolog of SEQ ID NO 408 in the 11/435,388 US patent application
  misc_feature: The sequence is a functional homolog of SEQ ID NO 410 in the 10/714,887 US patent application
  misc_feature: The sequence is a functional homolog of SEQ ID NO 84 in the 10/675,852 US patent application
  misc_feature: The sequence is a functional homolog of SEQ ID NO 26 in the 10/675,852 US patent application
  misc_feature: The sequence is a functional homolog of SEQ ID NO 802 in the 10/374,780 US patent application
  misc_feature: Useful for making plants with altered alkaloid content
  misc_feature: Useful for making plants with altered terpenoid content
  misc_feature: Functional homolog of the protein sequence given in SEQ ID NO 13247
  misc_feature: The sequence is a functional homolog of SEQ ID NO 44 in the 10/675,852 US patent application
  misc_feature: The sequence is a functional homolog of SEQ ID NO 308 in the 11/435,388 US patent application
  misc_feature: The sequence is a functional homolog of SEQ ID NO 310 in the 10/714,887 US patent application
  misc_feature: The sequence is a functional homolog of SEQ ID NO 64 in the 10/675,852 US patent application
  misc_feature: The sequence is a functional homolog of SEQ ID NO 14 in the 10/675,852 US patent application
  misc_feature: Useful for making plants with modulated biomass
  misc_feature: Functional homolog of the protein sequence given in SEQ ID NO 13228
  misc_feature: The sequence is a functional homolog of SEQ ID NO 36 in the 10/675,852 US patent application
  misc_feature: The sequence is a functional homolog of SEQ ID NO 2149 in the 10/666,642 US patent application
  misc_feature: The sequence is a functional homolog of SEQ ID NO 362 in the 11/435,388 US patent application
  misc_feature: The sequence is a functional homolog of SEQ ID NO 364 in the 10/714,887 US patent application
  misc_feature: The sequence is a functional homolog of SEQ ID NO 40 in the 10/675,852 US patent application
  misc_feature: The sequence is a functional homolog of SEQ ID NO 58 in the 10/675,852 US patent application
  misc_feature: The sequence is a functional homolog of SEQ ID NO 78 in the 10/675,852 US patent application
  misc_feature: The sequence is a functional homolog of SEQ ID NO 806 in the 10/374,780 US patent application
  misc_feature: The sequence is a functional homolog of SEQ ID NO 12 in the 10/675,852 US patent application
  misc_feature: The sequence is a functional homolog of SEQ ID NO 2137 in the 10/666,642 US patent application
  misc_feature: The sequence is a functional homolog of SEQ ID NO 332 in the 11/435,388 US patent application
  misc_feature: The sequence is a functional homolog of SEQ ID NO 334 in the 10/714,887 US patent application
  misc_feature: The sequence is a functional homolog of SEQ ID NO 54 in the 10/675,852 US patent application
  misc_feature: The sequence is a functional homolog of SEQ ID NO 74 in the 10/675,852 US patent application
  misc_feature: The sequence is a functional homolog of SEQ ID NO 790 in the 10/374,780 US patent application
  misc_feature: The sequence is a functional homolog of SEQ ID NO 787 in the 10/374,780 US patent application
  misc_feature: The sequence is a functional homolog of SEQ ID NO 42 in the 10/675,852 US patent application
  misc_feature: The sequence is a functional homolog of SEQ ID NO 294 in the 11/435,388 US patent application
  misc_feature: The sequence is a functional homolog of SEQ ID NO 296 in the 10/714,887 US patent application
  misc_feature: The sequence is a functional homolog of SEQ ID NO 308 in the 10/412,699 US patent application
  misc_feature: The sequence is a functional homolog of SEQ ID NO 723 in the 11/479,226 US patent application
  misc_feature: The sequence is a functional homolog of SEQ ID NO 2139 in the 10/666,642 US patent application
  misc_feature: The sequence is a functional homolog of SEQ ID NO 334 in the 11/435,388 US patent application
  misc_feature: The sequence is a functional homolog of SEQ ID NO 336 in the 10/714,887 US patent application
  misc_feature: The sequence is a functional homolog of SEQ ID NO 90 in the 10/675,852 US patent application
  misc_feature: The sequence is a functional homolog of SEQ ID NO 793 in the 10/374,780 US patent application
  misc_feature: The sequence is a functional homolog of SEQ ID NO 414 in the 11/435,388 US patent application
  misc_feature: The sequence is a functional homolog of SEQ ID NO 416 in the 10/714,887 US patent application
  misc_feature: The sequence is a functional homolog of SEQ ID NO 2177 in the 10/666,642 US patent application
  misc_feature: The sequence is a functional homolog of SEQ ID NO 400 in the 11/435,388 US patent application
  misc_feature: The sequence is a functional homolog of SEQ ID NO 402 in the 10/714,887 US patent application
  misc_feature: The sequence is a functional homolog of SEQ ID NO 52 in the 10/675,852 US patent application
  misc_feature: The sequence is a functional homolog of SEQ ID NO 799 in the 10/374,780 US patent application
  misc_feature: The sequence is a functional homolog of SEQ ID NO 1167 in the 10/412,699 US patent application
  misc_feature: The sequence is a functional homolog of SEQ ID NO 783 in the 10/374,780 US patent application
  misc_feature: The sequence is a functional homolog of SEQ ID NO 810 in the 10/666,642 US patent application
  misc_feature: The sequence is a functional homolog of SEQ ID NO. 318 in the 11/188,298 US application
MNPQSPKTSAPCTLPVEPAAAVVPNEAVATDKAPPPPTANTVIIREQDRLMPVANVSRIMRQVLPPYAKISDDAKEVIQECVSEFISFVTGEANERCHTERRKTVASEDIVWALNRLGFDDYVAPVGTFLQRMRESEAGGEERGPGRGGGSRRGSSVVTLTLPVNGGAQLTMHHPAAVSRHPHQGVSPAAGYAVRPVPRPAAVPSANGAVAAPHFGGRSYQMYGGNHRPVVPCYHGGGGAAFVDAGGSQHVGFHDDEASSSTENPPAGRPGSH

SEQ ID NO: 5615 - DNA, 279 bp, Sorghum bicolor
  misc_feature: Ceres ANNOT ID no. 6051879
  misc_feature: Encodes the peptide sequence at SEQ ID NO 5616
atggcggaggaatcaggccgccccttgccaaagtttggtgaatgggatgtcaatgatccagcttctgcagacggatttactgtcatattcaacaaagcaagagatgagaagaagggtgggaatggacaagacactgattcaccttccaaggacaccaggactgagagggtggaatcttatgctgcaaaaccaaaagaaatggttttgttgtgtgacagccagccctacgcaatcctgaggaagacaagtgcatgcgctttggaaatactgtccctttaa

SEQ ID NO: 5616 - protein, 92 aa, Sorghum bicolor
  misc_feature: Ceres ANNOT ID no. 6051879
  misc_feature (1)..(73): Pfam Id: NOI Pfam Desc: Nitrate-induced NOI protein
  misc_feature (1)..(71): NCBI GI: 2895781 NCBI Desc: nitrate-induced noi protein [zea mays]
  misc_feature (1)..(71): NCBI GI: 86361426 NCBI Desc: nitrate-induced noi protein-like protein [oryza sativa (indica cultivar-group)]
  misc_feature (1)..(77): NCBI GI: 47848486 NCBI Desc: noi protein [oryza sativa (japonica cultivar-group)]
  misc_feature (1)..(77): NCBI GI: 2642217 NCBI Desc: noi protein [oryza sativa]
  misc_feature (4)..(82): NCBI GI: 79537400 NCBI Desc: noi [arabidopsis thaliana]
  misc_feature: Useful for making plants with modulated nitrogen use efficiency
  misc_feature: Functional homolog of the protein sequence encoded by LOCUS at2g17660
  misc_feature: Useful for making plants with modulated nitrogen use efficiency
  misc_feature: Functional homolog of the protein sequence given in SEQ ID NO 13927
MAEESGRPLPKFGEWDVNDPASADGFTVIFNKARDEKKGGNGQDTDSPSKDTRTERVESYAAKPKEMVLLCDSQPYAILRKTSACALEILSL

SEQ ID NO: 5617 - DNA, 798 bp, Sorghum bicolor
  misc_feature: Ceres ANNOT ID no. 6051909
  misc_feature: Encodes the peptide sequence at SEQ ID NO 5618
atggcttcgcgcctccgcctcgtcggctcgaccccaagcacagacgcggactccgcccagaacccaggcatctccggcaacgcagcgggggagggggagggggagcgactgggagaggcgaagacgccggagccgccgcgacaggaggtgacggaccttggcggcggcagcgaggtggtctacatcccccggttcgtggcccgggagaaggcgtgggggtggttcgactacctcgacaagtccatcccctggacgcgccccgaaatccgcgtcttcggccgctctgccaaacagcctagagatgtgtgctatgttgcagatgaagggttaactgttttgaaatatagtggtcatcagcctcatgcacattcttgggatgaattccccgtgctcaaggacatcttgaagttggtccatgaagcccttcccgggagctattttaacagcttgctcctgaacagatacgagacaggttcagactacgtttcatggcatgctgatgatgagcccctctacggaccgactccagagatagcatctgtcacctttgggtgtgaacgcgacttcttacttaggaagaagcctgccaaatcgcaagccatttctgcatctggagaagctggtcgaaagcggctcaaggtcgctgcatctcaaaagcagcattcttttcttctgaagcatggctcgctgcttgtgatgagaggctacacccagcgggactggcagcactcagttccgaagcgagccaaagtgagctcaccgaggatcaatctgactttcaggcatgtgctgtcctaa

SEQ ID NO: 5618 - protein, 265 aa, Sorghum bicolor
  misc_feature: Ceres ANNOT ID no. 6051909
  misc_feature (47)..(263): NCBI GI: 87162794 NCBI Desc: 2og-fe(ii) oxygenase [medicago truncatula]
  misc_feature (58)..(192): NCBI GI: 37676115 NCBI Desc: alkylated dna repair protein [vibrio vulnificus yj016]
  misc_feature (57)..(193): NCBI GI: 67154664 NCBI Desc: 2og-fe(ii) oxygenase superfamily [azotobacter vinelandii avop]
  misc_feature (80)..(194): NCBI GI: 28198460 NCBI Desc: alkylated dna repair protein [xylella fastidiosa temecula1]
  misc_feature (80)..(194): NCBI GI: 71898799 NCBI Desc: 2og-fe(ii) oxygenase superfamily [xylella fastidiosa ann-1]
MASRLRLVGSTPSTDADSAQNPGISGNAAGEGEGERLGEAKTPEPPRQEVTDLGGGSEVVYIPRFVAREKAWGWFDYLDKSIPWTRPEIRVFGRSAKQPRDVCYVADEGLTVLKYSGHQPHAHSWDEFPVLKDILKLVHEALPGSYFNSLLLNRYETGSDYVSWHADDEPLYGPTPEIASVTFGCERDFLLRKKPAKSQAISASGEAGRKRLKVAASQKQHSFLLKHGSLLVMRGYTQRDWQHSVPKRAKVSSPRINLTFRHVLS

SEQ ID NO: 5619 - DNA, 1749 bp, Sorghum bicolor
  misc_feature: Ceres ANNOT ID no. 6051917
  misc_feature: Encodes the peptide sequence at SEQ ID NO 5620
atggctacagagacattgcctgaaacacttccagtggtccctgatactcaaacactgaagttgcattctcagattggttcctctttggaggcttccaggctcaataaaccttgtgcatcggtgcgaacaaggctgcctgaaccaaacaacttgagcaaaccaagttctgaagcggagcctaaggtccagaaaccaagcaacctactaaatgagtcagttgatcacactagtttagacaagatttccacagaccccatccaagataaactggttttagagtgtcctgtggatgaacagaagaaagatgtgaaccaagagaatatgtgcagaagattgaaaccatcttcaatattggacaaggaatgtggcctagcaaaggcaaatgaaagtggcaggctgatcaagagatcagatactggtgaaagaggaacaagtagcagatacaggccaagcaatagcagtgatattagtgatgaaagctcgtgtagcagtatcaccaagcctcataaggcaaatgattcacgctgggaggcaattcagatgatcaggactagagatgggatctttggtctgagccattttaagctgttgaagaagctaggctgtggtgacattggcagtgtatatctttcagaattgagtggaacaaagagttattttgcaatgaaggtcatggacaaggcatcacttgcaagtcgtaagaagttgcttcggtcccagactgaaaaggacatcttgcagtgcctggatcacccattccttcctacattgtatacccactttgagaccgataaattttcatgtctggttatggagttttgtcctggaggagacatgcataccctgcgacaaaggcaacgtggcaagtattttccagaacaagcggtcaaattctatgtatctgaaattctcctagcattggagtacctgcacatgctcggtatcatatatcgggatctcaaaccagaaaatgtccttatccgtgaggatggacacatcatgttaacggatttcgacctctcccttcgttgtgcagtgagcccaatactgatcaggttgtctaactccgttccagaatcacttaagaagtataaccaaactcatagtgctcaacaagcttgtgttcagccatcctgtgtgatgcagccatcatgcacagctcccacggcatgctttggcccacgactgttttctaaatcaaagaaagttcgaaaaccgaagcttgaagttgtcaaccaggtgagcccatggcctgagcttatagcagaacctagtgatgcacgatcgatgtcatttgttggtacacatgagtacttggcacccgagattatcaaaggtgagggtcatggtagtgctgttgactggtggacctttggtatattcctatatgagctcctgtttgggaaaacaccattcaaaggcacggggaaccgggcgacactgttcaatgtcattggtcagcccttgcgtttccctgaatatccagttgtgagcttcccagctagggatttaataagaagtctcctggtcaaagagccccaacaacgattgggttttaagcgtggtgccaccgagataaaacagcacccattttttgagggtgtgaactgggcattgatacgctgtgcgagtcctccagaggttccaaggcattttgacattgagaagcccccgaagcagcctgtgtcaacatcagagagtgctgcccagaatggtggtgataactatttagagtttggtttcttttag

SEQ ID NO: 5620 - protein, 582 aa, Sorghum bicolor
  misc_feature: Ceres ANNOT ID no. 6051917
  misc_feature (194)..(532): Pfam Id: Pkinase Pfam Desc: Protein kinase domain
  misc_feature (194)..(526): Pfam Id: Pkinase_Tyr Pfam Desc: Protein tyrosine kinase
  misc_feature (1)..(582): NCBI GI: 90178578 NCBI Desc: protein kinase g11a
  misc_feature (57)..(577): NCBI GI: 169788 NCBI Desc: g11a protein
  misc_feature (26)..(582): NCBI GI: 20259910 NCBI Desc: protein kinase 5 [arabidopsis thaliana]
  misc_feature (135)..(582): NCBI GI: 217843 NCBI Desc: protein kinase [arabidopsis thaliana]
  misc_feature (167)..(582): NCBI GI: 168618 NCBI Desc: protein kinase
  misc_feature (1)..(582): SWISSPROT Homolog: EC 2.7.11.1 Protein kinase G11A
  misc_feature: The sequence is a functional homolog of SEQ ID NO. 441 in the 11/188,298 US application
  misc_feature: The sequence is a functional homolog of SEQ ID NO. 399 in the 11/188,298 US application
  misc_feature: The sequence is a functional homolog of SEQ ID NO. 310 in the 11/188,298 US application
  misc_feature: The sequence is a functional homolog of SEQ ID NO. 464 in the 11/188,298 US application
  misc_feature: The sequence is a functional homolog of SEQ ID NO. 498 in the 11/188,298 US application
  misc_feature: The sequence is a functional homolog of SEQ ID NO. 340 in the 11/188,298 US application
  misc_feature: The sequence is a functional homolog of SEQ ID NO. 323 in the 11/188,298 US application
  misc_feature: The sequence is a functional homolog of SEQ ID NO. 311 in the 11/188,298 US application
  misc_feature: The sequence is a functional homolog of SEQ ID NO. 358 in the 11/188,298 US application
  misc_feature: The sequence is a functional homolog of SEQ ID NO. 332 in the 11/188,298 US application
  misc_feature: The sequence is a functional homolog of SEQ ID NO. 312 in the 11/188,298 US application
  misc_feature: The sequence is a functional homolog of SEQ ID NO. 495 in the 11/188,298 US application
  misc_feature: The sequence is a functional homolog of SEQ ID NO. 520 in the 11/188,298 US application
MATETLPETLPVVPDTQTLKLHSQIGSSLEASRLNKPCASVRTRLPEPNNLSKPSSEAEPKVQKPSNLLNESVDHTSLDKISTDPIQDKLVLECPVDEQKKDVNQENMCRRLKPSSILDKECGLAKANESGRLIKRSDTGERGTSSRYRPSNSSDISDESSCSSITKPHKANDSRWEAIQMIRTRDGIFGLSHFKLLKKLGCGDIGSVYLSELSGTKSYFAMKVMDKASLASRKKLLRSQTEKDILQCLDHPFLPTLYTHFETDKFSCLVMEFCPGGDMHTLRQRQRGKYFPEQAVKFYVSEILLALEYLHMLGIIYRDLKPENVLIREDGHIMLTDFDLSLRCAVSPILIRLSNSVPESLKKYNQTHSAQQACVQPSCVMQPSCTAPTACFGPRLFSKSKKVRKPKLEVVNQVSPWPELIAEPSDARSMSFVGTHEYLAPEIIKGEGHGSAVDWWTFGIFLYELLFGKTPFKGTGNRATLFNVIGQPLRFPEYPVVSFPARDLIRSLLVKEPQQRLGFKRGATEIKQHPFFEGVNWALIRCASPPEVPRHFDIEKPPKQPVSTSESAAQNGGDNYLEFGFF

SEQ ID NO: 5621 - DNA, 753 bp, Sorghum bicolor
  misc_feature: Ceres ANNOT ID no. 6052186
  misc_feature: Encodes the peptide sequence at SEQ ID NO 5622
atgatctcccccgacaccatccgcacggccatcggcgtcatcggcaatgggacggcacttgtgctcttcctctccccagtgcctacgttcatccgcatctggaagaaagggtcagtggagcagtactcgccgatcccatacgtggcgacgctgctcaattgcatgatgtgggtgctgtatggcctgccggcggtgcacccgcacagtatgctggtgatcaccatcaacggcactggcatggctatccagctcacctacgtcacgctcttcctcctcttctccgctggtgcggtgcgtcgcaaggttgtcctcctgctcgccgctgaggtggccttcgtcggcgccgttgccgcgctggtgctcagcctggcgcacacgcatgaccgcaggtctatggtggtcggcatcctctgcgtcctcttcggcacgggcatgtacgccgccccgctctccgtcatgaaaatggtgatccagacaaagagcgtggagtacatgccccttttcctgtcgctagcttccctcgtcaatggcatctgctggactgcttacgcactcatccgcttcgacctctacatcaccatccccaacgggctaggcgtgctgttcgcggtggcgcagctagtgctgtacgccatctactacaagtccacgcaggagatcgtcgaggcacgcaagcgcaaggccgagcaggttgccatgaccgaggtggtcatcgacggcggcaagacaaacaaccacgccagcggctactga

SEQ ID NO: 5622 - protein, 250 aa, Sorghum bicolor
  misc_feature: Ceres ANNOT ID no. 6052186
  misc_feature (9)..(101): Pfam Id: MtN3_slv Pfam Desc: MtN3/saliva family
  misc_feature (132)..(218): Pfam Id: MtN3_slv Pfam Desc: MtN3/saliva family
  misc_feature (39)..(237): NCBI GI: 431154 NCBI Desc: orf [lilium longiflorum]
  misc_feature (7)..(245): NCBI GI: 21592843 NCBI Desc: contains similarity to medicago truncatula mtn3 (gb:y08726) [arabidopsis thaliana]
  misc_feature (17)..(240): NCBI GI: 115438370 NCBI Desc: os01g0606000 [oryza sativa (japonica cultivar-group)]
  misc_feature (1)..(217): NCBI GI: 21592355 NCBI Desc: contains similarity to nodulin mtn3 protein [arabidopsis thaliana]
  misc_feature (1)..(217): NCBI GI: 37050896 NCBI Desc: seven-transmembrane-domain protein 1 [lycopersicon esculentum]
  misc_feature: The sequence is a functional homolog of SEQ ID NO. 328 in the 11/188,298 US application
MISPDTIRTAIGVIGNGTALVLFLSPVPTFIRIWKKGSVEQYSPIPYVATLLNCMMWVLYGLPAVHPHSMLVITINGTGMAIQLTYVTLFLLFSAGAVRRKVVLLLAAEVAFVGAVAALVLSLAHTHDRRSMVVGILCVLFGTGMYAAPLSVMKMVIQTKSVEYMPLFLSLASLVNGICWTAYALIRFDLYITIPNGLGVLFAVAQLVLYAIYYKSTQEIVEARKRKAEQVAMTEVVIDGGKTNNHASGY

SEQ ID NO: 5623 - DNA, 822 bp, Sorghum bicolor
  misc_feature: Ceres ANNOT ID no. 6052789
  misc_feature: Encodes the peptide sequence at SEQ ID NO 5624
atgaggggttcgtcgcggaggccggtggccgtggtgatggcctggatgcggcgccagccgcccaaggtcaaggccttcctcgccgtcgtcgcggggatggccgcgctcgtcttcatccgcttcatcgtccacgaccacgacaacctcttcgtcgccgccgaggccgcgcacgcgctcgggatcgccgtgctcatctacaagctcaccaaggagaagacctgcgccggattgtcactcaagtctcaggatttgaccgcattatttctggctgttaggttgtattgtagttttgttatggaatatgacatccatacaattctggatacagctacacttgcagctaccctttttgttatttacatgattcggttcaaactgaggtcaacatatatgctggacaaagacaactttgcattgtactatgtggtattgccttgtgctgtgctagcgctacttattcatccttcaacatcgcacaacatagtgaacagaatctgctgggccttctgtgtttatttggaagcagtttcagtgctgccccagttgcgcttgatgcaaaataccaagatcgttgagccgttcacagctcattatgtgtttgccctgggtgttgcaaggtttcttagctgtgcacactgggtccttcaggttttggatacccgcggccgtttgttgactgctctgggctatggtttgtggccctcaatggttcttctctccgaaattgttcagacattcatccttgcagatttctgctactactatgtgaagagtgttttcggtgggcaactggtgctgcggcttccgtccggggtggtttga

SEQ ID NO: 5624 - protein, 273 aa, Sorghum bicolor
  misc_feature: Ceres ANNOT ID no. 6052789
  misc_feature (48)..(259): Pfam Id: ER_lumen_recept Pfam Desc: ER lumen protein retaining receptor
  misc_feature (1)..(273): NCBI GI: 50725803 NCBI Desc: er lumen protein-retaining receptor-like [oryza sativa (japonica cultivar-group)]
  misc_feature (13)..(273): NCBI GI: 115480359 NCBI Desc: os09g0534200 [oryza sativa (japonica cultivar-group)]
  misc_feature (4)..(272): NCBI GI: 140048069 NCBI Desc: er lumen protein retaining receptor [medicago truncatula]
  misc_feature (4)..(273): NCBI GI: 15223724 NCBI Desc: er lumen protein retaining receptor family protein [arabidopsis thaliana]
  misc_feature (4)..(273): NCBI GI: 9369358 NCBI Desc: f10a5.5 [arabidopsis thaliana]
MRGSSRRPVAVVMAWMRRQPPKVKAFLAVVAGMAALVFIRFIVHDHDNLFVAAEAAHALGIAVLIYKLTKEKTCAGLSLKSQDLTALFLAVRLYCSFVMEYDIHTILDTATLAATLFVIYMIRFKLRSTYMLDKDNFALYYVVLPCAVLALLIHPSTSHNIVNRICWAFCVYLEAVSVLPQLRLMQNTKIVEPFTAHYVFALGVARFLSCAHWVLQVLDTRGRLLTALGYGLWPSMVLLSEIVQTFILADFCYYYVKSVFGGQLVLRLPSGVV

SEQ ID NO: 5625 - DNA, 945 bp, Sorghum bicolor
  misc_feature: Ceres ANNOT ID no. 6052790
  misc_feature: Encodes the peptide sequence at SEQ ID NO 5626
atggacggctcatccaagcggatcgacggtggcggcgccgacaagcccagccccgacaacgaccagaaccagaacgctagccccaacgtaccggcggcgtccgccgccggagacgacggcgcctcggtcgctgctgcggcggcggcggctgccgcgccgcccgccgacgggaggcggccgttcaccagcctcagccaagaggaggccgacctcgccctcgcccgcgttctccaggagcaggagcgggcgtacatgatgctgaccggcggcgagtacgcgatctcggacgccgggagctacgactacgacgaggaggagggggaagatgacgacgatgggagcgactacgaggaggaaggggaggcgctcgacgaggacgagcaggttggggacgcggaagcggagggggccgagggggaccaggacctggaccttgaccctgcgcagtacgaggacgacgaggccttcgcgcgcgccctgcaggacgccgaggagcgcgacgtcgccgacaggctcatggcgctcgttgggatcggtgattggcgagccatggagcaggatgatgctggggaccacgaggaggacgaagatgatggggttcatacacaggatgcatgggaagatgttgatccagacgaatactcttatgaggagctaattgcattgggtgaagttgtcggtacagaaagcaaaggccttgctgctgatactattgcttcattaccttcggtaacttaccatgcacaagacaagcaagatggcaacatggaacaatgtgttatttgtcgtgtggagtttgacgaaggcgagtcattagttgcacttccttgcaaacatccttatcattctgagtgcataaaccagtggctgcagttaaacaaggtatgcccgatgtgcagtgctgaagtttccacctctgcgaacaatgtgaacaagcaggcatga

SEQ ID NO: 5626 - protein, 314 aa, Sorghum bicolor
  misc_feature: Ceres ANNOT ID no. 6052790
  misc_feature (259)..(299): Pfam Id: zf-C3HC4 Pfam Desc: Zinc finger, C3HC4 type (RING finger)
  misc_feature (2)..(310): NCBI GI: 140068969 NCBI Desc: zinc finger, ring-type [medicago truncatula]
  misc_feature (204)..(310): NCBI GI: 92868552 NCBI Desc: zinc finger, ring-type; ringv [medicago truncatula]
  misc_feature (184)..(306): NCBI GI: 6522599 NCBI Desc: zinc-finger-like protein [arabidopsis thaliana]
  misc_feature (148)..(303): NCBI GI: 115460008 NCBI Desc: os04g0571200 [oryza sativa (japonica cultivar-group)]
  misc_feature (148)..(303): NCBI GI: 116310277 NCBI Desc: osigba0111l12.9 [oryza sativa (indica cultivar-group)]
  misc_feature: The sequence is a functional homolog of SEQ ID NO. 271 in the 11/188,298 US application
  misc_feature: The sequence is a functional homolog of SEQ ID NO. 329 in the 11/188,298 US application
  misc_feature: The sequence is a functional homolog of SEQ ID NO. 424 in the 11/188,298 US application
  misc_feature: The sequence is a functional homolog of SEQ ID NO. 468 in the 11/188,298 US application
MDGSSKRIDGGGADKPSPDNDQNQNASPNVPAASAAGDDGASVAAAAAAAAAPPADGRRPFTSLSQEEADLALARVLQEQERAYMMLTGGEYAISDAGSYDYDEEEGEDDDDGSDYEEEGEALDEDEQVGDAEAEGAEGDQDLDLDPAQYEDDEAFARALQDAEERDVADRLMALVGIGDWRAMEQDDAGDHEEDEDDGVHTQDAWEDVDPDEYSYEELIALGEVVGTESKGLAADTIASLPSVTYHAQDKQDGNMEQCVICRVEFDEGESLVALPCKHPYHSECINQWLQLNKVCPMCSAEVSTSANNVNKQA

SEQ ID NO: 5627 - DNA, 777 bp, Sorghum bicolor
  misc_feature: Ceres ANNOT ID no. 6052800
  misc_feature: Encodes the peptide sequence at SEQ ID NO 5628
atggggcggtcgccgtgctgcgagaaggcgcacacgaacaagggcgcgtggaccaaggaggaggacgaccgcctggtggcgtacatccgcgcgcacggcgaagggtgctggcggtcgctgcccaaggcggccggactgatgcgctgcggcaagagctgccgcctccgctggatcaactacctccgccccgacctcaagcgcggcaacttcaccgccgacgaggacgacctcatcatcaagctgcacagcctcctcggcaacaagtggtcgctcatcgccgcgcggctcccggggcggacggacaacgagatcaagaactactggaacacgcacatccggcggaagctgcttggcaggggcatcgaccccgtcacgcaccgccccatcgccgacgccggcgccggcaccgtcaccaccatctcgttccagcccaacaaacccaacgccgccgtcgcagcgcaggcgccacaacatcagccgatcaaggcggtggcgacggccgtcgttaaggtgcccaggtgccccgacctcaacctcgatctctgcatcagcccgccgtgccaacagaaggaagacgaggagctggacctcaagcccgccgtcgtcgtcaagcgggaggtgctgcaggccggccatggcggcagcctctgcttcggctgcagcctgggcatccaaaaaggagcccccgggtgcagctgcagcagcagcaacagccaccaccgcttcttggggctccggtccggcatgctcgacttcagaggcctcgagatgaagtga

SEQ ID NO: 5628 - protein, 258 aa, Sorghum bicolor
  misc_feature: Ceres ANNOT ID no. 6052800
  misc_feature (14)..(61): Pfam Id: Myb_DNA-binding Pfam Desc: Myb-like DNA-binding domain
  misc_feature (67)..(112): Pfam Id: Myb_DNA-binding Pfam Desc: Myb-like DNA-binding domain
  misc_feature (1)..(258): NCBI GI: 127582 NCBI Desc: myb-related protein zm38
  misc_feature (1)..(258): NCBI GI: 89143149 NCBI Desc: transcription factor myb42 [zea mays]
  misc_feature (1)..(150): NCBI GI: 89143145 NCBI Desc: transcription factor myb31 [zea mays]
  misc_feature (1)..(226): NCBI GI: 19072766 NCBI Desc: typical p-type r2r3 myb protein [oryza sativa]
  misc_feature (1)..(258): NCBI GI: 13346194 NCBI Desc: ghmyb9 [gossypium hirsutum]
  misc_feature: The sequence is a functional homolog of SEQ ID NO 1010 in the 11/435,388 US patent application
  misc_feature: The sequence is a functional homolog of SEQ ID NO 1065 in the 10/374,780 US patent application
  misc_feature: The sequence is a functional homolog of SEQ ID NO 1307 in the 10/412,699 US patent application
  misc_feature: The sequence is a functional homolog of SEQ ID NO 986 in the 11/435,388 US patent application
  misc_feature: The sequence is a functional homolog of SEQ ID NO 1006 in the 11/435,388 US patent application
  misc_feature: The sequence is a functional homolog of SEQ ID NO 1008 in the 11/435,388 US patent application
  misc_feature: The sequence is a functional homolog of SEQ ID NO 1004 in the 11/435,388 US patent application
  misc_feature: The sequence is a functional homolog of SEQ ID NO 1068 in the 10/374,780 US patent application
  misc_feature: The sequence is a functional homolog of SEQ ID NO 984 in the 11/435,388 US patent application
  misc_feature: The sequence is a functional homolog of SEQ ID NO 1002 in the 11/435,388 US patent application
  misc_feature: The sequence is a functional homolog of SEQ ID NO 2221 in the 10/666,642 US patent application
  misc_feature: The sequence is a functional homolog of SEQ ID NO 998 in the 11/435,388 US patent application
  misc_feature: The sequence is a functional homolog of SEQ ID NO 1072 in the 10/374,780 US patent application
  misc_feature: The sequence is a functional homolog of SEQ ID NO 996 in the 11/435,388 US patent application
  misc_feature: The sequence is a functional homolog of SEQ ID NO 1000 in the 11/435,388 US patent application
  misc_feature: The sequence is a functional homolog of SEQ ID NO 2223 in the 10/666,642 US patent application
  misc_feature: The sequence is a functional homolog of SEQ ID NO 1073 in the 10/374,780 US patent application
  misc_feature: The sequence is a functional homolog of SEQ ID NO 108 in the 10/412,699 US patent application
  misc_feature: The sequence is a functional homolog of SEQ ID NO 1740 in the 10/412,699 US patent application
  misc_feature: The sequence is a functional homolog of SEQ ID NO 1964 in the 10/374,780 US patent application
  misc_feature: The sequence is a functional homolog of SEQ ID NO 255 in the 11/479,226 US patent application
  misc_feature: The sequence is a functional homolog of SEQ ID NO 908 in the 11/435,388 US patent application
  misc_feature: The sequence is a functional homolog of SEQ ID NO 1064 in the 10/374,780 US patent application
  misc_feature: The sequence is a functional homolog of SEQ ID NO 1306 in the 10/412,699 US patent application
  misc_feature: The sequence is a functional homolog of SEQ ID NO 990 in the 11/435,388 US patent application
  misc_feature: Useful for making plants with altered lignin content
  misc_feature: Functional homolog of the protein sequence given in SEQ ID NO 13921
  misc_feature: Useful for making plants with altered alkaloid content
  misc_feature: Useful for making plants with modulated nitrogen use efficiency
  misc_feature: Functional homolog of the protein sequence given in SEQ ID NO 13922
  misc_feature: The sequence is a functional homolog of SEQ ID NO 1069 in the 10/374,780 US patent application
  misc_feature: The sequence is a functional homolog of SEQ ID NO 988 in the 11/435,388 US patent application
  misc_feature: The sequence is a functional homolog of SEQ ID NO 1070 in the 10/374,780 US patent application
  misc_feature: The sequence is a functional homolog of SEQ ID NO 992 in the 11/435,388 US patent application
  misc_feature: The sequence is a functional homolog of SEQ ID NO 2564 in the 10/374,780 US patent application
  misc_feature: The sequence is a functional homolog of SEQ ID NO 276 in the 10/225,066 US patent application
  misc_feature: The sequence is a functional homolog of SEQ ID NO 818 in the 10/412,699 US patent application
  misc_feature: The sequence is a functional homolog of SEQ ID NO 1684 in the 11/479,226 US patent application
  misc_feature: The sequence is a functional homolog of SEQ ID NO 2582 in the 10/374,780 US patent application
  misc_feature: The sequence is a functional homolog of SEQ ID NO 30 in the 11/375,241 US patent application
  misc_feature: The sequence is a functional homolog of SEQ ID NO 854 in the 10/412,699 US patent application
  misc_feature: The sequence is a functional homolog of SEQ ID NO 2572 in the 10/374,780 US patent application
  misc_feature: The sequence is a functional homolog of SEQ ID NO 636 in the 10/225,066 US patent application
  misc_feature: The sequence is a functional homolog of SEQ ID NO 838 in the 10/412,699 US patent application
  misc_feature: The sequence is a functional homolog of SEQ ID NO 110 in the 10/412,699 US patent application
  misc_feature: The sequence is a functional homolog of SEQ ID NO 259 in the 11/479,226 US patent application
  misc_feature: The sequence is a functional homolog of SEQ ID NO 824 in the 10/412,699 US patent application
  misc_feature: The sequence is a functional homolog of SEQ ID NO 122 in the 10/412,699 US patent application
  misc_feature: The sequence is a functional homolog of SEQ ID NO 126 in the 11/375,241 US patent application
  misc_feature: The sequence is a functional homolog of SEQ ID NO 148 in the 10/286,264 US patent application
  misc_feature: The sequence is a functional homolog of SEQ ID NO 34 in the 10/374,780 US patent application
  misc_feature: The sequence is a functional homolog of SEQ ID NO 438 in the 10/225,066 US patent application
  misc_feature: The sequence is a functional homolog of SEQ ID NO 58 in the 10/666,642 US patent application
  misc_feature: The sequence is a functional homolog of SEQ ID NO 1660 in the 11/479,226 US patent application
  misc_feature: The sequence is a functional homolog of SEQ ID NO 840 in the 10/412,699 US patent application
  misc_feature: The sequence is a functional homolog of SEQ ID NO 1052 in the 11/479,226 US patent application
  misc_feature: The sequence is a functional homolog of SEQ ID NO 456 in the 10/412,699 US patent application
  misc_feature: The sequence is a functional homolog of SEQ ID NO 430 in the 10/412,699 US patent application
  misc_feature: The sequence is a functional homolog of SEQ ID NO 995 in the 11/479,226 US patent application
  misc_feature: The sequence is a functional homolog of SEQ ID NO 18 in the 11/375,241 US patent application
  misc_feature: The sequence is a functional homolog of SEQ ID NO 426 in the 10/374,780 US patent application
  misc_feature: The sequence is a functional homolog of SEQ ID NO 458 in the 10/225,066 US patent application
  misc_feature: Useful for biocontainment applications
  misc_feature: Functional homolog of the protein sequence given in SEQ ID NO 13923
  misc_feature: Useful for making plants with altered carbohydrate content
  misc_feature: Functional homolog of the protein sequence given in SEQ ID NO 13924
  misc_feature: The sequence is a functional homolog of SEQ ID NO 271 in the 11/479,226 US patent application
  misc_feature: The sequence is a functional homolog of SEQ ID NO 1011 in the 11/479,226 US patent application
  misc_feature: The sequence is a functional homolog of SEQ ID NO 434 in the 10/412,699 US patent application
  misc_feature: The sequence is a functional homolog of SEQ ID NO 442 in the 10/412,699 US patent application
  misc_feature: Useful for making plants with altered cell wall content and/or composition
  misc_feature: Functional homolog of the protein sequence given in SEQ ID NO 13925
  misc_feature: The sequence is a functional homolog of SEQ ID NO 112 in the 10/412,699 US patent application
  misc_feature: The sequence is a functional homolog of SEQ ID NO 267 in the 11/479,226 US patent application
  misc_feature: The sequence is a functional homolog of SEQ ID NO 1411 in the 11/479,226 US patent application
  misc_feature: The sequence is a functional homolog of SEQ ID NO 2492 in the 10/374,780 US patent application
  misc_feature: The sequence is a functional homolog of SEQ ID NO 52 in the 10/225,066 US patent application
  misc_feature: The sequence is a functional homolog of SEQ ID NO 836 in the 10/412,699 US patent application
  misc_feature: The sequence is a functional homolog of SEQ ID NO 1118 in the 10/225,066 US patent application
  misc_feature: The sequence is a functional homolog of SEQ ID NO 1396 in the 11/479,226 US patent application
  misc_feature: The sequence is a functional homolog of SEQ ID NO 2488 in the 10/374,780 US patent application
  misc_feature: The sequence is a functional homolog of SEQ ID NO 658 in the 10/412,699 US patent application
  misc_feature: Useful for making plants with modulated biomass
  misc_feature: Functional homolog of the protein sequence given in SEQ ID NO 13926
  misc_feature: The sequence is a functional homolog of SEQ ID NO 743 in the 10/666,642 US patent application
  misc_feature: The sequence is a functional homolog of SEQ ID NO 1056 in the 11/479,226 US patent application
  misc_feature: The sequence is a functional homolog of SEQ ID NO 144 in the 10/374,780 US patent application
  misc_feature: The sequence is a functional homolog of SEQ ID NO 458 in the 10/412,699 US patent application
  misc_feature: The sequence is a functional homolog of SEQ ID NO 756 in the 10/225,066 US patent application
  misc_feature: The sequence is a functional homolog of SEQ ID NO 170 in the 10/412,699 US patent application
  misc_feature: The sequence is a functional homolog of SEQ ID NO 1756 in the 10/412,699 US patent application
  misc_feature: The sequence is a functional homolog of SEQ ID NO 1980 in the 10/374,780 US patent application
  misc_feature: The sequence is a functional homolog of SEQ ID NO 750 in the 10/225,066 US patent application
  misc_feature: The sequence is a functional homolog of SEQ ID NO 1656 in the 11/479,226 US patent application
  misc_feature: The sequence is a functional homolog of SEQ ID NO 834 in the 10/412,699 US patent application
  misc_feature: The sequence is a functional homolog of SEQ ID NO 266 in the 10/374,780 US patent application
  misc_feature: The sequence is a functional homolog of SEQ ID NO 536 in the 11/435,388 US patent application
  misc_feature: The sequence is a functional homolog of SEQ ID NO 640 in the 10/225,066 US patent application
  misc_feature: The sequence is a functional homolog of SEQ ID NO 856 in the 10/412,699 US patent application
  misc_feature: The sequence is a functional homolog of SEQ ID NO 2 in the 10/225,068 US patent application
  misc_feature: The sequence is a functional homolog of SEQ ID NO 22 in the 10/225,068 US patent application
  misc_feature: The sequence is a functional homolog of SEQ ID NO 230 in the 10/225,066 US patent application
  misc_feature: The sequence is a functional homolog of SEQ ID NO 258 in the 10/374,780 US patent application
  misc_feature: The sequence is a functional homolog of SEQ ID NO 442 in the 11/435,388 US patent application
  misc_feature: The sequence is a functional homolog of SEQ ID NO 842 in the 10/412,699 US patent application
  misc_feature: The sequence is a functional homolog of SEQ ID NO 98 in the 11/375,241 US patent application
  misc_feature: The sequence is a functional homolog of SEQ ID NO 1541 in the 10/374,780 US patent application
  misc_feature: The sequence is a functional homolog of SEQ ID NO 1635 in the 10/412,699 US patent application
  misc_feature: The sequence is a functional homolog of SEQ ID NO 1564 in the 10/374,780 US patent application
  misc_feature: The sequence is a functional homolog of SEQ ID NO 126 in the 10/412,699 US patent application
  misc_feature: Useful for making plants with modulated flowering time
  misc_feature: Functional homolog of the protein sequence given in SEQ ID NO 13601
  misc_feature: The sequence is a functional homolog of SEQ ID NO 1625 in the 10/412,699 US patent application
  misc_feature: The sequence is a functional homolog of SEQ ID NO 978 in the 10/666,642 US patent application
  misc_feature: The sequence is a functional homolog of SEQ ID NO 1088 in the 10/374,780 US patent application
  misc_feature: The sequence is a functional homolog of SEQ ID NO 2167 in the 10/666,642 US patent application
  misc_feature: The sequence is a functional homolog of SEQ ID NO 380 in the 11/435,388 US patent application
  misc_feature: The sequence is a functional homolog of SEQ ID NO 382 in the 10/714,887 US patent application
  misc_feature: The sequence is a functional homolog of SEQ ID NO 1050 in the 10/412,699 US patent application
  misc_feature: The sequence is a functional homolog of SEQ ID NO 1065 in the 10/666,642 US patent application
  misc_feature: The sequence is a functional homolog of SEQ ID NO 2133 in the 10/666,642 US patent application
  misc_feature: The sequence is a functional homolog of SEQ ID NO 328 in the 11/435,388 US patent application
  misc_feature: The sequence is a functional homolog of SEQ ID NO 330 in the 10/714,887 US patent application
  misc_feature: The sequence is a functional homolog of SEQ ID NO 559 in the 10/374,780 US patent application
  misc_feature: The sequence is a functional homolog of SEQ ID NO 1087 in the 10/374,780 US patent application
  misc_feature: The sequence is a functional homolog of SEQ ID NO 2165 in the 10/666,642 US patent application
  misc_feature: The sequence is a functional homolog of SEQ ID NO 378 in the 11/435,388 US patent application
  misc_feature: The sequence is a functional homolog of SEQ ID NO 380 in the 10/714,887 US patent application
  misc_feature: The sequence is a functional homolog of SEQ ID NO. 395 in the 11/188,298 US application
MGRSPCCEKAHTNKGAWTKEEDDRLVAYIRAHGEGCWRSLPKAAGLMRCGKSCRLRWINYLRPDLKRGNFTADEDDLIIKLHSLLGNKWSLIAARLPGRTDNEIKNYWNTHIRRKLLGRGIDPVTHRPIADAGAGTVTTISFQPNKPNAAVAAQAPQHQPIKAVATAVVKVPRCPDLNLDLCISPPCQQKEDEELDLKPAVVVKREVLQAGHGGSLCFGCSLGIQKGAPGCSCSSSNSHHRFLGLRSGMLDFRGLEMK

SEQ ID NO: 5629 - DNA, 870 bp, Sorghum bicolor
  misc_feature: Ceres ANNOT ID no. 6052801
  misc_feature: Encodes the peptide sequence at SEQ ID NO 5630
atggcggctcccgtggtcgacgccgagtacctgcgccaggtcgacagggcgcgccgccacctccgcgccctcatctccaacaagggatgcgccccgatcatgctccgcctcgcatggcatgatgctggaacttatgacgtgaagacaaagaccggtggtgcaaatggttcgattagatatgaggaagagtacacccatggctcaaatgctggtttaaagattgccatcgatctccttgagcctatcaaagcaaagaatcccaagataacatatgcagacctttatcagcttgctggagtggttgcagttgaagtgactgggggaccaactgttgagtttattcctgggagacgtgattcgtcagtgtgcccccgtgaagggcgtctgccagatgctaagaaaggtgcaccacatctgagggacatcttttatcggatgggcttatcggacaaagatattgtagctctatcagggggccatactctgggaagggctcatcctgacaggtctggattcgaaggtgcctggacaaaggagcctcttaagtttgataactcatactttcttgagctgttgattgaggaatctgaggggcttttaaagctcccaactgataaggcactgttatcagatcctgagtttaggcgctatgtggacctttatgcaaaggatgaagatgccttcttcaaggactacgctgaatcacacaagaaactctctgagcttggcttcacgcctcgcagcacagcatcagccaaatcagaccttccaaccggtgctgtacttgcacagagcgcctttggggtagcggttgctgcagccgtagtcatcgctggctacttgtacgaggcttccaagaaggccaagtag

SEQ ID NO: 5630 - protein, 289 aa, Sorghum bicolor
  misc_feature: Ceres ANNOT ID no. 6052801
  misc_feature (17)..(224): Pfam Id: peroxidase Pfam Desc: Peroxidase
  misc_feature (1)..(289): NCBI GI: 15080682 NCBI Desc: peroxisome type ascorbate peroxidase [hordeum vulgare subsp. vulgare]
  misc_feature (1)..(289): NCBI GI: 1019946 NCBI Desc: ascorbate peroxidase
  misc_feature (1)..(289): NCBI GI: 5442410 NCBI Desc: ascorbate peroxidase [zantedeschia aethiopica]
  misc_feature (1)..(289): NCBI GI: 75221319 NCBI Desc: l-ascorbate peroxidase 3, peroxisomal precursor (atapx03)
  misc_feature (1)..(289): NCBI GI: 15430584 NCBI Desc: peroxisomal ascorbate peroxidase [cucurbita cv. kurokawa amakuri]
  misc_feature (1)..(289): SWISSPROT Homolog: EC 1.11.1.11 L-ascorbate peroxidase 3, peroxisomal precursor
  misc_feature (32)..(243): SWISSPROT Homolog: EC 1.11.1.5 Cytochrome c peroxidase, mitochondrial precursor
  misc_feature: Useful for making plants with altered cell wall content and/or composition
  misc_feature: Functional homolog of the protein sequence encoded by LOCUS at4g35970
  misc_feature: Useful for making plants with altered carbohydrate content
  misc_feature: Functional homolog of the protein sequence given in SEQ ID NO 13795
  misc_feature: Useful for making plants with altered cell wall content and/or composition
  misc_feature: Functional homolog of the protein sequence given in SEQ ID NO 13796
  misc_feature: Useful for making plants with modulated water use efficiency
  misc_feature: Functional homolog of the protein sequence given in SEQ ID NO 13794
  misc_feature: Useful for making plants with modulated heat sensitivity
  misc_feature: Functional homolog of the protein sequence given in SEQ ID NO 13793
MAAPVVDAEYLRQVDRARRHLRALISNKGCAPIMLRLAWHDAGTYDVKTKTGGANGSIRYEEEYTHGSNAGLKIAIDLLEPIKAKNPKITYADLYQLAGVVAVEVTGGPTVEFIPGRRDSSVCPREGRLPDAKKGAPHLRDIFYRMGLSDKDIVALSGGHTLGRAHPDRSGFEGAWTKEPLKFDNSYFLELLIEESEGLLKLPTDKALLSDPEFRRYVDLYAKDEDAFFKDYAESHKKLSELGFTPRSTASAKSDLPTGAVLAQSAFGVAVAAAVVIAGYLYEASKKAK

SEQ ID NO: 5631 - DNA, 1491 bp, Sorghum bicolor
  misc_feature: Ceres ANNOT ID no. 6052814
  misc_feature: Encodes the peptide sequence at SEQ ID NO 5632
atgccggaagacgtgcagatgaacgactcggagccccagcctgcggcgccagttcccgtcgccgccgccgccgccgcggcggcgccggcgctctccacactgcaccatctgaaggagatcgcgaccgtgatcgaggctggttccctgtccaaggaggtccgccggatctcccgcgccttccgcctcaccgtcgcgctccgccgccgcctcgccgcgcgggacgtctccgccttcctcgccttcgcgctacccgcgtcctctgaagcctacggacgcctcaccgcgctggtgcccaaggaagatgatactgagatggatgttgatgctgcggctccggcaactcagatttcaatcaaacatggtctccctgagattgaaatattttgctacttgcttgtactgattttccttattgatcagaagaaatatgatgaggctaaagcatgcgcaaatgtgagcattgctcgcctgaagaacctaaaccgtagaacggttgatgtcctggcatctcgtctgtacttttattactcttatgtgtatgagcttaccaacagccttgctgaaatacgtgggactctgcttgctctacacagaatggcaactttgcatcgcgacgagcttggccaggaaacactgctcaatctcctcctccgcaattacctccactacaacttgtatgatcaggcagagaagcttagatcaaaggcacctcgttttgaggcacattccaatcaacaattctgccgatacttgttctacttgggcaaaattaggacaattcagttggagtacactgatgctaaagaaagcctcctgcaagctgctcgtaaggcaccaacaacagcccgtggttttcggattcagtgcaacaaatgggctatcatagtgaggctgctgcttggagagattccagagaggactgttttcatgcagaaaggaatgaagaaagctctgacaccttattttgagctcacaaatgctgtcagggttggggaccttgaactgttcagggccgtcgcagacaaatttgcaagcacattcagcgcagacaggactcgcaacttgattgtgaggctgcgccacaatgtcattcgaactggactgcgcaacatcagcatttcttactcaaggatctcccttgctgacattgctaagaagctcagattagactctgagaaccctattgctgacgcggagagcattgtagccaaggccataagagatggcgcaattgacgccaccatagatcatgcaaatggctggatggtttcaaaggaaactggtgatgtctactcgacaaatgagccacaaattgcattcaactccaggattgcgttctgcctcaacatgcacaatgaggcggtcaaggcgatgaggttcccccctaattctcacaaggaaaaggagagtgctgagaagcgccgagagaggcttcagcaggaggaagaactggctaagcacatggctgaggaggatgacgatgacttctaa

SEQ ID NO: 5632 - protein, 496 aa, Sorghum bicolor
  misc_feature: Ceres ANNOT ID no. 6052814
  misc_feature (429)..(495): Pfam Id: Rpn3_C Pfam Desc: Proteasome regulatory subunit C-terminal
  misc_feature (319)..(426): Pfam Id: PCI Pfam Desc: PCI domain
  misc_feature (78)..(496): NCBI GI: 17298155 NCBI Desc: 26s proteasome regulatory particle non-atpase subunit3 [oryza sativa (japonica cultivar-group)]
  misc_feature (1)..(496): NCBI GI: 12230970 NCBI Desc: probable 26s proteasome non-atpase regulatory subunit 3 (26s proteasome subunit s3) (nuclear antigen 21d7)
  misc_feature (1)..(496): NCBI GI: 3914467 NCBI Desc: probable 26s proteasome non-atpase regulatory subunit 3 (26s proteasome subunit s3) (nuclear antigen 21d7)
  misc_feature (37)..(496): NCBI GI: 8778979 NCBI Desc: contains similarity to 26s proteasome regulatory subunit s3 from nicotiana tabacum gi3914467 and contains a pci pf01399 domain. ests gbav527569, gbt75824, gbt88578, gbf15139,
  misc_feature (37)..(496): NCBI GI: 8778979 (continued) gbav520993, gbav440056, gbai099602, gbf15138 come from this gene. [arabidopsis thaliana]
  misc_feature (1)..(496): NCBI GI: 217911 NCBI Desc: 21d7 antigen [daucus carota]
MPEDVQMNDSEPQPAAPVPVAAAAAAAAPALSTLHHLKEIATVIEAGSLSKEVRRISRAFRLTVALRRRLAARDVSAFLAFALPASSEAYGRLTALVPKEDDTEMDVDAAAPATQISIKHGLPEIEIFCYLLVLIFLIDQKKYDEAKACANVSIARLKNLNRRTVDVLASRLYFYYSYVYELTNSLAEIRGTLLALHRMATLHRDELGQETLLNLLLRNYLHYNLYDQAEKLRSKAPRFEAHSNQQFCRYLFYLGKIRTIQLEYTDAKESLLQAARKAPTTARGFRIQCNKWAIIVRLLLGEIPERTVFMQKGMKKALTPYFELTNAVRVGDLELFRAVADKFASTFSADRTRNLIVRLRHNVIRTGLRNISISYSRISLADIAKKLRLDSENPIADAESIVAKAIRDGAIDATIDHANGWMVSKETGDVYSTNEPQIAFNSRIAFCLNMHNEAVKAMRFPPNSHKEKESAEKRRERLQQEEELAKHMAEEDDDDF

SEQ ID NO: 5633 - DNA, 429 bp, Sorghum bicolor
  misc_feature: Ceres ANNOT ID no. 6052822
  misc_feature: Encodes the peptide sequence at SEQ ID NO 5634
atgatcagctccaagaaactagctcaactgtccaagaagtggcagggaatgggtgcggttgcgcgaagaagggtcacaacagtcgacaaggatccatcttgcagcagcgtagttgcagggaagggcaactgcgttgtctactcttctgatgggaagcggtttgagatccccctcacttacctccacacaagagtctttgcagagctcctcaagctgtcacaggaagagtttgggtacacaagtgatgagaggatcacacttccttgtgatacagccgtcatggagtatgtgatgtgtttgctgaggagagaagcctccgaagatgtcgagaaggcactcagttccatagtgatgccttgccaccatcaaagcagaatggtgcaaccatccagtggatttaaccaccaatttgctctgtctagctcctga

SEQ ID NO: 5634 - protein, 142 aa, Sorghum bicolor
  misc_feature: Ceres ANNOT ID no. 6052822
  misc_feature (1)..(102): Pfam Id: Auxin_inducible Pfam Desc: Auxin responsive protein
  misc_feature (1)..(139): NCBI GI: 115480483 NCBI Desc: os09g0545300 [oryza sativa (japonica cultivar-group)]
  misc_feature (1)..(139): NCBI GI: 32187718 NCBI Desc: auxin induced protein [zea mays]
  misc_feature (1)..(104): NCBI GI: 115480493 NCBI Desc: os09g0546200 [oryza sativa (japonica cultivar-group)]
  misc_feature (1)..(136): NCBI GI: 20149052 NCBI Desc: auxin-induced saur-like protein [capsicum annuum]
  misc_feature (1)..(113): NCBI GI: 15241052 NCBI Desc: auxin-responsive family protein [arabidopsis thaliana]
  misc_feature: Useful for making plants with modulated cold sensitivity
  misc_feature: Functional homolog of the protein sequence given in SEQ ID NO 13492
  misc_feature: The sequence is a functional homolog of SEQ ID NO. 443 in the 11/188,298 US application
  misc_feature: The sequence is a functional homolog of SEQ ID NO. 402 in the 11/188,298 US application
  misc_feature: The sequence is a functional homolog of SEQ ID NO. 505 in the 11/188,298 US application
MISSKKLAQLSKKWQGMGAVARRRVTTVDKDPSCSSVVAGKGNCVVYSSDGKRFEIPLTYLHTRVFAELLKLSQEEFGYTSDERITLPCDTAVMEYVMCLLRREASEDVEKALSSIVMPCHHQSRMVQPSSGFNHQFALSSS

SEQ ID NO: 5635 - DNA, 1158 bp, Sorghum bicolor
  misc_feature: Ceres ANNOT ID no. 6052851
  misc_feature: Encodes the peptide sequence at SEQ ID NO 5636
atggcgtcgaccagcctcgccgcgctgccatcgcagctcgcttccccgggccgcctgcgccgccgcgccgctctctcctctgctagccgctcgaatctcctcctccaccgcgcaaccaaaggtggatcgcgatgcaggctggcggtgacctgcaacgcgcaggcggtggcgccgaccagcattgcgcaggggacgcccgtccgaccgacgagcatactggtggtgggcgccacggggacgctggggcggcaggtggtcaggagggcgctggacgagggctacgacgtcaggtgcctcgtcaggccgcgcccggcgcccgcagatttcctccgggactggggcgccactgtcgtcaatgccgacctcagcaagccggagaccatacctgcgacacttgttggtattcacacagtcattgactgtgcgacaggacggccagaagagcccatccggacggtagattgggaaggaaaagttgctctaatacagtgtgcaaaggctatgggaattcaaaagtatgtgttctattccatccacaactgtgacaagcatcctgaggttcccttgatggaaatcaagtattgcactgagaagttcattcaggacagtggtctggattatatcatcatccgtttgtgtggtttcatgcagggccttattgggcaatatgctgtgcctatactagaagagaagtctgtctggggaactgatgctccaactcggattgcttacatggatactcaggacgtagctcgactaacgtttatagctatgcggaacgagaaggccaacaggaaactcatgacttttgctggcccacgagcttggacaactcaagaggtgattactttgtgtgagagattagctgggcaagatgccaatgtaaccactgtccctgttgcagtcttgagatttactcgtcagttgacacggttcttccaatggacaaatgatgtggctgacagactggcattttcagaggtgctctcaagtgacacagttttctctgctccaatgaatgagacctaccagcttctcggggtggatggaaatgacatcctcagcttagagaaatatttacaagattattttaccaacatattgaagaagttaaaggatctgaaggcacaatccaagcaaaccgacatattcttttga

SEQ ID NO: 5636 - protein, 385 aa, Sorghum bicolor
  misc_feature: Ceres ANNOT ID no. 6052851
  misc_feature (72)..(297): Pfam Id: NmrA Pfam Desc: NmrA-like family
  misc_feature (72)..(285): Pfam Id: Epimerase Pfam Desc: NAD dependent epimerase/dehydratase family
  misc_feature (72)..(374): NCBI GI: 67926100 NCBI Desc: isoflavone reductase [crocosphaera watsonii wh 8501]
  misc_feature (71)..(381): NCBI GI: 75908141 NCBI Desc: 3-beta hydroxysteroid dehydrogenase/isomerase [anabaena variabilis atcc 29413]
  misc_feature (71)..(381): NCBI GI: 22298402 NCBI Desc: chaperon-like protein for quinone binding in photosystem ii [thermosynechococcus elongatus bp-1]
  misc_feature (72)..(379): NCBI GI: 113476702 NCBI Desc: nmra-like [trichodesmium erythraeum ims101]
  misc_feature (72)..(381): NCBI GI: 16331123 NCBI Desc: ycf39 gene product [synechocystis sp. pcc 6803]
MASTSLAALPSQLASPGRLRRRAALSSASRSNLLLHRATKGGSRCRLAVTCNAQAVAPTSIAQGTPVRPTSILVVGATGTLGRQVVRRALDEGYDVRCLVRPRPAPADFLRDWGATVVNADLSKPETIPATLVGIHTVIDCATGRPEEPIRTVDWEGKVALIQCAKAMGIQKYVFYSIHNCDKHPEVPLMEIKYCTEKFIQDSGLDYIIIRLCGFMQGLIGQYAVPILEEKSVWGTDAPTRIAYMDTQDVARLTFIAMRNEKANRKLMTFAGPRAWTTQEVITLCERLAGQDANVTTVPVAVLRFTRQLTRFFQWTNDVADRLAFSEVLSSDTVFSAPMNETYQLLGVDGNDILSLEKYLQDYFTNILKKLKDLKAQSKQTDIFF

SEQ ID NO: 5637 - DNA, 1056 bp, Sorghum bicolor
  misc_feature: Ceres ANNOT ID no. 6052852
  misc_feature: Encodes the peptide sequence at SEQ ID NO 5638
atgcagggcggatccagcggcatcgtctatggcggcctcaagtaccaggcgcggtgtatcgccgacgtgcgcgcggacgccggctcgaccaccttcctcgccggcaccctcagcctcaaggaggagaacgaggtgcacctgatccggctttcgccggcggagggcgagctggtgtgcgatggcctcttctaccaccccgacgagatctgggacctcaaatcatgccccttcgatcacaggatcttctccacagtctacacgtctggtgagggctatggtgcgtcagtttggaagatgccagaggtcaatgggcaatcaaactcaccgcaacttgaccagctctttgagcttagtgggcataggggcaagattagacgtgtgatctggtggccacttggaaagcatgataaactaattagcattgatgaccgaaatatttttctttggagcatagacacgtcaaataaatcagctaaggtgatctcacaaggatcagctgacatgcttccaaatttacgtggtggagcttgggatccacacaatcataattcagttgctgcaatatctgattcgtcacttcagttgtgggatctacgttctatggaaaaatcaactgcaattgaacatgcacatatacgggacgtggattataaccccaagaagcaaaacattatcgcaacagcagaagacgaatttggaattcgcttgtgggatctcagaatgcttaagcatcctctaaaagatctccctgggcactcacattggacatgggctgttcggcacaatcctgagtatgacgagttgcttctgagtgctggaacagattcaactgtaaatttatggttggctaaagttagcagtgacgattctgaatctgatagcccttctggttcaccgaataggcaagaagaaccattactcaactcatataccgactacgaagacagcatctatggtattgcatggagctcccatgatccatcattattcgcttctttgtcgtatgatggaagggttgtcttggaatcagtgaagccctacttgcagagaaaataa

SEQ ID NO: 5638 - protein, 351 aa, Sorghum bicolor
  misc_feature: Ceres ANNOT ID no. 6052852
  misc_feature (243)..(282): Pfam Id: WD40 Pfam Desc: WD domain, G-beta repeat
  misc_feature (1)..(351): NCBI GI: 42408969 NCBI Desc: transducin / wd-40 repeat protein-like [oryza sativa (japonica cultivar-group)]
  misc_feature (1)..(318): NCBI GI: 42408968 NCBI Desc: transducin / wd-40 repeat protein-like [oryza sativa (japonica cultivar-group)]
  misc_feature (1)..(339): NCBI GI: 8778614 NCBI Desc: f5m15.14 [arabidopsis thaliana]
  misc_feature (1)..(339): NCBI GI: 8886922 NCBI Desc: f2d10.2 [arabidopsis thaliana]
  misc_feature (127)..(293): NCBI GI: 6573710 NCBI Desc: t23e18.19 [arabidopsis thaliana]
MQGGSSGIVYGGLKYQARCIADVRADAGSTTFLAGTLSLKEENEVHLIRLSPAEGELVCDGLFYHPDEIWDLKSCPFDHRIFSTVYTSGEGYGASVWKMPEVNGQSNSPQLDQLFELSGHRGKIRRVIWWPLGKHDKLISIDDRNIFLWSIDTSNKSAKVISQGSADMLPNLRGGAWDPHNHNSVAAISDSSLQLWDLRSMEKSTAIEHAHIRDVDYNPKKQNIIATAEDEFGIRLWDLRMLKHPLKDLPGHSHWTWAVRHNPEYDELLLSAGTDSTVNLWLAKVSSDDSESDSPSGSPNRQEEPLLNSYTDYEDSIYGIAWSSHDPSLFASLSYDGRVVLESVKPYLQRK

SEQ ID NO: 5639 - DNA, 1911 bp, Sorghum bicolor
  misc_feature: Ceres ANNOT ID no. 6052864
  misc_feature: Encodes the peptide sequence at SEQ ID NO 5640
atgcgagctccggcgatgctccgctgggccgcggcggcgctcgtgctcgcggcgctcctcgccgcctcgccggccgccgccttctacctccccggcgtggcgcccaacgacttccacaagaaagatccacttttggtgaaggtgaataagctgacatccacaaagacgcaacttccctactcgtattactctcttccattctgcaagccaaacacgatagttgatagtgcagagaatcttggagaggttctgcgtggtgatcgcattgagaactctccttatgtgtttgagatgggggagcccaagatgtgccagattatctgcagagcaaaaattgacgataaacaagcaaaggagctcaaggaaaagatagaggatgagattcttgacaacctcccactagttgttgctattgcaaggcaggataggggtgctcctgtttaccaggctggatatcatgttggtgtcaagggccaatatgctggtaacaaggatgagaagtcctttatccacaaccacttgacatttttagtaaaatatcacaaggatgaaactgcagatctctctagaattgttggatttgaggtcaaaccattcagtatcaatcaccagtttgaagggccgtggaatgataaaaacactcgtttaatcacatgtgatcctcatgccagcaagcttgtggtaaactcagatactcctcaggaggttgaagctggaaaggaaatcatatttacctatgatgtggccttcgaggagagtgatgtcaagtgggcttctcgctgggacacctacctgttaatgacagacgatcaaattcactggttttctattgtgaactctctcatgatcgtactctttttatctgggatggtggccatgattatgctccgcaccttgtatagagatatctctagatacaatcagcttgaaactgaagaagaagcccaagaggagacagggtggaagcttgttcatggagacgtattccgccctcctgcaaactctgacttactctgtgtctgtgttgggactggtgttcagttctttggtatgctgctagtaaccatgatttttgctgttttgggtttcctttcgccgtcaaaccggggaggactcatgactgccatgctgctcacttgggtcttgatgggtttgtttgctggctatgcttcttcacgcctatataagatgttcaaaggatcagaatggaagagcatcaccctaaggactgctttcctgtttcccgggattgcttttggtattttcttcatcctgaatgctcttatatggggggagaagtcgtctggtgccgttcctttcaccacaatgtttgcgttggtcctcctttggtttggtatctcggttcctcttgtatttgttgggagctatctgggcttcaagcaacctgccattgaggctccggtgaagacaaacaagattccaagacaggtccctgagcaggcttggtacatgaaccctgccttcaccattcttattggtggtattcttccgtttggagcagttttcattgagctcttcttcatcctgacatcaatctggcttcaccagttctactacatctttggctttctcttcctggtgttcattatcctcatcatcacctgtgcggagatcacgatcgtgctgtgctatttccagctgtgcagtgaggactacatgtggtggtggaggtcctatctgacctcaggatcatctgcaatctacctcttcctgtatgccgggttctacttcttcactaaactgcagatcaccaaggtggtgtcgggcatactgtactttggctacatgcttcttgcctcgtgtgctttctgtgtgctcactggtgcgatcggcttctgtgcctgcttctggttcacaagattgatttattcatctgtgaagatcgactag

SEQ ID NO: 5640 - protein, 636 aa, Sorghum bicolor
  misc_feature: Ceres ANNOT ID no. 6052864
  misc_feature (58)..(594): Pfam Id: EMP70 Pfam Desc: Endomembrane protein 70
  misc_feature (1)..(636): NCBI GI: 115477743 NCBI Desc: os08g0554900 [oryza sativa (japonica cultivar-group)]
  misc_feature (1)..(636): NCBI GI: 115480625 NCBI Desc: os09g0557800 [oryza sativa (japonica cultivar-group)]
  misc_feature (248)..(636): NCBI GI: 115477747 NCBI Desc: os08g0555200 [oryza sativa (japonica cultivar-group)]
  misc_feature (5)..(636): NCBI GI: 92897792 NCBI Desc: nonaspanin (tm9sf) [medicago truncatula]
  misc_feature (14)..(636): NCBI GI: 51534986 NCBI Desc: endomembrane protein 70-like [oryza sativa (japonica cultivar-group)]
MRAPAMLRWAAAALVLAALLAASPAAAFYLPGVAPNDFHKKDPLLVKVNKLTSTKTQLPYSYYSLPFCKPNTIVDSAENLGEVLRGDRIENSPYVFEMGEPKMCQIICRAKIDDKQAKELKEKIEDEILDNLPLVVAIARQDRGAPVYQAGYHVGVKGQYAGNKDEKSFIHNHLTFLVKYHKDETADLSRIVGFEVKPFSINHQFEGPWNDKNTRLITCDPHASKLVVNSDTPQEVEAGKEIIFTYDVAFEESDVKWASRWDTYLLMTDDQIHWFSIVNSLMIVLFLSGMVAMIMLRTLYRDISRYNQLETEEEAQEETGWKLVHGDVFRPPANSDLLCVCVGTGVQFFGMLLVTMIFAVLGFLSPSNRGGLMTAMLLTWVLMGLFAGYASSRLYKMFKGSEWKSITLRTAFLFPGIAFGIFFILNALIWGEKSSGAVPFTTMFALVLLWFGISVPLVFVGSYLGFKQPAIEAPVKTNKIPRQVPEQAWYMNPAFTILIGGILPFGAVFIELFFILTSIWLHQFYYIFGFLFLVFIILIITCAEITIVLCYFQLCSEDYMWWWRSYLTSGSSAIYLFLYAGFYFFTKLQITKVVSGILYFGYMLLASCAFCVLTGAIGFCACFWFTRLIYSSVKID

SEQ ID NO: 5641 - DNA, 2103 bp, Sorghum bicolor
  misc_feature: Ceres ANNOT ID no. 6052869
  misc_feature: Encodes the peptide sequence at SEQ ID NO 5642
atggcgaggaagaacggatggcagctccccgcgcacacgctccagattgttgcaattacggttttcttccttctggtgattgctttttatgcattcttcgcaccatttctagggaaacaagtcctaggatatgttgtaattggtatctatactgccgtggtgttttctgtcttcatcctttatatccgctgcactagtataaaccctgcagatcctggaatcatgtcaaagttcgataatggcttcatcgatgcacttggaagtactgctaacatacagggcaagaatttgccaacaaaagcttatattggtgctggaacaacctccccaacggcaacatctacttgtaggaactctctagatgggcgttctaacactggtggtttagctgctggagacacaaatccggatttagggtctcagctgccaagaagttcaaggagctgcttacttggagggcttctttgtgctttgtttgtgaagcaggattgtaggaaattcgatgattcagagaatcaagttgatggggaaaacgtcttgttctgcacattatgtgatgccgaggttcgcaaattcagtaaacactgcagaagttgtgacaagtgtgtggatggatttgatcatcactgtcggtggctaaataactgtgttggccggaagaattatttcacgtttctggctctgatgactaccagtctcctctggcttgctattgaaattggagtaggcatcgctgttcttgttatatgctttgccaacaagaattcagagagaattattcaagacaggcttgggaatggtttgcctcggcctgcctttgctaccattgtagcattttttactcttctttctctagtcgcttgcatacctttaggggaacttttcttcttccacatgatcttaatcagaaaggggatcacaacttatgaatatgtcgttgcaatgagagctatgagtgaagcacctcaagaggaagaggacgaggagggggtaaacattgtttattccccaacaaattcagctaccactgcgttcagtggtgctagtgcacttagtctgcactacaagggttcatggtgcacacctccaaggatttttgttgatcaggatgaagtgatcccacatttggagccagggatggtaccttcaaccattgatcctgatactgctggacatgctgaaagagccaacaaagccaagaagcaagtcaaaatcagtgcctggaagcttgcaaagctggacagcaatgaggcaatgaaggctgctgctaaagcccgggcatcatcctctgtcctccgacctattgatacccgccgggttccaggtgctagccctaactctagtggcaatgccagcatgagaagcagcatgagtgctgattacagcgccagtggcgccaaggaaaggggggctggtatgaagttgttgtctcttcagagttcctcgtatcctcagagccttgcaagccaggacgagtatgagtcaggcacgcagagtgctagcagcagaagcagtccggtccacattcacaaacccgcggcgcctcacacacagatcaacgtgccacctcgtgtgcctccagcgcctccaaggcctgtgccggcggtaccgaggccgcctgttccaaccacgcagatatccaagccattgttccagtcagcaacatcttatgtccgtgagaaccgaaaagcctcagttgtttgggatcaagaggctggtcggtatgtgtcggtggcacctgcgcccacaagggcagtagctggtagtgatcttgatcaaccagcaagagcaccacatttcttgacaaacccaggtagcgagccaagcaatcacgggagaaccctctcacccatgaatgctccttcctcagcattgccgtctggacagccgtccgagaggttgacatacactgggcagtcgatattctttggtggaccacttcttggtggtgctgctgctgatcctcagaggactgatgctgccgccggagcacgaccggagacaaggagggatgggtttgggggagagaggagaagaactgcggagtccttcccggtgtttgctccaggatcctttcagaagaacccgccgttcaacaggtga

SEQ ID NO: 5642 - protein, 700 aa, Sorghum bicolor
  misc_feature: Ceres ANNOT ID no. 6052869
  misc_feature (171)..(235): Pfam Id: zf-DHHC Pfam Desc: DHHC zinc finger domain
  misc_feature (196)..(700): NCBI GI: 52077070 NCBI Desc: dhhc-type zinc finger domain-containing protein -like [oryza sativa (japonica cultivar-group)]
  misc_feature (1)..(695): NCBI GI: 15233295 NCBI Desc: zinc finger (dhhc type) family protein [arabidopsis thaliana]
  misc_feature (107)..(577): NCBI GI: 38344276 NCBI Desc: osjnba0013k16.7 [oryza sativa (japonica cultivar-group)]
  misc_feature (137)..(591): NCBI GI: 92875106 NCBI Desc: zinc finger, dhhc-type [medicago truncatula]
  misc_feature (369)..(700): NCBI GI: 42407934 NCBI Desc: dhhc-type zinc finger domain-containing protein-like [oryza sativa (japonica cultivar-group)]
MARKNGWQLPAHTLQIVAITVFFLLVIAFYAFFAPFLGKQVLGYVVIGIYTAVVFSVFILYIRCTSINPADPGIMSKFDNGFIDALGSTANIQGKNLPTKAYIGAGTTSPTATSTCRNSLDGRSNTGGLAAGDTNPDLGSQLPRSSRSCLLGGLLCALFVKQDCRKFDDSENQVDGENVLFCTLCDAEVRKFSKHCRSCDKCVDGFDHHCRWLNNCVGRKNYFTFLALMTTSLLWLAIEIGVGIAVLVICFANKNSERIIQDRLGNGLPRPAFATIVAFFTLLSLVACIPLGELFFFHMILIRKGITTYEYVVAMRAMSEAPQEEEDEEGVNIVYSPTNSATTAFSGASALSLHYKGSWCTPPRIFVDQDEVIPHLEPGMVPSTIDPDTAGHAERANKAKKQVKISAWKLAKLDSNEAMKAAAKARASSSVLRPIDTRRVPGASPNSSGNASMRSSMSADYSASGAKERGAGMKLLSLQSSSYPQSLASQDEYESGTQSASSRSSPVHIHKPAAPHTQINVPPRVPPAPPRPVPAVPRPPVPTTQISKPLFQSATSYVRENRKASVVWDQEAGRYVSVAPAPTRAVAGSDLDQPARAPHFLTNPGSEPSNHGRTLSPMNAPSSALPSGQPSERLTYTGQSIFFGGPLLGGAAADPQRTDAAAGARPETRRDGFGGERRRTAESFPVFAPGSFQKNPPFNR

SEQ ID NO: 5643 - DNA, 3270 bp, Sorghum bicolor
  misc_feature: Ceres ANNOT ID no. 6052870
  misc_feature: Encodes the peptide sequence at SEQ ID NO 5644
  misc_feature: Up-regulated in shoot tissues in response to salicylic acid treatment
  misc_feature: Up-regulated in root tissues in response to salicylic acid treatment
atggaggtggaggttcgcgtggtgggcggcgcccggagctgcttcgccgcgctcccgctccacctcatccacgccctggagcgcacctccgccaccggcgacctcccgcccgtcctcgcgctcgaacttcgcggccccgccggcgcgcgctggtccctcgcctggtccggcgccgcgtcccgatcccgcgccatcgaggttgcacaagagttagcagaatgcatctcgctgcctgacagaactacagcacagttgagcgtagctcgctctctggccaaagctgactcggtcagtattgaaccctacagtgaggatgactgggagatactggagagccgtgctgatttggctgaagaaacaatcttgaagcaggtcggcatcgtttatgagggcatgaaatttccattgtggttggatggacataatattgtgaagttcgttgttgtgtcatcttttcccgagaagacagttgttcaacttgtaccaggcactgaagttgctgttgcacccaaaaaacgaaaagagaagccttctcaggatctgcaaaagcaaagtgcactgaatgaaccagtcaaaacaaaggcactcctgcgtgttcaagcagctgataggaagtatgcacatacattcaaatataaaggtgttgagataggtgtggttgtcagctatgctgtgctaattcatcctgatacagctgcaagtatttcggttggcaatctccaattagtcactgtttcacctaaatcatcaaagaaaggactagctccaaaaggcaaagaagttggacaaaaaaagggaattccagtaactaaagaaagggcccatgaagccattgtttatatcttactttcagactctgttgcaaaagggcatgttatgcttccctactctattcgtcacttcataagtgctgatgtacattcatgggtatatattaagacatattctgccaacatcaaggaggatgaacctctagtgacaatatctcctttacagttcaagatgcgtgtgaaagatgcccatggtagcagtaaattagtcagtcaagaagcagacacttcgaggataaccaggattccttcagaaaatggtgatttcttccagaaagctcgttacagtgaaagtgaaaatcttcaaggtgcagatattgagagcatttctgaatcagtgtcaaagcagaaattttttattaagcattggcttattggacaccttaaagaaatgggcttgcatgctagccataccgagatgaattcaatagttttgccaaccaatattttgcttcatttagaagtgacagataaagaaggaatcaaaggagttgaatttttatacctactagcacttacttcggaaaattctagtttcaacaattcacaacttaatgttgagactgtttggagtgttccaaccggcaattccgatgatcttgaactgcatttcgggaagttggagctgggtgagcctgtatcttttgattccctagtggacagtggttccagtgatggtttcaagctgacccgatcttctttaggttggatggagaatgcaatgtcagatgtgacaaaaaggttatctgtgctcttatcagcaactagcctaaggttatttaataggataaagttcccctttcctggacatgttcttgtctatggacctcgaggttctggcaaaaccgctttgaccagggcttctgcaaaatactttgaagaccataaagatatcttggcacacatagtatacatagattgttccaaacttgcacttggcaaggctaaggagacaaggcaagagattgaagacagaatatctgaagcactgcttcattcaccttcgatcatcatatttgacgatctggacagtgtaatttcagtctcttcagatcctcaagtgtctcaatcgtccagttcttctgattctcttgtgagatatttaactgacattatggatgagtacaaggataagattcgaaatacatgcgggtatggacctatggcatttatggcttcggttcaatcacttcagagtcttcctcaagacttaacctcttctgggagatttgatttccatattgagcttcctgctcttgcagtcgctgagcgcaaagccctattgcaacatcaagttgaggagcatgagttactgtgttctgaggaagttctatcagagatagcatcaaaatgtgaaggttatgatgcatatgacttggaaattttggttgatagggctgtgcatgctgctgcttatcgctttcttctgccttctaatgcttctcacaactctctgaaacaaactttgctgatggaagatttctctgaagcaatgcatggcttccttccagtcgccatgcgtgatcttaggaaatatgctcctgatgataaagatggtggttgggaggatgttggagggctaaatgaagcagtaactatcattaaagagactcttgaactgccatcaaaatacccaaatatctttaccaaggcacctgtgcggttgcggtcgaacattctcctgtatggaccacctggatgtggtaaaactcacattgtgagagctgcagctgctgcttgttctttgcgattcatttcagtcaagggtccagagctattgaataagtatattggttcatctgagcaatctgttcgcgacttttttgcaaaggccgttgcagcagcaccttgcctattattctttgatgaatttgactccattgcaccccagcgaggaacccatagtgctggagtttctgatcgtgtagttaatcagtttttgacggaactcgatggtgtggagaccttgactggagtatttgtatttgcagctacgagcaagccacagctaattgatgctgcgcttttgcggcctggaaggtttgatcgtctagtcttttgtgatttccctcggtgggacgaacgtttagaaattctgaaggtgcattctaggacggtttcactggcaagtgatgccagtctcgaagatgttgcttctctaactgaaggatttactggtgctgatctcgctgctattctaacggatgctggactagcagcagttcatgaacttttggacaaccaggagaatggtgtcccagaaagtgaaccgtgcatcagcaaagaacttctcatgtctgtcactaggaaggctcgaccttccacaccagcagatgagaagaggcgatacgatagggagtttggtgaattcgtgtcatccaggaagtctatttcgacgaaggcaagagagtcgaaaggcaaaaaggtcacactagcttga

SEQ ID NO: 5644 - protein, 1089 aa, Sorghum bicolor
  misc_feature: Ceres ANNOT ID no. 6052870
  misc_feature (547)..(749): Pfam Id: AAA Pfam Desc: ATPase family associated with various cellular activities(AAA)
  misc_feature (835)..(1019): Pfam Id: AAA Pfam Desc: ATPase family associated with various cellular activities(AAA)
  misc_feature (94)..(170): Pfam Id: PEX-1N Pfam Desc: Peroxisome biogenesis factor 1, N-terminal
  misc_feature (370)..(1089): NCBI GI: 12006272 NCBI Desc: peroxisome biogenesis protein pex1 [arabidopsis thaliana]
  misc_feature (370)..(1089): NCBI GI: 30682405 NCBI Desc: peroxisome biogenesis protein (pex1) [arabidopsis thaliana]
  misc_feature (506)..(1065): NCBI GI: 4505725 NCBI Desc: peroxisome biogenesis factor 1 [homo sapiens]
  misc_feature (506)..(1065): NCBI GI: 123980036 NCBI Desc: peroxisome biogenesis factor 1 [synthetic construct]
  misc_feature (506)..(1022): NCBI GI: 119597250 NCBI Desc: peroxisome biogenesis factor 1, isoform cra_e [homo sapiens]
  misc_feature: Up-regulated in shoot tissues in response to salicylic acid treatment
  misc_feature: Up-regulated in root tissues in response to salicylic acid treatment
  misc_feature: The sequence is a functional homolog of SEQ ID NO. 462 in the 11/188,298 US application
  misc_feature: The sequence is a functional homolog of SEQ ID NO. 471 in the 11/188,298 US application
MEVEVRVVGGARSCFAALPLHLIHALERTSATGDLPPVLALELRGPAGARWSLAWSGAASRSRAIEVAQELAECISLPDRTTAQLSVARSLAKADSVSIEPYSEDDWEILESRADLAEETILKQVGIVYEGMKFPLWLDGHNIVKFVVVSSFPEKTVVQLVPGTEVAVAPKKRKEKPSQDLQKQSALNEPVKTKALLRVQAADRKYAHTFKYKGVEIGVVVSYAVLIHPDTAASISVGNLQLVTVSPKSSKKGLAPKGKEVGQKKGIPVTKERAHEAIVYILLSDSVAKGHVMLPYSIRHFISADVHSWVYIKTYSANIKEDEPLVTISPLQFKMRVKDAHGSSKLVSQEADTSRITRIPSENGDFFQKARYSESENLQGADIESISESVSKQKFFIKHWLIGHLKEMGLHASHTEMNSIVLPTNILLHLEVTDKEGIKGVEFLYLLALTSENSSFNNSQLNVETVWSVPTGNSDDLELHFGKLELGEPVSFDSLVDSGSSDGFKLTRSSLGWMENAMSDVTKRLSVLLSATSLRLFNRIKFPFPGHVLVYGPRGSGKTALTRASAKYFEDHKDILAHIVYIDCSKLALGKAKETRQEIEDRISEALLHSPSIIIFDDLDSVISVSSDPQVSQSSSSSDSLVRYLTDIMDEYKDKIRNTCGYGPMAFMASVQSLQSLPQDLTSSGRFDFHIELPALAVAERKALLQHQVEEHELLCSEEVLSEIASKCEGYDAYDLEILVDRAVHAAAYRFLLPSNASHNSLKQTLLMEDFSEAMHGFLPVAMRDLRKYAPDDKDGGWEDVGGLNEAVTIIKETLELPSKYPNIFTKAPVRLRSNILLYGPPGCGKTHIVRAAAAACSLRFISVKGPELLNKYIGSSEQSVRDFFAKAVAAAPCLLFFDEFDSIAPQRGTHSAGVSDRVVNQFLTELDGVETLTGVFVFAATSKPQLIDAALLRPGRFDRLVFCDFPRWDERLEILKVHSRTVSLASDASLEDVASLTEGFTGADLAAILTDAGLAAVHELLDNQENGVPESEPCISKELLMSVTRKARPSTPADEKRRYDREFGEFVSSRKSISTKARESKGKKVTLA

SEQ ID NO: 5645 - DNA, 699 bp, Sorghum bicolor
  misc_feature: Ceres ANNOT ID no. 6052884
  misc_feature: Encodes the peptide sequence at SEQ ID NO 5646
atggagcatcatggcctgtggtccagcggggccagcgacaagaacaagtccatggttgagcagctccagaggtacggggtcatcaggtcgaccaaagtcgcggaggtgatggaggccatcgacagggggttgttcgtgccacctgggggcacgccgtaccacgacagccccatgccgattgggtacaatgccacgatatcggcgccacacatgcacgccgcttgcctggagctcctggagaagaatcttcagcctggaatgcgagctctcgatgttgggtcaggcactggatacctaactgcttgctttgcactgatggttggaccagaaggacgagcagttggtgttgaacacatcccagagttggttgctacttctattgagaacatcaagaaaagtgcagcagccccacagctaaatgatggatccctcagtatacacgttgctgatgggagggaaggttggccagagctggcaccctatgacgccatccatgttggagctgcagcaccgcagatcccagaggcgctgatagagcagctgaagcccggcggcagaatggtgatccctgtcgggacagtcttccaggagctgaaggttgtggacaagaagttggatggcacggtcggcataagagacgaaacgtctgtgcgctatgtgcccctcactagcaaggaatctcaattgcacgcaagatga

SEQ ID NO: 5646 - protein, 232 aa, Sorghum bicolor
  misc_feature: Ceres ANNOT ID no. 6052884
  misc_feature (12)..(227): Pfam Id: PCMT Pfam Desc: Protein-L-isoaspartate(D-aspartate) O-methyltransferase(PCMT)
  misc_feature (63)..(212): Pfam Id: MTS Pfam Desc: Methyltransferase small domain
  misc_feature (7)..(229): NCBI GI: 90265055 NCBI Desc: h0510a06.5 [oryza sativa (indica cultivar-group)]
  misc_feature (7)..(229): NCBI GI: 38345249 NCBI Desc: osjnbb0011n17.10 [oryza sativa (japonica cultivar-group)]
  misc_feature (7)..(229): NCBI GI: 2499570 NCBI Desc: protein-l-isoaspartate o-methyltransferase (protein-beta-aspartate methyltransferase) (pimt) (protein l-isoaspartyl methyltransferase) (l-isoaspartyl protein carboxyl
  misc_feature (7)..(229): NCBI GI: 2499570 (continued) methyltransferase)
  misc_feature (7)..(229): NCBI GI: 1322021 NCBI Desc: l-isoaspartyl methyltransferase
  misc_feature (7)..(229): NCBI GI: 4678355 NCBI Desc: protein-l-isoaspartate(d-aspartate) o-methyltransferase [arabidopsis thaliana]
  misc_feature (7)..(229): SWISSPROT Homolog: EC 2.1.1.77 Protein-L-isoaspartate O-methyltransferase
MEHHGLWSSGASDKNKSMVEQLQRYGVIRSTKVAEVMEAIDRGLFVPPGGTPYHDSPMPIGYNATISAPHMHAACLELLEKNLQPGMRALDVGSGTGYLTACFALMVGPEGRAVGVEHIPELVATSIENIKKSAAAPQLNDGSLSIHVADGREGWPELAPYDAIHVGAAAPQIPEALIEQLKPGGRMVIPVGTVFQELKVVDKKLDGTVGIRDETSVRYVPLTSKESQLHAR

SEQ ID NO: 5647 - DNA, 879 bp, Sorghum bicolor
  misc_feature: Ceres ANNOT ID no. 6052885
  misc_feature: Encodes the peptide sequence at SEQ ID NO 5648
atggcaaccatgtccctccgctccctcgccatggccatggccgacacggccctcccgccggcccacaagctcctccccacggtctccctcccgctcctctcctcatccacgcacgccgcgccgctcctcctccgcgccagccgccgcctgccgctcgcgcccctcgtggcctcctccgacgccgtcgaggcgggcgtcgagtgggccgacgaggaggaagaggaggaggaggaggctggagaggccttcgacgaggaggctggggaggttgaggaggaggtgctggcctcaggcgacgagggtgagggggagtacgccgcggtcgagccgcccgaggaggccaaggtctacgttgggaacctcccctacgacatcgacagcgagggactcgcgcagctcttcgaccaggccggcgtcgtcgaggtcgccgaggttatttacaacagagagactggccagagccgtgggtttggctttgttaccatgagcactattgaggaagctgacaaagccattgagatgttcaaccgctatgacattagcgggaggcttctgaatgtaaacagggcatctcctaggggcactcgcatggaaagacctccgagacaatttgcacctgctttcagagcttatgttggcaacttgccatggcaagttgatgactctaggctggtgcaattgttcagcgagcatggagaagttgttaatgctactgttgtctatgatagagaatctgggcgttcacgaggatttggttttgtaacaatggtgtcaaaggaggaactcgatgatgctatttctgcgctggatggacaggaattggacgggcgccctcttcgagtaaatgttgcagcagagcgaccacagaggggcttttga

SEQ ID NO: 5648 - protein, 292 aa, Sorghum bicolor
  misc_feature: Ceres ANNOT ID no. 6052885
  misc_feature (116)..(187): Pfam Id: RRM_1 Pfam Desc: RNA recognition motif. (a.k.a. RRM, RBD, or RNP domain)
  misc_feature (210)..(281): Pfam Id: RRM_1 Pfam Desc: RNA recognition motif. (a.k.a. RRM, RBD, or RNP domain)
  misc_feature (1)..(292): NCBI GI: 3550483 NCBI Desc: cp31bhv [hordeum vulgare subsp. vulgare]
  misc_feature (8)..(292): NCBI GI: 168526 NCBI Desc: nucleic acid-binding protein
  misc_feature (1)..(292): NCBI GI: 3550467 NCBI Desc: cp31ahv protein [hordeum vulgare subsp. vulgare]
  misc_feature (1)..(292): NCBI GI: 2443390 NCBI Desc: ps16 protein [triticum aestivum]
  misc_feature (59)..(290): NCBI GI: 19032260 NCBI Desc: rna-binding protein precursor [persea americana]
  misc_feature: The sequence is a functional homolog of SEQ ID NO 1039 in the 10/374,780US patent application
  misc_feature: The sequence is a functional homolog of SEQ ID NO 849 in the 10/666,642US patent application
  misc_feature: Useful for making plants with modulated growth and phenotype characteristics
  misc_feature: The sequence is a functional homolog of SEQ ID NO 1039 in the 20060162006 US patent application
  misc_feature: The sequence is a functional homolog of SEQ ID NO 22 in US patent 7244875
  misc_feature: Useful for making plants with altered alkaloid content
  misc_feature: Functional homolog of the protein sequence given in SEQ ID NO 13848
  misc_feature: The sequence is a functional homolog of SEQ ID NO. 339 in the 11/188,298 US application
  misc_feature: The sequence is a functional homolog of SEQ ID NO. 458 in the 11/188,298 US application
MATMSLRSLAMAMADTALPPAHKLLPTVSLPLLSSSTHAAPLLLRASRRLPLAPLVASSDAVEAGVEWADEEEEEEEEAGEAFDEEAGEVEEEVLASGDEGEGEYAAVEPPEEAKVYVGNLPYDIDSEGLAQLFDQAGVVEVAEVIYNRETGQSRGFGFVTMSTIEEADKAIEMFNRYDISGRLLNVNRASPRGTRMERPPRQFAPAFRAYVGNLPWQVDDSRLVQLFSEHGEVVNATVVYDRESGRSRGFGFVTMVSKEELDDAISALDGQELDGRPLRVNVAAERPQRGF

SEQ ID NO: 5649 - DNA, 915 bp, Sorghum bicolor
  misc_feature: Ceres ANNOT ID no. 6052889
  misc_feature: Encodes the peptide sequence at SEQ ID NO 5650
atggctgccgccaggggcattaaccagcttctgaagagaactctccacaaccagtctgctggttcatcgctgctttcttcattgaggggaaagcatgaagagtcctctgctggactgagagcattggctcttcttggagttggtgcctctggtcttttgagttttgctacaatagcatctgctgatgaagctgagcatggcttggcagccccagattatccctggccccatgctggcatcatgagctcttatgatcacgcgtcaattcggcgtgggcatcaagtttacacacaagtttgtgcttcttgtcactccatgtccttgatttcgtaccgtgatttggttggggtggcctatactgaggaggaaacaaaggcaatggctgctgagattgaggtggttgatggtcctaacgatgagggtgaaatgttcacccgccctggtaagctgagtgatcgcttcccacagccttatgcgaacgagcaagcagcccgatttgctaatggtggtgcataccccccggaccttagtcttatcacaaaggcaaggcacaatggtcagaactatgtttttgctcttcttactggatatcgtgatccaccagctggcgttcagattcgtgagggtctgcactacaatccctacttccctggtggtgccatagccatgcccaagatgcttaatgatggagctgtggagtatgaggatggtactcctgcaactgaagcccagatgggtaaggatgtcgtatcattcctttcttgggcagccgagcctgagatggaagagagaaagctgatgggagtgaaatggatcttcctactatcactagcgcttctccaagctgcctactaccgccgcatgaagtggtcagtcttgaagtcccgtaagctggtcctggatgttgtcaactga

SEQ ID NO: 5650 - protein, 304 aa, Sorghum bicolor
  misc_feature: Ceres ANNOT ID no. 6052889
  misc_feature (69)..(294): Pfam Id: Cytochrom_C1 Pfam Desc: Cytochrome C1 family
  misc_feature (4)..(304): NCBI GI: 92872511 NCBI Desc: cytochrome c, monohaem [medicago truncatula]
  misc_feature (7)..(304): NCBI GI: 17981653 NCBI Desc: at3g27240/k17e12_6 [arabidopsis thaliana]
  misc_feature (7)..(304): NCBI GI: 110738762 NCBI Desc: cytochrome c1 precursor [arabidopsis thaliana]
  misc_feature (7)..(304): NCBI GI: 21435987 NCBI Desc: at5g40810/mhk7_4 [arabidopsis thaliana]
  misc_feature (4)..(304): NCBI GI: 140051803 NCBI Desc: cytochrome c, monohaem [medicago truncatula]
  misc_feature: The plant is abnormally small.
  misc_feature: The plant produces a reduced number of seeds.
  misc_feature: Useful for biocontainment applications
  misc_feature: Useful for making plants with modulated biomass
  misc_feature: GREAT-hit functional homolog of the protein sequence given in SEQ ID NO 13178
  misc_feature: Useful for biocontainment applications
  misc_feature: Useful for making plants with modulated biomass
  misc_feature: Functional homolog of the protein sequence given in SEQ ID NO 13178
MAAARGINQLLKRTLHNQSAGSSLLSSLRGKHEESSAGLRALALLGVGASGLLSFATIASADEAEHGLAAPDYPWPHAGIMSSYDHASIRRGHQVYTQVCASCHSMSLISYRDLVGVAYTEEETKAMAAEIEVVDGPNDEGEMFTRPGKLSDRFPQPYANEQAARFANGGAYPPDLSLITKARHNGQNYVFALLTGYRDPPAGVQIREGLHYNPYFPGGAIAMPKMLNDGAVEYEDGTPATEAQMGKDVVSFLSWAAEPEMEERKLMGVKWIFLLSLALLQAAYYRRMKWSVLKSRKLVLDVVN

SEQ ID NO: 5651 - DNA, 840 bp, Sorghum bicolor
  misc_feature: Ceres ANNOT ID no. 6052891
  misc_feature: Encodes the peptide sequence at SEQ ID NO 5652
atgcctggagccgttgcgcccgcgcccacgctcgcgccgacgaggagctccgcctacacgtccgccgccgcggcctccacgctgtctccgaacccgacaagccgaggcgacccgcttactctcagttcgtgccgcaacgctcctgctagtgctactccacttgtcccacttgcggccacccgtcgtcacgtgcgcggcttccgcggcgcgcctctagtcgccagtcccagtccccaccacgctcgaaaccctcgcctccgattcgcgtctgcggcggcggcggaggggatggctgcggaggccagcacggcggatgcggcggcggcagccgaggcgaagcccttcgccgtcctcttcgtgtgccttgggaacatttgccggagtcctgcagctgaagctgtgttccggacccttgtaagcaagcgtgggcttgactccaagtttctcatagactctgctggtaccatcgggtatcatgagggtaataaggcagactcaaggatgagagcagcttcaaagaagcgggggattgaggtcacctcaatatccaggcctatcagaccctcagactttcgtgattttgatcttatccttgcaatggacaggcagaactatgaagacatattgaactcgtttgagagatggagacgtaaggagcccctccctgagaatgcacccgataaggttaagctgatgtgctcctactgcaaacgacatactgagtctgaagtcccagatccttattatggaggccctcagggatttgaaaaggtgttggatatattggaagatgcttgcgagtcactgctcgatagtatcgttgcaagcatttctgggtga

SEQ ID NO: 5652 - protein, 279 aa, Sorghum bicolor
  misc_feature: Ceres ANNOT ID no. 6052891
  misc_feature (115)..(272): Pfam Id: LMWPc Pfam Desc: Low molecular weight phosphotyrosine protein phosphatase
  misc_feature (17)..(275): NCBI GI: 29367341 NCBI Desc: protein tyrosine phosphatase-like protein [oryza sativa (japonica cultivar-group)]
  misc_feature (113)..(275): NCBI GI: 92888004 NCBI Desc: low molecular weight phosphotyrosine protein phosphatase [medicago truncatula]
  misc_feature (97)..(275): NCBI GI: 79432726 NCBI Desc: protein tyrosine phosphatase [arabidopsis thaliana]
  misc_feature (102)..(275): NCBI GI: 34365639 NCBI Desc: at3g44620 [arabidopsis thaliana]
  misc_feature (114)..(276): NCBI GI: 22299353 NCBI Desc: low molecular weight phosphotyrosine protein [thermosynechococcus elongatus bp-1]
MPGAVAPAPTLAPTRSSAYTSAAAASTLSPNPTSRGDPLTLSSCRNAPASATPLVPLAATRRHVRGFRGAPLVASPSPHHARNPRLRFASAAAAEGMAAEASTADAAAAAEAKPFAVLFVCLGNICRSPAAEAVFRTLVSKRGLDSKFLIDSAGTIGYHEGNKADSRMRAASKKRGIEVTSISRPIRPSDFRDFDLILAMDRQNYEDILNSFERWRRKEPLPENAPDKVKLMCSYCKRHTESEVPDPYYGGPQGFEKVLDILEDACESLLDSIVASISG

SEQ ID NO: 5653 - DNA, 1032 bp, Sorghum bicolor
  misc_feature: Ceres ANNOT ID no. 6052893
  misc_feature: Encodes the peptide sequence at SEQ ID NO 5654
atgctctccgccaccatccccgcgcacccggccgccgccacaccgctgcggcgaaggtaccggcttcgccctcgccagccactctgcgccccaattggcacggcggcgacgaggcagtggatggcgacgacgaggctctcggtcaccaacgcgcttgctaacctatccgttgagagtgcccccgcggcgcctcccaagctctcgttcccgatactggtgaatagttgcactggaaaaatgggaaaggctgttgctgaagcagctgtctcggctggtcttcagttagttcctgtatcattcagtgccatggaggtccctgatggaaagattgaagtatgtgatagagaaatttgtattcatgacccatctgaaagtgaaaaaattctcccttccattgttaaggagtacccagatctcatagttgtcgattacactgtgcctgatgctgttaatgccaatgctgaactctattgcaaattgggtttgccatttgtaatgggcacaactggtggaaataggcaactgttgcacaaaactgtgcttgatgcgaatatttatgctgtgatatccccacagatgggaaagcaggttgttgcttttcttgctgccatggaaattatgtcagagcaatttcctggtgcattttctggttacaaactggaggtcatggagtctcatcaagcaacaaaattggacatttctgggactgccaaggctgttatctcttgctttcagaagttgggtgtatcatttgacatgaatgaggtaaagcaagttagggatcctgaggagcaggtagctttggtgggtgtcccagaagaacatctcgggggtcatgccttccacatgtatcatctcacttcacctgatgggacagtttcgtttgagtttcagcacaatgtatgtggccgttcaatatatgcagaaggaactgttgatgctgctatgtttctctacacaaagataaaatctggggcgagcaagaaattgtatgacatgattgatgtcttgagagaagggaacatgagatga

SEQ ID NO: 5654 - protein, 343 aa, Sorghum bicolor
  misc_feature: Ceres ANNOT ID no. 6052893
  misc_feature (196)..(337): Pfam Id: DapB_C Pfam Desc: Dihydrodipicolinate reductase, C-terminus
  misc_feature (69)..(193): Pfam Id: DapB_N Pfam Desc: Dihydrodipicolinate reductase, N-terminus
  misc_feature (1)..(343): NCBI GI: 51535668 NCBI Desc: dihydrodipicolinate reductase-like [oryza sativa (japonica cultivar-group)]
  misc_feature (22)..(343): NCBI GI: 115451871 NCBI Desc: os03g0245100 [oryza sativa (japonica cultivar-group)]
  misc_feature (58)..(343): NCBI GI: 42572737 NCBI Desc: dihydrodipicolinate reductase family protein [arabidopsis thaliana]
  misc_feature (70)..(340): NCBI GI: 121542607 NCBI Desc: dihydrodipicolinate reductase family protein [candidatus desulfococcus oleovorans hxd3]
  misc_feature (71)..(318): NCBI GI: 68052089 NCBI Desc: dihydrodipicolinate reductase (dhpr)
MLSATIPAHPAAATPLRRRYRLRPRQPLCAPIGTAATRQWMATTRLSVTNALANLSVESAPAAPPKLSFPILVNSCTGKMGKAVAEAAVSAGLQLVPVSFSAMEVPDGKIEVCDREICIHDPSESEKILPSIVKEYPDLIVVDYTVPDAVNANAELYCKLGLPFVMGTTGGNRQLLHKTVLDANIYAVISPQMGKQVVAFLAAMEIMSEQFPGAFSGYKLEVMESHQATKLDISGTAKAVISCFQKLGVSFDMNEVKQVRDPEEQVALVGVPEEHLGGHAFHMYHLTSPDGTVSFEFQHNVCGRSIYAEGTVDAAMFLYTKIKSGASKKLYDMIDVLREGNMR

SEQ ID NO: 5655 - DNA, 1914 bp, Sorghum bicolor
  misc_feature: Ceres ANNOT ID no. 6052894
  misc_feature: Encodes the peptide sequence at SEQ ID NO 5656
atggcgtcggccagcgagacgacagagcagtccaccataacgagcacgaccatggacgacggtggtgcgcacgagagcaagcgggagcacctcaatggcgcggcggccacccccacggtggggcaggaggaggatgagatgatcgggccgggccctgcgccggcgaagcagcggcagaagcgcccgctccagttcgagcaggcgtacgagaagagctatatgcatcgggatgtcgtcacccacgtcgccgtatcacctgctgacttcttcatcactgggagtgcagatgggcatctgaagttttggaagaagaaacctgttgggattgaatttgctaaacattttcggtctcatctcagtcccatcgaaggtctagctgtgagtgttgatggattgctttgctgcacaatatccaacgatcggtctgtgaagatatatgatgttgtaaactatgacatgatgttcatgatgcgtctctcatttgttcctggggctattgagtgggttcatcgagaaggagatgttaaaccaaaacttgctgttagtgaccggaatacacctttagttcacatatttgatactcattctggttcaaatgacccaatcatgtccaaagagattcatggtggccctgtcaaagttatgaaatataaccacattcatgatgttgttatatctgctgatgccaaaggactgttggaatactggtctccatctaccctcaagtttccagaaaatgaggtgaggtttcgcctgaaatcggatacaaatctatttgaaattgcgaaatgcaagacaagtgtgtctgctattgaggtaagcaatgatggcactcaatttgctgtcacatcccctgatcgcaggatacgggtattttggttcaaaactgggaaattaagacgtgtatatgacgagtccctagaggtggcacaagatcttcaaagaagtgatgttccattgtatcaccttgatgctattgattttggacgacgaatggctgtagagaaggaaatagagaaaacagaaaatgtcccacaacctaatgctgtctttgatgagagcagcaattttcttatttacgctacccttttgggtgtaaagattgtaaatttgcacacaaataaggtttcccgcatcctggggaaggtagagaacaatgagaggtttctgagaattgcattataccaaggagacaaaggcaacaagaaggttagaaaaataccttcagtagctgccaatgtcaatgatagcaaggaacccttatcagatccaacactgctctgttgtgctttcaagaagcatcggatatatctctttagtcgtagggaaccggaagagcctgaagacgcaactaagggtagagatgttttcaatgaaaaaccacctccagaagagcttttgtctgtatcagacctaggaaaaactgctacaacatcattgcctgataatttggtgctacatacttctatgggtgacattcacttgagactatacccagaagagtgtccaaaaactgtggaaaacttcactacccattgccggaatggttattatgacaatcttatatttcaccgtgtgattaaaggattcatgattcagactggagatcctttgggggatggcactggtgggcaatcaatctggggcactgaatttgaagatgaatttcacaagagcttgaggcatgataggccttttacactttccatggccaatgctggacctaataccaatggttctcaattctttatcaccactgtggcaactccatggctagataacaaacacacagtgttcggtagagttgtgaaagggatggatgttgtccagcaaattgagaaggtcaagactgacaagaatgacaaaccatatcaagatgtaaagatcttgaatgttacagttcccaagacataa

SEQ ID NO: 5656 - protein, 637 aa, Sorghum bicolor
  misc_feature: Ceres ANNOT ID no. 6052894
  misc_feature (483)..(635): Pfam Id: Pro_isomerase Pfam Desc: Cyclophilin type peptidyl-prolyl cis-trans isomerase/CLD
  misc_feature (66)..(103): Pfam Id: WD40 Pfam Desc: WD domain, G-beta repeat
  misc_feature (109)..(147): Pfam Id: WD40 Pfam Desc: WD domain, G-beta repeat
  misc_feature (98)..(637): NCBI GI: 143346745 NCBI Desc: peptidyl-prolyl cis-trans isomerase [silene latifolia]
  misc_feature (248)..(637): NCBI GI: 143346701 NCBI Desc: peptidyl-prolyl cis-trans isomerase [silene latifolia]
  misc_feature (69)..(632): NCBI GI: 145341074 NCBI Desc: peptidyl-prolyl cis-trans isomerase, cyclophilin-type [ostreococcus lucimarinus cce9901]
  misc_feature (26)..(634): NCBI GI: 559713 NCBI Desc: kiaa0073 [homo sapiens]
  misc_feature (26)..(634): NCBI GI: 24308049 NCBI Desc: kiaa0073 protein [homo sapiens]
  misc_feature (483)..(634): SWISSPROT Homolog: EC 5.2.1.8 Peptidyl-prolyl cis-trans isomerase-like 1
MASASETTEQSTITSTTMDDGGAHESKREHLNGAAATPTVGQEEDEMIGPGPAPAKQRQKRPLQFEQAYEKSYMHRDVVTHVAVSPADFFITGSADGHLKFWKKKPVGIEFAKHFRSHLSPIEGLAVSVDGLLCCTISNDRSVKIYDVVNYDMMFMMRLSFVPGAIEWVHREGDVKPKLAVSDRNTPLVHIFDTHSGSNDPIMSKEIHGGPVKVMKYNHIHDVVISADAKGLLEYWSPSTLKFPENEVRFRLKSDTNLFEIAKCKTSVSAIEVSNDGTQFAVTSPDRRIRVFWFKTGKLRRVYDESLEVAQDLQRSDVPLYHLDAIDFGRRMAVEKEIEKTENVPQPNAVFDESSNFLIYATLLGVKIVNLHTNKVSRILGKVENNERFLRIALYQGDKGNKKVRKIPSVAANVNDSKEPLSDPTLLCCAFKKHRIYLFSRREPEEPEDATKGRDVFNEKPPPEELLSVSDLGKTATTSLPDNLVLHTSMGDIHLRLYPEECPKTVENFTTHCRNGYYDNLIFHRVIKGFMIQTGDPLGDGTGGQSIWGTEFEDEFHKSLRHDRPFTLSMANAGPNTNGSQFFITTVATPWLDNKHTVFGRVVKGMDVVQQIEKVKTDKNDKPYQDVKILNVTVPKT

SEQ ID NO: 5657 - DNA, 1527 bp, Sorghum bicolor
  misc_feature: Ceres ANNOT ID no. 6052903
  misc_feature: Encodes the peptide sequence at SEQ ID NO 5658
atgatgtacgagtacgatagcatggacggggcgaggatcatagcgtatttcaagggcaagagcatcctcatcaccggctcaacaggctttcttgggaagattcttgtggagaagatactccgggtgcagcctgatgccaacaagatctaccttcttgtacgagggaaggacgcgtcatctgcaaagcaacgcgtccaacaagaggtgattggcaccgagctgttcggcaagctgagagagaagcacggggaagacgggttccagcagttcatgcaggagaagatagttgccttgcctggggacatcatctacgacaacctgggactggatgctcctacgctggaggctctggccaaggacatagacatcattgtcaacattgcggcaactaccaacttctacgaaagatatgatgtctcgttggacgtgaacgtgatgggggtgaagcacctctgccacttcgctcagcagtgcgccaatctcaagatgttcatgcatgtctccactgcatatgtctgcggcgacagggacgggctccacctggagaagcccatcaaccatggcgagtcgctgtgggagggcaggtacctcgacgtcgacgccgagctgcagctcgtcagggaagccaagaaggagctcatcatggacgacaccagcggcgacgaggccgccggcaggaagacggagaggaaggcgatgaaggagctgggcatccagagggctcgccactttggttggtccaacacgtacgtcttcaccaaggccatgggggagatggtgctggggcagctccgcggcgacatgcccgtggtggtcatgcgccccagcatcatcaccagcgtgctggcggacccgctgccggggtggatgcagggcatgcgcaccatcgacacgctcatcatcggctacgccaagcagaacctctcctgcttcctcggcgacctcagcgtcgtcgtggacgtcgtcccgggggacatggtggccaacgcgatgatggcggccatggtggcgcactcggaggagaagagtagtactgcggaggcggtgccggtgtaccacgtcacctcgtcgctgcgcaacccagtcacctactccgtcctgtacgaatccggccgccggcacttctaccagaacccgcgcgtggggatggacggcaaggtcatccccaccaaggagatgcgcttcttccccaccatcgcgcagttccagctctacatgctgttcacattcaagctgccactagaggttctgcatttggtgaatctgctgctttgtgggcttttctcgcggctctacaacgatctcaaccgcaagtataagtttgtgatgcatcttgttgacgtctatggcccctttgccttcttcaacggatgctttgatgacatgaacttggagcggttgaggttgacaatggcgatgaagacctctgaagatcacatgttcaattttgaccccaagacaatcgactgggacgattacttcactagaatccacatccctggtgttctcaagtatttgtgcaagtga

SEQ ID NO: 5658 - protein, 508 aa, Sorghum bicolor
  misc_feature: Ceres ANNOT ID no. 6052903
  misc_feature (24)..(331): Pfam Id: NAD_binding_4 Pfam Desc: Male sterility protein
  misc_feature (408)..(509): Pfam Id: Sterile Pfam Desc: Male sterility protein
  misc_feature (6)..(506): NCBI GI: 22003092 NCBI Desc: fatty acyl coa reductase [triticum aestivum]
  misc_feature (7)..(506): NCBI GI: 115480737 NCBI Desc: os09g0567500 [oryza sativa (japonica cultivar-group)]
  misc_feature (6)..(508): NCBI GI: 22003084 NCBI Desc: fatty acyl coa reductase [triticum aestivum]
  misc_feature (8)..(505): NCBI GI: 38346871 NCBI Desc: osjnbb0002n06.11 [oryza sativa (japonica cultivar-group)]
  misc_feature (8)..(505): NCBI GI: 116309526 NCBI Desc: osigba0092g14.1 [oryza sativa (indica cultivar-group)]
MMYEYDSMDGARIIAYFKGKSILITGSTGFLGKILVEKILRVQPDANKIYLLVRGKDASSAKQRVQQEVIGTELFGKLREKHGEDGFQQFMQEKIVALPGDIIYDNLGLDAPTLEALAKDIDIIVNIAATTNFYERYDVSLDVNVMGVKHLCHFAQQCANLKMFMHVSTAYVCGDRDGLHLEKPINHGESLWEGRYLDVDAELQLVREAKKELIMDDTSGDEAAGRKTERKAMKELGIQRARHFGWSNTYVFTKAMGEMVLGQLRGDMPVVVMRPSIITSVLADPLPGWMQGMRTIDTLIIGYAKQNLSCFLGDLSVVVDVVPGDMVANAMMAAMVAHSEEKSSTAEAVPVYHVTSSLRNPVTYSVLYESGRRHFYQNPRVGMDGKVIPTKEMRFFPTIAQFQLYMLFTFKLPLEVLHLVNLLLCGLFSRLYNDLNRKYKFVMHLVDVYGPFAFFNGCFDDMNLERLRLTMAMKTSEDHMFNFDPKTIDWDDYFTRIHIPGVLKYLCK

SEQ ID NO: 5659 - DNA, 1518 bp, Sorghum bicolor
  misc_feature: Ceres ANNOT ID no. 6052906
  misc_feature: Encodes the peptide sequence at SEQ ID NO 5660
atgtacgagagcatggacgcggcgaggatcgtagcgtatttcaagggcaagagaatcctcatcactggcgcaactggctttcttgggaagattcttgtggagaagatactccgggtgcagcctgatgtcaacaagatctaccttcttgtacgagggacgaacgagtcatctgcaaagcaacgcgtccaacaagaggtgattggcaccgatctgttcggcaagctgagagagaagcacggcgacgtgttccagcagttcatccaggacaagattgttgccttgcctggggacatcatctgcgacaacctgggattagaaactcctaagctggagactctggccaaggacatagacatcattgtcaacattgcggcaaccaccaacttctatgaaagatatgatgtctcgttggatgtgaacgtgatgggggtgaagcacctttgccagttcgcccagcagtgctccaacctcaagatgtttatgcatgtctccactgcttatgtctgcggcgacagggacgggctcatcctggagaatcccatccaacccggcgagtctcggcgggagggcaggtacctcgacgtcgacgccgagctgcggctcgtcagcgaagccaagaaggagctcatggcggacgccagccgtcatgagctgaagacgacggagacgaaggcgatgaaggagctgggcctccagagggctcgccacttcgggtggtccaacacgtacgtcttcaccaaggccatgggcgagatgctgctgctggaggagctgcagctccgggggacgacggacatggcgcccgtggtgatcatgcgccctagcatcatcaccagcgtgctggcagacccgctgcccgggtggatgcagggcacccgcaccatcgacacgctcatcatcgggtacgccaagcagaacctgtcgtgcttcctcgccgacctgggactcgtcatggacgtcatcccgggggacatggtggccaacgccatgatggcggccatggtggcgcactcggaggaggcggcggcggtaccaccgccggtgtaccacgtcacctcgtcgctgcgcaacccggtcacctactccgtgctgtacgagtccggccgccggcacttctacccgaacccgcgcgtggggaaggacggcaaggtcatccccaccagggagatgcgttttttccccaccgttgcgcagttccacctctacatgatgctcaccttcaagctgcctctagagattctgcacttggtgaatctgctgctttgtgggctcttctcgcggctttacaacgacctcaaccgcaagtacaagtttgtgatgcatcttgttgatgtctacgcacccttcgccttgttcaaaggatgctttgatgacatgaatttggagcggctgaggctgacgataacgatgaagacccctgaagatcacatgttcaatttcgacaccaagattatcgactgggatgattacttcaccagaatccacatcccaggtgttctcaagtatttgtgcaagtga

SEQ ID NO: 5660 - protein, 505 aa, Sorghum bicolor
  misc_feature: Ceres ANNOT ID no. 6052906
  misc_feature (21)..(330): Pfam Id: NAD_binding_4 Pfam Desc: Male sterility protein
  misc_feature (405)..(506): Pfam Id: Sterile Pfam Desc: Male sterility protein
  misc_feature (1)..(503): NCBI GI: 115480737 NCBI Desc: os09g0567500 [oryza sativa (japonica cultivar-group)]
  misc_feature (1)..(503): NCBI GI: 22003092 NCBI Desc: fatty acyl coa reductase [triticum aestivum]
  misc_feature (1)..(505): NCBI GI: 22003084 NCBI Desc: fatty acyl coa reductase [triticum aestivum]
  misc_feature (1)..(425): NCBI GI: 22003088 NCBI Desc: fatty acyl coa reductase [triticum aestivum]
  misc_feature (5)..(502): NCBI GI: 38346871 NCBI Desc: osjnbb0002n06.11 [oryza sativa (japonica cultivar-group)]
MYESMDAARIVAYFKGKRILITGATGFLGKILVEKILRVQPDVNKIYLLVRGTNESSAKQRVQQEVIGTDLFGKLREKHGDVFQQFIQDKIVALPGDIICDNLGLETPKLETLAKDIDIIVNIAATTNFYERYDVSLDVNVMGVKHLCQFAQQCSNLKMFMHVSTAYVCGDRDGLILENPIQPGESRREGRYLDVDAELRLVSEAKKELMADASRHELKTTETKAMKELGLQRARHFGWSNTYVFTKAMGEMLLLEELQLRGTTDMAPVVIMRPSIITSVLADPLPGWMQGTRTIDTLIIGYAKQNLSCFLADLGLVMDVIPGDMVANAMMAAMVAHSEEAAAVPPPVYHVTSSLRNPVTYSVLYESGRRHFYPNPRVGKDGKVIPTREMRFFPTVAQFHLYMMLTFKLPLEILHLVNLLLCGLFSRLYNDLNRKYKFVMHLVDVYAPFALFKGCFDDMNLERLRLTITMKTPEDHMFNFDTKIIDWDDYFTRIHIPGVLKYLCK

SEQ ID NO: 5661 - DNA, 651 bp, Sorghum bicolor
  misc_feature: Ceres ANNOT ID no. 6052928
  misc_feature: Encodes the peptide sequence at SEQ ID NO 5662
atgagtaagttgcagtccgaggttctcaaggatgccatctctcagattgttggggatgccaaggagaagaataggaagttcaccgagactgttgagcttcagattggtctgaagaattatgatccacagaaggacaagcgtttcagtggctctgttaagttgccccacatccctcgtccaaagatgaaggtgtgcatgcttggtgatgcccagcacgttgaggaggctgagaagatgggacttgactacatggatgttgagtccctcaagaaaatgaacaagaacaagaagcttgttaagaagcttgccaagaagtaccatgcgtttttggcatcagaggccatcatcaagcagattccccgtctccttggtcctggtcttaacaaggcaggcaagttccctacgcttgttactcaccaggagtccctggaatccaaggtgaatgagacgaaggctactgtcaagtttcagctgaagaaggtcctctgcatgggtgtcgccgtcggtaacttgtccatggaggagaagcagatccagcagaacatccaaatgagtgtgaacttccttgtgtccctcctgaagaagaactggcagaatgtgagatgcctttacgtcaagagcaccatggggaaaccatacagggtgttctaa

SEQ ID NO: 5662 - protein, 216 aa, Sorghum bicolor
  misc_feature: Ceres ANNOT ID no. 6052928
  misc_feature (8)..(212): Pfam Id: Ribosomal_L1 Pfam Desc: Ribosomal protein L1p/L10e family
  misc_feature (1)..(216): NCBI GI: 57471702 NCBI Desc: ribosomal protein l10a [triticum aestivum]
  misc_feature (1)..(216): NCBI GI: 92898021 NCBI Desc: ribosomal protein l1 [medicago truncatula]
  misc_feature (1)..(216): NCBI GI: 9757825 NCBI Desc: 60s ribosomal protein l10a [arabidopsis thaliana]
  misc_feature (2)..(216): NCBI GI: 25294932 NCBI Desc: 60s ribosomal protein l10a [imported] - arabidopsis thaliana
  misc_feature (34)..(216): NCBI GI: 47026982 NCBI Desc: 60s ribosomal protein l10a [hyacinthus orientalis]
MSKLQSEVLKDAISQIVGDAKEKNRKFTETVELQIGLKNYDPQKDKRFSGSVKLPHIPRPKMKVCMLGDAQHVEEAEKMGLDYMDVESLKKMNKNKKLVKKLAKKYHAFLASEAIIKQIPRLLGPGLNKAGKFPTLVTHQESLESKVNETKATVKFQLKKVLCMGVAVGNLSMEEKQIQQNIQMSVNFLVSLLKKNWQNVRCLYVKSTMGKPYRVF

SEQ ID NO: 5663 - DNA, 1050 bp, Sorghum bicolor
  misc_feature: Ceres ANNOT ID no. 6052933
  misc_feature: Encodes the peptide sequence at SEQ ID NO 5664
atggctccacccgcggccccgaccgcgctgcaccaccgcacgcccctcctcctcccccgccgcgccaccgccgccccgggtgccaccgccaccgccaccgcgcgcgccgccagagccgcttctctagccgtcgtcagggcccagccggacaccaccgccgcgacctccgcccccgagccgccgacgccggagttcaagccgccgccggggttcaaggtgcccgagcccaagaggttcgaggtcaagcccggccagcagaacagcgtcctcggcgcctcgctcgccatcccgctccgcctcggcaccggcgtcttcgtcctcgggtactcgccatcacttgtttctccgtcagagataccatcagatcaatatgcactggaattcggagcttggaaggtgaaggaggaatcaaaaataggacagtgcaaacgaccggaaaagcctatcgagatatatgaatttgaaggttgtccattttgtcgaaaggtcagagagatggtatcagttttggacctagacgtattgttttacccctgtcctcaaaaaggcccaacattccgacctaaagtcctcgagatgggtggaaagaaacagtttccttacatggtggatccaaacacaggggtcgccatgtatgaatcagatgacatcataaaatacctagctgacacatacggcgatggaactgttccaattatgctatcacttggtctgttaacaacaatcacagcagggcttgctactcttggtcgttttggaaagggaaattcctatactgcttcaaaagttccaccacagccaatagagatatgggcatatgagggatctcccttctgtagattagtacgagagacgcttgttgagttggaattgccacatctgctgcacagctgcgcacgtggcagccccaaacgacaagaattcttgaagaaaaagggagttttccaggcgccttacattgaagatccgaacaccggagtccagatgttcgaaagcgctgaaatcatagactacctgaaggcaacatatgccctgtacccaagctcatag

SEQ ID NO: 5664 - protein, 349 aa, Sorghum bicolor
  misc_feature: Ceres ANNOT ID no. 6052933
  misc_feature (128)..(300): NCBI GI: 120555110 NCBI Desc: glutathione s-transferase, n-terminal domain [marinobacter aquaeolei vt8]
  misc_feature (76)..(343): NCBI GI: 119358800 NCBI Desc: ccd-arp undefined product (ic) [ostreococcus tauri]
  misc_feature (62)..(233): NCBI GI: 83584367 NCBI Desc: plastid auxin-regulated protein [prototheca wickerhamii]
  misc_feature (149)..(226): NCBI GI: 55379179 NCBI Desc: glutathione s-transferase n-terminal domain [haloarcula marismortui atcc 43049]
  misc_feature (149)..(226): NCBI GI: 76801277 NCBI Desc: probable glutaredoxin [natronomonas pharaonis dsm 2160]
MAPPAAPTALHHRTPLLLPRRATAAPGATATATARAARAASLAVVRAQPDTTAATSAPEPPTPEFKPPPGFKVPEPKRFEVKPGQQNSVLGASLAIPLRLGTGVFVLGYSPSLVSPSEIPSDQYALEFGAWKVKEESKIGQCKRPEKPIEIYEFEGCPFCRKVREMVSVLDLDVLFYPCPQKGPTFRPKVLEMGGKKQFPYMVDPNTGVAMYESDDIIKYLADTYGDGTVPIMLSLGLLTTITAGLATLGRFGKGNSYTASKVPPQPIEIWAYEGSPFCRLVRETLVELELPHLLHSCARGSPKRQEFLKKKGVFQAPYIEDPNTGVQMFESAEIIDYLKATYALYPSS

SEQ ID NO: 5665 - DNA, 573 bp, Sorghum bicolor
  misc_feature: Ceres ANNOT ID no. 6052934
  misc_feature: Encodes the peptide sequence at SEQ ID NO 5666
atgggcagcgcgtcgccgccttcgtcgcgccggcggtggagctggggctcggcgctggccggcgcggcgacgacggccgccgccacggcgctggtgctgtgccggccgcgggaccctcggttcgagctcatctccatcagcctgtccgccttccacttccgcgcgccggcggcgctggacatcggcctcaccctcaccgtgcacgccaccaaccccaacgtcgtgccggtccgctacggggcctccaccgtctccatcctctacggcggcgcgcacctcggcaccgcccgcctcgacgccggcgagcagcccgccacctcgtgccgcctgctccacctcccggcgcgcctcgacggcgtcgagctcgcgcaccgcgcccgcgccatcctctccgacgtcgcccgccgccacatggagctcgacgccgccgtcgagatcgccggcgaggccgcggtgctgctctggtcacgccccttctccgtccgcatcgacagccacatcaccgtcgaccccgtcttcctggaagtggtcgagcaggagaaccgctccgagatgcagctctatctcgcctga

SEQ ID NO: 5666 - protein, 190 aa, Sorghum bicolor
  misc_feature: Ceres ANNOT ID no. 6052934
  misc_feature (31)..(169): Pfam Id: Hin1 Pfam Desc: Harpin-induced protein 1 (Hin1)
  misc_feature (31)..(171): NCBI GI: 16323356 NCBI Desc: at2g01080/f23h14.5 [arabidopsis thaliana]
MGSASPPSSRRRWSWGSALAGAATTAAATALVLCRPRDPRFELISISLSAFHFRAPAALDIGLTLTVHATNPNVVPVRYGASTVSILYGGAHLGTARLDAGEQPATSCRLLHLPARLDGVELAHRARAILSDVARRHMELDAAVEIAGEAAVLLWSRPFSVRIDSHITVDPVFLEVVEQENRSEMQLYLA

SEQ ID NO: 5667 - DNA, 1116 bp, Sorghum bicolor
  misc_feature: Ceres ANNOT ID no. 6052948
  misc_feature: Encodes the peptide sequence at SEQ ID NO 5668
  misc_feature: Up-regulated in root tissues in response to methyl jasmonate treatment
  misc_feature: Up-regulated in shoot tissues in response to methyl jasmonate treatment
atggaatccttgtggaaattgacctacttgctcgagccggcatcgcttgctctaattgccacagccatttctgtggcctatgcatcagcatcgcgtgctctggactatggcaaagagatggagagaaacttggatttttcagaggcttccattacattggatcggtcacaggctctaatgattccccttgcaagctcatgcagtctgttgctaatgttctacttgttctcgtctgtctcacatctcgtgactgcttttactgctgtggcctcagcaatggcattgttcttttgcctgtctccacacatcacctatctcaagacacagtacaatctaatggacccattcgtgtccaggtgttgttcaaagccgtttacacggttgcaaggtttgctgatgctcttctgcatagccacagtcttagcctggttggtttcagggcattggttgctaaataacctactggggatttccatatgtgtagcatttgtcagccatgtgaggcttcccaacataaagatctgtgcgctgcttcttgcctgcttatttgtgtatgatattttctgggtgttcttctcagaaaggttttttggagcaaatgtcatggtctctgttgccactcagaaggcatctaatcctgttcacacagtagcaaataagctcagcctgcccgggttgcagttgattacaaagaagctggagcttccagtcaagcttgtatttcccaggaatttgttgggtggtattgttccaggaagcaatcctggtgactacatgatgcttggccttggagacatggccattccagggatgcttctagctctggtactcttttttgataaccggaagttcaaggatgtgaatgttccatcagatgtgtctcccccaaaacggcggaagtatgtgtggtatgctctaacagggtatggtattggcttggtagctgcactagctgctgggatcttgtctcagtctccccaaccagccttactgtacctggtgccatcgacactggggcctgtcatgtacttgtcatggttacggaatgagctgtgggagctatgggaagggtctgggacgattctaaacgagaaagctcgtttgctggaggtctga

SEQ ID NO: 5668 - protein, 371 aa, Sorghum bicolor
  misc_feature: Ceres ANNOT ID no. 6052948
  misc_feature (45)..(359): Pfam Id: Peptidase_A22B Pfam Desc: Signal peptide peptidase
  misc_feature (1)..(371): NCBI GI: 23308167 NCBI Desc: at4g33410/f17m5_170 [arabidopsis thaliana]
  misc_feature (9)..(371): NCBI GI: 140060401 NCBI Desc: peptidase a22b, minor histocompatibility antigen h13 [medicago truncatula]
  misc_feature (47)..(371): NCBI GI: 60499142 NCBI Desc: signal peptide peptidase-like protein 3 [danio rerio]
  misc_feature (47)..(371): NCBI GI: 66910472 NCBI Desc: sppl3 protein [danio rerio]
  misc_feature (39)..(371): NCBI GI: 27820032 NCBI Desc: gm06145p [drosophila melanogaster]
  misc_feature: Up-regulated in root tissues in response to methyl jasmonate treatment
  misc_feature: Up-regulated in shoot tissues in response to methyl jasmonate treatment
MESLWKLTYLLEPASLALIATAISVAYASASRALDYGKEMERNLDFSEASITLDRSQALMIPLASSCSLLLMFYLFSSVSHLVTAFTAVASAMALFFCLSPHITYLKTQYNLMDPFVSRCCSKPFTRLQGLLMLFCIATVLAWLVSGHWLLNNLLGISICVAFVSHVRLPNIKICALLLACLFVYDIFWVFFSERFFGANVMVSVATQKASNPVHTVANKLSLPGLQLITKKLELPVKLVFPRNLLGGIVPGSNPGDYMMLGLGDMAIPGMLLALVLFFDNRKFKDVNVPSDVSPPKRRKYVWYALTGYGIGLVAALAAGILSQSPQPALLYLVPSTLGPVMYLSWLRNELWELWEGSGTILNEKARLLEV

SEQ ID NO: 5669 - DNA, 1776 bp, Sorghum bicolor
  misc_feature: Ceres ANNOT ID no. 6052950
  misc_feature: Encodes the peptide sequence at SEQ ID NO 5670
atgcagtccatggcgctcacctccccctccctcccggcggcgggccccgtcaccggccgccgcctccagcgcgtccgcgccaccgcggtctccgacgagcccaagctcaacaagtacagcgcgcgcatcacggagcccaagtcgcagggcgcctcacaggcggtgctgtacggggtcggcctcaccgacgccgacctccgcaagccgcaggtcggcgtctcctcggtgtggtacgaggggaacacctgcaacatgcacctgctccgcctcgccgaggccgtccgcgacggcgtccgcgaggccggcatggtcggcttccggttcaacaccgtcggcgtcagcgacgccatctccatgggcacccggggcatgtgctacagcctccagtcccgcgacctcatcgccgacagcatcgagaccgtcatgggcgcgcagcactacgacgccaatatctccatacctgggtgcgacaagaacatgccaggtacaataatggcaatgggacggcttaatcgacctagtatcatgatatatggtggaactattaagcctggtcactttcagggaaattcctatgatatagtatctgctttccagtgctacggagaatatgttagtggctcaatcactgatgagcaaagaaagaacgtcctccgcaattcatgtccaggggcaggtgcctgtggtggtatgtacacagcaaacactatggcatctgctattgaaacattgggcatgagccttccatacagttcttcgacacctgctgaagatccgctaaagctagaagaatgccatctcgccgggaagtatcttttagagttgctaaagatggatttgaagcctaaggacattatcactgagaagtcattacgaaatgcaatggttatcgttatggcacttggtggttcaactaatgctgttctgcatttgattgccattgctcggtctgtaggtctgcatttgactcttgatgatttccagaaggtcagtgaccaagttcctttccttgcagacctcaagcccagtggcaaatatgtcatggaggatctgcataagattggtgggacacctgcagtcattcattatcttctggagcaaggtcttcttgatggtgattgcatgactgtcactgggaaaactctagccgagaatgccaaaatcttccctcctctgtctgaagggcagcaaataattcgaccacttgacaatcctatcaaatcaactgggcatattcaaatactttatggcaatcttgcaccagaaggttctgtggcaaaaataactggaaaagagggactgttcttctcagggcctgcattagtttttgagggtgaagaatccatgattacagctatctcagaaaacccagcgaatttcaagggaaaggtagtagtgatccgaggagaaggaccaaaaggtgggccagggatgcctgaaatgttgactccaacaagcgcaataatgggtgctggtcttggaaaggaatgtgccctgctgacagatggtagattttccggagggtcacatggatttgttgttggtcacatatgccctgaagcacaggaaggtggcccaattggtcttgtccagagtggtgatgtaatcaccatcgatgtaagtaagagggtaatcgatgttgaccttaccgaacagcagctcgaagaaagacggaggaaatggaccccaccgccatacaagtccacccgtggagctctttggaagtacatcaagcttgtggctccagcgtcgagaggatgtgtcactgatgagtag

SEQ ID NO: 5670 - protein, 591 aa, Sorghum bicolor
  misc_feature: Ceres ANNOT ID no. 6052950
  misc_feature (68)..(590): Pfam Id: ILVD_EDD Pfam Desc: Dehydratase family
  misc_feature (36)..(591): NCBI GI: 87312336 NCBI Desc: dihydroxy-acid dehydratase [blastopirellula marina dsm 3645]
  misc_feature (31)..(591): NCBI GI: 32477320 NCBI Desc: dihydroxy-acid dehydratase [rhodopirellula baltica sh 1]
  misc_feature (31)..(591): NCBI GI: 39931384 NCBI Desc: dihydroxy-acid dehydratase (dad)
  misc_feature (33)..(590): NCBI GI: 115383796 NCBI Desc: dihydroxy-acid dehydratase [aspergillus terreus nih2624]
  misc_feature (36)..(590): NCBI GI: 118497634 NCBI Desc: dihydroxy-acid dehydratase [francisella tularensis subsp. novicida u112]
  misc_feature (31)..(591): SWISSPROT Homolog: EC 4.2.1.9 Dihydroxy-acid dehydratase
MQSMALTSPSLPAAGPVTGRRLQRVRATAVSDEPKLNKYSARITEPKSQGASQAVLYGVGLTDADLRKPQVGVSSVWYEGNTCNMHLLRLAEAVRDGVREAGMVGFRFNTVGVSDAISMGTRGMCYSLQSRDLIADSIETVMGAQHYDANISIPGCDKNMPGTIMAMGRLNRPSIMIYGGTIKPGHFQGNSYDIVSAFQCYGEYVSGSITDEQRKNVLRNSCPGAGACGGMYTANTMASAIETLGMSLPYSSSTPAEDPLKLEECHLAGKYLLELLKMDLKPKDIITEKSLRNAMVIVMALGGSTNAVLHLIAIARSVGLHLTLDDFQKVSDQVPFLADLKPSGKYVMEDLHKIGGTPAVIHYLLEQGLLDGDCMTVTGKTLAENAKIFPPLSEGQQIIRPLDNPIKSTGHIQILYGNLAPEGSVAKITGKEGLFFSGPALVFEGEESMITAISENPANFKGKVVVIRGEGPKGGPGMPEMLTPTSAIMGAGLGKECALLTDGRFSGGSHGFVVGHICPEAQEGGPIGLVQSGDVITIDVSKRVIDVDLTEQQLEERRRKWTPPPYKSTRGALWKYIKLVAPASRGCVTDE

SEQ ID NO: 5671 - DNA, 891 bp, Sorghum bicolor
  misc_feature: Ceres ANNOT ID no. 6052977
  misc_feature: Encodes the peptide sequence at SEQ ID NO 5672
atgtcgcacttcgggaggtcgggtccgccggacatccgcgacaccttctcgctgctcgtcctcaacatcagcttccgcaccacggccgacgacctctacccgctcttcgagcgctacggcaaggtcgtcgacgtcttcatcccgagggaccggaggaccggggactcgaggggtttcgcgttcgtgcggtacaagtatgccgacgaggcgcagaaggctatagatcggctcgatggccgtaatgtggatggaaggaacatcatggtgcagtttgcaaagtacggccccaatgctgagccaatccaaaaaggaagggtcaaagagggggctgagaaatcacgagacaggtcaagaagccgtagtccaaggccaaggaatagagacagagatcatagaaggcgaagtcgaagcaggagtaggagcagagaaaggcatggtcgtgatagagacagggactatcgtcgtcggagcagaagtagaagccgaagtccaagttcaagccctgaccgcaaaagtcatcgtagagcaagagatgatggcaagcgcaagagcaggagtaagagtagaagcaagagcaggagcaggagcaggagcaagagtatgagcagaagcaggagtagaagccgctcgtaccatagtgcttcacctgcccggcgtagtgctagccctcacaagagcccaccgccacggaggagccccactcctgaaaagcataccaatgggaaagattcacctctgtcacgcagtgtttctccatcaccaaagcgtgcaagctcccacagcccaggcagcgatggcaaggttagattgatgtttgactgttggctatttagttttttgcccattcatttaagtatcttacttttgaaagcaaattcacgtcaggaatga

SEQ ID NO: 5672 - protein, 296 aa, Sorghum bicolor
  misc_feature: Ceres ANNOT ID no. 6052977
  misc_feature (18)..(89): Pfam Id: RRM_1 Pfam Desc: RNA recognition motif. (a.k.a. RRM, RBD, or RNP domain)
  misc_feature (1)..(266): NCBI GI: 92896886 NCBI Desc: rna-binding region rnp-1 (rna recognition motif) [medicago truncatula]
  misc_feature (1)..(265): NCBI GI: 9843653 NCBI Desc: splicing factor sc35 [arabidopsis thaliana]
  misc_feature (4)..(222): NCBI GI: 47087067 NCBI Desc: zgc:56283 [danio rerio]
  misc_feature (4)..(227): NCBI GI: 47604918 NCBI Desc: arginine/serine-rich2 splicing factor [gallus gallus]
  misc_feature (4)..(227): NCBI GI: 30583339 NCBI Desc: splicing factor, arginine/serine-rich 2 [homo sapiens]
  misc_feature: Useful for making plants with altered Lignin content
  misc_feature: Useful for making plants with altered alkaloid content
  misc_feature: Functional homolog of the protein sequence given in SEQ ID NO 12946
  misc_feature: Functional homolog of the protein sequence given in SEQ ID NO 12947
  misc_feature: The sequence is a functional homolog of SEQ ID NO. 339 in the 11/188,298 US application
MSHFGRSGPPDIRDTFSLLVLNISFRTTADDLYPLFERYGKVVDVFIPRDRRTGDSRGFAFVRYKYADEAQKAIDRLDGRNVDGRNIMVQFAKYGPNAEPIQKGRVKEGAEKSRDRSRSRSPRPRNRDRDHRRRSRSRSRSRERHGRDRDRDYRRRSRSRSRSPSSSPDRKSHRRARDDGKRKSRSKSRSKSRSRSRSKSMSRSRSRSRSYHSASPARRSASPHKSPPPRRSPTPEKHTNGKDSPLSRSVSPSPKRASSHSPGSDGKVRLMFDCWLFSFLPIHLSILLLKANSRQE

SEQ ID NO: 5673 - DNA, 696 bp, Sorghum bicolor
  misc_feature: Ceres ANNOT ID no. 6052982
  misc_feature: Encodes the peptide sequence at SEQ ID NO 5674
atgtaccaccatctccatggcgaggtggccagcctccgcttcctgtcccctccgagcgcctcgcaccagcaccaccacatgaacatggccttgccgcctccggcctacttcccggcgctgtccttggagctggagtcggctctccaggacgatgctactctactgaccatcatcgacggcggcggcgacacggcttgttttgagcttgacaccatcgtccgggaagccgcagcccacctcgccggcaacaataatggctcgcccagcttgtcgggctcgggctccgacggcgcgggcagagactaccaccagctgggcgctgtgacgatgacaacgacggcggccgccgacgaggagcgccggcgccggaggatggtgtcgaaccgggagtcggcgcggcggtcgcgcatgcgcaagcagcggcagctcagcgagctgtgggcgcaggtctcgcacctccgcggcgccaaccgccgcctcctcgacgacctcaaccgcgcgctcaggagctgcgccgacgcccgccgcgagagcgcgcgcctcagggacgagaaggccgagctggccaacaagctcgaccagctgctgctgctgcaggcggccgccgagaagggcgcccctgccgccgcgtcgacctccagttgctcatcggaggcggagccacgcagcaacaacaccagcagcacaagcacctga

SEQ ID NO: 5674 - protein, 231 aa, Sorghum bicolor
  misc_feature: Ceres ANNOT ID no. 6052982
  misc_feature (116)..(179): Pfam Id: bZIP_1 Pfam Desc: bZIP transcription factor
  misc_feature (119)..(197): NCBI GI: 113367190 NCBI Desc: bzip transcription factor bzip73b [glycine max]
  misc_feature (83)..(195): NCBI GI: 20198170 NCBI Desc: bzip protein (atbzip48) [arabidopsis thaliana]
  misc_feature (118)..(202): NCBI GI: 113367166 NCBI Desc: bzip transcription factor bzip35 [glycine max]
  misc_feature (78)..(226): NCBI GI: 113367218 NCBI Desc: bzip transcription factor bzip124 [glycine max]
  misc_feature (114)..(228): NCBI GI: 22597162 NCBI Desc: bzip transcription factor atb2 [glycine max]
  misc_feature: The sequence is a functional homolog of SEQ ID NO 1342 in the 10/374,780US patent application
  misc_feature: The sequence is a functional homolog of SEQ ID NO 1343 in the 10/374,780US patent application
  misc_feature: Useful for making plants with modulated growth and phenotype characteristics
  misc_feature: The sequence is a functional homolog of SEQ ID NO 1342 in the 20060162006 US patent application
  misc_feature: The sequence is a functional homolog of SEQ ID NO 1343 in the 20060162006 US patent application
MYHHLHGEVASLRFLSPPSASHQHHHMNMALPPPAYFPALSLELESALQDDATLLTIIDGGGDTACFELDTIVREAAAHLAGNNNGSPSLSGSGSDGAGRDYHQLGAVTMTTTAAADEERRRRRMVSNRESARRSRMRKQRQLSELWAQVSHLRGANRRLLDDLNRALRSCADARRESARLRDEKAELANKLDQLLLLQAAAEKGAPAAASTSSCSSEAEPRSNNTSSTST

SEQ ID NO: 5675 - DNA, 930 bp, Sorghum bicolor
  misc_feature: Ceres ANNOT ID no. 6053001
  misc_feature: Encodes the peptide sequence at SEQ ID NO 5676
atgcctacctccgccgccgcctccgccaccgccgcgtgggccaccctatcctccgtcaatccccgccggtcgtcgtctgcgctcaggctcccaccgtccctccgccggtcccttcccagcagactctcatcgtcgtcaccctcgcgctctccgctcgtgccggtctccgccatggcctctcccgccgccgccgcctccggtgagacggcctccaggaagaaactcatcatattcgatgccgaggaggacctcgcggcgtcgctggccaagtacacggcggagttgtcggcaaagttcgcggcggagaggggcgccttcactgtcgtcctctccggcggctccctcgtgaaggccctcaggaaactagcggagccgccgtacctggaggcggtggattggagtaaatggcatgtgttctgggtggatgagagggtggtgcccaaggatcacgcggatagcaactacaagctcgcctcagatgagttcctctctaaggtgccaattcctgctgaccaagtttatgccataaatgatgcactgtcatccgagggtgctgcagaggattatgaaactcgtttaaagcaacttgttaaggatggtgtgattgaaacatcaacagtgtccgggttccccaagttcgatcttatgcttatggggatgggacctgatggccacattgcctcactcttccctggccaccctgtagtcaatgaaaaccagaagtgggtcacctttgtcaaggattctccgaagccaccaccagagagaataaccttcactttcccggtgataaattcgtcagcgcacatcgcacttgtggtcaccggtgccggcaaagctggtgctgttcataaaagcactttcgggagggatggggagctcatttggttcactgacaagccagcggtgtcaatgttgtcaagcatttga

SEQ ID NO: 5676 - protein, 309 aa, Sorghum bicolor
  misc_feature: Ceres ANNOT ID no. 6053001
  misc_feature (88)..(309): Pfam Id: Glucosamine_iso Pfam Desc: Glucosamine-6-phosphate isomerases/6-phosphogluconolactonase
  misc_feature (72)..(306): NCBI GI: 21554291 NCBI Desc: 6-phosphogluconolactonase-like protein [arabidopsis thaliana]
  misc_feature (72)..(306): NCBI GI: 10177901 NCBI Desc: 6-phosphogluconolactonase-like protein [arabidopsis thaliana]
  misc_feature (77)..(306): NCBI GI: 21536675 NCBI Desc: 6-phosphogluconolactonase-like protein [arabidopsis thaliana]
  misc_feature (71)..(306): NCBI GI: 21537412 NCBI Desc: 6-phosphogluconolactonase-like protein [arabidopsis thaliana]
  misc_feature (71)..(306): NCBI GI: 10177903 NCBI Desc: 6-phosphogluconolactonase-like protein [arabidopsis thaliana]
  misc_feature: The plant flowers significantly late compared to wild-type.
  misc_feature: The plant produces a reduced number of seeds.
  misc_feature: Useful for biocontainment applications
  misc_feature: Useful for making plants with modulated flowering time
  misc_feature: Functional homolog of the protein sequence given in SEQ ID NO 13189
  misc_feature: Useful for biocontainment applications
  misc_feature: Useful for making plants with modulated flowering time
  misc_feature: Functional homolog of the protein sequence given in SEQ ID NO 13189
MPTSAAASATAAWATLSSVNPRRSSSALRLPPSLRRSLPSRLSSSSPSRSPLVPVSAMASPAAAASGETASRKKLIIFDAEEDLAASLAKYTAELSAKFAAERGAFTVVLSGGSLVKALRKLAEPPYLEAVDWSKWHVFWVDERVVPKDHADSNYKLASDEFLSKVPIPADQVYAINDALSSEGAAEDYETRLKQLVKDGVIETSTVSGFPKFDLMLMGMGPDGHIASLFPGHPVVNENQKWVTFVKDSPKPPPERITFTFPVINSSAHIALVVTGAGKAGAVHKSTFGRDGELIWFTDKPAVSMLSSI

SEQ ID NO: 5677 - DNA, 1125 bp, Sorghum bicolor
  misc_feature: Ceres ANNOT ID no. 6053030
  misc_feature: Encodes the peptide sequence at SEQ ID NO 5678
atggcgccgccggagctcatggacgacctcatcggcgagatcctcctccgcctcccgccggaagatccagggtgccttgtccgcgcgtccctcgtctgcaagccctggcgtcgcctcctctccgatccgagcttcccccgccgctaccgcgagttccacggagtgccacccctgctcggcttcctccactacgtcaaaaagtgcggagatttccttagccccttcttccccagcttcttccccatcaaagaagcttctcctatcctcaaccccccgccggagcctaaatcctatatcctcgactgccgccacggccgcgtgctcctcttcaactacagtaacaaagatctcatcgtgtgggaccccatcaccaacagccggcaggaccttgggtggcctcccaagttggagcactatttctgcttcagggcagcggtgctctgtgccttggacggctgcgaccacctcagttgccgtggtggtcccttcctcgtggtcttagtagccatcgacttcccaaacgagattggcggtgacggtgcatcagctagaacctactcatctgagactggcgcatggagtacaggtgtctcatcacttcacgttggcttccccatgaatggccacaagatgattgggagcagcctacttgccagaggcgccctatatttcatgctcgataaaggccggagcatcctcaagtatgacttggctgggtgtggcatgtcggtgatgagcgcaccacccttcactggccctgtgggaaacatggtgctcgtcaaggcagagggcggcggcctgggagcctgcggtgtggagggccacaacctgcacctgtgggcgtggcggagtactggtggccccaatggcggcattccggaatgggagaggagcagggttatggatatccagcttgacattgctgacctgtctacacagcttgatgtagttgattttgcggaaggtgctggttccatgttcgtattggcaaacaaggacgtctttgctgttgacctaaaatctggccgggccaggaagataggaaagcgagggaggttcaaggtcatctttcccttcatgagcttctatagcctcatgcccactgatttatttccacagtcgtaa

SEQ ID NO: 5678 - protein, 374 aa, Sorghum bicolor
  misc_feature: Ceres ANNOT ID no. 6053030
  misc_feature (1)..(51): Pfam Id: F-box Pfam Desc: F-box domain
  misc_feature (1)..(363): NCBI GI: 115470391 NCBI Desc: os07g0122900 [oryza sativa (japonica cultivar-group)]
  misc_feature (1)..(363): NCBI GI: 115437584 NCBI Desc: os01g0557400 [oryza sativa (japonica cultivar-group)]
  misc_feature (89)..(364): NCBI GI: 115475786 NCBI Desc: os08g0299900 [oryza sativa (japonica cultivar-group)]
  misc_feature (19)..(362): NCBI GI: 115481210 NCBI Desc: os10g0158700 [oryza sativa (japonica cultivar-group)]
  misc_feature (2)..(364): NCBI GI: 115481076 NCBI Desc: os10g0137700 [oryza sativa (japonica cultivar-group)]
  misc_feature: The sequence is a functional homolog of SEQ ID NO. 456 in the 11/188,298 US application
MAPPELMDDLIGEILLRLPPEDPGCLVRASLVCKPWRRLLSDPSFPRRYREFHGVPPLLGFLHYVKKCGDFLSPFFPSFFPIKEASPILNPPPEPKSYILDCRHGRVLLFNYSNKDLIVWDPITNSRQDLGWPPKLEHYFCFRAAVLCALDGCDHLSCRGGPFLVVLVAIDFPNEIGGDGASARTYSSETGAWSTGVSSLHVGFPMNGHKMIGSSLLARGALYFMLDKGRSILKYDLAGCGMSVMSAPPFTGPVGNMVLVKAEGGGLGACGVEGHNLHLWAWRSTGGPNGGIPEWERSRVMDIQLDIADLSTQLDVVDFAEGAGSMFVLANKDVFAVDLKSGRARKIGKRGRFKVIFPFMSFYSLMPTDLFPQS

SEQ ID NO: 5679 - DNA, 630 bp, Sorghum bicolor
  misc_feature: Ceres ANNOT ID no. 6053108
  misc_feature: Encodes the peptide sequence at SEQ ID NO 5680
atggaggtggtggtgctggacaacgacgttgcgggggtggcggcaggaggacagtaccgtggcgtgaggaagaggaagtgggggaagtgggtgtcggagatcagagagcccggcaagaagacgcgcatctggctgggcagcttcgagtccccggagatggcggcggtggcgcacgacgtggccgcgctgcgcctgcgcggccgcgaggccaggctcaacttcccgggcctcgtccaccgcttccgccgcccggccaccgccgagcccgacgacgtccgcgccgccgcgctcgaggccgccgcccaggtccggttcaggcccgacctcgtcgtaatgcatcatcgtcatcaggccgccggcgacggcgaggtcgtcggctgctgctacggcggcggtggcagcggcagcggcagcgacgcaggcagcccggagccgctggtcggcgacgacgtggcgtgggacgccttgctcgggaccgacgagctggcggcagaggcagagtcgcccaagatgtgggctgagctggccgaggccatgctcatggcccctcctgtatgggagggcagtatggccgacaatgacgagtgggcccagggaaatctctgggacctacctgtctggaactgctaa

SEQ ID NO: 5680 - protein, 209 aa, Sorghum bicolor
  misc_feature: Ceres ANNOT ID no. 6053108
  misc_feature (17)..(68): Pfam Id: AP2 Pfam Desc: AP2 domain
  misc_feature (11)..(203): NCBI GI: 21742878 NCBI Desc: osjnba0058g03.2 [oryza sativa (japonica cultivar-group)]
  misc_feature (19)..(111): NCBI GI: 32455220 NCBI Desc: transcription factor [oryza sativa (japonica cultivar-group)]
  misc_feature (19)..(111): NCBI GI: 116310707 NCBI Desc: osigba0134h18.7 [oryza sativa (indica cultivar-group)]
  misc_feature (19)..(105): NCBI GI: 125995279 NCBI Desc: embryonic element binding factor 1 [daucus carota]
  misc_feature (6)..(103): NCBI GI: 76593967 NCBI Desc: transcription factor drebiii-2 [brassica napus]
  misc_feature: The sequence is a functional homolog of SEQ ID NO 1050 in the 10/666,642US patent application
  misc_feature: The sequence is a functional homolog of SEQ ID NO 1222 in the 10/374,780US patent application
  misc_feature: The sequence is a functional homolog of SEQ ID NO 1223 in the 10/374,780US patent application
  misc_feature: The sequence is a functional homolog of SEQ ID NO 1232 in the 10/374,780US patent application
  misc_feature: The sequence is a functional homolog of SEQ ID NO 1233 in the 10/374,780US patent application
  misc_feature: The sequence is a functional homolog of SEQ ID NO 1234 in the 10/374,780US patent application
  misc_feature: The sequence is a functional homolog of SEQ ID NO 1291 in the 10/374,780US patent application
  misc_feature: The sequence is a functional homolog of SEQ ID NO 1411 in the 10/412,699US patent application
  misc_feature: The sequence is a functional homolog of SEQ ID NO 1412 in the 10/412,699US patent application
  misc_feature: The sequence is a functional homolog of SEQ ID NO 1530 in the 11/479,226US patent application
  misc_feature: The sequence is a functional homolog of SEQ ID NO 164 in the 11/375,241US patent application
  misc_feature: The sequence is a functional homolog of SEQ ID NO 1781 in the 11/479,226US patent application
  misc_feature: The sequence is a functional homolog of SEQ ID NO 188 in the 11/375,241US patent application
  misc_feature: The sequence is a functional homolog of SEQ ID NO 206 in the 10/374,780US patent application
  misc_feature: The sequence is a functional homolog of SEQ ID NO 2233 in the 10/666,642US patent application
  misc_feature: The sequence is a functional homolog of SEQ ID NO 239 in the 11/479,226US patent application
  misc_feature: The sequence is a functional homolog of SEQ ID NO 26 in the 10/374,780US patent application
  misc_feature: The sequence is a functional homolog of SEQ ID NO 270 in the 10/374,780US patent application
  misc_feature: The sequence is a functional homolog of SEQ ID NO 2820 in the 10/374,780US patent application
  misc_feature: The sequence is a functional homolog of SEQ ID NO 4 in the 10/225,066US patent application
  misc_feature: The sequence is a functional homolog of SEQ ID NO 436 in the 11/435,388US patent application
  misc_feature: The sequence is a functional homolog of SEQ ID NO 44 in the 10/225,066US patent application
  misc_feature: The sequence is a functional homolog of SEQ ID NO 440 in the 11/435,388US patent application
  misc_feature: The sequence is a functional homolog of SEQ ID NO 442 in the 10/225,066US patent application
  misc_feature: The sequence is a functional homolog of SEQ ID NO 489 in the 10/374,780US patent application
  misc_feature: The sequence is a functional homolog of SEQ ID NO 682 in the 10/666,642US patent application
  misc_feature: The sequence is a functional homolog of SEQ ID NO 712 in the 11/435,388US patent application
  misc_feature: The sequence is a functional homolog of SEQ ID NO 716 in the 11/435,388US patent application
  misc_feature: The sequence is a functional homolog of SEQ ID NO 718 in the 11/435,388US patent application
  misc_feature: The sequence is a functional homolog of SEQ ID NO 734 in the 10/412,699US patent application
  misc_feature: The sequence is a functional homolog of SEQ ID NO 76 in the 10/225,068US patent application
  misc_feature: The sequence is a functional homolog of SEQ ID NO 776 in the 11/435,388US patent application
  misc_feature: The sequence is a functional homolog of SEQ ID NO 778 in the 11/435,388US patent application
  misc_feature: The sequence is a functional homolog of SEQ ID NO 780 in the 11/435,388US patent application
  misc_feature: The sequence is a functional homolog of SEQ ID NO 96 in the 10/714,887US patent application
  misc_feature: The sequence is a functional homolog of SEQ ID NO 96 in the 11/435,388US patent application
  misc_feature: The sequence is a functional homolog of SEQ ID NO 98 in the 10/412,699US patent application
  misc_feature: The sequence is a functional homolog of SEQ ID NO 989 in the 10/412,699US patent application
  misc_feature: Useful for making plants with modulated growth and phenotype characteristics
  misc_feature: The sequence is a functional homolog of SEQ ID NO 1411 in the 20040045049 US patent application
  misc_feature: The sequence is a functional homolog of SEQ ID NO 1412 in the 20040045049 US patent application
  misc_feature: The sequence is a functional homolog of SEQ ID NO 734 in the 20040045049 US patent application
  misc_feature: The sequence is a functional homolog of SEQ ID NO 98 in the 20040045049 US patent application
  misc_feature: The sequence is a functional homolog of SEQ ID NO 989 in the 20040045049 US patent application
  misc_feature: The sequence is a functional homolog of SEQ ID NO 4 in the 20050160493 US patent application
  misc_feature: The sequence is a functional homolog of SEQ ID NO 44 in the 20050160493 US patent application
  misc_feature: The sequence is a functional homolog of SEQ ID NO 442 in the 20050160493 US patent application
  misc_feature: The sequence is a functional homolog of SEQ ID NO 96 in the 20060015972 US patent application
  misc_feature: The sequence is a functional homolog of SEQ ID NO 1232 in the 20060162006 US patent application
  misc_feature: The sequence is a functional homolog of SEQ ID NO 1233 in the 20060162006 US patent application
  misc_feature: The sequence is a functional homolog of SEQ ID NO 1234 in the 20060162006 US patent application
  misc_feature: The sequence is a functional homolog of SEQ ID NO 1291 in the 20060162006 US patent application
  misc_feature: The sequence is a functional homolog of SEQ ID NO 776 in the 20060272060 US patent application
  misc_feature: The sequence is a functional homolog of SEQ ID NO 778 in the 20060272060 US patent application
  misc_feature: The sequence is a functional homolog of SEQ ID NO 780 in the 20060272060 US patent application
  misc_feature: The sequence is a functional homolog of SEQ ID NO 1050 in the 20070033671 US patent application
  misc_feature: The sequence is a functional homolog of SEQ ID NO. 274 in the 11/188,298 US application
MEVVVLDNDVAGVAAGGQYRGVRKRKWGKWVSEIREPGKKTRIWLGSFESPEMAAVAHDVAALRLRGREARLNFPGLVHRFRRPATAEPDDVRAAALEAAAQVRFRPDLVVMHHRHQAAGDGEVVGCCYGGGGSGSGSDAGSPEPLVGDDVAWDALLGTDELAAEAESPKMWAELAEAMLMAPPVWEGSMADNDEWAQGNLWDLPVWNC

SEQ ID NO: 5681 - DNA, 396 bp, Sorghum bicolor
  misc_feature: Ceres ANNOT ID no. 6053184
  misc_feature: Encodes the peptide sequence at SEQ ID NO 5682
atggacggcggcggcacgcaccgcacgccggaagacgtgttccgggacttccgcgcgcggcgggctggcatgatcaaagcgctcaccaccgagaaagagaatctgtgtttgtatggtcttcccaatgaaacatgggaagtgaacttgcctgcagaggaggttcctcctgaacttccagagccagctctgggaattaattttgctcgtgacgggatggatgagaaagattggctgtcactagtagcggtgcacagtgatgcttggttgctggctgtggccttttactttggtgcaagatttggatttgacaaagaatccagttgttctgtaccattctttgtaaccaatttttcatcaaaatttaaaggtgaattgggcatcagtgcatacaaatga

SEQ ID NO: 5682 - protein, 131 aa, Sorghum bicolor
  misc_feature: Ceres ANNOT ID no. 6053184
  misc_feature (1)..(104): NCBI GI: 3319341 NCBI Desc: similar to medicago sativa nucleic acid binding protein alfin-1 (gb:l07291) [arabidopsis thaliana]
  misc_feature (1)..(103): NCBI GI: 115394650 NCBI Desc: phd2 [glycine max]
  misc_feature (1)..(104): NCBI GI: 115394658 NCBI Desc: phd6 [glycine max]
  misc_feature (1)..(104): NCBI GI: 73921146 NCBI Desc: phd finger protein at5g26210
  misc_feature (1)..(104): NCBI GI: 110740836 NCBI Desc: nucleic acid binding protein - like [arabidopsis thaliana]
  misc_feature: The sequence is a functional homolog of SEQ ID NO 1052 in the 10/225,066US patent application
  misc_feature: The sequence is a functional homolog of SEQ ID NO 2552 in the 10/374,780US patent application
  misc_feature: Useful for making plants with modulated growth and phenotype characteristics
  misc_feature: The sequence is a functional homolog of SEQ ID NO 1052 in the 20050160493 US patent application
  misc_feature: The sequence is a functional homolog of SEQ ID NO 1052 in the 10/225,066 US patent application
  misc_feature: The sequence is a functional homolog of SEQ ID NO 2552 in the 10/374,780 US patent application
  misc_feature: The sequence is a functional homolog of SEQ ID NO 1981 in the 11/479,226 US patent application
  misc_feature: Useful for making plants with altered alkaloid content
  misc_feature: Functional homolog of the protein sequence given in SEQ ID NO 13176
  misc_feature: The sequence is a functional homolog of SEQ ID NO 1645 in the 11/479,226 US patent application
  misc_feature: The sequence is a functional homolog of SEQ ID NO 782 in the 10/412,699 US patent application
  misc_feature: The sequence is a functional homolog of SEQ ID NO 816 in the 10/412,699 US patent application
  misc_feature: Useful for making plants with altered lignin content
  misc_feature: Useful for making plants with modulated flowering time
  misc_feature: Functional homolog of the protein sequence given in SEQ ID NO 13473
  misc_feature: The sequence is a functional homolog of SEQ ID NO. 482 in the 11/188,298 US application
MDGGGTHRTPEDVFRDFRARRAGMIKALTTEKENLCLYGLPNETWEVNLPAEEVPPELPEPALGINFARDGMDEKDWLSLVAVHSDAWLLAVAFYFGARFGFDKESSCSVPFFVTNFSSKFKGELGISAYK

SEQ ID NO: 5683 - DNA, 1413 bp, Sorghum bicolor
  misc_feature: Ceres ANNOT ID no. 6053186
  misc_feature: Encodes the peptide sequence at SEQ ID NO 5684
atggctcgtgtcgccgccatagtggtgctggtgctcctcctgcagctggcctcctcctcgtacctcgtcgcggcccacgccgatgctgtcagcgtgcttggccgcaaggccggcgtcgtcgacgagcctcccttggagaacgcgccggcggttgggccggggaggtacgccgtcatcttcgacgccggcagcacggggagccgagtgtacgttttcaggttcgacaggcagatggaccttctccgcatcggcgatgagatcgaattcttcgccaaggtgaaaccaggcctgagctcgtatgctggacagcctcaagaggccgcaaagtccattctgcctcttcttgacaaggctaagcgcattgtcccttcatggcttatgaaaaggacaccactgaagcttggagcaactgctggattacgcctcatcggaaaccaacaagcagaccaaattcttgatgcggtcagagatcttgtccacaaaaagagcaaattccagtgcaagtccaactgtatcaatgttcttgagggatctcaggaaggatcctacctatgggttgctctgaattatttgttggataaactgggaggggactattcccagacggtaggcgtgattgatatgggtggtggatcggtgcaaatggcctatgctgtttcttcatattctgctgcgagagctcccgctgtgcctgacggcgaggatccctatattaccaaagagtattttaaaggaaaagagtacaatgtatatgttcacagctacttgcactatggttcctttgcatcacgagcggagattttgaagtccaagaatggaccattcagcttctgcatgctgcgcggatttagtggtaaatacacctataatggacagcaatacgatgcaattgctagaccagaaggagcattatatgaaaaatgtagggaagagatcaccaaggcactgaatctgaaggcaccatgcaagacaaagaactgcaccttcggtggtgtgtggaatgggggaggtggagctggacaaaacaatatctacgttgcatcaggcttctactaccttgcctcacatgaactgaatttcctcacttgcattggcaaggttgggttcatagatagcaaagctcccagcgcgaaggccgctcctgccgcattcagggctgctgctaagaaggcttgccaattggatgtcaagaaagcaaaagttgcctacccaaatatttctgatagtgatgtgccatacttgtgtatggatcttacttacacgtacacattgctcgttgacggcttcggtctgcagccaatgaaaaagatcacatttgtatccaaggtgaagcatggcgagtactacatggaagccgcctggcctctgggtactgctattgaggctgtgtcaccgatactaaacggtgattaa

SEQ ID NO: 5684 - protein, 470 aa, Sorghum bicolor
  misc_feature: Ceres ANNOT ID no. 6053186
  misc_feature (47)..(470): Pfam Id: GDA1_CD39 Pfam Desc: GDA1/CD39 (nucleoside phosphatase) family
  misc_feature (1)..(464): NCBI GI: 62732856 NCBI Desc: apyrase [oryza sativa (japonica cultivar-group)]
  misc_feature (93)..(464): NCBI GI: 62732863 NCBI Desc: s-type apyrase [oryza sativa (japonica cultivar-group)]
  misc_feature (56)..(466): NCBI GI: 6006797 NCBI Desc: apyrase [dolichos biflorus]
  misc_feature (56)..(466): NCBI GI: 11225137 NCBI Desc: apyrase gs52 [glycine soja]
  misc_feature (11)..(466): NCBI GI: 11225135 NCBI Desc: apyrase gs50 [glycine soja]
  misc_feature (56)..(466): SWISSPROT Homolog: EC 3.6.1.15 Nucleoside-triphosphatase
  misc_feature (56)..(468): SWISSPROT Homolog: EC 3.6.1.5 Apyrase precursor
MARVAAIVVLVLLLQLASSSYLVAAHADAVSVLGRKAGVVDEPPLENAPAVGPGRYAVIFDAGSTGSRVYVFRFDRQMDLLRIGDEIEFFAKVKPGLSSYAGQPQEAAKSILPLLDKAKRIVPSWLMKRTPLKLGATAGLRLIGNQQADQILDAVRDLVHKKSKFQCKSNCINVLEGSQEGSYLWVALNYLLDKLGGDYSQTVGVIDMGGGSVQMAYAVSSYSAARAPAVPDGEDPYITKEYFKGKEYNVYVHSYLHYGSFASRAEILKSKNGPFSFCMLRGFSGKYTYNGQQYDAIARPEGALYEKCREEITKALNLKAPCKTKNCTFGGVWNGGGGAGQNNIYVASGFYYLASHELNFLTCIGKVGFIDSKAPSAKAAPAAFRAAAKKACQLDVKKAKVAYPNISDSDVPYLCMDLTYTYTLLVDGFGLQPMKKITFVSKVKHGEYYMEAAWPLGTAIEAVSPILNGD

SEQ ID NO: 5685 - DNA, 894 bp, Sorghum bicolor
  misc_feature: Ceres ANNOT ID no. 6053256
  misc_feature: Encodes the peptide sequence at SEQ ID NO 5686
atgccctttactgggtccgtccctggtttcatagttaggctggttggggttcggccaagctgctgtcctccttcccgtgcatttgcggctgtcagagctcaaaagattcagcttcccaagaaaaaaaggcgattggatgaagtgtgcttagaaaggtttcaacaatacagtagaacatacatccagtcatggattcttcaaggtaaagtcattgtggatggaagagttgtgaataaagctggaacacaagtatctgacaagtctgtcatcgaaatcaaggctgaaatcccaaaatatgtatgtagagcaggacataagcttgaggcagctatcaaaggatttgatattgattgtgagggaaagatagcccttgattcaggattatctacaggtggctttactgactgcttacttcagcatggagcatcacatgtttatggtgtagatgttggctatggacaggtggctgaaaaaattcgcacacatgaacgtgtttcagtgatcgaacgcacaaatttaagatatctatctcaactgccagaaccggttgatttggtgacactggacctatcatttatctccattctcttggtcatgcctgctgttatcaaagtaatgaagccggattctatattgataacacttatcaagcctcaatttgaagcacgtagatcacaggtaggaggtggagggattgttcgagatcctctggttcataaagaggtactggatagaataatttcaggcgtggaagaatttggattctgcaataagggttggatcgaatctcctataaagggtgcagaagggaataaggagttccttgcttgctttcacaggatcccaatatcagaatcacagccagatgtagaggcaaaggaacctgtaacatag

SEQ ID NO: 5686 - protein, 297 aa, Sorghum bicolor
  misc_feature: Ceres ANNOT ID no. 6053256
  misc_feature (99)..(282): Pfam Id: FtsJ Pfam Desc: FtsJ-like methyltransferase
  misc_feature (43)..(90): Pfam Id: S4 Pfam Desc: S4 domain
  misc_feature (38)..(275): NCBI GI: 76796738 NCBI Desc: hemolysin a [thermoanaerobacter ethanolicus atcc 33223]
  misc_feature (38)..(275): NCBI GI: 114844755 NCBI Desc: hemolysin a [thermoanaerobacter ethanolicus x514]
  misc_feature (38)..(278): NCBI GI: 82749345 NCBI Desc: hemolysin a [clostridium beijerincki ncimb 8052]
  misc_feature (39)..(278): NCBI GI: 121541356 NCBI Desc: rrna methylase [candidatus desulfococcus oleovorans hxd3]
  misc_feature (38)..(280): NCBI GI: 109645428 NCBI Desc: hemolysin a [desulfitobacterium hafniense dcb-2]
MPFTGSVPGFIVRLVGVRPSCCPPSRAFAAVRAQKIQLPKKKRRLDEVCLERFQQYSRTYIQSWILQGKVIVDGRVVNKAGTQVSDKSVIEIKAEIPKYVCRAGHKLEAAIKGFDIDCEGKIALDSGLSTGGFTDCLLQHGASHVYGVDVGYGQVAEKIRTHERVSVIERTNLRYLSQLPEPVDLVTLDLSFISILLVMPAVIKVMKPDSILITLIKPQFEARRSQVGGGGIVRDPLVHKEVLDRIISGVEEFGFCNKGWIESPIKGAEGNKEFLACFHRIPISESQPDVEAKEPVT

SEQ ID NO: 5687 - DNA, 1041 bp, Sorghum bicolor
  misc_feature: Ceres ANNOT ID no. 6053365
  misc_feature: Encodes the peptide sequence at SEQ ID NO 5688
atggccggcagcagcagcgaggagaaagcggtggcggcggtgcagaacaagaaggtggtgctgaggaggcacgtcaccgggttccccaccgaagacgacatggagatcacggtggacactaccgagattcgtgtgccggcggggcagaccgccgtgctgctcaagaacctctacctgtcctgtgacccatggatgcgcggccgcatgaccaagcacgaagacggcgcctccgtgccggccaccgactttgcgatcggagaggccatggtcaactacggtgtcggcaaggtgatagactcgacgcacccagagttcaccggcggcgacctcgtctgggggatgagtggatgggaagagtacacactcatcacccagccggaatccctgcacaagatcaaccacgccgacctgccgctctcctactacaccggcgttcttgggttcacccaggtcggcaggcccaaaaagggcgacttcgtgttcgtctcggcggcgtcaggcgccgtcgggcagctcgtcggtcagctggcgaagatcgccggctgctacgtggtcggcagcgccggctccgacgagaaggtgggtctgctcaagaccaagttcggctacgacgacgcgttcaactacaagtccgagaccgacctcggcgccgcgctgaagcggcgcctccccgacggcgtcgacatctacttcgacaacgtcggcggcgcgacgctggacgccgcgctgctgcacatgcgcgacggcggcagggtcgccgtctgcgggatgatctcgcagtacaacctggaggagcgagacggcctgcgcaacctgtactgcgtcatccccaaggccatcagggtggaggggttcaatgttggccgcttcttccatctgtacgagaggttcgaggaggagatggctgggtacatcaaggacgggaaggtcgccgtcgttgaggacgtcgtcgagggtattgaaagcgcaccggcagctctgatcgggctgttctcgggcaaaaatgtggggaagcaggtggttgcgattgcaagggcatga

SEQ ID NO: 5688 - protein, 346 aa, Sorghum bicolor
  misc_feature: Ceres ANNOT ID no. 6053365
  misc_feature (156)..(306): Pfam Id: ADH_zinc_N Pfam Desc: Zinc-binding dehydrogenase
  misc_feature (10)..(345): NCBI GI: 62765876 NCBI Desc: 2-alkenal reductase [hordeum vulgare subsp. vulgare]
  misc_feature (13)..(345): NCBI GI: 116310695 NCBI Desc: h0306b06.9 [oryza sativa (indica cultivar-group)]
  misc_feature (14)..(345): NCBI GI: 6692816 NCBI Desc: allyl alcohol dehydrogenase [nicotiana tabacum]
  misc_feature (16)..(345): NCBI GI: 21554121 NCBI Desc: quinone oxidoreductase-like protein [arabidopsis thaliana]
  misc_feature (16)..(345): NCBI GI: 886430 NCBI Desc: zeta-crystallin homologue [arabidopsis thaliana]
  misc_feature: Useful for biocontainment applications
  misc_feature: Useful for making plants with modulated nitrogen use efficiency
  misc_feature: Functional homolog of the protein sequence given in SEQ ID NO 12982
MAGSSSEEKAVAAVQNKKVVLRRHVTGFPTEDDMEITVDTTEIRVPAGQTAVLLKNLYLSCDPWMRGRMTKHEDGASVPATDFAIGEAMVNYGVGKVIDSTHPEFTGGDLVWGMSGWEEYTLITQPESLHKINHADLPLSYYTGVLGFTQVGRPKKGDFVFVSAASGAVGQLVGQLAKIAGCYVVGSAGSDEKVGLLKTKFGYDDAFNYKSETDLGAALKRRLPDGVDIYFDNVGGATLDAALLHMRDGGRVAVCGMISQYNLEERDGLRNLYCVIPKAIRVEGFNVGRFFHLYERFEEEMAGYIKDGKVAVVEDVVEGIESAPAALIGLFSGKNVGKQVVAIARA

SEQ ID NO: 5689 - DNA, 1041 bp, Sorghum bicolor; identical to SEQ ID NO: 5687
  misc_feature: Ceres ANNOT ID no. 6053369
  misc_feature: Encodes the peptide sequence at SEQ ID NO 5690

SEQ ID NO: 5690 - protein, 346 aa, Sorghum bicolor; identical to SEQ ID NO: 5688
  misc_feature: Ceres ANNOT ID no. 6053369
  misc_feature (156)..(306): Pfam Id: ADH_zinc_N Pfam Desc: Zinc-binding dehydrogenase
  misc_feature (10)..(345): NCBI GI: 62765876 NCBI Desc: 2-alkenal reductase [hordeum vulgare subsp. vulgare]
  misc_feature (13)..(345): NCBI GI: 116310695 NCBI Desc: h0306b06.9 [oryza sativa (indica cultivar-group)]
  misc_feature (14)..(345): NCBI GI: 6692816 NCBI Desc: allyl alcohol dehydrogenase [nicotiana tabacum]
  misc_feature (16)..(345): NCBI GI: 21554121 NCBI Desc: quinone oxidoreductase-like protein [arabidopsis thaliana]
  misc_feature (16)..(345): NCBI GI: 886430 NCBI Desc: zeta-crystallin homologue [arabidopsis thaliana]
  misc_feature: Useful for biocontainment applications
  misc_feature: Useful for making plants with modulated nitrogen use efficiency
  misc_feature: Functional homolog of the protein sequence given in SEQ ID NO 12982

SEQ ID NO: 5691 - DNA, 1431 bp, Sorghum bicolor
  misc_feature: Ceres ANNOT ID no. 6053404
  misc_feature: Encodes the peptide sequence at SEQ ID NO 5692
atgaacgctgctgcaatcatctcccgacttggcctcgccacctcagggtctggggccgggtcccacgcggactgccggccgccgacgccggcggtgggtttcacggcggggccgagagcgcgcccagttgccgtcgtcgccgccgcctcctcctcttctccggcgaccggtggcgtggcgccggtgccaccccgctccaatcactcggtcataaagcgtcacacactatcagtttttgttggtgatgaaagtgggatgatcaatcgaattgctggggtttttgctagaagaggatataacatcgagtcattggctgttgggttgaacaaggataaagcattatttacaatagttgtgtcaggaacagacaaaatattgaaccaggttgtagagcaactaaacaaacttgttaatgtaataaaggttgatgacttatcaatggaaccacaagttgaaagagaacttatgcttataaaagtaaatgcagagcgggaaaagctacctgagataatgggtttggttcgcattttcaaagcagaagtggttgatctttcagaccatacactaactattgaggtaactggagatcctggaaagatggttgcaatacagaagactctgagcaaatatgggatcagagaaattgctagaactggcaagatagctttacgccgtgaaagaatgggagaaactgctccattttggaggttctctgcagcttcttatcctgatctcgaaatggcaataccttcaaatttccagcaaaacactggtgcgagggcaatcgatcagaatacagaaggatcttcagggggtgatgtttatccagtggaatcttatgaaagcttctcatcaagtcaaattctggatgctcattggggtgttatgactgatggtgatccaacagggttttgttcacatactctatcaattcttgtgaatgatgtccctggagttctcaatgttgtaacaggtgttttctccagaaggggctacaatattcagagtcttgctgttggtccagctgcaaaagaaggaacttctcgcatcactactgttgttcctggaaatgatgaatccattgccaagctagtacatcaactgtacaagctcattgatgttcatgaggtccaggattttactcacttaccatttgttggtagagagttaatgatcataaaggttgctgcaaatgctacagcccgaagggatgtcttagatattgctcagatttttgaggcacagaaagttgacatatctgatcacacaattacactactgctcaccggagacattgacagaatggttagattgcaaaagatgctggagcaatatggtatctgtgaggttgcacgaacaggacgggttgctctgctccgtgagtctggagttgactccaaatacctccgtgggttttccctccctctgtaa

SEQ ID NO: 5692 - protein, 476 aa, Sorghum bicolor
  misc_feature: Ceres ANNOT ID no. 6053404
  misc_feature (74)..(138): Pfam Id: ACT Pfam Desc: ACT domain
  misc_feature (307)..(373): Pfam Id: ACT Pfam Desc: ACT domain
  misc_feature (1)..(300): NCBI GI: 115484977 NCBI Desc: os11g0256000 [oryza sativa (japonica cultivar-group)]
  misc_feature (86)..(453): NCBI GI: 5931761 NCBI Desc: acetolactate synthase small subunit [nicotiana plumbaginifolia]
  misc_feature (142)..(476): NCBI GI: 144924647 NCBI Desc: acetolactate synthase, small subunit [medicago truncatula]
  misc_feature (307)..(470): NCBI GI: 67921725 NCBI Desc: acetolactate synthase, small subunit [crocosphaera watsonii wh 8501]
  misc_feature (307)..(470): NCBI GI: 126657041 NCBI Desc: acetolactate synthase small subunit [cyanothece sp. ccy0110]
  misc_feature (307)..(470): SWISSPROT Homolog: EC 2.2.1.6 Acetolactate synthase small subunit
MNAAAIISRLGLATSGSGAGSHADCRPPTPAVGFTAGPRARPVAVVAAASSSSPATGGVAPVPPRSNHSVIKRHTLSVFVGDESGMINRIAGVFARRGYNIESLAVGLNKDKALFTIVVSGTDKILNQVVEQLNKLVNVIKVDDLSMEPQVERELMLIKVNAEREKLPEIMGLVRIFKAEVVDLSDHTLTIEVTGDPGKMVAIQKTLSKYGIREIARTGKIALRRERMGETAPFWRFSAASYPDLEMAIPSNFQQNTGARAIDQNTEGSSGGDVYPVESYESFSSSQILDAHWGVMTDGDPTGFCSHTLSILVNDVPGVLNVVTGVFSRRGYNIQSLAVGPAAKEGTSRITTVVPGNDESIAKLVHQLYKLIDVHEVQDFTHLPFVGRELMIIKVAANATARRDVLDIAQIFEAQKVDISDHTITLLLTGDIDRMVRLQKMLEQYGICEVARTGRVALLRESGVDSKYLRGFSLPL

SEQ ID NO: 5693 - DNA, 1713 bp, Sorghum bicolor
  misc_feature: Ceres ANNOT ID no. 6053442
  misc_feature: Encodes the peptide sequence at SEQ ID NO 5694
atgccagcacgaccctcaaccgccgccgccgtcctcgtccgcctcatcaccgccgccgccaccgtgtcctcctccccggcctccctgcgcgccctcctccccatccacgcccgcgccatcgtcctcggcgtatccgcgaacctggccttcgccaccagcctcatcgccggcgcggcgcccgcctctctcgcctacgcacgcagggtgttcgacgccgcgcctgtacgcgatgcctacatgtggaacacgctcctccgcgcgcacgcccactcccactcccactcccagtcgtcgcactcgcacgccgtcgacgccctcgccctctacaagcggatgcgcgccgcgggcgtcgcgccggaccattacacctacccgatcgtgctcccggcttgcgcggctgcacgccagccgcggctcgggcgggccgtgcacggagacgcggtgcggtttgcgctcgatggggacgggttcgtgcgctgcactcttatcgcgatgtacttccaggaaggagaggtggcggacgctgagctggtctttgcagaaagccatggatcgtcccggacggtcgtgtcgtggacggccatggttgctggctacgtgcagaactacttctttggggaggcacttgcgctgttcagcacgatggtcgccgagggtgtccttccgaatgagatcactctgatcagtttcctgccctgcttgcagggccaagaatggctggatgctggggaaatggtgcacgggttcgtgatcaggtcagggtttgatgcaaacattccattggctaatgccctcatcgcaatgtatgggaagtgtgggagcattcccatggcagaagctctgtttgagggaatggcagtacgcagtctggtttcttggaacacgatggttgcaatctatgagcagcatggtgatgtggttgaggcaatcaagttcttccaccggatgcttactgagaaggtggggtttgattgtgtgactttggtcagtgttctatctgcctgcggacggtcaggagccctggagactggcaaatgggtgcatgagtttgcccggagtcatgggcttgacgcagatgcaaggattggcaatgttcttgtcgacatgtatgcaaagtgtggcgagattgctgatgcaaggaaagtctttgactgtttgcatgtgcgtggtgttgtgtcctggagtgccatgataagtgcatatgccaaccatggggattctgaggaggctctcaagctcttctgcctgatgaaaagtgaaggggtgagaccaaattctttcacattcactgcagttcttgtggcgtgtggccactcaggccttgttaacgaaggactgaagcatttcaacagcatcctttctgactatcaaatgtcgcctacactggagcactatgcctgcattgttgacatgctagggcgagctggtagacttgtggaagcatatgaaatcatcaggggaatgtcgttgtgcccagacaagtgcgtgtggggcgcatttcttgggggttgtaagcttcacagcaatctggagctagctgaattcgttgccaaggacctcttccagtcaggctccaatgatgtcacattctatgttttgatgtcaaacatgtacttcgaagccggaatgttggaagatgcagaaaggataagacgagccatgaaggagatggaactcaagaagacagctgggcatagcgcagtaaaccaatag

SEQ ID NO: 5694 - protein, 570 aa, Sorghum bicolor
  misc_feature: Ceres ANNOT ID no. 6053442
  misc_feature (190)..(224): Pfam Id: PPR Pfam Desc: PPR repeat
  misc_feature (291)..(325): Pfam Id: PPR Pfam Desc: PPR repeat
  misc_feature (392)..(426): Pfam Id: PPR Pfam Desc: PPR repeat
  misc_feature (20)..(568): NCBI GI: 11994419 NCBI Desc: selenium-binding protein-like [arabidopsis thaliana]
  misc_feature (20)..(568): NCBI GI: 15230593 NCBI Desc: pentatricopeptide (ppr) repeat-containing protein [arabidopsis thaliana]
  misc_feature (3)..(568): NCBI GI: 115465982 NCBI Desc: os06g0112000 [oryza sativa (japonica cultivar-group)]
  misc_feature (26)..(566): NCBI GI: 54695180 NCBI Desc: ppr986-12 [physcomitrella patens]
  misc_feature (62)..(568): NCBI GI: 7268714 NCBI Desc: putatative protein [arabidopsis thaliana]
MPARPSTAAAVLVRLITAAATVSSSPASLRALLPIHARAIVLGVSANLAFATSLIAGAAPASLAYARRVFDAAPVRDAYMWNTLLRAHAHSHSHSQSSHSHAVDALALYKRMRAAGVAPDHYTYPIVLPACAAARQPRLGRAVHGDAVRFALDGDGFVRCTLIAMYFQEGEVADAELVFAESHGSSRTVVSWTAMVAGYVQNYFFGEALALFSTMVAEGVLPNEITLISFLPCLQGQEWLDAGEMVHGFVIRSGFDANIPLANALIAMYGKCGSIPMAEALFEGMAVRSLVSWNTMVAIYEQHGDVVEAIKFFHRMLTEKVGFDCVTLVSVLSACGRSGALETGKWVHEFARSHGLDADARIGNVLVDMYAKCGEIADARKVFDCLHVRGVVSWSAMISAYANHGDSEEALKLFCLMKSEGVRPNSFTFTAVLVACGHSGLVNEGLKHFNSILSDYQMSPTLEHYACIVDMLGRAGRLVEAYEIIRGMSLCPDKCVWGAFLGGCKLHSNLELAEFVAKDLFQSGSNDVTFYVLMSNMYFEAGMLEDAERIRRAMKEMELKKTAGHSAVNQ

SEQ ID NO: 5695 - DNA, 528 bp, Sorghum bicolor
  misc_feature: Ceres ANNOT ID no. 6053503
  misc_feature: Encodes the peptide sequence at SEQ ID NO 5696
atggccttcttcgcaatagctcctctcctttgcgcgctagcccaaaatgagattcagatgaccctatacatccatcaggtgcctagtggaccaaacataaaccaagcagtagtgatagatccatcaaatggctttggtcggaccgctgttatagattggactatacgcgacggggcagatccaagttcaaaagtcattgggcaagctcagggcattcatatgaggacaagtcaaaatgagagcatctggcacacgtccatgaatttggtgttctcggacgctaggttcggtgggtctacacttcaggtgatggggcttattgctgaaggtcctcgtgattggagtattgtcggtgggaccggagaatttagtatggcacgtggtgttgctaagtacactgtcgagcccaattcatcgaggatttatagagtaaatgttcatgcatattactcttcaatggactccagggcggtttctggtaagagtggctgtaactctaagataagtgagcctattacagtcaattag

SEQ ID NO: 5696 - protein, 175 aa, Sorghum bicolor
  misc_feature: Ceres ANNOT ID no. 6053503
  misc_feature (3)..(150): Pfam Id: Dirigent Pfam Desc: Dirigent-like protein
  misc_feature (1)..(160): NCBI GI: 55416171 NCBI Desc: dirigent-like protein [saccharum hybrid cultivar]
  misc_feature (16)..(157): NCBI GI: 20160673 NCBI Desc: beta-glucosidase aggregating factor precursor-like protein [oryza sativa (japonica cultivar-group)]
  misc_feature (1)..(160): NCBI GI: 37700483 NCBI Desc: dirigent [saccharum hybrid cultivar]
  misc_feature (3)..(159): NCBI GI: 115481556 NCBI Desc: os10g0335000 [oryza sativa (japonica cultivar-group)]
  misc_feature (38)..(155): NCBI GI: 53793505 NCBI Desc: disease resistance protein-like [oryza sativa (japonica cultivar-group)]
MAFFAIAPLLCALAQNEIQMTLYIHQVPSGPNINQAVVIDPSNGFGRTAVIDWTIRDGADPSSKVIGQAQGIHMRTSQNESIWHTSMNLVFSDARFGGSTLQVMGLIAEGPRDWSIVGGTGEFSMARGVAKYTVEPNSSRIYRVNVHAYYSSMDSRAVSGKSGCNSKISEPITVN

SEQ ID NO: 5697 - DNA, 1749 bp, Sorghum bicolor
  misc_feature: Ceres ANNOT ID no. 6053735
  misc_feature: Encodes the peptide sequence at SEQ ID NO 5698
  misc_feature: Up-regulated in shoot tissues in response to salicylic acid treatment
atgtcggcggctgtggcatgcgcggagagggcgaccaacgacatgctgatcggcccggactgggcggtcaacatcgagctctgcgacatcatcaacatggatcccggacaagcaaaggacacactcaagctcctaaagaaacgtcttggaagcaagaattcaaaagtgcaaattctaacactttatgtgctagagacgctaagcaaaaattgtggggatattgttcatcaacagatcgttgagcgtgacatattgagtgaaatggttaagatagtaaagaagaagccagacttaaacgtccgcgagaagatattgagtttgattgacacatggcaagtggcatttggaggtccatccggaaaatataaacagtatcatgtggcttaccaagaactcagggctgctggtgttgattttccacctcgtgaggaaaattcagtcccgttgtttacaccacctcaaacgcaaccattaagacatccacatctatatccacctccaggtcaaagctatgaagatgctgccatacaagcttctcttcagtctgcccctcctgcacctcccctcagtctgagtgagattcaaagtgctcgaggtattgtggatgtgttagatgaaatgttaaatgctctggaccaccggcatcctgagggtgtaagggaggaggtgattgttgatcttgttggccaatgtcgatcatatcaatctcgtgtcatggatcttgttaacagtactggcgacgagagccttctatttcaggctctaggactaaatgatgagttacagcgtgttgttcagcgtcatgatgacatagcaaaggggatccctcctggtactggagcacctgtacctgcttctgcaaatgtcaaccaagggactgcgccacctaggtccactgcggtttcattttctccacttctaaatgtacatgaggacgatgaaccggaagacgagttctctgtgctttcccgtaggtctgcaagggatggcgcagtaccacagaacaatctgccttctgctacaagaaatgaaaggccatacccaagcccacttcttcctcctccaccagcatcgaagaggcctgtttacagtgaggcaagcagtattgactatcttagtggtgactcctacaagtcagaaaaggttccagatgatttcatcaacccaactgctccatctaatatatctacatcatcccattcaaagccagaagtatatccgccaccaagttatggtagcaggccagacagtgtgtctgatgactttataaacccaactgcacctagcttctctgcgccttctcgtcctacaaatgaggagccaacccattcatctgttaagcggcaggaaagtctacctgacgatgacttcataaacccaactgctcttcctggtttctcgtcatcttcagctagtaaggagtccagtgaagatcttccaaaggctccatgggaatcacaagctgctgctgcaggttccctgccgccacctccagcgaggtatggccagagacagcagtactttgagcaaaatgtgtattccggtgggagcaatggaggtggttacgatggactgatgacacagactgaaaacctctccctgaacccacggagcagtgagagtgcatcacggccaacagcatcccgccaggctaaacccgaggactcccttttcaaggacctggtcgacttcgcaaagaccaagccttcgtctccatcgaaaccagccaacagccgcaggacccgctaa

SEQ ID NO: 5698 - protein, 582 aa, Sorghum bicolor
  misc_feature: Ceres ANNOT ID no. 6053735
  misc_feature (2)..(136): Pfam Id: VHS Pfam Desc: VHS domain
  misc_feature (184)..(281): Pfam Id: GAT Pfam Desc: GAT domain
  misc_feature (207)..(582): NCBI GI: 62734629 NCBI Desc: seed protein b32e [oryza sativa (japonica cultivar-group)]
  misc_feature (221)..(506): NCBI GI: 18201649 NCBI Desc: seed protein b32e [oryza sativa]
  misc_feature (9)..(498): NCBI GI: 82791812 NCBI Desc: vhs and gat domain protein [glycine max]
  misc_feature (326)..(582): NCBI GI: 1345530 NCBI Desc: b32e [hordeum vulgare subsp. vulgare]
  misc_feature (2)..(498): NCBI GI: 92887452 NCBI Desc: epsin, n-terminal; gat; enth/vhs [medicago truncatula]
  misc_feature: Up-regulated in shoot tissues in response to salicylic acid treatment
MSAAVACAERATNDMLIGPDWAVNIELCDIINMDPGQAKDTLKLLKKRLGSKNSKVQILTLYVLETLSKNCGDIVHQQIVERDILSEMVKIVKKKPDLNVREKILSLIDTWQVAFGGPSGKYKQYHVAYQELRAAGVDFPPREENSVPLFTPPQTQPLRHPHLYPPPGQSYEDAAIQASLQSAPPAPPLSLSEIQSARGIVDVLDEMLNALDHRHPEGVREEVIVDLVGQCRSYQSRVMDLVNSTGDESLLFQALGLNDELQRVVQRHDDIAKGIPPGTGAPVPASANVNQGTAPPRSTAVSFSPLLNVHEDDEPEDEFSVLSRRSARDGAVPQNNLPSATRNERPYPSPLLPPPPASKRPVYSEASSIDYLSGDSYKSEKVPDDFINPTAPSNISTSSHSKPEVYPPPSYGSRPDSVSDDFINPTAPSFSAPSRPTNEEPTHSSVKRQESLPDDDFINPTALPGFSSSSASKESSEDLPKAPWESQAAAAGSLPPPPARYGQRQQYFEQNVYSGGSNGGGYDGLMTQTENLSLNPRSSESASRPTASRQAKPEDSLFKDLVDFAKTKPSSPSKPANSRRTR

SEQ ID NO: 5699 - DNA, 1446 bp, Sorghum bicolor
  misc_feature: Ceres ANNOT ID no. 6053796
  misc_feature: Encodes the peptide sequence at SEQ ID NO 5700
atggtggccaagaagcaggccccgttcgacgagttgtcgctggtggaggcccgcggcggcggcggtggcggtggcgatgacgcggagtggcgcgacgacgacgggcggccgcggcggacgggcacggtgtggacggcgagcgcgcacatcatcacggccgtgatcggctccggcgtcctgtcgctggcgtgggccatcgcgcagctcgggtgggcggccggccccgccgtcatgatcctcttcgccgtcgtcatctactacacctccacgctgctcgccgagtgctaccgctccggcgaccccgtggcggggaagcgcaactacacctacatggacgccgtccgctccagccttggcggcgccaaggtcacgctctgcggctccatccagtacgccaacctcttcggcgtcgccatcggttacaccatcgccgcatccatcagcatgctggcgatcaagagggcggactgcttccacgtcaagggccaccggaacccgtgccggagctccagcaacccgtacatgatcctcttcggcgtcgccgaggtcgtcttctcgcagataccggacttcgaccagatatggtggctctccatcgtcgccgccgtcatgtccttcacctactccaccatcggcctcgtcctcggcgtcatgcagaccgtcgccaacggcgggttccagggcagcctcaccgggatcagcatcggcgccggcatcacgcccacgcagaaggtctggcgcagcttgcaggccttcggcaacatcgccttcgcctactcctactccatcatcctcatcgagatccaggacacggtgaaggcgccgccgccgtcggaggcgaaggtgatgaagagggcgacgatggtgagcgtggcgacgacgacggtgttctacatgctgtgcgggtgcatgggctacgcggcgttcggcgacggcgcgccggacaacctcctcaccgggttcggcttctacgagcccttctggctgctggacatcgccaacgtcgccatcgtcgtgcacctcgtcggcgcgtaccaggtcttctgccagccgctcttcgccttcgtcgagaagtgggcggcggcgacgtggcccgacagcgccttcatcgcgcgggagctcggcgccgtcgggcccttcaagctcagcgcgttccgcctcgcctggcgcacggcgttcgtctgcctcaccaccgtcgtcgccatgatgctccctttcttcggcgacgtcgtcggcctcctcggcgccgtctccttctggccgctcaccgtctacttccccatcgagatgtacgtcgtgcagcgcggcgtgcgcagggggagcacgcactggatctgcctacagatgctcagcgtcgcgtgcctcgtcgtgtccgtcgccgccgccgccggatccatcgccgacgtgatcggcgcgctcaaggtgtaccgcccgttcagcggctag

SEQ ID NO: 5700 - protein, 481 aa, Sorghum bicolor
  misc_feature: Ceres ANNOT ID no. 6053796
  misc_feature (39)..(471): Pfam Id: Aa_trans Pfam Desc: Transmembrane amino acid transporter protein
  misc_feature (29)..(481): NCBI GI: 62733942 NCBI Desc: transmembrane amino acid transporter protein [oryza sativa (japonica cultivar-group)]
  misc_feature (23)..(481): NCBI GI: 77553159 NCBI Desc: transmembrane amino acid transporter protein [oryza sativa (japonica cultivar-group)]
  misc_feature (28)..(479): NCBI GI: 3293031 NCBI Desc: amino acid carrier [ricinus communis]
  misc_feature (32)..(479): NCBI GI: 19699271 NCBI Desc: at5g09220/t5e8_20 [arabidopsis thaliana]
  misc_feature (32)..(479): NCBI GI: 27447657 NCBI Desc: amino acid transporter [lycopersicon esculentum]
  misc_feature: The sequence is a functional homolog of SEQ ID NO. 313 in the 11/188,298 US application
  misc_feature: The sequence is a functional homolog of SEQ ID NO. 438 in the 11/188,298 US application
MVAKKQAPFDELSLVEARGGGGGGGDDAEWRDDDGRPRRTGTVWTASAHIITAVIGSGVLSLAWAIAQLGWAAGPAVMILFAVVIYYTSTLLAECYRSGDPVAGKRNYTYMDAVRSSLGGAKVTLCGSIQYANLFGVAIGYTIAASISMLAIKRADCFHVKGHRNPCRSSSNPYMILFGVAEVVFSQIPDFDQIWWLSIVAAVMSFTYSTIGLVLGVMQTVANGGFQGSLTGISIGAGITPTQKVWRSLQAFGNIAFAYSYSIILIEIQDTVKAPPPSEAKVMKRATMVSVATTTVFYMLCGCMGYAAFGDGAPDNLLTGFGFYEPFWLLDIANVAIVVHLVGAYQVFCQPLFAFVEKWAAATWPDSAFIARELGAVGPFKLSAFRLAWRTAFVCLTTVVAMMLPFFGDVVGLLGAVSFWPLTVYFPIEMYVVQRGVRRGSTHWICLQMLSVACLVVSVAAAAGSIADVIGALKVYRPFSG

SEQ ID NO: 5701 - DNA, 3240 bp, Sorghum bicolor
  misc_feature: Ceres ANNOT ID no. 6053812
  misc_feature: Encodes the peptide sequence at SEQ ID NO 5702
atggccgccgcctccgccggcggctctctgtccaccgcctccgcctccctcgttcccactcccacctcagccccggcccctcggctcctcagcaggcgaagcaccaagcccacaacacgagctagccccaccccgagaccaaaaaagccgcctcctctctcctgcgcggccgcagcgactcccacccccgcccccgcggtcgcgtccaagtcggccgggtcatggagggacctgtgcagcctcaacgcctgggtggtgcgggactaccgccgcctcgtcgactccgtcggcgcgctcgagccggcgcttcggaggctctcggacgaacagttgaaggcaaagacggcggagttccgcagccgcctaacgcgcggggagacgctcgccgacgtccaggccgaggcgtttgctgtggtacgggaggcagctaggaggacgcttgggatgcggcatttcgacgtccagataattggtggtgctgtgctcaacgatggctgcattgcagagatgaagacaggcgaggggaagacacttgtttccacactcgcggcttatctcaatgcccttacaggggaaggggttcatgtggtgactgtaaatgattatttggcgcagcgtgatgctgaatggatgggccgtgttcatcgctttctcggtcttactgttggtctggttcaggcgggtatgaagtcagatgagagaagagccagctacagatgcgacattacatacactaacaactcggaacttggatttgactatcttcgtgacaacctatctcgaaacaaagaacaacttgttatgagatggccaaagccattccattttgctattgtggatgaagtggactcagtacttatagatgagggaaggaatccattgttaataagtggagaggataatagagatgcagctcggtatccaattgctgctaaagtcgcagaacttcttgtggagggtgttcattacaccgtcgaactaaagggcaataatatagatctgacagaggacggtgtagcacatgctgagattattcttgggacagatgatctatgggatgagaatgatccatgggcaaggtttgtgatgaatgctttgaaggcaaaagtgttctaccgaagggatgtccagtatattgtcagggatgggaaagctattataattaatgagttcaacaattgcatgctttggaaatcctgtcgttggatgataatattaattcttttccagctaactggccgagttgaacccaaaagaagatggtctgatggtatccaccaagcagtagaagcaaaagaaggcctaaaaatccaggcagactcagtaattgtggctcaaatcacatatcagtcactgtttaagctttatcctaagctttctgggatgacaggaactgctaagacagaggaaaaggagtttttaaagatgttcaagatgcctgttattgaagtacctactaatctgccaaatatacgggtggacttgcctatccaagcttttgcgactgcaagaggcaaatggcaatatgtacgggctgaagtagagtctatgttccaattaggccgccctgtttatgttgagagttctgaatacttgtcagagctacttaaacttcgcaatattccacacaatgtccttaatgcaagaccaaagtatgctgcaagagaagccgaaataattgcccaagctggaagaaaacatgctattacaatttcaactaatatggctggtagaggaactgacattattttaggtggtaatccaaaaatgcttgcaaaagaaatagtagaagataacatacttccatttttgagccatgaacctcctgatattgacatggaaggggaatccacatcccacaagggtctctcaaatatagaacttggtccatcatcagtaggtctgcttgccaaagctgcaatcatgtcaaaatatattcacaaaagtgagataaatgaatggtcttttagtaaggcaaaatccactattgctgaatctatagaaatgggtcaaatgattgggatggagaaactgcaagagcacatgactgaagagtctgagatgtaccctctttgtgatgcaataggacttgcttatctcagtgtcttaagggattgcgaaattcattgttcagctgaaggtgctgccgtgaagagattaggtgggctccatgtagtaggaacttctttgcatgagtcgcgccgaattgataaccaactgtgtggcagagcaggcagacagggtgatcctgggtcaacaaggtttatggtgagcttacaagatgaaatattccagaaatttaatctggacactgaatgggctgtgaggctaatatcaaggataacaaatgatgaagacatagctattgagagcaatgttgttgtgaagcagcttctaggccttcaaatcaacgcagagaaatattattttggaataaggaaaagtcttgttgagtttgatgaagtcctggaggtccaaagaaagcatgtgtacaaccttaggcaggtgatattatctggtgactctgaaagctgcagtgaacaaattttccagtacatgcaagcagtagctgatgaaattgttttgttaaatattgatccccaaaagccacccaaggcatggaatctggtaaagcttttggatgaatttgtcagactaggcggaaaactactgagtgaatcattcgaggacatccaagaggaaaacctacaatcagcacttgaggaaatgcaaggttgggacccagtgaaagctgatagttttgctcttccaaacatgccggtgccgcctgattcacttagaggaattcgaaagaaaacatcttctataatgcggtggtttgccatttgtgttgatgatacgtcaaagaaagggagatatacaaacactgtcaatctgctccggaaatattttggggattttctaatagctacctacttgaatgctgtgcaagagtcccgttacgacgatggatatataagtggaatcgagcgggaagtacttttgaagactcttgatacgttatggaaagatcacttggtaaacatgaacaagcttagttctgctgtgaacgttcggagttttggacacagaaatcctctggaagaatacaagatcgatggctgccgcttcttcatctcgatgctgagcgccacacgacgtctcaccgtggaatccctactgcactactggtcgtctcccatggaatccgaagagatcttcaacacagaggatcaatag

SEQ ID NO: 5702 - protein, 1079 aa, Sorghum bicolor
  misc_feature: Ceres ANNOT ID no. 6053812
  misc_feature (74)..(474): Pfam Id: SecA_DEAD Pfam Desc: SecA DEAD-like domain
  misc_feature (299)..(430): Pfam Id: SecA_PP_bind Pfam Desc: SecA preprotein cross-linking domain
  misc_feature (788)..(1065): Pfam Id: SecA_SW Pfam Desc: SecA Wing and Scaffold domain
  misc_feature (3)..(1079): NCBI GI: 62733946 NCBI Desc: preprotein translocase, seca subunit [oryza sativa (japonica cultivar-group)]
  misc_feature (76)..(953): NCBI GI: 15219056 NCBI Desc: preprotein translocase seca family protein [arabidopsis thaliana]
  misc_feature (403)..(1079): NCBI GI: 115484559 NCBI Desc: os11g0195100 [oryza sativa (japonica cultivar-group)]
  misc_feature (15)..(625): NCBI GI: 5263315 NCBI Desc: similar to gbx82404 chloroplast seca protein from pisum sativum. [arabidopsis thaliana]
  misc_feature (405)..(910): NCBI GI: 86605469 NCBI Desc: preprotein translocase, seca subunit [cyanobacteria bacterium yellowstone a-prime]
MAAASAGGSLSTASASLVPTPTSAPAPRLLSRRSTKPTTRASPTPRPKKPPPLSCAAAATPTPAPAVASKSAGSWRDLCSLNAWVVRDYRRLVDSVGALEPALRRLSDEQLKAKTAEFRSRLTRGETLADVQAEAFAVVREAARRTLGMRHFDVQIIGGAVLNDGCIAEMKTGEGKTLVSTLAAYLNALTGEGVHVVTVNDYLAQRDAEWMGRVHRFLGLTVGLVQAGMKSDERRASYRCDITYTNNSELGFDYLRDNLSRNKEQLVMRWPKPFHFAIVDEVDSVLIDEGRNPLLISGEDNRDAARYPIAAKVAELLVEGVHYTVELKGNNIDLTEDGVAHAEIILGTDDLWDENDPWARFVMNALKAKVFYRRDVQYIVRDGKAIIINEFNNCMLWKSCRWMIILILFQLTGRVEPKRRWSDGIHQAVEAKEGLKIQADSVIVAQITYQSLFKLYPKLSGMTGTAKTEEKEFLKMFKMPVIEVPTNLPNIRVDLPIQAFATARGKWQYVRAEVESMFQLGRPVYVESSEYLSELLKLRNIPHNVLNARPKYAAREAEIIAQAGRKHAITISTNMAGRGTDIILGGNPKMLAKEIVEDNILPFLSHEPPDIDMEGESTSHKGLSNIELGPSSVGLLAKAAIMSKYIHKSEINEWSFSKAKSTIAESIEMGQMIGMEKLQEHMTEESEMYPLCDAIGLAYLSVLRDCEIHCSAEGAAVKRLGGLHVVGTSLHESRRIDNQLCGRAGRQGDPGSTRFMVSLQDEIFQKFNLDTEWAVRLISRITNDEDIAIESNVVVKQLLGLQINAEKYYFGIRKSLVEFDEVLEVQRKHVYNLRQVILSGDSESCSEQIFQYMQAVADEIVLLNIDPQKPPKAWNLVKLLDEFVRLGGKLLSESFEDIQEENLQSALEEMQGWDPVKADSFALPNMPVPPDSLRGIRKKTSSIMRWFAICVDDTSKKGRYTNTVNLLRKYFGDFLIATYLNAVQESRYDDGYISGIEREVLLKTLDTLWKDHLVNMNKLSSAVNVRSFGHRNPLEEYKIDGCRFFISMLSATRRLTVESLLHYWSSPMESEEIFNTEDQ

SEQ ID NO: 5703 - DNA, 267 bp, Sorghum bicolor
  misc_feature: Ceres ANNOT ID no. 6053876
  misc_feature: Encodes the peptide sequence at SEQ ID NO 5704
atgatcatcccggtgcgctgcttcacatgcggcaaggtgatcggggacaagtgggatgcatacctcgaactcgtccaggcggactatgacgaggaggatgctctgactgccttgaatttaaaccgttactgctgtaggcgaatgctgatgacccatgtcgacctcattgagaagctcctcaactacaacaattctgtcttcatttttatcatcttcgtttctcaagaaaataaaactagttgtgaaaattcaaggcactgtatgtag

SEQ ID NO: 5704 - protein, 88 aa, Sorghum bicolor
  misc_feature: Ceres ANNOT ID no. 6053876
  misc_feature (1)..(60): Pfam Id: RNA_pol_N Pfam Desc: RNA polymerases N / 8 kDa subunit
  misc_feature (1)..(63): NCBI GI: 2833375 NCBI Desc: dna-directed rna polymerase ii 8.2 kda polypeptide (rpb10) (rp10) (abc10)
  misc_feature (1)..(63): NCBI GI: 62733950 NCBI Desc: dna-directed rna polymerase ii 8.2 kda polypeptide (ec 2.7.7.6)(rpb10) (rp10) (abc10) [oryza sativa (japonica cultivar-group)]
  misc_feature (1)..(63): NCBI GI: 115487650 NCBI Desc: os12g0180400 [oryza sativa (japonica cultivar-group)]
  misc_feature (1)..(62): NCBI GI: 60473508 NCBI Desc: rna polymerases n/8 kda subunit [dictyostelium discoideum]
  misc_feature (1)..(62): NCBI GI: 33086454 NCBI Desc: ab1-108 [rattus norvegicus]
  misc_feature (1)..(63): SWISSPROT Homolog: EC 2.7.7.6 DNA-directed RNA polymerase II 8.2 kDa polypeptide
MIIPVRCFTCGKVIGDKWDAYLELVQADYDEEDALTALNLNRYCCRRMLMTHVDLIEKLLNYNNSVFIFIIFVSQENKTSCENSRHCM

SEQ ID NO: 5705 - DNA, 3324 bp, Sorghum bicolor
  misc_feature: Ceres ANNOT ID no. 6053981
  misc_feature: Encodes the peptide sequence at SEQ ID NO 5706
atgagctcaggcgggcgcggcggcaagcggcggggtcccccgccccccgccccctccggggcggcggcgaagagggccaaccccagccccggcatgccgcagcctcctcctcccgcggcggcggaggaggacatgatggacgaggacgtgttcctggacgagtccatcctggcggaggacgaggcggcgctgctgatgctccagcgcgacgaggccctcgcgtcccgcctcgcgcggtggaagcgccccgcactcccctccgacctcgccgccgggtgctcccgcgccgtcgcttttcagcagttggaaatagattatgttattggtgagagccacaaagaattgctccccaactcatctggttcggcagccatactcaggatttttggtgttaccagagaaggtcacagcatatgctgtcaggtgcatggatttgagccatatttctacattggctgtccttcagggatgggtcctgatgatatatcgcgctttcaccaaacactagaggggaggatgaaggagtcaaatagaagcagcaatgttccaaggttcgtgaagagagttgagcttgtgcagaagcagacaattatgcattaccaaacgcaggaatctcagcctttcctcaagatagtagtcgctttgcctaccatggttgctagctgtcgtggtattctggaaaggggcataatgattgaaggccttggttcaaagagtttcctgacatatgaaagcaacattctttttgcccttcgtttcatgattgattgcaatattgttggtggcaactggattgagcttcctgctggaaaatacaggaaagcagcccgtctcatgtcctattttatgtctattcttaacacaactaatagatactcagatctggtaagtcatgctgctgaaggagaatattctaagatggccccatttcgcatattaagttttgatattgaatgtgctggtcgcaaaggtcatttcccagaaccaactcatgatcctgttattcaggttgacttcattattcatatagctaacttggtaacacatcaaggagaaggccaaccttttgtacagaatgtcatgactcttaagtcatgctctcccattgtgggagtcgatgttaggtcatttgatacggagagagatattctacttgcatggagggatttcatacgtgaagtggatcctgatatcataattggatacaatatctgcaaatttgacatgccatatcttattgagagggctgaagttctcaagatagcggagtttccaatacttggccgaatcagaaatagtcgtgttcgtgtccgtgatacgaccttttcctcaaggcaatatggtgtgcgtgaaagtaaggatgttaccattgaaggaagagtgcaatttgatctcctgcaggctatgcaacgggattacaagctgagttcttattcattgaactctgtatcggcacacttccttggggagcaaaaagaagatgttcatcattcaattatatctgatcttcaaaatggaaactcagagacacgaaggcggctggcagtttattgcttgaaggatgcttatcttcctcaaagactgttagacaaattgatgtatatctacaattatgtggaaatggcgagggtcactggtgttcccatttcgtttctactttcgaggggacaaagtattaaggtcctctcgcaactactcaggaaagcaaaacagaaaaaccttgttataccaaatataaagggtcaagggtctgggcaagatacctttgagggtgcaactgttttggaggcaagggctggattttatgagaagcccatcgcaactttggactttgcttctttgtatccatccatcatgatggcatataacctttgctactgtactttggtgcccccggaggacgcccgtaaactcaacttacctccagaaagcatcaataaaaccccatctggtgaaatatttgtgaaaccagaactacagaagggtatacttcctgagatccttgaagaattattagcagctcggaaaagggcaaaagcagatttaaaggaagcaaaggacccactcgaaagggctgttcttgatggtcgtcagcttgcactgaaaataagtgcaaactcagtttatggtttcactggagcaactgttggtcagttaccttgcttagagatttcttcaagtgtgaccagctatggacgacagatgattgaacatacaaaaaagcttgttgaagataaattcacaacagtaggaggttatgagcataatgcagaggtaatttatggggacactgattctgtgatggtacagtttggtgtttctacagttcaagatgcaatgaagttaggaagagaagctgcagattatattagtggaacctttaccaagcccatcaagctggagtttgagaaggtctattttccttaccttctgatcagcaagaagagatatgctggtttgtactggacgaatcctgagaaatttgacaaaatggatgcaaaaggtattgaaactgtgagaagggacaactgtttgttggtaaagaacctggtaaccgagtgccttcataaaatactggtggatcgtgatgttcctggtgcagtccaatatgtcaagaacaccatatctgatctattaatgaatcgtgtcgacttgtctcttcttgtcataacaaagggtttgacaaaaacgggagaagattatgcggtaaaagctgctcatgtggagcttgctgagaggatgcgaaagagagatccagctactgcacctactgttggtgatcgtgttccttatgttataattaaagcagcaaaaggggcaaaggcatatgagaaatcagaagatccaatttatgttttggacaataatatacccattgatcctcaatactaccttgagaaccaaattagcaagccacttttgaggatctttgagccaattctgaagaatgccagcaaagagttgcttcatggaagccacaccagatctgtttcaatctcaactccttcaaatagcgggataatgaaatttgcaaagaaacaattaacttgccttgggtgcaaagctgttatcagtggtgccagtcagacactttgctcacattgcaagggaagagaagcagagttatactgcaaaacagtagcaaatgtttctgacctggagatgctctttgggaggttatggacacaatgccaggagtgccaaggatctctgcaccaggacgttctctgcacgagtcgggattgtccgattttctatcggcgaaggaaggctcagaaggatatggccgaagctaggctgcagcttgaccggtgggacttttga

SEQ ID NO: 5706 - protein, 1107 aa, Sorghum bicolor
  misc_feature: Ceres ANNOT ID no. 6053981
  misc_feature (556)..(1014): Pfam Id: DNA_pol_B Pfam Desc: DNA polymerase family B
  misc_feature (131)..(483): Pfam Id: DNA_pol_B_exo Pfam Desc: DNA polymerase family B, exonuclease domain
  misc_feature (1)..(1107): NCBI GI: 62734232 NCBI Desc: dna polymerase delta catalytic subunit (ec 2.7.7.7). [oryza sativa (japonica cultivar-group)]
  misc_feature (1)..(1107): NCBI GI: 13124219 NCBI Desc: dna polymerase delta catalytic subunit
  misc_feature (9)..(1107): NCBI GI: 76262800 NCBI Desc: dna-directed dna polymerase delta catalytic subunit [arabidopsis thaliana]
  misc_feature (42)..(1044): NCBI GI: 2895198 NCBI Desc: dna polymerase delta [glycine max]
  misc_feature (22)..(1106): NCBI GI: 81157941 NCBI Desc: dna polymerase delta subunit [chlorella pyrenoidosa]
  misc_feature (1)..(1107): SWISSPROT Homolog: EC 2.7.7.7 DNA polymerase delta catalytic subunit
MSSGGRGGKRRGPPPPAPSGAAAKRANPSPGMPQPPPPAAAEEDMMDEDVFLDESILAEDEAALLMLQRDEALASRLARWKRPALPSDLAAGCSRAVAFQQLEIDYVIGESHKELLPNSSGSAAILRIFGVTREGHSICCQVHGFEPYFYIGCPSGMGPDDISRFHQTLEGRMKESNRSSNVPRFVKRVELVQKQTIMHYQTQESQPFLKIVVALPTMVASCRGILERGIMIEGLGSKSFLTYESNILFALRFMIDCNIVGGNWIELPAGKYRKAARLMSYFMSILNTTNRYSDLVSHAAEGEYSKMAPFRILSFDIECAGRKGHFPEPTHDPVIQVDFIIHIANLVTHQGEGQPFVQNVMTLKSCSPIVGVDVRSFDTERDILLAWRDFIREVDPDIIIGYNICKFDMPYLIERAEVLKIAEFPILGRIRNSRVRVRDTTFSSRQYGVRESKDVTIEGRVQFDLLQAMQRDYKLSSYSLNSVSAHFLGEQKEDVHHSIISDLQNGNSETRRRLAVYCLKDAYLPQRLLDKLMYIYNYVEMARVTGVPISFLLSRGQSIKVLSQLLRKAKQKNLVIPNIKGQGSGQDTFEGATVLEARAGFYEKPIATLDFASLYPSIMMAYNLCYCTLVPPEDARKLNLPPESINKTPSGEIFVKPELQKGILPEILEELLAARKRAKADLKEAKDPLERAVLDGRQLALKISANSVYGFTGATVGQLPCLEISSSVTSYGRQMIEHTKKLVEDKFTTVGGYEHNAEVIYGDTDSVMVQFGVSTVQDAMKLGREAADYISGTFTKPIKLEFEKVYFPYLLISKKRYAGLYWTNPEKFDKMDAKGIETVRRDNCLLVKNLVTECLHKILVDRDVPGAVQYVKNTISDLLMNRVDLSLLVITKGLTKTGEDYAVKAAHVELAERMRKRDPATAPTVGDRVPYVIIKAAKGAKAYEKSEDPIYVLDNNIPIDPQYYLENQISKPLLRIFEPILKNASKELLHGSHTRSVSISTPSNSGIMKFAKKQLTCLGCKAVISGASQTLCSHCKGREAELYCKTVANVSDLEMLFGRLWTQCQECQGSLHQDVLCTSRDCPIFYRRRKAQKDMAEARLQLDRWDF

SEQ ID NO: 5707 - DNA, 984 bp, Sorghum bicolor
  misc_feature: Ceres ANNOT ID no. 6054073
  misc_feature: Encodes the peptide sequence at SEQ ID NO 5708
atggactgcggtggcgcgctgcagctcccgcccgggttccggttccaccccaccgacgacgagctggtgatgtactacctcctccgcaagtgcggcggcctgcccctcgccgcgccggtcatcgccgaggtcgacctctacaagttcgatccatggcagctcccagagaaggcgtatggtggggagaaggagtggtacttcttctcgccgagggaccgcaagtacccgaacgggtcgaggccgaacagggcggccgggacggggtactggaaggccaccggcgccgacaagcccgtcgggtcgccgcgccccgtcgccatcaagaaggccctcgtcttctacgccggcaagccgcccaagggcgtcaagaccaactggatcatgcacgagtaccgcctcgccgacgtcgaccgttccgccgccgcacgcaagaagaccaacaacgccctcaggctggatgactgggtgctgtgccggatctacaacaagaagggcgtgatcgagcggtacgacacggtggacgacgacgccgacgacgccgtggcagaggacgtcaagcctgcgccggcgtccaggaataacccgcgcgggaccgccagtggccgcggcggggcagcagcagcagcggcgccgatgaaggtggagttcccggagtacggtgggtactacgactacgaagacctcgaggcgacgccgtcggcggggatgctgtgcttcgatcgcccctgcggctccgagcacgtgctgtcgccgtcgccggacctccccgaccgcgaccacgccgagagccagtccgccgggttatggtggcccgtcggcgtcggcggcgactgggccgccgccgaggacgggttcatggtcgacgtcgacgtcgacgacgggagctcgctgttcgggccgccgtccccggggctgccgttcgctcgcgtcgacgccgccgcgttcggcgacatgctcgcgtcgtacctccacaagccgttctga

SEQ ID NO: 5708 - protein, 327 aa, Sorghum bicolor
  misc_feature: Ceres ANNOT ID no. 6054073
  misc_feature (9)..(134): Pfam Id: NAM Pfam Desc: No apical meristem (NAM) protein
  misc_feature (1)..(327): NCBI GI: 115484515 NCBI Desc: os11g0184900 [oryza sativa (japonica cultivar-group)]
  misc_feature (1)..(327): NCBI GI: 6730940 NCBI Desc: osnac5 protein [oryza sativa]
  misc_feature (5)..(187): NCBI GI: 140069452 NCBI Desc: no apical meristem (nam) protein [medicago truncatula]
  misc_feature (1)..(265): NCBI GI: 138753442 NCBI Desc: nac transcription factor [hordeum vulgare subsp. vulgare]
  misc_feature (1)..(251): NCBI GI: 6730942 NCBI Desc: osnac6 protein [oryza sativa]
  misc_feature: The sequence is a functional homolog of SEQ ID NO 2 in the 10/286,264US patent application
  misc_feature: The sequence is a functional homolog of SEQ ID NO 2060 in the 10/374,780US patent application
  misc_feature: The sequence is a functional homolog of SEQ ID NO 26 in the 10/286,264US patent application
  misc_feature: The sequence is a functional homolog of SEQ ID NO 2658 in the 10/374,780US patent application
  misc_feature: The sequence is a functional homolog of SEQ ID NO 336 in the 10/412,699US patent application
  misc_feature: The sequence is a functional homolog of SEQ ID NO 516 in the 10/412,699US patent application
  misc_feature: The sequence is a functional homolog of SEQ ID NO 652 in the 10/225,066US patent application
  misc_feature: The sequence is a functional homolog of SEQ ID NO 770 in the 11/479,226US patent application
  misc_feature: The sequence is a functional homolog of SEQ ID NO 853 in the 10/374,780US patent application
  misc_feature: The sequence is a functional homolog of SEQ ID NO 890 in the 10/374,780US patent application
  misc_feature: The sequence is a functional homolog of SEQ ID NO 922 in the 10/412,699US patent application
  misc_feature: Useful for making plants with modulated growth and phenotype characteristics
  misc_feature: The sequence is a functional homolog of SEQ ID NO 2 in the 20030093837 US patent application
  misc_feature: The sequence is a functional homolog of SEQ ID NO 26 in the 20030093837 US patent application
  misc_feature: The sequence is a functional homolog of SEQ ID NO 516 in the 20040045049 US patent application
  misc_feature: The sequence is a functional homolog of SEQ ID NO 853 in the 20060162006 US patent application
  misc_feature: The sequence is a functional homolog of SEQ ID NO 890 in the 20060162006 US patent application
  misc_feature: The sequence is a functional homolog of SEQ ID NO 890 in the 10/374,780 US patent application
  misc_feature: The sequence is a functional homolog of SEQ ID NO 102 in the 10/374,780 US patent application
  misc_feature: The sequence is a functional homolog of SEQ ID NO 886 in the 10/225,066 US patent application
  misc_feature: The sequence is a functional homolog of SEQ ID NO 2060 in the 10/374,780 US patent application
  misc_feature: The sequence is a functional homolog of SEQ ID NO 516 in the 10/412,699 US patent application
  misc_feature: The sequence is a functional homolog of SEQ ID NO 2012 in the 10/374,780 US patent application
  misc_feature: The sequence is a functional homolog of SEQ ID NO 312 in the 10/412,699 US patent application
  misc_feature: The sequence is a functional homolog of SEQ ID NO 731 in the 11/479,226 US patent application
  misc_feature: The sequence is a functional homolog of SEQ ID NO 853 in the 10/374,780 US patent application
  misc_feature: Useful for making plants with modulated oxidative stress sensitivity
  misc_feature: Functional homolog of the protein sequence given in SEQ ID NO 13621
  misc_feature: The sequence is a functional homolog of SEQ ID NO 808 in the 10/225,066 US patent application
  misc_feature: The sequence is a functional homolog of SEQ ID NO 926 in the 11/435,388 US patent application
  misc_feature: The sequence is a functional homolog of SEQ ID NO 98 in the 10/374,780 US patent application
  misc_feature: Useful for making plants with altered cell wall content and/or composition
  misc_feature: Useful for making plants with altered lignin content
  misc_feature: Functional homolog of the protein sequence given in SEQ ID NO 13620
  misc_feature: The sequence is a functional homolog of SEQ ID NO 891 in the 10/374,780 US patent application
  misc_feature: The sequence is a functional homolog of SEQ ID NO 316 in the 10/412,699 US patent application
  misc_feature: The sequence is a functional homolog of SEQ ID NO 738 in the 11/479,226 US patent application
  misc_feature: The sequence is a functional homolog of SEQ ID NO 1036 in the 10/225,066 US patent application
  misc_feature: The sequence is a functional homolog of SEQ ID NO 216 in the 10/666,642 US patent application
  misc_feature: The sequence is a functional homolog of SEQ ID NO 2608 in the 10/374,780 US patent application
  misc_feature: The sequence is a functional homolog of SEQ ID NO 658 in the 11/435,388 US patent application
  misc_feature: The sequence is a functional homolog of SEQ ID NO 880 in the 10/412,699 US patent application
  misc_feature: Useful for making plants with modulated water use efficiency
  misc_feature: The sequence is a functional homolog of SEQ ID NO 852 in the 10/374,780 US patent application
  misc_feature: The sequence is a functional homolog of SEQ ID NO 26 in the 10/286,264 US patent application
  misc_feature: The sequence is a functional homolog of SEQ ID NO 336 in the 10/412,699 US patent application
  misc_feature: The sequence is a functional homolog of SEQ ID NO 770 in the 11/479,226 US patent application
  misc_feature: The sequence is a functional homolog of SEQ ID NO 476 in the 10/666,642 US patent application
  misc_feature: The sequence is a functional homolog of SEQ ID NO 2478 in the 10/374,780 US patent application
  misc_feature: The sequence is a functional homolog of SEQ ID NO 572 in the 10/225,066 US patent application
  misc_feature: The sequence is a functional homolog of SEQ ID NO 2346 in the 10/374,780 US patent application
  misc_feature: The sequence is a functional homolog of SEQ ID NO 238 in the 10/225,068 US patent application
  misc_feature: The sequence is a functional homolog of SEQ ID NO 338 in the 10/412,699 US patent application
  misc_feature: The sequence is a functional homolog of SEQ ID NO 774 in the 11/479,226 US patent application
  misc_feature: Useful for making plants with modulated nitrogen use efficiency
  misc_feature: Functional homolog of the protein sequence given in SEQ ID NO 13624
  misc_feature: The sequence is a functional homolog of SEQ ID NO 328 in the 10/374,780 US patent application
  misc_feature: The sequence is a functional homolog of SEQ ID NO 852 in the 10/225,066 US patent application
  misc_feature: The sequence is a functional homolog of SEQ ID NO 1196 in the 10/412,699 US patent application
  misc_feature: The sequence is a functional homolog of SEQ ID NO 865 in the 10/374,780 US patent application
  misc_feature: The sequence is a functional homolog of SEQ ID NO. 362 in the 11/188,298 US application
  misc_feature: The sequence is a functional homolog of SEQ ID NO. 466 in the 11/188,298 US application
  misc_feature: The sequence is a functional homolog of SEQ ID NO. 335 in the 11/188,298 US application
MDCGGALQLPPGFRFHPTDDELVMYYLLRKCGGLPLAAPVIAEVDLYKFDPWQLPEKAYGGEKEWYFFSPRDRKYPNGSRPNRAAGTGYWKATGADKPVGSPRPVAIKKALVFYAGKPPKGVKTNWIMHEYRLADVDRSAAARKKTNNALRLDDWVLCRIYNKKGVIERYDTVDDDADDAVAEDVKPAPASRNNPRGTASGRGGAAAAAAPMKVEFPEYGGYYDYEDLEATPSAGMLCFDRPCGSEHVLSPSPDLPDRDHAESQSAGLWWPVGVGGDWAAAEDGFMVDVDVDDGSSLFGPPSPGLPFARVDAAAFGDMLASYLHKPF

SEQ ID NO: 5709 - DNA, 1248 bp, Sorghum bicolor
  misc_feature: Ceres ANNOT ID no. 6054093
  misc_feature: Encodes the peptide sequence at SEQ ID NO 5710
atggcggcggcttccagcaggtggaccccggcggccgggctcctgctgctgctcctcctcctcgtcccgttcgccgccatcccgtcccgcgccgccacgccggcggcgtcgtccaccgccatcttccagctccagggcaacgtctatcccaccggccactactatgtcacgatgaacattgggaacccggcgaagccctacttcctggacgtggacactggcagtgatctcacctggctgcagtgcgacgcaccctgtcggagttgcaacaaggtgccacatcccttatatcgaccaacggcaaacagccttgtgccatgtgcaaatgcactctgcactgcacttcacagtggacatggctctaataacaaatgtccttcaccgaaacaatgtgactatcagataaagtacactgatagtgcatcttctcaaggtgtgctgatcaacgacaacttctcactgcccatgagatcctccaacattcgtcctggcctcacatttggctgtggatatgaccagcaagtggggaaaaatggagctgtgcaggcagcgactgacggcatgcttgggcttgggaggggatcagttagcctcgtttcacagctcaagcagcaagggatcaccaagaatgtccttggccattgcctcagcacgaatggaggggggttcctcttctttggcgatgatattgtgcctacatcacgtgtaacttgggtaccgatggcgaagatatctgggaactactactcacctggctcaggaacattgtacttcgatagacgttcacttggcgtgaagccaatggaggtggtatttgacagtggtagcacctatacctattttactgctcagccataccaagctgttgtttctgcgctcaaaagtggtctcagcaaatcacttaaacaggtgtcagatcccagtctgcctctgtgctggaaaggtccgaaagcattcaaatctgtgtttgacgtcaagaaggaattcaagtcactgtttctgagctttgccagtgccaagaatgccgtcatggagatccctcctgaaaactacctcattgttacaaaaaatggaaatgtgtgcttgggcatccttgatggagcggctgccaagctgaatttcaacgtaattggagacatcacgatgcaggatcagatggtgatatatgacaatgagaagtcacagctgggatgggcgcgtggggcatgcactaggagtgccaagtctatcatgtcttcctttccctga

SEQ ID NO: 5710 - protein, 415 aa, Sorghum bicolor
  misc_feature: Ceres ANNOT ID no. 6054093
  misc_feature (53)..(401): Pfam Id: Asp Pfam Desc: Eukaryotic aspartyl protease
  misc_feature (60)..(415): NCBI GI: 21805926 NCBI Desc: nucellin-like aspartic protease [zea mays]
  misc_feature (1)..(415): NCBI GI: 62954888 NCBI Desc: nucellin-like aspartic protease [oryza sativa (japonica cultivar-group)]
  misc_feature (12)..(409): NCBI GI: 114152773 NCBI Desc: aspartic proteinase asp1 precursor (osasp1) (osap1) (nucellin-like protein)
  misc_feature (36)..(407): NCBI GI: 21592493 NCBI Desc: nucellin-like protein [arabidopsis thaliana]
  misc_feature (24)..(408): NCBI GI: 56692305 NCBI Desc: nucellin-like protein [daucus carota]
MAAASSRWTPAAGLLLLLLLLVPFAAIPSRAATPAASSTAIFQLQGNVYPTGHYYVTMNIGNPAKPYFLDVDTGSDLTWLQCDAPCRSCNKVPHPLYRPTANSLVPCANALCTALHSGHGSNNKCPSPKQCDYQIKYTDSASSQGVLINDNFSLPMRSSNIRPGLTFGCGYDQQVGKNGAVQAATDGMLGLGRGSVSLVSQLKQQGITKNVLGHCLSTNGGGFLFFGDDIVPTSRVTWVPMAKISGNYYSPGSGTLYFDRRSLGVKPMEVVFDSGSTYTYFTAQPYQAVVSALKSGLSKSLKQVSDPSLPLCWKGPKAFKSVFDVKKEFKSLFLSFASAKNAVMEIPPENYLIVTKNGNVCLGILDGAAAKLNFNVIGDITMQDQMVIYDNEKSQLGWARGACTRSAKSIMSSFP

SEQ ID NO: 5711 - DNA, 2331 bp, Sorghum bicolor
  misc_feature: Ceres ANNOT ID no. 6054098
  misc_feature: Encodes the peptide sequence at SEQ ID NO 5712
atgcctcgtaaggcctcgtcaacctcagattcgcgcctgaaatggcgcaagcggaagcgcaacccggacgcgtccccgtccaagccctccacctcggccgccgccgaccactccgacgactccgactccgccgacgaggacgccgccgtggccgcccacggcgccgcacccggcgacgacgacgaggccgcccccgcgctcagcctccgcgaggcggaggtgctgccctcggccgaggccatctctggtttccccgccgccaagcgccgcgtggtcaaccggccgcatccgtccgtcctcgcgctgctcgaggccgagcgatccgctcgttccggcgatgccccgaccgtggcaccgccggcgctggagaacatctcgcacgggcagctgcaggtgctgtccggggtgcttccggaccacccgtcccttgcgacagaccccgacaagccgtccttgtatgtgtgcacgccgcctcccctcatggaggggcatggggtgcccaagcagttccagggtcgcctccatgtggtgcccaagcactcagattggttctcaccggggacagttcataggctggaaaggcaggtagtgccacacttctttacgggcaagtctccagggcacactccggagaagtatgtcatgttaaggaataaagtcattgctaaatacttagagaacccaaacaagaggcttgcttttgccgagtgccaggggcttgttgggagcacagctgaactgtatgatctgagtaggattgttaggttcttggacacttggggcatcatcaactaccttgcggccgggtctgtgcaccgtggcctcaggatggcaacttcgcttctaagagaggaacctacaggggaactgcagttgcttacagcgccgttgaaatcaatcgatggtctgattttgtttgaccggccaaaatgtagcctcccagcggaggatgtttcttcgatggcagcgtcttcgtcgaactcggaggctgtggattttgatgctgcatttgcagacttggatggaaagattagggagcgtttgtctgagaactcttgcagttattgcttacagcctctgccaagtttacattaccggtcacaaaaggaggcagatacttttctatgttctgagtgcttccatgatgcgagatatattactgggcattctagcttagatttccagagagtcgatggggataatgatggatcagaaaatgatagtgataaatggactgatgaagaaacattgttgctattggaaggcattgagaagtacaatgacaactgggatgacattgcaagtcatgttggaacaaaatcaaaggcacaatgtatttaccattttattcagttgccagtggaagatggtttgctagagaatgttgagatacctaatgtacccattccatttcgaccacaaagcaatggttatcaacattcagattccaatggcagcacttcaggagctccagttcaaaatattcaacaaggaaatcagcttccattcattaactcttctaatccggtcatgtcattggttgcatttttggcctcttcaattggaccaagagttgcagcttcatgcgcacatgcagcattatcttttttgacaagagatgatgactccagggtgagttcagaaggcatgcatgctgatggtatgggcaatggtgcaaatccaaattttcggaaccattatggtgcttcaccatccatttctccagaaaatgtgaaacatgctgccatgtttggtctgtcagcagcagcaatgaagtctaagctctttgccgatcaagaggaacgtgaagttcaaagactagctgctactgtaataaatcatcagttaaagagattggagttgaagctgaagcagtttgcggaagttgagaccttgctcttgaaggaatgtgaacaagtagaaagggttagacagaggatttcagctgaacgcgtcaggatgaggtcagccctattaggtcccaccggaagcggtctgccagggggcagtagcaccatgccatcaaatccagcaggcatgagccccagaccaatcggtgtgccaggctccatgccacagaccagcatggcagccacatatgccaacaacatgcaggggcatgggcatcctccaatgcctcagatgccgttcttacatcagcggccgcagatgctctcattcggccctcgcctaccactctcggctatccagactcaaccatcgccacaggcatcaaacatcatgttcaactctggcatgcccaattcgattgctcctaaccaccatcagttgctgagatcgtcttctggaaacaattctagtgcaggatag

SEQ ID NO: 5712 - protein, 776 aa, Sorghum bicolor
  misc_feature: Ceres ANNOT ID no. 6054098
  misc_feature (175)..(265): Pfam Id: SWIRM Pfam Desc: SWIRM domain
  misc_feature (408)..(453): Pfam Id: Myb_DNA-binding Pfam Desc: Myb-like DNA-binding domain
  misc_feature (103)..(370): NCBI GI: 115487622 NCBI Desc: os12g0176700 [oryza sativa (japonica cultivar-group)]
  misc_feature (6)..(370): NCBI GI: 140053641 NCBI Desc: swirm [medicago truncatula]
  misc_feature (42)..(491): NCBI GI: 30690036 NCBI Desc: dna-binding family protein [arabidopsis thaliana]
  misc_feature (363)..(549): NCBI GI: 140053642 NCBI Desc: heavy metal transport/detoxification protein; homeodomain-related [medicago truncatula]
  misc_feature (42)..(491): NCBI GI: 42573171 NCBI Desc: dna-binding family protein [arabidopsis thaliana]
  misc_feature: The sequence is a functional homolog of SEQ ID NO. 492 in the 11/188,298 US application
MPRKASSTSDSRLKWRKRKRNPDASPSKPSTSAAADHSDDSDSADEDAAVAAHGAAPGDDDEAAPALSLREAEVLPSAEAISGFPAAKRRVVNRPHPSVLALLEAERSARSGDAPTVAPPALENISHGQLQVLSGVLPDHPSLATDPDKPSLYVCTPPPLMEGHGVPKQFQGRLHVVPKHSDWFSPGTVHRLERQVVPHFFTGKSPGHTPEKYVMLRNKVIAKYLENPNKRLAFAECQGLVGSTAELYDLSRIVRFLDTWGIINYLAAGSVHRGLRMATSLLREEPTGELQLLTAPLKSIDGLILFDRPKCSLPAEDVSSMAASSSNSEAVDFDAAFADLDGKIRERLSENSCSYCLQPLPSLHYRSQKEADTFLCSECFHDARYITGHSSLDFQRVDGDNDGSENDSDKWTDEETLLLLEGIEKYNDNWDDIASHVGTKSKAQCIYHFIQLPVEDGLLENVEIPNVPIPFRPQSNGYQHSDSNGSTSGAPVQNIQQGNQLPFINSSNPVMSLVAFLASSIGPRVAASCAHAALSFLTRDDDSRVSSEGMHADGMGNGANPNFRNHYGASPSISPENVKHAAMFGLSAAAMKSKLFADQEEREVQRLAATVINHQLKRLELKLKQFAEVETLLLKECEQVERVRQRISAERVRMRSALLGPTGSGLPGGSSTMPSNPAGMSPRPIGVPGSMPQTSMAATYANNMQGHGHPPMPQMPFLHQRPQMLSFGPRLPLSAIQTQPSPQASNIMFNSGMPNSIAPNHHQLLRSSSGNNSSAG

SEQ ID NO: 5713 - DNA, 1320 bp, Sorghum bicolor
  misc_feature: Ceres ANNOT ID no. 6054107
  misc_feature: Encodes the peptide sequence at SEQ ID NO 5714
atggaggcgagcggcagtcggggccggagcgggagcgcggttcccaagcgccgcagaggcgtcggcgcggctaccggctccggttcgacggcgcagtcgctgaacgacgacatcctccggtccgtcttctcccgcctggacgaccacttcgacctcgcccgctgctccgccgtctgcggcacatggaataggataattgaaacagctcatctcatgaaggatctgtattacaaaaggaatccatcagtaagaggttcaagctctaacatttctgtaaaaagttactttgagatgcttgccatggatgagcatgcatcctctttctctagaggacctgctgaagcttttcagtggattgggcacccaatacgggctaccttgtgccgtatgaagagtggttcaattttaactggagttggagataagattctccggctttggtctgctgaaagctgcaaattcatgaatgagtacaatgtgccaaattctaaaacattagtcgacttcgattttgacgaaaataagattgtaggtttaactagctcccagatttgcatatggagacgcaatgaaccaaggagcatatttcaatctggtggagcctcatttaatcatgggttatgcatgagttatgctgacccagaggttgtaattggctgtgaggatggtcgagcctttgtatatgatatgtacagcaggagttgctcaagcatctatcggcttcactcctctcctgtgacatgcttggcattaacagacgaccagctgattgttggtggttcgacatttggaagtgtagctattgcagatcaaacctcaggacagaagttaggtgttctgaaatcagcttatgcaccattggcaataagatccttatctttctgcacaaattcacatatgatatttgctggctcgtcagctggttatgctcattgctgggacttaaggactttgaggcctctatgggaaaacagagtcagcccaaatgtcatctacagcacacgtcatttgcctggtgacacggcaacactagcagttggaggcattgacggtgtgcttcgcattatatgccagaaaaccggtgaaaccattcgatgccttgtcgtggacgcagaccgcccagcagaagccgcatctagatccaggccgcaaatagagaagaaacctgttcgcaggattgaccctgatgcgcaggtggacagcatcccgagacgcttgcgccctcagattaccagcctatcggttggcatgaagaagattgtgaccacgcatggcgaaaactacatcagggtttggaagttccgcccaaaaagctcgtga

SEQ ID NO: 5714 - protein, 439 aa, Sorghum bicolor
  misc_feature: Ceres ANNOT ID no. 6054107
  misc_feature (29)..(77): Pfam Id: F-box Pfam Desc: F-box domain
  misc_feature (175)..(434): NCBI GI: 22331742 NCBI Desc: f-box family protein / wd-40 repeat family protein [arabidopsis thaliana]
  misc_feature (84)..(314): NCBI GI: 40949819 NCBI Desc: will die slowly [bombyx mori]
  misc_feature (136)..(313): NCBI GI: 119490023 NCBI Desc: serine/threonine kinase with wd-40 repeat [lyngbya sp. pcc 8106]
  misc_feature (208)..(367): NCBI GI: 41152004 NCBI Desc: f-box and wd-40 domain protein 1b [danio rerio]
  misc_feature (177)..(364): NCBI GI: 87309635 NCBI Desc: tyrosine protein kinase:wd-40 repeat:serine/threonine protein kinase [blastopirellula marina dsm 3645]
MEASGSRGRSGSAVPKRRRGVGAATGSGSTAQSLNDDILRSVFSRLDDHFDLARCSAVCGTWNRIIETAHLMKDLYYKRNPSVRGSSSNISVKSYFEMLAMDEHASSFSRGPAEAFQWIGHPIRATLCRMKSGSILTGVGDKILRLWSAESCKFMNEYNVPNSKTLVDFDFDENKIVGLTSSQICIWRRNEPRSIFQSGGASFNHGLCMSYADPEVVIGCEDGRAFVYDMYSRSCSSIYRLHSSPVTCLALTDDQLIVGGSTFGSVAIADQTSGQKLGVLKSAYAPLAIRSLSFCTNSHMIFAGSSAGYAHCWDLRTLRPLWENRVSPNVIYSTRHLPGDTATLAVGGIDGVLRIICQKTGETIRCLVVDADRPAEAASRSRPQIEKKPVRRIDPDAQVDSIPRRLRPQITSLSVGMKKIVTTHGENYIRVWKFRPKSS

SEQ ID NO: 5715 - DNA, 1542 bp, Sorghum bicolor
  misc_feature: Ceres ANNOT ID no. 6054111
  misc_feature: Encodes the peptide sequence at SEQ ID NO 5716
atgatcggtgatgaagtggattcagatgttgttgtacgctacttcagaggcaagagcatcctgatcactggttcaactggcttcctggggaaagtgcttgtggagaagatactgagggttcagccggacgtcaagaagatcttcctccttattcgagccgccgatgtcgagtctgcgaagcagagggtcgagaccgaggtgacaggaagggagatcttccaaattttgaaaaacaagcatggtaatgggtttgaaggtttcatccaagaaaaaatatgccctttaccaggagacgtcatgtatgagaacttgggcctaggccctgccaaactgagagaagtatgcaaagaaatagacatcattgtcaatggagctgcaactacaaatttctacgaaaggtatgatgtggctttcgacacaaatgtcatgggagccaaacacatttgtgagtttgcaaaaaggtgcagtaaactcaagatgctgctacatgtttcaacagcttatgtagccggtgaacaagaaggggtagtgctagagaagccattccgtttgggtgaaaccctgagggaaggcacgcacctggacatcgaatccgaactaaatctgataaaagagaccaggagagaactgaaagccaactgttcttcggaaaaggttgagagaagaaccatgaaggatcttggcctcaagagggcaagggagtttgggtggccaaacacctatgtgttcaccaaagccatgggggagatgctgctgggacaccttcgaggagatctcccagtcgtcatcgtccggccgagcatcataaccagcatcctgaacgagccgttgcctggatggatggaagggatcaggacaattgactcgttcatcatcggctacgcgaagcaggctctgtcaatcttcttagttgacctcgagttgataatggacgtgattccgggggacatggtggtgaacgccatgatggtggccatggcggcgcactcggaggagcaggcgcagcaactgagcatctaccacctgacgtcgtcggtgcggcacccggcgccgtacgccgtcctcgcggagtgcggccaccgctacttcctccacaatccactgatgaggtccgggtccgggtccggcggcaagaacagcggcgagcccgtgcggcctgccaggatgcgcttcttccgcacgctccccaggttccgcgcctacatggccgtcaagttcaggcttccccgcgagatccttcgcctgctcaacatcgccctgtgcggcgcgttctcccggcgctacgacgagctcagcaggaagtacagatacgtcatgcatattgcagagctgtacgcgccatacgccttgttcaaaggatgctttgatgactccaacacggagaggctgagggtggcgatggcgaacaacaacaacaacaacaataataacgggcaagacaggaaatatgatgagtttggttttgatcccaagtgcatagactgggacgactacttctacagggttcacatccccggtgttgtcaagtacctgtgggattag

SEQ ID NO: 5716 - protein, 513 aa, Sorghum bicolor
  misc_feature: Ceres ANNOT ID no. 6054111
  misc_feature (22)..(322): Pfam Id: NAD_binding_4 Pfam Desc: Male sterility protein
  misc_feature (404)..(514): Pfam Id: Sterile Pfam Desc: Male sterility protein
  misc_feature (20)..(320): Pfam Id: Epimerase Pfam Desc: NAD dependent epimerase/dehydratase family
  misc_feature (1)..(511): NCBI GI: 115480737 NCBI Desc: os09g0567500 [oryza sativa (japonica cultivar-group)]
  misc_feature (4)..(511): NCBI GI: 22003092 NCBI Desc: fatty acyl coa reductase [triticum aestivum]
  misc_feature (4)..(511): NCBI GI: 22003084 NCBI Desc: fatty acyl coa reductase [triticum aestivum]
  misc_feature (11)..(474): NCBI GI: 38346871 NCBI Desc: osjnbb0002n06.11 [oryza sativa (japonica cultivar-group)]
  misc_feature (11)..(474): NCBI GI: 116309533 NCBI Desc: osigba0092g14.8 [oryza sativa (indica cultivar-group)]
MIGDEVDSDVVVRYFRGKSILITGSTGFLGKVLVEKILRVQPDVKKIFLLIRAADVESAKQRVETEVTGREIFQILKNKHGNGFEGFIQEKICPLPGDVMYENLGLGPAKLREVCKEIDIIVNGAATTNFYERYDVAFDTNVMGAKHICEFAKRCSKLKMLLHVSTAYVAGEQEGVVLEKPFRLGETLREGTHLDIESELNLIKETRRELKANCSSEKVERRTMKDLGLKRAREFGWPNTYVFTKAMGEMLLGHLRGDLPVVIVRPSIITSILNEPLPGWMEGIRTIDSFIIGYAKQALSIFLVDLELIMDVIPGDMVVNAMMVAMAAHSEEQAQQLSIYHLTSSVRHPAPYAVLAECGHRYFLHNPLMRSGSGSGGKNSGEPVRPARMRFFRTLPRFRAYMAVKFRLPREILRLLNIALCGAFSRRYDELSRKYRYVMHIAELYAPYALFKGCFDDSNTERLRVAMANNNNNNNNNGQDRKYDEFGFDPKCIDWDDYFYRVHIPGVVKYLWD

SEQ ID NO: 5717 - DNA, 1533 bp, Sorghum bicolor
  misc_feature: Ceres ANNOT ID no. 6054113
  misc_feature: Encodes the peptide sequence at SEQ ID NO 5718
atgatcggtgatgaactggattcagaagttgttgtacgctacttcagaggcaagagcatcctgatcactggttcaactggcttcctggggaaagtgcttgcggagaagatactgagggttcagccggatgtcaagaagctcttcctccttattcgagccgccgatgtcgagtctgcgaagcagagggtcgagactgaggtgacaggaagggagatctttcaaattttgaaacaaaagcatggtaatgggtttgaaggcttcatccaagaaaaagtatgccctttgccaggagacgtcatgtatgagaacttgggcctagcccctgccaaactgagagaagtatggaaagaaatagacatcattgtcaatggagctgcaactacaaatttctacgaaaggtatgatgtggctttcgacacaaatgtcatgggagccaagcgcatatgcgagtttgcaaagaggtgcagcaaactgaagatgctgctacatgtttcaacagcttatgtagccggtgaacaagaagggatagtgctagagaagccattccatttgggtgaaaccctgagggaaggcacgcacctggacatcgaatccgaactaaatctgataaaagagaccaggagagaactgaaagccaaccgttcttcagaaaaggctgagagaagaaccatgaaggagcttggcctcaagagggcaagggagtttgggtggccaaacacctatgtgttcaccaaagccatgggggagatgctgctgggacactttagaggagatctcgcagtcgtcatcgtccggcctagcatcataaccagcatcctgaacgagccgttgcctggatggatggaagggatcaggacaattgactcgttcatcgtcggctacgccaagcaggctttgtcaatcttcttagttgatctcgacttgataatggacgtgattccgggggacatggtggtgaacggcatgatggtggccatggcagcgcactcggaggatcagacgaccctgagcatctaccacctgacgtcgtcgctgcggcagccggcgccgtacgccgtcctggccgagtcggcccaccgctacttcctccacaacccgccgcgctccggcggcgttggcaagaagaacaacagcggcgagcccgccgtgcagcagcttagcaggatgcgcttcttccgcacgctccccaggttccaagcctacatggccgtcaagttcaggcttcccctcgaggcccttcgcctgctcaacatcgccctgtgcggcgccttctcccggcgctacgacgagctcagcaggaagttcagatacgtcatgcatattgcagagctgtatgctccatacgccttgttcaaaggatgcttcgacgactccaacacagagaggctgagggcggcgacggcgaacaacaacaataataacgggcaagacaggaaatatgatgactttggttttgatcccaagtgcatagactgggacgactacttctacagggttcacatcccaggtgttgttaagtacctgtgtgattag

SEQ ID NO: 5718 - protein, 510 aa, Sorghum bicolor
  misc_feature: Ceres ANNOT ID no. 6054113
  misc_feature (22)..(322): Pfam Id: NAD_binding_4 Pfam Desc: Male sterility protein
  misc_feature (404)..(511): Pfam Id: Sterile Pfam Desc: Male sterility protein
  misc_feature (20)..(320): Pfam Id: Epimerase Pfam Desc: NAD dependent epimerase/dehydratase family
  misc_feature (1)..(508): NCBI GI: 115480737 NCBI Desc: os09g0567500 [oryza sativa (japonica cultivar-group)]
  misc_feature (4)..(508): NCBI GI: 22003092 NCBI Desc: fatty acyl coa reductase [triticum aestivum]
  misc_feature (4)..(508): NCBI GI: 22003084 NCBI Desc: fatty acyl coa reductase [triticum aestivum]
  misc_feature (11)..(510): NCBI GI: 38346871 NCBI Desc: osjnbb0002n06.11 [oryza sativa (japonica cultivar-group)]
  misc_feature (11)..(507): NCBI GI: 38346864 NCBI Desc: osjnbb0002n06.4 [oryza sativa (japonica cultivar-group)]
MIGDELDSEVVVRYFRGKSILITGSTGFLGKVLAEKILRVQPDVKKLFLLIRAADVESAKQRVETEVTGREIFQILKQKHGNGFEGFIQEKVCPLPGDVMYENLGLAPAKLREVWKEIDIIVNGAATTNFYERYDVAFDTNVMGAKRICEFAKRCSKLKMLLHVSTAYVAGEQEGIVLEKPFHLGETLREGTHLDIESELNLIKETRRELKANRSSEKAERRTMKELGLKRAREFGWPNTYVFTKAMGEMLLGHFRGDLAVVIVRPSIITSILNEPLPGWMEGIRTIDSFIVGYAKQALSIFLVDLDLIMDVIPGDMVVNGMMVAMAAHSEDQTTLSIYHLTSSLRQPAPYAVLAESAHRYFLHNPPRSGGVGKKNNSGEPAVQQLSRMRFFRTLPRFQAYMAVKFRLPLEALRLLNIALCGAFSRRYDELSRKFRYVMHIAELYAPYALFKGCFDDSNTERLRAATANNNNNNGQDRKYDDFGFDPKCIDWDDYFYRVHIPGVVKYLCD

SEQ ID NO: 5719 - DNA, 1104 bp, Sorghum bicolor
  misc_feature: Ceres ANNOT ID no. 6054119
  misc_feature: Encodes the peptide sequence at SEQ ID NO 5720
atgtttgagcaggtggtgtcggatttctgctggcatgcgagggaagtagtgtcgtcagcgatggggctctggggctggccctgggggcggcgtggcccgtcgggcttcggctccgcgtccaccgccgaggaggtcaccgccggcgtcgacgccagcaacctcaccgccatcgtcacaggagcaacgaatggcattggaaaggagacggccagagtgctagcactgaggggagcaaaggtgatcataccagctaggacgctggagagtggcctgaaggtgaaagagagcctcgcagaacaggtcccgagctccaagctgcacgtcatggagatggacctgagctctctcagctccgtccgcgacttcgcgcggtccttcgattcatctcaccagcatctgaacctcctcataaacaatgcagggattatggcctgcccttaccagctctccaaggatggaatcgagctacaattcgcaactaatcatgttggccatttcttgctgacaagtctcctgctagacaagatgaaatcaactgctagagagacaggtgtgcagggcaggatcataaacgtatcatccattgcgcataaaagaagtgatggtacatgctttgagttgaacaagctaaacgataaggataggtaccagccgttcattgcatatgcacattcaaaattagccaatattctccacgcaaatgagttgtccaggcgttttcaggaagaaggatgcaatctgacagcgaattccctgcatcctggagtaatcatcaccaatatcattcgctatgttgcaggaaacaacagtgcgctgatttcggttctgtcccctgtagcaaatctttttctgaagagcgtaccccagggagctgcaactacttgctacctggcattacaccctaatgtcaaagatgtaactggtaaatactttgcggactgcaatgaagcaacgccgactgctgtcgcaagagattcagagctggcgaagaggctatggtcgttcagcgaagaacttgtagggaccaatgcagatatgtcacagacgacacaggcaagtgaagaagaggacgtacaagcgaaagacgttttccaagaccagtag

SEQ ID NO: 5720 - protein, 367 aa, Sorghum bicolor
  misc_feature: Ceres ANNOT ID no. 6054119
  misc_feature (54)..(203): Pfam Id: adh_short Pfam Desc: short chain dehydrogenase
  misc_feature (21)..(345): NCBI GI: 62734079 NCBI Desc: short-chain dehydrogenase tic32 [oryza sativa (japonica cultivar-group)]
  misc_feature (21)..(342): NCBI GI: 18413950 NCBI Desc: short-chain dehydrogenase/reductase (sdr) family protein [arabidopsis thaliana]
  misc_feature (26)..(349): NCBI GI: 30686197 NCBI Desc: short-chain dehydrogenase/reductase (sdr) family protein [arabidopsis thaliana]
  misc_feature (26)..(340): NCBI GI: 42725482 NCBI Desc: short-chain dehydrogenase tic32 [pisum sativum]
  misc_feature (29)..(342): NCBI GI: 124359195 NCBI Desc: short-chain dehydrogenase/reductase sdr [medicago truncatula]
  misc_feature: The sequence is a functional homolog of SEQ ID NO. 453 in the 11/188,298 US application
  misc_feature: The sequence is a functional homolog of SEQ ID NO. 389 in the 11/188,298 US application
MFEQVVSDFCWHAREVVSSAMGLWGWPWGRRGPSGFGSASTAEEVTAGVDASNLTAIVTGATNGIGKETARVLALRGAKVIIPARTLESGLKVKESLAEQVPSSKLHVMEMDLSSLSSVRDFARSFDSSHQHLNLLINNAGIMACPYQLSKDGIELQFATNHVGHFLLTSLLLDKMKSTARETGVQGRIINVSSIAHKRSDGTCFELNKLNDKDRYQPFIAYAHSKLANILHANELSRRFQEEGCNLTANSLHPGVIITNIIRYVAGNNSALISVLSPVANLFLKSVPQGAATTCYLALHPNVKDVTGKYFADCNEATPTAVARDSELAKRLWSFSEELVGTNADMSQTTQASEEEDVQAKDVFQDQ

SEQ ID NO: 5721 - DNA, 678 bp, Sorghum bicolor
  misc_feature: Ceres ANNOT ID no. 6054129
  misc_feature: Encodes the peptide sequence at SEQ ID NO 5722
atgcaggcggcggcggcggccgtggcgtgggcgccgggcccgtcggcgtccacctcctcatcgtcctcgccctccgccttcagggtgggggttccgtcgacggccgtgccggcttcttccgcgcctaggcttgttgccgcctccgcgcccctgggtcgtcgacggcggcggcaagtggttcaagctgttgccaatccagaccctgcaatcaagctgccattgactgctgaaaatgttgagatggtgttggatgaagtaaggccgtatcttatggcagacggaggcaatgttgcgttgcatgagattgatgggaacatggtaaggttaaagctgcaaggagcatgtgggtcgtgcccagcttcagtaacaacgatgaagatgggtattgagcggcgcttgatggagaaaataccggagattgttgcggttgagcccatcgcggatgaggagactggccttgagttgaaccaagagaacattgaaaaggtacttgacgagattaggccataccttgctggcacaggaggtggcgagcttgagtttgtcacaatcgaggagcctattgtcaaggttaggcttacaggcccagctgctggtgtgatgactgtccgagtagcgttgactcagaagctccgtgagaagatccctaaaattgcagctgtccagctattgccataa

SEQ ID NO: 5722 - protein, 225 aa, Sorghum bicolor
  misc_feature: Ceres ANNOT ID no. 6054129
  misc_feature (79)..(146): Pfam Id: NifU Pfam Desc: NifU-like domain
  misc_feature (160)..(224): Pfam Id: NifU Pfam Desc: NifU-like domain
  misc_feature (3)..(224): NCBI GI: 75147032 NCBI Desc: nifu-like protein 1, chloroplast precursor (osnifu1)
  misc_feature (51)..(224): NCBI GI: 124360086 NCBI Desc: nitrogen-fixing nifu, c-terminal [medicago truncatula]
  misc_feature (72)..(224): NCBI GI: 21554503 NCBI Desc: nitrogen fixation like protein [arabidopsis thaliana]
  misc_feature (72)..(224): NCBI GI: 4538920 NCBI Desc: nitrogen fixation like protein [arabidopsis thaliana]
  misc_feature (72)..(224): NCBI GI: 110738975 NCBI Desc: nitrogen fixation like protein [arabidopsis thaliana]
MQAAAAAVAWAPGPSASTSSSSSPSAFRVGVPSTAVPASSAPRLVAASAPLGRRRRRQVVQAVANPDPAIKLPLTAENVEMVLDEVRPYLMADGGNVALHEIDGNMVRLKLQGACGSCPASVTTMKMGIERRLMEKIPEIVAVEPIADEETGLELNQENIEKVLDEIRPYLAGTGGGELEFVTIEEPIVKVRLTGPAAGVMTVRVALTQKLREKIPKIAAVQLLP

SEQ ID NO: 5723 - DNA, 1755 bp, Sorghum bicolor
  misc_feature: Ceres ANNOT ID no. 6054136
  misc_feature: Encodes the peptide sequence at SEQ ID NO 5724
atgctccgccgcggcgtgctcctccaggcggccgtccacctcctcctcctcctcgccgtcgcacgctcgcccctcgcgtacgcctcggaggccgaccacaagtataaaacagaagaaccagttaagctatgggtaaacaaggttgggccttacaataaccctcaagagacttacaactattacagtctcccattttgtcaaccatctgaaaacccttcacataaatggggtggtctcggagaggtccttggtggaaatgagctgattgatagtcagatcgatataaagttcataaaaaatgtggacaagggggccatttgcacaattgaacttgatgctcaaaaggttgagcaatttgctaatgccattgaaaactcatattggtttgagcttttcataggttttgttggggagactgacaaaaacaatgagaacaagcactacctttacactcataagaacattgttgttaaatacaatggtaacaggataattcatgtgaatctaacgcaagagtcacctaagcttcttgtagctggtaaaaagttggatatgacatattcagtcaagtgggtgcaaacaaatgtagcatttgcacggcgtttcgaggtttacttagactacccgttctttgaacaccagattcattggttctccatcttcaattcattcatgatggttattttcttgactggtttagtgtcaatgatattgatgaggacactaagaaatgattatgcaaaatatgctcgtgaagatgacgatctggaatcacttgagcgagatgttagtgaggaatccgggtggaagcttgtccatggtgatgtgttccgacctcctcgcagcctggtgtttctttctgcccttgttggtattggcactcagctagcagctcttatcctgcttgtgattgtgttggccattgttggcatgttatatgttgggcgaggagctatcatcacaacctttattgtgtgctatgctcttacatctttcatctctggatatgttagtggtggcctctattcaaggaatggtggcaaaacctggataaaggctatggtccttacggcatcactttttccattcttgtgtttctcaattggattggtgttaaacactattgctatcttctaccgatcattagcagctataccatttggcacaatggttgtcatgtttgttctttgggctttcatctccttcccgttggttctattggggactgtagttggtaggaattggagtggtgctcccaacaacccatgtcgtgtgaaaacgatcccacgccctattcctgagaagaagtggtaccttacaccttctgttatttcattgatgggtggacttctccccttcggcagcatcttcattgagatgtactttgtattcacttccttctggaactacaaggtgtactacgtctatggtttcatgttgctggtctttgtcatcctcataatagttaccatatgtgtcactattgtgggtacttatttcttgttgaatgctgagaactatcattggcaatggacatcattcttctctgctgcttctaccgccttgtatgtatatctatactctatatactattatcatgtgaagacaaagatgtcaggctttttccagacaagcttttactttggttacaccttgatgttctgtcttggattgggaatactttgcggtgctgttggatatttgggctccactctatttgtgaggagaatctacagaaatatcaaatgcgactaa

SEQ ID NO: 5724 - protein, 584 aa, Sorghum bicolor
  misc_feature: Ceres ANNOT ID no. 6054136
  misc_feature (56)..(542): Pfam Id: EMP70 Pfam Desc: Endomembrane protein 70
  misc_feature (10)..(584): NCBI GI: 1931647 NCBI Desc: endomembrane protein emp70 precusor isolog; 68664-64364 [arabidopsis thaliana]
  misc_feature (16)..(584): NCBI GI: 92885243 NCBI Desc: nonaspanin (tm9sf) [medicago truncatula]
  misc_feature (27)..(584): NCBI GI: 92889078 NCBI Desc: nonaspanin (tm9sf) [medicago truncatula]
  misc_feature (5)..(584): NCBI GI: 55957668 NCBI Desc: sm-11044 binding protein (smbp)(ep70-p-iso) [homo sapiens]
  misc_feature (5)..(584): NCBI GI: 60359970 NCBI Desc: mkiaa4036 protein [mus musculus]
MLRRGVLLQAAVHLLLLLAVARSPLAYASEADHKYKTEEPVKLWVNKVGPYNNPQETYNYYSLPFCQPSENPSHKWGGLGEVLGGNELIDSQIDIKFIKNVDKGAICTIELDAQKVEQFANAIENSYWFELFIGFVGETDKNNENKHYLYTHKNIVVKYNGNRIIHVNLTQESPKLLVAGKKLDMTYSVKWVQTNVAFARRFEVYLDYPFFEHQIHWFSIFNSFMMVIFLTGLVSMILMRTLRNDYAKYAREDDDLESLERDVSEESGWKLVHGDVFRPPRSLVFLSALVGIGTQLAALILLVIVLAIVGMLYVGRGAIITTFIVCYALTSFISGYVSGGLYSRNGGKTWIKAMVLTASLFPFLCFSIGLVLNTIAIFYRSLAAIPFGTMVVMFVLWAFISFPLVLLGTVVGRNWSGAPNNPCRVKTIPRPIPEKKWYLTPSVISLMGGLLPFGSIFIEMYFVFTSFWNYKVYYVYGFMLLVFVILIIVTICVTIVGTYFLLNAENYHWQWTSFFSAASTALYVYLYSIYYYHVKTKMSGFFQTSFYFGYTLMFCLGLGILCGAVGYLGSTLFVRRIYRNIKCD

SEQ ID NO: 5725 - DNA, 1689 bp, Sorghum bicolor
  misc_feature: Ceres ANNOT ID no. 6054233
  misc_feature: Encodes the peptide sequence at SEQ ID NO 5726
atggcgtcggcggcggggtcgggcggcggggccggcgcgggggccggcgggctgaagacctacttcaagacccctgaggggcggcacaagctgcagtacgagaagacgcactcccccgccgtcgtgcactacaaccacagcggcaagaccgtctcccagatgacggtggcatatttgaaggagaagccagcaggccagggttccacgccttcaacaccaagtgctggtagtgggatgcggtctgcagctgcaaggctgctcggcactgggaatgggagccgggcacttagctttgggaacaatggtaccagcagggctgtctcaggaaacagccgcatgggtggaggcatcggtgtgtcgactagtgcgagtgcatcgcaagccatggcgaactatgatggaaagggcacgtacatcatattcaatactgcggatacacttttcatcagtgatctcaactcacacgacaaagatccaataaagtccatccacttcagcagctcaaacccgctttgccatgcatttgacccagaggccaaggatgggcacgatctgctcgttggggtgttctcaggagatgtctattcaatgtcactgaggcagcagttgcaagatcctggaaagaagcccgtttcatatcagcattttgttaataaagacaaagacaaagacaaagatccaagtcaagcagccagtcggtgcacttgtgtggcatgggttccagagcgtgaaggaatttttgttgttagtcatgctgatgggaatctgtacgtgtatgacaaatccaaggatggaaatactgattggacatttccaactgtaaaggatcaaagccaggtgctgatttcacatgcaaagtcgagtaagggtaatccaattgcaaggtggcacatctgtcaaggtgcaatcaatggcatttccttttcaccagatggtgcttacttggcaactgttgggcgagatggttatttaagagtatttgactttgcgaaagaacaactaatatttggtgggaaaagttactatggtgcactgttgtgttgttcttggagtgcggatggcaaatatttgttatcaggtggtgaagatgatcttgtgcaagtatggagcatggatgaaagaaagatagttgcatggggcgaagggcataattcatgggttagtgcagtttcttttgatccatattggtccccaccaaattcagatgaaacggaagaaaatgtcatgtatcgctttgggtcagttggacaggatacccaactgcttctctgggatctggcattggaggagattgctgtccctctacgccatccttcaggtggctcaccgacattcagtagtggaagcccttctgcacactgggacaatgcatgccctccaaccggtgttctccagccttctccacggatgcgagatgtgccaaagctctcacctcttgttgcacaccgggtacatgtagatcccctatctggcgtggaattcactagtgaatcaatcctcactatatgccgtgaggggctaatcaaaatttgggcccgacccattcatagtgaaaacaaccagcagccagattcttctgaacaggttgtaggcaatgctactgctaaggataagatgttaacatcatcaaataaagcaggtgcttccagctccagcttcaagcaaccgccatctgttcttttcacatga

SEQ ID NO: 5726 - protein, 562 aa, Sorghum bicolor
  misc_feature: Ceres ANNOT ID no. 6054233
  misc_feature (290)..(328): Pfam Id: WD40 Pfam Desc: WD domain, G-beta repeat
  misc_feature (332)..(370): Pfam Id: WD40 Pfam Desc: WD domain, G-beta repeat
  misc_feature (374)..(425): Pfam Id: WD40 Pfam Desc: WD domain, G-beta repeat
  misc_feature (2)..(562): NCBI GI: 115487588 NCBI Desc: os12g0172500 [oryza sativa (japonica cultivar-group)]
  misc_feature (2)..(555): NCBI GI: 42565893 NCBI Desc: transducin family protein / wd-40 repeat family protein [arabidopsis thaliana]
  misc_feature (4)..(550): NCBI GI: 42569691 NCBI Desc: transducin family protein / wd-40 repeat family protein [arabidopsis thaliana]
  misc_feature (233)..(555): NCBI GI: 124359426 NCBI Desc: wd40-like [medicago truncatula]
  misc_feature (233)..(555): NCBI GI: 140042781 NCBI Desc: wd40-like [medicago truncatula]
MASAAGSGGGAGAGAGGLKTYFKTPEGRHKLQYEKTHSPAVVHYNHSGKTVSQMTVAYLKEKPAGQGSTPSTPSAGSGMRSAAARLLGTGNGSRALSFGNNGTSRAVSGNSRMGGGIGVSTSASASQAMANYDGKGTYIIFNTADTLFISDLNSHDKDPIKSIHFSSSNPLCHAFDPEAKDGHDLLVGVFSGDVYSMSLRQQLQDPGKKPVSYQHFVNKDKDKDKDPSQAASRCTCVAWVPEREGIFVVSHADGNLYVYDKSKDGNTDWTFPTVKDQSQVLISHAKSSKGNPIARWHICQGAINGISFSPDGAYLATVGRDGYLRVFDFAKEQLIFGGKSYYGALLCCSWSADGKYLLSGGEDDLVQVWSMDERKIVAWGEGHNSWVSAVSFDPYWSPPNSDETEENVMYRFGSVGQDTQLLLWDLALEEIAVPLRHPSGGSPTFSSGSPSAHWDNACPPTGVLQPSPRMRDVPKLSPLVAHRVHVDPLSGVEFTSESILTICREGLIKIWARPIHSENNQQPDSSEQVVGNATAKDKMLTSSNKAGASSSSFKQPPSVLFT

SEQ ID NO: 5727 - DNA, 495 bp, Sorghum bicolor
  misc_feature: Ceres ANNOT ID no. 6054241
  misc_feature: Encodes the peptide sequence at SEQ ID NO 5728
atggcgccgatgccgatgccgccgccctccggagcgatgccgcctatggacaacaacatgccgacgatgcacgcggccttcttctggggccaccgcgcgcaggtgctcttctccaactggccgggcgaccaccgcgccggcgccggcatgtacgtgctctgcctcctcgccgtggccgcgctggccgcgctcgccgaggtgctcgcggcgtggtcccgcgccctcgccggggccggccgtggctccggctcatccgacgacgcgccgtggtgggcgacgctgcaggtggcgtggatccacgtgctcaaggtgggcctgtcgtacctggtgatgctggccgtcatgtccttcaacggtggggtgttcctcgccgtcgtcgccggccacgccgccgggttcctgatcgcccggagatggaggctgctacgccctgcggtccgtgacgacgacgacggcggcggcgcgcataccaacggtgatctctgcgttagttaa

SEQ ID NO: 5728 - protein, 164 aa, Sorghum bicolor
  misc_feature: Ceres ANNOT ID no. 6054241
  misc_feature (23)..(144): Pfam Id: Ctr Pfam Desc: Ctr copper transporter family
  misc_feature (1)..(161): NCBI GI: 116309342 NCBI Desc: h0622f05.9 [oryza sativa (indica cultivar-group)]
  misc_feature (1)..(161): NCBI GI: 32479733 NCBI Desc: oj991214_12.9 [oryza sativa (japonica cultivar-group)]
  misc_feature (23)..(135): NCBI GI: 1082054 NCBI Desc: copper transporter protein [arabidopsis thaliana]
  misc_feature (7)..(150): NCBI GI: 115440199 NCBI Desc: os01g0770700 [oryza sativa (japonica cultivar-group)]
  misc_feature (23)..(137): NCBI GI: 115440201 NCBI Desc: os01g0770800 [oryza sativa (japonica cultivar-group)]
MAPMPMPPPSGAMPPMDNNMPTMHAAFFWGHRAQVLFSNWPGDHRAGAGMYVLCLLAVAALAALAEVLAAWSRALAGAGRGSGSSDDAPWWATLQVAWIHVLKVGLSYLVMLAVMSFNGGVFLAVVAGHAAGFLIARRWRLLRPAVRDDDDGGGAHTNGDLCVS

SEQ ID NO: 5729 - DNA, 1212 bp, Sorghum bicolor
  misc_feature: Ceres ANNOT ID no. 6054333
  misc_feature: Encodes the peptide sequence at SEQ ID NO 5730
atggcaaccggcgttccgccggaacccgagccccaggcaccggcgatctctcaccacattggtacaatcctcgattatctccaaaactataggattgtccttgtctccgcggcgccaggctccggcaagtccacggtgctcccccgatacctcgccaactatggcttcggcccggtcatctgcgcgcagcctcggctcctcgcggtgaccgtggcctcgtcgaaacccggccaggagcgggattccgacgacgtctggttcacgaccacccgggtgctcatcgacatgttgtgctgcaacgacgggaggccggccttcgccgcggcgttccgcacggtcgtcgtcgacgaggcacacgaccgcacgctctgcaccgacctcctcctcggggtagtcaaggccgccgtggccacggaggaaacgggtcacctcaacgtggtcgtctgcaccgccggcggaccggaagacagctcgctcagcgacttcttcttcggcgcgccgatcgtcgcgttccagcgcgcgctgcaccccgtcgcggtgcactactcgcgggggcccatgctcgacatggtgagcgcggtggtcgacgaggtgacggacatccacaggtcgaagccgcccggcgacgtgctggtgttcttgccggatatcatccgcatccaggaggcctacgagaagcttgcgcagctcgacctgccagggctggtccttcgcttcgtccacgacaacctcccggaagagttcatggactacgcactggaccctgcgccaggtggatcgaggagagtcgtgctggcgacggacgtggccgagacggctgttctggtccccgggatcacgtacgtcgtcgacaccggcgtgctgtcagaggacccgcttgcgatggtctccaaggaggcggcgatcaggcgggcagcggtggccggcgccgcctctgcggggcactgccaccggctctacatggagggcgagtacgctggattccaagagcacacagttccgcacgtcaagcgagatggcggcgcgctcaacaagctcgcgctgatgctcaagagacacgctgctgatggcatgccgggcttcgagcttcttgacccgccagtggcgccatcactggagaatgttgttgctgagctggtcaccagcggctacttggataagcatggcaaattgacagaggaagggaaacgcgaagcatacgatgaagactaa

SEQ ID NO: 5730 - protein, 403 aa, Sorghum bicolor
  misc_feature: Ceres ANNOT ID no. 6054333
  misc_feature (102)..(399): NCBI GI: 145360634 NCBI Desc: mee29 (maternal effect embryo arrest 29); atp-dependent rna helicase [arabidopsis thaliana]
  misc_feature (110)..(399): NCBI GI: 119572064 NCBI Desc: deah (asp-glu-ala-his) box polypeptide 8, isoform cra_d [homo sapiens]
  misc_feature (110)..(397): NCBI GI: 119572063 NCBI Desc: deah (asp-glu-ala-his) box polypeptide 8, isoform cra_c [homo sapiens]
  misc_feature (110)..(399): NCBI GI: 119572065 NCBI Desc: deah (asp-glu-ala-his) box polypeptide 8, isoform cra_e [homo sapiens]
  misc_feature (110)..(399): NCBI GI: 123236580 NCBI Desc: deah (asp-glu-ala-his) box polypeptide 8 [mus musculus]
MATGVPPEPEPQAPAISHHIGTILDYLQNYRIVLVSAAPGSGKSTVLPRYLANYGFGPVICAQPRLLAVTVASSKPGQERDSDDVWFTTTRVLIDMLCCNDGRPAFAAAFRTVVVDEAHDRTLCTDLLLGVVKAAVATEETGHLNVVVCTAGGPEDSSLSDFFFGAPIVAFQRALHPVAVHYSRGPMLDMVSAVVDEVTDIHRSKPPGDVLVFLPDIIRIQEAYEKLAQLDLPGLVLRFVHDNLPEEFMDYALDPAPGGSRRVVLATDVAETAVLVPGITYVVDTGVLSEDPLAMVSKEAAIRRAAVAGAASAGHCHRLYMEGEYAGFQEHTVPHVKRDGGALNKLALMLKRHAADGMPGFELLDPPVAPSLENVVAELVTSGYLDKHGKLTEEGKREAYDED

SEQ ID NO: 5731 - DNA, 1059 bp, Sorghum bicolor
  misc_feature: Ceres ANNOT ID no. 6054346
  misc_feature: Encodes the peptide sequence at SEQ ID NO 5732
atggcggacgcggcggcgccggggctgctgccggtggcggcggacagggacagggagagggacaaggacaaggacgaccgccgccgctgggcagcccgctgcggcttcgccgtcctgggcatcatgagcaccctcctcgtctacggcgtcctccaggagaagatcatgagggttccgtatggagtggagaaggagttcttcagatactcgcttttccttgtcttctgtaaccgcatcaccacatccatggcaagtaagaaatccttggaccctgtggctccgctacacaaatatggtattgtctccatatcaaatatactgaccacaacctgccagtatgaggccctcaagtatgtcagcttccctgtccaaacgcttgctaaatgtgccaagatgatacctgtcatgatctggggcacaataataatgagaaagaaatatggcggaaaagattacttctttgctgtcatcgtgactctgggttgcgcattgttcattctgtatccggcgtcgatggatgtgaatccatttaataaaggcagagaaagcactatttggggtgtttcactcatgctcggttatcttggtttcgatgggttcacaagcacgttccaagataaactcttcaaagggtatgacatggaaatacacaaccaaatattctacacgacagtgtgctcttgtcttcttagtttaagcgggctgattctccagaaccatatgattccagctgtggattttatgtttcgccacccagattgcttctctgatgttgtaatcctgtccagtgttgcaacagctagtcagttcttcatatcctacaccattcgaacatttggggctctcacatttgctaccataatgacaactagacagctggtgagtatattgctttcctgcatctggtttgtacatcctctgagctggatgcagtgggttggcgcagctattgtattcggagccctatacacaaagagcttcttgaggagtaaaccacagaagccagcggtggcaagcccgccacgtggctctagcccgaatcctgttaacaatagttaa

SEQ ID NO: 5732 - protein, 352 aa, Sorghum bicolor
  misc_feature: Ceres ANNOT ID no. 6054346
  misc_feature (34)..(333): Pfam Id: UAA Pfam Desc: UAA transporter family
  misc_feature (82)..(352): NCBI GI: 140052500 NCBI Desc: udp-galactose transporter homolog 1, related [medicago truncatula]
  misc_feature (14)..(352): NCBI GI: 45752698 NCBI Desc: at3g46180 [arabidopsis thaliana]
  misc_feature (36)..(341): NCBI GI: 44917565 NCBI Desc: at5g59740 [arabidopsis thaliana]
  misc_feature (36)..(341): NCBI GI: 9758839 NCBI Desc: udp-galactose transporter related protein-like [arabidopsis thaliana]
  misc_feature (33)..(330): NCBI GI: 145355333 NCBI Desc: dmt family transporter: udp-galactose/udp-glucose [ostreococcus lucimarinus cce9901]
MADAAAPGLLPVAADRDRERDKDKDDRRRWAARCGFAVLGIMSTLLVYGVLQEKIMRVPYGVEKEFFRYSLFLVFCNRITTSMASKKSLDPVAPLHKYGIVSISNILTTTCQYEALKYVSFPVQTLAKCAKMIPVMIWGTIIMRKKYGGKDYFFAVIVTLGCALFILYPASMDVNPFNKGRESTIWGVSLMLGYLGFDGFTSTFQDKLFKGYDMEIHNQIFYTTVCSCLLSLSGLILQNHMIPAVDFMFRHPDCFSDVVILSSVATASQFFISYTIRTFGALTFATIMTTRQLVSILLSCIWFVHPLSWMQWVGAAIVFGALYTKSFLRSKPQKPAVASPPRGSSPNPVNNS

SEQ ID NO: 5733 - DNA, 2271 bp, Sorghum bicolor
  misc_feature: Ceres ANNOT ID no. 6054348
  misc_feature: Encodes the peptide sequence at SEQ ID NO 5734
atggcgacccccgacgacggcccggcgccggccggggccgggggccgcaagttctggcgctccgtgtcgtggtccgagccgagggagccggcgccgccgccggacgccgcgggcggggctggggcggcaggtggcgggggcgggcagtcccgccgcgtcccgccgccgccgccgctcaccccgcggtcgatgagctccaaggcccggtcctgcctcccgcctctgcagccgctcgccatcgcgcgccgcaccctggacgagtggcctaaggctggctccgacgacgtcggcgagtggcccaaccccaccacgcccggcgcctccaggccttcctccgccaagcctggggaggggctccgcctcgacctctcctcgctccgttcccagggacgcaaggaccaaatcgccttcttcgacaaggagtgctccaaggtcgccgagcatgtctacctcggtggcgacgccgtcgctaagaaccgagacatcctgaggaagaacggcatcacccacgtccttaactgtgtcggcttcgtctgcccggagtacttcaagtccgacctcgtctaccgcacgctctggctgcaggacagccccaccgaggacatcaccagcatcctctacgacgtgtttgattactttgaggatgtcagggagcagggcggccgcgtcttcgtgcattgctgccagggggtgtcgcgctccacgtcgctggtcatcgcctacttgatgtggagggaaggccagagcttcgatgatgccttccagttcgtcaaggctgcccgggggattgcgaatccaaacatgggctttgcctgccagcttctccagtgccagaagcgggtgcatgctattccgttgtccccaaattcagtgctcaggatgtaccgcatggcgcctcactcccagtatgctcctctgcatttagtgcccaaaatgctcaatgacccttcccctgctgccctcgactctagaggagcgtttattgtacatgttctgtcgtccatatatgtctgggctggaatgaagtgtgatccggtaatggaaaaggatgcaaaggctgctgcgtttcaggtggtgaggtatgagaaggtgcaggggcacatcaaggttgtgagggaaggtttggagccacaagagttttgggatgcattttcaagtacgccgcctaattcggatagtaatacaaagattagcaaggaccagatcgattcagcatccaagagtaacccaggaagccggagaattgaatcttatgatgctgatttcgagctcgtctacaaagcaatcactgggggagtggttccagcgttctcaacttctggagctggcgacgagacccatcttccagctagagaaagcagctggagtttactgaggcacaagtttatctccaggtcgctagcccgtgtttattcagattctgctctaatcagggattttgatctgcgggtagaccgtgtacagcacctggctgctgaagcatcaacctcacctcctttcctttctccaagctccttgtcatcggattcaagcgtcagctcgaagtatagttcagactcaccctccttatcacctacaactagctccccaccatcattaggtccctcgcctgcttcatctaatccgcctcatgctttggtgccatcgtccaggtctcccctttctcatcaatcatctaatgagggaccttcaaagccttctggcatggaatcaatacgatctccttccaagacctcttctatagcagaaagaagaggaggcttcacacttctaaagctaccatctctccaaaaggatcttgtattgccgccaagggtaccgtctagtattcgcaggactgaggaggcctcaaataagagtagtacaaatggtgttaaacagctgactggcgatttttgctcagaaaaatgcaccggtaatagttcaagctcgcattctgaaactagattaactgagcgtactgacagtaactcagaagcttgcagtaatgcacaactgttagtctaccagtggcccagcatggaaaagctaactgcatttgcacgcaaggatcttgacccaaagtcggttttgatttttgttacatcgaataccatcagaagagaagcagttaaaatggtgtatgtatgggtaggaggcgaaaatgaaagcagcaagagtgttgaggctgttgattggcaacaggtcactggtgattttcttcatcgaaaaggcctcagtgatgctcttcctgtcaaggttgactcggttcaagttgagcatgattattag

SEQ ID NO: 5734 - protein, 756 aa, Sorghum bicolor
  misc_feature: Ceres ANNOT ID no. 6054348
  misc_feature (141)..(280): Pfam Id: DSPc Pfam Desc: Dual specificity phosphatase, catalytic domain
  misc_feature (1)..(747): NCBI GI: 125988083 NCBI Desc: map kinase phosphatase [oryza sativa (japonica cultivar-group)]
  misc_feature (106)..(747): NCBI GI: 13540264 NCBI Desc: map kinase phosphatase [zea mays]
  misc_feature (296)..(747): NCBI GI: 115461735 NCBI Desc: os05g0115800 [oryza sativa (japonica cultivar-group)]
  misc_feature (9)..(747): NCBI GI: 13540262 NCBI Desc: map kinase phosphatase [arabidopsis thaliana]
  misc_feature (9)..(747): NCBI GI: 15450858 NCBI Desc: phosphatase-like protein [arabidopsis thaliana]
MATPDDGPAPAGAGGRKFWRSVSWSEPREPAPPPDAAGGAGAAGGGGGQSRRVPPPPPLTPRSMSSKARSCLPPLQPLAIARRTLDEWPKAGSDDVGEWPNPTTPGASRPSSAKPGEGLRLDLSSLRSQGRKDQIAFFDKECSKVAEHVYLGGDAVAKNRDILRKNGITHVLNCVGFVCPEYFKSDLVYRTLWLQDSPTEDITSILYDVFDYFEDVREQGGRVFVHCCQGVSRSTSLVIAYLMWREGQSFDDAFQFVKAARGIANPNMGFACQLLQCQKRVHAIPLSPNSVLRMYRMAPHSQYAPLHLVPKMLNDPSPAALDSRGAFIVHVLSSIYVWAGMKCDPVMEKDAKAAAFQVVRYEKVQGHIKVVREGLEPQEFWDAFSSTPPNSDSNTKISKDQIDSASKSNPGSRRIESYDADFELVYKAITGGVVPAFSTSGAGDETHLPARESSWSLLRHKFISRSLARVYSDSALIRDFDLRVDRVQHLAAEASTSPPFLSPSSLSSDSSVSSKYSSDSPSLSPTTSSPPSLGPSPASSNPPHALVPSSRSPLSHQSSNEGPSKPSGMESIRSPSKTSSIAERRGGFTLLKLPSLQKDLVLPPRVPSSIRRTEEASNKSSTNGVKQLTGDFCSEKCTGNSSSSHSETRLTERTDSNSEACSNAQLLVYQWPSMEKLTAFARKDLDPKSVLIFVTSNTIRREAVKMVYVWVGGENESSKSVEAVDWQQVTGDFLHRKGLSDALPVKVDSVQVEHDY

SEQ ID NO: 5735 - DNA, 1611 bp, Sorghum bicolor
  misc_feature: Ceres ANNOT ID no. 6054349
  misc_feature: Encodes the peptide sequence at SEQ ID NO 5736
atgcccctcaacctccacgcttacctcctctccgccctcctcctcctcgccggcgccgccgccgccgccgcggcgcggcaccacgcgtcgccggccgcgaacgcgacctcctccagcgagcccgtctacctctggcccctgcccaagagcgtctcgtcggggtccaggaccctgacggtggacccggacctcgcgctcgacccgcagggccccggcggccgctccccggccgtggccgaggcgttccagcggtaccggggccacgtgttcacgccgtgggcgcacgccgcgcgcccgcgcggggcgcggtacgacgtcacaaggctcaccgtcgtcgtcaactccgccaacgacacgttggcgctgggcgtggacgagagctacgccatctacgtcggggcggccggcggcgtcaattccatcgtcggaggagcaatcattgaggcaaacacaatatatggagctattcgagggctggagacattcagtcaactttgtgttttcaactatgacaccaaaaatattgaagtgcgcaatgccccatggcatattcaagatgagccccgctttgcttttcgtgggctgctcctagacacctcacggcattatcttccggttgatgttattaagcaagtgatcgactctatgtcatttgctaagctgaatgttcttcattggcatatcatcgatgaggaatcctttccattggaggtgccaacatatccaaacctttggaaaggttcgtactccaaatgggagcgctacaccgtggaagatgcacgtatcaatgtcatggcagaaattgacgtgcctggtcatgcagaatcatggggaaatggctacccaaagctctggccttctcccaattgtacagagccattagatgtctctagcaatttcacatttgaagtaatttctggaattttgtctgatatgaggaaaatctttccattcgggctgtttcacttgggtggcgatgaagtatatacagggtgctggaacacaacacctcatgtgaggcagtggcttaatgagcacaacatgaccacaaaggaggcttataaatactttgttctgaaggcccaacagttggcaattaagctaaactggattcctgtgaattgggaagaaaccttcaattcattcgcagaaaatctcaatcctcttacagtggtgcacaattggctggggcctggagtctgccctaaggttgtggcaaagggtttcaaatgtataatgagcaatcaaggtgtctggtaccttgatcatcttgatgttccctgggaagatgtctacagtggcgagccactagatggcatcagtgacaaagaccagcaaaagctagtacttggtggggaagtttgcatgtggggtgagacagcagacacatccgacgttctacaaacaatatggccccgagcagctgcagcagcagagcgtctgtggagtcaattggaggccataaccgcccaagacgtggaaacaaccgtcctgtcacggctacactatttcagatgcctgctgaatcaccgtgggattgctgcggctccagtcacaaactactatgctaggaggcccccaatcggcccaggttcatgctttgttcagtaa

SEQ ID NO: 5736 - protein, 536 aa, Sorghum bicolor
  misc_feature: Ceres ANNOT ID no. 6054349
  misc_feature (190)..(485): Pfam Id: Glyco_hydro_20 Pfam Desc: Glycosyl hydrolase family 20, catalytic domain
  misc_feature (56)..(188): Pfam Id: Glyco_hydro_20b Pfam Desc: Glycosyl hydrolase family 20, domain 2
  misc_feature (262)..(536): NCBI GI: 7019659 NCBI Desc: beta-n-acetylhexosaminidase-like protein [arabidopsis thaliana]
  misc_feature (30)..(536): NCBI GI: 30694211 NCBI Desc: glycosyl hydrolase family 20 protein [arabidopsis thaliana]
  misc_feature (30)..(536): NCBI GI: 110742769 NCBI Desc: beta-n-acetylhexosaminidase -like protein [arabidopsis thaliana]
  misc_feature (34)..(536): NCBI GI: 23463073 NCBI Desc: at1g65600/f5i14_13 [arabidopsis thaliana]
  misc_feature (262)..(536): NCBI GI: 2190547 NCBI Desc: ests gbt43256,gb46316,gbn64930,gbaa395255,gbaa404382 come from this gene. [arabidopsis thaliana]
  misc_feature: Useful for making plants with altered carbohydrate content
  misc_feature: Functional homolog of the protein sequence given in SEQ ID NO 13835
MPLNLHAYLLSALLLLAGAAAAAAARHHASPAANATSSSEPVYLWPLPKSVSSGSRTLTVDPDLALDPQGPGGRSPAVAEAFQRYRGHVFTPWAHAARPRGARYDVTRLTVVVNSANDTLALGVDESYAIYVGAAGGVNSIVGGAIIEANTIYGAIRGLETFSQLCVFNYDTKNIEVRNAPWHIQDEPRFAFRGLLLDTSRHYLPVDVIKQVIDSMSFAKLNVLHWHIIDEESFPLEVPTYPNLWKGSYSKWERYTVEDARINVMAEIDVPGHAESWGNGYPKLWPSPNCTEPLDVSSNFTFEVISGILSDMRKIFPFGLFHLGGDEVYTGCWNTTPHVRQWLNEHNMTTKEAYKYFVLKAQQLAIKLNWIPVNWEETFNSFAENLNPLTVVHNWLGPGVCPKVVAKGFKCIMSNQGVWYLDHLDVPWEDVYSGEPLDGISDKDQQKLVLGGEVCMWGETADTSDVLQTIWPRAAAAAERLWSQLEAITAQDVETTVLSRLHYFRCLLNHRGIAAAPVTNYYARRPPIGPGSCFVQ

SEQ ID NO: 5737 - DNA, 645 bp, Sorghum bicolor
  misc_feature: Ceres ANNOT ID no. 6054354
  misc_feature: Encodes the peptide sequence at SEQ ID NO 5738
atggccgccgtggaggtgtgcgtgaaggcagccgccgggaagcccgacacgctcggcgactgcccgttctcgcagagggtgctgctcacgctggaggagaagaaagtcccctacgaggtcaagctcgtcgacctcggcaacaagcccgaatggtttctggagattaacccagagggtaaggtgcctgtgctcaaaggtgatgatggtaaatgcattgctgattctgatgtaatcacccaagtcatcgaggagaagttcccaactccatctctggtcacccctccagaatatgcatcagtgggatcaaagattttcccagcctttgtcaagttcttgaagagcaaggatgctagtgatggttcagagaaggcgcttctggatgagctgcaggcactggatgagcatctcaaagctcatggcccttacatcaatggggacaatgtgtcagcggctgatctaagccttgcgccaaagctcttccacctccaggtcgcactagagcatttcaaaggctggaagatcccagaaaacctaaccaacgtccacgcctacaccaaggctcttttcagccgtgaatcttttgtcaagactaagccatccgaggagcacgtgattgcgggatgggcgcccaaggtgaacgcataa

SEQ ID NO: 5738 - protein, 214 aa, Sorghum bicolor
  misc_feature: Ceres ANNOT ID no. 6054354
  misc_feature (16)..(84): Pfam Id: GST_N Pfam Desc: Glutathione S-transferase, N-terminal domain
  misc_feature (92)..(192): Pfam Id: GST_C Pfam Desc: Glutathione S-transferase, C-terminal domain
  misc_feature (4)..(214): NCBI GI: 55168334 NCBI Desc: dehydroascorbate reductase [oryza sativa (japonica cultivar-group)]
  misc_feature (4)..(214): NCBI GI: 28192425 NCBI Desc: dehydroascorbate reductase [oryza sativa]
  misc_feature (4)..(214): NCBI GI: 6939839 NCBI Desc: gsh-dependent dehydroascorbate reductase 1 [oryza sativa (japonica cultivar-group)]
  misc_feature (5)..(213): NCBI GI: 28192421 NCBI Desc: dehydroascorbate reductase [triticum aestivum]
  misc_feature (3)..(214): NCBI GI: 82698815 NCBI Desc: dehydroascorbate reductase [sesamum indicum]
MAAVEVCVKAAAGKPDTLGDCPFSQRVLLTLEEKKVPYEVKLVDLGNKPEWFLEINPEGKVPVLKGDDGKCIADSDVITQVIEEKFPTPSLVTPPEYASVGSKIFPAFVKFLKSKDASDGSEKALLDELQALDEHLKAHGPYINGDNVSAADLSLAPKLFHLQVALEHFKGWKIPENLTNVHAYTKALFSRESFVKTKPSEEHVIAGWAPKVNA

SEQ ID NO: 5739 - DNA, 915 bp, Sorghum bicolor
  misc_feature: Ceres ANNOT ID no. 6054408
  misc_feature: Encodes the peptide sequence at SEQ ID NO 5740
atggagaaccctccgagtttcgtagtgactcccatcgctgcacctgtatcagcggagttcaccaaactcaccttccgtagcttgtatattcgtcgaagtggtccaagcagcagggagatatctatggatggaaaatctgatctcggcaagagatatttcagtgacttccccgtatacgatggtcctggctccgaggccaaactcgtggctcgtgtgcagggactctcagtccaagttggtaacacataccaaatattcaccatcgtctttgagaccgagaggctcaagggctcaacgctccttaccaatggagtgataactggtgggtctgatgaatgggcaattttcggcggaaccggagcgtttgctatggcgactggtgtcataaaaagaaaatatcttgctgatagggatggggggaaaaatactgaagaacttatgatagatgttttctgcccactgtttgttgcttcacagccgaagggccctaccacgaaggctggattatggggtggacagggagggtcgaaccaggacataacggtgccaccaaagcgtctgcagagcctcaccattcgcagtggcagcgctattgatgctattgagttcacttatattgacaatgctggtcagaagcacactgctggcgcatggggtggacctggtggcactgctcacaggatcgatcttgacgatgccgagtatgtcaaggaagtttcaggaacctacggcacatttgaaggcattaccgtcttgacctcattcaaacttgtcaccaatgtcagaacctggggcccatgggccatcgagaatgggacacctttctccatcaccgcgccaaccaacagcagcattgtgggattctatggacgtgcaggaaggctcatcgatgccattggtgtttactttgcgtga

SEQ ID NO: 5740 - protein, 304 aa, Sorghum bicolor
  misc_feature: Ceres ANNOT ID no. 6054408
  misc_feature (175)..(305): Pfam Id: Jacalin Pfam Desc: Jacalin-like lectin domain
  misc_feature (6)..(152): Pfam Id: Dirigent Pfam Desc: Dirigent-like protein
  misc_feature (6)..(302): NCBI GI: 38455904 NCBI Desc: jasmonate-induced protein [triticum aestivum]
  misc_feature (6)..(302): NCBI GI: 9313027 NCBI Desc: beta-glucosidase aggregating factor precursor [zea mays]
  misc_feature (6)..(302): NCBI GI: 116282914 NCBI Desc: beta-glucosidase aggregating factor 1 [zea mays]
  misc_feature (6)..(296): NCBI GI: 2465430 NCBI Desc: 32 kda protein [hordeum vulgare]
  misc_feature (9)..(302): NCBI GI: 112821038 NCBI Desc: beta-glucosidase aggregating factor [sorghum bicolor]
MENPPSFVVTPIAAPVSAEFTKLTFRSLYIRRSGPSSREISMDGKSDLGKRYFSDFPVYDGPGSEAKLVARVQGLSVQVGNTYQIFTIVFETERLKGSTLLTNGVITGGSDEWAIFGGTGAFAMATGVIKRKYLADRDGGKNTEELMIDVFCPLFVASQPKGPTTKAGLWGGQGGSNQDITVPPKRLQSLTIRSGSAIDAIEFTYIDNAGQKHTAGAWGGPGGTAHRIDLDDAEYVKEVSGTYGTFEGITVLTSFKLVTNVRTWGPWAIENGTPFSITAPTNSSIVGFYGRAGRLIDAIGVYFA

SEQ ID NO: 5741 - DNA, 1026 bp, Sorghum bicolor
  misc_feature: Ceres ANNOT ID no. 6054416
  misc_feature: Encodes the peptide sequence at SEQ ID NO 5742
atgcctcgctatgatgaccgctatggaggcacgcgcttgtatgttggcagattggccccccgtactcgttcccgcgatttagaatatctgttcggcagatatgggagaatacgagaagtggagttgaagcgcgactatgcatttattgagttcagtgatcatcgtgatgctgatgaggctcgataccaactagatggcagggatgttgatgggagtcgcattgttgttgagtttgctaaaggggtcccacgtggtccaggtggctcacgtgaatatatgggaagaggccctccaccaggtaccggtcgttgtttcaactgtggaattgatggtcactgggcaagagactgtaaggctggtgactggaaaaacaaatgctaccgttgtggagaaagagggcatatagaaagaaattgccagaacagtcctaggagtgtcaggcgtgaaagaagttactcacggtccccatctccacgtcgtggaaggggtcgcagtccaagctatagtagaagcaggagcaggagccggagtcggagctatagccgatcgagatccctatctggatctcctaggggaggtcgccgtgaccgtgacgataggagatcaaggagtcttagctacagcaggagccccatgcgatctgcctcgccacctccaaaggaaaaggagcgcagccccacacctgatggaagcaggagcccaaggagtcgcagcccccaggatcaggtgatgagcccaccaccaaaggataacggcgaaggcaatggttcagaccgtggcgagagccccagaggaagggaaactagcaggagcaggagccgcagcaggagcccatccggtgataaccgcagccctgcagctaatgggcggagcccgagtcctagaggtgaccgtagcccaagccccagggctgaccgtagcccaagccccaaggctgaccgtagcccaagccccaagggcaatggtaacaatgacgatgatgatgctgcccgtggtgcttccccagcaggaagcaagtcaccctga

SEQ ID NO: 5742 - protein, 341 aa, Sorghum bicolor
  misc_feature: Ceres ANNOT ID no. 6054416
  misc_feature (13)..(76): Pfam Id: RRM_1 Pfam Desc: RNA recognition motif. (a.k.a. RRM, RBD, or RNP domain)
  misc_feature (102)..(119): Pfam Id: zf-CCHC Pfam Desc: Zinc knuckle
  misc_feature (124)..(141): Pfam Id: zf-CCHC Pfam Desc: Zinc knuckle
  misc_feature (1)..(341): NCBI GI: 68035567 NCBI Desc: alternative splicing regulator [triticum aestivum]
  misc_feature (1)..(300): NCBI GI: 9843663 NCBI Desc: splicing factor rsz33 [arabidopsis thaliana]
  misc_feature (1)..(300): NCBI GI: 9795142 NCBI Desc: splicing factor-like protein [arabidopsis thaliana]
  misc_feature (42)..(300): NCBI GI: 24111329 NCBI Desc: at3g53500/f4p12_200 [arabidopsis thaliana]
  misc_feature (50)..(300): NCBI GI: 42571091 NCBI Desc: splicing factor rsz33 (rsz33) [arabidopsis thaliana]
  misc_feature: The sequence is a functional homolog of SEQ ID NO 1039 in the 10/374,780US patent application
  misc_feature: The sequence is a functional homolog of SEQ ID NO 849 in the 10/666,642US patent application
  misc_feature: Useful for making plants with modulated growth and phenotype characteristics
  misc_feature: The sequence is a functional homolog of SEQ ID NO 1039 in the 20060162006 US patent application
  misc_feature: The sequence is a functional homolog of SEQ ID NO. 339 in the 11/188,298 US application
MPRYDDRYGGTRLYVGRLAPRTRSRDLEYLFGRYGRIREVELKRDYAFIEFSDHRDADEARYQLDGRDVDGSRIVVEFAKGVPRGPGGSREYMGRGPPPGTGRCFNCGIDGHWARDCKAGDWKNKCYRCGERGHIERNCQNSPRSVRRERSYSRSPSPRRGRGRSPSYSRSRSRSRSRSYSRSRSLSGSPRGGRRDRDDRRSRSLSYSRSPMRSASPPPKEKERSPTPDGSRSPRSRSPQDQVMSPPPKDNGEGNGSDRGESPRGRETSRSRSRSRSPSGDNRSPAANGRSPSPRGDRSPSPRADRSPSPKADRSPSPKGNGNNDDDDAARGASPAGSKSP

SEQ ID NO: 5743 - DNA, 594 bp, Sorghum bicolor
  misc_feature: Ceres ANNOT ID no. 6054426
  misc_feature: Encodes the peptide sequence at SEQ ID NO 5744
atgggaggagggaaggacaagcatgatgagagcgacaaggggctcttctcaaacatgatgcacggcgttgccggtggccatgggtaccctcaccagggataccctccgcagggctacccaccaccacaaggagcatacccacctcccccaggggcgtatcctcctcctccaccaggggcatacccacctccacctggggcatacccaccacaacatgggtaccctcagccaggtggctacccaccgcaaggtggatatcctcctgcaggctacccaggctcatctcaccagggttatgggagcagccatggcgggagccacatggggatggggacagttctagctggaggtgctgccgccgccgcagctgcttatggagcacacaagctttctcatggccatagcggacacggtggacatggtgtctttggaggaggctatggtcatggtggctacggccacggctacggcggccacggcaagttcaagcatggtcacggcggccacggcaagttcaagcacggtcacggcaagttcaagcatggcaagcacgggcacggcatgttcggcggcaagttcaagaagtggaagtga

SEQ ID NO: 5744 - protein, 197 aa, Sorghum bicolor
  misc_feature: Ceres ANNOT ID no. 6054426
  misc_feature (1)..(197): NCBI GI: 33668156 NCBI Desc: gprp [oryza sativa (indica cultivar-group)]
  misc_feature (1)..(197): NCBI GI: 144925037 NCBI Desc: xyppx repeat [medicago truncatula]
  misc_feature (4)..(183): NCBI GI: 9755790 NCBI Desc: glycine/proline-rich protein [arabidopsis thaliana]
  misc_feature (4)..(183): NCBI GI: 110740633 NCBI Desc: glycine/proline-rich protein [arabidopsis thaliana]
  misc_feature (1)..(153): NCBI GI: 297887 NCBI Desc: glycine rich protein [daucus carota]
  misc_feature: The sequence is a functional homolog of SEQ ID NO. 392 in the 11/188,298 US application
MGGGKDKHDESDKGLFSNMMHGVAGGHGYPHQGYPPQGYPPPQGAYPPPPGAYPPPPPGAYPPPPGAYPPQHGYPQPGGYPPQGGYPPAGYPGSSHQGYGSSHGGSHMGMGTVLAGGAAAAAAAYGAHKLSHGHSGHGGHGVFGGGYGHGGYGHGYGGHGKFKHGHGGHGKFKHGHGKFKHGKHGHGMFGGKFKKWK

SEQ ID NO: 5745 - DNA, 3159 bp, Sorghum bicolor
  misc_feature: Ceres ANNOT ID no. 6054447
  misc_feature: Encodes the peptide sequence at SEQ ID NO 5746
atggacaagaagaattaccctccgtcgccatcgccaaggtcgacagagaagtctggaagagaattgagatccggggacgccaatggcagcacaaacaccaatagtaacaccatctcaaaaggtgacagggagaaaggagtcaatgtgcaagtcattctaagatgcaggcccttgagtgatgaagaaacaaagtcgaacactcctgtcgttatttcgtgcaatgagcgtcgccgggaagttgccgccactcaaattattgccaataagcagattgatcgtacatttgcatttgataaggtttttggcccatcatccaagcagaaagatttgtttgagcaatccatctcgccgatagtatatgaggtccttgaaggttataattgcactatttttgcctatgggcaaactggtaccgggaaaacttacacaatggagggaggtgggactagaaagaccaagaatggtgaacttccaactgatgctggtgttatcccaagggctgtaaggcaaatatttgacattctcgagtctcagtgcgcagaatatagcatgaaagtcacctttcttgagctttacaatgaagaaatcactgatctgttggcacctgaagaaccgaaattccctgttcctgaagacaagacgaaaaaacctattgcccttatggaagatggaaaggggtttgtttttgttagaggacttgaagaagaagtcgtgtactcagctggcgaaatctacaagattcttgacaagggttctgcaaagaggcgtactgcagaaacattgctgaacaagcaaagtagtaggtcacactctatattctcaatcacaattcacattaaggaactcactcatgagggtgaggagatgatcaaaattgggaagcttaatcttgtcgatctagctggttcagaaaatatatcacgctcaggagctagagatggcagagcgagagaggctggagagatcaacaagagtttgctcacacttggtcgtgttattaatgctctagtagagcactctggacatgtcccatacagagatagtaaactgacaagattgctgagagattcattgggagggaaaacaaagacttgtattattgctacaatatcaccttcagtgtattgcttggaagagacattgagcacacttgattatgcacaccgtgcaaaaaatatcaagaacaaaccagaggtaaatcaaaggatgatgaagtctgctatgatcaaggacttgtactatgaaattgaccgcctcaaacaagaggtttttgctgcaagagagaagaatggtatctatattccaagagagcgctacctccaagaagaagctgagaaaaaggccatgacagagaaaattgaacgactgggtgctgatttggaggctagggataagcaattggttgaactaaaagagctttatgatgctgaacaacgtctgagtgcagagttgggtgaaaaacttggaaagactcagaaagatctggaggacaccaggagtgctctgcatgatctagaagaaaaatacaatgaagcaaagtctactattaaagaaaaggaatatgtcatatttaatcttctgaaatcagaaaaatcactagtggattgtgcatataaccttcgtgcggagttagaaaatgcagcagcagatgtttctgggctattctccaaaatagagcgcaaagacaggatagaagatgggaacagatcgatagtgcagagatttaggtttcaactgactcatcagctagatgccttacataaaactgtatccagttctgtcatgcaacaggaggaccaccttaatgaaatggaacatgatatgcaatccttcgtgtcttcaaaagatgaggctgcacaagggctaagaaagagtgtacaaaagctcaaagtcttgcatggttctggtatcactgctttggatgatttagcgggtgaaattgacatgaattcgcagacaacatttgagagattaaattcacaaatacaatcacatacatcagcccttgagaaatgtttcggaggaattgcttcggaagcagatagcttgttaaatgagcttcagtgcagcctatcgaaacaagaagagagactagcccattttgcaaagaagcagagggagggacacctgagagctgtggaagcatcacgttccatctcaaagatcactgctggtttcttccactcgctagatgttcatgcatctaagctcaccagtattttggaagacacacaaagcgtgcaagatcaacaacttgttgaccttgaaaggaaatttgaggagtgtgcagctaatgaagaaaaacaacttctcgagaaggtggcggagatgcttgcaagttccaatgcacgaaagaagaagctggtccaaacagcagtaggcagccttcgagagagcgccgtaaacagaacaagtcacctacagaaagaaatttcgacagcccaggacttcacctcatccgtgcgggaaaagtggggcttttacatggaagaaaccgagaagaattatattgaggataccactgcagttgacagtggaaggtcttgcttggccgaagtgcttgtagaatgcaaggcgaagactaccatgggtgcacaacaatggaagaatgcagaggattctctattcagccttggcaaaggaaatgtggaatctgtagattctatagtcaggactggaacagaggccaaccaagtactgcgttccaaattgtcatctgcagcatcgtcaactcttgaagatatagatgttgcaaacaaggctctcctttcttcaattgacagctcgctgaagcttgaccatgacgcatgcgcaaacattggtgcgattcttacgccgtgccatggggaaatgagggagctgaagggggagcatcaccacaaggttgtggagatcagtgaaaacgctgggaaatgccttgaggaagagtatctggtggatgaaccctcgtgttcgacgccaaggagaaggcagatcgacctgccaagtgtggagtcaatagaggagttgcgaaccccagactatgacgagcttctcaagtcgttccgggagtcgagggggagctggaagcaggcaaatggagacacaagacatttgtcagagacagctcaggaaccaacagtcatggattcaagaattcctctcataggaagaaattag

SEQ ID NO: 5746 - protein, 1052 aa, Sorghum bicolor
  misc_feature: Ceres ANNOT ID no. 6054447
  misc_feature (54)..(394): Pfam Id: Kinesin Pfam Desc: Kinesin motor domain
  misc_feature (8)..(1048): NCBI GI: 124359634 NCBI Desc: kinesin, motor region [medicago truncatula]
  misc_feature (8)..(1052): NCBI GI: 7339486 NCBI Desc: kinesin-related protein-like [arabidopsis thaliana]
  misc_feature (8)..(1039): NCBI GI: 15186760 NCBI Desc: krp120-2 [daucus carota]
  misc_feature (43)..(1032): NCBI GI: 87240830 NCBI Desc: kinesin, motor region [medicago truncatula]
  misc_feature (42)..(1018): NCBI GI: 11132775 NCBI Desc: 125 kda kinesin-related protein
MDKKNYPPSPSPRSTEKSGRELRSGDANGSTNTNSNTISKGDREKGVNVQVILRCRPLSDEETKSNTPVVISCNERRREVAATQIIANKQIDRTFAFDKVFGPSSKQKDLFEQSISPIVYEVLEGYNCTIFAYGQTGTGKTYTMEGGGTRKTKNGELPTDAGVIPRAVRQIFDILESQCAEYSMKVTFLELYNEEITDLLAPEEPKFPVPEDKTKKPIALMEDGKGFVFVRGLEEEVVYSAGEIYKILDKGSAKRRTAETLLNKQSSRSHSIFSITIHIKELTHEGEEMIKIGKLNLVDLAGSENISRSGARDGRAREAGEINKSLLTLGRVINALVEHSGHVPYRDSKLTRLLRDSLGGKTKTCIIATISPSVYCLEETLSTLDYAHRAKNIKNKPEVNQRMMKSAMIKDLYYEIDRLKQEVFAAREKNGIYIPRERYLQEEAEKKAMTEKIERLGADLEARDKQLVELKELYDAEQRLSAELGEKLGKTQKDLEDTRSALHDLEEKYNEAKSTIKEKEYVIFNLLKSEKSLVDCAYNLRAELENAAADVSGLFSKIERKDRIEDGNRSIVQRFRFQLTHQLDALHKTVSSSVMQQEDHLNEMEHDMQSFVSSKDEAAQGLRKSVQKLKVLHGSGITALDDLAGEIDMNSQTTFERLNSQIQSHTSALEKCFGGIASEADSLLNELQCSLSKQEERLAHFAKKQREGHLRAVEASRSISKITAGFFHSLDVHASKLTSILEDTQSVQDQQLVDLERKFEECAANEEKQLLEKVAEMLASSNARKKKLVQTAVGSLRESAVNRTSHLQKEISTAQDFTSSVREKWGFYMEETEKNYIEDTTAVDSGRSCLAEVLVECKAKTTMGAQQWKNAEDSLFSLGKGNVESVDSIVRTGTEANQVLRSKLSSAASSTLEDIDVANKALLSSIDSSLKLDHDACANIGAILTPCHGEMRELKGEHHHKVVEISENAGKCLEEEYLVDEPSCSTPRRRQIDLPSVESIEELRTPDYDELLKSFRESRGSWKQANGDTRHLSETAQEPTVMDSRIPLIGRN

SEQ ID NO: 5747 - DNA, 1143 bp, Sorghum bicolor
  misc_feature: Ceres ANNOT ID no. 6054451
  misc_feature: Encodes the peptide sequence at SEQ ID NO 5748
atggcttcggcggtggcggcttcgaccgccacgcggtttctcccgcggcgaacggacccgtggtggccgccgcgtcgtgcgcgcgcggcgctcccgccgctcacgtggcggcctccagcggtcacggtggtcgccgcgtcgttccgccctggggaagcggaaggtgggaggcgcgggaggacgcggaggcgccgcgccaggagggcggaacaggaggaaggcgtctcgctaagctctgaaaaggagacggtaaattctactccacgtgctcaaaccaacaagggtgtggagcccgtaccggtgtccagcacgaacaggaaaggtgccattagaagggtgacactggtggttctcgctgcggtggtttttggagttagcattgccttgagggatggggctgagaaggcatcagagtattttgcggggtatttgttggaacagagtttgtcggtggacaatctctttgtttttgttctggtctttaagtatttccaagtgccaaaggaataccagaatcgagtactttcttatggtattgctggagctgtggtctttcgggctgtgatgatcatcctaggaacagctaccatccagaaatttgaggcggtgaacttgctgttggctttgatcctgttattcacttcttacaagctatttgctaaagaagaagaagaatctgatctatccgacaacttcattgtgaaaacatgccaaaagttcattccagtcactgattattatgatggtgatcagtttttcataattcaagatggtttgtggaaagctacaccattgctcttgactttggcagtgattgaactgagtgatattgcttttgccattgactcaataccagcagtttttggtgtcacaagggatccacttataatactatcatcaaatatttttgctattgctggtttgcggtcgctttatgtgctcatttctgaaagcatgggtgaattggagtatctacagcctgccattggtatcgtgttgggctttatagggacaaagatgacctttgacttttttggttatcatataccaacagaagcttcgcttgctattgtaactacctgtcttagtggaggcgtcatattaagtcttaggaaagcatcaaaagaggagggggacaagtag

SEQ ID NO: 5748 - protein, 380 aa, Sorghum bicolor
  misc_feature: Ceres ANNOT ID no. 6054451
  misc_feature (138)..(255): Pfam Id: TerC Pfam Desc: Integral membrane protein TerC family
  misc_feature (70)..(376): NCBI GI: 18416778 NCBI Desc: integral membrane terc family protein [arabidopsis thaliana]
  misc_feature (70)..(376): NCBI GI: 21592518 NCBI Desc: transmembrane transport protein-like protein [arabidopsis thaliana]
  misc_feature (106)..(378): NCBI GI: 113940673 NCBI Desc: integral membrane protein terc [herpetosiphon aurantiacus atcc 23779]
  misc_feature (114)..(377): NCBI GI: 118745636 NCBI Desc: integral membrane protein terc [geobacter lovleyi sz]
  misc_feature (120)..(373): NCBI GI: 118744264 NCBI Desc: integral membrane protein terc [geobacter lovleyi sz]
MASAVAASTATRFLPRRTDPWWPPRRARAALPPLTWRPPAVTVVAASFRPGEAEGGRRGRTRRRRARRAEQEEGVSLSSEKETVNSTPRAQTNKGVEPVPVSSTNRKGAIRRVTLVVLAAVVFGVSIALRDGAEKASEYFAGYLLEQSLSVDNLFVFVLVFKYFQVPKEYQNRVLSYGIAGAVVFRAVMIILGTATIQKFEAVNLLLALILLFTSYKLFAKEEEESDLSDNFIVKTCQKFIPVTDYYDGDQFFIIQDGLWKATPLLLTLAVIELSDIAFAIDSIPAVFGVTRDPLIILSSNIFAIAGLRSLYVLISESMGELEYLQPAIGIVLGFIGTKMTFDFFGYHIPTEASLAIVTTCLSGGVILSLRKASKEEGDK

SEQ ID NO: 5749 - DNA, 1008 bp, Sorghum bicolor
  misc_feature: Ceres ANNOT ID no. 6054461
  misc_feature: Encodes the peptide sequence at SEQ ID NO 5750
atggggcagcaggaggcccagactcaccaccccgacgaggcggcgctcccgacaaccaccgccgccgccgcgtcctcctcctcctcctcctccaggctcttcacggcgtggctggtggcgtcgtggtacgcctccaacatcggggtgctcctcctcaacaagtacctcctctccgtctacggcttccgcttccccatcctgctcaccgcctgccacatgaccgcctgcacgctcctctccgcgctcgtccaccaccaccaccaccaccgctcctcctcccgcagccgcggctccaggtccagggcgcagctcgcgcgcgtcgccgtcctcggcgccgtcttctgcgcctccgtcgtcgcggggaacgtctcgctccgccacctcccggtctccttcaaccaggccgtcggcgccaccacgcctttcttcaccgcgctcctcgcctacgccgttgctggtcgccgcgaggccttcgccacctacgccgcgctcgtccccgtcgtcgccggcgtcgtcatcgccaccgggggcgagccgagcttccacctcttcggattcatcatgtgcgtcgccgccacggccgggcgcgcgctcaagtccgtgctgcaggggatcctgctgtcgtccgaggaggagaagatggactccatggacctcctccgctacatggcgccggtggccgtcctgctgctggtgccggcgacgctggccatggagcgcgacgcgttcggggtggtggcggacctcgcccgggtggaccctagcttcctctggatcctgctctgcaactcctgcctcgcctacttcgtcaacctcaccaacttcctcgtcaccaagcacaccagcgcgctcacgctccaggttcttgggaacgcgaaaggcgccgtcgcggtggtcgtctccatcctcatcttcaggaaccccgtgacggtcgtggggatgctgggctacggtgtcacggtcgccggcgtcgtcttgtacggcgaggccaagaagaggagcaagtga

SEQ ID NO: 5750 - protein, 335 aa, Sorghum bicolor
  misc_feature: Ceres ANNOT ID no. 6054461
  misc_feature (185)..(329): Pfam Id: TPT Pfam Desc: Triose-phosphate Transporter family
  misc_feature (32)..(335): Pfam Id: UAA Pfam Desc: UAA transporter family
  misc_feature (1)..(335): NCBI GI: 115461805 NCBI Desc: os05g0121900 [oryza sativa (japonica cultivar-group)]
  misc_feature (29)..(335): NCBI GI: 61651608 NCBI Desc: plastidic phosphate translocator-like protein2 [mesembryanthemum crystallinum]
  misc_feature (28)..(335): NCBI GI: 9759107 NCBI Desc: phosphate/phosphoenolpyruvate translocator protein-like [arabidopsis thaliana]
  misc_feature (28)..(335): NCBI GI: 52421287 NCBI Desc: at5g05820 [arabidopsis thaliana]
  misc_feature (25)..(333): NCBI GI: 20259810 NCBI Desc: phosphate/phosphoenolpyruvate translocator-like protein [arabidopsis thaliana]
  misc_feature: Useful for making plants with altered cell wall content and/or composition
  misc_feature: Functional homolog of the protein sequence given in SEQ ID NO 13792
  misc_feature: The sequence is a functional homolog of SEQ ID NO. 360 in the 11/188,298 US application
  misc_feature: The sequence is a functional homolog of SEQ ID NO. 484 in the 11/188,298 US application
MGQQEAQTHHPDEAALPTTTAAAASSSSSSSRLFTAWLVASWYASNIGVLLLNKYLLSVYGFRFPILLTACHMTACTLLSALVHHHHHHRSSSRSRGSRSRAQLARVAVLGAVFCASVVAGNVSLRHLPVSFNQAVGATTPFFTALLAYAVAGRREAFATYAALVPVVAGVVIATGGEPSFHLFGFIMCVAATAGRALKSVLQGILLSSEEEKMDSMDLLRYMAPVAVLLLVPATLAMERDAFGVVADLARVDPSFLWILLCNSCLAYFVNLTNFLVTKHTSALTLQVLGNAKGAVAVVVSILIFRNPVTVVGMLGYGVTVAGVVLYGEAKKRSK

SEQ ID NO: 5751 - DNA, 1131 bp, Sorghum bicolor
  misc_feature: Ceres ANNOT ID no. 6054469
  misc_feature: Encodes the peptide sequence at SEQ ID NO 5752
atgggcacgggcgcgctcgcggtggcggcggcggcgccggcggaccgggccaacaagcagcgccgggccggcggcggcgcacacctgtggaagaaagcgctgctccacttctccctctgcttcgtcatgggcttcttcaccggcttcgcgccctcctcttcctcctcctggaaggccgccaccaccacccctcacccgccgcaccgtcccggggaccgcctcgccgcctcccgcgtcgccgtcgacgtcaacgcgcgcgccacccttccgccgcccgcgtccgccggcgatgcgctcggtgtcggcggcgccacggtggacgtgggcgacgagtacgaggagggcgacgccaacggccagcgccgacgcctcctgatcgtggtcaccaccacgcggtcgggccccggggagcgccggcggcggcggggcgagctgctgcgcctggcccacacgctccgcctcgtccgcccgcccgtcgtctgggtcgtcgtcgagcccgccgccgacgcgcccgccaccgccgtggtgctccgcggcaccggcgtcatgtacaggcacctcgccttcaagcccgaggaaaatttcaccaccgccgaagccgaggcgcacgcgcagcggaacgccgcgctcgcgcacgtcgagaagcaccggctcgctggcgtcctccacttcgccgacgccgccggtgtctacgacgttgggttcttcgaccagatccgacagatcgaggcgtttgggacatggcctgtggcaacaatgttggctggcgagaagaaagtggtagtagaaggtccgctatgcagtgcctcaaaggtcgtcggttggttctcaagggactttaacgatgggacaacccgttcagtgacgtataacacggaagttgacttgaatcctgctggtgctgctggtacacgagcccacacaattgacgtctcaggtttcgcgttcaacagttcaattttgtgggatcctgagcggtggggacggccaacctcattaccagatacttcacaggactccatcaagtttgtgcaagaagtggtacttgaagaccgagctaagctgaaggggatcccctctgattgctcccagatcatggtgtggcagtatagtgtgcccagctcacaatag

SEQ ID NO: 5752 - protein, 376 aa, Sorghum bicolor
  misc_feature: Ceres ANNOT ID no. 6054469
  misc_feature (148)..(374): Pfam Id: Glyco_transf_43 Pfam Desc: Glycosyltransferase family 43
  misc_feature (1)..(376): NCBI GI: 63087724 NCBI Desc: glycosyltransferase [saccharum officinarum]
  misc_feature (1)..(375): NCBI GI: 32879543 NCBI Desc: beta3-glucuronyltransferase [zea mays]
  misc_feature (124)..(375): NCBI GI: 32968187 NCBI Desc: beta3-glucuronyltransferase [triticum aestivum]
  misc_feature (98)..(375): NCBI GI: 32968174 NCBI Desc: beta3-glucuronyltransferase [hordeum vulgare]
  misc_feature (102)..(376): NCBI GI: 115452359 NCBI Desc: os03g0287800 [oryza sativa (japonica cultivar-group)]
  misc_feature: Useful for making plants with altered carbohydrate content
  misc_feature: Functional homolog of the protein sequence given in SEQ ID NO 13929
MGTGALAVAAAAPADRANKQRRAGGGAHLWKKALLHFSLCFVMGFFTGFAPSSSSSWKAATTTPHPPHRPGDRLAASRVAVDVNARATLPPPASAGDALGVGGATVDVGDEYEEGDANGQRRRLLIVVTTTRSGPGERRRRRGELLRLAHTLRLVRPPVVWVVVEPAADAPATAVVLRGTGVMYRHLAFKPEENFTTAEAEAHAQRNAALAHVEKHRLAGVLHFADAAGVYDVGFFDQIRQIEAFGTWPVATMLAGEKKVVVEGPLCSASKVVGWFSRDFNDGTTRSVTYNTEVDLNPAGAAGTRAHTIDVSGFAFNSSILWDPERWGRPTSLPDTSQDSIKFVQEVVLEDRAKLKGIPSDCSQIMVWQYSVPSSQ

SEQ ID NO: 5753 - DNA, 1422 bp, Sorghum bicolor
  misc_feature: Ceres ANNOT ID no. 6054472
  misc_feature: Encodes the peptide sequence at SEQ ID NO 5754
atggggaagaagggcaagtggttcggcgccgtcaagaaggtcttcagccctgaatccaaggagaagaaagaggagagactaaggaggaaatcagcagctagcaacccagcaccgctagatctgaccccatctacctccttggaagtcaatgtttcggtgccaccccctccagctccggcacctcctccagttctccaccaggccgaggaggtcagggtccctgaacccgagcaggagcagagcaagcatgtcaccgtggaggagccccctgctgttccagcacagccgtcggtgctgccacctggtgtgccaaccgaagagcttgctgcggtcaagatccagaccgccttccgaggttacctggcaaggagggcactaagagcactgcgaggtcttgttcgattgaagtcattggttgagggtaattcagtcaagcgtcaatctgcaagcactctgcgctgtatgcaaactctatcgcgggtgcagtcacaaatacgttctaggagagcaaagatgtccgaggagaaccaggccctccaacgccagctcctacttaaacaggaattggagaatttcagaatgggtgagaactgggatgacagcactcaatccaaggagcaaatcgaggcaagcctgataagcaggcaagaagcagcgataagaagagaaagagcgcttgcatatgcattttcacatcagtggaagagtacttcaagatctgtcaacccaatgtttgtagacccaaacaacttgcagtggggctggagctggttggagcgctggatggcagcaaaaccttgggagggccgtaatggggctgacaaggagagcaactttgaccgcggatcagttaagagtatgagcttgaaccttggagagggtgaaatcacaaaagctttcaaccgccgggactcaaagccagaaaagccatcaccaccaactccaaaaccaacccgtccagcctggcaatccccttcgacgccatctgctaaagtggcaccaatacctgccaggaggaaatccgccacgccaaagaatgggctttcacaggtggacgatgacgctaggagtgtgctcagcgtgcagtctgagcgaccaaggaggcacagtatagccacctcgactgtgcgggatgatgaaagcctcgcaagctccccatcactccccagctacatggttcccacggaatctgcaagagccaaatctcgtctccagggctcatcaatgaccaatggtgcagagacaccagagaaaggaggctctactggaccagtcaagaagaggttgtccttccaaggtggaactgcagctgcctcaccaatgcggcggcattctggtcctcccaaggtggagagtgcagtgaaggacattgttgcaccaccacagccagaggccttggtagtcaatggtggaagcaagtga

SEQ ID NO: 5754 - protein, 473 aa, Sorghum bicolor
  misc_feature: Ceres ANNOT ID no. 6054472
  misc_feature (107)..(127): Pfam Id: IQ Pfam Desc: IQ calmodulin-binding motif
  misc_feature (1)..(301): NCBI GI: 115461823 NCBI Desc: os05g0123200 [oryza sativa (japonica cultivar-group)]
  misc_feature (1)..(454): NCBI GI: 92868235 NCBI Desc: iq calmodulin-binding region [medicago truncatula]
  misc_feature (1)..(452): NCBI GI: 23506103 NCBI Desc: at5g03040/f15a17_70 [arabidopsis thaliana]
  misc_feature (102)..(413): NCBI GI: 140068222 NCBI Desc: iq calmodulin-binding region [medicago truncatula]
  misc_feature (1)..(268): NCBI GI: 560150 NCBI Desc: sf16 protein [helianthus annuus]
  misc_feature: Useful for making plants with modulated oxidative stress sensitivity
  misc_feature: Useful for making plants with modulated salt sensitivity
  misc_feature: GREAT-hit functional homolog of the protein sequence given in SEQ ID NO 12884
  misc_feature: Functional homolog of the protein sequence given in SEQ ID NO 13100
  misc_feature: Useful for making plants with modulated salt sensitivity
  misc_feature: Functional homolog of the protein sequence given in SEQ ID NO 13100
MGKKGKWFGAVKKVFSPESKEKKEERLRRKSAASNPAPLDLTPSTSLEVNVSVPPPPAPAPPPVLHQAEEVRVPEPEQEQSKHVTVEEPPAVPAQPSVLPPGVPTEELAAVKIQTAFRGYLARRALRALRGLVRLKSLVEGNSVKRQSASTLRCMQTLSRVQSQIRSRRAKMSEENQALQRQLLLKQELENFRMGENWDDSTQSKEQIEASLISRQEAAIRRERALAYAFSHQWKSTSRSVNPMFVDPNNLQWGWSWLERWMAAKPWEGRNGADKESNFDRGSVKSMSLNLGEGEITKAFNRRDSKPEKPSPPTPKPTRPAWQSPSTPSAKVAPIPARRKSATPKNGLSQVDDDARSVLSVQSERPRRHSIATSTVRDDESLASSPSLPSYMVPTESARAKSRLQGSSMTNGAETPEKGGSTGPVKKRLSFQGGTAAASPMRRHSGPPKVESAVKDIVAPPQPEALVVNGGSK

SEQ ID NO: 5755 - DNA, 1233 bp, Sorghum bicolor
  misc_feature: Ceres ANNOT ID no. 6054482
  misc_feature: Encodes the peptide sequence at SEQ ID NO 5756
  misc_feature: Up-regulated in shoot tissues in response to methyl jasmonate treatment
  misc_feature: Up-regulated in root tissues in response to methyl jasmonate treatment
  misc_feature: Up-regulated in shoot tissues in response to salicylic acid treatment
  misc_feature: Up-regulated in root tissues in response to salicylic acid treatment
atgcagcggtggctcccggcgctcctccgccgcgcggcgcccgcggtctccggcggcggcgtggcgcggctcttcgcctcgtcctccctcctcttcgacgacacgcaggtgcagttcaaggagagcgtgcgcaagttcgcgcaggaggcaatcgcgccgcacgcggcggcgatcgacgcgtccaaccacttccctcgggaggtggacctgtggaggctcatgggggacttcaacctccacggcctcaccgcccccgaggagtacggcgggatggggctcggctacatgtaccactgcatcgccatggaggagatcaccagggcctccggcgccgtcggactctcctacggcgcccactccaacctctgcatcaaccagctcgtccggcacggcaacccggagcagaagctcaagtatctgcccaagctgattagtggggagcacatcggggcactggcgatgagtgaacccaactctggctctgatgtcgtcagcatgaagtgcaaagctgagaaagtggacggcggctatgttcttaacgggaacaagatgtggtgcaccaatgggccgtctgctcagacactggttgtttatgcaaaaacagatctggctgcaggatcaaaaggaataactgcattcataatcgagaaagggatgcctgggttcagtactgctcagaagttggacaaacttggcatgagaggaagcgacacatgtgagcttgtttttgagaactgctttgtgccacgtgaaaatgtcctcggtgaagaaggcaaaggtgtttatgtcatgatgtcagggcttgatctggaaaggcttgtattagctgggggtcctattggccttatgcaggcatgccttgatgttgtacttccatatgttcgccagagggagcaattcggccgtccaattggtgaatttcagttcatacaggggaaaatggctgatatgtacacctcattgcagtcgtcaagatcatttgtatactcggttgctagggactgcgataatggcaaagttgaccgcaaggattgtgcaggagtaattctctttgctgctgaaaatgcaacccaagttgcacttcaggcaatccagtgtcttggtggaaatgggtacataaatgagtacccaactggtcgtctcctgagagatgcaaaattgtttgagattggtgctggtactagtgaggtaagaagaatgataattggccgtgagctcttcaaagaggactga

SEQ ID NO: 5756 - protein, 410 aa, Sorghum bicolor
  misc_feature: Ceres ANNOT ID no. 6054482
  misc_feature (258)..(407): Pfam Id: Acyl-CoA_dh_1 Pfam Desc: Acyl-CoA dehydrogenase, C-terminal domain
  misc_feature (33)..(147): Pfam Id: Acyl-CoA_dh_N Pfam Desc: Acyl-CoA dehydrogenase, N-terminal domain
  misc_feature (151)..(202): Pfam Id: Acyl-CoA_dh_M Pfam Desc: Acyl-CoA dehydrogenase, middle domain
  misc_feature (22)..(409): NCBI GI: 92888788 NCBI Desc: acyl-coa dehydrogenase [medicago truncatula]
  misc_feature (1)..(410): NCBI GI: 112005099 NCBI Desc: isovaleryl-coa dehydrogenase [beta vulgaris]
  misc_feature (27)..(409): NCBI GI: 5869965 NCBI Desc: isovaleryl-coa dehydrogenase; auxin binding protein (abp44) [pisum sativum]
  misc_feature (27)..(410): NCBI GI: 21592889 NCBI Desc: isovaleryl-coa-dehydrogenase precursor (ivd) [arabidopsis thaliana]
  misc_feature (27)..(409): NCBI GI: 5869967 NCBI Desc: auxin binding protein (abp44); isovaleryl-coa dehydrogenase [pisum sativum]
  misc_feature (27)..(410): SWISSPROT Homolog: EC 1.3.99.10 Isovaleryl-CoA dehydrogenase, mitochondrial precursor
  misc_feature: Up-regulated in shoot tissues in response to methyl jasmonate treatment
  misc_feature: Up-regulated in root tissues in response to methyl jasmonate treatment
  misc_feature: Up-regulated in shoot tissues in response to salicylic acid treatment
  misc_feature: Up-regulated in root tissues in response to salicylic acid treatment
MQRWLPALLRRAAPAVSGGGVARLFASSSLLFDDTQVQFKESVRKFAQEAIAPHAAAIDASNHFPREVDLWRLMGDFNLHGLTAPEEYGGMGLGYMYHCIAMEEITRASGAVGLSYGAHSNLCINQLVRHGNPEQKLKYLPKLISGEHIGALAMSEPNSGSDVVSMKCKAEKVDGGYVLNGNKMWCTNGPSAQTLVVYAKTDLAAGSKGITAFIIEKGMPGFSTAQKLDKLGMRGSDTCELVFENCFVPRENVLGEEGKGVYVMMSGLDLERLVLAGGPIGLMQACLDVVLPYVRQREQFGRPIGEFQFIQGKMADMYTSLQSSRSFVYSVARDCDNGKVDRKDCAGVILFAAENATQVALQAIQCLGGNGYINEYPTGRLLRDAKLFEIGAGTSEVRRMIIGRELFKED

SEQ ID NO: 5757 - DNA, 468 bp, Sorghum bicolor
  misc_feature: Ceres ANNOT ID no. 6054506
  misc_feature: Encodes the peptide sequence at SEQ ID NO 5758
atggagacggctgcgctcacctcccactcgctgcagtgtccagctgctgctgctgctcccgtgcatggcaagcggcggaggggaggaggagcggcggccttgccgcgccggcggcagacgttcgccggcaggatccgggctctgccgtcggcggaggtcatcagcgagatcctgcacccgaagctggtgcccggctcgccctccgacaccggcgacgtctcctcgctcgtcccggtcagtgctctcatgctgctcttctacttcgtgtccaactgggtggtgcccgagctgctcatgaagcgcctcaacgagcccaagcccgaggaggacgaagctgctgctgctgctgcatccatggcgtcgtccggcgcagcggacggcggcgacgacgccgccgcctcgccccgtaaaatccggctcaaggtcaagaagaagaagaacgggaaagcaaccatcgtgaaggtctag

SEQ ID NO: 5758 - protein, 155 aa, Sorghum bicolor
  misc_feature: Ceres ANNOT ID no. 6054506
  misc_feature (44)..(155): NCBI GI: 115461873 NCBI Desc: os05g0128100 [oryza sativa (japonica cultivar-group)]
  misc_feature: Useful for making plants with modulated nitrogen use efficiency
  misc_feature: GREAT-hit functional homolog of the protein sequence given in SEQ ID NO 13127
METAALTSHSLQCPAAAAAPVHGKRRRGGGAAALPRRRQTFAGRIRALPSAEVISEILHPKLVPGSPSDTGDVSSLVPVSALMLLFYFVSNWVVPELLMKRLNEPKPEEDEAAAAAASMASSGAADGGDDAAASPRKIRLKVKKKKNGKATIVKV

SEQ ID NO: 5759 - DNA, 1263 bp, Sorghum bicolor
  misc_feature: Ceres ANNOT ID no. 6054512
  misc_feature: Encodes the peptide sequence at SEQ ID NO 5760
atgccgccgcagccgcgcgagctctcggacgacctcctcggcgaggcattcctccgcctcccgccggacgaccccgcgtgccttctccgcgcctccctcacctgcaagcgctggcgccgcatcctcgccgacccggccttccgccgccgccaccgggagctccacgggacgccatcagtcctggggttcctccgcatctcctccggatactacgcgtcccgcttcgtccccaacaaccccgccgcctccggccgccccgccgcccgcgacctcccggggcgggtcgtgctcgactgccgccacggccgcgtcctcttccgcgcgccgagcccactcctcggcaggaaactaaactacgacctcgtcgtctgggacccgttgacgaacgagcagcgctgcctgccccgcctctcgccgccactcacggacgtatcccgcggccacttcaacgccgccgtgctctgctccgccgctgtggaagaaggctgtgaccacagcatatgccacggcggccccttccgcgtggccttcatctggagtcaagccagacaattgcatgctcgtttgtactcctcggagacggagaattggagtgaggccatctctgttcagaagccccctcggaatccagtgaggttgtgtctccgcatgttgctatgcagcaaaactcttgtgggagacactctctatttccactacagctcggactatgccttggagtaccagcttggtgcacagagcttatcgatcatccacggacctccacggccggggtcccaaatttcagcctttttcgtgatgcccatggggggcggtgggctgggatgcatggacgtcgaggaggacgaatcaagcctccgtctacagctatggtcaagggaagcagcttcaggcagtgatggagttgcgagatggacaaggggcagagccatagatcttgaggaactcctgcctaatggtgctctaccatctccacggtgggcacctgatcttcgttcccggttaacgagtgtacaattgctcggctttgcggagggcaccgatgtcatctttgtgggcacacgggcgcatgcgcgtaaccaccctggtggtatctatatggtccaactcaattcagggagggctaggaaggtttcagcgtttgacactgcacccattcctttttataatgagatggtcgttccttatacaagcttctgcattccagtaactgatgcctcttctacaaccgaggtgccaggagataatgcttcagtgggatga

SEQ ID NO: 5760 - protein, 420 aa, Sorghum bicolor
  misc_feature: Ceres ANNOT ID no. 6054512
  misc_feature (3)..(53): Pfam Id: F-box Pfam Desc: F-box domain
  misc_feature (71)..(415): NCBI GI: 38567955 NCBI Desc: osjnbb0115i21.11 [oryza sativa (japonica cultivar-group)]
  misc_feature (5)..(286): NCBI GI: 115437584 NCBI Desc: os01g0557400 [oryza sativa (japonica cultivar-group)]
  misc_feature (5)..(298): NCBI GI: 115470391 NCBI Desc: os07g0122900 [oryza sativa (japonica cultivar-group)]
  misc_feature (86)..(378): NCBI GI: 115475786 NCBI Desc: os08g0299900 [oryza sativa (japonica cultivar-group)]
  misc_feature (21)..(305): NCBI GI: 115481210 NCBI Desc: os10g0158700 [oryza sativa (japonica cultivar-group)]
MPPQPRELSDDLLGEAFLRLPPDDPACLLRASLTCKRWRRILADPAFRRRHRELHGTPSVLGFLRISSGYYASRFVPNNPAASGRPAARDLPGRVVLDCRHGRVLFRAPSPLLGRKLNYDLVVWDPLTNEQRCLPRLSPPLTDVSRGHFNAAVLCSAAVEEGCDHSICHGGPFRVAFIWSQARQLHARLYSSETENWSEAISVQKPPRNPVRLCLRMLLCSKTLVGDTLYFHYSSDYALEYQLGAQSLSIIHGPPRPGSQISAFFVMPMGGGGLGCMDVEEDESSLRLQLWSREAASGSDGVARWTRGRAIDLEELLPNGALPSPRWAPDLRSRLTSVQLLGFAEGTDVIFVGTRAHARNHPGGIYMVQLNSGRARKVSAFDTAPIPFYNEMVVPYTSFCIPVTDASSTTEVPGDNASVG

SEQ ID NO: 5761 - DNA, 1260 bp, Sorghum bicolor
  misc_feature: Ceres ANNOT ID no. 6054516
  misc_feature: Encodes the peptide sequence at SEQ ID NO 5762
atggaaagcaataatccatcacattctcagattgctgaagtgaagatggacatctcagcatcagcttctggagcagcagggtacaaattctgcaaaggtgctgcctgtgatttctctgattccagcaactcctcgaaagatgccaaggagagatccgcgtccatgaggaagcttataattgcagtgatcctttgcatcatattcatgacggtggaagtggttgggggcatcaaagcaaacagtcttgccatcttaactgatgcagcacatcttctttctgatgtggcagcatttgccatatcattattctctctctgggctgctggatgggaagcaacaccgcagcagtcttatgggttctttcgaattgagatccttggtgccttggtctccattcagctcatatggctacttgctggcatcctcgtatatgaggctattgtaaggctcattaatgagagtggcgaagtgcagggctccctgatgtttgctgtgtcggcgtttggattgttagtcaacattgtaatggctgtattgctaggccatgaccatgggcatggccatggacacagccatggacattcacatgaccatggtcatggtgattcagatgatgaccattcccaccatgaagaacaagaacagggccatgttcatcaccacgagcacggacatggaagttctattactgttacaacacatcaccaccaccaccaccactcaggcactggacaacatcatgatgttgaggagccactgattaagcatgaggctgactgtgagggtacccaatctgctgccaaagctgctaagaagcctcgacgtaatataaatgtacacagtgcttatcttcatgtgcttggggactccatccaaagcatcggagtgatgatcggtggggctatcatctggtacaagcctgagtggaagatcattgatctcatctgcaccctcatcttctcggtgattgtgctgttcaccacaatcaggatgttgcgcaacatccttgaagtcctgatggagagcacaccccgcgagatcgacgccaccaggctgcagagggggctctgcgagatggaaggggtggttgccgtccatgagctgcatatctgggccatcacagtggggaaggtgctcctggcttgccatgtgacaatcgcccgggaagcagatgctgatcagatcctcgacaaagtaattgggtacatcaagacggagtacaacatcagccatgtgaccattcaggtcgagcgtgaatag

SEQ ID NO: 5762 - protein, 419 aa, Sorghum bicolor
  misc_feature: Ceres ANNOT ID no. 6054516
  misc_feature (58)..(420): Pfam Id: Cation_efflux Pfam Desc: Cation efflux family
  misc_feature (1)..(419): NCBI GI: 30420736 NCBI Desc: zinc transporter [oryza sativa (japonica cultivar-group)]
  misc_feature (1)..(419): NCBI GI: 59275989 NCBI Desc: ntmtp1a [nicotiana tabacum]
  misc_feature (1)..(419): NCBI GI: 59275987 NCBI Desc: ngmtp1 [nicotiana glauca]
  misc_feature (1)..(419): NCBI GI: 59275991 NCBI Desc: ntmtp1b [nicotiana tabacum]
  misc_feature (1)..(224): NCBI GI: 37778436 NCBI Desc: cation-efflux transporter [brassica juncea]
MESNNPSHSQIAEVKMDISASASGAAGYKFCKGAACDFSDSSNSSKDAKERSASMRKLIIAVILCIIFMTVEVVGGIKANSLAILTDAAHLLSDVAAFAISLFSLWAAGWEATPQQSYGFFRIEILGALVSIQLIWLLAGILVYEAIVRLINESGEVQGSLMFAVSAFGLLVNIVMAVLLGHDHGHGHGHSHGHSHDHGHGDSDDDHSHHEEQEQGHVHHHEHGHGSSITVTTHHHHHHHSGTGQHHDVEEPLIKHEADCEGTQSAAKAAKKPRRNINVHSAYLHVLGDSIQSIGVMIGGAIIWYKPEWKIIDLICTLIFSVIVLFTTIRMLRNILEVLMESTPREIDATRLQRGLCEMEGVVAVHELHIWAITVGKVLLACHVTIAREADADQILDKVIGYIKTEYNISHVTIQVERE

SEQ ID NO: 5763 - DNA, 1494 bp, Sorghum bicolor
  misc_feature: Ceres ANNOT ID no. 6054518
  misc_feature: Encodes the peptide sequence at SEQ ID NO 5764
atggcggtggtgtcgcggctggcagtcgcgcgggtgtcgtcggacggcgcggcgcgccccgcggcggcaggggggaggaggacgaggactgcgctcgcgggggttcggttcccgccggccgccaggacggggaggacgaggcgcggcggggccgtcgcggctagcccccccacggaggaggcggtgcagatgacggagccgctcaccaaggacgacctcgtcgcctacctcgtctccgggtgcaagcccaaggagaattggagaattggcacggagcatgaaaagtttggtttcgaagtcgacacgttacgccctataaaatacgatcagattcgtgacatactgaatgggctcgctgagcgatttgattgggacaagataatggaaggagacaatgttatcggcctcaagcagggaaagcaaagcatctcactagaacctggaggccaatttgaacttagtggcgctcctctcgaaacattacatcaaacttgtgctgaggtcaattcacatctttatcaggtcaaagcagttggagaggaaatgggaataggatttcttgggcttggctttcagccgaaatgggcactgagtgatataccaataatgccaaagggaagatacgaaataatgaagaattacatgcctaaagttggtacccttggtcttgacatgatgttccggacatgtactgtgcaggttaatcttgacttcagttcagaacaggatatgataaggaaatttcgcgctggccttattgcaactgcaatatttgccaattctcccttcaaagaaggaaaaccaaatggatttctcagcttaaggagccatatctggacagatactgataacaaccgtgcagggatgctcccttttgtcttcgataactcatttgggtttgagcaatatgtggattatgcattggatgttccaatgtattttgtgtatcgaaataaaaagtatattgactgcaccggaatgtcgtttcgggattttatgcaaggaaagctcccacaggctcctggggagttgcctactcttaatgattgggagaaccatctaacaacaatttttcctgaggttagattaaaaagataccttgagatgagaggtgctgatggtggcccatggaggagattgtgtgcactgcctgcattttgggttgggctgctgtacgatgaggaatcgttacaaagtattatagacatgacttttgattggacaaaggaggaaagagagatgctaagacggaaggtacctgtgactggtctgaagacaccatttcgtgatggatatgtaagagatttagctgaggaagttctaaaactggccaagagtggactggaaagaagaggatacaaggaggttggtttccttagagaggttgacgaagtggtgagaacaggagtgacacctgctgagaggcttctgaatctgtacgagacgaagtggcaacgcaacgtagaccatgttttcgagcatttgttatactga

SEQ ID NO: 5764 - protein, 497 aa, Sorghum bicolor
  misc_feature: Ceres ANNOT ID no. 6054518
  misc_feature (95)..(408): Pfam Id: GCS2 Pfam Desc: Glutamate-cysteine ligase family 2(GCS2)
  misc_feature (1)..(497): NCBI GI: 34394064 NCBI Desc: gamma-glutamylcysteine synthetase [oryza sativa (japonica cultivar-group)]
  misc_feature (1)..(497): NCBI GI: 26986170 NCBI Desc: gamma-glutamylcysteine synthetase [oryza sativa (japonica cultivar-group)]
  misc_feature (243)..(497): NCBI GI: 115471961 NCBI Desc: os07g0462000 [oryza sativa (japonica cultivar-group)]
  misc_feature (64)..(497): NCBI GI: 23343600 NCBI Desc: gamma-glutamylcysteine synthetase [oryza sativa (japonica cultivar-group)]
  misc_feature (41)..(497): NCBI GI: 37681494 NCBI Desc: gamma-glutamylcysteine synthetase [lotus corniculatus var. japonicus]
  misc_feature (46)..(497): SWISSPROT Homolog: EC 6.3.2.2 Glutamate--cysteine ligase, chloroplast precursor
MAVVSRLAVARVSSDGAARPAAAGGRRTRTALAGVRFPPAARTGRTRRGGAVAASPPTEEAVQMTEPLTKDDLVAYLVSGCKPKENWRIGTEHEKFGFEVDTLRPIKYDQIRDILNGLAERFDWDKIMEGDNVIGLKQGKQSISLEPGGQFELSGAPLETLHQTCAEVNSHLYQVKAVGEEMGIGFLGLGFQPKWALSDIPIMPKGRYEIMKNYMPKVGTLGLDMMFRTCTVQVNLDFSSEQDMIRKFRAGLIATAIFANSPFKEGKPNGFLSLRSHIWTDTDNNRAGMLPFVFDNSFGFEQYVDYALDVPMYFVYRNKKYIDCTGMSFRDFMQGKLPQAPGELPTLNDWENHLTTIFPEVRLKRYLEMRGADGGPWRRLCALPAFWVGLLYDEESLQSIIDMTFDWTKEEREMLRRKVPVTGLKTPFRDGYVRDLAEEVLKLAKSGLERRGYKEVGFLREVDEVVRTGVTPAERLLNLYETKWQRNVDHVFEHLLY

SEQ ID NO: 5765 - DNA, 1401 bp, Sorghum bicolor
  misc_feature: Ceres ANNOT ID no. 6054519
  misc_feature: Encodes the peptide sequence at SEQ ID NO 5766
atgacctcgctccagtccttcctcgccatcaagccggccgccgccggctgggccgcgggcgcgcggcccgccgccgctccgcagtcccgccgcgcgcgcgtctcggcttgcctcgcggcgccgccgccgccgccgaccaccgcggcctctgccgtggggccggcgcggcgggagctgtcggccgcgagccgcgccgtcatggacgacgaggcgcggtacctcgtcggcacatacaagcggtcccgcgtcgtcttcgagtacgggcgcgggtgcaagctctacgacgtcgacggccgcgagtacctcgacatgtccgctggcatcgccgtcacggcgctcggccacgcggatcccgacgtgtgcgctaccatcgcggagcagagcggtaaaatcgtccacgtcagcaacgtcttctacactacaccccaggtggagctcgcgaagcggctcgtggaggtgtcgttcgcggaccgcgctttcttcgctagcactggcacggaggccaacgaggcggccatcaaattctcccgcaagttccagcgggtcgcccacccggacagtgacgatccgcccatggagttcttggcgttcagcagcagcttccatggccgaaccatgggcgcggtcgcgctcaccagcaagtcgcagtaccgggagcccttcgcgcccgtcatgcccggagtgaccttcgtggattacggcgatttggaggcggccaagaagttcatacagtccggtagggtcgctgctgtgttcgtcgagcccgtgcagggtgagggtggtattcacagcgccacacaggagttcttgcaggggctgcgggaggcctgtgatgaggcgggagccctcttggtctttgatgaggtgcaatgtggtttcgggcgcacaggttacctttgggcccatgaggcgtatggagtagaaccagacatcatgaccttagcaaagccattggccaacggtattccgataggtgttgtcttggtcaaggagaaggttgctgcagccataaactatggcgaccatggtacaacgttcggcggcggccctcttgcctgccagactgcgataaccgtgtttgacaaaatcatgaaacctgggttcttggctgaggtgtccaagaaaggggaaaacttcaagcagctcctccgcactaagctgagtggaaacccacacgtaaaggaggtccgtggggttggtcttcttgttggcattgagctagatgtaccagctggtcctctggtcgacgcatgcttggacgctggcgtcatagtgctgacggccggcaaaggcaatgttgtgaggctggtgccaccactcatcatctcagaaaaggagctggagcatgccgcggatgttataagggattgtctaccggtgcttgatgttgctgctgcttaa

SEQ ID NO: 5766 - protein, 466 aa, Sorghum bicolor
  misc_feature: Ceres ANNOT ID no. 6054519
  misc_feature (84)..(409): Pfam Id: Aminotran_3 Pfam Desc: Aminotransferase class-III
  misc_feature (1)..(462): NCBI GI: 1944511 NCBI Desc: acetylornithine aminotransferase [alnus glutinosa]
  misc_feature (121)..(435): NCBI GI: 115471959 NCBI Desc: os07g0461900 [oryza sativa (japonica cultivar-group)]
  misc_feature (70)..(458): NCBI GI: 118062525 NCBI Desc: acetylornithine and succinylornithine aminotransferases [roseiflexus castenholzii dsm 13941]
  misc_feature (66)..(458): NCBI GI: 106892480 NCBI Desc: acetylornithine and succinylornithine aminotransferases [roseiflexus sp. rs-1]
  misc_feature (62)..(458): NCBI GI: 76259626 NCBI Desc: acetylornithine and succinylornithine aminotransferase [chloroflexus aurantiacus j-10-fl]
  misc_feature (1)..(462): SWISSPROT Homolog: EC 2.6.1.11 Acetylornithine aminotransferase, mitochondrial precursor
  misc_feature: Useful for making plants with modulated nitrogen use efficiency
  misc_feature: Useful for making plants with modulated nitrogen use efficiency
  misc_feature: GREAT-hit functional homolog of the protein sequence given in SEQ ID NO 12981
  misc_feature: Useful for making plants with modulated nitrogen use efficiency
  misc_feature: Functional homolog of the protein sequence given in SEQ ID NO 12981
MTSLQSFLAIKPAAAGWAAGARPAAAPQSRRARVSACLAAPPPPPTTAASAVGPARRELSAASRAVMDDEARYLVGTYKRSRVVFEYGRGCKLYDVDGREYLDMSAGIAVTALGHADPDVCATIAEQSGKIVHVSNVFYTTPQVELAKRLVEVSFADRAFFASTGTEANEAAIKFSRKFQRVAHPDSDDPPMEFLAFSSSFHGRTMGAVALTSKSQYREPFAPVMPGVTFVDYGDLEAAKKFIQSGRVAAVFVEPVQGEGGIHSATQEFLQGLREACDEAGALLVFDEVQCGFGRTGYLWAHEAYGVEPDIMTLAKPLANGIPIGVVLVKEKVAAAINYGDHGTTFGGGPLACQTAITVFDKIMKPGFLAEVSKKGENFKQLLRTKLSGNPHVKEVRGVGLLVGIELDVPAGPLVDACLDAGVIVLTAGKGNVVRLVPPLIISEKELEHAADVIRDCLPVLDVAAA

SEQ ID NO: 5767 - DNA, 912 bp, Sorghum bicolor
  misc_feature: Ceres ANNOT ID no. 6054524
  misc_feature: Encodes the peptide sequence at SEQ ID NO 5768
atggaggatctgtacagcatccacccggggatctcgcgcgccggggcggcggcggcggccagcgaggcgtccggtgtagccggtggaccgggctcttccccgcccccgccgccgcagccgcctcctccgccgccggcggatctgacggagctggtcaaggcgcagatcgccgggcacccgcgctacccctctctcctctccgcctacatcgagtgccgcaaggtgggcgcgccgccggaggtggccacgctgctggaggagatcggacgggagaggtgcgccgccgcctccgctggcggggaggtcggcctggaccccgagctcgacgagttcatggaggcgtactgccgggtgctggagcggtacaaggaggagctgtcgcggccgttcgacgaggcggcgtctttcctcagcagcgtccggacgcagctcagctccctctgcggcggcgccgcctcgctctccgatgaaatggtagggtcctctgaggacgaaccatgctcaggagacacagaggcgactgacctgggtcaggagcacagctcacggttggctgaccgtgagctcaaggagatgctgctgaagaagtacagtggttgtttgagccggctgcggtctgagttcctgaagaagaggaagaaagggaagctaccgaaggatgctcggtcggcgctgatggactggtggaacacgcattaccgctggccataccctactgaagaggataaggtgaggctggcagcgatgactgggttggacccgaagcagatcaacaactggttcatcaaccagcggaagcggcactggaagccatcggaggacatgcggttcgcgctaatggagggtgtcacgggcggcggatcatcctccgggacgacgctctacttcgacactggcacgatcgggccgtga

SEQ ID NO: 5768 - protein, 303 aa, Sorghum bicolor
  misc_feature: Ceres ANNOT ID no. 6054524
  misc_feature (98)..(149): Pfam Id: KNOX2 Pfam Desc: KNOX2 domain
  misc_feature (50)..(94): Pfam Id: KNOX1 Pfam Desc: KNOX1 domain
  misc_feature (188)..(209): Pfam Id: ELK Pfam Desc: ELK domain
  misc_feature (1)..(303): NCBI GI: 30348863 NCBI Desc: knotted1-like homeodomain protein liguleless4a [zea mays]
  misc_feature (1)..(303): NCBI GI: 30348865 NCBI Desc: knotted1-like homeodomain protein liguleless4b [zea mays]
  misc_feature (1)..(303): NCBI GI: 51854371 NCBI Desc: knox class homeodomain protein [oryza sativa (japonica cultivar-group)]
  misc_feature (1)..(303): NCBI GI: 2935573 NCBI Desc: knox class homeodomain protein [oryza sativa]
  misc_feature (1)..(303): NCBI GI: 5103729 NCBI Desc: knotted1-type homeobox protein osh71 [oryza sativa]
  misc_feature: The sequence is a functional homolog of SEQ ID NO 200 in the 10/225,066US patent application
  misc_feature: The sequence is a functional homolog of SEQ ID NO 2334 in the 10/374,780US patent application
  misc_feature: The sequence is a functional homolog of SEQ ID NO 2674 in the 10/374,780US patent application
  misc_feature: The sequence is a functional homolog of SEQ ID NO 272 in the 10/412,699US patent application
  misc_feature: The sequence is a functional homolog of SEQ ID NO 601 in the 11/479,226US patent application
  misc_feature: The sequence is a functional homolog of SEQ ID NO 76 in the 10/225,066US patent application
  misc_feature: Useful for making plants with modulated growth and phenotype characteristics
  misc_feature: The sequence is a functional homolog of SEQ ID NO 272 in the 20040045049 US patent application
  misc_feature: The sequence is a functional homolog of SEQ ID NO 76 in the 20050160493 US patent application
  misc_feature: The sequence is a functional homolog of SEQ ID NO 2674 in the 10/374,780 US patent application
  misc_feature: The sequence is a functional homolog of SEQ ID NO 76 in the 10/225,066 US patent application
  misc_feature: The sequence is a functional homolog of SEQ ID NO. 320 in the 11/188,298 US application
  misc_feature: The sequence is a functional homolog of SEQ ID NO. 499 in the 11/188,298 US application
MEDLYSIHPGISRAGAAAAASEASGVAGGPGSSPPPPPQPPPPPPADLTELVKAQIAGHPRYPSLLSAYIECRKVGAPPEVATLLEEIGRERCAAASAGGEVGLDPELDEFMEAYCRVLERYKEELSRPFDEAASFLSSVRTQLSSLCGGAASLSDEMVGSSEDEPCSGDTEATDLGQEHSSRLADRELKEMLLKKYSGCLSRLRSEFLKKRKKGKLPKDARSALMDWWNTHYRWPYPTEEDKVRLAAMTGLDPKQINNWFINQRKRHWKPSEDMRFALMEGVTGGGSSSGTTLYFDTGTIGP

SEQ ID NO: 5769 - DNA, 1194 bp, Sorghum bicolor
  misc_feature: Ceres ANNOT ID no. 6054525
  misc_feature: Encodes the peptide sequence at SEQ ID NO 5770
  misc_feature: Up-regulated in shoot tissues in response to salicylic acid treatment
atggaatataaggcgagatcttctgggacctcaggaacttccactaaaagtttccgtgatctgtacaatatgaagtactcaagctacttaaatgacgaaccaatgccagatgctacatcagaaaaggagcagggaaatgaatatttcaaacagaagaagttcgctgatgctattgagtgctattccagaagtattgggctgtctcctacagcagtcacatttgcaaatagagctatggcatatcttaaactaagaaggttcaaggaggcagaggacgattgcactgaagctctgaatctggatgatcgctatattaaagcatactcacgccgaattactgcacgaaaagaacttgggaagcttaaggaggcaatggaagatgctgaatttgccatcagtcttgatccaaacaatccagagctaaggaagcagtattctgagataaaagctttgcacatggagaaaatggctaaaaaggttccagcaccagctaaacgtgcagtttctggaattgctaaaactgctgatgtcacttctcacccaccgactatctcccagaaggacactatcatggaagttgatccgcctgttggagatgcaatgaagatcagagagagtgcaagcggcaggtctaacggaggatctggagtcatcatcaatgacaataccatacagcagacccaaggtcgggatgctaacctgaagcctgggccagaagtttcagttcaagatcttgcagctcgtgctgcttcacggtatatggccagcactgtgaaaagcgttaagacgccaaaaacagcttatgactttgaggtttcttggagagctctttctgatgacactgcccagcaaatacagttattaaagtcaattccaccagcaagcttaccagagattttcaagaacgcactttctgcaccttttcttattgacatcgtgaagtgttcagcctcaattttccgggatgatacggcattagctgtcagtattttggagaatttggctcgagttccacgctttgacttgataatcatgtgcctttcatccatgcacaaatctgaactgaggaagatatgggatcaagtattccttgctgaaaaggcatcggctgatgatcagatggaagctcttaggcagctgcgaggcagatacattccgggaggatggcaggatagcatgctcacttcgagttaa

SEQ ID NO: 5770 - protein, 397 aa, Sorghum bicolor
  misc_feature: Ceres ANNOT ID no. 6054525
  misc_feature (38)..(71): Pfam Id: TPR_1 Pfam Desc: Tetratricopeptide repeat
  misc_feature (105)..(138): Pfam Id: TPR_1 Pfam Desc: Tetratricopeptide repeat
  misc_feature (1)..(397): NCBI GI: 115461897 NCBI Desc: os05g0129900 [oryza sativa (japonica cultivar-group)]
  misc_feature (37)..(202): NCBI GI: 87248243 NCBI Desc: tpr-repeat protein [bombyx mori]
  misc_feature (38)..(240): NCBI GI: 46250303 NCBI Desc: mgc81126 protein [xenopus laevis]
  misc_feature (38)..(155): NCBI GI: 51260045 NCBI Desc: similar to riken cdna 2310042p20 [rattus norvegicus]
  misc_feature (38)..(210): NCBI GI: 68731768 NCBI Desc: sperm-associated antigen 1 (infertility-related sperm protein spag-1) (tpr-containing protein involved in spermatogenesis) (tpis)
  misc_feature: Up-regulated in shoot tissues in response to salicylic acid treatment
MEYKARSSGTSGTSTKSFRDLYNMKYSSYLNDEPMPDATSEKEQGNEYFKQKKFADAIECYSRSIGLSPTAVTFANRAMAYLKLRRFKEAEDDCTEALNLDDRYIKAYSRRITARKELGKLKEAMEDAEFAISLDPNNPELRKQYSEIKALHMEKMAKKVPAPAKRAVSGIAKTADVTSHPPTISQKDTIMEVDPPVGDAMKIRESASGRSNGGSGVIINDNTIQQTQGRDANLKPGPEVSVQDLAARAASRYMASTVKSVKTPKTAYDFEVSWRALSDDTAQQIQLLKSIPPASLPEIFKNALSAPFLIDIVKCSASIFRDDTALAVSILENLARVPRFDLIIMCLSSMHKSELRKIWDQVFLAEKASADDQMEALRQLRGRYIPGGWQDSMLTSS

SEQ ID NO: 5771 - DNA, 903 bp, Sorghum bicolor
  misc_feature: Ceres ANNOT ID no. 6054536
  misc_feature: Encodes the peptide sequence at SEQ ID NO 5772
  misc_feature: Down-regulated in shoot tissues in response to salicylic acid treatment
atggcagggcggcggccgggggcgaagcccaggggcggtagcggcggcgcggggaggaggaggagcgcgtggatggcggaggacgggagcaagcgctggggggaggccttcttcctgctctacacgcccttctggctcacgctctgcctcggcgtcgtcgtccccttcaagctctacgagaggttcacggagctggagtacctgatccttggcttggtgtccacggtgccggcgttcgtcatcccactcttcctcgtagggaaggcagatagtgttagaaatttgaaagatcgatactgggtcaaggctaatatttggattataatttttagctatgtcggtaactacttctggacacattacttcttcacagttcttggcgcgtcatatacttttccatcatggaggatgaataatgtaccccatacgacgtttctcctgacccatgcttgtttcctgttctatcatatggcatcaaatatgacactccgtagattacgtcactctacagctaacttaccacagtctattcgctggttatttgaagctgcatggattttagcactgtcatacttcatagcgtacctggagaccctagccattgcaaatttcccatactatgaattcgttgaccgggatataatgtacaaagtaggttctttgttctatgcaatatacttcatcgtcagcttcccaatgttttcaaggattgacgagaaagatgagaagtggaacctgtccagggtggctgttgactctctgggcgcagcgatgctcgtcacgataatactggacctatggcgcatattcttggggccaatagttcccatcccagagtcgaggcattgtggtggtcagccagggctcgcatggttccaacaagtgcagaacgaaagcacctga

SEQ ID NO: 5772 - protein, 300 aa, Sorghum bicolor
  misc_feature: Ceres ANNOT ID no. 6054536
  misc_feature (22)..(292): NCBI GI: 62320905 NCBI Desc: cyclopropyl isomerase [arabidopsis thaliana]
  misc_feature (22)..(292): NCBI GI: 7715089 NCBI Desc: cyclopropyl isomerase [arabidopsis thaliana]
  misc_feature (204)..(299): NCBI GI: 115485179 NCBI Desc: os11g0302500 [oryza sativa (japonica cultivar-group)]
  misc_feature (22)..(292): SWISSPROT Homolog: EC 5.5.1.9 Cycloeucalenol cycloisomerase
  misc_feature: Useful for making plants with altered sterol content
  misc_feature: Useful for making plants with modulated seed size
  misc_feature: Useful for making plants with modulated nitrogen use efficiency
  misc_feature: GREAT-hit functional homolog of the protein sequence given in SEQ ID NO 13481
  misc_feature: GREAT-hit functional homolog of the protein sequence given in SEQ ID NO 13508
  misc_feature: Useful for making plants with altered sterol content
  misc_feature: Functional homolog of the protein sequence given in SEQ ID NO 13930
  misc_feature: Down-regulated in shoot tissues in response to salicylic acid treatment
MAGRRPGAKPRGGSGGAGRRRSAWMAEDGSKRWGEAFFLLYTPFWLTLCLGVVVPFKLYERFTELEYLILGLVSTVPAFVIPLFLVGKADSVRNLKDRYWVKANIWIIIFSYVGNYFWTHYFFTVLGASYTFPSWRMNNVPHTTFLLTHACFLFYHMASNMTLRRLRHSTANLPQSIRWLFEAAWILALSYFIAYLETLAIANFPYYEFVDRDIMYKVGSLFYAIYFIVSFPMFSRIDEKDEKWNLSRVAVDSLGAAMLVTIILDLWRIFLGPIVPIPESRHCGGQPGLAWFQQVQNEST

SEQ ID NO: 5773 - DNA, 2013 bp, Sorghum bicolor
  misc_feature: Ceres ANNOT ID no. 6054539
  misc_feature: Encodes the peptide sequence at SEQ ID NO 5774
atggaggcaaatccgaagaacgtcttcacgattaaagtggaggacggtaagcctggaaaagacggccagccggcggtaggaccggtgttccggagcgtgctggccaaggatggattcccagttcttgagcctgacatgcaaacatcatgggatgtgttcagggtagcagtaggcaagtatcccaacaaccggatgcttggatggcgtccgtttaaagatggagtgccagggccctacttgtggaaatcatacaaggagatctatgatgaggtgctgcaagctggctctgctttgcagcacctgggagtgcaaccaggttccagggtcggaatctacggcgcaaactgtcctcagtggatagtggcaatggaggcttgcaatgccaatagtctgatctgtgtcccactatatgatactttaggtgcaggagctgttgactacatcattaatcacgctgagattgatgttgtcttcatacaggacaagaaaataaaagagatactatcccctaattgcaagtctgctaagagactaaaagctttggtggcattcacttcggcaacaagtgaacaaatcaaagaagcagataattttgggatgaaaatgtacgcgtggaatgatttcttaaaagtgggaaaagataatcctcatcaaccttgccctccacaagcaagtgatatatgcactatcatgtatacaagtggaacaagcggacagcccaaaggtgtgatgctgacccatgaaagccatgccatgtatgtaaaaggggtggacctctttatggatcagtttgatgacaagatgacaacagatgatgtctttctatcctttctcccacttgctcacatccttgaccgcatgattgaagagtatttctttcacaaaggggcctcaattggctattaccatggagatttgaatgccttgagggacgatatcgtggagctaaagccaactttactggttggggtgccccgagtgtacgaaagaatttatgaaggtatcttaaaggccattgcggaactcagacctctaagaagggtaatttttaatgctttgtacaatcgcaaactggcaagcatgaaagcaggctactcgcacaaaactgcttcaccttttgcggacatgctggcttttcgcaaggtcaaggcaaggcttggaggtcgtcttcgcttattaatttcaggaggggctccgttaagtaatgagattgaagagttcatgagagtgaccacctgtgcatactttatccaaggctatggtttaacagaaacactgggacctagtaccgtctgctacattgatgacatggccctggttggaagtgctggtgtacctgccacctacactgaaatacgactggaagaagtacccgagatggggtatgatccacttggtgtcccttcacgtggtgaaatctgcattcacgggaaatctctcttcgctgggtactacaaaagtccagaactcacaaatgaagcaatagttgacggatggtttcatacaggtgacattggagagatgaccccagacggaatcctgaaggtgattgaccgaaaaaagaacatatttaagttgtcacaaggggagtatgttgcagttgagtacctggagaaagtgtatggcttccctccacttgttgaagatatctgggtatatggggacagtttcagatcaagtttagttgcagtagtcaatccacacgaagaaaacacaatgaagtgggcacactccaatggctataagggttcgtttgctgaaatctgcaaacttgaaggacttaaagagtacatcctgaaagagctggcagctgttgcacagaagaacaagctacgaggttttgagtacatcaaaggcatagtgttggatcctgtaccttttgacattgaaagggatttggtgactgcaacaatgaagaagagaagaaagaatatgcagaactattaccagtctgagattgacatagtatacaaaaagctggaggcacagaagaatgctgccaaatctaagtga

SEQ ID NO: 5774 - protein, 670 aa, Sorghum bicolor
  misc_feature: Ceres ANNOT ID no. 6054539
  misc_feature (83)..(552): Pfam Id: AMP-binding Pfam Desc: AMP-binding enzyme
  misc_feature (9)..(665): NCBI GI: 92885332 NCBI Desc: amp-dependent synthetase and ligase [medicago truncatula]
  misc_feature (1)..(663): NCBI GI: 20805869 NCBI Desc: long chain acyl-coa synthetase 4 [arabidopsis thaliana]
  misc_feature (11)..(667): NCBI GI: 83320523 NCBI Desc: acs1 [ricinus communis]
  misc_feature (7)..(658): NCBI GI: 74147576 NCBI Desc: acs-like protein [gossypium hirsutum]
  misc_feature (3)..(666): NCBI GI: 74147588 NCBI Desc: acs-like protein [gossypium hirsutum]
MEANPKNVFTIKVEDGKPGKDGQPAVGPVFRSVLAKDGFPVLEPDMQTSWDVFRVAVGKYPNNRMLGWRPFKDGVPGPYLWKSYKEIYDEVLQAGSALQHLGVQPGSRVGIYGANCPQWIVAMEACNANSLICVPLYDTLGAGAVDYIINHAEIDVVFIQDKKIKEILSPNCKSAKRLKALVAFTSATSEQIKEADNFGMKMYAWNDFLKVGKDNPHQPCPPQASDICTIMYTSGTSGQPKGVMLTHESHAMYVKGVDLFMDQFDDKMTTDDVFLSFLPLAHILDRMIEEYFFHKGASIGYYHGDLNALRDDIVELKPTLLVGVPRVYERIYEGILKAIAELRPLRRVIFNALYNRKLASMKAGYSHKTASPFADMLAFRKVKARLGGRLRLLISGGAPLSNEIEEFMRVTTCAYFIQGYGLTETLGPSTVCYIDDMALVGSAGVPATYTEIRLEEVPEMGYDPLGVPSRGEICIHGKSLFAGYYKSPELTNEAIVDGWFHTGDIGEMTPDGILKVIDRKKNIFKLSQGEYVAVEYLEKVYGFPPLVEDIWVYGDSFRSSLVAVVNPHEENTMKWAHSNGYKGSFAEICKLEGLKEYILKELAAVAQKNKLRGFEYIKGIVLDPVPFDIERDLVTATMKKRRKNMQNYYQSEIDIVYKKLEAQKNAAKSK

SEQ ID NO: 5775 - DNA, 1968 bp, Sorghum bicolor
  misc_feature: Ceres ANNOT ID no. 6054553
  misc_feature: Encodes the peptide sequence at SEQ ID NO 5776
  misc_feature: Up-regulated in root tissues in response to methyl jasmonate treatment
  misc_feature: Up-regulated in shoot tissues in response to methyl jasmonate treatment
  misc_feature: Up-regulated in shoot tissues in response to salicylic acid treatment
atggttaagatcgaagaccatgccgaggacggcggcatagatgctgatgtcaggggcctcggggaggctgctgtggatccgctgcctggctcggtgcatgccaccttcaaggaggaggagggtgaaccgagttcttcatctggtaaactaagatcagagttcattggaatgggtttctcatccaagctggtagacaaggttctccagagacatggtgatgatgattctaacacaattttggaatctcttctgtcctattctgaccttaagcaatctggatccgagtcatcgggttctcttggaagtttatttgattctgataatgaagagaacaattcttctttagagtctaggaaagtaatcaaccaagacatcaagccagagcttgattctttctcagagaagtggtcatttttactcagaacaatgaacttttcacaacaagaagttgatttagccttcaagcaactaggtgatgaagcgccattagaacagctcgtggacttcattgtcaatgctcaatcaggagtatcgtctggaggaccggaaaatggtgatgctacaaatgaggggaagactgaattactctatggtgtgatggaaaaaacacttagcttgcttcagatgggctttaccgaggaagaggtatcatcagtgcttgagaattctgaccagagagcaactattcaggagctggctgactcaattttggcaaggcgaatagccaatagcattgagcagaaagaggtaaaaattgaatctgactttctaggcgaggcagaacctgattattcttcataccagccctcatactctgctgcaagctattatgacgatgacaacaacaatatacgggttaaaagggctaagcatgtatttatcgatgacacaggtgcctccagtagtcaccttggcaatccatggtctatggggacaagtgatatgcctgttaaggtagaacttgaggcaatgacaccaggccgccgtgcaaatgtacaaggtgaccttgctaaacccccatttttcttgtatggaaatatggtagacatcccaaaagacacatggtatcaactcacacagttcttatacaatgtggagcctgagtttgtgaacagtcagtccttctctgctctgactcgaaaggaaggttacattcacaaccttccagtggagaaaagacgtgtcgtggttccaaagtctccaatgactattgaagaagcacttccgttcaccagacagtggtggccctcttgggatacaaggaaacatatcagtgtagttactatagaggttggagagattgagcagacatgtgaaagattggggagcatggttagagagtcaagaggtgtgctttcagaagcaagacagatgcagattatacaccagtgcagggtttcaaaccttatttgggttggccagaacaagttaggccctttggagcctcgtcaagtggaaaggatactaggctacccacataaccatacaaatctgtttgaattaaaccaatctgatagatttggtgccatgaaatttgcatttcagactgatacattgtcatattttctatcagtcctgaaaggcatgtatccagatggaataagagtgctatccatctacagtggcattggaggtgcagaagtaacacttcatcggctaggcattcctttaaaatgtgtaatatctgttgaggaatctgaggtgaataggaaaattctaagaaggtggtggtcaaaaactgaacaaactggagtgctaaggcagcatccgggaatctggaagctcaaaacacacgtgattgaagacttggtgaaagagtttggtggttttgatctgattatcggtgggaattatacttcttgcaaaggtggtaatacagtaaatacgacaatgggcttggattccaaccgcttctatgagtatgcccgtgttgttaaaagagtaaggactgcagttggactcagttga

SEQ ID NO: 5776 - protein, 655 aa, Sorghum bicolor
  misc_feature: Ceres ANNOT ID no. 6054553
  misc_feature (1)..(655): NCBI GI: 22135461 NCBI Desc: dna methyltransferase dmt106 [zea mays]
  misc_feature (1)..(653): NCBI GI: 115461927 NCBI Desc: os05g0133900 [oryza sativa (japonica cultivar-group)]
  misc_feature (201)..(649): NCBI GI: 140056280 NCBI Desc: uba-like [medicago truncatula]
  misc_feature (281)..(650): NCBI GI: 29467228 NCBI Desc: dna methyltransferase [nicotiana tabacum]
  misc_feature (72)..(649): NCBI GI: 92874580 NCBI Desc: ubiquitin-associated [medicago truncatula]
  misc_feature: Up-regulated in root tissues in response to methyl jasmonate treatment
  misc_feature: Up-regulated in shoot tissues in response to methyl jasmonate treatment
  misc_feature: Up-regulated in shoot tissues in response to salicylic acid treatment
MVKIEDHAEDGGIDADVRGLGEAAVDPLPGSVHATFKEEEGEPSSSSGKLRSEFIGMGFSSKLVDKVLQRHGDDDSNTILESLLSYSDLKQSGSESSGSLGSLFDSDNEENNSSLESRKVINQDIKPELDSFSEKWSFLLRTMNFSQQEVDLAFKQLGDEAPLEQLVDFIVNAQSGVSSGGPENGDATNEGKTELLYGVMEKTLSLLQMGFTEEEVSSVLENSDQRATIQELADSILARRIANSIEQKEVKIESDFLGEAEPDYSSYQPSYSAASYYDDDNNNIRVKRAKHVFIDDTGASSSHLGNPWSMGTSDMPVKVELEAMTPGRRANVQGDLAKPPFFLYGNMVDIPKDTWYQLTQFLYNVEPEFVNSQSFSALTRKEGYIHNLPVEKRRVVVPKSPMTIEEALPFTRQWWPSWDTRKHISVVTIEVGEIEQTCERLGSMVRESRGVLSEARQMQIIHQCRVSNLIWVGQNKLGPLEPRQVERILGYPHNHTNLFELNQSDRFGAMKFAFQTDTLSYFLSVLKGMYPDGIRVLSIYSGIGGAEVTLHRLGIPLKCVISVEESEVNRKILRRWWSKTEQTGVLRQHPGIWKLKTHVIEDLVKEFGGFDLIIGGNYTSCKGGNTVNTTMGLDSNRFYEYARVVKRVRTAVGLS

SEQ ID NO: 5777 - DNA, 1026 bp, Sorghum bicolor
  misc_feature: Ceres ANNOT ID no. 6054561
  misc_feature: Encodes the peptide sequence at SEQ ID NO 5778
atgaaggtgtcggcgctgtgcgcggcggcggtgctgctgctgctggtggcgcaggcgccgtcggcggcggaggcatcgcacctcaagctggggtactacaagaagacatgcccgggcgtggagaagatcgtcaagtaccacgtcgccaaggccatcaaggccaaccgtgccgccggcgccgccctcgtccgcctcatcttccacgactgcttcgtcagggggtgcgacgggtcggtgctgctagacccaacgccggcgaacccaaagacggagaagacggcgccggtcaacatcggtctagccgccttcgacgtgatcgacgacatcaaggcggcgctggagtctcactgcccgggcaccgtctcctgcgcggacatcgtcatctacgccgcgcgcgacgcgtcgagcctcctgagcaacgggcacgtccacttcgccgctcccgccggccgcctcgacggcgtgatctcccgcgccgccgacgcgcagcgggacctcccggactccaccttcacgatctccgagctgatccgcaacttccggcggaagaacttcaccgtcgaggagctggtgatcctgtcgggcgcgcacgccatcggcgtcggccactgctcctccttccgggcgcggctgtcgtcgccgccgagccagatcgtgccggcgtaccggaacctgctgtcggccaagtgcgcggcgggtccggaccccgtggtgaccaacaacgtccgcgacgaggacccccgtgccgtggcggcgtcgttcccgtcgttcttgaagaagctccgcaaggcgaaggatttcttggataacagctactaccacaacaacctggcgaggatcgtcaccttcaactccgattggcagctgctgacggagaaggaggcgctgggacatgtcaaggagtacgccgagaatggcacgctgtgggacgaggacttctctgacgcgctcgtcaagctcagcaagctgcccatgccgccgcacagcaagggggagatcaggaagagctgccgctgggtgaactga

SEQ ID NO: 5778 - protein, 341 aa, Sorghum bicolor
  misc_feature: Ceres ANNOT ID no. 6054561
  misc_feature (44)..(305): Pfam Id: peroxidase Pfam Desc: Peroxidase
  misc_feature (15)..(341): NCBI GI: 115470645 NCBI Desc: os07g0156100 [oryza sativa (japonica cultivar-group)]
  misc_feature (146)..(341): NCBI GI: 115461935 NCBI Desc: os05g0134400 [oryza sativa (japonica cultivar-group)]
  misc_feature (6)..(341): NCBI GI: 55700885 NCBI Desc: tpa: class iii peroxidase 9 precursor [oryza sativa (japonica cultivar-group)]
  misc_feature (4)..(341): NCBI GI: 55700999 NCBI Desc: tpa: class iii peroxidase 66 [oryza sativa (japonica cultivar-group)]
  misc_feature (9)..(341): NCBI GI: 12056450 NCBI Desc: peroxidase [zea mays]
  misc_feature: Useful for making plants with altered carbohydrate content
  misc_feature: Functional homolog of the protein sequence given in SEQ ID NO 13931
MKVSALCAAAVLLLLVAQAPSAAEASHLKLGYYKKTCPGVEKIVKYHVAKAIKANRAAGAALVRLIFHDCFVRGCDGSVLLDPTPANPKTEKTAPVNIGLAAFDVIDDIKAALESHCPGTVSCADIVIYAARDASSLLSNGHVHFAAPAGRLDGVISRAADAQRDLPDSTFTISELIRNFRRKNFTVEELVILSGAHAIGVGHCSSFRARLSSPPSQIVPAYRNLLSAKCAAGPDPVVTNNVRDEDPRAVAASFPSFLKKLRKAKDFLDNSYYHNNLARIVTFNSDWQLLTEKEALGHVKEYAENGTLWDEDFSDALVKLSKLPMPPHSKGEIRKSCRWVN

SEQ ID NO: 5779 - DNA, 792 bp, Sorghum bicolor
  misc_feature: Ceres ANNOT ID no. 6054570
  misc_feature: Encodes the peptide sequence at SEQ ID NO 5780
  misc_feature: Up-regulated in root tissues in response to methyl jasmonate treatment
  misc_feature: Up-regulated in shoot tissues in response to methyl jasmonate treatment
  misc_feature: Up-regulated in shoot tissues in response to salicylic acid treatment
atggcgacggcggcggcacccgatgactccaccgtcagagagacgacgaaagcggaggaggtgctgcccccaaccctgggttctggttctcaaccaccaaacctcttcgatggcacaacaaggctctacatctcctacatatgcccatatgtgcagagagtttggatagctaggaacttcaaggggttacaagaaaagattcagctggttgccattgatttgcaagacaagcctgcttggttcctcgagaaagtttacccaccgggcaaggtccccgtcctggagcacaatggcaacatcatagcagagtccttggatctactcagctacctggacgccaactttgagggccccaaattgtttcctggtgatcaggaccctgcaaaacaagcttttgctgatgagttgattgccaacagcgattccatcatcatagccttgttcagggcaggccgtgcctatgccgaaggacaaggagatgatgatatcagtaagctacttgctcctgctcttgacaaggtggaggagtccctgggacgtttctctgatgggccattcctcctggggcagtccatgagcgcagtcgacatggtttatgcgccctttattgaacgcttcaaggatttcttcgctgcagtgaagcactacgatatgacacaagaaaggcctaaactcaaggagtggatagaggagctcaacaagatagatgcctacacagcgacctggggggatcgccgtctgcagcttgctgccttgatgaacaagtttgggatacaaagcccagtagcctga

SEQ ID NO: 5780 - protein, 263 aa, Sorghum bicolor
  misc_feature: Ceres ANNOT ID no. 6054570
  misc_feature (2)..(258): NCBI GI: 85700990 NCBI Desc: glutathione s-transferase [oryza sativa (indica cultivar-group)]
  misc_feature (21)..(255): NCBI GI: 11385579 NCBI Desc: in2-1 protein [glycine max]
  misc_feature (1)..(244): NCBI GI: 7939638 NCBI Desc: xig [oryza sativa]
  misc_feature (21)..(241): NCBI GI: 37051105 NCBI Desc: glutathione s-transferase [pisum sativum]
  misc_feature (23)..(256): NCBI GI: 21537338 NCBI Desc: in2-1 protein [arabidopsis thaliana]
  misc_feature: Up-regulated in root tissues in response to methyl jasmonate treatment
  misc_feature: Up-regulated in shoot tissues in response to methyl jasmonate treatment
  misc_feature: Up-regulated in shoot tissues in response to salicylic acid treatment
MATAAAPDDSTVRETTKAEEVLPPTLGSGSQPPNLFDGTTRLYISYICPYVQRVWIARNFKGLQEKIQLVAIDLQDKPAWFLEKVYPPGKVPVLEHNGNIIAESLDLLSYLDANFEGPKLFPGDQDPAKQAFADELIANSDSIIIALFRAGRAYAEGQGDDDISKLLAPALDKVEESLGRFSDGPFLLGQSMSAVDMVYAPFIERFKDFFAAVKHYDMTQERPKLKEWIEELNKIDAYTATWGDRRLQLAALMNKFGIQSPVA

SEQ ID NO: 5781 - DNA, 1032 bp, Sorghum bicolor
  misc_feature: Ceres ANNOT ID no. 6054578
  misc_feature: Encodes the peptide sequence at SEQ ID NO 5782
atgagccgctcgacatggctggcttttgcatgggcggcggccctcgtcgtcgtcgtcgtggcggcgtccacgacgacgacggcacacgcctcgcaccacgcgtcgctggaggtcggtttctacaagcactcgtgcccagaggccgagtccatcgtgcgcgacgccgtccgccgcggcgtcgcccgcgacgccggcgtcggcgcggggctcatccggatgcagttccacgactgcttcgtccggggctgcgacgcctccatcctcatcaactccacgccgggcaacaaagccgagaaggactccgtcgccaacaaccccagcatgcgcggcttcgacgtcgtcgacgacgccaaggccgtcctcgaggcgcactgcccgcgcaccgtctcctgcgccgacatcgtcgcgttcgccgcccgcgacggcgcctacctcgccggcggcctcgactacaaggtcccctcgggacgccgcgacggccgcgtgtccagagaagacgaggtgctcgacagcaacgtccccgcaccgttcgacgacgtcgccgagctcatccagagcttcaagcgcaagggcctcaccgccgacgacatggtcacgctctccggcgcgcacaccatcggccgctcccactgctcctccttcacgcagcggctctacaacttcagcgggcaactggggcggacggacccgtcgctcgacgtcgcctacgccgaccacctcaagatgcggtgcccatggccgtccagcgacggcaagaggcaccccgcggtggtgccgcaggaccctgtcacgccggcgaccttcgacaaccagtacttcaagaacgtggtggcgcacaagggcctgttcgtctccgacaagacgctgctcgacagcacctgcacggctgggatcgtccacttcaacgccgcagtcgacaaggcatggcaggtcaagttcgccaaggccatggtgaagatgggcaagatccaggtgctcaccggcgatgagggagagatcagggagaagtgcttcgtcgtcaacccacactag

SEQ ID NO: 5782 - protein, 343 aa, Sorghum bicolor
  misc_feature: Ceres ANNOT ID no. 6054578
  misc_feature (52)..(305): Pfam Id: peroxidase Pfam Desc: Peroxidase
  misc_feature (3)..(343): NCBI GI: 55701007 NCBI Desc: tpa: class iii peroxidase 70 precursor [oryza sativa (japonica cultivar-group)]
  misc_feature (33)..(341): NCBI GI: 92878644 NCBI Desc: haem peroxidase, plant/fungal/bacterial [medicago truncatula]
  misc_feature (13)..(341): NCBI GI: 92874087 NCBI Desc: haem peroxidase, plant/fungal/bacterial [medicago truncatula]
  misc_feature (13)..(341): NCBI GI: 92895421 NCBI Desc: haem peroxidase, plant/fungal/bacterial [medicago truncatula]
  misc_feature (34)..(341): NCBI GI: 7453849 NCBI Desc: peroxidase prx12 precursor [spinacia oleracea]
  misc_feature: Useful for making plants with altered cell wall content and/or composition
  misc_feature: Functional homolog of the protein sequence encoded by LOCUS at1g05260
  misc_feature: Useful for making plants with altered carbohydrate content
  misc_feature: Functional homolog of the protein sequence given in SEQ ID NO 13714
MSRSTWLAFAWAAALVVVVVAASTTTTAHASHHASLEVGFYKHSCPEAESIVRDAVRRGVARDAGVGAGLIRMQFHDCFVRGCDASILINSTPGNKAEKDSVANNPSMRGFDVVDDAKAVLEAHCPRTVSCADIVAFAARDGAYLAGGLDYKVPSGRRDGRVSREDEVLDSNVPAPFDDVAELIQSFKRKGLTADDMVTLSGAHTIGRSHCSSFTQRLYNFSGQLGRTDPSLDVAYADHLKMRCPWPSSDGKRHPAVVPQDPVTPATFDNQYFKNVVAHKGLFVSDKTLLDSTCTAGIVHFNAAVDKAWQVKFAKAMVKMGKIQVLTGDEGEIREKCFVVNPH

SEQ ID NO: 5783 - DNA, 954 bp, Sorghum bicolor
  misc_feature: Ceres ANNOT ID no. 6054585
  misc_feature: Encodes the peptide sequence at SEQ ID NO 5784
atggcgacccccttacgcccgtccgcgccggccccgtccgccaagggcggctgcggcggcgaccgctgcgcctccggccgcgacgcgtggccgctccaccacttccgccacgagggggtcttctgcctcctctgctcctcctgcgtcctcctctacagcccgtccgccttctgctccgcctgcctccacctcctcgccacctcccccgccgccgccaacgctaccccgggcgaccccgccgtcgccgcgcccgggcccaccgcgccctgctccgcctgcggcgtctccgtcgcgcacctctcctgcgtcccgggggcggaccgtcaccccttcgtctgcccgccctgcgccgccgccgccgagggcagggccttctccttcgcgccggcgcccggcggccgcccgctccaggagcgcgacgcaagggtcctcctcgtcgcggcccgcctctcgcaccactccgtcagccgcgccgcggccaccgcccgcgaggaggctgagcgccgcgtcgccgaggccgccgaggctaggaagcgcacccgcgagatgctcgacgccgccttccgcgcgctcgaggcggaggccagggacgccaagatgaagcccgccgtgcccgcccagcccccaccaccccccaagaagaagcccgaggccaccctgcccccgccgccgcccccgcctcccaagaagaagcccgaggccattagggacaaggacaagctgctcaagctcaacgccatgcagcagcctgcgctggcgttcgccgcggctgctgctgctgcggcggcggcgaccacctcggtgccattgccgacgccctcatacaaggaggagaagaagcctgtcgtgaagcaggaagcgcaaggttctgcgccaccgccgagggaggataaggatcgccccccgctgtttgggaccttgcaatcatggttttggttgtttcgacggagctag

SEQ ID NO: 5784 - protein, 317 aa, Sorghum bicolor
  misc_feature: Ceres ANNOT ID no. 6054585
  misc_feature (1)..(285): NCBI GI: 115435626 NCBI Desc: os01g0245600 [oryza sativa (japonica cultivar-group)]
  misc_feature (66)..(260): NCBI GI: 89361763 NCBI Desc: alginate regulatory protein algp [xanthobacter autotrophicus py2]
  misc_feature (4)..(302): NCBI GI: 115524286 NCBI Desc: peptidase c14, caspase catalytic subunit p20 [rhodopseudomonas palustris bisa53]
  misc_feature (55)..(302): NCBI GI: 118718438 NCBI Desc: dna polymerase iii, subunits gamma and tau [burkholderia multivorans atcc 17616]
  misc_feature (202)..(301): NCBI GI: 116131047 NCBI Desc: ensangp00000031521 [anopheles gambiae str. pest]
MATPLRPSAPAPSAKGGCGGDRCASGRDAWPLHHFRHEGVFCLLCSSCVLLYSPSAFCSACLHLLATSPAAANATPGDPAVAAPGPTAPCSACGVSVAHLSCVPGADRHPFVCPPCAAAAEGRAFSFAPAPGGRPLQERDARVLLVAARLSHHSVSRAAATAREEAERRVAEAAEARKRTREMLDAAFRALEAEARDAKMKPAVPAQPPPPPKKKPEATLPPPPPPPPKKKPEAIRDKDKLLKLNAMQQPALAFAAAAAAAAAATTSVPLPTPSYKEEKKPVVKQEAQGSAPPPREDKDRPPLFGTLQSWFWLFRRS

SEQ ID NO: 5785 - DNA, 1251 bp, Sorghum bicolor
  misc_feature: Ceres ANNOT ID no. 6054586
  misc_feature: Encodes the peptide sequence at SEQ ID NO 5786
atgcagcatcacctacgccgatgcggcggcggcgccctcgccgctctacgacggctccgccacagcgcttcctctgcggcagcgtcgcctcctgcggcctggaggcgcccttcccctcctccacgactctactccaccgccgagatgagccagcagttgcctgcgaacctagtgcagatcatggagcagagaatgaagttgatcgagcagaggagcgcgtacctccaggagcaaatcaaccagccagctgcctcgcccgaagagtactcgagggctaacaaggaattccgcaagctggagagcaccatggagttgatcaaggagctgagatcgaaacgggaggaaattgagggtctcaaatctttggtaacaaatgctcgtgaagagaaagacatgcgtgaaatggcagctgaggagcttcttgaggctgttgaggtggagaaacgattgcagcatgagctgtttagatcgttgcttccaaaagatgaagcagatgaaagggattgcatattggaggtgcgggcaggaactggaggagaagaggcatctttgtttgcaatggatatatttagaatgtatgagaaatatgcccagaagaatgggtggaaatttgatgtcatcgacataatggaatctgctgtgaaaggatacaaggaagctagtggaactatatcaggtcctggggcgtttggcaaactaaagtttgagagtggcattcatagagttcagcgagtgccagtgactgagaaatctggaagagtgcacactagtgctgtatcagttgctgttcttccgcaagctgatgaggttgatgtccagctgcgaaatgaggacctgagaattgatacctacagatcaggtggctctggaggtcagtctgtcaatacaaccgatagtgctgttaggataactcatattccaaccggcacagtggttgcaatccaagatgagagatcacagcacatgaacaaggccaaagctctgaaagttctccgagcgcgactgtatgagttggagaggcatagactccatatggaccgatcaaagcttcgatcagaacagattggaagtggtgacaggtctgagagaatcagaacatacaactttccacagggccgtgtcactgatcatcgtgttggaatcacacaccactccatagcagatgtcatggagggggagagcctggacgtattcgttgatgcactactgcttcaagaagagatggacgccattgcttcatttggcgcataa

SEQ ID NO: 5786 - protein, 416 aa, Sorghum bicolor
  misc_feature: Ceres ANNOT ID no. 6054586
  misc_feature (265)..(378): Pfam Id: RF-1 Pfam Desc: Peptidyl-tRNA hydrolase domain
  misc_feature (124)..(236): Pfam Id: PCRF Pfam Desc: PCRF domain
  misc_feature (68)..(416): NCBI GI: 115462961 NCBI Desc: os05g0277300 [oryza sativa (japonica cultivar-group)]
  misc_feature (61)..(412): NCBI GI: 58698355 NCBI Desc: peptide chain release factor 1 [wolbachia endosymbiont of drosophila ananassae]
  misc_feature (61)..(412): NCBI GI: 42520141 NCBI Desc: peptide chain release factor 1 [wolbachia endosymbiont of drosophila melanogaster]
  misc_feature (61)..(412): NCBI GI: 81652805 NCBI Desc: peptide chain release factor 1 (rf-1)
  misc_feature (60)..(415): NCBI GI: 121524555 NCBI Desc: peptide chain release factor 1 [parvibaculum lavamentivorans ds-1]
MQHHLRRCGGGALAALRRLRHSASSAAASPPAAWRRPSPPPRLYSTAEMSQQLPANLVQIMEQRMKLIEQRSAYLQEQINQPAASPEEYSRANKEFRKLESTMELIKELRSKREEIEGLKSLVTNAREEKDMREMAAEELLEAVEVEKRLQHELFRSLLPKDEADERDCILEVRAGTGGEEASLFAMDIFRMYEKYAQKNGWKFDVIDIMESAVKGYKEASGTISGPGAFGKLKFESGIHRVQRVPVTEKSGRVHTSAVSVAVLPQADEVDVQLRNEDLRIDTYRSGGSGGQSVNTTDSAVRITHIPTGTVVAIQDERSQHMNKAKALKVLRARLYELERHRLHMDRSKLRSEQIGSGDRSERIRTYNFPQGRVTDHRVGITHHSIADVMEGESLDVFVDALLLQEEMDAIASFGA

SEQ ID NO: 5787 - DNA, 3858 bp, Sorghum bicolor
  misc_feature: Ceres ANNOT ID no. 6054599
  misc_feature: Encodes the peptide sequence at SEQ ID NO 5788
atgtccgagtccagcagggcgttccacctcgacgcgccgtcctcctcctcgtcgtcgtcgtccaccgccgccgctgccggcgaccgtcatcatcaccatgggaagtccgccgcctcggcctccaccacgggcggcggcagcgtgccgttccacaggctgttcgcgttcgcggacgccgccgacgccgcgctcatgtccctgggcacgctcggcgcgctcgccaacggcgccgcgatgccgctcatgacggtcctcttcgcccgcctcatcgacgccttcggcggcgccgccgacacgcgcgacgtcgtcgcccgggtctccaacgtctcgctccagttcatctacctcgccgtcgcatccgccgtcgcctccttcgtccaggtggcgagctggatgatcaccggcgagcggcaggcggcgcggatccgggggctgtacctgggtgccatcctgcggcaggaggtggcgttcttcgaccagcgggccaccacgggggaggtggtggggcggatgtcgggggacacggtgctcatccaggacgccatgggcgagaaagtcggcaagtgcatccagctgctcgtcgccttcgcgggcggcttcgccgtcgccttcgcgcagggctggctcctcgcgctcgtcatgctcgccaccatcccgccgctcgtgctcgccggcgcgctcatgtccagcgtcgtcgccaggatggcttccctcggacaggccgcctacgccgacgccgccggcgtcgtcgaccagaccatcggctccatcacgacagtcgcgtctttcaccggcgagcagcgggcggtggagaagtacagcagctcgctcaagagggcgtacagctccggcgtctgggaggggctcgccgccggcgtcggcatgggcatcgtcatggtgctcctcttctgcggctactccctggggatttggtacggcgccaagctcatcctggacaagggctacaccggcgcacaagtcatgaatgtcatcttcgcagtgctcactggctcactagctctgggccaagcatctccgagcatgaaagcattcgcgggagggcaggctgcggcatacaagatgtttgaaacaatcaacagggagcctgagattgacgcgtacagcacggcaggtaggaagctggacgacattcagggagacattgagttcagggatgtttacttttcatatccgacaaggcctgatgaacagatcttcagtggtttctcccttaccatacagagtggcacaactgtcgcactagttgggcagagtgggagtggcaagtcgacggttatcagcttgattgagcggttctacgaccctcagctcggtgaagttctgatagacggtgttgatctaagggagttccagttgaggtggatcagaagtaaaatcggtcttgttagccaagaaccggtcctgttcactgctagcataagagacaacatagcttatggcaagtacaatgcaaccgatgaggaaatcagagctgcagctgagcttgctaatgcctccaaattcatagataaaatgccccagggtttcgctacttcagttggtgaacatggaacacaactttcaggtgggcaaaagcaaagaatagccattgccagagcaattctcaaagatccaagaatcttactattagatgaagcaacaagcgctctagacactgaatctgaaaggattgtacaggaggctcttgatagggtcatgacaaaccgtacaactgtcatagttgctcaccgtttgagcactgtcaggaatgctggtaccattgccgtgattcatcgaggatcagtagttgaaaaaggttcacaccatgatcttataagggatccagagggagcttacagtcaactgatacaactacaggaagcgagccatgcttctgagggtgcaaactaccagaacaagtcaaacaggaagggtgattctgggattcacttaggaaaacaaatgtcgacaaatcagtcaccaagccaaaggtcaccacagaacaatagcagcaaccactcgttctcagtatcacatggtgtgcctctagaaattgacgtccaaaacagttcatcaaagaatatagatgaagaaattcagcacgaagtgcctctcagtcgcctcgcctcacttaacaaacccgaaatcccagtgcttatccttggttctattgcttcggctgtcagcggaatgatcttcccaatctttgcgatacttctatcaaatgtgataaaagcattttatgagccgccacgtattctgaggaaggatgctgagttttggtcatctatgttcttggtattcggtgcagtgtacttcttgtcacttcctcttggctcataccttttctcagtggctgggtgcaagttgataagaaggatcagactgatgacatttgagaaggttgtcaatatggagatcgaatggttcgattacccagagaattcaagtggagcaataggcgcaaggctatcagcggatgcagcaaaagttcgggggcttgtgggtgatgcattgcaactggtggtgcagaacttggcaactttagttgccggtctggtaattgcttttgtatcaaactgggagctctctcttattatactggctctgataccgcttattggcctcaatggatggatccagatgaaatttattcagggatttagtgcagatgcaaagttgatgtatgaggaggcaagtcaagtagcaactgatgcagtgagcagcataaggacagtggcatcattttcagctgaagaaaaggtgatggatttgtacaagaaaaaatgtgaaggacctttaagagcagggatcaggacaggaataacaaacggtattggctttggggtttccttcttcttgctgtttggagtttatgctgccagcttctatgctggtgcacggcttgtagagaatgataaaacaacttttcccaaagttttcagggtatttcttgctctcagtatggcagcaatcggggtgtcacatacaagtaccctcacatcagattcttccaaagcaaaatcagccgtatcttctatatttgccatcatggatcgaaaatcaaggatagatccaagcgatgatgctggggtaactctggagccactaagtggcaacattgaatttcggcatgtgagattcagatatccaacacggcccgatgttcagattttccaagacctatgcctgacaattcaatctggaaagactgttgcacttgttggagagagtggtagtggcaaatcaacagcgatagcgttgctgcagagattctatgatcctaacgcaggccatatactcctagatggagtggacatacagaagttccagctgaggtggctaaggcaacagatggggctggtgagtcaagaaccatccctgttcaacgacacgatacgggcaaacattgcctacggaaaggacgggcaagcaacagaattagatatcgtggctgccgcacggttggcaaatgctcacaagttcatcagttcactgcatcagggatatgacaccatggtcggggagcgtggggctcagctatcaggagggcagaagcagcgcgtcgccattgcccgcgccatcattaaggatcccaagatccttctgctcgacgaagcgacaagcgccctcgacgcagaatccgaacgttcagtgcaggacgccctggaccgggtgatggtgaacagaacaacagtgatcgtcgcgcaccggctgtccacgatacagggcgcggatgtgatcgcggtggtcaaggatggggtgatcgtcgagaaggggaggcatgacgccttgatcaagatcgagggtggcgcttatgcgtccctcgtcgcgctccattcagcagcgccgtcgtaa

SEQ ID NO: 5788 - protein, 1285 aa, Sorghum bicolor
  misc_feature: Ceres ANNOT ID no. 6054599
  misc_feature (416)..(600): Pfam Id: ABC_tran Pfam Desc: ABC transporter
  misc_feature (1069)..(1254): Pfam Id: ABC_tran Pfam Desc: ABC transporter
  misc_feature (65)..(344): Pfam Id: ABC_membrane Pfam Desc: ABC transporter transmembrane region
  misc_feature (719)..(994): Pfam Id: ABC_membrane Pfam Desc: ABC transporter transmembrane region
  misc_feature (1)..(1283): NCBI GI: 27368865 NCBI Desc: mdr-like abc transporter [oryza sativa (japonica cultivar-group)]
  misc_feature (9)..(1283): NCBI GI: 92894394 NCBI Desc: cyclic peptide transporter [medicago truncatula]
  misc_feature (9)..(1283): NCBI GI: 14715462 NCBI Desc: cjmdr1 [coptis japonica]
  misc_feature (48)..(1283): NCBI GI: 92896736 NCBI Desc: cyclic peptide transporter [medicago truncatula]
  misc_feature (30)..(1283): NCBI GI: 140052713 NCBI Desc: cyclic peptide transporter [medicago truncatula]
MSESSRAFHLDAPSSSSSSSSTAAAAGDRHHHHGKSAASASTTGGGSVPFHRLFAFADAADAALMSLGTLGALANGAAMPLMTVLFARLIDAFGGAADTRDVVARVSNVSLQFIYLAVASAVASFVQVASWMITGERQAARIRGLYLGAILRQEVAFFDQRATTGEVVGRMSGDTVLIQDAMGEKVGKCIQLLVAFAGGFAVAFAQGWLLALVMLATIPPLVLAGALMSSVVARMASLGQAAYADAAGVVDQTIGSITTVASFTGEQRAVEKYSSSLKRAYSSGVWEGLAAGVGMGIVMVLLFCGYSLGIWYGAKLILDKGYTGAQVMNVIFAVLTGSLALGQASPSMKAFAGGQAAAYKMFETINREPEIDAYSTAGRKLDDIQGDIEFRDVYFSYPTRPDEQIFSGFSLTIQSGTTVALVGQSGSGKSTVISLIERFYDPQLGEVLIDGVDLREFQLRWIRSKIGLVSQEPVLFTASIRDNIAYGKYNATDEEIRAAAELANASKFIDKMPQGFATSVGEHGTQLSGGQKQRIAIARAILKDPRILLLDEATSALDTESERIVQEALDRVMTNRTTVIVAHRLSTVRNAGTIAVIHRGSVVEKGSHHDLIRDPEGAYSQLIQLQEASHASEGANYQNKSNRKGDSGIHLGKQMSTNQSPSQRSPQNNSSNHSFSVSHGVPLEIDVQNSSSKNIDEEIQHEVPLSRLASLNKPEIPVLILGSIASAVSGMIFPIFAILLSNVIKAFYEPPRILRKDAEFWSSMFLVFGAVYFLSLPLGSYLFSVAGCKLIRRIRLMTFEKVVNMEIEWFDYPENSSGAIGARLSADAAKVRGLVGDALQLVVQNLATLVAGLVIAFVSNWELSLIILALIPLIGLNGWIQMKFIQGFSADAKLMYEEASQVATDAVSSIRTVASFSAEEKVMDLYKKKCEGPLRAGIRTGITNGIGFGVSFFLLFGVYAASFYAGARLVENDKTTFPKVFRVFLALSMAAIGVSHTSTLTSDSSKAKSAVSSIFAIMDRKSRIDPSDDAGVTLEPLSGNIEFRHVRFRYPTRPDVQIFQDLCLTIQSGKTVALVGESGSGKSTAIALLQRFYDPNAGHILLDGVDIQKFQLRWLRQQMGLVSQEPSLFNDTIRANIAYGKDGQATELDIVAAARLANAHKFISSLHQGYDTMVGERGAQLSGGQKQRVAIARAIIKDPKILLLDEATSALDAESERSVQDALDRVMVNRTTVIVAHRLSTIQGADVIAVVKDGVIVEKGRHDALIKIEGGAYASLVALHSAAPS

SEQ ID NO: 5789 - DNA, 561 bp, Sorghum bicolor
  misc_feature: Ceres ANNOT ID no. 6054614
  misc_feature: Encodes the peptide sequence at SEQ ID NO 5790
atggccgccggcaacgacgactgctgcagcagcaagcgaacaaagcctccgccgccaccaccaccaccaccagcgggcaaggacgaggacgaaggcgagggcgagggcaccgtggcggcggacaaggcgctgcacgcgctgggcttcgagttcacgcgcatcgacgcgcgcgaggtcgccggccgcctccccgtcaccgacacctgctgccagccgttcggggtgctcaacggcggcgtgtcggcgctggtcgccgagtccacggccagcgtcggcgcgtacatggcgtccgggtaccgccgggtggccggcgtgcagctgtccgtcaaccacctccgccccgcccgcctcggcgacgtcgtccgcgcgcaggccgcccccgtccagctcggccgcagcatccaggtgtgggaggtgcagatatggcgagcagacccttccacagaggagtgcaaagatctggtgtcaacagcgagagttaccatgttgataaaaaacccatcaacaccagaggagatgtcgacccacgaagcaagcatcaagaaatacgccaaactgtag

SEQ ID NO: 5790 - protein, 186 aa, Sorghum bicolor
  misc_feature: Ceres ANNOT ID no. 6054614
  misc_feature (73)..(150): Pfam Id: 4HBT Pfam Desc: Thioesterase superfamily
  misc_feature (1)..(186): NCBI GI: 115461977 NCBI Desc: os05g0137700 [oryza sativa (japonica cultivar-group)]
  misc_feature (31)..(186): NCBI GI: 33589776 NCBI Desc: at1g48320 [arabidopsis thaliana]
  misc_feature (41)..(140): NCBI GI: 42573630 NCBI Desc: thioesterase family protein [arabidopsis thaliana]
  misc_feature (43)..(167): NCBI GI: 121607543 NCBI Desc: uncharacterized domain 1 [verminephrobacter eiseniae ef01-2]
  misc_feature (39)..(167): NCBI GI: 121592480 NCBI Desc: uncharacterized domain 1 [acidovorax sp. js42]
  misc_feature: Abnormal phyllotaxy, leaf number higher than wild-type
  misc_feature: The plant is abnormally small.
  misc_feature: Useful for making plants with modulated biomass
  misc_feature: Functional homolog of the protein sequence given in SEQ ID NO 13187
  misc_feature: Useful for making plants with modulated biomass
  misc_feature: Functional homolog of the protein sequence given in SEQ ID NO 13187
MAAGNDDCCSSKRTKPPPPPPPPPAGKDEDEGEGEGTVAADKALHALGFEFTRIDAREVAGRLPVTDTCCQPFGVLNGGVSALVAESTASVGAYMASGYRRVAGVQLSVNHLRPARLGDVVRAQAAPVQLGRSIQVWEVQIWRADPSTEECKDLVSTARVTMLIKNPSTPEEMSTHEASIKKYAKL

SEQ ID NO: 5791 - DNA, 891 bp, Sorghum bicolor
  misc_feature: Ceres ANNOT ID no. 6054628
  misc_feature: Encodes the peptide sequence at SEQ ID NO 5792
atggcggcgctcccgttgttcctccgtcccgtcctgctggccgccgccgcctgcttgtcggtctcggtctcgatcatctccaacgccggcgtggcggaggcgggcttcggcttcggctaccatggcggcgacgacgactggagcaagagccgcgtggcgtcgatcgtgacggagaagctatacagcgacatgttcaagcacaaggacgacacggcctgcccagcgcacggcttctacaactacacctccttcctccgggccgcggaacgtttcccggcgttcggcggcgacggcgacgccgccacacggaagcgcgaggtggcggcgttcctggcgcagatctcgcacgagaccaccggcgggtgggcgacggcacccgacggtccctacgcgtgggggctctgcttcaaggaggagatcagcccggcgagcaactactgcgacaacaccaccacggagtggccgtgcgtcgccggcgagtcgtaccatggccggggacccatccagctgtcgtggaacttcaactacgggccggcggggcaggcgctgggcttcgacgggctgggcaacccggaggtggtcgccggtgaccccgaggtggcgttcaagacggcgctgtggttctggatgaccccgaggtcgcccaagccgtcgtgccacgacgtcatggtcgggcggtaccggccgaccgacgccgatgtggcggcgaacaggacggcggggttcgggctcacgactaacattatcaatggcggcatcgagtgcggcaagactggcgtcccgcaggtggacgaccggatcggcttcttccggaggtactgcgagctgctcggcggcgtcgatgtcggtcccaacttggattgtactcagcagcagccctactcttcttga

SEQ ID NO: 5792 - protein, 296 aa, Sorghum bicolor
  misc_feature: Ceres ANNOT ID no. 6054628
  misc_feature (55)..(288): Pfam Id: Glyco_hydro_19 Pfam Desc: Chitinase class I
  misc_feature (52)..(294): NCBI GI: 6002766 NCBI Desc: class ii chitinase [fragaria x ananassa]
  misc_feature (17)..(287): NCBI GI: 4008074 NCBI Desc: chitinase [cynodon dactylon]
  misc_feature (52)..(294): NCBI GI: 5880845 NCBI Desc: chitinase precursor [petroselinum crispum]
  misc_feature (52)..(294): NCBI GI: 5880847 NCBI Desc: chitinase precursor [petroselinum crispum]
  misc_feature (52)..(294): NCBI GI: 1237025 NCBI Desc: chitinase (class ii) [arachis hypogaea]
  misc_feature (42)..(296): SWISSPROT Homolog: EC 3.2.1.14 Endochitinase CH25 precursor
  misc_feature: The cauline leaves are abnormally small.
  misc_feature: The plant produces a reduced number of seeds.
  misc_feature: Useful for biocontainment applications
  misc_feature: Useful for making plants with modulated biomass
  misc_feature: Functional homolog of the protein sequence given in SEQ ID NO 13042
  misc_feature: Useful for biocontainment applications
  misc_feature: Useful for making plants with modulated biomass
  misc_feature: Functional homolog of the protein sequence given in SEQ ID NO 13042
MAALPLFLRPVLLAAAACLSVSVSIISNAGVAEAGFGFGYHGGDDDWSKSRVASIVTEKLYSDMFKHKDDTACPAHGFYNYTSFLRAAERFPAFGGDGDAATRKREVAAFLAQISHETTGGWATAPDGPYAWGLCFKEEISPASNYCDNTTTEWPCVAGESYHGRGPIQLSWNFNYGPAGQALGFDGLGNPEVVAGDPEVAFKTALWFWMTPRSPKPSCHDVMVGRYRPTDADVAANRTAGFGLTTNIINGGIECGKTGVPQVDDRIGFFRRYCELLGGVDVGPNLDCTQQQPYSS

SEQ ID NO: 5793 - DNA, 1191 bp, Sorghum bicolor
  misc_feature: Ceres ANNOT ID no. 6054633
  misc_feature: Encodes the peptide sequence at SEQ ID NO 5794
atggaggactcaagcctgttcatgcagtgggcgatggacacgctgctgcaggaggaggagcctgcggtcgacgacgtgcactgggcgatggacacgctcctgcaggaggaggaggaggagcatgcggcggtcgacggcggcgacgcagtagtcttcccctcgctccaagcgctccgcgacgcctcccacgcggcggagatggtgcgggagcttatggccgtggctgccgccgccgaaacccacgacgcggcggcggcaaacagctcgccgagcggtggttccggcgacggcggcggcgaggtcacggacggcggcagcagcggggccaccggcaccgatcctgcagccccggccactacggcggccacggattactacggcggatcctggccgccacagtcgcccaccagctcgtcgttcgcgcgcgcgccaccgccagcaccgccgagcagcaacagcaacaccatcctgcccacggtgagctggaacttcgtcaccggctcggcgcagcctggcagcgagggcgtgctggaggaagccgccgtcccggcacgcagcttgccgccgcctgagctggctcaacgccgccggtcaccgccgccgccgagaagagcggcccaccacccagtacgcagcatgggagcgccatcgtcggcgtcgtgcacgccggaccacatcgtcgcggagcgcaagcgccgggagaagatcaacaagcgattgatcgagctctccaccgtcatccctggcctcaagaagatggacaaggcgacgatcctctccgacgcggccaagtacgtgaaggagcttcagcagcggctcaaggccctggaagacgctgctgccgccgacgccggcagcatcaggagaaaagcgccgccggcggcggacgagaatggtggctccgggtcgccgacgtcggcatcctcctcgtcgggggcaccagcacttccggagatcgaggcacgcttgtcggagaggagcgtgatggtaaggatccatagctgcggcggcaaaggggtggcggcggcagcgctcgccgtggtcgagggcctcgggctcaccgtcgtccatgccaatgtcatgccattctcggcttgcactatcagcataaccatcacagcagaggcaagtccgttttcttcttattattcttttctccccatatttattttatttggatatttggactaa

SEQ ID NO: 5794 - protein, 396 aa, Sorghum bicolor
  misc_feature: Ceres ANNOT ID no. 6054633
  misc_feature (221)..(270): Pfam Id: HLH Pfam Desc: Helix-loop-helix DNA-binding domain
  misc_feature (217)..(377): NCBI GI: 108710324 NCBI Desc: helix-loop-helix dna-binding domain containing protein [oryza sativa (japonica cultivar-group)]
  misc_feature (224)..(375): NCBI GI: 3399777 NCBI Desc: symbiotic ammonium transporter; nodulin [glycine max]
  misc_feature (220)..(375): NCBI GI: 144922982 NCBI Desc: helix-loop-helix dna-binding [medicago truncatula]
  misc_feature (221)..(375): NCBI GI: 4206118 NCBI Desc: transporter homolog [mesembryanthemum crystallinum]
  misc_feature (211)..(375): NCBI GI: 91806240 NCBI Desc: basic helix-loop-helix family protein [arabidopsis thaliana]
  misc_feature: The sequence is a functional homolog of SEQ ID NO 1108 in the 10/225,066US patent application
  misc_feature: The sequence is a functional homolog of SEQ ID NO 12 in the 10/412,699US patent application
  misc_feature: The sequence is a functional homolog of SEQ ID NO 1238 in the 10/412,699US patent application
  misc_feature: The sequence is a functional homolog of SEQ ID NO 1272 in the 10/666,642US patent application
  misc_feature: The sequence is a functional homolog of SEQ ID NO 1273 in the 10/666,642US patent application
  misc_feature: The sequence is a functional homolog of SEQ ID NO 1274 in the 10/666,642US patent application
  misc_feature: The sequence is a functional homolog of SEQ ID NO 1275 in the 10/666,642US patent application
  misc_feature: The sequence is a functional homolog of SEQ ID NO 1276 in the 10/666,642US patent application
  misc_feature: The sequence is a functional homolog of SEQ ID NO 1501 in the 10/374,780US patent application
  misc_feature: The sequence is a functional homolog of SEQ ID NO 1701 in the 10/374,780US patent application
  misc_feature: The sequence is a functional homolog of SEQ ID NO 1702 in the 10/374,780US patent application
  misc_feature: The sequence is a functional homolog of SEQ ID NO 1703 in the 10/374,780US patent application
  misc_feature: The sequence is a functional homolog of SEQ ID NO 1704 in the 10/374,780US patent application
  misc_feature: The sequence is a functional homolog of SEQ ID NO 1705 in the 10/374,780US patent application
  misc_feature: The sequence is a functional homolog of SEQ ID NO 2 in the 10/374,780US patent application
  misc_feature: The sequence is a functional homolog of SEQ ID NO 464 in the 11/435,388US patent application
  misc_feature: The sequence is a functional homolog of SEQ ID NO 943 in the 10/374,780US patent application
  misc_feature: Useful for making plants with altered alkaloid content
  misc_feature: Useful for making plants with modulated growth and phenotype characteristics
  misc_feature: Functional homolog of the protein sequence given in SEQ ID NO 13317
  misc_feature: The sequence is a functional homolog of SEQ ID NO 12 in the 20040045049 US patent application
  misc_feature: The sequence is a functional homolog of SEQ ID NO 1238 in the 20040045049 US patent application
  misc_feature: The sequence is a functional homolog of SEQ ID NO 1501 in the 20060162006 US patent application
  misc_feature: The sequence is a functional homolog of SEQ ID NO 1701 in the 20060162006 US patent application
  misc_feature: The sequence is a functional homolog of SEQ ID NO 1702 in the 20060162006 US patent application
  misc_feature: The sequence is a functional homolog of SEQ ID NO 1703 in the 20060162006 US patent application
  misc_feature: The sequence is a functional homolog of SEQ ID NO 1704 in the 20060162006 US patent application
  misc_feature: The sequence is a functional homolog of SEQ ID NO 1705 in the 20060162006 US patent application
  misc_feature: The sequence is a functional homolog of SEQ ID NO. 483 in the 11/188,298 US application
  misc_feature: The sequence is a functional homolog of SEQ ID NO. 414 in the 11/188,298 US application
MEDSSLFMQWAMDTLLQEEEPAVDDVHWAMDTLLQEEEEEHAAVDGGDAVVFPSLQALRDASHAAEMVRELMAVAAAAETHDAAAANSSPSGGSGDGGGEVTDGGSSGATGTDPAAPATTAATDYYGGSWPPQSPTSSSFARAPPPAPPSSNSNTILPTVSWNFVTGSAQPGSEGVLEEAAVPARSLPPPELAQRRRSPPPPRRAAHHPVRSMGAPSSASCTPDHIVAERKRREKINKRLIELSTVIPGLKKMDKATILSDAAKYVKELQQRLKALEDAAAADAGSIRRKAPPAADENGGSGSPTSASSSSGAPALPEIEARLSERSVMVRIHSCGGKGVAAAALAVVEGLGLTVVHANVMPFSACTISITITAEASPFSSYYSFLPIFILFGYLD

SEQ ID NO: 5795 - DNA, 1293 bp, Sorghum bicolor
  misc_feature: Ceres ANNOT ID no. 6054637
  misc_feature: Encodes the peptide sequence at SEQ ID NO 5796
atggggaggcattcttgctgctacaagcaaaagttgagaaaggggctctggtcccctgaggaggatgagaaactcatgaatcacataacaaagcatggccatggctgctggagttctgttcccaaactcgctgggctccaaagatgcggaaagagttgtaggctgaggtggataaactatctgaggccagacctcaagagaggggcattctcccaagacgaagaagagctcatcattgagctgcacgctgtcctcggaaacaggtggtctcaaattgcagcacagctgccagggaggactgataatgagatcaagaatctatggaactcgtgcatcaagaagaagctgaggcagaaaggcattgatcccaacacccacaagccccttactgaggctgatcgcagcggagcagctcccaccgtcagcaccgagagaacctcagggtccagcgatgtcaacccatcaagtgctggtgctctggggaacttgagccacctcctcagcgagacggctcaatcatcaatgctgatgcccatgtatgacaagaatcgcactgaaactccgaacttggcacgccctaaggtgccaccaaaagagttgttcctggagcagcttactgctggacacgagagtccatcaacctgccgctcatcaggccaaactctctatttccctttccaacagcctttaggctacaacagtgagagtggcagtggcgatggggcgaatatgaattcactctggttcaaccagagtgacttcaactgcagcacaatttctacagtgatgccgccagtttcaccatcggccctctctacatcaatggggctgaatcttccgcctgataatcctcgacatggaggaactggtattggaagtaccgcagtagattcattctactgggatggtactaatcctagcagcagtagcagtactgggagcagaggaagcaacagtatgggctttgaaccacagagcacgagctcaattctggagaacagtgtcttcccatggacaaacatcggacaagaaaaagatacaagggctcacctagtagaggaacttaagtggcctgacttgctccatggaacctttgccgagacgaccacagccatgcagaaccagagccagacgctctatgatgacgtgatcaaggcagagagccaattcagcatggaagggatatgtgcttcttggttccagaatcagcagacacagcaacagctgcaggctgcacccaacatgtatgacaaggacttgcaaagaatgcaactgtcttttgagaatatctag

SEQ ID NO: 5796 - protein, 430 aa, Sorghum bicolor
  misc_feature: Ceres ANNOT ID no. 6054637
  misc_feature (14)..(61): Pfam Id: Myb_DNA-binding Pfam Desc: Myb-like DNA-binding domain
  misc_feature (67)..(112): Pfam Id: Myb_DNA-binding Pfam Desc: Myb-like DNA-binding domain
  misc_feature (1)..(430): NCBI GI: 56605400 NCBI Desc: myb18 protein [oryza sativa (japonica cultivar-group)]
  misc_feature (1)..(133): NCBI GI: 28628949 NCBI Desc: myb2 [dendrobium sp. xmw-2002-2]
  misc_feature (1)..(273): NCBI GI: 92873337 NCBI Desc: homeodomain-related [medicago truncatula]
  misc_feature (1)..(152): NCBI GI: 87241324 NCBI Desc: homeodomain-like [medicago truncatula]
  misc_feature (1)..(180): NCBI GI: 140049898 NCBI Desc: homeodomain-related [medicago truncatula]
  misc_feature: The sequence is a functional homolog of SEQ ID NO 136 in the 10/412,699 US patent application
  misc_feature: The sequence is a functional homolog of SEQ ID NO 325 in the 11/479,226 US patent application
  misc_feature: Useful for biocontainment applications
  misc_feature: Functional homolog of the protein sequence given in SEQ ID NO 13923
  misc_feature: The sequence is a functional homolog of SEQ ID NO 188 in the 10/412,699 US patent application
  misc_feature: The sequence is a functional homolog of SEQ ID NO 2274 in the 10/374,780 US patent application
  misc_feature: The sequence is a functional homolog of SEQ ID NO 704 in the 10/225,066 US patent application
  misc_feature: The sequence is a functional homolog of SEQ ID NO 1006 in the 11/435,388 US patent application
  misc_feature: The sequence is a functional homolog of SEQ ID NO 1008 in the 11/435,388 US patent application
  misc_feature: The sequence is a functional homolog of SEQ ID NO 1000 in the 11/435,388 US patent application
  misc_feature: The sequence is a functional homolog of SEQ ID NO 2223 in the 10/666,642 US patent application
  misc_feature: Useful for making plants with altered lignin content
  misc_feature: Functional homolog of the protein sequence given in SEQ ID NO 13921
  misc_feature: The sequence is a functional homolog of SEQ ID NO 1070 in the 10/374,780 US patent application
  misc_feature: The sequence is a functional homolog of SEQ ID NO 992 in the 11/435,388 US patent application
  misc_feature: The sequence is a functional homolog of SEQ ID NO 1065 in the 10/374,780 US patent application
  misc_feature: The sequence is a functional homolog of SEQ ID NO 1307 in the 10/412,699 US patent application
  misc_feature: The sequence is a functional homolog of SEQ ID NO 986 in the 11/435,388 US patent application
  misc_feature: The sequence is a functional homolog of SEQ ID NO 1094 in the 10/225,066 US patent application
  misc_feature: The sequence is a functional homolog of SEQ ID NO 386 in the 10/374,780 US patent application
  misc_feature: The sequence is a functional homolog of SEQ ID NO 1068 in the 10/374,780 US patent application
  misc_feature: The sequence is a functional homolog of SEQ ID NO 984 in the 11/435,388 US patent application
  misc_feature: The sequence is a functional homolog of SEQ ID NO 1004 in the 11/435,388 US patent application
  misc_feature: The sequence is a functional homolog of SEQ ID NO 1073 in the 10/374,780 US patent application
  misc_feature: The sequence is a functional homolog of SEQ ID NO 1002 in the 11/435,388 US patent application
  misc_feature: Useful for making plants with modulated nitrogen use efficiency
  misc_feature: Functional homolog of the protein sequence given in SEQ ID NO 13932
  misc_feature: The sequence is a functional homolog of SEQ ID NO 1010 in the 11/435,388 US patent application
  misc_feature: Useful for making plants with altered carbohydrate content
  misc_feature: Functional homolog of the protein sequence given in SEQ ID NO 13924
  misc_feature: Useful for making plants with altered alkaloid content
  misc_feature: Functional homolog of the protein sequence given in SEQ ID NO 13600
  misc_feature: The sequence is a functional homolog of SEQ ID NO 2572 in the 10/374,780 US patent application
  misc_feature: The sequence is a functional homolog of SEQ ID NO 636 in the 10/225,066 US patent application
  misc_feature: The sequence is a functional homolog of SEQ ID NO 838 in the 10/412,699 US patent application
  misc_feature: The sequence is a functional homolog of SEQ ID NO 2574 in the 10/374,780 US patent application
  misc_feature: The sequence is a functional homolog of SEQ ID NO 278 in the 10/225,066 US patent application
  misc_feature: The sequence is a functional homolog of SEQ ID NO 430 in the 10/412,699 US patent application
  misc_feature: The sequence is a functional homolog of SEQ ID NO 995 in the 11/479,226 US patent application
  misc_feature: The sequence is a functional homolog of SEQ ID NO 836 in the 10/412,699 US patent application
  misc_feature: Useful for making plants with altered terpenoid content
  misc_feature: Functional homolog of the protein sequence given in SEQ ID NO 13688
  misc_feature: The sequence is a functional homolog of SEQ ID NO 116 in the 10/412,699 US patent application
  misc_feature: The sequence is a functional homolog of SEQ ID NO 280 in the 11/479,226 US patent application
  misc_feature: The sequence is a functional homolog of SEQ ID NO 1118 in the 10/225,066 US patent application
  misc_feature: The sequence is a functional homolog of SEQ ID NO 1396 in the 11/479,226 US patent application
  misc_feature: The sequence is a functional homolog of SEQ ID NO 2488 in the 10/374,780 US patent application
  misc_feature: The sequence is a functional homolog of SEQ ID NO 658 in the 10/412,699 US patent application
  misc_feature: The sequence is a functional homolog of SEQ ID NO 569 in the 10/374,780 US patent application
  misc_feature: The sequence is a functional homolog of SEQ ID NO 1680 in the 11/479,226 US patent application
  misc_feature: The sequence is a functional homolog of SEQ ID NO 202 in the 10/666,642 US patent application
  misc_feature: The sequence is a functional homolog of SEQ ID NO 852 in the 10/412,699 US patent application
  misc_feature: The sequence is a functional homolog of SEQ ID NO 1056 in the 11/479,226 US patent application
  misc_feature: The sequence is a functional homolog of SEQ ID NO 144 in the 10/374,780 US patent application
  misc_feature: The sequence is a functional homolog of SEQ ID NO 458 in the 10/412,699 US patent application
  misc_feature: The sequence is a functional homolog of SEQ ID NO 756 in the 10/225,066 US patent application
  misc_feature: The sequence is a functional homolog of SEQ ID NO 196 in the 10/225,066 US patent application
  misc_feature: The sequence is a functional homolog of SEQ ID NO 2900 in the 10/374,780 US patent application
  misc_feature: The sequence is a functional homolog of SEQ ID NO 36 in US patent 7193132
  misc_feature: The sequence is a functional homolog of SEQ ID NO 126 in the 10/412,699 US patent application
  misc_feature: The sequence is a functional homolog of SEQ ID NO 1564 in the 10/374,780 US patent application
  misc_feature: Useful for making plants with modulated biomass
  misc_feature: Useful for making plants with modulated flowering time
  misc_feature: Functional homolog of the protein sequence given in SEQ ID NO 13601
  misc_feature: The sequence is a functional homolog of SEQ ID NO 1625 in the 10/412,699 US patent application
  misc_feature: The sequence is a functional homolog of SEQ ID NO 978 in the 10/666,642 US patent application
  misc_feature: Useful for making plants with altered cell wall content and/or composition
  misc_feature: Functional homolog of the protein sequence given in SEQ ID NO 13602
  misc_feature: The sequence is a functional homolog of SEQ ID NO 1088 in the 10/374,780 US patent application
  misc_feature: The sequence is a functional homolog of SEQ ID NO 2167 in the 10/666,642 US patent application
  misc_feature: The sequence is a functional homolog of SEQ ID NO 380 in the 11/435,388 US patent application
  misc_feature: The sequence is a functional homolog of SEQ ID NO 382 in the 10/714,887 US patent application
  misc_feature: The sequence is a functional homolog of SEQ ID NO 1087 in the 10/374,780 US patent application
  misc_feature: The sequence is a functional homolog of SEQ ID NO 2165 in the 10/666,642 US patent application
  misc_feature: The sequence is a functional homolog of SEQ ID NO 378 in the 11/435,388 US patent application
  misc_feature: The sequence is a functional homolog of SEQ ID NO 380 in the 10/714,887 US patent application
  misc_feature: The sequence is a functional homolog of SEQ ID NO. 395 in the 11/188,298 US application
MGRHSCCYKQKLRKGLWSPEEDEKLMNHITKHGHGCWSSVPKLAGLQRCGKSCRLRWINYLRPDLKRGAFSQDEEELIIELHAVLGNRWSQIAAQLPGRTDNEIKNLWNSCIKKKLRQKGIDPNTHKPLTEADRSGAAPTVSTERTSGSSDVNPSSAGALGNLSHLLSETAQSSMLMPMYDKNRTETPNLARPKVPPKELFLEQLTAGHESPSTCRSSGQTLYFPFQQPLGYNSESGSGDGANMNSLWFNQSDFNCSTISTVMPPVSPSALSTSMGLNLPPDNPRHGGTGIGSTAVDSFYWDGTNPSSSSSTGSRGSNSMGFEPQSTSSILENSVFPWTNIGQEKDTRAHLVEELKWPDLLHGTFAETTTAMQNQSQTLYDDVIKAESQFSMEGICASWFQNQQTQQQLQAAPNMYDKDLQRMQLSFENI

SEQ ID NO: 5797 - DNA, 603 bp, Sorghum bicolor
  misc_feature: Ceres ANNOT ID no. 6054656
  misc_feature: Encodes the peptide sequence at SEQ ID NO 5798
atggcggcggtgacgaacgccgacgtggaggtggtcgacttcgacctcgacgacgacgacctcatggacgaggacgccgggccggatccagcgccggcccccgcccctgcctcccgcctccgctccaccatcgcgggcgacgacgcgccgcgtaggaccaagggccgcggcttccgcgaggaccctaactcctccgcgcaccgcgactcccgctttggcgcggggggacgcgccgacctcgactcgctcggcggcccgggacccatccaatcaattgaaggatggattgtgttggtcactggagttcatgaagaagctcaagaagatgaccttcaaaatgctttccaagaatttgggcaggtcaaaaacctgcatttgaatttggaccgtcgtaccggatttgtcaaggggtacgctttgattgaatacgagaagtttgaagaagctcaggctgcaataaaagaattggatggagctgagcttcatgagcaaataatgagtgttgattgggcatttagcagtggccctgctaagcgcagaaatactcgaaaaaggtcaccaccaagagctcgttcaaggaccccacccaggagaaggcactga

SEQ ID NO: 5798 - protein, 200 aa, Sorghum bicolor
  misc_feature: Ceres ANNOT ID no. 6054656
  misc_feature (97)..(168): Pfam Id: RRM_1 Pfam Desc: RNA recognition motif. (a.k.a. RRM, RBD, or RNP domain)
  misc_feature (1)..(200): NCBI GI: 115461997 NCBI Desc: os05g0140500 [oryza sativa (japonica cultivar-group)]
  misc_feature (2)..(200): NCBI GI: 68037220 NCBI Desc: mrna transport factor [triticum aestivum]
  misc_feature (7)..(198): NCBI GI: 30524687 NCBI Desc: salt tolerance protein 4 [beta vulgaris]
  misc_feature (2)..(200): NCBI GI: 82798422 NCBI Desc: y14 protein [taiwania cryptomerioides]
  misc_feature (51)..(199): NCBI GI: 20804381 NCBI Desc: rna binding motif protein 8 [oryzias latipes]
  misc_feature: The sequence is a functional homolog of SEQ ID NO. 339 in the 11/188,298 US application
  misc_feature: The sequence is a functional homolog of SEQ ID NO. 458 in the 11/188,298 US application
MAAVTNADVEVVDFDLDDDDLMDEDAGPDPAPAPAPASRLRSTIAGDDAPRRTKGRGFREDPNSSAHRDSRFGAGGRADLDSLGGPGPIQSIEGWIVLVTGVHEEAQEDDLQNAFQEFGQVKNLHLNLDRRTGFVKGYALIEYEKFEEAQAAIKELDGAELHEQIMSVDWAFSSGPAKRRNTRKRSPPRARSRTPPRRRH

SEQ ID NO: 5799 - DNA, 663 bp, Sorghum bicolor
  misc_feature: Ceres ANNOT ID no. 6054668
  misc_feature: Encodes the peptide sequence at SEQ ID NO 5800
atggcggcggcggtggagagcgtggtggtggtccacaacgtggcgaagcggcacaacgtggggacactggcgcggagcgcgacggcgttcggcgtcgcggaggtggtcgtcgtcggccgccgcgacgtcagcgccttcggcagccacggcgccacctcacacctccgcttccgccacttcgcctccctcgccctcgcccgcgcctacctcaaggaagagagagggtgtgacatttgcggcgtggagatcaccgaagacgcgaagccggtgaccgcgcatccgttccatcggagcacagcgtttctctttggcaatgagggcacaggactctcacagaaagagtgtgatatctgcgacttctttgtctacattcctcagtatggtggtggaactgcatctctcaatgttaccgttgcagcttcaattgttctccaccactttggggtctgggctggctttcctgaacgaggccgagagggcaacaaattcattgtggctgatagaccacaggggcattcaaggggcctttactgcacagactcaattgaagcagtgattgaagagcggaaaatgcgaaaagaaaatgcatgtgatatacttgaggaaaatggaggcagccatcctcaggaatcaaatggcctagatttgatgtttacggactag

SEQ ID NO: 5800 - protein, 220 aa, Sorghum bicolor
  misc_feature: Ceres ANNOT ID no. 6054668
  misc_feature (6)..(145): Pfam Id: SpoU_methylase Pfam Desc: SpoU rRNA Methylase family
  misc_feature (3)..(218): NCBI GI: 7268299 NCBI Desc: obp33pep like protein [arabidopsis thaliana]
  misc_feature (20)..(218): NCBI GI: 1022801 NCBI Desc: obp33pep
  misc_feature (6)..(167): NCBI GI: 67596101 NCBI Desc: obp33pep like protein [cryptosporidium hominis]
  misc_feature (6)..(167): NCBI GI: 51951322 NCBI Desc: trna/rrna methyltransferase-like protein [cryptosporidium parvum]
  misc_feature (6)..(167): NCBI GI: 54656965 NCBI Desc: obp33pep like protein [cryptosporidium hominis]
MAAAVESVVVVHNVAKRHNVGTLARSATAFGVAEVVVVGRRDVSAFGSHGATSHLRFRHFASLALARAYLKEERGCDICGVEITEDAKPVTAHPFHRSTAFLFGNEGTGLSQKECDICDFFVYIPQYGGGTASLNVTVAASIVLHHFGVWAGFPERGREGNKFIVADRPQGHSRGLYCTDSIEAVIEERKMRKENACDILEENGGSHPQESNGLDLMFTD

SEQ ID NO: 5801 - DNA, 735 bp, Sorghum bicolor
  misc_feature: Ceres ANNOT ID no. 6054714
  misc_feature: Encodes the peptide sequence at SEQ ID NO 5802
atggatcccaacttcaatagtgtgtggagcacctctgagatcaatatggcaaagtcactcatcactagtcacatcaccaacaacacctacacaagtagtgcccatgtcaacaataactttgggatgccaatggaggctccactcgtagacaacatgggcatgttgaaatgttgtctaatggatgagactagagcaatgaggtgtagagagggacaacaacatatgccaaatgttgttcctaagcaaaggagacatgcagtgaggttttggactacacacgagcataggaatttcctccatggactagaagtgtttgggcgtggtaaatggaagaacatctccaagtacttcgtccccacaaggacaccggtgcagatctcaagccatgcacaaaagtatttccataggcaggagtgcaccaccaaaaaacaacacttcagcatcaatgatgtgagcctctatgacacacaaccatgggtgcagaacaactcttctagatgggagaccctcaccttcactagtggtgctttcaacacaaactacaacaactttgatggaaagcatgttgccttcaatagccttgcatgtgcgagccaaacaagtttcaaccaggtagctacatggattacagaccaacaaacaacaataagttcttttgtagctccagtaatggaggtggatgggagccagatgactagtaatggtcatcaactgggacactttcttcacaattag

SEQ ID NO: 5802 - protein, 244 aa, Sorghum bicolor
  misc_feature: Ceres ANNOT ID no. 6054714
  misc_feature (87)..(134): Pfam Id: Myb_DNA-binding Pfam Desc: Myb-like DNA-binding domain
  misc_feature (1)..(222): NCBI GI: 20067663 NCBI Desc: one repeat myb transcriptional factor [zea mays]
  misc_feature (88)..(175): NCBI GI: 55773705 NCBI Desc: one repeat myb transcriptional factor-like [oryza sativa (japonica cultivar-group)]
  misc_feature (71)..(165): NCBI GI: 146147359 NCBI Desc: myb_al protein [aeluropus littoralis]
  misc_feature (81)..(240): NCBI GI: 12406995 NCBI Desc: mcb2 protein [hordeum vulgare subsp. vulgare]
  misc_feature (79)..(174): NCBI GI: 110931658 NCBI Desc: myb transcription factor myb57 [glycine max]
  misc_feature: The sequence is a functional homolog of SEQ ID NO 10 in the 10/225,066US patent application
  misc_feature: The sequence is a functional homolog of SEQ ID NO 1002 in the 10/225,066US patent application
  misc_feature: The sequence is a functional homolog of SEQ ID NO 136 in the 11/375,241US patent application
  misc_feature: The sequence is a functional homolog of SEQ ID NO 1873 in the 11/479,226US patent application
  misc_feature: The sequence is a functional homolog of SEQ ID NO 304 in the 10/374,780US patent application
  misc_feature: The sequence is a functional homolog of SEQ ID NO 308 in the 10/374,780US patent application
  misc_feature: The sequence is a functional homolog of SEQ ID NO 838 in the 10/225,066US patent application
  misc_feature: Useful for making plants with modulated growth and phenotype characteristics
  misc_feature: The sequence is a functional homolog of SEQ ID NO 10 in the 20050160493 US patent application
  misc_feature: The sequence is a functional homolog of SEQ ID NO 1002 in the 20050160493 US patent application
  misc_feature: The sequence is a functional homolog of SEQ ID NO. 514 in the 11/188,298 US application
MDPNFNSVWSTSEINMAKSLITSHITNNTYTSSAHVNNNFGMPMEAPLVDNMGMLKCCLMDETRAMRCREGQQHMPNVVPKQRRHAVRFWTTHEHRNFLHGLEVFGRGKWKNISKYFVPTRTPVQISSHAQKYFHRQECTTKKQHFSINDVSLYDTQPWVQNNSSRWETLTFTSGAFNTNYNNFDGKHVAFNSLACASQTSFNQVATWITDQQTTISSFVAPVMEVDGSQMTSNGHQLGHFLHN

SEQ ID NO: 5803 - DNA, 1461 bp, Sorghum bicolor
  misc_feature: Ceres ANNOT ID no. 6054724
  misc_feature: Encodes the peptide sequence at SEQ ID NO 5804
atgcgaggagtgcggcggagcgcgcgcggggaatcgtccaggaaggcggcggaccgggaccgggaccgggaccgggaccaggacgtggagcggttcgcgctgtgcgccaagatgtcccacctcacgaggaccacgtcggagccgtgccgcaggacccgcggcgccgcttgggcgcgacggagcaggcccttctcggcgttcgagctggtgtcggcgagggaggccggccgcgcgggcggcgccgggttctccgccgccgaccgagcctacctcggtaggcagcacatccccagcaaggggccctggggcgtcgacgacgtggacagcgaggcctacgtctcgcagttctccgccgatggctcgttgctcatcgctgggtttcggggaagccgcatcaaagtctacgacgccgagaaagggtggaagattcagaaggatataagctgcagaatggtgcactggacgatttcagatattgctctctcacccgaccaacgattccttgcctatgcaagtttgtcacctactgttcacattgtgaacgtgcagagtgctggaaaggaatcacatgctaatattactgaaattcatgagggattggatttaactggtggtgatgaggatgaggactttggaatattttctgttaaattctcaaaagatggtaaagaaattgttgttggcaacaatgaaaggtcaatatatgtttatgaccttgcaacaaataaagtgtcagcccgtatccgtgctcataaagctgatgtcaatgctgttaccttcgctgatgaaagtggaaatgtgttgtactctggaagtgatgacagtttctgtaaggtgtgggacagacgttgcctttcaggggaaaagtcagcaggtattttgacaggtcatttagatggagttacatttatcgatagccgtggtgatgggcgttatttcatctccaattgcaaggatcagagaatcaaactttgggacatcaggaaaatgtcttccgtcgtgagagctcgcccagtgagtctagtggactgggactataggtggatgccatttccatcagaagcccactattttaagcatccagatgatcagtctgtggccacatacagaggccattcagttctgcgaacacttatccgttgctatttctcccctgtgcacagcacgggtcagaggtacatatacacaggatcaagtgacaagactgtacatatttatgatgtggtaagcggggagactgtcaagaagctatcgtggcatgactcgatcatcagagactgcacctggcatccatactacccaacgctcgtcagctcctcctgggacggctatgttgcccgctgggaggcatccggcgacgacaaggacccttcaatgctcgtccacaacgagaagagggcaggtgcaggtacccgttacttccggagatacgctgatcccttcacagatgccttcatgtag

SEQ ID NO: 5804 - protein, 486 aa, Sorghum bicolor
  misc_feature: Ceres ANNOT ID no. 6054724
  misc_feature (242)..(281): Pfam Id: WD40 Pfam Desc: WD domain, G-beta repeat
  misc_feature (288)..(326): Pfam Id: WD40 Pfam Desc: WD domain, G-beta repeat
  misc_feature (411)..(449): Pfam Id: WD40 Pfam Desc: WD domain, G-beta repeat
  misc_feature (154)..(477): NCBI GI: 115462045 NCBI Desc: os05g0144100 [oryza sativa (japonica cultivar-group)]
  misc_feature (37)..(459): NCBI GI: 2351587 NCBI Desc: lec14b homolog [prunus armeniaca]
  misc_feature (37)..(457): NCBI GI: 3122326 NCBI Desc: lec14b protein
  misc_feature (129)..(387): NCBI GI: 115436674 NCBI Desc: os01g0383700 [oryza sativa (japonica cultivar-group)]
  misc_feature (54)..(449): NCBI GI: 119586513 NCBI Desc: wd repeat domain 23, isoform cra_b [homo sapiens]
  misc_feature: The sequence is a functional homolog of SEQ ID NO. 502 in the 11/188,298 US application
MRGVRRSARGESSRKAADRDRDRDRDQDVERFALCAKMSHLTRTTSEPCRRTRGAAWARRSRPFSAFELVSAREAGRAGGAGFSAADRAYLGRQHIPSKGPWGVDDVDSEAYVSQFSADGSLLIAGFRGSRIKVYDAEKGWKIQKDISCRMVHWTISDIALSPDQRFLAYASLSPTVHIVNVQSAGKESHANITEIHEGLDLTGGDEDEDFGIFSVKFSKDGKEIVVGNNERSIYVYDLATNKVSARIRAHKADVNAVTFADESGNVLYSGSDDSFCKVWDRRCLSGEKSAGILTGHLDGVTFIDSRGDGRYFISNCKDQRIKLWDIRKMSSVVRARPVSLVDWDYRWMPFPSEAHYFKHPDDQSVATYRGHSVLRTLIRCYFSPVHSTGQRYIYTGSSDKTVHIYDVVSGETVKKLSWHDSIIRDCTWHPYYPTLVSSSWDGYVARWEASGDDKDPSMLVHNEKRAGAGTRYFRRYADPFTDAFM

SEQ ID NO: 5805 - DNA, 1149 bp, Sorghum bicolor
  misc_feature: Ceres ANNOT ID no. 6054725
  misc_feature: Encodes the peptide sequence at SEQ ID NO 5806
atggggaaggcgtccaagggctcgcggaaggggaagaaggcgtggcgcgccaacatccgcaccgacgacatcgacgacttcttcgagaagcagacgcgcgatgcccacgcgggcgccgccgccatcccctcccttccttccgactcgctcttctttgtcgacaagccggccgcttccgcgtctacttccgccgccggcgcctcggacacaaccaccaaagatattcctgtcaaaaggaagatcgagaagaagagggagaaggttctttaccatgagagtttgttgaagcggaatccatttgtgcagccaatcccatcttctgtggtgagcaagaaggataagaagaaggcaaagaagaaggaactgcaggagacacagggagagaaaagtgtccctatggaagatgattctgtagtaaagaactttgacatctgggctgtggatggtagaggtgattccaaggcaaaaaagagatctactacatcagttattcctgctgttgaagttgagcctgcaggatgttcatttaatcctccattggaagcgcatcaagactcccttgctcaagctgtagcagacgaaaagcgtaaagagtacatgaaagaattggggccagcacctgtaccactcatagttcctggtgaagctataactgaagaagataaattctttcttgatgctgatgatggagatgaagatgctgcagaagaggatggagatcaggatgctgataattcggttggacaaaggaagaacaaaacaaaaagagttaccagagtagaactgaataaaagagctcgtcggaaggagaggttaagagcagaagcggaagcaaagaaaatggaaaatatttcaaaagaaattgacagcttgccaaatataatgaatgagatagctaaagaggacaaggaaaaggagaagaggcgcatacggcgaactgtggttaaagaggagaggcgtaaattgggcccacctcgtctgggcagacacaaatttgaaccagctcctgttcaagttctattgacagaagagattagtggctctcttagaaagctaaaggggtgttgtaatcttgcaagggatcgctacaagagcattgagaaacgtggaatacttgcaccaagcaagagaataagcaaacatcggtag

SEQ ID NO: 5806 - protein, 382 aa, Sorghum bicolor
  misc_feature: Ceres ANNOT ID no. 6054725
  misc_feature (8)..(367): Pfam Id: Nop53 Pfam Desc: Nop53 (60S ribosomal biogenesis)
  misc_feature (1)..(379): NCBI GI: 115462047 NCBI Desc: os05g0144200 [oryza sativa (japonica cultivar-group)]
  misc_feature (162)..(377): NCBI GI: 55778544 NCBI Desc: glioma tumor suppressor candidate region gene 2 [rattus norvegicus]
  misc_feature (162)..(377): NCBI GI: 19387929 NCBI Desc: gltscr2 protein [mus musculus]
  misc_feature (162)..(377): NCBI GI: 21539653 NCBI Desc: glioma tumor suppressor candidate region gene 2 [mus musculus]
  misc_feature (61)..(377): NCBI GI: 8574095 NCBI Desc: gltscr2, glioma tumor suppressor candidate region protein 2 (af182076_1) [homo sapiens]
MGKASKGSRKGKKAWRANIRTDDIDDFFEKQTRDAHAGAAAIPSLPSDSLFFVDKPAASASTSAAGASDTTTKDIPVKRKIEKKREKVLYHESLLKRNPFVQPIPSSVVSKKDKKKAKKKELQETQGEKSVPMEDDSVVKNFDIWAVDGRGDSKAKKRSTTSVIPAVEVEPAGCSFNPPLEAHQDSLAQAVADEKRKEYMKELGPAPVPLIVPGEAITEEDKFFLDADDGDEDAAEEDGDQDADNSVGQRKNKTKRVTRVELNKRARRKERLRAEAEAKKMENISKEIDSLPNIMNEIAKEDKEKEKRRIRRTVVKEERRKLGPPRLGRHKFEPAPVQVLLTEEISGSLRKLKGCCNLARDRYKSIEKRGILAPSKRISKHR

SEQ ID NO: 5807 - DNA, 2688 bp, Sorghum bicolor
  misc_feature: Ceres ANNOT ID no. 6054726
  misc_feature: Encodes the peptide sequence at SEQ ID NO 5808
  misc_feature: Down-regulated in shoot tissues in response to salicylic acid treatment
atggggacggcggggaagggtgcgtgggtggtgccggcgccggcgtacagggaggtggaggggtgggagggcgtcggggatgacgcgccgggcttcaggtgcggccactcgctcaccgccgtcgcgcccaccaagggccacggcccgcggctcatcctcttcggcggcgccaccgccatcgaggccggcgcgtcctcgggcctccccggcatcaggctcgcgggggtgacgaactcggtgcactcgtacgatgtggagaagcgcaagtggactagattacatcctgctggagagcctccatctccgagggccgcgcacgctgcagctgcagtgggcaccatggttgttttccagggtgggattggaccagcagggcactcaacagacgatctctatgtccttgacctcacaaacgacaagtttaaatggcacagggtcgttgttcaaggggcaggccctggtcctcgctatggtcactgcatggatttggtagcccagcggtatcttgtcactgtttcgggaaatgacggaaagcgggtattgtcagatgcttgggctttggacacagcacagaaaccatataggtggcagaaacttaaccctgaaggtgataaaccttcagcaagaatgtatgctactgccagtgcacgctctgatggcatgcttttactttgtggtggaagggatgcttctggcacgccactttctgacgcctatggactattgatgcatacaaatggtcagtgggaatggactctagccccaggggtatctccatctccaagatatcagcatgcagccgtttttgttggtgctcggttgcatgttactggaggtgtccttagaggaggtagagctattgaaggagagggcgcaatagcagtcctggacactgctgctggagtttggttggatagaaatggcattgtgacctctcgtactttgaagtcatccaatgagcatgatgctgcttcggatctgcttcggcgctgtcggcatgctgctgcctcagttggttctcagatttacatttatggcggactcaggggagatatcctccttgatgatttcctggttgctgagaatgcacctttccaatcagaaatcacttcatctatgtacaatgttgatagagtccctaggggggaatctcaaaatagaaacaatagttttcatccagattcacctgtccatcaatctgcaaataacaggcaagagacagcttctggtttcagtgcggacaagaagtcaattgacatgttgatagaggcctcaactgcggaagctgaagctgtcagcgctgtatggcgagctgctaaggaagcatctgcagcatcttcggaagacagtctttcggagggaataggatctgagtccccactgagtgaaacttcaccaatgcctgaagatttcgatgatgggggatccctagaaccagatgtgaaactacattctagagcagttgtggttgctaaagaagcagtaggagatttaggatgcttggtcagacagctctcactggatcaatttgagaatgaaagcagacggatgcatccttcaaacaatgaccaatcttatccaggcagaagaacattaaatagacaacgatctccacaaggtttgcataagaaggttatttcgttcttacttaagccaaggaattggagagcacctgctgatagaaccttttttctggattcttacgaagttggcgagctatgctatgctgccgagcagatttttatgcaagaaccaactgttttacaattaaaagcaccaattaaagtatttggtgatcttcatgggcagtttggggacttaatgcgcctttttgatgagtatggttatccgtcaactgcaggtgacataacgtatattgattatctcttcttgggagactatgttgaccgaggtcagcatagtttggagacaataactttacttcttgctcttaaaattgagtaccctgaaaacgtacacttgatcagaggaaatcatgaagctgctgacatcaatgctctttttggcttccgtcttgaatgcattgagagaatgggtgaaagtgatgggatatgggcttggacaagattcaatcaactgttcaattatctcccacttgcggccatgatagaaaagaaaataatctgcatgcatggtggcataggaaggtcaataaacaccgtagagcaaattgagaaacttgaaaggcctatcacaatggatgttggttccattatcctcatggacctcttatggtctgatcctacagaaaatgatagtgtggagggtttgagacctaatgcacgagggcccggcttagtgacatttgggcctgatcgagtaaccgaattctgtaaacgaaacaaattgcaattgattataagagcccatgagtgtgttatggatgggtttgaacgttttgctcatggacaattgatcactttattttcagcaacaaattactgtggtactgcgaacaatgcaggggcgatacttgttgttggcaggggtttagttatcgtgccaaagttaattcatccacttccaccccctgttaattcacctgagtcctcccctgaacgtggggatgccacatggatgcaggagcttaacattcagcggccacctactccaaccagagggcggccgcaagctgccggtgataggaattctcttgcttacatatga

SEQ ID NO: 5808 - protein, 895 aa, Sorghum bicolor
  misc_feature: Ceres ANNOT ID no. 6054726
  misc_feature (592)..(801): Pfam Id: Metallophos Pfam Desc: Calcineurin-like phosphoesterase
  misc_feature (1)..(895): NCBI GI: 75288644 NCBI Desc: serine/threonine protein phosphatase bsl1 homolog (bsu1-like protein 1 homolog)
  misc_feature (5)..(895): NCBI GI: 30679350 NCBI Desc: kelch repeat-containing serine/threonine phosphoesterase family protein [arabidopsis thaliana]
  misc_feature (5)..(895): NCBI GI: 22022522 NCBI Desc: at4g03080/t4i9_4 [arabidopsis thaliana]
  misc_feature (410)..(895): NCBI GI: 42569377 NCBI Desc: kelch repeat-containing serine/threonine phosphoesterase family protein [arabidopsis thaliana]
  misc_feature (410)..(895): NCBI GI: 92876063 NCBI Desc: dna topoisomerase ii; serine/threonine-specific protein phosphatase and bis(5-nucleosyl)-tetraphosphatase [medicago truncatula]
  misc_feature (1)..(895): SWISSPROT Homolog: EC 3.1.3.16 Serine/threonine protein phosphatase BSL1 homolog
  misc_feature: Down-regulated in shoot tissues in response to salicylic acid treatment
  misc_feature: The sequence is a functional homolog of SEQ ID NO. 354 in the 11/188,298 US application
MGTAGKGAWVVPAPAYREVEGWEGVGDDAPGFRCGHSLTAVAPTKGHGPRLILFGGATAIEAGASSGLPGIRLAGVTNSVHSYDVEKRKWTRLHPAGEPPSPRAAHAAAAVGTMVVFQGGIGPAGHSTDDLYVLDLTNDKFKWHRVVVQGAGPGPRYGHCMDLVAQRYLVTVSGNDGKRVLSDAWALDTAQKPYRWQKLNPEGDKPSARMYATASARSDGMLLLCGGRDASGTPLSDAYGLLMHTNGQWEWTLAPGVSPSPRYQHAAVFVGARLHVTGGVLRGGRAIEGEGAIAVLDTAAGVWLDRNGIVTSRTLKSSNEHDAASDLLRRCRHAAASVGSQIYIYGGLRGDILLDDFLVAENAPFQSEITSSMYNVDRVPRGESQNRNNSFHPDSPVHQSANNRQETASGFSADKKSIDMLIEASTAEAEAVSAVWRAAKEASAASSEDSLSEGIGSESPLSETSPMPEDFDDGGSLEPDVKLHSRAVVVAKEAVGDLGCLVRQLSLDQFENESRRMHPSNNDQSYPGRRTLNRQRSPQGLHKKVISFLLKPRNWRAPADRTFFLDSYEVGELCYAAEQIFMQEPTVLQLKAPIKVFGDLHGQFGDLMRLFDEYGYPSTAGDITYIDYLFLGDYVDRGQHSLETITLLLALKIEYPENVHLIRGNHEAADINALFGFRLECIERMGESDGIWAWTRFNQLFNYLPLAAMIEKKIICMHGGIGRSINTVEQIEKLERPITMDVGSIILMDLLWSDPTENDSVEGLRPNARGPGLVTFGPDRVTEFCKRNKLQLIIRAHECVMDGFERFAHGQLITLFSATNYCGTANNAGAILVVGRGLVIVPKLIHPLPPPVNSPESSPERGDATWMQELNIQRPPTPTRGRPQAAGDRNSLAYI

SEQ ID NO: 5809 - DNA, 2277 bp, Sorghum bicolor
  misc_feature: Ceres ANNOT ID no. 6054727
  misc_feature: Encodes the peptide sequence at SEQ ID NO 5810
atgcggttcgacctggatggcctgccggtgcacttcccgtacgcggcgatctacccggagcagcacgcgtacatgggggagctgaagcgcgccctggacgcgcgcgggcacgcgctgctggagatgcccacgggcacgggcaagacggcggcgctcatctccctcatcacctcctactccctcgccaacccgtcccgcccgctccgcctcatctactgcacccgcaccgtgcacgagatggagaagacgctcgccgagctccgcctcctcttcgcccacctcccgccgcccgccgcccgctccctcctcgcgctcggcctctcctcccgcaagaacctctgcgtccacccgcaggcgtccgccgccgcggcgcgggactccgtcgacaccgcctgccgacgcctcacggcgtcatgggtccgcgagaaggccgcctccgacccggaatccaccccgctgtgcgagttctacgagacgttcgatcgggccgctgccgccggcgacctcgcctccttcatgccgcctggggtgtacactctcgccgacctccgcgcgctcgggagggagcgccgggtctgcccttacttccttgccaggcagatggtcaagtacgccaatgttgtcgtgtacagctaccagtacctgctcgaccccaaggtggccagcattgtgtccagggagatgcagaaggagtgtgtggtagttttcgatgaggctcacaacatcgacaatgtctgcatagaggcgttgagcgtcagcatccgcaagcagacgctggaaggagctgagcgaaacctgcggcgcatctcgcaagagatcgacaggttcaaggccactgatgccaataggcttcgtgctgaatacaacagactggtggatgggctggcgcagagaggaaatctaccaatatcggatgcctggctcgcaaatccggctttgcctgatgatattctgaaggaagctgttcctggaaacataaggagggctgaacactttcttgctgtcttgcggaggcttgtcagatttcttgatggccggcttgaaacagaaaatgttgagaatgaaatgcctgtttcctttgttgcttcaatccattcccaggctggaatcgaccaaaaaatgctgaggttttgttatgaccggctacactccctaatgatgacattagagataactgatacagatgagttcatgcacatacagaccatatgtgactttgccacactgattggaacatatacacggggcttctctattataatagagccatatgatgagagaatgcctgatattcgtgaccctgttattcagctgagttgccatgatgcttcactcgcaataagacctgtttttgatcgtttcgaaacggttgtgatcacttctggaactctcagcccaatagatctttatcctcgtctcttgaattttaatcctgtcataagcagaagcttcacaatgtccttaacaagagactgtatttgtccaatggtcttgactcgaggaagtgatcagctacctgtgagtacaaagttcgatatgcgtagtgatcctggtgttgtgaggaattatggccgcctcttgctggaaatggcttctgctgttccagatggcatagtttgcttttttgtcagttattcctatatggatggcattgtcaacagctggcacgaaatgggaattctgcaggacatcatgcaacataaattagtgttcattgaaacaccagatgttgttgagacaacattggctctcgataactacagaaaggcatgtgattgtggaagaggtgccattttcttctctgttgccaggggcaaagttgctgaaggtattgattttgatcggcactatggcagattagtcatcatgtttggtgttcctttccagtacacactgagccggatattgcttgctaggttggagtacctccgggaaactttccagataaaggagggtgacttcctaacatttgatgctttgagacaagcagctcaatgtgttggccgtgtgattcgctccaaagctgattatgggatgatgatatttgctgacaagagatacagtcggcatgataaacggtctaagttgcctgggtggatactctcgcatttgcatgatgcgcacctaaatctgagcactgatatggctctccacatagctcgtgagtttctccggaggatggcacagccatatgacaagacgggaagcggtggcaagaaaacactgttgaccgaggaggatctgcagaatatggcgcaggacggcatggagatgtaa

SEQ ID NO: 5810 - protein, 758 aa, Sorghum bicolor
  misc_feature: Ceres ANNOT ID no. 6054727
  misc_feature (72)..(259): Pfam Id: DEAD_2 Pfam Desc: DEAD_2
  misc_feature (1)..(757): NCBI GI: 6503086 NCBI Desc: nucleotide excision repair protein xp-d homolog [arabidopsis thaliana]
  misc_feature (1)..(722): NCBI GI: 3850576 NCBI Desc: strong similarity to gbu04968 nucleotide excision repair protein (ercc2) from cricetulus grisseus. [arabidopsis thaliana]
  misc_feature (1)..(757): NCBI GI: 45551134 NCBI Desc: cg9433-pa, isoform a [drosophila melanogaster]
  misc_feature (1)..(758): NCBI GI: 83405523 NCBI Desc: excision repair cross-complementing rodent repair deficiency, complementation group 2 protein [homo sapiens]
  misc_feature (1)..(750): NCBI GI: 82568960 NCBI Desc: excision repair cross-complementing rodent repair deficiency, complementation group 2 protein [homo sapiens]
  misc_feature: Useful for making plants with modulated heat sensitivity
  misc_feature: GREAT-hit functional homolog of the protein sequence given in SEQ ID NO 13395
  misc_feature: The sequence is a functional homolog of SEQ ID NO. 2 in the 7,202,396 US patent
  misc_feature: Useful for making plants with modulated heat sensitivity
  misc_feature: Functional homolog of the protein sequence given in SEQ ID NO 13395
MRFDLDGLPVHFPYAAIYPEQHAYMGELKRALDARGHALLEMPTGTGKTAALISLITSYSLANPSRPLRLIYCTRTVHEMEKTLAELRLLFAHLPPPAARSLLALGLSSRKNLCVHPQASAAAARDSVDTACRRLTASWVREKAASDPESTPLCEFYETFDRAAAAGDLASFMPPGVYTLADLRALGRERRVCPYFLARQMVKYANVVVYSYQYLLDPKVASIVSREMQKECVVVFDEAHNIDNVCIEALSVSIRKQTLEGAERNLRRISQEIDRFKATDANRLRAEYNRLVDGLAQRGNLPISDAWLANPALPDDILKEAVPGNIRRAEHFLAVLRRLVRFLDGRLETENVENEMPVSFVASIHSQAGIDQKMLRFCYDRLHSLMMTLEITDTDEFMHIQTICDFATLIGTYTRGFSIIIEPYDERMPDIRDPVIQLSCHDASLAIRPVFDRFETVVITSGTLSPIDLYPRLLNFNPVISRSFTMSLTRDCICPMVLTRGSDQLPVSTKFDMRSDPGVVRNYGRLLLEMASAVPDGIVCFFVSYSYMDGIVNSWHEMGILQDIMQHKLVFIETPDVVETTLALDNYRKACDCGRGAIFFSVARGKVAEGIDFDRHYGRLVIMFGVPFQYTLSRILLARLEYLRETFQIKEGDFLTFDALRQAAQCVGRVIRSKADYGMMIFADKRYSRHDKRSKLPGWILSHLHDAHLNLSTDMALHIAREFLRRMAQPYDKTGSGGKKTLLTEEDLQNMAQDGMEM

SEQ ID NO: 5811 - DNA, 1272 bp, Sorghum bicolor
  misc_feature: Ceres ANNOT ID no. 6054728
  misc_feature: Encodes the peptide sequence at SEQ ID NO 5812
atggataggctcgacggttctgcccgcctcatgctcgtttccgatcttgaccagacgatgattgatcatcaggatcgagagaacctgtccttgcttaggttcgaggcgctgtgggaggccgagttctcccaagattctctcctggtcttctcgactggaagaacgccgatcagttacaagggcttgcgtaaagataagcctctgatcacaccagacatcactatcatgtctgtgggaaccgtgatagcatacggtgaagagatgatccgcgacgttggctgggaggagtatctgaacaataaatgggacagggctattgtcgttgaggagacagctaggttccctcagctaaagcctcagccagagaggaaccagggtccccataaggttagtttcttcgttgacaagcagggtgctcaagaagtaatggatcatctcccgcagaagttggagaaacgtgggctagatgtgaaaatagtctacagcagcggtgaggcccttgatgttctaccacaaggtgcaggcaagggccaggcccttatgtacttgttaaataagctcaattcatacgagaaaccaccaaagaatactcttgtttgtggcgactctggaaacgatgcagaactattcagtgtcccatctgtacatggagtcatggtttgcaatgcccaagaggagctgcttcagtggtatgaagaaaatgcaagggacaatcctaagataattcatgcaactgagagatgtgctgccggtatcatgcaagctattggacacttcaaactaggacccaatgtttctgcaagagatcttgagttcccttatctaaaggcagacaccgctaagcctgcagatgtggtggtgaagttctatgttctctatgagaagtggcggaggggtgaccttccaaattcatcatcagttatgcagtacatgaaaagcattactcatctgaatggtacaattattcatccttctggatcggagcgttctcttcatgcatctattgatgctctaagttcttgctatggggacaaacaaagcaccaagttctgggtatgggtggacagactagttacatcgccaattggtacaagtaactggttggtgaggtttgacaactgggaaatggaaggtgctgttcggtattgctgccgcactactcttttgctgaatatcaagcctgagactccagagggcttggagctgacacacatccacaagacctgggttgaaggacactctgcagggagcgaacacacgttcatcttgtag

SEQ ID NO: 5812 - protein, 423 aa, Sorghum bicolor
  misc_feature: Ceres ANNOT ID no. 6054728
  misc_feature (8)..(261): Pfam Id: S6PP Pfam Desc: Sucrose-6F-phosphate phosphohydrolase
  misc_feature (262)..(393): Pfam Id: S6PP_C Pfam Desc: Sucrose-6-phosphate phosphohydrolase C-terminal
  misc_feature (12)..(242): Pfam Id: Hydrolase_3 Pfam Desc: haloacid dehalogenase-like hydrolase
  misc_feature (1)..(416): NCBI GI: 28190683 NCBI Desc: sucrose-phosphatase [zea mays]
  misc_feature (1)..(420): NCBI GI: 14587240 NCBI Desc: sucrose-phosphatase-like protein [oryza sativa (japonica cultivar-group)]
  misc_feature (1)..(420): NCBI GI: 115436646 NCBI Desc: os01g0376700 [oryza sativa (japonica cultivar-group)]
  misc_feature (1)..(423): NCBI GI: 11127755 NCBI Desc: sucrose-phosphatase [zea mays]
  misc_feature (1)..(421): NCBI GI: 69205229 NCBI Desc: sucrose phosphate phosphatase [saccharum officinarum]
MDRLDGSARLMLVSDLDQTMIDHQDRENLSLLRFEALWEAEFSQDSLLVFSTGRTPISYKGLRKDKPLITPDITIMSVGTVIAYGEEMIRDVGWEEYLNNKWDRAIVVEETARFPQLKPQPERNQGPHKVSFFVDKQGAQEVMDHLPQKLEKRGLDVKIVYSSGEALDVLPQGAGKGQALMYLLNKLNSYEKPPKNTLVCGDSGNDAELFSVPSVHGVMVCNAQEELLQWYEENARDNPKIIHATERCAAGIMQAIGHFKLGPNVSARDLEFPYLKADTAKPADVVVKFYVLYEKWRRGDLPNSSSVMQYMKSITHLNGTIIHPSGSERSLHASIDALSSCYGDKQSTKFWVWVDRLVTSPIGTSNWLVRFDNWEMEGAVRYCCRTTLLLNIKPETPEGLELTHIHKTWVEGHSAGSEHTFIL

SEQ ID NO: 5813 - DNA, 1278 bp, Sorghum bicolor
  misc_feature: Ceres ANNOT ID no. 6054729
  misc_feature: Encodes the peptide sequence at SEQ ID NO 5814
atggagaagctcgacgcttcagcccgcctcatgatcgtctcggatcttgatcagaccatggttgatcatgatgatccagaagacttgtccttgctcagttttgaggcgctctgggaggccgagttctcccatgattctcttctgatcttctcaaccgggagatcgcctatcagctacaatgatttgaggaaaaacaagcctctgatcactcccgacatcaccatcatgtctgtggggactgtgatagcttatggcaccgacatggttcgcgattctgactgggaggagcatttgaacaggaactgggaccgagatatcgtcgtcgaggaggcggcaaagttccctcagctgaagcctgagccagagaaggatcagggtccccataaggttacatttttggttgacaagcaaggtgctcaggaagtaatgcatgctcttcctcacaacttgaagaaacgtgggatacatgtaaaaataatcttcagctacggtgtgcttattgatgtggtgccgcaaggtgcaggaaaggggcaggctcttcagtatttgctgaacaagttcactttacagaggaaagcacccaacaatattcttgtttgtggtgactccggaaatgatgcagaattattcagtgtcccatcagtccatggcgttatggtcagcaatgcccaagaggagcttcttcaatggcgcgaagaaaatgccatgtgcaatcccaagataattcattccactaagagatgtgcagccggtgtcatgcaagctattggacacttcaaactaggacccaatgtttctcctagggatcttgaactccctcatccaaagttaagtatcatcaatcctgcagatttggtggtcaagttctacgttatctacgagaagtggcggaggggcgaagttgaaaagtcctcatcagtaatacagtacttgaaaagcattgctcatttgaatggaacaattattcgtccttgtggattggagcattctcttcatgcatccattgatgcactgcgttcatgctatggtgacaaaaaaggcaagaagttccgggcatgggtggacagacttgttacatcaccgatggcgatgggtacaagtaactggttggttaagtttgacaactgggaaatggaaggagatgctcggtattgctgccacacaacttttctgctgaatatgaagtcagacactcctgagggattggagctggtacatatcgacaagtcctggcttgaaggacactctgcagcaattgagcacgcattcatcttataa

SEQ ID NO: 5814 - protein, 425 aa, Sorghum bicolor
  misc_feature: Ceres ANNOT ID no. 6054729
  misc_feature (8)..(261): Pfam Id: S6PP Pfam Desc: Sucrose-6F-phosphate phosphohydrolase
  misc_feature (262)..(395): Pfam Id: S6PP_C Pfam Desc: Sucrose-6-phosphate phosphohydrolase C-terminal
  misc_feature (12)..(256): Pfam Id: Hydrolase_3 Pfam Desc: haloacid dehalogenase-like hydrolase
  misc_feature (1)..(424): NCBI GI: 28190683 NCBI Desc: sucrose-phosphatase [zea mays]
  misc_feature (1)..(422): NCBI GI: 14587240 NCBI Desc: sucrose-phosphatase-like protein [oryza sativa (japonica cultivar-group)]
  misc_feature (1)..(422): NCBI GI: 115436646 NCBI Desc: os01g0376700 [oryza sativa (japonica cultivar-group)]
  misc_feature (1)..(425): NCBI GI: 11127755 NCBI Desc: sucrose-phosphatase [zea mays]
  misc_feature (1)..(423): NCBI GI: 69205229 NCBI Desc: sucrose phosphate phosphatase [saccharum officinarum]
MEKLDASARLMIVSDLDQTMVDHDDPEDLSLLSFEALWEAEFSHDSLLIFSTGRSPISYNDLRKNKPLITPDITIMSVGTVIAYGTDMVRDSDWEEHLNRNWDRDIVVEEAAKFPQLKPEPEKDQGPHKVTFLVDKQGAQEVMHALPHNLKKRGIHVKIIFSYGVLIDVVPQGAGKGQALQYLLNKFTLQRKAPNNILVCGDSGNDAELFSVPSVHGVMVSNAQEELLQWREENAMCNPKIIHSTKRCAAGVMQAIGHFKLGPNVSPRDLELPHPKLSIINPADLVVKFYVIYEKWRRGEVEKSSSVIQYLKSIAHLNGTIIRPCGLEHSLHASIDALRSCYGDKKGKKFRAWVDRLVTSPMAMGTSNWLVKFDNWEMEGDARYCCHTTFLLNMKSDTPEGLELVHIDKSWLEGHSAAIEHAFIL

SEQ ID NO: 5815 - DNA, 1794 bp, Sorghum bicolor
  misc_feature: Ceres ANNOT ID no. 6054737
  misc_feature: Encodes the peptide sequence at SEQ ID NO 5816
atgcccaaaacacctcctgtcaaagcaagcaagaacactgaactgcagaaacaatctgcacccaacttgacaataacaaatgggcacacaagtacaaaggaagtggctaaaacagagcaccctatcaatgatgtgaaacgcattaccacttggatctgcaaaaatttggcctgtaaagctgttagaccatcagaagattccttctgcaagaggtgctcgtgttgtatttgccacaagtttgatgacaataaggatcctagtcaatggttagtttgttcatctgaaaatgatagcaagaattgctgtggttcttcttgccatattgaatgtgctttccgagacaagaggttaggatgttttgatctggagcaaattatacatctggatgggagttattcttgtgcctcgtgtggaaagatttctggaatactaggatattggaaaaggcaattagttattggaaaagatgctcgccgagttgataatctctgccagcgcatttttttgagctacaggctattagagggaactacccaatttaaagaattgcatgagattatcaaagatgcaaaagcaaaattggaaagtgaggttggcccacttgatggaatctcggcaaagaatgcacatggtatcgtaagcaggttctcagctggtattgctgtgcagaaactatgctctacagcgattcaaaaagctgatgagtggttaagttctcctgacctgcatcttcgagattcattacctgttgcctgtagatttaaatttgtagacataaaatcttcttcgctcattgtcatcttgaaagaaacctcgtcttctgacactatcaaaggttataagctatggtactggaagagcagagagcaaccaagtatggaacagcctgttattgtgcccaaagataaaagaaaaatactactttttgaccttaccccatgcaccgaatattctttcagagttatatcatttacagatgatggggtacttggccattcagaatctagatgtcgtactgagagcagggagatatttggcatgcgtgcaccacagaatgcagtgggagggggtacacaggcacaaaaaagagacaggaatcactcttgtaagtcatctgggttcaagatccgagatatttggaagaattttcaggaagctttggatgcagaaggctgttttgaagggttttctgaagatgtacatgaaggttcctgcagcagaaatgttacagagactgagttatctggagcttgtcggaaacttcatttcaactcttctgtccctgacctaaatgctgaggtacctgtgcccatggactacaccactgagaaacattattattctaagaagggacttgtgagatcaaatgacagtggtgactctgagacctgcgcagttggccagactgcagagccgcctgctgttgaatctcggtcagtaagcaaggtgaataccgtacaagttaataaatgtgagcagaatggtgcctctgctatttgccatgaaaaaatgctctctggatcaacaaggcaactagatggggattatgagcattgtgtaaaggtaatacggcagttggaatgcgatggacacattgaaaactgtttcaggatgaagttcttgacctggtatagtctgagatcgacagaccaggagcgcaaggctgtgaccacatatgtcaaaacattaagcgacgaaccaagcagcctggctgagcagctcgtcgattcctttggagaaatcttaaacagcaagaaggcaaaaactggtttctgcaacaaactatggcattag

SEQ ID NO: 5816 - protein, 597 aa, Sorghum bicolor
  misc_feature: Ceres ANNOT ID no. 6054737
  misc_feature (248)..(334): Pfam Id: fn3 Pfam Desc: Fibronectin type III domain
  misc_feature (1)..(597): NCBI GI: 116562979 NCBI Desc: vil3 protein [triticum monococcum subsp. aegilopoides]
  misc_feature (1)..(597): NCBI GI: 116563056 NCBI Desc: vil3 protein [triticum monococcum subsp. monococcum]
  misc_feature (1)..(597): NCBI GI: 116563005 NCBI Desc: vil1 protein [triticum monococcum subsp. aegilopoides]
  misc_feature (1)..(597): NCBI GI: 116563079 NCBI Desc: vil1 protein [triticum monococcum subsp. monococcum]
  misc_feature (8)..(323): NCBI GI: 92882107 NCBI Desc: fibronectin, type iii-like fold [medicago truncatula]
MPKTPPVKASKNTELQKQSAPNLTITNGHTSTKEVAKTEHPINDVKRITTWICKNLACKAVRPSEDSFCKRCSCCICHKFDDNKDPSQWLVCSSENDSKNCCGSSCHIECAFRDKRLGCFDLEQIIHLDGSYSCASCGKISGILGYWKRQLVIGKDARRVDNLCQRIFLSYRLLEGTTQFKELHEIIKDAKAKLESEVGPLDGISAKNAHGIVSRFSAGIAVQKLCSTAIQKADEWLSSPDLHLRDSLPVACRFKFVDIKSSSLIVILKETSSSDTIKGYKLWYWKSREQPSMEQPVIVPKDKRKILLFDLTPCTEYSFRVISFTDDGVLGHSESRCRTESREIFGMRAPQNAVGGGTQAQKRDRNHSCKSSGFKIRDIWKNFQEALDAEGCFEGFSEDVHEGSCSRNVTETELSGACRKLHFNSSVPDLNAEVPVPMDYTTEKHYYSKKGLVRSNDSGDSETCAVGQTAEPPAVESRSVSKVNTVQVNKCEQNGASAICHEKMLSGSTRQLDGDYEHCVKVIRQLECDGHIENCFRMKFLTWYSLRSTDQERKAVTTYVKTLSDEPSSLAEQLVDSFGEILNSKKAKTGFCNKLWH

SEQ ID NO: 5817 - DNA, 1380 bp, Sorghum bicolor
  misc_feature: Ceres ANNOT ID no. 6054738
  misc_feature: Encodes the peptide sequence at SEQ ID NO 5818
atggctctcctcaagaactccctcgtgctccaggggcggttgcgccatgcggcggcggcggcgttgttcacggcgcggcgcggcgcggcgacggcgacggaagagtacgcgcgccggaactacgccgataacacctccgagtacaacacggtcatcggctcgctcgtcgcccagcgcaggcaagagaatgttgttcatcggccctaccttctgcgtgatgcttatgacgacatgatgcttgatggcgtgaagcctgagcgggatacattccacacactcatagtcggtaccatgaaaggcagccggctacaagatgcactctacttccgtgatcagatgaaagaaatgggtttgcagcctgatgttaacctttacaacttcttgatctccacttgtggaaaatgcaagaactcagatgcagcaatcatgcttttagaagaaatgaaggcacatggtgttaagttgaaaggagaaacctacatttgtctactgaatgcacttgcatcaacagggcagactgatcaagtgtatgccatagttagtgatatgagtgctgctggtcttggattaaacaagttttgttatgctggactgataactgctttcaagaacaagacaccaaccactgaggaaactatggcaaagattcttgactttgtcgggcagtcgaaaggttggcaatatgttgaaagagcagcaaaggacagtgctgagaatataatgatgaatgtgtcagaggaagagctatacaacctcccaacagcagaatatgtaaatagacgaggaggatttgtctttaaacagcatacagtttatcatgttgctatccatgcttgtgcagaactgcgtagtaaagagacacttgaagcacttctggaaatgttcaataaggataatagagatggatctacttatgatgcctacatggtgatgcaagctatgaggtgttacctacggtgtggtgattttgattctgctgttaagatgtttgaagagtatttaagctcgagatccccacccgtggagttgtatgcgacacttgctgagggagctatgattgggtacactccgagaggaatgcaacttgctcaagaaactatagagaaaatggtttcaagaaatttcttcttgaatgccaggctgggatctgatctcctacttgcagctgccggtgaaacaactggtggatatacaactgcaaattatgtctgggatctcctgcaaagccgtaatgtcactccatatcttactgctgttgaggcataccacaaaggtttgatggcgcgagagattccttctgatgatccacggcttctcaatgtttcccgcgttttggacaacttgcagctccgatttggaccaagaagaaacactcagtaa

SEQ ID NO: 5818 - protein, 459 aa, Sorghum bicolor
  misc_feature: Ceres ANNOT ID no. 6054738
  misc_feature (88)..(122): Pfam Id: PPR Pfam Desc: PPR repeat
  misc_feature (123)..(157): Pfam Id: PPR Pfam Desc: PPR repeat
  misc_feature (1)..(458): NCBI GI: 51038198 NCBI Desc: unkonw protein [oryza sativa (japonica cultivar-group)]
  misc_feature (41)..(350): NCBI GI: 15221549 NCBI Desc: pentatricopeptide (ppr) repeat-containing protein [arabidopsis thaliana]
  misc_feature (41)..(350): NCBI GI: 6630464 NCBI Desc: f23n19.4 [arabidopsis thaliana]
  misc_feature (67)..(202): NCBI GI: 9759163 NCBI Desc: salt-inducible protein-like [arabidopsis thaliana]
  misc_feature (76)..(350): NCBI GI: 5454208 NCBI Desc: t3p18.22 [arabidopsis thaliana]
MALLKNSLVLQGRLRHAAAAALFTARRGAATATEEYARRNYADNTSEYNTVIGSLVAQRRQENVVHRPYLLRDAYDDMMLDGVKPERDTFHTLIVGTMKGSRLQDALYFRDQMKEMGLQPDVNLYNFLISTCGKCKNSDAAIMLLEEMKAHGVKLKGETYICLLNALASTGQTDQVYAIVSDMSAAGLGLNKFCYAGLITAFKNKTPTTEETMAKILDFVGQSKGWQYVERAAKDSAENIMMNVSEEELYNLPTAEYVNRRGGFVFKQHTVYHVAIHACAELRSKETLEALLEMFNKDNRDGSTYDAYMVMQAMRCYLRCGDFDSAVKMFEEYLSSRSPPVELYATLAEGAMIGYTPRGMQLAQETIEKMVSRNFFLNARLGSDLLLAAAGETTGGYTTANYVWDLLQSRNVTPYLTAVEAYHKGLMAREIPSDDPRLLNVSRVLDNLQLRFGPRRNTQ

SEQ ID NO: 5819 - DNA, 1815 bp, Sorghum bicolor
  misc_feature: Ceres ANNOT ID no. 6054744
  misc_feature: Encodes the peptide sequence at SEQ ID NO 5820
atggcgtgcgtcgccgcgctcttcgcctccccggcgctcctcccctttccctccaccacctcgtccacggcctcggcctcggcctcctgctcgtgccgcctccgcctccgccccgccgtcgtcgcccgcgcgccgcgcgagcagccgcgtggccggcgcgcgctccggcgcttcgacgaggtggagggggtgtcgaagaagcggcgcggcatcggaggaggtagcggcgctggagggtcgccgccgtcgtcgtcgcgcagggatagggggcttgccgtagatttcaaggagtcacaggttgctgattttgatgatcttgaagaggacaaattccttaatgctgtcgtcaaggtctactgcactcatatcgcacccgattatggtcttccttggcagaagcaaaggcagcattcaagtagtgggagtgcttttatgattggggatggcaaactcttgacaaatgcacactgcgttgagcacgacacccaggtcaaagtaaagagaaggggagatgataaaaagtatattgccaaggttttagctaggggtaccgaatgcgatcttgcattgctatctgttgagaatgaagagttctggagaggaacggaggcacttaattttggtcgtttgccatgccttcaggattcagtaactgttgtgggatatcctcttggtggagacactatatctgtaacaaaaggcgttgtatcacgcattgaggtcactccatatgcacatgggacatcagatcttcttggcattcaaattgatgcagccataaatcctggaaacagtgggggaccagcctttaatgaacaaggggagtgcattggtgttgcatttcaggtgtacaggtcagatgaagctgaaaatattggatatgttattccaactacagttgtatcccatttcttaaatgactatcagaaaaatggaaagtacacaggatttccttgtttgggcgtcttacttcagaaattggaaaatccggcattacgtgaaagcttaaaagtaccttcaagcgagggtgttcttgttcgtcgggttgagcctactgctccagcaagcagtgttttgcgaaagggagatgtaattgttagctttgatggtacctcagtaggatgtgaagcaacagtaccgtttcggtccacagaacggattgctttccgctatctcacaagccaaaagtatgcaggtgatattgctcagctaggaatcattcgtgatggcaattccatgaaagtccaaactattttgcagccaagaaaacatttggttccgtttcatgtcgagggtggccaaccttcttatctgatagttgccggccttgtctttacacctttaacagaaccatttatagaggaggagtgtgaagatacattagggttgaaattgttagcaaaagcacgttactctctagcaacatttgagggtgagcaaattgttattgtctcacaggttttggcgcacgaggtcaacatcggatatgagcacatgggcaatcaacaagtcatgaaactaaatggaaccacaataaagaatatccatcaccttgctcatcttgtggacacttgtaaagataagttcctgacgttcgaattcgaagacgacttccttgttgttttgcatcgagaagaagcggctgctgcatcatcagacattctcaaggaacatgccataccgtctatacggtcatctgatctatcagaaccatatgtagaaacaaagaatgacatacaaaaaacaagcgaagattttggtgaaagtcctgtcacaaactttgaaatgggaatcgattgtctcttgtgggcatga

SEQ ID NO: 5820 - protein, 604 aa, Sorghum bicolor
  misc_feature: Ceres ANNOT ID no. 6054744
  misc_feature (118)..(305): Pfam Id: Trypsin Pfam Desc: Trypsin
  misc_feature (284)..(604): NCBI GI: 115462085 NCBI Desc: os05g0147500 [oryza sativa (japonica cultivar-group)]
  misc_feature (113)..(565): NCBI GI: 84999382 NCBI Desc: serine protease [theileria annulata strain ankara]
  misc_feature (94)..(485): NCBI GI: 91806029 NCBI Desc: degp protease [arabidopsis thaliana]
  misc_feature (94)..(454): NCBI GI: 2190549 NCBI Desc: f5i14.17 gene product [arabidopsis thaliana]
  misc_feature (110)..(342): NCBI GI: 33332321 NCBI Desc: degp-like serine protease 1 precursor [plasmodium falciparum]
MACVAALFASPALLPFPSTTSSTASASASCSCRLRLRPAVVARAPREQPRGRRALRRFDEVEGVSKKRRGIGGGSGAGGSPPSSSRRDRGLAVDFKESQVADFDDLEEDKFLNAVVKVYCTHIAPDYGLPWQKQRQHSSSGSAFMIGDGKLLTNAHCVEHDTQVKVKRRGDDKKYIAKVLARGTECDLALLSVENEEFWRGTEALNFGRLPCLQDSVTVVGYPLGGDTISVTKGVVSRIEVTPYAHGTSDLLGIQIDAAINPGNSGGPAFNEQGECIGVAFQVYRSDEAENIGYVIPTTVVSHFLNDYQKNGKYTGFPCLGVLLQKLENPALRESLKVPSSEGVLVRRVEPTAPASSVLRKGDVIVSFDGTSVGCEATVPFRSTERIAFRYLTSQKYAGDIAQLGIIRDGNSMKVQTILQPRKHLVPFHVEGGQPSYLIVAGLVFTPLTEPFIEEECEDTLGLKLLAKARYSLATFEGEQIVIVSQVLAHEVNIGYEHMGNQQVMKLNGTTIKNIHHLAHLVDTCKDKFLTFEFEDDFLVVLHREEAAAASSDILKEHAIPSIRSSDLSEPYVETKNDIQKTSEDFGESPVTNFEMGIDCLLWA

SEQ ID NO: 5821 - DNA, 1224 bp, Sorghum bicolor
  misc_feature: Ceres ANNOT ID no. 6054746
  misc_feature: Encodes the peptide sequence at SEQ ID NO 5822
atggctccggcggccggcgcccccatcgtcgcgctgggcgaggacctcctccgcgaggtcttcatccaccttccggcctccgccgacctcctccgcgcagccgccgcctgcaagcctttcctccgcgctgcgcgcagcgcgcccttcctccgccgcttccgccgccgccacccctcctgcccgcgcctcctcggctgtctcctcctttaccccaaccgccgcagcggcaaatcccaattcgtacccatctctgcttcctcttccccttcctcctcttcttcctcctcgtcgtctgcggccgcggccgccgaccgtggcgacttcgccctctcattccttcccggcggcggttggctgggcctgggcgcagccacgtggaagcacctggactgccgcaacggccgccttctcctcgagaacctgaggacccatgaactcgccgtcgcggatccgatctcccgccgctacgtttccctccccgcgcctcccgccgggcgcgccgtcgggtacgggctcttcactgacgacggagacaagtcggagttccgggtggtttgcgtctcgcgggacgccgcctcgcccgagctgcgcgcgctggtcctagcctccggcgagctctcctgggccgacgtcgccggcatcgcttgccaacccaatctagccgtcggctcccgggtgatgcaggcgaaccggtcgctgtactggaggctcgagggcggggagcgcatggtggcgttcagcacggcgtccatggagctctcggttttggacctcccgcctgccctgcgggacctccgcttcgacgccatggacagagggaaagaagaggatgccaatgtcctccacctgctcactatgactggctaccgcatcgaggtgtgggctggcacggcggacggtgacggtgggatggcatggaggcaggtggagaaatcgttgaggttccacaaggcactgactgagataatcgatccttcactggagtcatacgagaggatcgatccttcagtgcagtcataccgagatgatatagatgtcatcggggtggtcgcgggccttgtgttcttccggaagtggactcatatattcaccattgatcttgaaactatgaagctcaagaggttgccgaaagcggattgcctgggggcgctgatctacccttacacagttgcgtggccaccctctttgttgaatcctgctgaacaagacaagcgcttgatgtag

SEQ ID NO: 5822 - protein, 407 aa, Sorghum bicolor
  misc_feature: Ceres ANNOT ID no. 6054746
  misc_feature (2)..(401): NCBI GI: 115462089 NCBI Desc: os05g0147700 [oryza sativa (japonica cultivar-group)]
  misc_feature (175)..(403): NCBI GI: 115445599 NCBI Desc: os02g0287900 [oryza sativa (japonica cultivar-group)]
  misc_feature (9)..(396): NCBI GI: 115481050 NCBI Desc: os10g0135300 [oryza sativa (japonica cultivar-group)]
  misc_feature (5)..(262): NCBI GI: 116308909 NCBI Desc: osigba0107a02.1 [oryza sativa (indica cultivar-group)]
  misc_feature (14)..(178): NCBI GI: 115478659 NCBI Desc: os09g0341500 [oryza sativa (japonica cultivar-group)]
MAPAAGAPIVALGEDLLREVFIHLPASADLLRAAAACKPFLRAARSAPFLRRFRRRHPSCPRLLGCLLLYPNRRSGKSQFVPISASSSPSSSSSSSSSAAAAADRGDFALSFLPGGGWLGLGAATWKHLDCRNGRLLLENLRTHELAVADPISRRYVSLPAPPAGRAVGYGLFTDDGDKSEFRVVCVSRDAASPELRALVLASGELSWADVAGIACQPNLAVGSRVMQANRSLYWRLEGGERMVAFSTASMELSVLDLPPALRDLRFDAMDRGKEEDANVLHLLTMTGYRIEVWAGTADGDGGMAWRQVEKSLRFHKALTEIIDPSLESYERIDPSVQSYRDDIDVIGVVAGLVFFRKWTHIFTIDLETMKLKRLPKADCLGALIYPYTVAWPPSLLNPAEQDKRLM

SEQ ID NO: 5823 - DNA, 1842 bp, Sorghum bicolor
  misc_feature: Ceres ANNOT ID no. 6054749
  misc_feature: Encodes the peptide sequence at SEQ ID NO 5824
atgagagatgcgtggtccccgctcctcaactacgcccacctcagcggcctcctcgcccgctgcggccgcgccggggacctccggctcggcaccgcgctgcacgccgtcgtcgccaagaaccccgcccacttccgcctctgcccacaccgtagtgccagcttgcaccacgtgctcgccgtatggaactccctcgtcgccatgtacgcccgctgcggccgccgcggggacgccgccagggcgttcgacgaaatgcccctccgggactccgtgtcctggaactcgctcctcgccgcgtccgcctcggccgcggatgcgctcgcgctgctcaggcggatgctgcgcgccgcgcctggcgccgccgcgtgcgaccacgccacgctcaccaccgtcctgtccgcatgcgcgcgtgctgacgggggtgggggcacgggcgccgcgtcgctccccgtggtgcacgggctggcggtgtcgtgcgggctcgacgctgaggtgtccgtcgggaacgcgctgatcaccgcctacttcgagtgcagctccccgggctcggcggaacgggtgttcgacgccatggcagacaggaacgtcgtcacgtggacggccatggtctccgggatggctcgggcagaacgatatagggagagtctgtctctgttccggcagatgaggcacgcggtggacgctaacagggcctcgtactcgagctctttgttagcatgcgccggatcacttgctgccagcgaagggcagcagattcatgggcttgtcgttaaggctgggttcgagactgatctccatgtcgagagtgagctcatggatatgtactccaaatgtgggttaatggaggatgcgttgagggtgttccgctcctgtcaggatcctgatgaagttttcttgacagtgattcttgttgggtttgctcaaaatggactggaggagaaggcattcgaattgtttgctgagatggtcggcaaaggaatcgacattgatgcaaacatggtttctgcagttctgggggccttcggtgcttctgcgccatttgctcttgggaagcagatccacgccctggtcataaaaaaatgcttcggagggaacacctatgtctgcaatggtctgatcaatatgtattctaaatgcggtgaactacaggagtctatcgaagtgtttgatggaacgccgagcaagaatacagttacatggaattccatcattgcggcctttgcacgacatggtcatggttccgaggtttttggattgtttgagtctatgaaagccgatggtgttaagcccactaatgtcacattcttgtcactgctccatggatgcagccatgttggatcagccagcaagggactggagatattgaattccatgtcatcacaatatggaatccatccgaaggtggagcattatgcatgtgtggttgacatgcttggccgagccagccagctggatgatgccaaagcattcatagaagatggacctttcaaggacagcgctcttctctggcaggccttaatgggagcttgcagcttccataaggactcagaagttggaaaatatgcagcagagaagttgctcctcctggaccccgactgcactgccgcttatgtcttgctctcaaacatctactcatccgagggcagatgggatgacagagccaggatcctgaaaaggatgagagaaaagggcttgaggaaggacactggcaagagctggattgagctggaaaaggaggtccgttcttttgtcatggccccaaggtctcgccctgatgatgtgctgatgcagttgtccgcagttgccagtgatcaagaagatctagtagagagcaatgctttgtga

SEQ ID NO: 5824 - protein, 613 aa, Sorghum bicolor
  misc_feature: Ceres ANNOT ID no. 6054749
  misc_feature (296)..(330): Pfam Id: PPR Pfam Desc: PPR repeat
  misc_feature (397)..(431): Pfam Id: PPR Pfam Desc: PPR repeat
  misc_feature (8)..(604): NCBI GI: 42563517 NCBI Desc: pentatricopeptide (ppr) repeat-containing protein [arabidopsis thaliana]
  misc_feature (62)..(590): NCBI GI: 115436472 NCBI Desc: os01g0355100 [oryza sativa (japonica cultivar-group)]
  misc_feature (62)..(606): NCBI GI: 78183583 NCBI Desc: ppr1106-17 [physcomitrella patens]
  misc_feature (14)..(604): NCBI GI: 115488988 NCBI Desc: os12g0552300 [oryza sativa (japonica cultivar-group)]
  misc_feature (62)..(590): NCBI GI: 47848643 NCBI Desc: pentatricopeptide (ppr) repeat-containing protein-like [oryza sativa (japonica cultivar-group)]
MRDAWSPLLNYAHLSGLLARCGRAGDLRLGTALHAVVAKNPAHFRLCPHRSASLHHVLAVWNSLVAMYARCGRRGDAARAFDEMPLRDSVSWNSLLAASASAADALALLRRMLRAAPGAAACDHATLTTVLSACARADGGGGTGAASLPVVHGLAVSCGLDAEVSVGNALITAYFECSSPGSAERVFDAMADRNVVTWTAMVSGMARAERYRESLSLFRQMRHAVDANRASYSSSLLACAGSLAASEGQQIHGLVVKAGFETDLHVESELMDMYSKCGLMEDALRVFRSCQDPDEVFLTVILVGFAQNGLEEKAFELFAEMVGKGIDIDANMVSAVLGAFGASAPFALGKQIHALVIKKCFGGNTYVCNGLINMYSKCGELQESIEVFDGTPSKNTVTWNSIIAAFARHGHGSEVFGLFESMKADGVKPTNVTFLSLLHGCSHVGSASKGLEILNSMSSQYGIHPKVEHYACVVDMLGRASQLDDAKAFIEDGPFKDSALLWQALMGACSFHKDSEVGKYAAEKLLLLDPDCTAAYVLLSNIYSSEGRWDDRARILKRMREKGLRKDTGKSWIELEKEVRSFVMAPRSRPDDVLMQLSAVASDQEDLVESNAL

SEQ ID NO: 5825 - DNA, 1533 bp, Sorghum bicolor
  misc_feature: Ceres ANNOT ID no. 6054751
  misc_feature: Encodes the peptide sequence at SEQ ID NO 5826
atggggctgggtttgggagctcttctcaaatccggcgctctctcggtctcggactacgacgccatcgtctccatcaacatcttcatcgcgctgctctgcagctgcattgtcatcggccacttgctggaagggaaccgatgggtgaacgagtccatcaccgcgcttgtcatgggtctcatcaccggaggcgtgatcctgctggtcactaatgggacaaactcacgcattcttgtgttcagcgaggacctgtttttcatatacttgcttccgccgataatcttcaatgccgggtttcaagtaaagaaaaagcaattcttccgcaactttataacaattattttgtttggtgctgttggaactctgatttcctttgtaataatctctcttggtgctatgggattgttcaagaaacttgacgttggtccactcgagcttggggactatcttgcaattggtgctattttctctgcgacagattctgtttgcaccttacaggtgcttaaccaggatgaaacacccctactctatagtctagtttttggtgaaggcgttgttaatgatgccacatctgttgtgctcttcaatgcaattgaaaaccttgatattgctaattttgatgctattgttctgttgaatttcgtcggaaaatttctctacctgttcttcaccagcaccatacttggagtagctactgggttgcttagtgcgtacattatcaagaagctctgttttgccagacattcaactgatagagaagtttctatcatgatactcatggcatacctttcgtacatgctacatacttttgcaactttatcattcattgcagaaattttcctcttcctctatgttgggatggatgcattggacattgagaagtggaagttagctagtagcagtcctaagaaaccgattgctttaagtgcaattatattgggcttggttatggttggaagagcggcctttgtattccctttgtcgttcctatccaacctaagtaaaaaggaggcccgtccaaagatctccttcaagcaacaagtaatcatatggtgggctggtctcatgagaggagcagtgtcaattgcacttgcctataacaagtttacatcatctggtcatactgaagtccgagttaatgctatcatgatcactagcacagttattgttgttctattcagcacaatggttttcggtctgctgaccaagccactgcttagtctcctgatcccaccaaggactggcttgaacacgtcatctctgctctccagccagtctattctggacccacttcttactagcatggtggggtctgactttgacgtaggacagatcaactcccctcagtacaacctccagtttattctcactgcgccaactcgctctgtccatcgcctttggcgcaagtttgatgatcggttcatgcgcccaatgtttggggggagaggtttcgttccctttgtgcctggttcgccggtggagcggagcgtccctgaacctcacctgggcactgtgacagaggctgagcatagttga

SEQ ID NO: 5826 - protein, 510 aa, Sorghum bicolor
  misc_feature: Ceres ANNOT ID no. 6054751
  misc_feature (23)..(407): Pfam Id: Na_H_Exchanger Pfam Desc: Sodium/hydrogen exchanger family
  misc_feature (1)..(279): NCBI GI: 124265192 NCBI Desc: vacuolar na+/h+ antiporter [hordeum vulgare]
  misc_feature (1)..(279): NCBI GI: 31580736 NCBI Desc: na+/h+ antiporter [triticum aestivum]
  misc_feature (1)..(279): NCBI GI: 30172041 NCBI Desc: na+/h+ antiporter nhx2 [zea mays]
  misc_feature (1)..(279): NCBI GI: 32396176 NCBI Desc: na+/h+ antiporter nhx6 [zea mays]
  misc_feature (1)..(279): NCBI GI: 77552321 NCBI Desc: sodium/hydrogen exchanger 3 [oryza sativa (japonica cultivar-group)]
  misc_feature: Useful for making plants with modulated drought sensitivity
  misc_feature: Functional homolog of the protein sequence given in SEQ ID NO 13374
  misc_feature: The sequence is a functional homolog of SEQ ID NO 2 in US patent 7250560
  misc_feature: Useful for making plants with modulated water use efficiency
  misc_feature: Functional homolog of the protein sequence given in SEQ ID NO 13934
  misc_feature: The sequence is a functional homolog of SEQ ID NO 2 in US patent 7041875
  misc_feature: Useful for making plants with modulated drought sensitivity
  misc_feature: The sequence is a functional homolog of SEQ ID NO 4 in US patent 7250560
  misc_feature: The sequence is a functional homolog of SEQ ID NO. 319 in the 11/188,298 US application
MGLGLGALLKSGALSVSDYDAIVSINIFIALLCSCIVIGHLLEGNRWVNESITALVMGLITGGVILLVTNGTNSRILVFSEDLFFIYLLPPIIFNAGFQVKKKQFFRNFITIILFGAVGTLISFVIISLGAMGLFKKLDVGPLELGDYLAIGAIFSATDSVCTLQVLNQDETPLLYSLVFGEGVVNDATSVVLFNAIENLDIANFDAIVLLNFVGKFLYLFFTSTILGVATGLLSAYIIKKLCFARHSTDREVSIMILMAYLSYMLHTFATLSFIAEIFLFLYVGMDALDIEKWKLASSSPKKPIALSAIILGLVMVGRAAFVFPLSFLSNLSKKEARPKISFKQQVIIWWAGLMRGAVSIALAYNKFTSSGHTEVRVNAIMITSTVIVVLFSTMVFGLLTKPLLSLLIPPRTGLNTSSLLSSQSILDPLLTSMVGSDFDVGQINSPQYNLQFILTAPTRSVHRLWRKFDDRFMRPMFGGRGFVPFVPGSPVERSVPEPHLGTVTEAEHS

SEQ ID NO: 5827 - DNA, 1197 bp, Sorghum bicolor
  misc_feature: Ceres ANNOT ID no. 6054760
  misc_feature: Encodes the peptide sequence at SEQ ID NO 5828
atggcgcagagcgcgctgcgaggcccctccgactactccagcgagcccccacgccacccctccctccgcatcaacgccaaggagccattcaacgcggagccggcgcggcgggacctggcggcgtcgtacatcacccccgttgacctcttcttcaagcgcaaccacggccccatccccatcctcgatgacattgacagctactacgtcaccatcggtggcctcgtaggcgagccgaggcgcctctctctggatgacataaggaagctgccgaagtacaatgttaccgccaccctgcagtgtgcagggaacaggaggacggagatgagcaggagcaggaaggtgaggggcgttggatgggatgtttgtgctcttgggaatgcaacttggggaggagctaaattgtcagatgtccttcagctcgtttgtgtgccatatcatactgaaatcactatggctggtggaaagcatgttgagttcattagtgttgatcagtgcccggaggaaaaaggtggcccatacagagcatcaattccattgggccaggcaaccaatcctgcagcagacgtattgcttgcttatgaaatgaatggcgaggtactcaagcgtgatcatggataccctctccgtgccattgttccaggtgtcattggtgctcgttctgtcaaatggttagataagattgacataattgaggaagagtctaaaggtttcttcatgcaaaaagattataagatgttccctccatcagttgattgggataatatcgtgtggtcaacgaggaagccccaaatggactacccagttcagtctgctgtatgttctttggaagataagagtgctgtcaaacctggacaggttactgttgctggatatgccctgtcaggaggtggcaggggcattgagagggttgacatttcccctgatggtggcaagagttggatcgaggcacaccggtaccaaaagcatgatgtcccatatgtgactagtgacataagctgtgataagtgggcatgggtgctcttcaaggccgttgtcaatgtcaaaggcgacactgtgattgtttcaaaagcggttgattccagtgcaaatgtgcaacctgagagcgtggaatcaatctggaacctgagaggaattctgaacacatgctggcatcgtgtccaccttttggctacacctaatcttagaagcttcatgtga

SEQ ID NO: 5828 - protein, 398 aa, Sorghum bicolor
  misc_feature: Ceres ANNOT ID no. 6054760
  misc_feature (51)..(240): Pfam Id: Oxidored_molyb Pfam Desc: Oxidoreductase molybdopterin binding domain
  misc_feature (260)..(391): Pfam Id: Mo-co_dimer Pfam Desc: Mo-co oxidoreductase dimerisation domain
  misc_feature (6)..(388): NCBI GI: 82621174 NCBI Desc: sulfite oxidase-like [solanum tuberosum]
  misc_feature (6)..(388): NCBI GI: 114186917 NCBI Desc: sulfite oxidase [solanum lycopersicum]
  misc_feature (6)..(394): NCBI GI: 6468008 NCBI Desc: sulfite oxidase [arabidopsis thaliana]
  misc_feature (6)..(388): NCBI GI: 82941457 NCBI Desc: sulfite oxidase [codonopsis lanceolata]
  misc_feature (98)..(394): NCBI GI: 79295451 NCBI Desc: sox (sulfite oxidase); oxidoreductase/ sulfite oxidase [arabidopsis thaliana]
  misc_feature (6)..(394): SWISSPROT Homolog: EC 1.8.3.1 Sulfite oxidase
MAQSALRGPSDYSSEPPRHPSLRINAKEPFNAEPARRDLAASYITPVDLFFKRNHGPIPILDDIDSYYVTIGGLVGEPRRLSLDDIRKLPKYNVTATLQCAGNRRTEMSRSRKVRGVGWDVCALGNATWGGAKLSDVLQLVCVPYHTEITMAGGKHVEFISVDQCPEEKGGPYRASIPLGQATNPAADVLLAYEMNGEVLKRDHGYPLRAIVPGVIGARSVKWLDKIDIIEEESKGFFMQKDYKMFPPSVDWDNIVWSTRKPQMDYPVQSAVCSLEDKSAVKPGQVTVAGYALSGGGRGIERVDISPDGGKSWIEAHRYQKHDVPYVTSDISCDKWAWVLFKAVVNVKGDTVIVSKAVDSSANVQPESVESIWNLRGILNTCWHRVHLLATPNLRSFM

SEQ ID NO: 5829 - DNA, 1089 bp, Sorghum bicolor
  misc_feature: Ceres ANNOT ID no. 6054767
  misc_feature: Encodes the peptide sequence at SEQ ID NO 5830
  misc_feature: Up-regulated in shoot tissues in response to methyl jasmonate treatment
atggcggaggcgattgagggaggcgcgagcgcgacgaaagggccggtggtggtgacgggggcgtcgggcttcgtcggctcctggctcgtcatgaagctcctccacgccggctacaccgtccgggcgaccgtgcgcgatcccgcgaacgtcgagaagacgaagccattgctggaccttcccggagcaacggagcgcctgtccttgtggaaagccgacctggcggtggaaggcagcttcgacgacgccatcaggggctgcaccggcgtcttccacgtcgccacgcccatggacttcgagtccaaagaccctgagaatgaggtaatcaagccgactgtcgaagggatgataagcatcatgcaagcctgcaaggaggccggcaccgtacgtcgcatcgtcttcacttcctccgctgggactgtcaacgtcgaggagcggcggaagcccgtctacgacgaggacagctggaccgacgtcgatttctgccgtcgcgtcaagatgaccggatggatgtacttcgtgtctaaaaccctagcggagaaggcggccatggcgtacgcggcggagcacggcgtggacctcatcaccgtcatcccgacgctcgtggtcggccctttcctcagcgccggcatgccgcccagccttgtcacggcgatggcgctcgtcaccgggaacgaggcccactactcgatcctgaagcaggtgcagttcatccacctcgacgacctctgcgacgcccacctgttcctcttcgagcacccggccgccgccgggcgctacgtctgctccgcggccgacgccaccatacacggcctcgccgccatgctgagggagaggtaccccgagtacaacatcccgcggaggttccctgggatcgacgacgacctccagctcgtgcgcttctcgtccaagaagctcctagaccatgggttcactttcaggtacacgacgatggagaacatgtacgacgccgccatccggacatgccgggagaagggcctcatccccctcgccactgccggaggggaaggtggctctgcctccgcgggggcacccggtcccggtgggacagatgcggcaattagtgcttaa

SEQ ID NO: 5830 - protein, 362 aa, Sorghum bicolor
  misc_feature: Ceres ANNOT ID no. 6054767
  misc_feature (16)..(262): Pfam Id: Epimerase Pfam Desc: NAD dependent epimerase/dehydratase family
  misc_feature (18)..(246): Pfam Id: NAD_binding_4 Pfam Desc: Male sterility protein
  misc_feature (17)..(286): Pfam Id: 3Beta_HSD Pfam Desc: 3-beta hydroxysteroid dehydrogenase/isomerase family
  misc_feature (14)..(150): Pfam Id: adh_short Pfam Desc: short chain dehydrogenase
  misc_feature (3)..(341): NCBI GI: 2735842 NCBI Desc: nadph-dependent reductase a1-a [sorghum bicolor]
  misc_feature (5)..(352): NCBI GI: 2735843 NCBI Desc: nadph-dependent reductase a1-b [sorghum bicolor]
  misc_feature (5)..(362): NCBI GI: 3287296 NCBI Desc: dihydroflavonol4-reductase [zea mays]
  misc_feature (5)..(362): NCBI GI: 78172239 NCBI Desc: nadph-dependent reductase [zea mays]
  misc_feature (5)..(362): NCBI GI: 78172244 NCBI Desc: nadph-dependent reductase [zea mays]
  misc_feature (5)..(362): SWISSPROT Homolog: EC 1.1.1.219 Dihydroflavonol-4-reductase
  misc_feature: Up-regulated in shoot tissues in response to methyl jasmonate treatment
MAEAIEGGASATKGPVVVTGASGFVGSWLVMKLLHAGYTVRATVRDPANVEKTKPLLDLPGATERLSLWKADLAVEGSFDDAIRGCTGVFHVATPMDFESKDPENEVIKPTVEGMISIMQACKEAGTVRRIVFTSSAGTVNVEERRKPVYDEDSWTDVDFCRRVKMTGWMYFVSKTLAEKAAMAYAAEHGVDLITVIPTLVVGPFLSAGMPPSLVTAMALVTGNEAHYSILKQVQFIHLDDLCDAHLFLFEHPAAAGRYVCSAADATIHGLAAMLRERYPEYNIPRRFPGIDDDLQLVRFSSKKLLDHGFTFRYTTMENMYDAAIRTCREKGLIPLATAGGEGGSASAGAPGPGGTDAAISA

SEQ ID NO: 5831 - DNA, 900 bp, Sorghum bicolor
  misc_feature: Ceres ANNOT ID no. 6054777
  misc_feature: Encodes the peptide sequence at SEQ ID NO 5832
atggcgtaccaggtgctggaggtgacgctgatctcggccaaggacctgaagcgggtcacgttcttcaccaagatgcgcgtgtacgccgtggcgtccatctccggcggcgacccgcggctgccgacgcaccggacgtacgccgaccgcgaagggggacggaacccgatgtggcacgccccgctgcggttcaccatccctcccgccgccgacccgcgcggcctcgccctgcacgtgctgctccgcgccgagcgcgccttcggcgaccgcgacgtcggcgaggtggtcgtgcccatgcaggacctcgccgccgccgcctcgcccgagggcgccgccactaacggcaacgccaacgccaacgccgagcagaggcacctcagctacgaggtgcgccgccccgtcagcggacgcaagcgcggcgtgctccacatctcctacaggctctccgacgcgccggcgccggacgcccacgccaaccacccgtacgcgcaccacgccccgccggcgtcgtccaagcggcaccacggcaagggcgccaacgccgccatcaccgcgtacccggtggcggccccgggcggcagcgcgcggcagtacccgccgtaccaccagccgtacggtcctggacctggagctccctacggcggccccgccggagcgtacccgcagcaccaccaccagtacgggtacggcgcgtatggctacggcgccgcgccgcacggtgcggtgccgtacaggtacgcgggccacggcgcggcgccggcggcgaggtccggcggagggctgggctcggcggcggggctcgggctcggcctcctcggcgggttgatgatcggcgacatgatcggcgacgccgaggtggacgcggcgtacgacggcgggttcatggacggcatgggcttctga

SEQ ID NO: 5832 - protein, 299 aa, Sorghum bicolor
  misc_feature: Ceres ANNOT ID no. 6054777
  misc_feature (6)..(95): Pfam Id: C2 Pfam Desc: C2 domain
  misc_feature (1)..(299): NCBI GI: 115436586 NCBI Desc: os01g0369500 [oryza sativa (japonica cultivar-group)]
  misc_feature (2)..(253): NCBI GI: 102139812 NCBI Desc: c2 domain-containing protein / xyppx domain-containing protein [musa acuminata]
  misc_feature (1)..(259): NCBI GI: 15408785 NCBI Desc: p0492g09.1 [oryza sativa (japonica cultivar-group)]
  misc_feature (1)..(299): NCBI GI: 2055230 NCBI Desc: src2 [glycine max]
  misc_feature (1)..(298): NCBI GI: 93115321 NCBI Desc: src2-like protein [nicotiana benthamiana]
MAYQVLEVTLISAKDLKRVTFFTKMRVYAVASISGGDPRLPTHRTYADREGGRNPMWHAPLRFTIPPAADPRGLALHVLLRAERAFGDRDVGEVVVPMQDLAAAASPEGAATNGNANANAEQRHLSYEVRRPVSGRKRGVLHISYRLSDAPAPDAHANHPYAHHAPPASSKRHHGKGANAAITAYPVAAPGGSARQYPPYHQPYGPGPGAPYGGPAGAYPQHHHQYGYGAYGYGAAPHGAVPYRYAGHGAAPAARSGGGLGSAAGLGLGLLGGLMIGDMIGDAEVDAAYDGGFMDGMGF

SEQ ID NO: 5833 - DNA, 1473 bp, Sorghum bicolor
  misc_feature: Ceres ANNOT ID no. 6054788
  misc_feature: Encodes the peptide sequence at SEQ ID NO 5834
atgagcaccgcctccggcgacggcgcggacgccggcggcgacggggcctcctctgcagcggccggcgcgtcggcgcccgcggggaggcggatcccgcccgcctcgtccatgccgtgggtccgcaacctccgccgcttcgtcggcacgggcgccggcctcggatccgaggccctcatggaactggagactaaaaggatattgcttgagattttcaaggagcggcagcggaagagtgccgaagctggttccatcccaagtttttacaagaagaaacctgaagaaggatccattagctctagagttcagaggttggccaagtacaggtttctaaagaaacaatcagagcttctgctgaatgctgatgatcttgatgccatgtgggtttgtcttagagaaaattgtgttattgatgatgctactggtgctgaaaagatgaattatgaagatttctgccatattgccacagtctgcacggagcagattggtcagaaatgcaaacgtttcttcagcccttcaaactttatgaagtttgagaaggatgattctgggaggattgctatcctaccattttatctttatgtcatgcgaacagtttctcttactcaagcaagaattgatatgagtgagcttgatgaggattctgatggtttccttcagcctcatgaaatggaagcatatattagaggactcatccccaatttggcacaattgcgtgacatgcccactgcatttgtccagatgtactgccgtatagctgcacgcaagttctttttcttctgtgatccacacagacgggggaaagcatgtataaagaaagtgttgctgagcaattgtcttcaagagctaatggaactacatcaggagagcgaggaagaggtaaccgataccgagcaggcagaaaattggttttccttaacttcagctcagcgcatatgtgacatgtttcttgcactagataaggatactaatggtacactgagcaaacaagagctcaaggaatatgcagatggcacattgactgagattttcattgaaagagtttttgatgagcatgtccgccggagcaaagttggaggtggaaacagtcgtgagatggactttgaaagctttcttgattttgttttggctctagaaaacaaagatacccctgaaggcctgacatatttatttagatgccttgatcttaatggaagagggttccttacaactgcagatatccatactttatttagagacgtacaccagaaatggattgagggcgggaactatgagctttgcatcgaagatgtgagggatgaaatctgggacatggtgaagcccgcagatcctctcaggatctcgctgccagatcttctttcttgcaagcaaggcgggactatcgccagcatgcttatagatgtgcgtggcttctgggcccacgacaacagggagaaccttctccaggaagaggaagagcaagtggaagaggcatga

SEQ ID NO: 5834 - protein, 490 aa, Sorghum bicolor
  misc_feature: Ceres ANNOT ID no. 6054788
  misc_feature (37)..(485): NCBI GI: 49522574 NCBI Desc: mgc89101 protein [xenopus tropicalis]
  misc_feature (37)..(485): NCBI GI: 30172460 NCBI Desc: chromosome 14 open reading frame transcript variant 1 [homo sapiens]
  misc_feature (51)..(485): NCBI GI: 41055993 NCBI Desc: similar to phosphatase subunit gene g4-1 [danio rerio]
  misc_feature (141)..(485): NCBI GI: 39645832 NCBI Desc: c14orf10 protein [homo sapiens]
  misc_feature (84)..(489): NCBI GI: 116122808 NCBI Desc: ensangp00000030355 [anopheles gambiae str. pest]
MSTASGDGADAGGDGASSAAAGASAPAGRRIPPASSMPWVRNLRRFVGTGAGLGSEALMELETKRILLEIFKERQRKSAEAGSIPSFYKKKPEEGSISSRVQRLAKYRFLKKQSELLLNADDLDAMWVCLRENCVIDDATGAEKMNYEDFCHIATVCTEQIGQKCKRFFSPSNFMKFEKDDSGRIAILPFYLYVMRTVSLTQARIDMSELDEDSDGFLQPHEMEAYIRGLIPNLAQLRDMPTAFVQMYCRIAARKFFFFCDPHRRGKACIKKVLLSNCLQELMELHQESEEEVTDTEQAENWFSLTSAQRICDMFLALDKDTNGTLSKQELKEYADGTLTEIFIERVFDEHVRRSKVGGGNSREMDFESFLDFVLALENKDTPEGLTYLFRCLDLNGRGFLTTADIHTLFRDVHQKWIEGGNYELCIEDVRDEIWDMVKPADPLRISLPDLLSCKQGGTIASMLIDVRGFWAHDNRENLLQEEEEQVEEA

SEQ ID NO: 5835 - DNA, 1656 bp, Sorghum bicolor
  misc_feature: Ceres ANNOT ID no. 6054789
  misc_feature: Encodes the peptide sequence at SEQ ID NO 5836
atggcggcgctcctcgacgccggcctcttcgggcccgcccaaacgctggggtgtttccttgtgtcgtcggcgggtgcgggcaacgatgctggcatgtccatgaaggtggagagcctggtccagcatggtgatgctttgtatggagagagagaatttcgcagggcactgaatgcgtacaagcaagctatgcaatatagtagaagtatccctaggcaagcaacaagtagcaccagaagttcagtatccgccacaggccgatcaccttctccgaattcttcgaatctcttatcattcaatgaaaatgaggtgaagttcaagattgctctctgccattctgctctatgtgagcaccgtgaagcacttcatgagatggaaggtattccttcgaaagtgagaacattaaaaatgaatatgatgttagggaagctatatcgaatatcaagaaatagtcgcacagctgctgtctgttataaggagtgcttgaggcaatgcccttatgttttcgaagctatcacagctttggcggaaatggggctttcagcaaaggaattttctttattatttccacaagcaccaaatagaggaggcaaggtgccgggtgactttgtagatgcacaacgttggtggactcgttatgttgaggcacagtgctgcattgcttcacatgattataaaggtggccttgacatatatctagaactaatgcaacggttccccaataatgtgcatatcttgctggagattgctaaggttgaagccatcataggcaggaatgatgaagcaataatgaactttgagaaggcccgtttgattgatccaaacattatgacatatatggatgagtatgcaattctactgaagtcaaagtctgactacgtcaaactgaataagttggtacatgatatgctgcatattgatcctgcgagaccagagacatgtgttgctcttgcagcaatgtggaaaagaaaggataaaagaaaagctttgacatatgcagaaaagagcctccgagttgatgacaggcatataactggctatattatgaagggcaatttgcatctttcattgaatcgaccagatttggcagtgacagacttcaggggggctcaagaattgagagctgatcttcgttcttatcaaggtttggtgtgtgcttatgtagcactttctaaatgcaaagaagcattattcactgcacgtgaggcaatgaaggttatgcatcagtctgcaaaagctctcaagctagttggcgatgttcatgcaattagttccagtgggagggagaaggcaagaaagttctatgaatcagccattcgtcttgaacctggatttcttggagctgcactggccctggctgatctgcatgttgtggaaggacggaacaaggaggctgttatgctacttgaaaaatatctaagacaatgggcagacgattctctacacatcaagttggctcaagtgcatgcgtcaacaaatatgctttctgatgcactttcccattatcaatctgccctaagaataaacccacaaaatgaagctgcaaagaatggattggagcgcttggaaaaacaaatgaagggagtggacccagatgctccggaagaggaggaagagaatgaggaggatgatatcgatgatcgagatgagtttatttga

SEQ ID NO: 5836 - protein, 551 aa, Sorghum bicolor
  misc_feature: Ceres ANNOT ID no. 6054789
  misc_feature (478)..(511): Pfam Id: TPR_2 Pfam Desc: Tetratricopeptide repeat
  misc_feature (123)..(549): NCBI GI: 115462123 NCBI Desc: os05g0149900 [oryza sativa (japonica cultivar-group)]
  misc_feature (356)..(549): NCBI GI: 3355640 NCBI Desc: ivr-like protein [nicotiana tabacum]
  misc_feature (7)..(548): NCBI GI: 62858677 NCBI Desc: loc549081 [xenopus tropicalis]
  misc_feature (7)..(548): NCBI GI: 51950161 NCBI Desc: mgc81861 protein [xenopus laevis]
  misc_feature (7)..(548): NCBI GI: 50417494 NCBI Desc: anapc7-prov protein [xenopus laevis]
  misc_feature: Useful for making plants with altered Lignin content
  misc_feature: Useful for making plants with altered cell wall content and/or composition
  misc_feature: Functional homolog of the protein sequence given in SEQ ID NO 13206
  misc_feature: Functional homolog of the protein sequence given in SEQ ID NO 13207
  misc_feature: The sequence is a functional homolog of SEQ ID NO. 298 in the 11/188,298 US application
MAALLDAGLFGPAQTLGCFLVSSAGAGNDAGMSMKVESLVQHGDALYGEREFRRALNAYKQAMQYSRSIPRQATSSTRSSVSATGRSPSPNSSNLLSFNENEVKFKIALCHSALCEHREALHEMEGIPSKVRTLKMNMMLGKLYRISRNSRTAAVCYKECLRQCPYVFEAITALAEMGLSAKEFSLLFPQAPNRGGKVPGDFVDAQRWWTRYVEAQCCIASHDYKGGLDIYLELMQRFPNNVHILLEIAKVEAIIGRNDEAIMNFEKARLIDPNIMTYMDEYAILLKSKSDYVKLNKLVHDMLHIDPARPETCVALAAMWKRKDKRKALTYAEKSLRVDDRHITGYIMKGNLHLSLNRPDLAVTDFRGAQELRADLRSYQGLVCAYVALSKCKEALFTAREAMKVMHQSAKALKLVGDVHAISSSGREKARKFYESAIRLEPGFLGAALALADLHVVEGRNKEAVMLLEKYLRQWADDSLHIKLAQVHASTNMLSDALSHYQSALRINPQNEAAKNGLERLEKQMKGVDPDAPEEEEENEEDDIDDRDEFI

SEQ ID NO: 5837 - DNA, 1776 bp, Sorghum bicolor
  misc_feature: Ceres ANNOT ID no. 6054793
  misc_feature: Encodes the peptide sequence at SEQ ID NO 5838
atgggccgcggcggcggctcgcgcgcggccccggccgccacggcgccgccgtggcacgtgctcccggacgaggtctgggagcacgccttctccttcctccccgcggactcggaccggggcgccgccgccgccgcctgccgctcctggctccgcgccgagcgccgctcgcgccgccgcctcgccgtcgccaactgctacgccgcgtccccgcaggacgccgtcgaccgcttcccggccgtacgcgccgtcgaggtcaagggcaagccccacttcgccgactttgggctcgtcccgccagcctggggcgccgccgccgcgccatgggtcgccgcagccgccgacggctggccgctgctcgaggagattagcttcaagcgcatggtcgtcaccgacgactgcctcgagatgatcgccgcctccttcagaaacttccaggtgctgcgcctcgtctcctgcgagggcttcagtaccgccgggctcgctgccattgccgccggttgcagaaatctaagagaacttgaccttcaggagaatgagattgaggattgctctattcattggctcagtctctttccagaatccttcacttctttggtaactctaaatttttcatgcctagagggggatgtcaatatcactgtacttgaaagactagtaaccagatgttgcaatctcaagactctcaagctcaacaatgctatacctcttgacaagcttgctaacctccttcgcaaagctcctcagattgtagaacttggaacaggaagattctctgcggattaccatccggatctcttttcaaagcttgaagcagcatttgctggttgtaaaagcttaagaaggctctctggggcttgggatgccgttccagaatacctgccagcattttactgtgtatgtgagggcctcacatcactaaatctgagctacgctactgtacgaggccctgaactgattaaattcattagcagatgcaaaaatttgcagctcttatgggtgatggacttgattgaagaccatggtctagctgttgtggcatcatcttgtaataaactgcaggagttgcgggtcttcccttctgctccttttgatgcagctgagcaggtttctttaactgaaagaggtcttgttgacgtctctgctagttgcccaatgctggagtcagtcctctacttctgcagacggatgaccaatgaggcccttattaccattgcaaagaaccggcccaactttacttgcttccgcctatgcatcattgagcctcacactccagactacactacacaccagcctcttgatgcaggttttagtgccattgtggaatcatgcaagggccttaggcggctttctgtttcaggccttctcacagatagtttatttaaatccatcggggctcatgctgatcgtcttgagatgctctcgattgcctttgctgggaacagtgatttgggcctgcattacatcctatcgggctgcaagagcttgaagaagctagagatcagggactgcccatttggtgataagcccttgctggcaaatgctgccaagctggagacaatgcgatccctttggatgtcgacgtgctcactgaccctgggcgcatgccgacagcttgcacgcaagatgccccgccttagtgtggaggtcatgaatgatcctcgacggggatgccccttggactctctcacagatgagagccctgtcgagacattgtatgtctaccggacaattgcaggtccaaggtctgacacaccagcctgtgtccagattgtctaa

SEQ ID NO: 5838 - protein, 591 aa, Sorghum bicolor
  misc_feature: Ceres ANNOT ID no. 6054793
  misc_feature (1)..(581): NCBI GI: 115462133 NCBI Desc: os05g0150500 [oryza sativa (japonica cultivar-group)]
  misc_feature (22)..(588): NCBI GI: 109729860 NCBI Desc: transport inhibitor response 1 [gossypium hirsutum]
  misc_feature (22)..(588): NCBI GI: 12658970 NCBI Desc: grr1-like protein 1 [arabidopsis thaliana]
  misc_feature (22)..(588): NCBI GI: 110225915 NCBI Desc: auxin-responsive factor tir1-like protein [populus tomentosa]
  misc_feature (22)..(588): NCBI GI: 92887633 NCBI Desc: cyclin-like f-box [medicago truncatula]
  misc_feature: Useful for making plants with altered carbohydrate content
  misc_feature: Functional homolog of the protein sequence given in SEQ ID NO 13641
MGRGGGSRAAPAATAPPWHVLPDEVWEHAFSFLPADSDRGAAAAACRSWLRAERRSRRRLAVANCYAASPQDAVDRFPAVRAVEVKGKPHFADFGLVPPAWGAAAAPWVAAAADGWPLLEEISFKRMVVTDDCLEMIAASFRNFQVLRLVSCEGFSTAGLAAIAAGCRNLRELDLQENEIEDCSIHWLSLFPESFTSLVTLNFSCLEGDVNITVLERLVTRCCNLKTLKLNNAIPLDKLANLLRKAPQIVELGTGRFSADYHPDLFSKLEAAFAGCKSLRRLSGAWDAVPEYLPAFYCVCEGLTSLNLSYATVRGPELIKFISRCKNLQLLWVMDLIEDHGLAVVASSCNKLQELRVFPSAPFDAAEQVSLTERGLVDVSASCPMLESVLYFCRRMTNEALITIAKNRPNFTCFRLCIIEPHTPDYTTHQPLDAGFSAIVESCKGLRRLSVSGLLTDSLFKSIGAHADRLEMLSIAFAGNSDLGLHYILSGCKSLKKLEIRDCPFGDKPLLANAAKLETMRSLWMSTCSLTLGACRQLARKMPRLSVEVMNDPRRGCPLDSLTDESPVETLYVYRTIAGPRSDTPACVQIV

SEQ ID NO: 5839 - DNA, 900 bp, Sorghum bicolor
  misc_feature: Ceres ANNOT ID no. 6054798
  misc_feature: Encodes the peptide sequence at SEQ ID NO 5840
atgccctttactgggtctgcccctgctttcatagctaggctggttggggtccggtcaagctgctgtcctccttcccgtgcatttgcggctgtcagagctcaaaagattcagcttcccaagaaaaaaaggcgattggatgaagtgtgcttaggaaggtttcaacaatacagtagaacatacatccagtcatggattcttcaaggtaaagtcattgtggatggaagagttgtgaataaagctggaacacaagtatctgacaagtctgtcattgaaatcaaggctgaaatcccaaaatatgtatgtagagcaggacataagctcgaggcagctatcaaaggatttgatattgattgtgatggaaagatagcccttgattcaggattatctacaggtggctttactgactgtttacttcagcatggagcatcacatgtttatggtgtagatgttggctatggacaggtggctgaaaaaattcgcacacatgaacgtgtttcagtgatcgaacgcacaaatttaagatatctatctcaactgccagaactggttgacttggtgacactggacctatcatttatctccattctcttggtcatgcctgctgttatcaaagtaatgaagacggattctacattggtaacacttatcaagcctcaatttgaagcacgtagatcacaggtaggaggtggagggattgttcgagatcctctggttcataaagaggtactggatagaataatttcaggcgtggaagaatttggattctgcaacaagggctggattgaatctcctataaagggtgcagaagggaataaggagtttcttgcttgctttcacaggatccgagtatcagagtcacagcaagaggtagagatagaggcaaaggaacctgtaacctag

SEQ ID NO: 5840 - protein, 299 aa, Sorghum bicolor
  misc_feature: Ceres ANNOT ID no. 6054798
  misc_feature (99)..(282): Pfam Id: FtsJ Pfam Desc: FtsJ-like methyltransferase
  misc_feature (43)..(90): Pfam Id: S4 Pfam Desc: S4 domain
  misc_feature (38)..(292): NCBI GI: 114844755 NCBI Desc: hemolysin a [thermoanaerobacter ethanolicus x514]
  misc_feature (38)..(275): NCBI GI: 76796738 NCBI Desc: hemolysin a [thermoanaerobacter ethanolicus atcc 33223]
  misc_feature (38)..(286): NCBI GI: 82749345 NCBI Desc: hemolysin a [clostridium beijerincki ncimb 8052]
  misc_feature (38)..(280): NCBI GI: 109645428 NCBI Desc: hemolysin a [desulfitobacterium hafniense dcb-2]
  misc_feature (42)..(275): NCBI GI: 118743814 NCBI Desc: hemolysin a [geobacter lovleyi sz]
MPFTGSAPAFIARLVGVRSSCCPPSRAFAAVRAQKIQLPKKKRRLDEVCLGRFQQYSRTYIQSWILQGKVIVDGRVVNKAGTQVSDKSVIEIKAEIPKYVCRAGHKLEAAIKGFDIDCDGKIALDSGLSTGGFTDCLLQHGASHVYGVDVGYGQVAEKIRTHERVSVIERTNLRYLSQLPELVDLVTLDLSFISILLVMPAVIKVMKTDSTLVTLIKPQFEARRSQVGGGGIVRDPLVHKEVLDRIISGVEEFGFCNKGWIESPIKGAEGNKEFLACFHRIRVSESQQEVEIEAKEPVT

SEQ ID NO: 5841 - DNA, 879 bp, Sorghum bicolor
  misc_feature: Ceres ANNOT ID no. 6054801
  misc_feature: Encodes the peptide sequence at SEQ ID NO 5842
atggcgcagatcatcgacggcaaggccatcgccgccgacatccgccgcgaggtcgccgccgatgtggccgcgctctcctcggcccacggactcgtgccggggctggccgtggtcatcgtggggagcaggaaggactcgcagacgtacgtgaacatgaagcgcaaggcgtgcgccgaggtcggcatctgctccatcgacgtcgacctccccgaggacatctccgagcccgcgctcgtcgccgaggttcatcgcctcaacgccgaccccgccgtgcacgggatccttgtccagcttccacttcctaagcacatcaatgaagaaaagatactgaacgagatcagcattgaaaaagatgttgatgggtttcatcctctcaatattggcaagcttgcaatgaaaggcagagagccactgttccaaccatgtacaccaaagggatgcatggagctcttgtcaaggagtggagtcactgttaaaggtaaacgggcagttgtggttggacgcagcaacattgtcgggttacctgtatccctgcttcttctgaaggaagatgcgactgtatctattgtgcactcacggacccctgatccagaaagcattgtacgcgaagctgacatagtcattgcagcagctgggcaggctatgatgatcaaaggggattggatcaagccaggtgctgcggtcatcgatgttgggacaaactctgttgatgaccctacccggaagtctgggtaccgacttgttggcgatgtagattttgcagcagtgagcaaggttgctggttacctgactccggttccaggaggcgttggcccaatgacggttgctatgctgctgaagaacacggtggatggggcaaagcggggaatagtcgagtag

SEQ ID NO: 5842 - protein, 292 aa, Sorghum bicolor
  misc_feature: Ceres ANNOT ID no. 6054801
  misc_feature (123)..(290): Pfam Id: THF_DHG_CYH_C Pfam Desc: Tetrahydrofolate dehydrogenase/cyclohydrolase, NAD(P)-bindingdomain
  misc_feature (3)..(120): Pfam Id: THF_DHG_CYH Pfam Desc: Tetrahydrofolate dehydrogenase/cyclohydrolase, catalyticdomain
  misc_feature (1)..(290): NCBI GI: 6002383 NCBI Desc: 5,10-methylenetetrahydrofolate dehydrogenase: 5,10-methenyltetrahydrofolate cyclohydrolase [pisum sativum]
  misc_feature (2)..(288): NCBI GI: 115443867 NCBI Desc: os02g0120900 [oryza sativa (japonica cultivar-group)]
  misc_feature (2)..(288): NCBI GI: 87162643 NCBI Desc: tetrahydrofolate dehydrogenase/cyclohydrolase [medicago truncatula]
  misc_feature (4)..(288): NCBI GI: 3786006 NCBI Desc: methylenetetrahydrofolate dehydrogenase [arabidopsis thaliana]
  misc_feature (2)..(287): NCBI GI: 48716904 NCBI Desc: methylenetetrahydrofolate dehydrogenase-like [oryza sativa (japonica cultivar-group)]
MAQIIDGKAIAADIRREVAADVAALSSAHGLVPGLAVVIVGSRKDSQTYVNMKRKACAEVGICSIDVDLPEDISEPALVAEVHRLNADPAVHGILVQLPLPKHINEEKILNEISIEKDVDGFHPLNIGKLAMKGREPLFQPCTPKGCMELLSRSGVTVKGKRAVVVGRSNIVGLPVSLLLLKEDATVSIVHSRTPDPESIVREADIVIAAAGQAMMIKGDWIKPGAAVIDVGTNSVDDPTRKSGYRLVGDVDFAAVSKVAGYLTPVPGGVGPMTVAMLLKNTVDGAKRGIVE

SEQ ID NO: 5843 - DNA, 1785 bp, Sorghum bicolor
  misc_feature: Ceres ANNOT ID no. 6054805
  misc_feature: Encodes the peptide sequence at SEQ ID NO 5844
atgccgacggtgagcgtcggccgggaccgtctcttcgcggccctgggtcggacctacacgcaggaggagttcgaggcgctctgcttcgagttcggcatcgagctggacgatgtgacgacggagaaggctattatcaggaaggagaagcacctcgaggacgacggcgaggtggacgacgatgacgaggtcatctacaagatagaggtcgccgccaacagatatgatttgctatgtcttgaagggttagcaagagctcttcgtgttttcacggggactgaaccaagccctgtattccaagtttcatccatccctcgtggttcaattcttcagatgcatgttaaaccagagacttcaaaaattagaccatatgtagtttgtgctgttctaagaggggtaacttttgacgaagcaagatacaacagcttcattgatcttcaagacaaactccaccaaaatatctgccggaagagaactcttgttgctattggcacccatgatctagacactctgcgaggacccttctcatatgaggctctaccaccacatgaaatcaactttgttccattaaagcaggagaaaagcttcagagctgataaactgatggaattctataaatcagacatgaaactgaagaagttcttgcatataattgagaattctcccgtgtacccagttatctatgatagcaacaggactgtattatcattacctcctatcatcaatggtgcacattcagctatcacccttgcaacaaggaatgtctttattgaatgtacagctactgaccttaccaaagcaaatatagttctgaatacaatggttaccatgttctctgagtattgtgagactaaatttgaagtggaacctgttgaagtggtacatcctgatggcaggaaaacagtttaccccgatctttcatgttacaaaatggatgtttcattatctgacattcttgggcctattggcatctcccaggacgaaaaacaggttgtctgtcttttgaataaaatgcaactgcaagctgaaagtcactcattgaagggggagcctcgcatttcagtgtctgttcctccaacaagaagtgatattctgcatgcccgggatttgtcggaggacgttgctatagcttatggattcaacaatgtgccaaaatcaaagccaaagtgtatgacaataggaggaagacaaccattaaacaggttctcagataaaattcgtgccgaggttgcaagagctggttacatggaggtgctcacatttatcttgtcttcacacgaagaaaactttgacatgttaaacagagcagatgataaaagtaaagcagtcattatcgcaaaccctcgcacttctgaattcgaggttgttagaactagtctgatgtcgtgtttattgaaaacactgaaacataatatagaccatccaagacctataaagatttttgaagttggtgatgttgtgatgctggactcgtcacgtgatgttggtgcctctaataatcgcaggcttgcagctttgtactgcaatagggtttctggatttgaggaaatcatgggattggtggatagtattgtcaaagttgtcagagctccgcacgtcaactttggcgagaattactatgtacctacagatgaacctgagttcttccctaaaagacaatgcaaaattgttacaagtgatggcaagcaagttggctacttaggaattgtccatgctgaggtgctaaggaaatttggcattccggatccctgcactttcgttgagatggacctcgaagcactgttgtag

SEQ ID NO: 5844 - protein, 594 aa, Sorghum bicolor
  misc_feature: Ceres ANNOT ID no. 6054805
  misc_feature (307)..(379): Pfam Id: B5 Pfam Desc: tRNA synthetase B5 domain
  misc_feature (120)..(282): Pfam Id: B3_4 Pfam Desc: B3/4 domain
  misc_feature (1)..(594): NCBI GI: 92878505 NCBI Desc: b3/4 [medicago truncatula]
  misc_feature (1)..(572): NCBI GI: 30698883 NCBI Desc: trna synthetase beta subunit family protein [arabidopsis thaliana]
  misc_feature (1)..(594): NCBI GI: 55715799 NCBI Desc: zgc:92055 [danio rerio]
  misc_feature (1)..(591): NCBI GI: 21355211 NCBI Desc: cg5706-pa [drosophila melanogaster]
  misc_feature (1)..(591): NCBI GI: 108879755 NCBI Desc: phenylalanyl-trna synthetase beta chain [aedes aegypti]
  misc_feature (1)..(594): SWISSPROT Homolog: EC 6.1.1.20 Phenylalanyl-tRNA synthetase beta chain
MPTVSVGRDRLFAALGRTYTQEEFEALCFEFGIELDDVTTEKAIIRKEKHLEDDGEVDDDDEVIYKIEVAANRYDLLCLEGLARALRVFTGTEPSPVFQVSSIPRGSILQMHVKPETSKIRPYVVCAVLRGVTFDEARYNSFIDLQDKLHQNICRKRTLVAIGTHDLDTLRGPFSYEALPPHEINFVPLKQEKSFRADKLMEFYKSDMKLKKFLHIIENSPVYPVIYDSNRTVLSLPPIINGAHSAITLATRNVFIECTATDLTKANIVLNTMVTMFSEYCETKFEVEPVEVVHPDGRKTVYPDLSCYKMDVSLSDILGPIGISQDEKQVVCLLNKMQLQAESHSLKGEPRISVSVPPTRSDILHARDLSEDVAIAYGFNNVPKSKPKCMTIGGRQPLNRFSDKIRAEVARAGYMEVLTFILSSHEENFDMLNRADDKSKAVIIANPRTSEFEVVRTSLMSCLLKTLKHNIDHPRPIKIFEVGDVVMLDSSRDVGASNNRRLAALYCNRVSGFEEIMGLVDSIVKVVRAPHVNFGENYYVPTDEPEFFPKRQCKIVTSDGKQVGYLGIVHAEVLRKFGIPDPCTFVEMDLEALL

SEQ ID NO: 5845 - DNA, 765 bp, Sorghum bicolor
  misc_feature: Ceres ANNOT ID no. 6054810
  misc_feature: Encodes the peptide sequence at SEQ ID NO 5846
atggccgattccaccaccaacgacgccccggtcgtcaacagccagcccaccacggaggaggaggtgacggtggagagggcggcggcggcggcggaggaggaggaggagaggctgcggtacctcgagttcgtgcagcaggcggcggcgcaggcgctggtgctggcggccgcggcctacgcgtacgccaagcagggcgcggggccgctccgccccggcgttgaccatgtcgagggcaccgtcaaggctgtcgtcgggccggtgtatgaccgcttccatgccgtcccgcttgacctcctcaagttcatcgatcgcaaggttggtgagtccgttgaggagatagaccgccgcgttcctccagtggtgaaggaagccccaacccttgcccgctcggctgcaaaggaggttcgtgaggccggccttgtgggtacggccacaggccttgccaagtcagccattgcccgcgcggagccaaaggccagggagctctacacccgctatgagcccgtggcagagcgccgtgctgcggaagcctgggtggccctgaaccgccttccgctggtgccttcagtcaccagggctgtcctccccacagccgcgcagctctcagccaggtacaattcagcggtgcgtgatggtgccaagcgcgggaacactgtggccacctatctcccgcttgtgcccactgagcggctcgcccgggtgttcccgtaccccatggctgatgttgccccagcaccagagatgcagcctatcccctcccagtag

SEQ ID NO: 5846 - protein, 254 aa, Sorghum bicolor
  misc_feature: Ceres ANNOT ID no. 6054810
  misc_feature (29)..(239): Pfam Id: REF Pfam Desc: Rubber elongation factor protein (REF)
  misc_feature (34)..(235): NCBI GI: 5802955 NCBI Desc: stress related protein [vitis riparia]
  misc_feature (33)..(235): NCBI GI: 87162885 NCBI Desc: rubber elongation factor [medicago truncatula]
  misc_feature (33)..(235): NCBI GI: 33332330 NCBI Desc: rubber synthesis protein [parthenium argentatum]
  misc_feature (30)..(235): NCBI GI: 3319925 NCBI Desc: hev b 3 [hevea brasiliensis]
  misc_feature (90)..(244): NCBI GI: 37622210 NCBI Desc: small rubber particle protein [hevea brasiliensis]
MADSTTNDAPVVNSQPTTEEEVTVERAAAAAEEEEERLRYLEFVQQAAAQALVLAAAAYAYAKQGAGPLRPGVDHVEGTVKAVVGPVYDRFHAVPLDLLKFIDRKVGESVEEIDRRVPPVVKEAPTLARSAAKEVREAGLVGTATGLAKSAIARAEPKARELYTRYEPVAERRAAEAWVALNRLPLVPSVTRAVLPTAAQLSARYNSAVRDGAKRGNTVATYLPLVPTERLARVFPYPMADVAPAPEMQPIPSQ

SEQ ID NO: 5847 - DNA, 1383 bp, Sorghum bicolor
  misc_feature: Ceres ANNOT ID no. 6054812
  misc_feature: Encodes the peptide sequence at SEQ ID NO 5848
atggcagatgaggaacaagccccaagctctaggaagagggttgcaggtacccaaatcaacaaggataatcctgagcctgatgatgatggaccagagccagagatgggtacatttaagaaagccactgaggaagttatggcaacccggagaattgtaaaggttcggcgccagcagacttcatcagctccttcttctaatcctttctctgcaatcagatttgcccccactgattctggtgctcaaacaagcgcccctgtcccagaggatgtcaaagctgatgagggaagtaatggtaatgagaaagatactttgtctgtgccagacaagaatgcaggctctggtgtaaatactgactctggtgccacaactgaagcaccacctcaacctgttgaaaccagtgacaaggcagaagacacaaaggatgaatctggtggagacaaagtggtagttggagaacccaatgaaggtagctgcatgccatctgaagttgagggcaaaccaaaagagggagatgctgaagaaacagaaggggcagatgaagctggaaataatgataaaattagcaagaatgatactgagaagaaagatggaggtgaatcagagaccaaggatggcctgtctgatgagcagagagatgctgataaaattggcaaggatgatactgagaagaaagatggaggtgaatcagagcagaaagatgctgataacaaagggcaggcatcatcagcggcaccccttttctcgtttaagaatctgtcaagtggtcaaaatgctttcacaggtctgaccggaactggattttcaagcacctcattctcgtttggctcagtgtctaaagatggctcaagtgctggtcccctatttgggctgaaaactgatggttcttcgttcccttcttttaatcttggtgcttctaacaacgggagttccgccacagcgcttgctacttcagcagaggcacccaagaaatttgctatgaccgagggccctgttgaaactggtgaagaaaatgagaaggctgtatttactgctgactctgctttgtacgagtacctagatggtggctggaaagaaagaggaaaaggtgaactgaagctgaacgtccctgtatctggcggcgagagagcccggctcgtcatgaggacaaaaggcaactaccggctggtcctgaatgcaagcctctacaacgacatgtcactcaaggacatggacaagaagggcgtgacatttgcctgcatgaacagcattggggagtcgccgagcagccttgccacatttgctctgaagttcaaggacacagccaccagggaggaattcaaggatgcggtggagtctcacaagacaagcaaggcaccggacgtggccgccgaagacgacgcctga

SEQ ID NO: 5848 - protein, 460 aa, Sorghum bicolor
  misc_feature: Ceres ANNOT ID no. 6054812
  misc_feature (10)..(300): Pfam Id: NUP50 Pfam Desc: NUP50 (Nucleoporin 50 kDa)
  misc_feature (330)..(449): Pfam Id: Ran_BP1 Pfam Desc: RanBP1 domain
  misc_feature (218)..(459): NCBI GI: 116129296 NCBI Desc: ensangp00000010912 [anopheles gambiae str. pest]
  misc_feature (12)..(268): NCBI GI: 108878649 NCBI Desc: nucleoporin [aedes aegypti]
  misc_feature (134)..(401): NCBI GI: 44982574 NCBI Desc: adl060wp [eremothecium gossypii]
  misc_feature (134)..(401): NCBI GI: 45187813 NCBI Desc: adl060wp [eremothecium gossypii]
  misc_feature (331)..(454): NCBI GI: 108873961 NCBI Desc: ran-binding protein [aedes aegypti]
MADEEQAPSSRKRVAGTQINKDNPEPDDDGPEPEMGTFKKATEEVMATRRIVKVRRQQTSSAPSSNPFSAIRFAPTDSGAQTSAPVPEDVKADEGSNGNEKDTLSVPDKNAGSGVNTDSGATTEAPPQPVETSDKAEDTKDESGGDKVVVGEPNEGSCMPSEVEGKPKEGDAEETEGADEAGNNDKISKNDTEKKDGGESETKDGLSDEQRDADKIGKDDTEKKDGGESEQKDADNKGQASSAAPLFSFKNLSSGQNAFTGLTGTGFSSTSFSFGSVSKDGSSAGPLFGLKTDGSSFPSFNLGASNNGSSATALATSAEAPKKFAMTEGPVETGEENEKAVFTADSALYEYLDGGWKERGKGELKLNVPVSGGERARLVMRTKGNYRLVLNASLYNDMSLKDMDKKGVTFACMNSIGESPSSLATFALKFKDTATREEFKDAVESHKTSKAPDVAAEDDA

SEQ ID NO: 5849 - DNA, 1266 bp, Sorghum bicolor
  misc_feature: Ceres ANNOT ID no. 6054815
  misc_feature: Encodes the peptide sequence at SEQ ID NO 5850
atgggaatggggaccgcgagaggggccgcagggggctggctccccggcgagcggtggcggcgggtcctcttcctggcgctggcgtccgtctccttcctcatctcgctcatcctcctcttcctctccgcgccgcgcctccgcctcccgagcgtcgtcctgccttacaccgccgctgccgcttccgccgtccgccgcgggcccgacgcgccgccctgcctcgcgtacctcctaatcggcgcgcgcggcgacgggcgccgcctcctcaggctcctcctcgcggtctaccacccgcgtaaccggtacgtgctccacctctccgccgacgcgcccgacgacgagcgcctgagcctcgccgccggggtcgtcgccgctgcacccgctgtcggagcattcgagaacgttgctgttgtcggcaaacccaccgccgggacgcccgtggggtcctccgggctcgccggcacgctccgcgctgcggccgtgctgctccgactccacgccgactgggattggttcctcaccctcaatgccgcagattaccccctcgtcacacaggatgacctgattcatgtcctttcttctgttccaagggatcttaacttcattgaccacatgggtgacattgaatcaaaagaacctgagaaagtgcaacaaattatagttgatgctggaatttacttgtcagggaggaccaacttctttcgaggaacacagaaacgaccagctcctgaggcttttaagttctttacaggttctccatgggtcatattaaaccggcgatttatagagtactgcattcttgcttgggagaatctccctcggattcttctcatgtacttccacaacgtaatacaaccccaggaaggatatttccagtcagtcatctgcaactcgctggacttccgcaatttcactgtgaacaacgacttgaggttcatggtgcgggatgattccgctgaggcaaagccccttttcctgagcagagaacattacggccacatggtggatagtggggcaccttttgcaaggccgtttcaggagaatgatcctctgctggaccagatcgacagcaacatactcaagcgttggagccatggaacagttcctggtgcctggtgcacaggtaggaagaggtggttcagtgatccatgttcccagtggggcgatgtgaatattgtgagaccaggccctcaagcagtgatgttgcaacagtatgtaaatcggaccttagaagaagcaaagtctggcagcaactcatgcaggcggtag

SEQ ID NO: 5850 - protein, 421 aa, Sorghum bicolor
  misc_feature: Ceres ANNOT ID no. 6054815
  misc_feature (73)..(298): Pfam Id: Branch Pfam Desc: Core-2/I-Branching enzyme
  misc_feature (27)..(421): NCBI GI: 52353585 NCBI Desc: unknow protein [oryza sativa (japonica cultivar-group)]
  misc_feature (250)..(420): NCBI GI: 115462149 NCBI Desc: os05g0152400 [oryza sativa (japonica cultivar-group)]
  misc_feature (25)..(406): NCBI GI: 115457614 NCBI Desc: os04g0301700 [oryza sativa (japonica cultivar-group)]
  misc_feature (25)..(406): NCBI GI: 116308950 NCBI Desc: h0215e01.4 [oryza sativa (indica cultivar-group)]
  misc_feature (4)..(420): NCBI GI: 77556820 NCBI Desc: glycosylation enzyme-like protein [oryza sativa (japonica cultivar-group)]
  misc_feature: Useful for making plants with altered carbohydrate content
  misc_feature: Functional homolog of the protein sequence given in SEQ ID NO 13933
MGMGTARGAAGGWLPGERWRRVLFLALASVSFLISLILLFLSAPRLRLPSVVLPYTAAAASAVRRGPDAPPCLAYLLIGARGDGRRLLRLLLAVYHPRNRYVLHLSADAPDDERLSLAAGVVAAAPAVGAFENVAVVGKPTAGTPVGSSGLAGTLRAAAVLLRLHADWDWFLTLNAADYPLVTQDDLIHVLSSVPRDLNFIDHMGDIESKEPEKVQQIIVDAGIYLSGRTNFFRGTQKRPAPEAFKFFTGSPWVILNRRFIEYCILAWENLPRILLMYFHNVIQPQEGYFQSVICNSLDFRNFTVNNDLRFMVRDDSAEAKPLFLSREHYGHMVDSGAPFARPFQENDPLLDQIDSNILKRWSHGTVPGAWCTGRKRWFSDPCSQWGDVNIVRPGPQAVMLQQYVNRTLEEAKSGSNSCRR

SEQ ID NO: 5851 - DNA, 2523 bp, Sorghum bicolor
  misc_feature: Ceres ANNOT ID no. 6054832
  misc_feature: Encodes the peptide sequence at SEQ ID NO 5852
  misc_feature: Up-regulated in root tissues in response to salicylic acid treatment
atgaagggcgtcgacgatgcgttcctcggcgtcggcgacaagccagggctggacatttggtgcattgttgggagcagtctggtcccggttgcaaaaccccagcacggcaagttctacaccggcagcacctacatcatactgaatacaaccgagctgaaatccggggctcgtcgacacaatgtgcattactgggttggggaggaggccaaagaggacgattgcctcatggcctcagacaaggctgttgagttggacgcggcactgggctccagcacggtccagtacagggaaacacagggtgaagaatctgacaagttcttgtcatacttcaaaccgtgtgtcatcccagtacaaggctgcttcttttcacacctgaaaggatctggtgatagatccaacgcgaccacgatgtttagatgccaaggagagcacattgctcgcgtcacacaaattccatttacgcggtcctctctggatcacaaatcggtttttatagtggacacgccgtcgaagatcttccttttcagtggctgtaattctagtttgcaaacaagggcgaaagcgttggatgttgttaagcatctgaaggagaaccgacacttgggcagatgtgagatcgcggcaatagaggatggaaagcttgttggtgattctgatgctggtgagttctggaacctgtttggaggctatgcacctattcctcgtgatttacctgacacagtcaaggaagagccactgactgcaccatccaagaaacttttttggatcaataagagaaaccttgttccattggaggcacatttgttggatagagaaatgctgaactcagacagaagttacatgctggactgtagcactgaaatattcttatggatggggatgacaacactagtttcggagaggaagtcatctgttactgtcttagaagattatatgcactcccagggcaggtcattcaatgttcgcacatttataatgacagaaggtcatgaaactgttgactttaagctgcactttcagcattggcccaggaatgttgaactaaagttatatgaggctggccgagagaaagtggcagctattttcaagcatcagggttatgatgtcacagaaattccagaggataaacctcagcagctcatcagttgtaatggcagtctgaaggtgtggttggtggaccatggctgtacaaacctccttagcactgaggaccaggagcagttgtacactggagactgttatatcatacggtacagctatgttgaagatggaaaagattaccatcttttctttgcttggtctggtaagaatagtgtaaaggacgatagcatgttggcaacatcgttaatgtctagcatggctgattcagtcaaagggcatccagttgtggcaaaagttttcgagggcagagaaccagaattgtttttctcggtgttcaagtcactaatcatattcaaggggggcaggagtgctgcatataagagttctgttctacagaaaaatcctagaaatggatatcatcagaaggaaggagtcgccctgttccgtgttcaaggccttaaacatgattgtgtgcaagccattcaagttgatctggctgcaagttcacttaattcctcgcactgttatattttggaagacaatggtttgttccttacctggttaggaagcctctcttcaccaaacgatcataatattcttgacttgatgatgaacaagttgtgtccaatgaaacagtccttgctagtcagagaaggctctgagccggatcacttctggatagctttgggaggacgatcagagtactcgaaagaaaagcgcgtgaagggttggccagcagatccacatctgtatgcttgtagatttgaacaaggtttgctcaaggtcaaggaggtattcagcttctgtcaggatgacctggcaactgaagcgacattgattctggactgcgatgaagaaatctacgtttgggttgggctacactcagacattacatccaaggagcaagccctgaatattggcaagatgttccttcaggatggcatttttcacagtggaagatcgattgaaacgacggtgtatacagtcacagaaggggacgagcctgtatttttcaccaatttcttcaacaactgggacaattccaagcaatcatctatggttggcaactcatttgagaggaagctggccgtcctgaaaggagtctctccaaaactagagacaccggacagaagcatgcgcaggccgccatcgaggaggcccggggtatcgtcggagccgaccacgccggagcaccaacaccagcagccgacggcgaggagggcctttggctccgcgtctgccgggaggtttggcagggagcgctcaccagctgccgcaccgccaatgtcatcgccatctcccaaaagccgctcgacgtcgtccacgcccaccgcggtggcacggcggctcttccctgcctcggtgcacgcatcggaggccgtgcacgtcgtctccacggggacgacagctcgacgacggtga

SEQ ID NO: 5852 - protein, 840 aa, Sorghum bicolor
  misc_feature: Ceres ANNOT ID no. 6054832
  misc_feature (24)..(107): Pfam Id: Gelsolin Pfam Desc: Gelsolin repeat
  misc_feature (144)..(224): Pfam Id: Gelsolin Pfam Desc: Gelsolin repeat
  misc_feature (260)..(336): Pfam Id: Gelsolin Pfam Desc: Gelsolin repeat
  misc_feature (1)..(839): NCBI GI: 115462153 NCBI Desc: os05g0153000 [oryza sativa (japonica cultivar-group)]
  misc_feature (2)..(822): NCBI GI: 145323093 NCBI Desc: vln1 (villin 1); actin binding [arabidopsis thaliana]
  misc_feature (2)..(822): NCBI GI: 3415113 NCBI Desc: villin 1 [arabidopsis thaliana]
  misc_feature (1)..(821): NCBI GI: 31339056 NCBI Desc: actin filament bundling protein p-115-abp [lilium longiflorum]
  misc_feature (1)..(821): NCBI GI: 115475477 NCBI Desc: os08g0240800 [oryza sativa (japonica cultivar-group)]
  misc_feature: Up-regulated in root tissues in response to salicylic acid treatment
MKGVDDAFLGVGDKPGLDIWCIVGSSLVPVAKPQHGKFYTGSTYIILNTTELKSGARRHNVHYWVGEEAKEDDCLMASDKAVELDAALGSSTVQYRETQGEESDKFLSYFKPCVIPVQGCFFSHLKGSGDRSNATTMFRCQGEHIARVTQIPFTRSSLDHKSVFIVDTPSKIFLFSGCNSSLQTRAKALDVVKHLKENRHLGRCEIAAIEDGKLVGDSDAGEFWNLFGGYAPIPRDLPDTVKEEPLTAPSKKLFWINKRNLVPLEAHLLDREMLNSDRSYMLDCSTEIFLWMGMTTLVSERKSSVTVLEDYMHSQGRSFNVRTFIMTEGHETVDFKLHFQHWPRNVELKLYEAGREKVAAIFKHQGYDVTEIPEDKPQQLISCNGSLKVWLVDHGCTNLLSTEDQEQLYTGDCYIIRYSYVEDGKDYHLFFAWSGKNSVKDDSMLATSLMSSMADSVKGHPVVAKVFEGREPELFFSVFKSLIIFKGGRSAAYKSSVLQKNPRNGYHQKEGVALFRVQGLKHDCVQAIQVDLAASSLNSSHCYILEDNGLFLTWLGSLSSPNDHNILDLMMNKLCPMKQSLLVREGSEPDHFWIALGGRSEYSKEKRVKGWPADPHLYACRFEQGLLKVKEVFSFCQDDLATEATLILDCDEEIYVWVGLHSDITSKEQALNIGKMFLQDGIFHSGRSIETTVYTVTEGDEPVFFTNFFNNWDNSKQSSMVGNSFERKLAVLKGVSPKLETPDRSMRRPPSRRPGVSSEPTTPEHQHQQPTARRAFGSASAGRFGRERSPAAAPPMSSPSPKSRSTSSTPTAVARRLFPASVHASEAVHVVSTGTTARRR

SEQ ID NO: 5853 - DNA, 1320 bp, Sorghum bicolor
  misc_feature: Ceres ANNOT ID no. 6054870
  misc_feature: Encodes the peptide sequence at SEQ ID NO 5854
atgccgctcgccctccagctgcggcttccactgccacgtgtcctcgtcgtccagcggtgcaggtgcaggctgcccccctcacgcctctctgtaagggcagaagcggcggccggggtggcagtggcggcagcggcggcgccatcgtcagtcgttcatgatgaactgtgcatgctacccttctcgccggagctcgcttcccaccaccgtgagctcgccgctgctgtcgcctccgtcgagcgagcctgccgcctatgtgtcgatgtgaaggcatcgctgctttcaggtgacaggaagtttcttgaaaagaatgacgaaactcctgtaacaattgctgattttggtgttcaggcccttattagctttgagctacagcaattgtttccatcaatacctctggtggcagaagaggactcggcatgcctacggtcgttgaatgctgatgaaagcaatagtaatgaacttgttgagtcaatttcaagttttgttgcagaaagagtcagtaacagtggttcaccattaagtcatgctgatgtgttgagcgcaattgatagaggaggcaaggatgctgtctccttcgatccaaatcccgctacttattgggtgcttgacccgatcgatggtactaagagtttcttgaaaggagcagatgattccctgtatgtggtgggcttggctcttgtggtggatggaaagttagcagtaggagtcatgggatgtccgaattggactgatggcatcacagacaaaaacaatgatgaatcccttgcagcccctcctggtcgtggtatccttatggtgtctcatgtaggctgtggcacttggtctaggcccttgtcttctgagattgaccagttcactacagcactggatgcttggaagagatgctttgttgatccctgttcaattgcacacatggcacgctactgcattgttgatagccatacatgggatatgatgccactgtctctctacttcaattcaacaatggatcaatctgatcccagagatgagaatagaattcttctccaaaattcttgtggtggcagcttgtccaagtatctcatggtggcctccgggagaatgtcagtttttatcctcctagcacgagccgaaaaacaaatcaaggcttgggaccatgcagttggggtaatttgtgttcaggaagctggagggcagacatgtgactggagaggggaacctttggattttgctgctgaccagacagggcgcagaatcatctacccttggggtggtgttctggctacaaactgtgctcttcatgacgagcttgtagaaatgatcacagcaacttataattag

SEQ ID NO: 5854 - protein, 439 aa, Sorghum bicolor
  misc_feature: Ceres ANNOT ID no. 6054870
  misc_feature (67)..(432): Pfam Id: Inositol_P Pfam Desc: Inositol monophosphatase family
  misc_feature (1)..(438): NCBI GI: 115472751 NCBI Desc: os07g0558300 [oryza sativa (japonica cultivar-group)]
  misc_feature (66)..(308): NCBI GI: 21618152 NCBI Desc: 3(2),5-bisphosphate nucleotidase [arabidopsis thaliana]
  misc_feature (66)..(281): NCBI GI: 29029098 NCBI Desc: at5g63980 [arabidopsis thaliana]
  misc_feature (66)..(281): NCBI GI: 145359623 NCBI Desc: sal1 (fiery1); 3'(2'),5'-bisphosphate nucleotidase/ inositol or phosphatidylinositol phosphatase [arabidopsis thaliana]
  misc_feature (58)..(309): NCBI GI: 77553176 NCBI Desc: 3'(2'),5'-bisphosphate nucleotidase [oryza sativa (japonica cultivar-group)]
MPLALQLRLPLPRVLVVQRCRCRLPPSRLSVRAEAAAGVAVAAAAAPSSVVHDELCMLPFSPELASHHRELAAAVASVERACRLCVDVKASLLSGDRKFLEKNDETPVTIADFGVQALISFELQQLFPSIPLVAEEDSACLRSLNADESNSNELVESISSFVAERVSNSGSPLSHADVLSAIDRGGKDAVSFDPNPATYWVLDPIDGTKSFLKGADDSLYVVGLALVVDGKLAVGVMGCPNWTDGITDKNNDESLAAPPGRGILMVSHVGCGTWSRPLSSEIDQFTTALDAWKRCFVDPCSIAHMARYCIVDSHTWDMMPLSLYFNSTMDQSDPRDENRILLQNSCGGSLSKYLMVASGRMSVFILLARAEKQIKAWDHAVGVICVQEAGGQTCDWRGEPLDFAADQTGRRIIYPWGGVLATNCALHDELVEMITATYN

SEQ ID NO: 5855 - DNA, 2259 bp, Sorghum bicolor
  misc_feature: Ceres ANNOT ID no. 6054877
  misc_feature: Encodes the peptide sequence at SEQ ID NO 5856
atgctgcacgagctcctcctcgcgctgctcggattcaccggcgacttcgtcctcgacgcctccccgccgcgccgccgcgccgcgtcccaggaagccggcggggatggagacggcgacggagacggcgaggtgggccccgccttccgcctcgcgccggacctcaccttcctccagccgtcagagaggactgctattgagaggctcatatctctgggattttactacagagaactgaaccgctttgcaactgagtctcgtgacctgagctggattcagtcttccgtagatgtttcatcacctcattctgataaaactcagaaggggaaagtgagaaaagggagtgtgtacaggagggcaattgccaatggtattacagagattctgtctgtgtacagatcagctgttctacaggttgagcaaaatctgttgtcagatccgttgcctatcctcgcgacagtaactcatgggttaaataagtttgaggtccttctgcctccactgtatgagcttgttatggaaattgagcagaaagacataaagggtggacaacttcttaatcttttacacaaacggtgccattgtggggttccagaactgcaaagctgcattcagaggttactttggcatggacaccaggtcatgttcaaccagctgacatcttggatggtttatgggattcttcaagatcagtacagtgaatttttcattagaaggcaagacgacagggatggggagaatgaatcatctcagcgtgatgtttctgataagtttaagcagaaattagctaaagacacatccctggctagttggcatacaggatttcatgtatcattggacatgttgcctgagtatatccacatgcgagttgcagagtccattctcttcgctggcaaagcaataagggtgcttcgaaatccaagtcctggtgctacattgcaggaacctgttaaccaaagccagaactctaaaggatctcatggaatgcaaagctttgtaggaggttctggtgctccaaaagaattgccaagcttctctaacatcagcgcagaagaactactgccacaaactgaagccgataaaattgatgttatgctcaaggagctaaagcattcttcggaatttcataaacggccttttgagtctgctgtcggctcaatacgcacaattgcagctaatcatctctggcagctagtggtggtacgtgctgatctcaacggtcatttgaaggcattgaaagattattttcttttagcaaaaggtgactttttccagtgttttcttgaggaaagccgacaattaatgcgtttaccacctcgtcaatctacagccgaagcagatctcatgattccatttcagctggctgcactgaagactattggtgaggaagacaagtactttaccagagtctcattaaggatgctatcatatggtatgaaaagtagtacatctcagaaagatctccaaaaacccaatgcttcagagctttcttcacaaggaaaagctacatcagaaatagcacttgatgggtgggatagtattgctctggaatattcagtcgactggcctctgcagctcttcttcactcctgatgttctgtccaagtatcgcaaggttttccagtatctcatccgattgaagaggacacaaatggaacttgagaaatcctgggcagctgtaatgcataaagaccatgctgatttttctgagtactgcaaggatcggaaaaataactctgcaacacaactgcgtcgacaacgctctaagcctttgtggcgagtaagggagcatatggcattcttgatcagaaacctgcaattttacatccaggttgatgtaattgagtcgcagtggaatgttttacaatctcatgtgcaagattcacatgattttacagagctagtgagctttcatcaagaatatttgtcagcactgatttcacaatccttcctggatattggatcagtttcaaggatactagacagcataatgaagctttgcttgcagttctgctggagcattgagcaatacgaaacccgcccaaatatttctgagattgatcacataactgaggagttcaacaagaagtcaaattcgctgtatactatcttgaggagcagtcgccttgcgggtagtcaaagagcacctttcctgaggcaatttctgatgaggctaaatttcaactctttctttgagaccaccgcaagaggagtgatgaattcaggaaggctgcgcccaagcactgcaggtgctcagctgtaa

SEQ ID NO: 5856 - protein, 752 aa, Sorghum bicolor
  misc_feature: Ceres ANNOT ID no. 6054877
  misc_feature (1)..(621): Pfam Id: Spc97_Spc98 Pfam Desc: Spc97 / Spc98 family
  misc_feature (48)..(749): NCBI GI: 6562700 NCBI Desc: 85p protein [medicago truncatula]
  misc_feature (1)..(746): NCBI GI: 46402452 NCBI Desc: at3g53760 [arabidopsis thaliana]
  misc_feature (504)..(740): NCBI GI: 51895805 NCBI Desc: mgc81229 protein [xenopus laevis]
  misc_feature (492)..(740): NCBI GI: 38454194 NCBI Desc: gamma tubulin ring complex protein (76p gene) [homo sapiens]
  misc_feature (492)..(740): NCBI GI: 123998721 NCBI Desc: gamma tubulin ring complex protein (76p gene) [synthetic construct]
MLHELLLALLGFTGDFVLDASPPRRRAASQEAGGDGDGDGDGEVGPAFRLAPDLTFLQPSERTAIERLISLGFYYRELNRFATESRDLSWIQSSVDVSSPHSDKTQKGKVRKGSVYRRAIANGITEILSVYRSAVLQVEQNLLSDPLPILATVTHGLNKFEVLLPPLYELVMEIEQKDIKGGQLLNLLHKRCHCGVPELQSCIQRLLWHGHQVMFNQLTSWMVYGILQDQYSEFFIRRQDDRDGENESSQRDVSDKFKQKLAKDTSLASWHTGFHVSLDMLPEYIHMRVAESILFAGKAIRVLRNPSPGATLQEPVNQSQNSKGSHGMQSFVGGSGAPKELPSFSNISAEELLPQTEADKIDVMLKELKHSSEFHKRPFESAVGSIRTIAANHLWQLVVVRADLNGHLKALKDYFLLAKGDFFQCFLEESRQLMRLPPRQSTAEADLMIPFQLAALKTIGEEDKYFTRVSLRMLSYGMKSSTSQKDLQKPNASELSSQGKATSEIALDGWDSIALEYSVDWPLQLFFTPDVLSKYRKVFQYLIRLKRTQMELEKSWAAVMHKDHADFSEYCKDRKNNSATQLRRQRSKPLWRVREHMAFLIRNLQFYIQVDVIESQWNVLQSHVQDSHDFTELVSFHQEYLSALISQSFLDIGSVSRILDSIMKLCLQFCWSIEQYETRPNISEIDHITEEFNKKSNSLYTILRSSRLAGSQRAPFLRQFLMRLNFNSFFETTARGVMNSGRLRPSTAGAQL

SEQ ID NO: 5857 - DNA, 1287 bp, Sorghum bicolor
  misc_feature: Ceres ANNOT ID no. 6054878
  misc_feature: Encodes the peptide sequence at SEQ ID NO 5858
atgggcgtcggtgcggcggagcccaaggagcctgcggcggcgacggccgccggggcgccggcggaggaggccgcggcgggcggcaaggaggacaaggccgcggcggtgtcctgctcgatctgcctcgacgccgtgctcgccggcgccggggagaggtccaccgccaggctgcactgcggccacgagttccacctagcatttaatgccaaaggggttatgcaatgccccaactgccgcaaaattgagaaagggaattggctttatgcaaatggttcccgatctgcacatgatgttagcatggatgagtgggcccatgatgaagacctttatgatgttagctactcagaaatgccacttcgcttccattggtgtccatttggtcgcttagcacaacttccatctttattcgaggaaggagaatcatcacctccaattacatttcatgacttcatgggacaacatgtatttacggagcaagtagctgtatctgctgcaccagggacaactcatccttgcccctatgtggcatacttgcatcctcttccaccactgacgtcatcgtcaagctcccatgtccctgagaggactatggatcgtcctgcataccatgatcattggaaccccatggctgggccatcagatgttaggcccatgcaaacaatgcaacctgctgatttccatcatagccattgggcacacgtgccccattcttatgctcaacccaacagtaataacgagcagccaggaatcccttttggaacaagggctgcacgggttgatggtgatagccaacgtcgagcatctgttgtttctccgtcttacttcagtaatggatctagacctcccagtgttcctcctctgatgcctcaattcatgagggctcatggcagcatcagcgaacagtaccaacagaattcatcatcgagcctatttgctggggcgcataggtcaggaggcatgcgacctgccccaacacctctaccagagaaccctaccttttccttgttcccgccgggttcatctggccatagctcgatggagactgatgatgtgggaggaagccggttctacgcctgggagcgtgaccgattcgccccatacccgttgatgcctgtggactgcgagacaagctggtggacctcacagcagcagtctcatagcacatcagagcctacatccgcgccaaggaggctgtttgggcaatggctcggcgtcggcaggtcgtcccctgaacatagatcgcccgaggggtcttcgtatcggcaaatgcactcaccgcggatgtag

SEQ ID NO: 5858 - protein, 428 aa, Sorghum bicolor
  misc_feature: Ceres ANNOT ID no. 6054878
  misc_feature (22)..(428): NCBI GI: 115462167 NCBI Desc: os05g0154600 [oryza sativa (japonica cultivar-group)]
  misc_feature (1)..(428): NCBI GI: 6996144 NCBI Desc: vip2 protein [avena fatua]
  misc_feature (2)..(278): NCBI GI: 115436448 NCBI Desc: os01g0350900 [oryza sativa (japonica cultivar-group)]
  misc_feature (35)..(279): NCBI GI: 92871674 NCBI Desc: zinc finger, ring-type; zinc finger, phd-type [medicago truncatula]
  misc_feature (35)..(391): NCBI GI: 144923772 NCBI Desc: zinc finger, ring-type [medicago truncatula]
MGVGAAEPKEPAAATAAGAPAEEAAAGGKEDKAAAVSCSICLDAVLAGAGERSTARLHCGHEFHLAFNAKGVMQCPNCRKIEKGNWLYANGSRSAHDVSMDEWAHDEDLYDVSYSEMPLRFHWCPFGRLAQLPSLFEEGESSPPITFHDFMGQHVFTEQVAVSAAPGTTHPCPYVAYLHPLPPLTSSSSSHVPERTMDRPAYHDHWNPMAGPSDVRPMQTMQPADFHHSHWAHVPHSYAQPNSNNEQPGIPFGTRAARVDGDSQRRASVVSPSYFSNGSRPPSVPPLMPQFMRAHGSISEQYQQNSSSSLFAGAHRSGGMRPAPTPLPENPTFSLFPPGSSGHSSMETDDVGGSRFYAWERDRFAPYPLMPVDCETSWWTSQQQSHSTSEPTSAPRRLFGQWLGVGRSSPEHRSPEGSSYRQMHSPRM

SEQ ID NO: 5859 - DNA, 2430 bp, Sorghum bicolor
  misc_feature: Ceres ANNOT ID no. 6054880
  misc_feature: Encodes the peptide sequence at SEQ ID NO 5860
atgggcggggactcgggcgacgcagtcacggcgcgctggctgcagtccgcggggctgcagcacctcgccgcggcctcctccgccgctggcgctggcggcgccgccgactaccgcgctgggatgcctgctgggcttggtggcgctggcgcggggagcatgctgtccagcctgctcatgcagggctatgggccagaatcgattgaggaaaagcagaggctttatacgcttctaagaggtctaaattttaacggagagtctgtacccacatcaatgtctgagccttacacaccaacggctcagagctttggtggtgggaaccctgtggagggcttttattcacccgaacttagaggggaacttggtgctggacttctagaccttcatgctatggatgatactgagcttctgtctgaggatgtagcgtcggaaccatttgagccatcaccttttgtcccaaaggatattgatgatgatgatgaggatgtgatatcagggagtcaacaagtcccagtagataattatggtgtggtgaccagtgaaaaagagagcacttctcgagaaaataatgtagcaaagattaaagtagtggtaaggaaaagacctttgaacagaaaggagctatctcgaaaggaagaagacattataactgtgcatgattcatcatgtttgacagtctacgagcctaagctgaaggtggatctgacagcctatgtggagcagcatgaattttgttttgatgctgttctggacgaacatgtctccaatgatgaggtttaccgtgaaacagttgagcccataattccaattatatttcagagaacaaaagcaacatgttttgcttatggccaaacaggcagtggcaagacatacaccatgcaacctttgcctctcagagctgcacaagacatggttcgtctattgcaccaacctgtctatcggaatcagaattttaagttgtggcttagctatttcgaaatatatggtgggaaactctttgatcttctatctgacagaaggcaattactgatgagggaagatggcaagaaacaagtttgcattgttggtctacaggaatttgaggtttctgatgttcaaattgtcaaggaatatattgaaagagggaatgcagccaggagcacagggtcaacaggggccaatgaggaatcatcaaggtcacatgctattctgcaactggctgtgaagaagcatataattgtaaaagataccaggagacagagagatcgtgatgctaatgaagctaagaatacaaaggctgtggggaaaatatcatttattgatcttgctggaagcgagcgtggtgctgatactactgataatgatagacagacaaggattgagggagcagagataaataaaagtctgttagctctcaaggaatgcattcgagctcttgataatgatcagatacacattcctttcagaggaagcaagcttacagaggttcttcgtgactcatttgttggtaactctaggacggtgatgatttcttgcatttctccaaatgcaggctcatgtgaacacacactaaataccttgagatacgctgatagggtcaaaagtctttccaagggtggaaacacaagaaaagagcaatctacagtaccaaccaccacttctagccgggagtcttcgtcggctccatcatatccactgcctgctgaagctgaagaaattcctaaccagattcaagagaagagaccagttgatactttccggaaaggcactgaaaattttatctccaacccttctgcggagcctgacagaaattcctttagtatgattccaagttattctaatagagggagagaagaaaacggcgcagcatctggtagtgacagggagaggtatgatttgaagtccacacaaactgcttacactagtaaggcacagttggttcagaattcagcaagcacacaggaggaggagaaagtcacaaaagtctcacctcctcggagaaaggcttatagagaagagaaatctgataggcagagcaattacatgaaaaaggataatggtcctgagacaggtcgggctgggtataaggtgcagcaggcaaagcagctgcaacagcagcaaaggccagcatctgcttcagcttcatcaaggcaatctgaaaaggaaagttcttgtgatgatgtagaaattgatgcaattcttgaggaagaggaggccctcattgcagctcacaggaaggagattgagaatactatggagattgtacgggaagagatgaaccttttggcagaagttgatcaaccaggtagcctgattgacaactatgtgacccaactgagctttttgctgtcacgcaaggctgcaggcttggtcagcctccaagcacgcttggcacggttccagcaccgcctcaaagagcaagagatccttagccgcaagaaaccttccagatag

SEQ ID NO: 5860 - protein, 809 aa, Sorghum bicolor
  misc_feature: Ceres ANNOT ID no. 6054880
  misc_feature (198)..(529): Pfam Id: Kinesin Pfam Desc: Kinesin motor domain
  misc_feature (2)..(714): NCBI GI: 33439496 NCBI Desc: central motor kinesin 1 [gossypium hirsutum]
  misc_feature (57)..(723): NCBI GI: 73656868 NCBI Desc: internal-motor kinesin [nicotiana tabacum]
  misc_feature (347)..(809): NCBI GI: 115462169 NCBI Desc: os05g0154700 [oryza sativa (japonica cultivar-group)]
  misc_feature (372)..(782): NCBI GI: 15208461 NCBI Desc: kinesin heavy chain [zea mays]
  misc_feature (119)..(599): NCBI GI: 16974325 NCBI Desc: at3g16060/msl1_10 [arabidopsis thaliana]
MGGDSGDAVTARWLQSAGLQHLAAASSAAGAGGAADYRAGMPAGLGGAGAGSMLSSLLMQGYGPESIEEKQRLYTLLRGLNFNGESVPTSMSEPYTPTAQSFGGGNPVEGFYSPELRGELGAGLLDLHAMDDTELLSEDVASEPFEPSPFVPKDIDDDDEDVISGSQQVPVDNYGVVTSEKESTSRENNVAKIKVVVRKRPLNRKELSRKEEDIITVHDSSCLTVYEPKLKVDLTAYVEQHEFCFDAVLDEHVSNDEVYRETVEPIIPIIFQRTKATCFAYGQTGSGKTYTMQPLPLRAAQDMVRLLHQPVYRNQNFKLWLSYFEIYGGKLFDLLSDRRQLLMREDGKKQVCIVGLQEFEVSDVQIVKEYIERGNAARSTGSTGANEESSRSHAILQLAVKKHIIVKDTRRQRDRDANEAKNTKAVGKISFIDLAGSERGADTTDNDRQTRIEGAEINKSLLALKECIRALDNDQIHIPFRGSKLTEVLRDSFVGNSRTVMISCISPNAGSCEHTLNTLRYADRVKSLSKGGNTRKEQSTVPTTTSSRESSSAPSYPLPAEAEEIPNQIQEKRPVDTFRKGTENFISNPSAEPDRNSFSMIPSYSNRGREENGAASGSDRERYDLKSTQTAYTSKAQLVQNSASTQEEEKVTKVSPPRRKAYREEKSDRQSNYMKKDNGPETGRAGYKVQQAKQLQQQQRPASASASSRQSEKESSCDDVEIDAILEEEEALIAAHRKEIENTMEIVREEMNLLAEVDQPGSLIDNYVTQLSFLLSRKAAGLVSLQARLARFQHRLKEQEILSRKKPSR

SEQ ID NO: 5861 - DNA, 969 bp, Sorghum bicolor
  misc_feature: Ceres ANNOT ID no. 6054896
  misc_feature: Encodes the peptide sequence at SEQ ID NO 5862
atgatgatgacgcgggccccgatggggccgatggaaggcgcggcggtggacgaggtggtgcgccgcctcgtggagggcggccgcggcgggcgccaggtgcagctgtccgaggcggagatccgccagctctgcgtcgagggcaagcgcgtgctcctctcccagcccaacctcctccgaatccacgcccccgtcaagatctgcggtgatatccacggccagtttgttgaccttctgaggttgttcgatttgggcggttatcctccagcttcgacttacgtattcctcggagactatgtcgatagaggcaaacagagcttggaaactatatgcttgctgctggcatacaaaatccggtaccccgagaagattttcctgttgagggggaaccatgaggatgccaagatcaacagagtctacggtttctatgacgaatgtaagaggaggttcaatgttcggctgtggaagatattctccgattgcttcaactgccttcctattgcagcgctcattgatgacaaaatactgtgcatgcatggtggtctgtcacctgagttgactagtttggaccagataaaggatattgagcggcctgctgagattcctgattatggtctcctgtgtgatctgctgtggtctgatcctagccctgatggagaagggtggggggagagtgacaggggtgtttcgtgtacgtttggtgcagataaacttgtggagtttttggagaagaacgatctcgatcttatatgccgagctcatcaggtggttgaagatggttatgagttctttgcacaacgaagattagtgacaatcttttcagctccaaattattgtggagagtttgataatgctggtgccctattgagcatagatgagagcctaatgtgttcatttcagatcctgaaaccaactgatatgggtccaccacatgcaagaaaacaaattccgaataagccagcaagagggtga

SEQ ID NO: 5862 - protein, 322 aa, Sorghum bicolor
  misc_feature: Ceres ANNOT ID no. 6054896
  misc_feature (62)..(257): Pfam Id: Metallophos Pfam Desc: Calcineurin-like phosphoesterase
  misc_feature (1)..(322): NCBI GI: 115436440 NCBI Desc: os01g0349400 [oryza sativa (japonica cultivar-group)]
  misc_feature (2)..(305): NCBI GI: 29290586 NCBI Desc: serine threonine protein phosphatase [phaseolus acutifolius]
  misc_feature (11)..(321): NCBI GI: 667049 NCBI Desc: protein phosphatase pp1 [phaseolus vulgaris]
  misc_feature (2)..(316): NCBI GI: 3153205 NCBI Desc: serine/threonine protein phosphatase type one [arabidopsis thaliana]
  misc_feature (2)..(314): NCBI GI: 38503411 NCBI Desc: serine/threonine protein phosphatase pp1 isozyme 8
  misc_feature (11)..(321): SWISSPROT Homolog: EC 3.1.3.16 Serine/threonine-protein phosphatase PP1
MMMTRAPMGPMEGAAVDEVVRRLVEGGRGGRQVQLSEAEIRQLCVEGKRVLLSQPNLLRIHAPVKICGDIHGQFVDLLRLFDLGGYPPASTYVFLGDYVDRGKQSLETICLLLAYKIRYPEKIFLLRGNHEDAKINRVYGFYDECKRRFNVRLWKIFSDCFNCLPIAALIDDKILCMHGGLSPELTSLDQIKDIERPAEIPDYGLLCDLLWSDPSPDGEGWGESDRGVSCTFGADKLVEFLEKNDLDLICRAHQVVEDGYEFFAQRRLVTIFSAPNYCGEFDNAGALLSIDESLMCSFQILKPTDMGPPHARKQIPNKPARG

SEQ ID NO: 5863 - DNA, 1899 bp, Sorghum bicolor
  misc_feature: Ceres ANNOT ID no. 6054900
  misc_feature: Encodes the peptide sequence at SEQ ID NO 5864
  misc_feature: Up-regulated in root tissues in response to aminocyclopropane carboxylic treatment
atggatggatgcgattgtattgagccactttggcaggccgatgatctgctaatgaagtaccagtacatatctgacttcttcatcgcacttgcatacttctcaatccctttggagctgatatactttgttcagaagtcagctttcttcccgtaccgatgggtgctcatacagtttggtgccttcatcgtcctctgtggggcgactcacctgataaacatgtggactttcactacacataccaggaccatagccgtggtgttgacggtggcaaaagtggcgacagcagttgtgtcatgcataacagctctgatgcttgttcatataatccctgatttgctcagtgtgaagttgagggaaaggttcctgaaggcgaaggcggaggagcttgatagggagatggggataataaggacacaagaggagacgggaagacatgtgcatatgctcacacacgagataaggagcacgcttgacaggcataccattctcagaactacacttgttgaaatggggagaactcttggtttagcagagtgtgccgtgtggacgccgtcccgctctggaacaacccttcagctctcacatgcgctcaatagcaatgctccgcttggatcagttgttcctatcaatcttccgattatagctaccatttttaatagtaatcgggctgagagaataccacatacttccccgttagcttcagtaaagactcagaagagcaagtatgtcccacccgaggtcgttgctgtccgtgttccactcctgcagcttacaaatttccaaataaatgattggcctgagctgtctgcgaaagcctttgcagtgatggttttgatgcttcctccagacagtgcacgaaaatggcgaccccatgaactggagcttgttgaagttgttgctgatcaggtggcagttgcactatcccatgctgccattttggaagagtccatgcgtgcccgtgatctgctaatggagcagaatattgctctggacgcagcacggcgagaggcagaaatggctatctgtgctcggaatgattttcttgctgtcatgaatcatgaaatgcggactcctatgcgagcaatcatttctttatcatccctcctgttagaaacaaaacttactgcagaacagcgcgtgatgattgaaactatactaaaaagcagtgatcttctagaaactctttcaaatgatgttttagatatctccaagcttggggatggcagtcttgagctggaagttgcaccttttaatctacatgcaacctttacagatgtggttgatttaattaaaccagtagctgcattgaaaagattatccgtaatggttcatttggctccagagttgcccacctgtgcaattggtgatcgaaagaggttgatgcagataatactaaatgttgctgggaactccgttaagtttacaaaggagggtcatatttcaatttcagcatctattgctaggacagattctctgagggacccatatgctcctgatttccatccagttctctccaatggatctttttacttggctgtgcaggtaaaagacaccggctgtggaattagcccgcaagatatgcctcacaccttcacaaaatttgcacacccgcaaaatgctataaacaaactgcataatggcaacggattgggtctggccctttccagaagatttgttacccttatgcaagggaacatctggctcgaaagcgaaggtgtagggaagggctgtacggcaacgttctttgtgaagctaggactatctgataaaccaaatgcaaatctccggagaatcatgcctcctgtccaaccaaaacaaggaactgcagatccagatgcatcatcaataatcaatggcgacatggcaattcttccgtatcgttaccagtcgatgatatga

SEQ ID NO: 5864 - protein, 632 aa, Sorghum bicolor
  misc_feature: Ceres ANNOT ID no. 6054900
  misc_feature (455)..(586): Pfam Id: HATPase_c Pfam Desc: Histidine kinase-, DNA gyrase B-, and HSP90-like ATPase
  misc_feature (158)..(307): Pfam Id: GAF Pfam Desc: GAF domain
  misc_feature (343)..(408): Pfam Id: HisKA Pfam Desc: His Kinase A (phosphoacceptor) domain
  misc_feature (1)..(632): NCBI GI: 115462179 NCBI Desc: os05g0155200 [oryza sativa (japonica cultivar-group)]
  misc_feature (1)..(610): NCBI GI: 121309562 NCBI Desc: ethylene receptor protein [musa acuminata]
  misc_feature (1)..(631): NCBI GI: 47716316 NCBI Desc: ethylene receptor [gladiolus hybrid cultivar 'traveler']
  misc_feature (1)..(632): NCBI GI: 38607375 NCBI Desc: ethylene receptor [zea mays]
  misc_feature (1)..(629): NCBI GI: 64967421 NCBI Desc: ethylene response sensor [phalaenopsis equestris]
  misc_feature (1)..(592): SWISSPROT Homolog: EC 2.7.13.3 Ethylene receptor
  misc_feature: Useful for making plants with modulated biomass
  misc_feature: Useful for making plants with modulated biotic stress sensitivity
  misc_feature: Useful for making plants with modulated light response
  misc_feature: Useful for making plants with modulated root development
  misc_feature: Useful for making plants with modulated salt sensitivity
  misc_feature: Functional homolog of the protein sequence given in SEQ ID NO 13935
  misc_feature: The sequence is a functional homolog of SEQ ID NO 6 in US patent 7105654
  misc_feature: Up-regulated in root tissues in response to aminocyclopropane carboxylic treatment
MDGCDCIEPLWQADDLLMKYQYISDFFIALAYFSIPLELIYFVQKSAFFPYRWVLIQFGAFIVLCGATHLINMWTFTTHTRTIAVVLTVAKVATAVVSCITALMLVHIIPDLLSVKLRERFLKAKAEELDREMGIIRTQEETGRHVHMLTHEIRSTLDRHTILRTTLVEMGRTLGLAECAVWTPSRSGTTLQLSHALNSNAPLGSVVPINLPIIATIFNSNRAERIPHTSPLASVKTQKSKYVPPEVVAVRVPLLQLTNFQINDWPELSAKAFAVMVLMLPPDSARKWRPHELELVEVVADQVAVALSHAAILEESMRARDLLMEQNIALDAARREAEMAICARNDFLAVMNHEMRTPMRAIISLSSLLLETKLTAEQRVMIETILKSSDLLETLSNDVLDISKLGDGSLELEVAPFNLHATFTDVVDLIKPVAALKRLSVMVHLAPELPTCAIGDRKRLMQIILNVAGNSVKFTKEGHISISASIARTDSLRDPYAPDFHPVLSNGSFYLAVQVKDTGCGISPQDMPHTFTKFAHPQNAINKLHNGNGLGLALSRRFVTLMQGNIWLESEGVGKGCTATFFVKLGLSDKPNANLRRIMPPVQPKQGTADPDASSIINGDMAILPYRYQSMI

SEQ ID NO: 5865 - DNA, 822 bp, Sorghum bicolor
  misc_feature: Ceres ANNOT ID no. 6054901
  misc_feature: Encodes the peptide sequence at SEQ ID NO 5866
atggcgaggaggaggcttctcgcgctcgcgtcccggctccatgggaggcctcaggcgacgcagccttggcggcgacccccgccccggttcctctcctcagcggcgtccggccccctcgaccgcctgaagtcgccgcctttcgcgcggccgggtgcccggaaccccgccgcctacccatgggatcgattcggaggagggcagaagaggaccatgttcatccagacgcagtcgacgccgaacccgcagtcactcatgttctatcctggaaagccagttatggaggttgggagctccgatttccctaatgctcggactgcaatgacatcccctttggctaaggcgctgtttgctattgatggagtaaccaggatcttctttggatctgattttgttactgttacaaaatcagaagaaacttcttgggattacctcaaacctgaggtttttgctgctataatggacttttactcatctggacaaccactttttctggactcaaatgctgcagcttctatggacacagcaattcatgaggatgattcagaaatagttgccatgataaaagaattattggagactcgcattcgaccagctgtcaagatgatggtggtgacattgaataccgaggatttgatccaacactatcctttcagagaaaacgggatagttaagcttaaaatgcaaggtgcctgcagcggctgtccaagttcatcagtcacattgaagtctgggatagaaaacatgcttatgcactatgtgcctgaggtgaaaggagtagagcaggagtttgatggtgatgaggaagctgaactggctggatag

SEQ ID NO: 5866 - protein, 273 aa, Sorghum bicolor
  misc_feature: Ceres ANNOT ID no. 6054901
  misc_feature (73)..(159): Pfam Id: Nfu_N Pfam Desc: Scaffold protein Nfu/NifU N terminal
  misc_feature (187)..(262): Pfam Id: NifU Pfam Desc: NifU-like domain
  misc_feature (57)..(200): NCBI GI: 79313311 NCBI Desc: nfu4 [arabidopsis thaliana]
  misc_feature (63)..(273): NCBI GI: 4836948 NCBI Desc: similar to human cgi-33 protein [arabidopsis thaliana]
  misc_feature (69)..(270): NCBI GI: 34500321 NCBI Desc: nifu-like protein hirip5 [mus musculus]
  misc_feature (71)..(270): NCBI GI: 9910264 NCBI Desc: histone cell cycle regulation defective interacting protein 5 [mus musculus]
  misc_feature (68)..(264): NCBI GI: 45556188 NCBI Desc: cg33502-pa [drosophila melanogaster]
MARRRLLALASRLHGRPQATQPWRRPPPRFLSSAASGPLDRLKSPPFARPGARNPAAYPWDRFGGGQKRTMFIQTQSTPNPQSLMFYPGKPVMEVGSSDFPNARTAMTSPLAKALFAIDGVTRIFFGSDFVTVTKSEETSWDYLKPEVFAAIMDFYSSGQPLFLDSNAAASMDTAIHEDDSEIVAMIKELLETRIRPAVKMMVVTLNTEDLIQHYPFRENGIVKLKMQGACSGCPSSSVTLKSGIENMLMHYVPEVKGVEQEFDGDEEAELAG

SEQ ID NO: 5867 - DNA, 1581 bp, Sorghum bicolor
  misc_feature: Ceres ANNOT ID no. 6054903
  misc_feature: Encodes the peptide sequence at SEQ ID NO 5868
  misc_feature: Down-regulated in shoot tissues in response to aminocyclopropane carboxylic treatment
atgtcgctccggccgagcgagcgggagcagatgcggaagggcaactacaagcagacggtggacgcggaggagagccgccgccgccgggagggccagatggtggacatccgcaaggccaagcgcgaggagagcctccagaagaagcgccgcgacggcttcccggcctccgccgccggcgccgtcccgcccatgggacactccaccgcgctccagcagaagctcgatggcttgcccgctatggtgcaggccgtcctctccaacgaccccaccgtgcagcttgacgccaccacgcagttcaggaagctgctctccatagagcgtagtcccccaattgaggaggtgatcagcacaggagtggtccctcgattcatcgagttccttacacgcgaggaccatccccaactccagtttgaggctgcgtgggcactcaccaacattgcctccggcacatcagagaataccaaggtggtggttgagagtggtgctgtgcccatctttgtcaagctcctcaactcccacagcgaggatgctgtgtgggctttaggtaatgttgctggtgactccccaaagtgccgtgatctggtgcttggtcatggtgggcttttccccttgctgcagcagcttaatgagcatgctaagctctcgatgctcaggaatgccacatggactctctccaacttttgccgtgggaagccacaaccaaactttgatcaggtcaaaccagcattgccagcactgcagcgccttatccactctcaggatgaggaggtcctaactgatgcctgctgggctctctcatacctatctgatgggactaatgacaaaatccaagctgtcattgaatctggcgtgttcccacgccttgtggaacttctgatgcatccttcggcctctgtactcattcctgctctgcgcacggtgggtaacattgtaactggggatgacatgcagactcagtgtgtcattgacaatcaagcacttccatgccttttgaacctcctgactaccaaccacaagaaaagcatcaagaaagaagcatgctggacaatctcaaacatcacagctggtaacagggaacaaattcaggccgtgatcaatgcaaacataattgcacctctggtgcaacttctgcaaactgctgaatttgacatcaagaaagaagcagcctgggcaatttcaaatgccacttctgggggcacacatgatcagatcaagtaccttgttgcccaggggtgcattaagccactctgtgacctgcttgtctgcccagatcctagaattgtaacagtttgcttggagggtcttgagaacatcctgaaggttggcgaggcagagaaaaaccttggtggaggcgatgtcaatgtctatgcacagatgattgatgatgctgagggccttgacaagatcgagaacctgcagagccatgacaacactgagatatatgagaaggctgtcaagatgctcgaatcctactggctggaggaggaagatgatgccatgccctcaggcgacaatccccagaatggcttcaactttgggaaccagccctctgttccatcaggtggattcaactttggctga

SEQ ID NO: 5868 - protein, 526 aa, Sorghum bicolor
  misc_feature: Ceres ANNOT ID no. 6054903
  misc_feature (400)..(440): Pfam Id: Arm Pfam Desc: Armadillo/beta-catenin-like repeat
  misc_feature (107)..(148): Pfam Id: Arm Pfam Desc: Armadillo/beta-catenin-like repeat
  misc_feature (188)..(229): Pfam Id: Arm Pfam Desc: Armadillo/beta-catenin-like repeat
  misc_feature (231)..(270): Pfam Id: Arm Pfam Desc: Armadillo/beta-catenin-like repeat
  misc_feature (150)..(186): Pfam Id: Arm Pfam Desc: Armadillo/beta-catenin-like repeat
  misc_feature (272)..(312): Pfam Id: Arm Pfam Desc: Armadillo/beta-catenin-like repeat
  misc_feature (314)..(355): Pfam Id: Arm Pfam Desc: Armadillo/beta-catenin-like repeat
  misc_feature (357)..(397): Pfam Id: Arm Pfam Desc: Armadillo/beta-catenin-like repeat
  misc_feature (4)..(98): Pfam Id: IBB Pfam Desc: Importin beta binding domain
  misc_feature (1)..(526): NCBI GI: 62900380 NCBI Desc: importin alpha-1b subunit
  misc_feature (1)..(526): NCBI GI: 115462185 NCBI Desc: os05g0155500 [oryza sativa (japonica cultivar-group)]
  misc_feature (1)..(526): NCBI GI: 6682927 NCBI Desc: importin alpha 1b [oryza sativa (japonica cultivar-group)]
  misc_feature (1)..(526): NCBI GI: 119866037 NCBI Desc: impa2 [nicotiana benthamiana]
  misc_feature (1)..(526): NCBI GI: 13752562 NCBI Desc: importin alpha 2 [capsicum annuum]
  misc_feature: Down-regulated in shoot tissues in response to aminocyclopropane carboxylic treatment
  misc_feature: The sequence is a functional homolog of SEQ ID NO. 309 in the 11/188,298 US application
MSLRPSEREQMRKGNYKQTVDAEESRRRREGQMVDIRKAKREESLQKKRRDGFPASAAGAVPPMGHSTALQQKLDGLPAMVQAVLSNDPTVQLDATTQFRKLLSIERSPPIEEVISTGVVPRFIEFLTREDHPQLQFEAAWALTNIASGTSENTKVVVESGAVPIFVKLLNSHSEDAVWALGNVAGDSPKCRDLVLGHGGLFPLLQQLNEHAKLSMLRNATWTLSNFCRGKPQPNFDQVKPALPALQRLIHSQDEEVLTDACWALSYLSDGTNDKIQAVIESGVFPRLVELLMHPSASVLIPALRTVGNIVTGDDMQTQCVIDNQALPCLLNLLTTNHKKSIKKEACWTISNITAGNREQIQAVINANIIAPLVQLLQTAEFDIKKEAAWAISNATSGGTHDQIKYLVAQGCIKPLCDLLVCPDPRIVTVCLEGLENILKVGEAEKNLGGGDVNVYAQMIDDAEGLDKIENLQSHDNTEIYEKAVKMLESYWLEEEDDAMPSGDNPQNGFNFGNQPSVPSGGFNFG

SEQ ID NO: 5869 - DNA, 885 bp, Sorghum bicolor
  misc_feature: Ceres ANNOT ID no. 6054932
  misc_feature: Encodes the peptide sequence at SEQ ID NO 5870
atgggggccggaagcggagaggcggcgatgtctccgccgtcctccggcggcagcggaagcggcggcgggaagcgcgggcgggacccggaggaggacgtgtacgtggacaatctccactcccacaagcggtacctcagcgagataatggcgtccagtctgaatggactgtctgttggggattcactgcctgacaacatcatggagtcccctgcaaggtcagagactgcttcttgcttcagggatgagatattatcccaatactcgccaatgtcagaagactcagatgattaccggtgctatgacactcaattaaaccccagtgggaatcatcctgatgcgatgatcagcccttcaactagtccaatgtcatctccccaccgacaccagagaccacaatctcctctgttaccttcaaacccataccctctcccaagctgctccctttcatcggtagtctgctctcatgctcggcgtggctccgataatgaaggtcggttcccatcctcaccaaatgacatgtgccacggggcagatctgaggcgaacagcactgctgaggtcagtgcaaatgagggtgcagggaccccattcgtacgacctatcattcggcatgagacaaggacaagaacatgtacatgagcatgaagatgaacatgagcatgaacatctagaggatttggaaaggacagaaaggtcatcatcttgcaataagtcaatcgttgacgaaatcgcgtaccagagacctgaccatgattttggtcaaccagagcacgagatagattacatcaacaactgcacatcagatgattgtccaagtgacctaaaatttaagcatgaagataagagccatagtaaatttgatacccgtatggacaagaatacatag

SEQ ID NO: 5870 - protein, 294 aa, Sorghum bicolor
  misc_feature: Ceres ANNOT ID no. 6054932
  misc_feature (15)..(264): NCBI GI: 61611694 NCBI Desc: early flowering 3 [pisum sativum]
  misc_feature: Useful for making plants with modulated oxidative stress sensitivity
  misc_feature: GREAT-hit functional homolog of the protein sequence given in SEQ ID NO 13295
MGAGSGEAAMSPPSSGGSGSGGGKRGRDPEEDVYVDNLHSHKRYLSEIMASSLNGLSVGDSLPDNIMESPARSETASCFRDEILSQYSPMSEDSDDYRCYDTQLNPSGNHPDAMISPSTSPMSSPHRHQRPQSPLLPSNPYPLPSCSLSSVVCSHARRGSDNEGRFPSSPNDMCHGADLRRTALLRSVQMRVQGPHSYDLSFGMRQGQEHVHEHEDEHEHEHLEDLERTERSSSCNKSIVDEIAYQRPDHDFGQPEHEIDYINNCTSDDCPSDLKFKHEDKSHSKFDTRMDKNT

SEQ ID NO: 5871 - DNA, 1752 bp, Sorghum bicolor
  misc_feature: Ceres ANNOT ID no. 6054943
  misc_feature: Encodes the peptide sequence at SEQ ID NO 5872
  misc_feature: Down-regulated in shoot tissues in response to salicylic acid treatment
atgcagtccaccgcggccgtctccgtctccgcctcggcgaccgcgtcccgcggcggcgccagatccgaggccgcgcggcggccaggtggggtccgggtctgcggactccggggcgaggccctagcgtgcccctcgctgcggatctcgcaggtgccagcgaggctggcggtggcgagggccgcggcggcgaccaatggcgcggtggcggggagcggcggcttcgattacgacctcgtcatcatcggcgcgggcgtcgggggtcacggcgccgcgctccacgccgttgaagagggtttgaaaacagccataattgagggagatgttgtgggtgggacttgtgtaaacagaggttgtgtcccatcgaaagcactccttgctgtcagtggtcgaatgcgggagcttcatgatgaacatcatttgaagtctatgggtctacaggtttcttctcctggatatgacaggcaaggtgttgctgatcatgcaagcaatcttgcctcaaaaatccgtagcaacttgactaactcaatgaaagctctgggagtggatatattgacaggtgttggcactattgtgggaaagcaaaaggtacgatatggaaaagccggttctccagataaagaaatcactgccagaaacatcataattgccactggttcagttccttttgttcccaaagggattgagattgatgggaaaactgtatttaccagtgatcatgcactgaaacttgagtcagttccagactggatagctattgttggaagtggttacattggacttgagttcagtgatgtatacacagctcttggaagtgaggttactttcgttgaagctcttgaccagctgatgcctggatttgatcctgaaattgcaaaattagcccagagagttcttatcaatcctcggaaaattgactatcacactggtgtttttgcaagcaagattactccagcaaaggacggaaaacctgtgctcatcgagcttattgatgcgaagacaaaggaacacaaagaaacccttgaggttgacgcagctcttattgccacaggaagggcgccattcaccaaagggcttggcttggaaaacatcaatgtcgttacacaacgtggttttgtgcctgttgatgaacggatgcgagtcatggatgcagatggcaatgtggtacccaatttatattgcattggagatgccaatggcaaactcatgcttgcccatgctgccagtgcacaaggaatttcagttgttgaacaaatctctggaaaggatcacatcctaaatcatttaagcatcccggccgcatgttttactcatccagagattagtatggttgggctgacagagccacaagccagggagcaggcagacaaagaaggatttgaggtaaatgttgtgaagactagctttaaggctaacactaaagctttggcagaaaatgaaggagatgggattgctaagttgatttaccgacctgacacgggtgaaattcttggggttcacattttgggtttgcatgctgctgatctcatccacgaggcctccaatgccattgccctaggaacacgtgtacaagacatcaagtttgctgttcacgctcaccccacattatccgaggtcctggatgaactcttcaaagcagcaaagcctagagaagggcgggatagcaagccaaggcagccaccccaaccgctcctgaaggtcctcagcttcctcacgaccctgttttcttccccaaaacgagatcggcaacggtaa

SEQ ID NO: 5872 - protein, 583 aa, Sorghum bicolor
  misc_feature: Ceres ANNOT ID no. 6054943
  misc_feature (430)..(543): Pfam Id: Pyr_redox_dim Pfam Desc: Pyridine nucleotide-disulphide oxidoreductase, dimerisationdomain
  misc_feature (77)..(401): Pfam Id: Pyr_redox_2 Pfam Desc: Pyridine nucleotide-disulphide oxidoreductase
  misc_feature (249)..(350): Pfam Id: Pyr_redox Pfam Desc: Pyridine nucleotide-disulphide oxidoreductase
  misc_feature (77)..(422): Pfam Id: GIDA Pfam Desc: Glucose inhibited division protein A
  misc_feature (1)..(547): NCBI GI: 21464567 NCBI Desc: at3g16950/k14a17_7 [arabidopsis thaliana]
  misc_feature (1)..(547): NCBI GI: 145332599 NCBI Desc: lpd1 (lipoamide dehydrogenase 1) [arabidopsis thaliana]
  misc_feature (31)..(559): NCBI GI: 87240458 NCBI Desc: pyridine nucleotide-disulphide oxidoreductase, class i [medicago truncatula]
  misc_feature (189)..(550): NCBI GI: 140041513 NCBI Desc: pyridine nucleotide-disulphide oxidoreductase, class i [medicago truncatula]
  misc_feature (71)..(546): NCBI GI: 23130019 NCBI Desc: cog1249: pyruvate/2-oxoglutarate dehydrogenase complex, dihydrolipoamide dehydrogenase (e3) component, and related enzymes [nostoc punctiforme pcc 73102]
  misc_feature (71)..(546): SWISSPROT Homolog: EC 1.8.1.4 Dihydrolipoyl dehydrogenase
  misc_feature: Down-regulated in shoot tissues in response to salicylic acid treatment
MQSTAAVSVSASATASRGGARSEAARRPGGVRVCGLRGEALACPSLRISQVPARLAVARAAAATNGAVAGSGGFDYDLVIIGAGVGGHGAALHAVEEGLKTAIIEGDVVGGTCVNRGCVPSKALLAVSGRMRELHDEHHLKSMGLQVSSPGYDRQGVADHASNLASKIRSNLTNSMKALGVDILTGVGTIVGKQKVRYGKAGSPDKEITARNIIIATGSVPFVPKGIEIDGKTVFTSDHALKLESVPDWIAIVGSGYIGLEFSDVYTALGSEVTFVEALDQLMPGFDPEIAKLAQRVLINPRKIDYHTGVFASKITPAKDGKPVLIELIDAKTKEHKETLEVDAALIATGRAPFTKGLGLENINVVTQRGFVPVDERMRVMDADGNVVPNLYCIGDANGKLMLAHAASAQGISVVEQISGKDHILNHLSIPAACFTHPEISMVGLTEPQAREQADKEGFEVNVVKTSFKANTKALAENEGDGIAKLIYRPDTGEILGVHILGLHAADLIHEASNAIALGTRVQDIKFAVHAHPTLSEVLDELFKAAKPREGRDSKPRQPPQPLLKVLSFLTTLFSSPKRDRQR

SEQ ID NO: 5873 - DNA, 528 bp, Sorghum bicolor
  misc_feature: Ceres ANNOT ID no. 6054947
  misc_feature: Encodes the peptide sequence at SEQ ID NO 5874
atggttttacttgaggcagagatgtcatggaatgtgctgatctcacctagccagctggaccgcaagggcctcctgctccgcaaggctatcattgtgcgtcttctggaggatgtcacaaacaggagggcttccaaagagcatggctactacgttgccgttagtcagctgaaggcgatatctgaagggaaagtgcgtgagctaactggagatgtactgttcccagtctcatttacctgcatcacactgaagcctatgaagggtgaggtcatggttggccacgtggacaggatcctcaagcatggtgtgttcctgaaatctggacccgtggagagcattttcctggctgagaaatcgatgagcgactacaagtacataggtggggagaatgcgatgttcatgaacgaccactcaaagctggagaaggacactgccgtgcgcttcaaggtactggggttccgctggatggaggctgaccgccagttccagctccttgctacgattgctggtgacttccttgggccactgtga

SEQ ID NO: 5874 - protein, 175 aa, Sorghum bicolor
  misc_feature: Ceres ANNOT ID no. 6054947
  misc_feature (9)..(82): Pfam Id: RNA_pol_Rpb7_N Pfam Desc: RNA polymerase Rpb7-like, N-terminal domain
  misc_feature (2)..(175): NCBI GI: 42566796 NCBI Desc: rna polymerase rpb7 n-terminal domain-containing protein [arabidopsis thaliana]
  misc_feature (19)..(175): NCBI GI: 7268172 NCBI Desc: rna polymerase ii fifth largest subunit like protein [arabidopsis thaliana]
  misc_feature (2)..(174): NCBI GI: 21553765 NCBI Desc: rna polymerase ii fifth largest subunit-like protein [arabidopsis thaliana]
  misc_feature (23)..(174): NCBI GI: 11994719 NCBI Desc: rna polymerase ii fifth largest subunit-like protein [arabidopsis thaliana]
  misc_feature (11)..(173): NCBI GI: 1173137 NCBI Desc: dna-directed rna polymerase ii 19 kda polypeptide (rna polymerase ii subunit 5)
MVLLEAEMSWNVLISPSQLDRKGLLLRKAIIVRLLEDVTNRRASKEHGYYVAVSQLKAISEGKVRELTGDVLFPVSFTCITLKPMKGEVMVGHVDRILKHGVFLKSGPVESIFLAEKSMSDYKYIGGENAMFMNDHSKLEKDTAVRFKVLGFRWMEADRQFQLLATIAGDFLGPL

SEQ ID NO: 5875 - DNA, 1272 bp, Sorghum bicolor
  misc_feature: Ceres ANNOT ID no. 6054948
  misc_feature: Encodes the peptide sequence at SEQ ID NO 5876
atggccgccgtcccggtcccgccaccgcctctcctcgcctcccacgcggccgtccgggccgcggcctccgccgtatcccactcccgccgggtccgcctcgccggcgaccacccgccgcaggtcgcggctctccggcgcggcgactgggtcaagctcatctgtggcgccagcttcgaggatgctgctgatgtcaggaacctctcccttgtctacactcttgctggagtggattgcatcgattgtgcagcagatgcatctgtggtgggtgcagtgaatgagggtattgatgtagcggcatcaatcgtaccagaagttcaaaggccatgggtgatgattagtgttaatgatgattgcagagatcttcatttccgtaaagctgggtttgatcctgaggattgcccaccggattgctcaaagccatgtgagaaagtttgcccggctgatgcaatatcactagagcattccatggttggtggagagcacactggatctgatcctttacgtggtaaatatgagggtggtgtaattacagagcggtgctatggatgcggtcgatgcttaccagtttgcccatatgacagaataagagctgtgtcctatgttcgggaccctactatgactgctgaattattgaaaagtaatgatgttgatgcaatagagatacataccactggaaagggaactgatatgttcaataccctctgggacagcttgagtgggtccatcaataatgtgaagctggttgcagttagtcttcctaatataggagaatcaactgccgatctcatgaatgcaatgtacataataatggagtcccaatttaaagggtataatctttggcagttagatggccgacctatgagtggcgacattggccgaggtgcaacaagggagacagtttcttttgccactcatgtggcttcaatgtcagaaagacctcctggcttctatcagttggccggtggcaccaactcatacactattgactgcttaaagaaagctggtcttttccaatctatttctgttgcagggaccgcagcctctgaaatagccagttctcaccaagctttaatcggagggattgcttatggtggctatgctcgcaagatcgttggacgggctttgcgcaaaataccagaacagtttggtcgtgtgcgcatcgaggatcatccggatcatctactggaggcactacaagaagccatgtcattaataggacctgtgaaggattataatccagtccttccaagcctttcccatgacacaagttga

SEQ ID NO: 5876 - protein, 423 aa, Sorghum bicolor
  misc_feature: Ceres ANNOT ID no. 6054948
  misc_feature (173)..(196): Pfam Id: Fer4 Pfam Desc: 4Fe-4S binding domain
  misc_feature (43)..(409): NCBI GI: 124359951 NCBI Desc: 4fe-4s ferredoxin, iron-sulfur binding [medicago truncatula]
  misc_feature (43)..(409): NCBI GI: 75906350 NCBI Desc: 4fe-4s ferredoxin, iron-sulfur binding [anabaena variabilis atcc 29413]
  misc_feature (43)..(409): NCBI GI: 119512853 NCBI Desc: 4fe-4s ferredoxin, iron-sulfur binding [nodularia spumigena ccy9414]
  misc_feature (43)..(388): NCBI GI: 113476581 NCBI Desc: 4fe-4s ferredoxin, iron-sulfur binding [trichodesmium erythraeum ims101]
  misc_feature (43)..(349): NCBI GI: 23127909 NCBI Desc: cog1142: fe-s-cluster-containing hydrogenase components 2 [nostoc punctiforme pcc 73102]
MAAVPVPPPPLLASHAAVRAAASAVSHSRRVRLAGDHPPQVAALRRGDWVKLICGASFEDAADVRNLSLVYTLAGVDCIDCAADASVVGAVNEGIDVAASIVPEVQRPWVMISVNDDCRDLHFRKAGFDPEDCPPDCSKPCEKVCPADAISLEHSMVGGEHTGSDPLRGKYEGGVITERCYGCGRCLPVCPYDRIRAVSYVRDPTMTAELLKSNDVDAIEIHTTGKGTDMFNTLWDSLSGSINNVKLVAVSLPNIGESTADLMNAMYIIMESQFKGYNLWQLDGRPMSGDIGRGATRETVSFATHVASMSERPPGFYQLAGGTNSYTIDCLKKAGLFQSISVAGTAASEIASSHQALIGGIAYGGYARKIVGRALRKIPEQFGRVRIEDHPDHLLEALQEAMSLIGPVKDYNPVLPSLSHDTS

SEQ ID NO: 5877 - DNA, 1269 bp, Sorghum bicolor
  misc_feature: Ceres ANNOT ID no. 6054966
  misc_feature: Encodes the peptide sequence at SEQ ID NO 5878
atggcgagcgcggggaacggcggcggcggaggcggagtcggggcgctgaagcggtccatgggcccgctgcggctgcagtactacatcgtgatgggcgcggtggcggcggcggtggtgctagccacgctgcggtacatgccgggcccggcaatccccgcgaccgccaccgccggtagcagcgctaccaccaccagcggcggcggcggcgctgtggtgcggtcggccccagcagccgccgctgaggtggaggatgaggagcaggcgcaggaggggacgacgacggcgacgacgaagaagaagaggaggaagaagggggacgggctggtgctgttcaacttcggcgactccaactccgacacgggcggcgtggcggcggtgatggggatccgtatcgcgccgcccgaagggagggcctacttccaccaccccacgggacggctctccgacggccgcgtcatcctcgacttcatctgtgagagcctgggcacgccgcacctgagcccgttcatgaagccgctgggctccaactacacccacggcgtcaacttcgccatcgccggatcaacggccacgccgggaactaccaccttctcgctggacgtgcaagtggaccagttcgtcttcttcaaggagaggtgcctcgacctcatcgacagaggtgaggctgccccaatcgaagagaaggcgttcccagatgctatatacttcatggacatcgggcacaatgacatcaacggtgttctccacttgccctatcatacgatgctcgaaaagcttccccctgtaattgctgaaatcaagaaagccatcgagaggttgcacaagaacggagccaggaagttctggatacatgggacgggagcgttggggtgcatgcctcagaagctttcgatgccgagggatgacgacagcgacctcgatgagcatgggtgcatcgcgaccatcaacaatagttcaacgatcgtcttcgtggatatgtttgctatcaagtatgatcttgttgccaaccacacgaaatacgggattgagaagccattgatgacatgttgtggtcatggaggccccccttacaactatgaccccaaggagagctgcatgacttcggacaaatacctgtgtaagcttggcgaaaagttcataagctgggacggggttcactttaccgatgctgcaaacggcattgtggcttccaaagtgctcagtggcgagtacaacattcccagggtcaagctgaccagcctcctccccaaaccaaaatccgatgaataa

SEQ ID NO: 5878 - protein, 422 aa, Sorghum bicolor
  misc_feature: Ceres ANNOT ID no. 6054966
  misc_feature (110)..(399): Pfam Id: Lipase_GDSL Pfam Desc: GDSL-like Lipase/Acylhydrolase
  misc_feature (318)..(419): NCBI GI: 115462233 NCBI Desc: os05g0159300 [oryza sativa (japonica cultivar-group)]
  misc_feature (159)..(319): NCBI GI: 115436334 NCBI Desc: os01g0330100 [oryza sativa (japonica cultivar-group)]
  misc_feature (110)..(318): NCBI GI: 87240518 NCBI Desc: lipolytic enzyme, g-d-s-l [medicago truncatula]
  misc_feature (110)..(329): NCBI GI: 115463771 NCBI Desc: os05g0401000 [oryza sativa (japonica cultivar-group)]
  misc_feature (110)..(319): NCBI GI: 140071480 NCBI Desc: lipolytic enzyme, g-d-s-l [medicago truncatula]
MASAGNGGGGGGVGALKRSMGPLRLQYYIVMGAVAAAVVLATLRYMPGPAIPATATAGSSATTTSGGGGAVVRSAPAAAAEVEDEEQAQEGTTTATTKKKRRKKGDGLVLFNFGDSNSDTGGVAAVMGIRIAPPEGRAYFHHPTGRLSDGRVILDFICESLGTPHLSPFMKPLGSNYTHGVNFAIAGSTATPGTTTFSLDVQVDQFVFFKERCLDLIDRGEAAPIEEKAFPDAIYFMDIGHNDINGVLHLPYHTMLEKLPPVIAEIKKAIERLHKNGARKFWIHGTGALGCMPQKLSMPRDDDSDLDEHGCIATINNSSTIVFVDMFAIKYDLVANHTKYGIEKPLMTCCGHGGPPYNYDPKESCMTSDKYLCKLGEKFISWDGVHFTDAANGIVASKVLSGEYNIPRVKLTSLLPKPKSDE

SEQ ID NO: 5879 - DNA, 1503 bp, Sorghum bicolor
  misc_feature: Ceres ANNOT ID no. 6054971
  misc_feature: Encodes the peptide sequence at SEQ ID NO 5880
atggcgatggcgagcctcgcgaggaggcgcgcggcggatgcgctgctgcggcggccgcaggcgggggcatgggcgtcggcactcagggcgtacgcgacgatcgaggacaccgacgtggtggtggtcggcggcgggcccggcgggtacgtggcggcgatcaaggcggcgcagctggggctcaggaccacctgcatcgagaagaggggcaccttgggcggcacctgcctcaacgtcggctgcatcccgtccaaggctcttcttcattcgtcacacatgtaccatgaggcaaagagttcttttgcacaccatggtgtgaagttttccaatctagaaatagatctgcctgccatgatgtcgcagaaagacaaggctgttgctggtcttacaaaaggtattgaaggcctgttcatgaagaacaaggttgaatacgtgagaggaattgggaggcttgtctccccttctgaagtagccgtggacttgcttgatggtgggtgcactaccgtcaaaggaaagaacataatcattgctactggttcagatgtgaaatcactccctggagttcatatagacgagaaaaagattgtatcatctactggtgctcttgctcttaaagaaatacctaagaagttggtggttattggagctggatacataggtttagagatgggctctgtctggaacaggctagggtctgaggttactgttgtggaatttgctcgtgacattgtcccatcaatggatggagagattaggaagcagttccagcgaatgttggagaagcagaaaatgaagttcatgctcaagacaaaggtaattggggttgatacttctgggagtggtgttaagttaactgtggaacctgctgctggtggagagcagagtgtgcttgacgcagatattgtcctggtatctgctggcagaacaccatacactgctgaccttgggttggacaccatcggtgttgagatggacaagggtggaagaatccttgttgacaagcgctttatgacaaatgttaatggggtctatgcgattggtgatgtgatacctggacccatgcttgcacacaaagctgaagaagatgggattgcatgcgtcgagttcatcgcagggaaggaaggccatgtagattatgatagtgtgcccggcgtggtgtacacccaccctgaggtggcctctgttggcaagacagaggaacaggtgaaggaatcaggcattgcctaccaggttggaaagttccctctattggcaaacagccgcgcaaaggcgattgatgacgctgaagggttggtgaaggtggtggctgagaaggaaaccgacagagttctcggcgtgcacatcatggcccctaatgctggcgagatcatccatgaggccgtgcttgcacttcagtatggagcatcaagcgaggatatcgcccgcacatgccatgctcatccgacggttagtgaggccctgaaggaagcctgccttgacacctacacaaagccaatccatatgtga

SEQ ID NO: 5880 - protein, 500 aa, Sorghum bicolor
  misc_feature: Ceres ANNOT ID no. 6054971
  misc_feature (38)..(352): Pfam Id: Pyr_redox_2 Pfam Desc: Pyridine nucleotide-disulphide oxidoreductase
  misc_feature (381)..(490): Pfam Id: Pyr_redox_dim Pfam Desc: Pyridine nucleotide-disulphide oxidoreductase, dimerisationdomain
  misc_feature (209)..(306): Pfam Id: Pyr_redox Pfam Desc: Pyridine nucleotide-disulphide oxidoreductase
  misc_feature (37)..(358): Pfam Id: HI0933_like Pfam Desc: HI0933-like protein
  misc_feature (1)..(500): NCBI GI: 23321340 NCBI Desc: dihydrolipoamide dehydrogenase precursor [lycopersicon esculentum]
  misc_feature (1)..(500): NCBI GI: 44662784 NCBI Desc: lipoamide dehydrogenase [capsicum annuum]
  misc_feature (1)..(500): NCBI GI: 10444388 NCBI Desc: dihydrolipoamide dehydrogenase precursor [solanum tuberosum]
  misc_feature (1)..(500): NCBI GI: 3309269 NCBI Desc: ferric leghemoglobin reductase-2 precursor [glycine max]
  misc_feature (1)..(500): NCBI GI: 13873336 NCBI Desc: dihydrolipoamide dehydrogenase precursor [bruguiera gymnorrhiza]
  misc_feature (1)..(500): SWISSPROT Homolog: EC 1.8.1.4 Dihydrolipoyl dehydrogenase, mitochondrial precursor
MAMASLARRRAADALLRRPQAGAWASALRAYATIEDTDVVVVGGGPGGYVAAIKAAQLGLRTTCIEKRGTLGGTCLNVGCIPSKALLHSSHMYHEAKSSFAHHGVKFSNLEIDLPAMMSQKDKAVAGLTKGIEGLFMKNKVEYVRGIGRLVSPSEVAVDLLDGGCTTVKGKNIIIATGSDVKSLPGVHIDEKKIVSSTGALALKEIPKKLVVIGAGYIGLEMGSVWNRLGSEVTVVEFARDIVPSMDGEIRKQFQRMLEKQKMKFMLKTKVIGVDTSGSGVKLTVEPAAGGEQSVLDADIVLVSAGRTPYTADLGLDTIGVEMDKGGRILVDKRFMTNVNGVYAIGDVIPGPMLAHKAEEDGIACVEFIAGKEGHVDYDSVPGVVYTHPEVASVGKTEEQVKESGIAYQVGKFPLLANSRAKAIDDAEGLVKVVAEKETDRVLGVHIMAPNAGEIIHEAVLALQYGASSEDIARTCHAHPTVSEALKEACLDTYTKPIHM

SEQ ID NO: 5881 - DNA, 825 bp, Sorghum bicolor
  misc_feature: Ceres ANNOT ID no. 6055016
  misc_feature: Encodes the peptide sequence at SEQ ID NO 5882
atggcgtctcgctctcgccacgccgccggccttctcctcgccgtcgccgccgtcgtcgtcctatcctccgcggcgccggtagcgcacggccaggcagcgacagcaccatccccagccccggcggcgccgaagacgatcacggcgatcctaagcaaagccgggcagttcaccaagttcatccagctgctgcaatccacgcgcgaggcggagcagatcacgaaccagctcaagggcaagtcgtcgtcgtccggcggcctcacggtgttcgcgccgcccgacagcgcgttctcggcgctgcccaagggcacgctcaactccctctccgaccagcagaagacgtcgctggtgcagttccacgtcgtctcggcggcgctcgcggcggcgcagctggagacggtcagcaacccgctgcggacgcaggcgggggacaccgggaggggaaagtacccgctcaacctcaccgccgacggcaccaacgtcaacatctccaccggggtggtgaacgccacgctcgacggcacgccgctctacgccggggacaggctcgtcgtctaccaggtcgacaaggtgctcctgccatgggcgctctacggcccgcccgtcccggcgcccgcgcccgcgcccgccgcgagcaagaagaagaagaaggccgcgccggatgcggtggctgacgcgcccgcggctgagaccgcggcggggacgacgacgacgacggcgtcggcggctacgcgcgcgcgcggtggcgtcggagctgctgctgccgccgccgcttcgtcctgcgcggcggccgccgccgccgtggcagctttgtggtgggccatctga

SEQ ID NO: 5882 - protein, 274 aa, Sorghum bicolor
  misc_feature: Ceres ANNOT ID no. 6055016
  misc_feature (55)..(193): Pfam Id: Fasciclin Pfam Desc: Fasciclin domain
  misc_feature (1)..(260): NCBI GI: 115462271 NCBI Desc: os05g0163300 [oryza sativa (japonica cultivar-group)]
  misc_feature (21)..(263): NCBI GI: 115349918 NCBI Desc: fasciclin-like protein fla17 [triticum aestivum]
  misc_feature (1)..(263): NCBI GI: 115349916 NCBI Desc: fasciclin-like protein fla16 [triticum aestivum]
  misc_feature (1)..(260): NCBI GI: 115349920 NCBI Desc: fasciclin-like protein fla18 [triticum aestivum]
  misc_feature (33)..(259): NCBI GI: 30841338 NCBI Desc: arabinogalactan protein [gossypium hirsutum]
  misc_feature: Useful for making plants with altered cell wall content and/or composition
  misc_feature: Functional homolog of the protein sequence encoded by LOCUS at5g03170
  misc_feature: Useful for making plants with altered carbohydrate content
  misc_feature: Functional homolog of the protein sequence given in SEQ ID NO 13936
  misc_feature: Useful for making plants with altered cell wall content and/or composition
  misc_feature: Functional homolog of the protein sequence given in SEQ ID NO 13937
MASRSRHAAGLLLAVAAVVVLSSAAPVAHGQAATAPSPAPAAPKTITAILSKAGQFTKFIQLLQSTREAEQITNQLKGKSSSSGGLTVFAPPDSAFSALPKGTLNSLSDQQKTSLVQFHVVSAALAAAQLETVSNPLRTQAGDTGRGKYPLNLTADGTNVNISTGVVNATLDGTPLYAGDRLVVYQVDKVLLPWALYGPPVPAPAPAPAASKKKKKAAPDAVADAPAAETAAGTTTTTASAATRARGGVGAAAAAAASSCAAAAAAVAALWWAI

SEQ ID NO: 5883 - DNA, 1620 bp, Sorghum bicolor
  misc_feature: Ceres ANNOT ID no. 6055017
  misc_feature: Encodes the peptide sequence at SEQ ID NO 5884
atggcgggacatcatcataataacacacatgcctccaggatggatcatgtgaacaggttccagagtgaaccgcagccttttggtccaaagttatttatgcattctagaactgatgcagcaaatggagctctatcatcaggttatgggggcgcaccaataagaccaaatgacattccatcctcaagtcacactgggcaatctcatattcagcatagtgatgctcctggaaccatgcttgcatcgtattctggctatcctcatgctggaagctccagcagcatctatgcaccacataatactcatcatccgccgcctttgagttatccacataggtctgaggataacttcattccgagttcccatatggatgacagaagggttgcactgaagcggagaaatccaattattcatccagtggatggagtcaatattgggagctcttatgctggcagttcatctaatcctcagttctctcgctacatgcctccaaatcatattcctgctcctgaaccctgcccttctcgaataacatcaaatatgggttcgagatactggagtgatcatccctttggtggccatggaggatctcagaggaatgtgagaggccgccatgatcacaatcccatccatttgggacacaatccaggtgtaccttgcgcatcaagcagcactcatgggccaccacaccaaactaatgtaattggtcatcctcgaagtacagcagtgccacaagatagagcgcatttttctatacctccaagagtggcagccccagggaccgatggaaactctagtatggtcttcagggagaggccatactattctgctccgcagaggaccaacataaatgccccccctgtcccaacacctcctggttcttctgatagtctacattttgtgcatggtgggtatgcccccagagcagcccctcctaacaccatcagcacatatcctgccccagcttttgcgacttctaacaacacggtgacagtcacccatgagcctgatatccctagctatcggcctgctgtccctagctacccgcctgctacctcagcagcagcatcaagtattcatgctgaagctgctacatctccaagacatctggggcatgtggctctaggttccggtggtagtgcaaggagtagaaggctgagggattcgtaccatgcttttcgtccactgattattgaagaaaataacttgagaggaccagcagctgagcggtttatgatgctggatgagttagttatccatgaatcgagagaagattctgatcctcactgggacatgagactggacattgatgatatgagttacgaggtagagctgctggctttgggagaacgaataggcaatgtcaacactggcctagctgatgaaaaactttcaagctgtgtgatggagataacttgctgcagctctgcccgtacccatggtgatactgagagcgcaagatgtgtaatttgcctggaggattacaaattcaaggactctatcggaaagctgaaatgcggtcacgactaccacgcagactgcatcaagaagtggctgcaggtgaagaacgcttgcccagtctgcaaagcttctgcggcagacgacagcggaggcaccgaatga

SEQ ID NO: 5884 - protein, 539 aa, Sorghum bicolor
  misc_feature: Ceres ANNOT ID no. 6055017
  misc_feature (487)..(527): Pfam Id: zf-C3HC4 Pfam Desc: Zinc finger, C3HC4 type (RING finger)
  misc_feature (238)..(532): NCBI GI: 115434650 NCBI Desc: os01g0159300 [oryza sativa (japonica cultivar-group)]
  misc_feature (7)..(530): NCBI GI: 1771195 NCBI Desc: ring-finger protein [lotus corniculatus var. japonicus]
  misc_feature (40)..(531): NCBI GI: 92868263 NCBI Desc: zinc finger, ring-type; ringv [medicago truncatula]
  misc_feature (70)..(530): NCBI GI: 4240031 NCBI Desc: dna binding zinc finger protein (pspzf) [pisum sativum]
  misc_feature (397)..(537): NCBI GI: 558543 NCBI Desc: c-terminal zinc-finger [glycine max]
  misc_feature: The sequence is a functional homolog of SEQ ID NO. 271 in the 11/188,298 US application
  misc_feature: The sequence is a functional homolog of SEQ ID NO. 329 in the 11/188,298 US application
  misc_feature: The sequence is a functional homolog of SEQ ID NO. 468 in the 11/188,298 US application
  misc_feature: The sequence is a functional homolog of SEQ ID NO. 350 in the 11/188,298 US application
MAGHHHNNTHASRMDHVNRFQSEPQPFGPKLFMHSRTDAANGALSSGYGGAPIRPNDIPSSSHTGQSHIQHSDAPGTMLASYSGYPHAGSSSSIYAPHNTHHPPPLSYPHRSEDNFIPSSHMDDRRVALKRRNPIIHPVDGVNIGSSYAGSSSNPQFSRYMPPNHIPAPEPCPSRITSNMGSRYWSDHPFGGHGGSQRNVRGRHDHNPIHLGHNPGVPCASSSTHGPPHQTNVIGHPRSTAVPQDRAHFSIPPRVAAPGTDGNSSMVFRERPYYSAPQRTNINAPPVPTPPGSSDSLHFVHGGYAPRAAPPNTISTYPAPAFATSNNTVTVTHEPDIPSYRPAVPSYPPATSAAASSIHAEAATSPRHLGHVALGSGGSARSRRLRDSYHAFRPLIIEENNLRGPAAERFMMLDELVIHESREDSDPHWDMRLDIDDMSYEVELLALGERIGNVNTGLADEKLSSCVMEITCCSSARTHGDTESARCVICLEDYKFKDSIGKLKCGHDYHADCIKKWLQVKNACPVCKASAADDSGGTE

SEQ ID NO: 5885 - DNA, 2307 bp, Sorghum bicolor
  misc_feature: Ceres ANNOT ID no. 6055020
  misc_feature: Encodes the peptide sequence at SEQ ID NO 5886
atggggacgtcggggtccaagagcatcgacggcgtgggcgccgtctcgggcgtcggcgccgccgcggcggggctgggcggcgccggcggggagggcggcgagggcggcgccgcggaggcgtggcacggcggggcgcagctgtacgtgtcgctcaagatggagaacgcggagatcagcggcgacctcgtcccgcacgtctacggctccgagcccatcatcggcacctgggacccttcccgcctcgccatggagagggagctcgcgtctatgtgggagctcagcttcgtcgtgccgccggaccatgaaacactggacttcaagttcttgctgaagcccaaagacgccgaaaccccctgcatcattgaggaagggcccacgcgtctcctcaccggaggcatgctcgagggcgatgtgagggttgcgctgttcaagctcaatggagatgatgaggtgctcgagttcagggtgttcaacaaggcagaccttgtgtcaccgctcgaacttgctgcgagctggagggtgtacaaggagaactttcagccttccaaagtcagggggatacctgatatcagtatcaatgtcgcgcccactaatgcaactgaggaaggatcagcggctactttggaacttgacttggaacactatgttgttccgtccccgccgactgcaccaccaaatggatatgctgcaaaccttgctgcgactccagcatccatgattcaaactggggcatcgtggacaaatgatatccttctaagtgatgggattcaaagtccaagtagtgtttctgcaaaattagaagatcgtagtaacaacaagaagaatattgaggcctgggcaacagattcttctaagaattctggactcattgaatcaaaatcagttggcacctttacaccactgcaaaagctagatggtcaaaaggggctgttcgttgacaggggtgttggctctcctatgcttccaaaatcagccagtgcatgctccctggcatctgggtttagttttggatcagcaaagactatgcctgaagcagcaggagctgttgcagctgcagctgtagctgatcgattgcatgggtcaaaggaggaccggaagctggccattgttttggttggcctaccagctcgtggtaaaaccttcactgcggttaagcttacaaggtaccttcgttggttgggtcatgaaactagacatttcaatgttgggaagtatcgccgtctgaagcatggagcaaatcagcctgcagactttttccgtgatgataaccctgaaggtattgaggcacgtaatgaggtggctgctttagcgatggaggacatgatagattggatgaatggtggaggtcaggttggtatatttgacgcaacaaacagcacaagaaagcgaagatatatgctaatgaaaatggctgaaggtaactgtaagattatatttctggagacaatatgtaatgatccaaatataatcgaaagaaatatacggctgaagatccaacaaagtccagactatgctgatcagccagattatgaagctggactggaggacttcaaggaacgtttgatcaattatgaaaaggtctacgagccagtaggggaaggttcttacatcaaaatgattgacatggtaaaggggcaagatggtcagttacaggtaaataatatcagcggttatctccctgggaggattgtcttcttcttggtgaactctcatcttacaccacgacctattttgcttaccaggcatggtgagagtttacataatgttagaggaagagtcggtggtgatacagttctaagtgaaactggagaactttatgcaaagaaactagccaactttatagaaaagcggctcaaatatgagaaaacagcaactatatggaccagtacccttcagagaacaattttgacagcaagtccaattgttggatttcctaagatacaatggcgtgctcttgatgagatcaattctggagtttgtgatgggatgacttatgaagagataaagaaaaatatgcccgaggaatttgagtcacgcaagaaggacaagctaagatatcgctacccccgtggagaatcttaccttgacgttatacagaggttggaacccgtcatcattgagctagaacgccagcgtgcaccagtggttgtcatatctcaccaggctgtactgcgagcactgtatgcatatttcgcggacaggcctttgagagaagttccagatatagagatgccactacacaccataatcgagatacaaatgggcgttctcggtgttgaagagaagaggtacaaactcatggactga

SEQ ID NO: 5886 - protein, 768 aa, Sorghum bicolor
  misc_feature: Ceres ANNOT ID no. 6055020
  misc_feature (355)..(574): Pfam Id: 6PF2K Pfam Desc: 6-phosphofructo-2-kinase
  misc_feature (576)..(727): Pfam Id: PGAM Pfam Desc: Phosphoglycerate mutase family
  misc_feature (32)..(768): NCBI GI: 15824754 NCBI Desc: fructose-6-phosphate-2-kinase/fructose-2,6-bisphosphatase [zea mays]
  misc_feature (1)..(768): NCBI GI: 115462281 NCBI Desc: os05g0164100 [oryza sativa (japonica cultivar-group)]
  misc_feature (33)..(768): NCBI GI: 18251459 NCBI Desc: fructose-6-phosphate-2-kinase/fructose-2,6-bisphosphatase [oryza sativa]
  misc_feature (27)..(768): NCBI GI: 14149116 NCBI Desc: fructose-6-phosphate 2-kinase/fructose-2,6-bisphosphatase [bruguiera gymnorrhiza]
  misc_feature (43)..(768): NCBI GI: 15222304 NCBI Desc: fructose-6-phosphate 2-kinase / fructose-2,6-bisphosphatase (f2kp) [arabidopsis thaliana]
MGTSGSKSIDGVGAVSGVGAAAAGLGGAGGEGGEGGAAEAWHGGAQLYVSLKMENAEISGDLVPHVYGSEPIIGTWDPSRLAMERELASMWELSFVVPPDHETLDFKFLLKPKDAETPCIIEEGPTRLLTGGMLEGDVRVALFKLNGDDEVLEFRVFNKADLVSPLELAASWRVYKENFQPSKVRGIPDISINVAPTNATEEGSAATLELDLEHYVVPSPPTAPPNGYAANLAATPASMIQTGASWTNDILLSDGIQSPSSVSAKLEDRSNNKKNIEAWATDSSKNSGLIESKSVGTFTPLQKLDGQKGLFVDRGVGSPMLPKSASACSLASGFSFGSAKTMPEAAGAVAAAAVADRLHGSKEDRKLAIVLVGLPARGKTFTAVKLTRYLRWLGHETRHFNVGKYRRLKHGANQPADFFRDDNPEGIEARNEVAALAMEDMIDWMNGGGQVGIFDATNSTRKRRYMLMKMAEGNCKIIFLETICNDPNIIERNIRLKIQQSPDYADQPDYEAGLEDFKERLINYEKVYEPVGEGSYIKMIDMVKGQDGQLQVNNISGYLPGRIVFFLVNSHLTPRPILLTRHGESLHNVRGRVGGDTVLSETGELYAKKLANFIEKRLKYEKTATIWTSTLQRTILTASPIVGFPKIQWRALDEINSGVCDGMTYEEIKKNMPEEFESRKKDKLRYRYPRGESYLDVIQRLEPVIIELERQRAPVVVISHQAVLRALYAYFADRPLREVPDIEMPLHTIIEIQMGVLGVEEKRYKLMD

SEQ ID NO: 5887 - DNA, 1302 bp, Sorghum bicolor
  misc_feature: Ceres ANNOT ID no. 6055040
  misc_feature: Encodes the peptide sequence at SEQ ID NO 5888
atgggcagcttgggaggtagcgccggtgctggggacggcggcaaggtcgggctgccggcgctggacgtggcgctcgcgttcccgcaggctacgccggcatcgctcttcccgcccgccgcctcggactactaccaatttgatgatttgctgactgaagaagagaaggcactcaggaagaaggtccggggtatcatggaaaaggaaatcccgcccattatgacggagtattgggagaaggctgaattcccattccatgccattcccagccttgccagtctcggcttagctggtggaacaataaaggggtatgggtgcccaggactctcgcttacagctagtgctatttcgatagcagaagttgcacgggtcgatgcgagctgctccacatttattctagtgcactcctcgttggctatgtccacgattgccctttgtggatctgaggctcaaaagcagaaatacttgccatctcttgccgagttcaaaactattggttgttgggctttgacagagccagattatggaagtgatgcaagctccctaaggactgcagcaaccaaggtacctggtggttggcagttagatggacaaaaacgctggataggtaacagcacttttgcagatgtcctcgtcattttggctaggaatgcagatacgaaccaactaaatggatttattgtaaagaaaggagctcccggtctaaaagcgacaaaaattcaaaacaaaattggactcagaatggttcaaaatggagacataattctaaataaagtatttgtccctgaggaagatagattaacaggcatcaattcatttcaggatataaacaaggtcctcgctatgtctcgaattatggtggcatggcaaccaataggcatatcaatgggagtttttgacatctgccatcggtatttgaaagaaaggaagcaatttggagctccactggcagcttttcagctgaatcaagaaaagcttgtccgaatgcttggcaacattcaggctatgcttctcgttggctggcgtctgtgcaagttctatgagtcaggcaaaatgacaccaggccgatctagtttaggcaaggcgtggacatcccagaaggctagggaggtagtttctcttggacgagagctactgggtggcaatggcattttggctgattttcttgttgccaaggcgttttgtgacctggagcccattttctcttacgagggcacctatgacattaacagcctggtaactggcagagagatcaccgggatcgcgagcttcaagcctgctatgtcagcaaaatcacgcctgtga

SEQ ID NO: 5888 - protein, 433 aa, Sorghum bicolor
  misc_feature: Ceres ANNOT ID no. 6055040
  misc_feature (272)..(418): Pfam Id: Acyl-CoA_dh_1 Pfam Desc: Acyl-CoA dehydrogenase, C-terminal domain
  misc_feature (166)..(218): Pfam Id: Acyl-CoA_dh_M Pfam Desc: Acyl-CoA dehydrogenase, middle domain
  misc_feature (51)..(162): Pfam Id: Acyl-CoA_dh_N Pfam Desc: Acyl-CoA dehydrogenase, N-terminal domain
  misc_feature (18)..(433): NCBI GI: 114794826 NCBI Desc: chain a, short chain specific acyl-coa oxidase from arabidopsis thaliana, acx4
  misc_feature (42)..(423): NCBI GI: 76260706 NCBI Desc: acyl-coa dehydrogenase, c-terminal:acyl-coa dehydrogenase, central region:acyl-coa dehydrogenase, n-terminal:acyl-coa dehydrogenase, n-terminal [chloroflexus
  misc_feature (42)..(423): NCBI GI: 76260706 (continued) aurantiacus j-10-fl]
  misc_feature (42)..(423): NCBI GI: 118046098 NCBI Desc: acyl-coa dehydrogenase-like [chloroflexus aggregans dsm 9485]
  misc_feature (40)..(423): NCBI GI: 113940286 NCBI Desc: acyl-coa dehydrogenase-like [herpetosiphon aurantiacus atcc 23779]
  misc_feature (37)..(423): NCBI GI: 86141033 NCBI Desc: acyl-coa dehydrogenase [flavobacterium sp. med217]
  misc_feature (18)..(433): SWISSPROT Homolog: EC 1.3.3.6 Acyl-coenzyme A oxidase 4, peroxisomal
MGSLGGSAGAGDGGKVGLPALDVALAFPQATPASLFPPAASDYYQFDDLLTEEEKALRKKVRGIMEKEIPPIMTEYWEKAEFPFHAIPSLASLGLAGGTIKGYGCPGLSLTASAISIAEVARVDASCSTFILVHSSLAMSTIALCGSEAQKQKYLPSLAEFKTIGCWALTEPDYGSDASSLRTAATKVPGGWQLDGQKRWIGNSTFADVLVILARNADTNQLNGFIVKKGAPGLKATKIQNKIGLRMVQNGDIILNKVFVPEEDRLTGINSFQDINKVLAMSRIMVAWQPIGISMGVFDICHRYLKERKQFGAPLAAFQLNQEKLVRMLGNIQAMLLVGWRLCKFYESGKMTPGRSSLGKAWTSQKAREVVSLGRELLGGNGILADFLVAKAFCDLEPIFSYEGTYDINSLVTGREITGIASFKPAMSAKSRL

SEQ ID NO: 5889 - DNA, 285 bp, Sorghum bicolor
  misc_feature: Ceres ANNOT ID no. 6055042
  misc_feature: Encodes the peptide sequence at SEQ ID NO 5890
atggcctgcttcctcgccgccggccacgcggcagctaagaggtccgccggaacggtgctgcgccgccgtgggttcgccgcctccgccactgcacgccgccacgacgacgcgaaggaggccgtgaagtgggagcggatcacgtacgccgggatcgctacgtgcaccgtgctggccatgttcaacctgtccaagggacaccaggaattccccgacccaccgccgaacccgtacctgcacatcaggaacaaggacttcccctggggtaaggccttgttttgttcgtga

SEQ ID NO: 5890 - protein, 94 aa, Sorghum bicolor
  misc_feature: Ceres ANNOT ID no. 6055042
  misc_feature (6)..(77): NCBI GI: 145334259 NCBI Desc: cytochrome c oxidase-related [arabidopsis thaliana]
  misc_feature (21)..(92): NCBI GI: 62858031 NCBI Desc: cox6a2 [xenopus tropicalis]
  misc_feature (6)..(92): NCBI GI: 53933242 NCBI Desc: zgc:103782 [danio rerio]
  misc_feature (23)..(88): NCBI GI: 180946 NCBI Desc: cytochrome c oxidase subunit via
MACFLAAGHAAAKRSAGTVLRRRGFAASATARRHDDAKEAVKWERITYAGIATCTVLAMFNLSKGHQEFPDPPPNPYLHIRNKDFPWGKALFCS

SEQ ID NO: 5891 - DNA, 1236 bp, Sorghum bicolor
  misc_feature: Ceres ANNOT ID no. 6055053
  misc_feature: Encodes the peptide sequence at SEQ ID NO 5892
atggcgtcgtcgagcgcggctgctgctaccagtgatgacagccagggcctcaaggctcgagatgtctgcatcgtcggcgtcgcccgcacgcccatcggcgccctccttggctcgctctcgtccctcccggccaccaagctcggctccatcgccatccagggtgctcttaagagggcgaaggtggacccggcgctcgtgcaggaggtgttcatgggcaacgtcctcagcgctaatctcggccaggccccggcaaggcaggcggcccttggcgccggcttgcccaactccgtcccctgcaccaccgtcaacaaagtttgctcctcaggaatgaaggctgtcatgtttgcggcgcaaagtattcagctggggatcaatgatgtcgtggtcgccggcggcatggagagcatgtcgaatgcacccaaatatgtggctgaagcaagacgagggtcacggttcggacatgatgtcctggttgacggcatgctcaaggatggcctgtgggatgtctataatgatttcccaatgggaatgtgtgctgaattgtgttcagaccagcactccatctcaagagaggagcaggattcttatgctatcctcagcaatgaacgtggactagcagctcgggacagcggtgcattttcttgggagattattcctgttgaagtttcttctggtagagggaaaccaccagtagttgtggacaaggatgagagtcttgcaaagtttgatccagtaaagctgaagaaacttgggccaacttttaagacgaatggttctgtgacggctggtaattcttctagtataagtgatggcgctgctgcaattgtccttgtcagtggagagaaagctaagaaacttggcctgcaagttattgcaaggattagagggtatgctgatgctgcacaggctccagagctgtttacaacagctccagctcttgctattccaaaggctatatcaaatgcagctcttcaaacttcacagattgattattatgaaataaatgaggctttctctgttgttgctgtagctaatcagaggcttcttggtatcccttctggaaagctaaacttaagtggtggtgctgtttctctgggccatcctatcggctgcagtggtgcacggattatagtcactctgcttgggattcttaggcagaaaaatggaaaatttggtgttgctggagtttgcaatggtggcggcggcgcttcagccctcgttttggagctcatgtaa

SEQ ID NO: 5892 - protein, 411 aa, Sorghum bicolor
  misc_feature: Ceres ANNOT ID no. 6055053
  misc_feature (19)..(281): Pfam Id: Thiolase_N Pfam Desc: Thiolase, N-terminal domain
  misc_feature (288)..(410): Pfam Id: Thiolase_C Pfam Desc: Thiolase, C-terminal domain
  misc_feature (8)..(410): NCBI GI: 115478180 NCBI Desc: os09g0252100 [oryza sativa (japonica cultivar-group)]
  misc_feature (14)..(411): NCBI GI: 85700246 NCBI Desc: acetoacetyl-coa thiolase [picrorhiza kurrooa]
  misc_feature (11)..(411): NCBI GI: 16417944 NCBI Desc: acetyl co-a acetyltransferase [hevea brasiliensis]
  misc_feature (9)..(411): NCBI GI: 8777413 NCBI Desc: acetyl-coa c-acetyltransferase [arabidopsis thaliana]
  misc_feature (14)..(411): NCBI GI: 53854352 NCBI Desc: peroxisomal acetoacetyl-coenzyme a thiolase [nicotiana tabacum]
  misc_feature (14)..(411): SWISSPROT Homolog: EC 2.3.1.9 Acetyl-CoA acetyltransferase, cytosolic 1
MASSSAAAATSDDSQGLKARDVCIVGVARTPIGALLGSLSSLPATKLGSIAIQGALKRAKVDPALVQEVFMGNVLSANLGQAPARQAALGAGLPNSVPCTTVNKVCSSGMKAVMFAAQSIQLGINDVVVAGGMESMSNAPKYVAEARRGSRFGHDVLVDGMLKDGLWDVYNDFPMGMCAELCSDQHSISREEQDSYAILSNERGLAARDSGAFSWEIIPVEVSSGRGKPPVVVDKDESLAKFDPVKLKKLGPTFKTNGSVTAGNSSSISDGAAAIVLVSGEKAKKLGLQVIARIRGYADAAQAPELFTTAPALAIPKAISNAALQTSQIDYYEINEAFSVVAVANQRLLGIPSGKLNLSGGAVSLGHPIGCSGARIIVTLLGILRQKNGKFGVAGVCNGGGGASALVLELM

SEQ ID NO: 5893 - DNA, 3117 bp, Sorghum bicolor
  misc_feature: Ceres ANNOT ID no. 6055055
  misc_feature: Encodes the peptide sequence at SEQ ID NO 5894
atgttggacacgacggacgacatcgcggaggggatatcgttccaggcgttcgaggacgactgccgcctcctcgccagcctcctccacgacgtcctcctccgcgagctcggcccccgcttcatccaaatcctcgagcgcaaccgcatcctcgcgcagagcgccgtctccatgcgcgcggcggggatggaggacacggcggccgtcgtcgagcggcagctggaggccgacctggccgcgatgtccctggacgacgcgctctgcgtcgcccgggccttctcccactacctcaacctcatgggcatcgccgagacccaccacagggttcgtaaagcacgcaacatagaacagctctcaaaatcatgtgatgatatattcaacaagctgattcaaagtggtgtccctccagaacaactatatgacactgtctgcaagcaggaggttgaaattgttctgacagcgcatccgacccaaataaatcggcgaactttgcaatacaagcacctaagagtagcacatcttttggagttcaacggtcgccctgatctaagccacgaggataaagaaatgctaattgaagatctggtaagggaaatcacagcaatatggcagacggatgagttgaggcgccacaaacctacaccagttgacgaagctagagctggtcttcatattgtggagcaatccctttggaaagcgataccacactatcttcgccgtgttagtagtgctctaaagaagcacactggaagaccacttccgctaacctgtacaccaatcaagtttggttcttggatgggtggtgaccgggatgggaatcctaacgttacagcaaaagtgactagggatgtttcattgctgtcccggtggatggcaatagacttttacattcgggaattagacaatctcagctttgagttgtctatcaagagatgcagtgacaaggttgcaagcttggctaatgacattattctcaaagagtcggcatccgaggacctaaaggccaatacctggaacaaaacagtaccacagaacaatgcaaagcttcatcataacttggctctgcctgcacaacttccttctggtgctgatcttccttcatgtacagaatgcagtgatggagaatctcaatttaggatgataaatcttccaaggaactcaagtcgtccgggtgctcttaatttaacagaaaaaattgaagacagtccattgtcatctcctactagtcgtcaaccacagctaagtagaacttcaagtggccatcaactaaggaagttgttcaaagaatctcatataggtcgatcaagtagcttccagaagctacttgagccaagcctatctgacagaccaggaattactccttacagggttgtccttggtaatgtgaaagaaaagctggtgaagacacgtagacggcttgagcttctgcttgaggatctaccatgtgactatgacactgaagaatattgtgaaacatcagatcaacttttggaacctttgctcttatgccatcaatctctgcaatcatgcggagcaagtgtccttgccgatggccggttagcagatttgatacgaagggttgcaacctttggtatggttcttatgaagctcgatgtacgccaggaatctggccgtcacacagaagcacttgattccgtcacatcctacttggatcttggtgtttatagtgagtgggatgaagaaaagaagctggatttcttgactagagagctgaaagggaagcgccctctagtaccccaaaacatagaggtttctgctgatgtgaaagaagttctggacaccttcaaagttgctgcagaattagggagtgactcgcttggagcatatgtcatttcaatggcctcaaatgcaagtgatgtcctcgctgtggagctgttgcagaaggatgcaagacttacagttagcggggacctaggaagaccatgtcctggtggcacgttaagagttgtccccttgttcgagaccgttaaagatttgcaggcagccgggtccgcaatcaggaagctactttccatcgactggtacagggagcacatcatcaagaaccacaacggccaccaggaggtaatggtggggtactcggactccggcaaggacgccggtcgcttcacggcggcatgggagctgtacaaggctcaggaagacgtggtcgcggcgtgcaacgagttcgggatcaaggtgacgctgttccacggccgtggcggcagcatcgggcgcggcggcgggccgacgtacctggccatccagtcgcagcctccggggtccgtgatgggcaccctccgttcgacggagcaaggcgagatggtgcaggccaagttcgggctcccacagaccgccgtccgccagctcgagatctacacgacggcggtgctgctggcgactctacggccgccgcatccgccgcgggaccccaactggcggaccgtcatggaggagatctcccgcgcgagctgcgcgcactaccgcgccacggtgtacgaggacccggagttcatcacctacttccaggaggcgacgccgcaggcggagctgggccacctcaacatcggcagccgcccggcgaagcgcaagcaggcgctgggcggcatctcgagcctgcgcgccatcccgtgggtgttcgcgtggacgcagacgcggctggtgctccccgcgtggctgggcgtcggcacggggctgcaggacgcgctggaccgcggccacggcgccgagctccgcgccatgtacggcgagtggccgtttttccagagcaccgtggacctgatcgagatggtgacggcgaaagccgacgcgcccgtggcggcgcactacgaggagatgctggtggcgcccgagcggcgcgccgtgggggaacggctgaggaaagagctggcccgcacggagcggtgcgtgctggcggtcagcgggcacagcaagctcacggcgcacaaccgcagcctgaggaggctcatcgagagccggctggcgtacctgaacccgatcaacatgctgcaggtggaggtgctccgtaggctccgccgcgacgacgataaccggaggctccgtgacgcgctgctcatcaccatcaatggcatcgccgccggcatgcgcaacaccggctga

SEQ ID NO: 5894 - protein, 1038 aa, Sorghum bicolor
  misc_feature: Ceres ANNOT ID no. 6055055
  misc_feature (16)..(1038): Pfam Id: PEPcase Pfam Desc: Phosphoenolpyruvate carboxylase
  misc_feature (1)..(1038): NCBI GI: 45505267 NCBI Desc: phosphoenolpyruvate carboxylase [glycine max]
  misc_feature (1)..(1038): NCBI GI: 26800703 NCBI Desc: phosphoenolpyruvate carboxylase [arabidopsis thaliana]
  misc_feature (374)..(1038): NCBI GI: 5734703 NCBI Desc: similar to gbx90982 phosphoenolpyruvate carboxylase (ppc1) from solanum tuberosum. [arabidopsis thaliana]
  misc_feature (490)..(1038): NCBI GI: 41387680 NCBI Desc: phosphoenolpyruvate carboxylase [chlamydomonas reinhardtii]
  misc_feature (493)..(1038): NCBI GI: 114319423 NCBI Desc: phosphoenolpyruvate carboxylase [alkalilimnicola ehrlichei mlhe-1]
  misc_feature (1)..(1038): SWISSPROT Homolog: EC 4.1.1.31 Phosphoenolpyruvate carboxylase 4
MLDTTDDIAEGISFQAFEDDCRLLASLLHDVLLRELGPRFIQILERNRILAQSAVSMRAAGMEDTAAVVERQLEADLAAMSLDDALCVARAFSHYLNLMGIAETHHRVRKARNIEQLSKSCDDIFNKLIQSGVPPEQLYDTVCKQEVEIVLTAHPTQINRRTLQYKHLRVAHLLEFNGRPDLSHEDKEMLIEDLVREITAIWQTDELRRHKPTPVDEARAGLHIVEQSLWKAIPHYLRRVSSALKKHTGRPLPLTCTPIKFGSWMGGDRDGNPNVTAKVTRDVSLLSRWMAIDFYIRELDNLSFELSIKRCSDKVASLANDIILKESASEDLKANTWNKTVPQNNAKLHHNLALPAQLPSGADLPSCTECSDGESQFRMINLPRNSSRPGALNLTEKIEDSPLSSPTSRQPQLSRTSSGHQLRKLFKESHIGRSSSFQKLLEPSLSDRPGITPYRVVLGNVKEKLVKTRRRLELLLEDLPCDYDTEEYCETSDQLLEPLLLCHQSLQSCGASVLADGRLADLIRRVATFGMVLMKLDVRQESGRHTEALDSVTSYLDLGVYSEWDEEKKLDFLTRELKGKRPLVPQNIEVSADVKEVLDTFKVAAELGSDSLGAYVISMASNASDVLAVELLQKDARLTVSGDLGRPCPGGTLRVVPLFETVKDLQAAGSAIRKLLSIDWYREHIIKNHNGHQEVMVGYSDSGKDAGRFTAAWELYKAQEDVVAACNEFGIKVTLFHGRGGSIGRGGGPTYLAIQSQPPGSVMGTLRSTEQGEMVQAKFGLPQTAVRQLEIYTTAVLLATLRPPHPPRDPNWRTVMEEISRASCAHYRATVYEDPEFITYFQEATPQAELGHLNIGSRPAKRKQALGGISSLRAIPWVFAWTQTRLVLPAWLGVGTGLQDALDRGHGAELRAMYGEWPFFQSTVDLIEMVTAKADAPVAAHYEEMLVAPERRAVGERLRKELARTERCVLAVSGHSKLTAHNRSLRRLIESRLAYLNPINMLQVEVLRRLRRDDDNRRLRDALLITINGIAAGMRNTG

SEQ ID NO: 5895 - DNA, 543 bp, Sorghum bicolor
  misc_feature: Ceres ANNOT ID no. 6055080
  misc_feature: Encodes the peptide sequence at SEQ ID NO 5896
atggagagccagcgggtggtggtggtcgtggaggacgcggccgccgcgcggtcggcgctgcagtgggccgtcggcaacttcatccgcagcagcgactccatcacgctgctccacgtctgcccgccggcgcggtcgcgccggaagcgccgccgcctccgcctcggcggattccagctcgcgctcgccttcaaggacctctgcaacggcatcgccgaggccaaggtggagatcgtggtgacggagggggagctcggggagacggtggtggccacggtgaacaagctcggcgccaccacgctcgtcgtcggcctccacgacaagagcttcctctacagggcgccgagccagtacagcagagtccggagcctgggctgcagggtgctcgccgtccggcagcacgccacggcgcgcggcggcttcttgaacgccgagctcacccagatcgagaccgtcagtttgcacataccaccgccgaagatcccgttcccgatgttcacgcttccccttggcgtgatatggagaagatcgaagcggagaaagtga

SEQ ID NO: 5896 - protein, 180 aa, Sorghum bicolor
  misc_feature: Ceres ANNOT ID no. 6055080
  misc_feature (2)..(131): Pfam Id: Usp Pfam Desc: Universal stress protein family
  misc_feature (20)..(107): NCBI GI: 115438310 NCBI Desc: os01g0604100 [oryza sativa (japonica cultivar-group)]
  misc_feature (72)..(132): NCBI GI: 92867991 NCBI Desc: universal stress protein family [medicago truncatula]
MESQRVVVVVEDAAAARSALQWAVGNFIRSSDSITLLHVCPPARSRRKRRRLRLGGFQLALAFKDLCNGIAEAKVEIVVTEGELGETVVATVNKLGATTLVVGLHDKSFLYRAPSQYSRVRSLGCRVLAVRQHATARGGFLNAELTQIETVSLHIPPPKIPFPMFTLPLGVIWRRSKRRK

SEQ ID NO: 5897 - DNA, 1104 bp, Sorghum bicolor
  misc_feature: Ceres ANNOT ID no. 6055091
  misc_feature: Encodes the peptide sequence at SEQ ID NO 5898
atggagtcgccggaggcctgctcgtccggggagacgtcccccttgtcaccggcggcggcagcggcggcggcggcggagcgcccgtccgaggcggcggcgctgcgagcgctcgtcgaccgggtgcgcgccggggaggtggacgccgcccgcgaggtgcgccgcctcaccagggcctccgcgaggcaccgccgcaagctcgccgccgccgtcgacccgctcgtcgccatgctacgctccgccgcgcccgaggctggggaggccgcgctcctcgcgctgctcaacctcgccgtcagggacgagagaaataaaaccaagatagtggatgccggtgcacttgagcccctgctttgttatttgcaatcaagtgatctaaatctgcaggagtatgcgactgctgctctccttacactttcagcctcgtccaccaataagcctatcataagtgcttcaggagcaattcctctactcgtgaaagtcctcaaagaagggaatcctcaagccaagaatgatgctgtgatggctctctacaacctctccacaatcgctgacaatcttcaagccatcctttctgttcagccgattcctcctttaatagagctactgaagggtggcaagaggtcctccaaaacagctgacaaatgctgtgctcttctcgagtcattgcttgcttttgatcaatgtcgggtggccttgacatctgaggaaggcggagtgctcgccatcgtggaggtacttgaggaaggctcccttcagggcagagaacatgctgtgggtgcgctcctgacaatgtgcgagagtgaccgcagcaagtacagagacctcattctgaatgaaggggcaattcctggtcttctcgagcttacagtccatggcacacccaagtctcggatgaaggctcatgttcttctcgacctgttgcgcaactcgccgtactcaagatcaaagctgcaggcagacacgctcgagaacctcgtgaccaacatcgcttcccaaatagacggcgaagaccgtggcggcaaagcgaagaagatgctcgctgagatggtgaaggtcagcatggagcagagcctgaggcatctgcagcgccgggcttccttcgcctga

SEQ ID NO: 5898 - protein, 367 aa, Sorghum bicolor
  misc_feature: Ceres ANNOT ID no. 6055091
  misc_feature (99)..(139): Pfam Id: Arm Pfam Desc: Armadillo/beta-catenin-like repeat
  misc_feature (140)..(180): Pfam Id: Arm Pfam Desc: Armadillo/beta-catenin-like repeat
  misc_feature (102)..(365): NCBI GI: 33337491 NCBI Desc: plakoglobin/armadillo/beta-catenin-like protein [oryza sativa]
  misc_feature (19)..(365): NCBI GI: 30678850 NCBI Desc: armadillo/beta-catenin repeat family protein [arabidopsis thaliana]
  misc_feature (11)..(307): NCBI GI: 34393717 NCBI Desc: arm repeat containing protein homolog-like [oryza sativa (japonica cultivar-group)]
  misc_feature (17)..(314): NCBI GI: 28974687 NCBI Desc: arm repeat-containing protein [nicotiana tabacum]
  misc_feature (34)..(309): NCBI GI: 92886249 NCBI Desc: imp dehydrogenase/gmp reductase [medicago truncatula]
  misc_feature: The sequence is a functional homolog of SEQ ID NO. 309 in the 11/188,298 US application
MESPEACSSGETSPLSPAAAAAAAAERPSEAAALRALVDRVRAGEVDAAREVRRLTRASARHRRKLAAAVDPLVAMLRSAAPEAGEAALLALLNLAVRDERNKTKIVDAGALEPLLCYLQSSDLNLQEYATAALLTLSASSTNKPIISASGAIPLLVKVLKEGNPQAKNDAVMALYNLSTIADNLQAILSVQPIPPLIELLKGGKRSSKTADKCCALLESLLAFDQCRVALTSEEGGVLAIVEVLEEGSLQGREHAVGALLTMCESDRSKYRDLILNEGAIPGLLELTVHGTPKSRMKAHVLLDLLRNSPYSRSKLQADTLENLVTNIASQIDGEDRGGKAKKMLAEMVKVSMEQSLRHLQRRASFA

SEQ ID NO: 5899 - DNA, 1164 bp, Sorghum bicolor
  misc_feature: Ceres ANNOT ID no. 6055124
  misc_feature: Encodes the peptide sequence at SEQ ID NO 5900
  misc_feature: Up-regulated in root tissues in response to methyl jasmonate treatment
  misc_feature: Up-regulated in shoot tissues in response to methyl jasmonate treatment
atggctatggcgacggcgaagctgagctccccggctaccagcctgctcgctggcggccgcacccggcgatccgcgcccgcccgccgcgcgacggtgatccgcgccgccgcaggctcctactccgacgagctcgtctccaccgcgaaatctgttgcttcgcctgggcgtggtattctggcaattgatgagtcaaatgcaacatgcggaaagaggctatcgtcaattggtttggacaacacagaacctaaccgccaggcttacaggcagcttttgctgacaactgctggtcttggtgaatacatttctggtgctattctttttgaggagactctttatcaatcaactacagatggcaagaagtttgttgactgcttgaaggaacagaatatcatgcccggcatcaaggttgacaagggtttggttccattgcctggatccaacaatgaatcgtggtgccaaggtcttgatggtttggcttcaaggtgtgctgagtactataagcagggggcacgcttcgcaaagtggaggactgttgttagcatcccttgtggtccatctgcattagcagtgaaggaagcagcatggggacttgcccgttatgctgctattgctcaggataatggcttagtgccaattgtggagccagagatccttcttgatggagatcatgggatcgaaacaactcttgaggtggcagagaaagtgtggtctgaggtgttcttctacttggccgaaaacaatgttctgtttgagggtatcctgctgaagccgagcatggtcactcctggagctgagcacaaggagaaggcttctccagaagccattgcaaagcatacgttaacaatgctcagaaggagagtacctcccgctgttcctggaatcatgttcctttctggtggtcaatccgaggtggaggcaactctgaacctgaatgcaatgaaccagtctccgaacccatggcatgtatcattctcctatgcccgggctctgcagaactcggtgctaaagacatggcaagggcgccctgagaacgtggaggcagcgcagaaggccctgctggcgcgtgcaaaggccaactcgctggcacagctcggtcgctacactggtgagggtgagagtgatgaggcaaagaaaggcatgttccagaagggctacacctactaa

SEQ ID NO: 5900 - protein, 387 aa, Sorghum bicolor
  misc_feature: Ceres ANNOT ID no. 6055124
  misc_feature (43)..(387): Pfam Id: Glycolytic Pfam Desc: Fructose-bisphosphate aldolase class-I
  misc_feature (23)..(387): NCBI GI: 21311559 NCBI Desc: latex plastidic aldolase-like protein [hevea brasiliensis]
  misc_feature (1)..(387): NCBI GI: 4827251 NCBI Desc: plastidic aldolase npaldp1 [nicotiana paniculata]
  misc_feature (23)..(387): NCBI GI: 4827253 NCBI Desc: plastidic aldolase [nicotiana paniculata]
  misc_feature (29)..(387): NCBI GI: 16226653 NCBI Desc: at4g38970/f19h22_70 [arabidopsis thaliana]
  misc_feature (36)..(387): NCBI GI: 1781348 NCBI Desc: homologous to plastidic aldolases [solanum tuberosum]
  misc_feature (1)..(387): SWISSPROT Homolog: EC 4.1.2.13 Fructose-bisphosphate aldolase, chloroplast precursor
  misc_feature: Useful for making plants with modulated biomass
  misc_feature: Functional homolog of the protein sequence given in SEQ ID NO 13636
  misc_feature: Useful for making plants with modulated phosphate use efficiency
  misc_feature: Functional homolog of the protein sequence given in SEQ ID NO 12920
  misc_feature: Up-regulated in root tissues in response to methyl jasmonate treatment
  misc_feature: Up-regulated in shoot tissues in response to methyl jasmonate treatment
MAMATAKLSSPATSLLAGGRTRRSAPARRATVIRAAAGSYSDELVSTAKSVASPGRGILAIDESNATCGKRLSSIGLDNTEPNRQAYRQLLLTTAGLGEYISGAILFEETLYQSTTDGKKFVDCLKEQNIMPGIKVDKGLVPLPGSNNESWCQGLDGLASRCAEYYKQGARFAKWRTVVSIPCGPSALAVKEAAWGLARYAAIAQDNGLVPIVEPEILLDGDHGIETTLEVAEKVWSEVFFYLAENNVLFEGILLKPSMVTPGAEHKEKASPEAIAKHTLTMLRRRVPPAVPGIMFLSGGQSEVEATLNLNAMNQSPNPWHVSFSYARALQNSVLKTWQGRPENVEAAQKALLARAKANSLAQLGRYTGEGESDEAKKGMFQKGYTY

SEQ ID NO: 5901 - DNA, 3630 bp, Sorghum bicolor
  misc_feature: Ceres ANNOT ID no. 6055125
  misc_feature: Encodes the peptide sequence at SEQ ID NO 5902
atgctcctgacctccgtcctccggggtcgcgtccgcctcctccgccggccccgcccgctgaccatgccctcccctctcttcctctccagaaaccctaatcctagccccggcaccactaacccccacctctcgtcgacccccgtgtcggccgcaatgagcaccaccggagtgtacgtgccgccgatgcggcggctccgctccgttatcgcgtcaaccaacgggagcctcgcgccaccaccgtccgccgcggcgcaggcacagcagacggcgcggacgccggagtggctggtggacggtcgttcgctcagccccccctcgccgcctcagccgcggcggcgcgatttacctccgttgccgaggccaccccagccagagcatttccggcagcagagcgctgggtatgcccgctatgcctacgatgatttctctgaggatgactcagataaggacatggaccgcacgtcagtttcgagcaagggtgcatccactttagataatgttgatgagtggaaatggaaactgcacatgctacttcgtaatgatgatgagcaagagattatctcaagggaaagaaaggataggcgagattttgaacaacttgcccaactggctgagagaatgcgtttgcacagccgtcagtattcaaaagttgttgtgttcagtaaggttccattgcctaattatagatcagatcttgatgacaaaagaccccaaagagaggtatctatacctgctggtttgcaaagagaagttgatgctctgctcgcagattatgttgcacggaagagaacaaacaacgggaacttccctagttcagccttctcacggtcaagcagcacagacagttttgcaactgatgaaggcttctttgatcagcaagataatcaaacttccactagtgctgtgatggacagaatccagcgaaggaaaagcctgcagttgcggaatcagcaggctgcttggcaggtcattgtagtttcaggtgagactggctgcggtaagacaacacaactaccgcagtacattctagaatctgaaatcgatgctgctcgtggtgctacgtgcagtattatttgcactcaaccgaggcgaatatcagcaattgctgtgtccgaaagagttgctgctgaaagaggcgagaaaattggtgaatcggttggctacaaagttcgactggaaggcatgagaggaagggatacacgccttcttttctgcaccactggagtcctgttgcgcagattgttggtggacagaaatttgaaaggtgttacccatgttattgttgatgaaatccatgagagaggcatgaatgaagattttcttcttattgtcttaaaggatcttcttccacgtcgtcctgagctgagacttatattgatgagtgcaacccttaatgctgagctattctcttcatactttggtggagcacccatgatacatatacctggttttacatatcctgttcggagtcgttttctggaagatattcttgaaattactgggcatcgtttaactccttacaatcaaattgatgactatggccaagaaaaaagttggaagatgcaaaagcaatctctacgaaagcggaagagccaaatcgcttctgttgtggaagatgcagttgatgccgctgatttgagagactatagttcgcgaactcgtgattctctatcctgttggaatcctgattcaattggttttaatttaatagaaaatgtcttatgccatatttgtcaaaaggaacgatcaggtgcaatacttgtatttatgactgggtgggatgacattaatgcattaaaagagcagctgcaagcaaatccactgcttggagatccaagcaaagttttgttgctcacttgtcatagctctatggccagttcagagcagaaattaatatttgataagcctgagcctggagtaaggaaaatagttctcgccacgaatttggctgaaactagtattactatcaacgatgtagtttttgttgttgactgtggcaaggcaaaagagacatcttacgatgcactgaataatactccctgtttgcttccaacctggatctccaaggcttctgccagacaaagacgaggacgagctggtcgagtccaaccaggggagtgctaccatctttatccacgatctgtatatgatgcatttgctgactaccagttaccagaacttctgagaacccctcttcaatccctctgtttgcaaataaaaagcttgaggctaggaagtatatcagaatttttatccagagctttacaatcacctgaatctctatcagtacaaaatgctattgaatatctcaaagtcattggagcttttgatcagaatgaagagttgacggttcttggaaagcacttgtctatgcttccagttgaacctaagttaggaaagatgcttatttttggggctatttttaattgtctggaccccatattaaccatagtttctggacttagtgttagagatccttttttgactcccttcgataagaaagatcttgcagagtcagctaagttgcagttttcatgccgggactacagtgatcatcttgcacttgttcgtgcatacgaaggatggagggaggctgaaagagaccgtgctggttatgactactgctggaaaaattttctctcggtgcaaacattgaaagcaatagattctcttcggcggcagtttctctttcttctgaaggatactggtttggttgatgaaaacatgactgtgtgcaataaatggagccgtgatgaaaatctagttcgggcagtaatttgtgcaggactatatccaggtgtttcctctgttgtgaacaaggagaaatccatctccctcaagacaatggaggatggacaggttatgctttattcgagttcggttaatggtaaagaagccaagattccattcccctggctagttttcaatgagaaggtgaaggtgaattctgttttcctccgggattcaactgctatatctgattctatactgttgttatttggaggctgcataaaacaagggggcttggatggacacttaaaaatgcttggaggttatcttgagttcttcatgaatcgtgatcttgcttcaacttatttgagtctgaagagtgaacttgagaatttaatccattgcaagctccaaaacccaaggatgaatatccaaacgagtgaagagctgctatcagccatccgtttgctggtgactgaggacccatgcagtgggcggttcgtctatggccgacaggagccaagatcaaagaaagcaaagacgatgttttcgccatcctccatgagtggcggtggtggcaacggaggggataatgccaagaaccagctccagactttcctgacccgggccgggcacagcaaccccacctacaagacgaagcagatcaagagctatctcttcaggtcgacggttgagttcaacggcatgcagttcgtggggcagccttgtgcaaacaagaaacttgcggagaaggatgctgcgagtgaggcactgaactggctcacaggagatggtggtgcaacgatcactgactctaggggcgcccaggacgcagaccccatgcccttgctgatgcaaccaccacgcaggcgacggcatagccatcgtcggaggagctga

SEQ ID NO: 5902 - protein, 1209 aa, Sorghum bicolor
  misc_feature: Ceres ANNOT ID no. 6055125
  misc_feature (765)..(856): Pfam Id: HA2 Pfam Desc: Helicase associated domain (HA2)
  misc_feature (609)..(703): Pfam Id: Helicase_C Pfam Desc: Helicase conserved C-terminal domain
  misc_feature (1109)..(1171): Pfam Id: dsrm Pfam Desc: Double-stranded RNA binding motif
  misc_feature (314)..(469): Pfam Id: DEAD Pfam Desc: DEAD/DEAH box helicase
  misc_feature (1)..(1207): NCBI GI: 115434200 NCBI Desc: os01g0118100 [oryza sativa (japonica cultivar-group)]
  misc_feature (319)..(1204): NCBI GI: 30694379 NCBI Desc: helicase domain-containing protein [arabidopsis thaliana]
  misc_feature (294)..(1173): NCBI GI: 79548544 NCBI Desc: atp binding / atp-dependent helicase/ double-stranded rna binding / helicase/ nucleic acid binding [arabidopsis thaliana]
  misc_feature (322)..(1209): NCBI GI: 145361138 NCBI Desc: atp binding / helicase/ nucleic acid binding [arabidopsis thaliana]
  misc_feature (322)..(988): NCBI GI: 115455343 NCBI Desc: os03g0748800 [oryza sativa (japonica cultivar-group)]
MLLTSVLRGRVRLLRRPRPLTMPSPLFLSRNPNPSPGTTNPHLSSTPVSAAMSTTGVYVPPMRRLRSVIASTNGSLAPPPSAAAQAQQTARTPEWLVDGRSLSPPSPPQPRRRDLPPLPRPPQPEHFRQQSAGYARYAYDDFSEDDSDKDMDRTSVSSKGASTLDNVDEWKWKLHMLLRNDDEQEIISRERKDRRDFEQLAQLAERMRLHSRQYSKVVVFSKVPLPNYRSDLDDKRPQREVSIPAGLQREVDALLADYVARKRTNNGNFPSSAFSRSSSTDSFATDEGFFDQQDNQTSTSAVMDRIQRRKSLQLRNQQAAWQVIVVSGETGCGKTTQLPQYILESEIDAARGATCSIICTQPRRISAIAVSERVAAERGEKIGESVGYKVRLEGMRGRDTRLLFCTTGVLLRRLLVDRNLKGVTHVIVDEIHERGMNEDFLLIVLKDLLPRRPELRLILMSATLNAELFSSYFGGAPMIHIPGFTYPVRSRFLEDILEITGHRLTPYNQIDDYGQEKSWKMQKQSLRKRKSQIASVVEDAVDAADLRDYSSRTRDSLSCWNPDSIGFNLIENVLCHICQKERSGAILVFMTGWDDINALKEQLQANPLLGDPSKVLLLTCHSSMASSEQKLIFDKPEPGVRKIVLATNLAETSITINDVVFVVDCGKAKETSYDALNNTPCLLPTWISKASARQRRGRAGRVQPGECYHLYPRSVYDAFADYQLPELLRTPLQSLCLQIKSLRLGSISEFLSRALQSPESLSVQNAIEYLKVIGAFDQNEELTVLGKHLSMLPVEPKLGKMLIFGAIFNCLDPILTIVSGLSVRDPFLTPFDKKDLAESAKLQFSCRDYSDHLALVRAYEGWREAERDRAGYDYCWKNFLSVQTLKAIDSLRRQFLFLLKDTGLVDENMTVCNKWSRDENLVRAVICAGLYPGVSSVVNKEKSISLKTMEDGQVMLYSSSVNGKEAKIPFPWLVFNEKVKVNSVFLRDSTAISDSILLLFGGCIKQGGLDGHLKMLGGYLEFFMNRDLASTYLSLKSELENLIHCKLQNPRMNIQTSEELLSAIRLLVTEDPCSGRFVYGRQEPRSKKAKTMFSPSSMSGGGGNGGDNAKNQLQTFLTRAGHSNPTYKTKQIKSYLFRSTVEFNGMQFVGQPCANKKLAEKDAASEALNWLTGDGGATITDSRGAQDADPMPLLMQPPRRRRHSHRRRS

SEQ ID NO: 5903 - DNA, 2766 bp, Sorghum bicolor
  misc_feature: Ceres ANNOT ID no. 6055161
  misc_feature: Encodes the peptide sequence at SEQ ID NO 5904
atggccttggcgctgcaatggccactccaactccacctcccgctccagctgcaggcgcggcctccagccgtcaccgcgggccatcaccggcgccgccaccgacttctccccgtccgccgctcccggccgctcctccgagctcgctgttgtgccagcgccgccgctgcggccgacacggggaaggcgcaggcggcggcgaggagggcgtacccgttcgacgagatcgagccgaggtggcagcggcactgggaggagcaccgcacgttccgcaccccggacatcggcgacgggctcgacacctccaagcctaagtgctacatcctcgacatgttcccctaccccagtggggctgggttgcatgttggacacccccttggatacacggcaactgacattctgtcaaggttcaagcgcatgaaaggcttcaacgttttgcatccaatgggatgggatgcatttggccttcctgctgagcaacgggaacccaccctaagattaccactgaaaggaacattgggcgcttccgcacacaggctggcattgatatcttgcaatcaggccgaggtaccagtcaattggtgccctgctcttggaactgtcctggcgaatgaagaagttgtagatggtgtgagcgaacgtggtggttatcctgttattcgaaagccaatgcgccagtggatgctgaggataacatcttatgctgatcgtcttcttgaagatttgaatgatcttgattggcctgagagtatcaaagaaatgcaaagaaactggatagggagatcaaaaggtgctgagcttgttttttctgcagttgaccaggaaggacatgacctaggtgccactttgttggtttacacaacgaggcccgacacgatttttggtgcaacatatcttgttgtggcacctgagcatgttttactttcatctctaacatctgaggaacaacgagaacatgtagaagaatacagggaactttcagcaagaaagagtgaactagaaagaactgatcttcagaaggaaaaaactggggttttcagtggttcttatgctaagaacccagcaaccggggaaatcattccaatatgggtggcagattatgttctaggaagctatggcactggtgctatcatggcagtgcctgcacatgattctcgcgaccatgaatttgccgtgaaatatgaacttccaatcattaaggttgtaagtccaccgaatggtaattgtgatccagtggaggcatatgaagatgatggcgtcatgattaattcatccagttcttcatctggattaaatattaatggaatgctttcccaagatgctgctaagaaagttattgagtgggtagagagtaatggttttggaaagaaaaaggttaactacaagctacgagattggctttttgccagacagcgctattggggtgaacctttccctgtgagctaccttgatgataccaatgaaatggttcctctttcagaagatgagttgcccttaactcttcctgaattggatgatttcactccgactggtactggggagccacctttgactaaagcaacaaattgggttagaaccatggatcctttatctggaaagcctgcaagaagagaaacaagcaccatgccacaatgggctggatcttgctggtactatttgaggttcatggatcccaaaaacggcagtatattggttgacaaggctaaagaaagatattggggtccagttgacatctatgttggtggtgctgaacattctgtattgcacttgctttatgcaagattttggcacaaggttctttatgacatgggtgtagtctccactaaagagcccttcaagtgcctgataaatcaaggattgatactaggagaagttgagtatactgcatatagagacaacgaaggcagatgggtttctgcagactcagactcaagtttgattgattgctaccaagaaaaagtagctgcagataaggttacaaaagttggagatcactatgttctgaaggatgatccaaacattcgactgaatgctcgtgcctacaagatgagtaaaagtcgagggaatgtcatcaatcctgatgatgttgtttcagaatatggtgctgattctcttcgcttgtacgaaatgttcatggggccattgagagattcaaagacatggagcactgggggaatcgaaggtgtgcaccggttccttggaagaacatggagactcacagttggtccacaattacctgatggatcatataatgatggaactacgactactgaagatgaaccaaccttggatcagcttcgagttcttcacaaatgtattgcaagggtcacagaggaaattcaggaaacaagatttaacactgcaatatctgcaatgatggagtttgtgaatgctgcatacaagtgggaaacccagccaaaaactgttattgaatcctttgttctgctgctttcacccttcgcaccacacttggctgaggagctttggtttcgccttggacatccacaatcattggcctatgaacagtttccagaggcaaaaagtgagtacctggaggaatcaaagcttgtacttcctgtccaaatcaatggaaagaccaggggtacaatccttgttgacaaagcgtgctcagaggatgatgctttccaagttgcagcctcagatgagaaactctccaaatattttgatggaaaaggcatcaggaagagaatttatgtccctggaaggatcttgaatgttatcttagatcaacaaaaggcaaggacctga

SEQ ID NO: 5904 - protein, 921 aa, Sorghum bicolor
  misc_feature: Ceres ANNOT ID no. 6055161
  misc_feature (78)..(721): Pfam Id: tRNA-synt_1 Pfam Desc: tRNA synthetases class I (I, L, M and V)
  misc_feature (763)..(883): Pfam Id: Anticodon_1 Pfam Desc: Anticodon-binding domain
  misc_feature (111)..(732): Pfam Id: tRNA-synt_1g Pfam Desc: tRNA synthetases class I (M)
  misc_feature (186)..(913): NCBI GI: 83758094 NCBI Desc: leucyl-trna synthetase [salinibacter ruber]
  misc_feature (188)..(623): NCBI GI: 138896379 NCBI Desc: leucyl-trna synthetase [geobacillus thermodenitrificans ng80-2]
  misc_feature (188)..(623): NCBI GI: 60390659 NCBI Desc: leucyl-trna synthetase (leucine--trna ligase) (leurs)
  misc_feature (188)..(623): NCBI GI: 56421377 NCBI Desc: leucyl-trna synthetase [geobacillus kaustophilus hta426]
  misc_feature (188)..(623): NCBI GI: 15615843 NCBI Desc: leucyl-trna synthetase [bacillus halodurans c-125]
  misc_feature (188)..(623): SWISSPROT Homolog: EC 6.1.1.4 Leucyl-tRNA synthetase
MALALQWPLQLHLPLQLQARPPAVTAGHHRRRHRLLPVRRSRPLLRARCCASAAAAADTGKAQAAARRAYPFDEIEPRWQRHWEEHRTFRTPDIGDGLDTSKPKCYILDMFPYPSGAGLHVGHPLGYTATDILSRFKRMKGFNVLHPMGWDAFGLPAEQREPTLRLPLKGTLGASAHRLALISCNQAEVPVNWCPALGTVLANEEVVDGVSERGGYPVIRKPMRQWMLRITSYADRLLEDLNDLDWPESIKEMQRNWIGRSKGAELVFSAVDQEGHDLGATLLVYTTRPDTIFGATYLVVAPEHVLLSSLTSEEQREHVEEYRELSARKSELERTDLQKEKTGVFSGSYAKNPATGEIIPIWVADYVLGSYGTGAIMAVPAHDSRDHEFAVKYELPIIKVVSPPNGNCDPVEAYEDDGVMINSSSSSSGLNINGMLSQDAAKKVIEWVESNGFGKKKVNYKLRDWLFARQRYWGEPFPVSYLDDTNEMVPLSEDELPLTLPELDDFTPTGTGEPPLTKATNWVRTMDPLSGKPARRETSTMPQWAGSCWYYLRFMDPKNGSILVDKAKERYWGPVDIYVGGAEHSVLHLLYARFWHKVLYDMGVVSTKEPFKCLINQGLILGEVEYTAYRDNEGRWVSADSDSSLIDCYQEKVAADKVTKVGDHYVLKDDPNIRLNARAYKMSKSRGNVINPDDVVSEYGADSLRLYEMFMGPLRDSKTWSTGGIEGVHRFLGRTWRLTVGPQLPDGSYNDGTTTTEDEPTLDQLRVLHKCIARVTEEIQETRFNTAISAMMEFVNAAYKWETQPKTVIESFVLLLSPFAPHLAEELWFRLGHPQSLAYEQFPEAKSEYLEESKLVLPVQINGKTRGTILVDKACSEDDAFQVAASDEKLSKYFDGKGIRKRIYVPGRILNVILDQQKART

SEQ ID NO: 5905 - DNA, 792 bp, Sorghum bicolor
  misc_feature: Ceres ANNOT ID no. 6055162
  misc_feature: Encodes the peptide sequence at SEQ ID NO 5906
atggcgcagcaggctgctgcaccggcgaggcctgcgggccccaccaggcttgtctacttcgatgatatgggagcgctccgctactccgccaccgtcctctccgtccaccaggaggacggcggccgggtagcggtggtgctggacgccacagtcttccacccgcagggcggcggccaaccggcggacacgggcgtcatctccgccggcggagccaggttcctcgtcgaggatgtgcgggcgaaggacggagtggttttccactatggaagatttgagggcacggaacaaggatgtgggattggatttaaagagggtgaaaccgttagcttggaggtcgacgcagaacggcgcagctttaattcaaggcttcattctgctgggcatttgttggacatctgtgtccacaatgtaggcctctttcatctgcaacctgggaaaggctaccattttcctgatggagcgtttgttgagtataagggagtaattcctccagatcaaataccggttaagaaaaatgaactggaaagggaagccaataggctaatttcagaaggagcgaaggtcttagcttctgtttttccttatgaggaggcagtgatattatgcggaggttctctgcctagttacatttcaaaggatagcactcctcgcattgtgaagttcggggataatcctggtggtccttgcggtggtactcatgttgctgacatttcaatcatcaatagccttaaggtaacaaacataagagtgaagaaaggcctcacgaaagtctcatacagcatcagcccatga

SEQ ID NO: 5906 - protein, 263 aa, Sorghum bicolor
  misc_feature: Ceres ANNOT ID no. 6055162
  misc_feature (14)..(262): NCBI GI: 145332595 NCBI Desc: atp binding / alanine-trna ligase [arabidopsis thaliana]
  misc_feature (14)..(262): NCBI GI: 145361275 NCBI Desc: atp binding / alanine-trna ligase [arabidopsis thaliana]
  misc_feature (1)..(261): NCBI GI: 119720099 NCBI Desc: threonyl/alanyl trna synthetase, sad [thermofilum pendens hrk 5]
  misc_feature (16)..(260): NCBI GI: 18976557 NCBI Desc: partial alanyl-trna synthetase matches cooh terminus half [pyrococcus furiosus dsm 3638]
  misc_feature (15)..(260): NCBI GI: 24418696 NCBI Desc: alanyl-trna synthetase (alanine--trna ligase) (alars)
MAQQAAAPARPAGPTRLVYFDDMGALRYSATVLSVHQEDGGRVAVVLDATVFHPQGGGQPADTGVISAGGARFLVEDVRAKDGVVFHYGRFEGTEQGCGIGFKEGETVSLEVDAERRSFNSRLHSAGHLLDICVHNVGLFHLQPGKGYHFPDGAFVEYKGVIPPDQIPVKKNELEREANRLISEGAKVLASVFPYEEAVILCGGSLPSYISKDSTPRIVKFGDNPGGPCGGTHVADISIINSLKVTNIRVKKGLTKVSYSISP

SEQ ID NO: 5907 - DNA, 864 bp, Sorghum bicolor
  misc_feature: Ceres ANNOT ID no. 6055164
  misc_feature: Encodes the peptide sequence at SEQ ID NO 5908
atgctcctgcggtccgcgccgcgcggcctccacctgctccggccgcaacacctacgcctcctctccgccgccgcctccgcctccgcggccccggccccgccccagctcccaaccgagtgggccgaggctccgcttgcctgcgtccgcccggccaccgccgacgcctcgctgttccacgtctcgcttgacctctccgcgcacggggagctcctcgcctcccacgccgccgccggccagttcctccccttccgcctccccgccgcgccctacccgatcttcctcgccatcgcgtcccctcctcccccacccctcacgcccgaggccggcctagcagggtcagggtcaccctcctgcttcgacttcctcgtcaagcgcctcccgggaaccccctccgcgcgcctctgtgacctccgacccggtgacctcgtccatgttggcgccagcgtcgtcggccgcggatttgacgtcgccaggatagccgacgcccgcgacgttctcgtcttcgccaccggatccgggatcagcccgatacggtcacttattgagtcaggttttgctgaaaacaagaaaactggtgtaaacctcttttatggggttagaaatcttcagaggatggcatatcaggagaggttcgatgattgggaatccagaggagttaaaattgtgcctgtcctctcaagaccagatggtcaatggacaggcgagcgaggttatgtccagaatgtgttctcaaggatgaagaatattgtaaacccttcatcagtgggagcaattttgtgtgggcataaacagatgactgaggaaatcacaagagttcttgttgccgatggtttatcaaaagataggatcttaactaacttctga

SEQ ID NO: 5908 - protein, 287 aa, Sorghum bicolor
  misc_feature: Ceres ANNOT ID no. 6055164
  misc_feature (166)..(271): Pfam Id: NAD_binding_1 Pfam Desc: Oxidoreductase NAD-binding domain
  misc_feature (31)..(287): NCBI GI: 115434222 NCBI Desc: os01g0120600 [oryza sativa (japonica cultivar-group)]
  misc_feature (13)..(287): NCBI GI: 92894452 NCBI Desc: phenol hydroxylase reductase [medicago truncatula]
  misc_feature (17)..(284): NCBI GI: 1170601 NCBI Desc: fruit protein pkiwi502
  misc_feature (11)..(250): NCBI GI: 42571485 NCBI Desc: oxidoreductase nad-binding domain-containing protein [arabidopsis thaliana]
  misc_feature (64)..(287): NCBI GI: 108763602 NCBI Desc: oxidoreductase, nad-binding [myxococcus xanthus dk 1622]
MLLRSAPRGLHLLRPQHLRLLSAAASASAAPAPPQLPTEWAEAPLACVRPATADASLFHVSLDLSAHGELLASHAAAGQFLPFRLPAAPYPIFLAIASPPPPPLTPEAGLAGSGSPSCFDFLVKRLPGTPSARLCDLRPGDLVHVGASVVGRGFDVARIADARDVLVFATGSGISPIRSLIESGFAENKKTGVNLFYGVRNLQRMAYQERFDDWESRGVKIVPVLSRPDGQWTGERGYVQNVFSRMKNIVNPSSVGAILCGHKQMTEEITRVLVADGLSKDRILTNF

SEQ ID NO: 5909 - DNA, 993 bp, Sorghum bicolor
  misc_feature: Ceres ANNOT ID no. 6055168
  misc_feature: Encodes the peptide sequence at SEQ ID NO 5910
atggcggggattcggtggccgccggaggacccggagatcttcccttctcgcatggtcagcggcggggcctggatccccgtcgcgcccccgggagagatggcgtcggacgacgaccggtcggtggccgcggactcgtggtcgatcaagagcgactacggcagcaccctcgacgacgatcagcgctacgcagacaccgccgaggtcctcctcgcctcctcctccgcctcctccgcggccgcgccctccgcgtcggttgccgtccacccctcctccgacttcagcttcgacaaggatgtccctgactccagtgacgttgagcctcggttgctggggttgcagaattttcaggatggtgcttatgctgaggatcttgcaaatttccatgaacgcagccacgctgatgactggtttggcactgagatcatggatatccgtgtaggttggaccaaaaatttgtgctcaagcagggatttacccagctgcagcgtacttgacattgggactgggagtggcagactcttgcagcagcttgcgaagcaggggttttctgatctgactgggattgactacagtgaaggcgcgattgagcttgctcggaacctagcaattcgtgatgggtttgagcacattaatttcttggttgatgatgtattagagtcgaagctggagagaagatttgaacttgtaatggatgaagggactcttgatgcaattgggctccatcctgatggacctgtgaagagaatgatgtattggcagtcagttgctagcttggttttccctggtggtatattggtcatcacatcatgcagcagaaccaaggatgagctggtgcaggaggtagagaacttcaaccaaaggaagcttggtgctatgggctcagaaggattgccagctagtgaagctgcggtgttcagctacctcgaccacgtccaaagttatcctagtgtggatagttcttgcatcacgaccgttgctttcctgcataagtga

SEQ ID NO: 5910 - protein, 330 aa, Sorghum bicolor
  misc_feature: Ceres ANNOT ID no. 6055168
  misc_feature (164)..(265): Pfam Id: Methyltransf_12 Pfam Desc: Methyltransferase domain
  misc_feature (164)..(267): Pfam Id: Methyltransf_11 Pfam Desc: Methyltransferase domain
  misc_feature (73)..(329): NCBI GI: 115434230 NCBI Desc: os01g0121100 [oryza sativa (japonica cultivar-group)]
  misc_feature (1)..(330): NCBI GI: 4760710 NCBI Desc: sll2-s9-protein [brassica rapa]
  misc_feature (1)..(330): NCBI GI: 1518113 NCBI Desc: sll2
  misc_feature (1)..(300): NCBI GI: 1669601 NCBI Desc: ar401 [arabidopsis thaliana]
  misc_feature (1)..(330): NCBI GI: 92897434 NCBI Desc: sam (and some other nucleotide) binding motif [medicago truncatula]
  misc_feature: The sequence is a functional homolog of SEQ ID NO. 415 in the 11/188,298 US application
MAGIRWPPEDPEIFPSRMVSGGAWIPVAPPGEMASDDDRSVAADSWSIKSDYGSTLDDDQRYADTAEVLLASSSASSAAAPSASVAVHPSSDFSFDKDVPDSSDVEPRLLGLQNFQDGAYAEDLANFHERSHADDWFGTEIMDIRVGWTKNLCSSRDLPSCSVLDIGTGSGRLLQQLAKQGFSDLTGIDYSEGAIELARNLAIRDGFEHINFLVDDVLESKLERRFELVMDEGTLDAIGLHPDGPVKRMMYWQSVASLVFPGGILVITSCSRTKDELVQEVENFNQRKLGAMGSEGLPASEAAVFSYLDHVQSYPSVDSSCITTVAFLHK

SEQ ID NO: 5911 - DNA, 1644 bp, Sorghum bicolor
  misc_feature: Ceres ANNOT ID no. 6055173
  misc_feature: Encodes the peptide sequence at SEQ ID NO 5912
  misc_feature: Down-regulated in shoot tissues in response to salicylic acid treatment
atgatgggtttccacgccgccgccgctgccgcggtggccgtgtttgcggcggcggtgctgctggcggtcgcggccggtgactcgctcgccgacctcggcggcgcggccagggagatcgaaagcgcgccagaggtgaagaacttgggaccatgggcaaaggggctgctgaaaggtatgccggagatggcggcaggaccggcagctatggcccctgttgtgaagtatccgctggttctggcagaggaccggacgcggcggccggatgttctcagccatctcaaaatgtacgatggagggtggaacgtcaccaacaagcactactgggcgtctgtttcattcacaggagtttctggatttcttcttggtgccttgtggttcatatttttcgggatagctgcagctggacgatgctattttggatcgagaatctgtaatgctgtattatcattagttctgataattatttccttttcatttcgtaccagagctgggtgcattgtccttctttatgggcagagtaaattccatgaagaagctacacggaccgtcgattttgttgtgaaccaatctgatttcactattcagacactaaggaatgttacggaatacttgtcgtttgcacagacgattactgtggcagcactctatcttccatcagatgttcaaggtcaaattgacaatttgaagggggacctgaacaaagcagctgacaccatatctctgaagacagcagaaaattacaaaaggataagaaaagttctccatatcataattgaactcttatatccttacaggtcggttgtattgatttgcatagccgtggtgttgcttattcttgcgttccttggatacggcttagagcaatatggaccaagatatacagtctacatatttgtcaccttatgctggaaagttgtggcggctctctttattcttctaggaattttcctgatactaaacagtgctgcgaaggatacctgcgaagcaatggaccaatgggcccagcatcctcaagcagagacagctctgagtaacatccttccatgtgtggatgaaagcacaacgaatcgaacattgtatcagagcaaagaggttgtggtgaggcttgttgggatagttaacagagctatatctgctctttcaaatcgaagaccacatcataagcatccaggacagttcatgccttacttatgttctccctacgattcaaacctcaatgatcggccgtgcaatcatagggaggtcacatttgaaaacgcaacaacagcatggctgaattatacatgcatggctcaagacaccgacttgtgttcaggcaacaagaccttaacctacgacatctacggccaactcgtcctggctgccaatgtaagctacgcgctgtaccattacgcccccttcctgctcaacctccaggactgcaagtttgtccgagccaccttcagcgccattgcctctcagtactgcccgcctctggagcatgaccttgggttagtctctgcgggcctggcgctcattgcctcgggctttgttctctacctcatctggatgctcttcgcggaccgcccccaaagaagggaggaggtgtccgatctggcgtcagggtcgaggatcacaccagtagacagctgctctccgtcgtag

SEQ ID NO: 5912 - protein, 547 aa, Sorghum bicolor
  misc_feature: Ceres ANNOT ID no. 6055173
  misc_feature (330)..(526): NCBI GI: 90399088 NCBI Desc: h0413e07.1 [oryza sativa (indica cultivar-group)]
  misc_feature (83)..(515): NCBI GI: 115485019 NCBI Desc: os11g0264500 [oryza sativa (japonica cultivar-group)]
  misc_feature: Down-regulated in shoot tissues in response to salicylic acid treatment
MMGFHAAAAAAVAVFAAAVLLAVAAGDSLADLGGAAREIESAPEVKNLGPWAKGLLKGMPEMAAGPAAMAPVVKYPLVLAEDRTRRPDVLSHLKMYDGGWNVTNKHYWASVSFTGVSGFLLGALWFIFFGIAAAGRCYFGSRICNAVLSLVLIIISFSFRTRAGCIVLLYGQSKFHEEATRTVDFVVNQSDFTIQTLRNVTEYLSFAQTITVAALYLPSDVQGQIDNLKGDLNKAADTISLKTAENYKRIRKVLHIIIELLYPYRSVVLICIAVVLLILAFLGYGLEQYGPRYTVYIFVTLCWKVVAALFILLGIFLILNSAAKDTCEAMDQWAQHPQAETALSNILPCVDESTTNRTLYQSKEVVVRLVGIVNRAISALSNRRPHHKHPGQFMPYLCSPYDSNLNDRPCNHREVTFENATTAWLNYTCMAQDTDLCSGNKTLTYDIYGQLVLAANVSYALYHYAPFLLNLQDCKFVRATFSAIASQYCPPLEHDLGLVSAGLALIASGFVLYLIWMLFADRPQRREEVSDLASGSRITPVDSCSPS

SEQ ID NO: 5913 - DNA, 3000 bp, Sorghum bicolor
  misc_feature: Ceres ANNOT ID no. 6055177
  misc_feature: Encodes the peptide sequence at SEQ ID NO 5914
atgtcgatgggcgtggtctcgagggaggtgttgccagcatgcgagaagctctgcttcatttgcccatccctgcggacgaggtcccgccatccggtgaagcgctacaagaagttgcttgcagaaatcttccctcggacacaggatgaaggaccaaatgatcgcaagatagggaaactgtgtgaatatatttcaaggaatcctatgcgtgttccaaagattacagtttacttagagcaaaaatgctacaaggaatttagggctgagcgctatggttcagtgaaagttgttatggcaatctatcgaaaggtgatatgttcttgtcaggagcaattgccactttttgccaacagcttgctaacaattgtagagacattattggagcaaaatagacaggatgacttgcggaaattagcatgtcaaacactttttgactttataaatcatcaggttgacagtacttacatgttcaatttagaaaaccagattcctaaactatgtcatctggcccaagagatgggtgaaaaggagaagatatgcattcttcatgcagctgggctacaagctctttcatctatgatttggtttatgggtgagtactcccacatgtcagcagagcttgataatgttgtttctgcagttctggaaaattatgagagcccatacgcaaatgctgataatgatgccgctgttgaggatagacgaattcaatgggtgaatgaagtgctcaaagctgaaggtcatgaacctcctgctgttaccattttgacaagggttccttcatggaaagttattagaactgttcacggtgaattaaggatttgtctacataaccttgctagaatatccaggggaggaacaacagtgcgacgagttctggaagctatatttcgttattttgataataacaatctatggtcaccttctaaaggatttgcactgtgtgtcctgctggatatgcagattgtgatggagaaatctggacagaatgctcatatattgttgtctatgttagtcaagcatcttgaacacaagaatgtattgaaacaaccagatatgaatctagatatcattgaagttacttcacgccttgctgaacactccaaagctcagtcttctacagcactgatggcttcaataagtgatatggtcaggcatatggctaaaagcatgcaatccttggccactgatgcagatcctggagacagcatggtcaaatggaatagcagatatgggaaagctgtagatgaatgtcttgttcagttgtctagaaaggtcggtgatgctggacctatccttgatacattagctgtagtactggaaaatatttcaagttctatgattgttgcacggtctactatttctgcagcatatcgcactgctcaaatagttgcatcattgccaaacttgtcacatcagagcaaagcatttcctgaggcgttgtttcatcaactgcttttagcaatggtctatccagattgtgagacacatttaggagcacatcggattttctctgttgttcttgttccctcttctgtcgctccatgctcatttgcaggcacatcacagacaaggaagattgatctccgaaggacattatctagaacaacatcggtgttttcatcttctgctgctttgtttgggaaacttaaaagagacatgctttcatttcgtgaaagtccgctccaggataacacaaagctactgcccatcagtgagagtgcagatgagatcagtgcaaatgatgcagagaatgcagatgagatcagtgcaaatgatgcaaaattattcaagtcacatactattcaaaggatggctagtacaaaagatatttctcttccctcttccacagatacaagtacttcaagtgaaccaactccaaatcaggaaaaggatgctgtcaccctcatgctcagtgttcgtcaggcaaatcttcttctttcctccttatggactcaggcactgttgcctgaaaatgttccgcggaattatgaagcaatttctcatacttacagcttgatgctattgttttctagagccaagggctcaggtgccgaagttttggttggtagctttcagcttgccttttcattaagaagtgtttcgttacaagcaggttttcttccaccttcacgcaggcgttctctttttactttggcaacttcaatgctcgtgtttttctcgaaagcttttagcattccagcgctcattccagttgtgaagcatgtgttgacagaaagtacagttgatccatttctttgtttaatagaagactgcagattgcaggctcttgatagtgctgctgagccttgcacgaaactctatggttcaaaagaagatgacgatctagctctgaaatcactctccaacattgacataaatgaagatcagtcaaaagaaacatcagtgtctcttatacttgacagcttggaacatctgtcagagtcagaattgtcgactattagaaaacagctgcttgaggaattttcagcagatgacatctgtatgggatctcattttactgaaacaccttcgaagtctccagcacaaaatggaaaactgcaccaaaagtctatggaggttattccattgggatttgtttttgaagatgatactctcgttgaagcatctgacagcttagtagaaccacacttgcgacatccgccatgtaacagcattcttgatgttgaccggcttcttaattcagtttcggaaacatctcagcatgttggaaggttgtcagtttcaacaaataaggatctgcctttcaaggaggtagccaaccaatgtgaagcacttctgattgggaagcagcaaaagctatctgtctgcatgagtgtccgtggaaaagaggatggtgaatcatccattgagcagtcatctccgcaggatcctcaagcagatacgtttctctgcacagctgatgaacaatggcaccccaattcctgcaagctcccagtgctgtgtccctatgaccagttccttgcaacgtctggatgctaa

SEQ ID NO: 5914 - protein, 999 aa, Sorghum bicolor
  misc_feature: Ceres ANNOT ID no. 6055177
  misc_feature (1)..(999): NCBI GI: 47497474 NCBI Desc: cyclin-like protein [oryza sativa (japonica cultivar-group)]
  misc_feature (4)..(979): NCBI GI: 45736188 NCBI Desc: cyclin-like protein [oryza sativa (japonica cultivar-group)]
  misc_feature (272)..(574): NCBI GI: 34393302 NCBI Desc: cyclin-like protein [oryza sativa (japonica cultivar-group)]
  misc_feature (4)..(765): NCBI GI: 42569848 NCBI Desc: cyclin-related [arabidopsis thaliana]
  misc_feature (3)..(566): NCBI GI: 56785280 NCBI Desc: cyclin-like [oryza sativa (japonica cultivar-group)]
MSMGVVSREVLPACEKLCFICPSLRTRSRHPVKRYKKLLAEIFPRTQDEGPNDRKIGKLCEYISRNPMRVPKITVYLEQKCYKEFRAERYGSVKVVMAIYRKVICSCQEQLPLFANSLLTIVETLLEQNRQDDLRKLACQTLFDFINHQVDSTYMFNLENQIPKLCHLAQEMGEKEKICILHAAGLQALSSMIWFMGEYSHMSAELDNVVSAVLENYESPYANADNDAAVEDRRIQWVNEVLKAEGHEPPAVTILTRVPSWKVIRTVHGELRICLHNLARISRGGTTVRRVLEAIFRYFDNNNLWSPSKGFALCVLLDMQIVMEKSGQNAHILLSMLVKHLEHKNVLKQPDMNLDIIEVTSRLAEHSKAQSSTALMASISDMVRHMAKSMQSLATDADPGDSMVKWNSRYGKAVDECLVQLSRKVGDAGPILDTLAVVLENISSSMIVARSTISAAYRTAQIVASLPNLSHQSKAFPEALFHQLLLAMVYPDCETHLGAHRIFSVVLVPSSVAPCSFAGTSQTRKIDLRRTLSRTTSVFSSSAALFGKLKRDMLSFRESPLQDNTKLLPISESADEISANDAENADEISANDAKLFKSHTIQRMASTKDISLPSSTDTSTSSEPTPNQEKDAVTLMLSVRQANLLLSSLWTQALLPENVPRNYEAISHTYSLMLLFSRAKGSGAEVLVGSFQLAFSLRSVSLQAGFLPPSRRRSLFTLATSMLVFFSKAFSIPALIPVVKHVLTESTVDPFLCLIEDCRLQALDSAAEPCTKLYGSKEDDDLALKSLSNIDINEDQSKETSVSLILDSLEHLSESELSTIRKQLLEEFSADDICMGSHFTETPSKSPAQNGKLHQKSMEVIPLGFVFEDDTLVEASDSLVEPHLRHPPCNSILDVDRLLNSVSETSQHVGRLSVSTNKDLPFKEVANQCEALLIGKQQKLSVCMSVRGKEDGESSIEQSSPQDPQADTFLCTADEQWHPNSCKLPVLCPYDQFLATSGC

SEQ ID NO: 5915 - DNA, 1191 bp, Sorghum bicolor
  misc_feature: Ceres ANNOT ID no. 6055182
  misc_feature: Encodes the peptide sequence at SEQ ID NO 5916
atgggcgccgccgacaagtggctgctcccgctcgtctccgtctccttcgtctcgctcctgctcttcctctccgcgctctcgggcttctccgcctcgtccgcgctcttcgcgcgcctcccgccgccctcctacgtgcgccggggcgccgccgcgccgccttccttcgcgtacctgctcgcgggggggcgaggcgacggcaggaagctcctgcggctgctcctcgccgtctaccaccccaggaaccgctacctgctccacctctccgccgacgcgccggcctccgagcgcgccgagctcgccgcggccgtcgcgcgcgccgcacccgccgtgcgcgccttcggaaatgtcgatgtcgtgggcaggcccaccgcgggcaccccaatgggctcctccggcctcgccgccacgctgcgtgcggccgccgcgatgctccggctcgatgcggagtgggactggttcgtcacgctcaacgccgccgactacccccttctcacccaggacgacttgattcatgttttctcctctgttccaaggcacctcaactttattgatcacacgagtgacattggatggaaagagtctcagagagtgcaaccgattatagtagatgctggagtatacttggcagggaggaatcagttcttccaagccacagagaaacgggacactcctgatggttctccatgggtcattttaaacagacgctttgtggagtattgtgtttttggttgggagaatctccctagaacactcctcatgtacttcacaaatgtgatgctacctctagaggggtatttccattcggttgcatgcaactcagacttccgcaatttcacggtgaacaatgacttgcggtatgtggtgtgggacgatccacctcagatggaaccccattccctaaatgttacacattatgatgagctagtagggagtggggttccttttgcccggaagtttaaggagaatgaaccactattggacaagattgatgataaagtgctacgacgttggcgccacagacctgttcctggtgcatggtgcacaggtaggaggaggtggttcagtgatccttgctcccagtggagcaatgtcaacattgtaagacctggtcctcaagctgagaagttccgaacatatatgaaccggattctggaagaatcaaagtcaagcaacaactcttgcaagcaatag

SEQ ID NO: 5916 - protein, 396 aa, Sorghum bicolor
  misc_feature: Ceres ANNOT ID no. 6055182
  misc_feature (55)..(275): Pfam Id: Branch Pfam Desc: Core-2/I-Branching enzyme
  misc_feature (223)..(395): NCBI GI: 115462149 NCBI Desc: os05g0152400 [oryza sativa (japonica cultivar-group)]
  misc_feature (24)..(237): NCBI GI: 70663986 NCBI Desc: osjnbb0018a10.9 [oryza sativa (japonica cultivar-group)]
  misc_feature (24)..(383): NCBI GI: 115457614 NCBI Desc: os04g0301700 [oryza sativa (japonica cultivar-group)]
  misc_feature (18)..(383): NCBI GI: 116308950 NCBI Desc: h0215e01.4 [oryza sativa (indica cultivar-group)]
  misc_feature (1)..(395): NCBI GI: 77556820 NCBI Desc: glycosylation enzyme-like protein [oryza sativa (japonica cultivar-group)]
  misc_feature: Useful for making plants with altered carbohydrate content
  misc_feature: Functional homolog of the protein sequence given in SEQ ID NO 13933
MGAADKWLLPLVSVSFVSLLLFLSALSGFSASSALFARLPPPSYVRRGAAAPPSFAYLLAGGRGDGRKLLRLLLAVYHPRNRYLLHLSADAPASERAELAAAVARAAPAVRAFGNVDVVGRPTAGTPMGSSGLAATLRAAAAMLRLDAEWDWFVTLNAADYPLLTQDDLIHVFSSVPRHLNFIDHTSDIGWKESQRVQPIIVDAGVYLAGRNQFFQATEKRDTPDGSPWVILNRRFVEYCVFGWENLPRTLLMYFTNVMLPLEGYFHSVACNSDFRNFTVNNDLRYVVWDDPPQMEPHSLNVTHYDELVGSGVPFARKFKENEPLLDKIDDKVLRRWRHRPVPGAWCTGRRRWFSDPCSQWSNVNIVRPGPQAEKFRTYMNRILEESKSSNNSCKQ

SEQ ID NO: 5917 - DNA, 453 bp, Sorghum bicolor
  misc_feature: Ceres ANNOT ID no. 6055192
  misc_feature: Encodes the peptide sequence at SEQ ID NO 5918
atggctcccaaggcggagaagaagccggcggcgaagaagcccgcggcggaggaggagcccgcggccgagaaggccccggcggggaagaagcccaaggcggagaagcgcctcccggcgggcaagtcggccggcaaggaaggcggcgacaagaaggggaagaagaaggccaagaagtcggtggagacctacaagatctacatcttcaaggtgctcaagcaggtgcaccctgacatcggcatctcctccaaggccatgtccatcatgaactccttcatcaacgacatcttcgagaagctcgccgccgaggccgccaagctcgcgcgctacaacaagaagcccaccatcacctccagggagatccagacgtcggtgcgcctcgtcctccccggcgagctcgccaagcacgccgtctccgagggcaccaaggccgtcaccaagttcacctcatcttag

SEQ ID NO: 5918 - protein, 150 aa, Sorghum bicolor
  misc_feature: Ceres ANNOT ID no. 6055192
  misc_feature (57)..(127): Pfam Id: Histone Pfam Desc: Core histone H2A/H2B/H3/H4
  misc_feature (1)..(150): NCBI GI: 21801 NCBI Desc: histone h2b [triticum aestivum]
  misc_feature (1)..(150): NCBI GI: 22325 NCBI Desc: h2b histone [zea mays]
  misc_feature (1)..(150): NCBI GI: 1708107 NCBI Desc: histone h2b
  misc_feature (1)..(150): NCBI GI: 577825 NCBI Desc: h2b histone [zea mays]
  misc_feature (1)..(150): NCBI GI: 22323 NCBI Desc: h2b histone [zea mays]
  misc_feature: No seed is being produced by the plant
  misc_feature: The plant flowers significantly late compared to wild-type.
  misc_feature: Useful for biocontainment applications
  misc_feature: Useful for making plants with modulated flowering time
  misc_feature: GREAT-hit functional homolog of the protein sequence given in SEQ ID NO 13102
  misc_feature: Useful for biocontainment applications
  misc_feature: Useful for making plants with modulated flowering time
  misc_feature: Functional homolog of the protein sequence given in SEQ ID NO 13102
MAPKAEKKPAAKKPAAEEEPAAEKAPAGKKPKAEKRLPAGKSAGKEGGDKKGKKKAKKSVETYKIYIFKVLKQVHPDIGISSKAMSIMNSFINDIFEKLAAEAAKLARYNKKPTITSREIQTSVRLVLPGELAKHAVSEGTKAVTKFTSS

SEQ ID NO: 5919 - DNA, 1833 bp, Sorghum bicolor
  misc_feature: Ceres ANNOT ID no. 6055246
  misc_feature: Encodes the peptide sequence at SEQ ID NO 5920
atggcgcagctggtggagacgtacgcgtgctcgccggcgacggagcgcggccgtgggatcctcctggccggggaccccaagacggacacgatcgcctactgcacgggccgcagcgtcatcatccgccgcctcgatgcgcccctcgacgcttgggcctaccaggaccacgcctaccccaccaccgtcgcccgcttctcccccaacggcgagtgggtcgcctccgccgacgcctccggctgcgtccgcgtctggggccgctacggcgaccgcgcgctcaaggccgagttccgacccctctcgggacgcgtcgacgacctccgctggtcccccgacggcctgcgcatcgtcgtctccggggacggcaagggcaagtccttcgtccgcgcattcgtgtgggactctggcagcacagttggtgagtttgatgggcactcaaagagggttctgagctgtgacttcaagcctacacgtccatttcgcattgtgacatgtggtgaagattttctggctaacttttatgaaggaccaccattcaaattcaagcattccataagggatcactcaaattttgttaattgtatccggtatgctcctgatggtagtaagtttatcactgtgagttctgataagaagggtttgatatatgatggcaaaactggagagaagataggagagctttccactgaaggcggtcatacagggagcatatatgctgttagctggagttctgatagtaaacaggttctaacagtttctgctgataaatctgcgaaagtatgggatatcatggaagatgcaagtgggaagttgaatcgaactttggcttgccctggtataggaggtgtggatgatatgcttgttggttgtctctggcagaatgaccatctcgtgacagtctctcttggtgggacatttaatgtgttctctgcaagcaacccagaccaagaaccagttacatttgcaggacatttgaagactgttagttctttggtcttctttactaaaagtagcccaagaactatactatctactagctatgatggtgtcatcatgaggtggatactgggtgttggatttggtggcagattgacgcgcaaaaacaacactcaaataaaatgctttgctgcagtagaagaagagcttgttacctcaggttatgataataaggtcttcagaattccacttaatggagaccagtgtggagatgctgagtcagttgatgtaggcggtcagccaaatgctttgaaccttgcacttcaaaaacctgaatttgcactgatcactactgattctgggattgtattactgcacaactcaaaagtcatctctacaaccaaagttaactataccatcacttcatcttcggtatctcctgatggcacggaagctgttgtgggtgctcaagatgggaaactgcgaatttattccatcagtggcgatacacttacagaagaagctctgcttgagaagcaccggggcgctatcacttccatacattattcaccagatgtttctatgtttgcttctgctgattccaacagggaagctgttgtgtgggatcgggcaagtagagagatcaagctgaagaacatgttgtaccacacagctaggataaactccctggcttggtcacctgacagtcgattggttgccactggctcactggacacctgtgcaattgtctacgagatagacaagccagcaaccagtcgcatcactatcaagggagcccatcttggtggagttcatggtttaaccttcctggagaatgatactctggtgactgcaggcgaggatgcttgcattcgtgtttggaaggtggtgcagcaatag

SEQ ID NO: 5920 - protein, 610 aa, Sorghum bicolor
  misc_feature: Ceres ANNOT ID no. 6055246
  misc_feature (178)..(216): Pfam Id: WD40 Pfam Desc: WD domain, G-beta repeat
  misc_feature (223)..(261): Pfam Id: WD40 Pfam Desc: WD domain, G-beta repeat
  misc_feature (525)..(563): Pfam Id: WD40 Pfam Desc: WD domain, G-beta repeat
  misc_feature (3)..(610): NCBI GI: 21387079 NCBI Desc: wd40-repeat protein [arabidopsis thaliana]
  misc_feature (138)..(610): NCBI GI: 42568857 NCBI Desc: transducin family protein / wd-40 repeat family protein [arabidopsis thaliana]
  misc_feature (8)..(607): NCBI GI: 3123032 NCBI Desc: 66 kda stress protein (p66)
  misc_feature (9)..(607): NCBI GI: 1722837 NCBI Desc: wd-repeat protein 2
  misc_feature (8)..(607): NCBI GI: 116129681 NCBI Desc: ensangp00000021922 [anopheles gambiae str. pest]
  misc_feature: The sequence is a functional homolog of SEQ ID NO. 502 in the 11/188,298 US application
  misc_feature: The sequence is a functional homolog of SEQ ID NO. 485 in the 11/188,298 US application
MAQLVETYACSPATERGRGILLAGDPKTDTIAYCTGRSVIIRRLDAPLDAWAYQDHAYPTTVARFSPNGEWVASADASGCVRVWGRYGDRALKAEFRPLSGRVDDLRWSPDGLRIVVSGDGKGKSFVRAFVWDSGSTVGEFDGHSKRVLSCDFKPTRPFRIVTCGEDFLANFYEGPPFKFKHSIRDHSNFVNCIRYAPDGSKFITVSSDKKGLIYDGKTGEKIGELSTEGGHTGSIYAVSWSSDSKQVLTVSADKSAKVWDIMEDASGKLNRTLACPGIGGVDDMLVGCLWQNDHLVTVSLGGTFNVFSASNPDQEPVTFAGHLKTVSSLVFFTKSSPRTILSTSYDGVIMRWILGVGFGGRLTRKNNTQIKCFAAVEEELVTSGYDNKVFRIPLNGDQCGDAESVDVGGQPNALNLALQKPEFALITTDSGIVLLHNSKVISTTKVNYTITSSSVSPDGTEAVVGAQDGKLRIYSISGDTLTEEALLEKHRGAITSIHYSPDVSMFASADSNREAVVWDRASREIKLKNMLYHTARINSLAWSPDSRLVATGSLDTCAIVYEIDKPATSRITIKGAHLGGVHGLTFLENDTLVTAGEDACIRVWKVVQQ

SEQ ID NO: 5921 - DNA, 3243 bp, Sorghum bicolor
  misc_feature: Ceres ANNOT ID no. 6055247
  misc_feature: Encodes the peptide sequence at SEQ ID NO 5922
  misc_feature: Down-regulated in root tissues in response to methyl jasmonate treatment
  misc_feature: Up-regulated in shoot tissues in response to methyl jasmonate treatment
atggaaaatcgaccaaatggttcagtaaataatgctgagcataataatcaggaaaatgagaagtccatggatgctagtgagcctgaagaagcacgagatgtttttgtttacagagaagatgttgtgagtttgaagtccaaggaggatgtccgtggattagttttggaggtagctggggagtatgattctgaaggtagcatcactgatgatgatattgatactgatgaacataaagataataaatctgctcatggagctgaaaatggtggtgctgatggtgataatgctagtaatggagctgaagttgaaagccagagttctttgcctgatgacaaagttcgagtgttatggatagatggtagtgagaagacagaagacattgatgaggtagttgttgttgatagaagtttccttcatggagatttagttgcctctgcctcagacccaactggtcagatggggcttgttttggatgtcaatcttgtggttgatttgcaaggtgccaatggcgatacgataaagggtgtatcttccaaggatttgagacgaatcagggaattcaatgtgggtgattatgtcgtctctgggctatggcttggtcgagttgatgaagtgctagataatgttaatgtgttgtttgatgatggctctgtatgtaaagttaatagggcagatcctatgcgcttaaagccagcatttggcccaattcatccagatacagcttgtcctttttatccaggacagcgtgtgaaggcagtgtcatcatctgttttcaaaacatccaggtggcttaatggattgtggagagcatgtcgtcttgaaggtactgtcacaaaagtggaaagtgctgctgttatagtctattggatggcatcagcacactttgctacagatcagcaacctgttcctccagaggagcagaacccaaaggaccttactcttttgtcttgtttctcatatgcaaactggcaattaactgactggtgtcttcctcaccgatacacttcatgtactaatgataccatggttaattctgataaacatacaaggcagatatgtacatgctcacaaagctcagctccactgtctgatattccagaatctcaagttgatgttcaggctgaacaagatcaaatgactgatacagatgcaggtcacaagcagacagatgttgattctactgcagatggattgagtatgtcggatggagataattcatgcatagccaaagaatcagaaacaggaactagtgtatcaagcatcccaaagttgggtccacaggacaatgcaacatccagaaaaaagtttaggaaagtgtttctaaaaaaggacaaaagaacaaaaaaaagagacgacagctttgagcgagctctactcatcgcaaatacctgtaccaaagttgatgtagtctggcaggacgggacaaaggaatgtggagtagctgcaacatcgttgatccctatccacagtccaaatgaccatgatttcttcccggagcagtatgttgtggacaaggtcacaaatgatgatgattcttctgaaccaaggcgtgtgggtcttgttagaagcgttaatgctaaggaccgaacagtaactgtatcatggtttaagccttcactacgtctagaggagccaatggagatcgggtgtaatgaagttgtgagtgcatatgaactggatggccatccggattatgattattgctatggagatattgtcgtccgcttgccgcctgtttcacctgtaattgaatcaaccaataacaaggaccaaatggaactggataagacggtagattcctcggaaggatttgctacttcgaatgatgcaccccctgatactagtgcagacgaacagctttcacagaaggaatactgctcgcagtttacaagcctctcatgggctggaaatatagttggctttcaagatggtgagattgaaatcatttggggtgatggctcgatttcaaaggttgggcctcatgaaatatatgttgttggtcgtgaagatgatggagcctcactagatgatggaacagcctctgatggtgctagctgggagactcttgatgacaacgaaatggatgtacttgatgattctgcaaaggatgattcgcaaaatgtacctgagaatagcattgaaagggaaaatggttcatttagctcccaggatggaagttctattgcaactggtcccctttcagttgcttttgggtttgtgacccgactggcgagtgatctctttgctcgagaaactggtgatgacattgataaaattaatgagaatcatgtggaatcgccagagcatgctgcagtcacagaaaacgattcttctgtcgagaagtctgtagacgtggtcttggctgataatcctgaagatccagaatgtttcaaacactttgatgttctgcagtgtcctccagatcaccactaccttgaaaacacagcccagggtacaggtggaagaaagtgggtcaaaaaggtacagcaggaatggagcatacttgagaagaacctaccagactatatttatgtcagggtatttgaggatcgcatggatctcttgagagctgtgattgttggagcaagcggaacaccctaccaagatggcctgttcttctttgatttccaccttccacctgagtacccagaagtccctccgtcagcatactatcattctggtggtttgcgtgtaaatccaaacctgtatgtggacgggaaggtttgtttaagtctcttaaatacttggactggcagagggaatgaagtgtgggataaatcatcatcaagtattctccaagtgctagtttcacttcagggattggttctcaatgaaaaaccctattttaatgaggctgggtatgagaagcaagttggtactgttgaaggggagaagaatgcagtgccgtataatgagaatacatacctgctgagcgtgaaatctatgctgtatatattgagacggcctcctttgcattttgaggattttgtgaagagccatttccgcaagcgtggccactacatccttaaagcttgtgaggcctatttgcaaggaaatgttgtgggcactctcactgacgacgcatgccccaccgagagaagcaaggagcactcgagctctgttggcttcaagcttgcactagcaaagattctacctcggctgattacagccctgaaggacactggagccgactgcgaccaatacgagcaccttgggaaaacagaaacagttagagaaagctga

SEQ ID NO: 5922 - protein, 1080 aa, Sorghum bicolor
  misc_feature: Ceres ANNOT ID no. 6055247
  misc_feature (827)..(976): Pfam Id: UQ_con Pfam Desc: Ubiquitin-conjugating enzyme
  misc_feature (11)..(1079): NCBI GI: 53792245 NCBI Desc: ubiquitin-conjugating enzyme -like [oryza sativa (japonica cultivar-group)]
  misc_feature (614)..(1065): NCBI GI: 115465383 NCBI Desc: os05g0557700 [oryza sativa (japonica cultivar-group)]
  misc_feature (632)..(1057): NCBI GI: 140055995 NCBI Desc: ubiquitin-conjugating enzyme, e2 [medicago truncatula]
  misc_feature (745)..(1067): NCBI GI: 110739706 NCBI Desc: ubiquitin-conjugating enzyme e2 -like protein [arabidopsis thaliana]
  misc_feature (800)..(1039): NCBI GI: 134035342 NCBI Desc: ubiquitin-conjugating enzyme e2 o (ubiquitin-protein ligase o) (ubiquitin carrier protein o) (ubiquitin-conjugating enzyme e2 of 230 kda) (e2-230k)
  misc_feature: Down-regulated in root tissues in response to methyl jasmonate treatment
  misc_feature: Up-regulated in shoot tissues in response to methyl jasmonate treatment
MENRPNGSVNNAEHNNQENEKSMDASEPEEARDVFVYREDVVSLKSKEDVRGLVLEVAGEYDSEGSITDDDIDTDEHKDNKSAHGAENGGADGDNASNGAEVESQSSLPDDKVRVLWIDGSEKTEDIDEVVVVDRSFLHGDLVASASDPTGQMGLVLDVNLVVDLQGANGDTIKGVSSKDLRRIREFNVGDYVVSGLWLGRVDEVLDNVNVLFDDGSVCKVNRADPMRLKPAFGPIHPDTACPFYPGQRVKAVSSSVFKTSRWLNGLWRACRLEGTVTKVESAAVIVYWMASAHFATDQQPVPPEEQNPKDLTLLSCFSYANWQLTDWCLPHRYTSCTNDTMVNSDKHTRQICTCSQSSAPLSDIPESQVDVQAEQDQMTDTDAGHKQTDVDSTADGLSMSDGDNSCIAKESETGTSVSSIPKLGPQDNATSRKKFRKVFLKKDKRTKKRDDSFERALLIANTCTKVDVVWQDGTKECGVAATSLIPIHSPNDHDFFPEQYVVDKVTNDDDSSEPRRVGLVRSVNAKDRTVTVSWFKPSLRLEEPMEIGCNEVVSAYELDGHPDYDYCYGDIVVRLPPVSPVIESTNNKDQMELDKTVDSSEGFATSNDAPPDTSADEQLSQKEYCSQFTSLSWAGNIVGFQDGEIEIIWGDGSISKVGPHEIYVVGREDDGASLDDGTASDGASWETLDDNEMDVLDDSAKDDSQNVPENSIERENGSFSSQDGSSIATGPLSVAFGFVTRLASDLFARETGDDIDKINENHVESPEHAAVTENDSSVEKSVDVVLADNPEDPECFKHFDVLQCPPDHHYLENTAQGTGGRKWVKKVQQEWSILEKNLPDYIYVRVFEDRMDLLRAVIVGASGTPYQDGLFFFDFHLPPEYPEVPPSAYYHSGGLRVNPNLYVDGKVCLSLLNTWTGRGNEVWDKSSSSILQVLVSLQGLVLNEKPYFNEAGYEKQVGTVEGEKNAVPYNENTYLLSVKSMLYILRRPPLHFEDFVKSHFRKRGHYILKACEAYLQGNVVGTLTDDACPTERSKEHSSSVGFKLALAKILPRLITALKDTGADCDQYEHLGKTETVRES

SEQ ID NO: 5923 - DNA, 1308 bp, Sorghum bicolor
  misc_feature: Ceres ANNOT ID no. 6055268
  misc_feature: Encodes the peptide sequence at SEQ ID NO 5924
atggaggacccaccagcgcttgctccgccggagccggagccggagccggagcccgaggcctccccggcgccgccgcaaaggctgctgcggctgcgctgcgcggtgcagcactacgagtggggccagcacggagccgcctccctcgtcgcgcgcctcgccgaccagaaccccgacccggctcgcccctacgccgagctctggatgggcactcacccgtccggcccctccacgctcctcggcgacggcgcgctcctcagggactggctcgcgcggaaccccgacgcgctcggccccgccgtcgccgcgcgctggggaggcgacctcccattcctcttcaaggtgctgtcggtggccaaagcgctctcgatccaggcgcacccggacaagaaactcgccgaggtgctgcacgcgctgcggccgtccacctacaaggacgacaatcacaagccggagatggccatcgccttcacggagttccgggcgctttgcggctttgcccctattgaggagctcaaggatgtcctgaggacagttcctgaaattgaaggcctaattgggcatgaagatactggcaagctgatgaacatgaaggagtatgatggggttagtgaagtaaagtccagtttgcgatcagcttttgctaagctaatgacagcaagtaaagacatggtttctgaagcagttgcaaaactgatcagtcgcctgaatactgacagcaagattaggaacttaacagacaaagaacagctggttttgtccctggagagacaatatcaagacgatgttggagttctagcagcacttttctttaactatgtgaagctcagtcctggtgaagcgctttatattggtccaaatgaaccgcatgcatacctctctggggaatgcattgaaattatggccacttcagacaacgttgtacgtgctggtttgacacctaaatacagagatgtgcaaactctctgctcaatgctaacatacaaacaggccttcccagaaattttgcgcggagttcctgtgcagccacacgtaaggcgctacacgccaccatttaacgagtttgaggtcgattgctgcttggttcctccaggtgaactgcttgtcatatccccggtaccaggaccatccgtatttctcgtaatgaccggggaaggcgagattcagttggattctatgtcaggtggagaaaaggcaaaggaaggtgatgttttcttcgttcctgcatacactgaggttaagatctctgcgtgtggccccgagtctgtgctgctgtacagggctggggtaaacagcagattcttcagctaa

SEQ ID NO: 5924 - protein, 435 aa, Sorghum bicolor
  misc_feature: Ceres ANNOT ID no. 6055268
  misc_feature (28)..(392): Pfam Id: PMI_typeI Pfam Desc: Phosphomannose isomerase type I
  misc_feature (91)..(431): NCBI GI: 115478975 NCBI Desc: os09g0389000 [oryza sativa (japonica cultivar-group)]
  misc_feature (26)..(434): NCBI GI: 60617303 NCBI Desc: phosphomannose isomerase [cyamopsis tetragonoloba]
  misc_feature (26)..(434): NCBI GI: 51970910 NCBI Desc: phosphomannose isomerase (din9) [arabidopsis thaliana]
  misc_feature (217)..(435): NCBI GI: 115486163 NCBI Desc: os11g0600900 [oryza sativa (japonica cultivar-group)]
  misc_feature (23)..(427): NCBI GI: 23574751 NCBI Desc: mannose-6-phosphate isomerase [macaca fascicularis]
MEDPPALAPPEPEPEPEPEASPAPPQRLLRLRCAVQHYEWGQHGAASLVARLADQNPDPARPYAELWMGTHPSGPSTLLGDGALLRDWLARNPDALGPAVAARWGGDLPFLFKVLSVAKALSIQAHPDKKLAEVLHALRPSTYKDDNHKPEMAIAFTEFRALCGFAPIEELKDVLRTVPEIEGLIGHEDTGKLMNMKEYDGVSEVKSSLRSAFAKLMTASKDMVSEAVAKLISRLNTDSKIRNLTDKEQLVLSLERQYQDDVGVLAALFFNYVKLSPGEALYIGPNEPHAYLSGECIEIMATSDNVVRAGLTPKYRDVQTLCSMLTYKQAFPEILRGVPVQPHVRRYTPPFNEFEVDCCLVPPGELLVISPVPGPSVFLVMTGEGEIQLDSMSGGEKAKEGDVFFVPAYTEVKISACGPESVLLYRAGVNSRFFS

SEQ ID NO: 5925 - DNA, 906 bp, Sorghum bicolor
  misc_feature: Ceres ANNOT ID no. 6055284
  misc_feature: Encodes the peptide sequence at SEQ ID NO 5926
atggcgccccaccagcgggtgctgctcccgttcccactcgtcttcctcctcctcctcctcctcgtcgtcccaccccgcgccgacgcgtggggcaaggagggccacatcatggtctgcaagatcgccgagaagtacctgtcggagaaggcggcggcggcggtgcaggcgctgctgccggagtcggcgggcggggagctgtcgacggtgtgcccgtgggcggacacggtgcgctggcactaccactgggccagcccgctccactacgtcaacacccctcaagtctgcaacttcaagtactctcgggattgccacaattctcgtggccagcaagggatgtgcgtcgtcggggctatcaacaactacactgaccagctctacagctatggccagaagacttcgtataacctgacggagagcctgatgttcctggcacattttgtcggcgacgtccaccagccactgcatgtaggctttgaagatgacgaaggcgggaacacgatcaccgtccactggtaccggaggaaagcaaacctccatcacgtgtgggatgtcagcattatagatacggcaatcaaggacttctacaataagagcatggatactatggtagagactctcaagatgaaccttacagatggatggtctgatgatattactcactgggaaaattgcgagaacaaacatgccacctgtgcaaatgactatgcaattgagagcattcattattcctgcaactatgcctacaaagatgtggagcaaggcattactctaggagatgattattttttcactagatacccgattgtggagaagagattagcacaggctggaatcagactggcgttgatacttaatcggatctttgatggggataaagcagatgatataccactacgagtacagtaa

SEQ ID NO: 5926 - protein, 301 aa, Sorghum bicolor
  misc_feature: Ceres ANNOT ID no. 6055284
  misc_feature (30)..(289): Pfam Id: S1-P1_nuclease Pfam Desc: S1/P1 Nuclease
  misc_feature (8)..(292): NCBI GI: 38345900 NCBI Desc: osjnba0060d06.10 [oryza sativa (japonica cultivar-group)]
  misc_feature (18)..(289): NCBI GI: 4099835 NCBI Desc: bifunctional nuclease [zinnia elegans]
  misc_feature (13)..(290): NCBI GI: 5672692 NCBI Desc: nuclease i [hordeum vulgare]
  misc_feature (13)..(291): NCBI GI: 3242403 NCBI Desc: endonuclease [hordeum vulgare subsp. vulgare]
  misc_feature (16)..(288): NCBI GI: 4099833 NCBI Desc: bifunctional nuclease [zinnia elegans]
MAPHQRVLLPFPLVFLLLLLLVVPPRADAWGKEGHIMVCKIAEKYLSEKAAAAVQALLPESAGGELSTVCPWADTVRWHYHWASPLHYVNTPQVCNFKYSRDCHNSRGQQGMCVVGAINNYTDQLYSYGQKTSYNLTESLMFLAHFVGDVHQPLHVGFEDDEGGNTITVHWYRRKANLHHVWDVSIIDTAIKDFYNKSMDTMVETLKMNLTDGWSDDITHWENCENKHATCANDYAIESIHYSCNYAYKDVEQGITLGDDYFFTRYPIVEKRLAQAGIRLALILNRIFDGDKADDIPLRVQ

SEQ ID NO: 5927 - DNA, 2469 bp, Sorghum bicolor
  misc_feature: Ceres ANNOT ID no. 6055286
  misc_feature: Encodes the peptide sequence at SEQ ID NO 5928
atggtgaagaagaagctgaagaaactgtatggcagggatgctcgggagttctttaaccaggtcatggtggagcaacccttgctgcccttcctgatcccgctcggcctctttgcgtggtttgtcgaacggtgggttgtgccattctcaaactgggttcccctcgctgctgctgtttgggcaaccattcagtatgggaggtttaagaggaggacaactgtagaagatttgaacaaaagatggaagcatcttatactgaatacagcacccaccacaccaattgagccttgcgaatggttgaacaaacttttgttagaagtttggcctaattacatggaaccaaaactatcgaagaggtttcagtctaccgtcgagagacgtttaaagaatcgaaaaccaaaattaatagataaaatagaattacaggaattctcacttggctcttgtccacctaccctgggagatcagggcatgcgttggattacttctggtgaccagcaagtcatgcgcttgggatttgattggaatagccacgagatgagtgtaatgtttttggcgaaattagcgaagccactgatgggggcttgtcgaattgttataaacagcattcacatcaagggagatcttctactattacccatacttgatggggaagctatactctattcttttgaatcaaccccagaagtcaggattggggtagcatttggaagtggtggaagccaagcaattcctggtatggagttaccaggtgtctcgacatggctggtgaagcttttgacggagaccatagggaaaacaatggttgaacctcgccggctatgtttttctttgccatcagtagatctacggaaacgagcagttggaggtgttctctcagttactgttgtatcagctagtaacctctgtaagagcacagctaatgatatagggaaccgccaaagctcaaatggaggggccgcgtacggaattgctgataacaaggtatcacagacatttgttgaggtagaagttggcaatttgatgagaaaaacaagtaccagtaagggtctaaatcctacgtggaacagtacatttaacatggtactgcatggagacacaggcattgtcaagtttcttctgtatgaattggattctgatggtgtcaaattcaattacttgacaagctgtgagataaaggtcaagtatgttcttgatggttcaacaatattttgggctatagggcataagtctggtgttgttgcaaagcatactgagcattgcggacaagaagttggaatggttgttccgtttgaggatatcaatggcgagttaactgtaagccttgtgctaaaagaatggcagttctctgatgggtcggttacattgagtaattctctgggcaatggacttcaaagctcatttgatggatcgataaagcttcagtccacaacaggaaggagacttagggccagagttgttgagggtagggcccttacagctaacagtaaatctggaaaatgtgacccttatgtgaaactccagtacggaaaggctctataccgaacaaaaacactgtcacatacagttcgaccagtttggaatgataagtttgagtttgatgagatctctggtggtgaatatctgaagatcaaatgctataatgcagatatgtttggtgatgagagcattggtagtgcaagagttaatttggagggacttctcgatggtgctagccgtgatgtttgggtaccacttgaaaaagtagatgcaggagagatcaggcttgaaatagagccaataaagaatgatcacaacaatagcatgcagagctcaagcagtaaagctggagctggttggattgagctagtcgtaattgaagccagagatctagttgctgccgatctgagaggcactagtgatccttatgtccgggtgcaatatgggaacaagaagaaacgaaccaaggtcatttacaaaactctctctccacagtggagccagacattcgagttcccagaaactggagaacccctggttttgcatgtgaaggaccacaacgccgtccttccaaccgctagtatcggccattgcaccgttgaatacagcatgctgtctccgaaccaatccgctgaaaaatggataccactccaaggggtaaaaagcggagaaatccatgtaaagatcgcacggagagtatcagtaccagactccgagaagaaaaacatactcgggacagatccatctggcaagggacacaagatatcgacacagatgagagacagcctgaagaaattcacaggcttgatcgacgacggaggtgacccggaggccctggcgctggcggtgacagagatggaaggcatccagggcgagcaggaagagtacatagaaaccctggagcgggagaaggcgatgctgctgcacaagatacatgagcttggttccgaaatcattaggacatcatctggtcctccaaggacgcggtactag

SEQ ID NO: 5928 - protein, 822 aa, Sorghum bicolor
  misc_feature: Ceres ANNOT ID no. 6055286
  misc_feature (291)..(382): Pfam Id: C2 Pfam Desc: C2 domain
  misc_feature (481)..(560): Pfam Id: C2 Pfam Desc: C2 domain
  misc_feature (613)..(691): Pfam Id: C2 Pfam Desc: C2 domain
  misc_feature (208)..(822): NCBI GI: 115434312 NCBI Desc: os01g0128800 [oryza sativa (japonica cultivar-group)]
  misc_feature (5)..(821): NCBI GI: 22137024 NCBI Desc: at3g18370/myf24_8 [arabidopsis thaliana]
  misc_feature (16)..(593): NCBI GI: 140066449 NCBI Desc: c2; sugar transporter superfamily [medicago truncatula]
  misc_feature (362)..(806): NCBI GI: 117557353 NCBI Desc: ntermtm-c2type3.1 protein [physcomitrella patens]
  misc_feature (98)..(591): NCBI GI: 8778718 NCBI Desc: t25n20.15 [arabidopsis thaliana]
MVKKKLKKLYGRDAREFFNQVMVEQPLLPFLIPLGLFAWFVERWVVPFSNWVPLAAAVWATIQYGRFKRRTTVEDLNKRWKHLILNTAPTTPIEPCEWLNKLLLEVWPNYMEPKLSKRFQSTVERRLKNRKPKLIDKIELQEFSLGSCPPTLGDQGMRWITSGDQQVMRLGFDWNSHEMSVMFLAKLAKPLMGACRIVINSIHIKGDLLLLPILDGEAILYSFESTPEVRIGVAFGSGGSQAIPGMELPGVSTWLVKLLTETIGKTMVEPRRLCFSLPSVDLRKRAVGGVLSVTVVSASNLCKSTANDIGNRQSSNGGAAYGIADNKVSQTFVEVEVGNLMRKTSTSKGLNPTWNSTFNMVLHGDTGIVKFLLYELDSDGVKFNYLTSCEIKVKYVLDGSTIFWAIGHKSGVVAKHTEHCGQEVGMVVPFEDINGELTVSLVLKEWQFSDGSVTLSNSLGNGLQSSFDGSIKLQSTTGRRLRARVVEGRALTANSKSGKCDPYVKLQYGKALYRTKTLSHTVRPVWNDKFEFDEISGGEYLKIKCYNADMFGDESIGSARVNLEGLLDGASRDVWVPLEKVDAGEIRLEIEPIKNDHNNSMQSSSSKAGAGWIELVVIEARDLVAADLRGTSDPYVRVQYGNKKKRTKVIYKTLSPQWSQTFEFPETGEPLVLHVKDHNAVLPTASIGHCTVEYSMLSPNQSAEKWIPLQGVKSGEIHVKIARRVSVPDSEKKNILGTDPSGKGHKISTQMRDSLKKFTGLIDDGGDPEALALAVTEMEGIQGEQEEYIETLEREKAMLLHKIHELGSEIIRTSSGPPRTRY

SEQ ID NO: 5929 - DNA, 507 bp, Sorghum bicolor
  misc_feature: Ceres ANNOT ID no. 6055307
  misc_feature: Encodes the peptide sequence at SEQ ID NO 5930
atgcacagttggacgctgcgcctgttggccgcggcgacaacggccggcgtcctcctcgccgccgtgtgcgcggccgcctccgcgctcgacgccttccacgcccccgccgtccaagcccaagcccatgttacgaagatcaaccggttccacaaacagattaatggcaatgacaaggtgacattgactttcaatgtatctgcaaatttggagtcactattcacatggaacacaaaacaggtctttgtctttctgacagctgagtatgaaaacacgaaaaattcactgaaccaggtttcgttgtgggaccatattatacctgacaaggaccttgcaaagctgcaactagaggtgaagagcaagtatcccctgatagaccagggtagcagtctgcgggggaagacgcttcagtttgttctacactggcatgctatgcccaatgctggcgccatgatcagagatcggatgccgctctcgaagttcagactgccggactcctatacctcttga

SEQ ID NO: 5930 - protein, 168 aa, Sorghum bicolor
  misc_feature: Ceres ANNOT ID no. 6055307
  misc_feature (1)..(167): Pfam Id: SPC22 Pfam Desc: Signal peptidase subunit
  misc_feature (1)..(168): NCBI GI: 115434338 NCBI Desc: os01g0131800 [oryza sativa (japonica cultivar-group)]
  misc_feature (1)..(166): NCBI GI: 28558783 NCBI Desc: signal peptidase protein-like protein [cucumis melo]
  misc_feature (1)..(166): NCBI GI: 115480605 NCBI Desc: os09g0556000 [oryza sativa (japonica cultivar-group)]
  misc_feature (1)..(166): NCBI GI: 87240531 NCBI Desc: signal peptidase 22 kda subunit [medicago truncatula]
  misc_feature (79)..(168): NCBI GI: 94730424 NCBI Desc: probable signal peptidase complex subunit 3 (microsomal signal peptidase 22 kda subunit) (spase 22 kda subunit) (spc22)
MHSWTLRLLAAATTAGVLLAAVCAAASALDAFHAPAVQAQAHVTKINRFHKQINGNDKVTLTFNVSANLESLFTWNTKQVFVFLTAEYENTKNSLNQVSLWDHIIPDKDLAKLQLEVKSKYPLIDQGSSLRGKTLQFVLHWHAMPNAGAMIRDRMPLSKFRLPDSYTS

SEQ ID NO: 5931 - DNA, 849 bp, Sorghum bicolor
  misc_feature: Ceres ANNOT ID no. 6055328
  misc_feature: Encodes the peptide sequence at SEQ ID NO 5932
atgactagccccaggctaaagctcttcggcttccacgtctccgaggaggagcggcaccacgagctgcctggcctggagacggaggcggcggaagccgagccggatcaggaggcgccggcgtgcggtaacaacggtggcggcggaggctccgactcgtcgtcctcgtctaccaccaccaccaccacggccacgggcgccgccacggcgggagcgggagccggcgacggccggaggtacgagtgccagtactgctgccgcgagttcgccaactcgcaggcgctgggcggccaccagaacgcgcacaagaaggagcggcagcagctcaagcgcgcgcagctgcaggccgcggccgccgccgccggccgcgtcgcgggcggggccgccgcgctctacccgcgcgccaacccgatggtgtccgccttcgtgccgccgccgcacctcctcggcggcggaggagtcggagacgcggcgcccacgagctgggtctacttctccccgcgcgccgccgccgtggccgggggcccgcagggccagcagttccacgtctcccacaactgcgtgttcccgtcgtcgcgcgcttccccggccgccgtgacggcgtcgccggccgtgttctcctacaccacggcacccgcctccgccgccggcgccgcctccgcgccctacgtgatgaccgacgaccacagcgggcggagggtccaccacgtgagcccggcggccgccctggggagataccccggcatggcagctggccctgggatggcggtggtggcggagccggtggtcaccgggccggaggacgccctggggctggacctgcagctcagccttgcgcccgccggcttgtga

SEQ ID NO: 5932 - protein, 282 aa, Sorghum bicolor
  misc_feature: Ceres ANNOT ID no. 6055328
  misc_feature (57)..(148): NCBI GI: 9755451 NCBI Desc: zinc finger protein zep6 [arabidopsis thaliana]
  misc_feature (27)..(136): NCBI GI: 56201819 NCBI Desc: sgt1-like protein [oryza sativa (japonica cultivar-group)]
  misc_feature (64)..(247): NCBI GI: 115479419 NCBI Desc: os09g0445500 [oryza sativa (japonica cultivar-group)]
  misc_feature (64)..(247): NCBI GI: 51536147 NCBI Desc: zinc finger protein-like [oryza sativa (japonica cultivar-group)]
  misc_feature (69)..(257): NCBI GI: 51091156 NCBI Desc: zinc finger protein-like [oryza sativa (japonica cultivar-group)]
  misc_feature: The plant flowers significantly late compared to wild-type.
  misc_feature: The plant is abnormally small.
  misc_feature: The plant produces a reduced number of seeds.
  misc_feature: The sequence is a functional homolog of SEQ ID NO 10 in the 10/412,699US patent application
  misc_feature: The sequence is a functional homolog of SEQ ID NO 1090 in the 10/412,699US patent application
  misc_feature: The sequence is a functional homolog of SEQ ID NO 1091 in the 10/412,699US patent application
  misc_feature: The sequence is a functional homolog of SEQ ID NO 1092 in the 10/412,699US patent application
  misc_feature: The sequence is a functional homolog of SEQ ID NO 1093 in the 10/412,699US patent application
  misc_feature: The sequence is a functional homolog of SEQ ID NO 1094 in the 10/412,699US patent application
  misc_feature: The sequence is a functional homolog of SEQ ID NO 124 in the 11/479,226US patent application
  misc_feature: The sequence is a functional homolog of SEQ ID NO 1279 in the 10/666,642US patent application
  misc_feature: The sequence is a functional homolog of SEQ ID NO 1386 in the 10/666,642US patent application
  misc_feature: The sequence is a functional homolog of SEQ ID NO 176 in the 10/412,699US patent application
  misc_feature: The sequence is a functional homolog of SEQ ID NO 1766 in the 10/412,699US patent application
  misc_feature: The sequence is a functional homolog of SEQ ID NO 385 in the 11/479,226US patent application
  misc_feature: The sequence is a functional homolog of SEQ ID NO 514 in the 10/225,066US patent application
  misc_feature: The sequence is a functional homolog of SEQ ID NO 62 in the 11/375,241US patent application
  misc_feature: The sequence is a functional homolog of SEQ ID NO 635 in the 10/374,780US patent application
  misc_feature: The sequence is a functional homolog of SEQ ID NO 636 in the 10/374,780US patent application
  misc_feature: The sequence is a functional homolog of SEQ ID NO 637 in the 10/374,780US patent application
  misc_feature: The sequence is a functional homolog of SEQ ID NO 638 in the 10/374,780US patent application
  misc_feature: The sequence is a functional homolog of SEQ ID NO 639 in the 10/374,780US patent application
  misc_feature: The sequence is a functional homolog of SEQ ID NO 66 in the 10/374,780US patent application
  misc_feature: The sequence is a functional homolog of SEQ ID NO 760 in the 10/666,642US patent application
  misc_feature: The sequence is a functional homolog of SEQ ID NO 761 in the 10/666,642US patent application
  misc_feature: The sequence is a functional homolog of SEQ ID NO 762 in the 10/666,642US patent application
  misc_feature: The sequence is a functional homolog of SEQ ID NO 763 in the 10/666,642US patent application
  misc_feature: The sequence is a functional homolog of SEQ ID NO 922 in the 11/435,388US patent application
  misc_feature: Useful for biocontainment applications
  misc_feature: Useful for making plants with modulated biomass
  misc_feature: Useful for making plants with modulated flowering time
  misc_feature: Useful for making plants with modulated growth and phenotype characteristics
  misc_feature: The sequence is a functional homolog of SEQ ID NO 10 in the 20040045049 US patent application
  misc_feature: The sequence is a functional homolog of SEQ ID NO 10 in the 20040045049 US patent application
  misc_feature: The sequence is a functional homolog of SEQ ID NO 1090 in the 20040045049 US patent application
  misc_feature: The sequence is a functional homolog of SEQ ID NO 1091 in the 20040045049 US patent application
  misc_feature: The sequence is a functional homolog of SEQ ID NO 1092 in the 20040045049 US patent application
  misc_feature: The sequence is a functional homolog of SEQ ID NO 1093 in the 20040045049 US patent application
  misc_feature: The sequence is a functional homolog of SEQ ID NO 1094 in the 20040045049 US patent application
  misc_feature: The sequence is a functional homolog of SEQ ID NO 176 in the 20040045049 US patent application
  misc_feature: The sequence is a functional homolog of SEQ ID NO 1766 in the 20040045049 US patent application
  misc_feature: GREAT-hit functional homolog of the protein sequence given in SEQ ID NO 13533
  misc_feature: Functional homolog of the protein sequence given in SEQ ID NO 13581
  misc_feature: The sequence is a functional homolog of SEQ ID NO. 351 in the 11/188,298 US application
MTSPRLKLFGFHVSEEERHHELPGLETEAAEAEPDQEAPACGNNGGGGGSDSSSSSTTTTTTATGAATAGAGAGDGRRYECQYCCREFANSQALGGHQNAHKKERQQLKRAQLQAAAAAAGRVAGGAAALYPRANPMVSAFVPPPHLLGGGGVGDAAPTSWVYFSPRAAAVAGGPQGQQFHVSHNCVFPSSRASPAAVTASPAVFSYTTAPASAAGAASAPYVMTDDHSGRRVHHVSPAAALGRYPGMAAGPGMAVVAEPVVTGPEDALGLDLQLSLAPAGL

SEQ ID NO: 5933 - DNA, 456 bp, Sorghum bicolor
  misc_feature: Ceres ANNOT ID no. 6055329
  misc_feature: Encodes the peptide sequence at SEQ ID NO 5934
atgagcaaagcaggcggcggtcccggctcggccccgggcccgacggccgcggcggcggcggcagcggtgcagaagcagaagtcgctgctgcagaaggcggacgccgacgtctccagcctcgtcgacaatttctcctcgctcatcaacatagctcgagtcaacgatccgccagtgcgcaactcgcaggaggtcttccagatggagatgcgcgccgcccgcatggtacatgcagcagactctctgttgaaattagtgtcggaacttaagaggacagccatcttttctgggcttgcttcattgaatgagaatgtggataggaggattgaagtgctgggtcagcaagctgagggaactgagagaatgctggagaggattgggcaggaggcagcagcaagcctcaaggagctagaggcacactactactcatctgttgtgcggtcaccatcctatgattga

SEQ ID NO: 5934 - protein, 151 aa, Sorghum bicolor
  misc_feature: Ceres ANNOT ID no. 6055329
  misc_feature (17)..(143): Pfam Id: SURF5 Pfam Desc: Surfeit locus protein 5
  misc_feature (1)..(148): NCBI GI: 115434352 NCBI Desc: os01g0132700 [oryza sativa (japonica cultivar-group)]
  misc_feature (4)..(146): NCBI GI: 8778847 NCBI Desc: t6d22.4 [arabidopsis thaliana]
  misc_feature (17)..(143): NCBI GI: 76781479 NCBI Desc: surfeit gene 5 isoform 2 [mus musculus]
  misc_feature (17)..(143): NCBI GI: 60822577 NCBI Desc: surfeit 5 [synthetic construct]
  misc_feature (17)..(143): NCBI GI: 119608462 NCBI Desc: surfeit 5, isoform cra_a [homo sapiens]
MSKAGGGPGSAPGPTAAAAAAAVQKQKSLLQKADADVSSLVDNFSSLINIARVNDPPVRNSQEVFQMEMRAARMVHAADSLLKLVSELKRTAIFSGLASLNENVDRRIEVLGQQAEGTERMLERIGQEAAASLKELEAHYYSSVVRSPSYD

SEQ ID NO: 5935 - DNA, 1626 bp, Sorghum bicolor
  misc_feature: Ceres ANNOT ID no. 6055333
  misc_feature: Encodes the peptide sequence at SEQ ID NO 5936
atgatacgctgcgctgtaacggccggcgggtgcgtcgcttcgtggagcggcgatcggaggtcgccggcggtcaacaacccctgcagcgtgcggatgccgacgggcaacggtggtgggtggtgcggcggcctgaggtcgcgggcggcggatctcgccggcctcgagatggccagcctgcgtggcggcgtcgggggcctcttccgcgcgagcccgcgctatgggcgcttgcaagccacggccgcagttgaccctgaagatattccattggagaaggttcaagttaaatcctcaggacatgttctgccatatgttggcgttgcttgtttgggggctattctgtttggttatcatcttggtgtggtcaatggcgcgcttgaatatctcgcgaaggatcttgggattgctgaaaatgctgtcttacagggatgggtggttagcacatccctggctggtgcaacactaggttcttttactgggggatctttggcagataaatttgggcggacaagaacattcatcctggatgcagtccctcttgctctaggtgcattcttgagtgcaacagctcaagatattcgcaccatgattattggtcggttgcttgctggaattggtattgggatctcatctgctcttgtgcccctctacatatctgagatctcaccaactgaaattcgtggaacacttggttctgttaatcaactttttatctgcattggaattcttgtagctttgttagctggattgcctttggcaggaaatcctgcctggtggaggacaatgtttggaattgctgtagttccatccattttgctggctgtaggaatggccttctctcctgaaagccctcgttggctattccagcaaggaaaggttatacaagcagaatcagctgtcaaaagactgtatggaaaagaaatggttaccgaaattatgtatgatctgagagctagtggccaaagttcttctgagcctgaagctggctggtttgatcttttcagcaagcgttactggaaagttgtgagtgtgggggcagcactgtttttgttccagcagcttgctggtataaacgccgttgtatattactctacatcagtgttccgcagtgcaggcattgcatctgatgttgctgctagtgctcttgttggagcagccaatgtttttggcaccatgattgcatcttctctaatggacaagcaaggaaggaaaagccttctgataacaagcttttctggaatgggtgcttcaatgctactcttagcattgtccttcacctggaaagctctggcaccttattctggtactcttgctgttgttggcactgttctgtatgtgctgtcttttgctctaggagctggtcctgttcctgccctacttcttcctgaaatatttgcctctagaataagggccaaggctgttgcattatctctaggcatgcactgggtaatcaacttctttattggcctgtacttcttgagtgtcgtcaacaagttcgggatcagcaatgtatatttgggatttgcatcagtgtgcgcccttgcagttctttacatagctgggaatgtggtcgagaccaaggggcgatcacttgaagagattgaacgggaattaagtgtagcagaatga

SEQ ID NO: 5936 - protein, 541 aa, Sorghum bicolor
  misc_feature: Ceres ANNOT ID no. 6055333
  misc_feature (103)..(537): Pfam Id: Sugar_tr Pfam Desc: Sugar (and other) transporter
  misc_feature (107)..(489): Pfam Id: MFS_1 Pfam Desc: Major Facilitator Superfamily
  misc_feature (1)..(541): NCBI GI: 8347248 NCBI Desc: hexose transporter [zea mays]
  misc_feature (12)..(540): NCBI GI: 115434360 NCBI Desc: os01g0133400 [oryza sativa (japonica cultivar-group)]
  misc_feature (27)..(540): NCBI GI: 15625046 NCBI Desc: hexose transporter pglt [olea europaea]
  misc_feature (16)..(540): NCBI GI: 8347244 NCBI Desc: hexose transporter [nicotiana tabacum]
  misc_feature (43)..(540): NCBI GI: 51574116 NCBI Desc: plastid hexose transporter [vitis vinifera]
  misc_feature: The sequence is a functional homolog of SEQ ID NO. 488 in the 11/188,298 US application
  misc_feature: The sequence is a functional homolog of SEQ ID NO. 449 in the 11/188,298 US application
  misc_feature: The sequence is a functional homolog of SEQ ID NO. 331 in the 11/188,298 US application
MIRCAVTAGGCVASWSGDRRSPAVNNPCSVRMPTGNGGGWCGGLRSRAADLAGLEMASLRGGVGGLFRASPRYGRLQATAAVDPEDIPLEKVQVKSSGHVLPYVGVACLGAILFGYHLGVVNGALEYLAKDLGIAENAVLQGWVVSTSLAGATLGSFTGGSLADKFGRTRTFILDAVPLALGAFLSATAQDIRTMIIGRLLAGIGIGISSALVPLYISEISPTEIRGTLGSVNQLFICIGILVALLAGLPLAGNPAWWRTMFGIAVVPSILLAVGMAFSPESPRWLFQQGKVIQAESAVKRLYGKEMVTEIMYDLRASGQSSSEPEAGWFDLFSKRYWKVVSVGAALFLFQQLAGINAVVYYSTSVFRSAGIASDVAASALVGAANVFGTMIASSLMDKQGRKSLLITSFSGMGASMLLLALSFTWKALAPYSGTLAVVGTVLYVLSFALGAGPVPALLLPEIFASRIRAKAVALSLGMHWVINFFIGLYFLSVVNKFGISNVYLGFASVCALAVLYIAGNVVETKGRSLEEIERELSVAE

SEQ ID NO: 5937 - DNA, 1554 bp, Sorghum bicolor
  misc_feature: Ceres ANNOT ID no. 6055335
  misc_feature: Encodes the peptide sequence at SEQ ID NO 5938
atgggctccccgtcctacaagcttgcggcggcgatcacggtcccctcgaccggcgagttcctcgtcgtccggcagccgcgcccgccatccccacccgatgaggaagaggactaccggcggttcgtcgacagcgacctctacgacctcccgtccgcgcccctcgcgccactcgcggggacactccggtcggaggtggccataggcggcgcggactctgtcgccgtgcgcctcgacctctcgcgcctcgacgtgtccgccgcccttgatcagatttttgatcaatttggcttgccggatgggatgcgtggggagtggaggctcctcaagtatgtggaggaagcagagtttggcccggatgctggcattaacacggtgtacatcatcgggtcacttgagtcgaaattggatgcaccacaagagtcatgtaagtggatgtccaaggagtgtgcattgaggttgctttcagaagcgaagccaggtaatgatcgcataggacagtatgcatatattggaattttgaattcggagctgtcatcaaacaccacaacttcccctgcattgccctcccaggaatacccacctggaataacacttgtacctatgaagagtaggacactagcaccattccgtacaactaatcttgtggtagtacgatcaaccaatggtgctggtggatctacatgttctgaattttttgcttcgggggacgctctgcttatagatcctggatgcagctctcaggttcatgcagagcttgcagatctcgtcaactcccttccaaaaaggttattagttcttgttacacatcatcatcatgatcacattgagggtctttcagtcgttcagagatgcaatcctgatgctgttcttctgacacaccaaagtacaatggatcgcatcgggaaaggaaattggcagattgactacacttcagtaactggtggtgaaaagatatgcataggtaaccaagaactgcaagttgtttttgcacctggtcatacagatggtcatatggggcttctccatgtaaataccaatacattggttgttggagatcattgtgtagggcatggaagtgcaactttggacagtagaaatggtggcaacatgaaggattactttgaaactacatacaaattcatggacttgtcaccacatgtattaattccaatgcatggaaggatcaacctatggcccaagtatatgctttgtggatacctcaggaatcgaagggctagagaagcgtccattctgcaatccattgagaatggggcccaaactctgtttgatatagtttcaaagacttacagtgatgtcgacaggaagttttggattcctgcttctttcaatgtccgccttcatgttgatcatctgaactccctacataaattgcccaaggatttctcattggagaactttaaggaaagctgtggagtgcatttcatattccgttgggcggtggcatatgtgcattccaggagctccccagctatccttgcggcaagtgccattgctggtggtcttgcaattgcttgtgctctcagaaggaactaa

SEQ ID NO: 5938 - protein, 517 aa, Sorghum bicolor
  misc_feature: Ceres ANNOT ID no. 6055335
  misc_feature (225)..(392): Pfam Id: Lactamase_B Pfam Desc: Metallo-beta-lactamase superfamily
  misc_feature (184)..(493): NCBI GI: 23308309 NCBI Desc: at1g25370/f4f7_22 [arabidopsis thaliana]
  misc_feature (185)..(438): NCBI GI: 108762170 NCBI Desc: metallo-beta-lactamase family protein [myxococcus xanthus dk 1622]
  misc_feature (194)..(439): NCBI GI: 110834197 NCBI Desc: metallo-beta-lactamase family protein [alcanivorax borkumensis sk2]
  misc_feature (188)..(458): NCBI GI: 114706952 NCBI Desc: metallo-beta-lactamase family protein [fulvimarina pelagi htcc2506]
  misc_feature (224)..(467): NCBI GI: 40062617 NCBI Desc: metallo-beta-lactamase family protein [uncultured bacterium 311]
MGSPSYKLAAAITVPSTGEFLVVRQPRPPSPPDEEEDYRRFVDSDLYDLPSAPLAPLAGTLRSEVAIGGADSVAVRLDLSRLDVSAALDQIFDQFGLPDGMRGEWRLLKYVEEAEFGPDAGINTVYIIGSLESKLDAPQESCKWMSKECALRLLSEAKPGNDRIGQYAYIGILNSELSSNTTTSPALPSQEYPPGITLVPMKSRTLAPFRTTNLVVVRSTNGAGGSTCSEFFASGDALLIDPGCSSQVHAELADLVNSLPKRLLVLVTHHHHDHIEGLSVVQRCNPDAVLLTHQSTMDRIGKGNWQIDYTSVTGGEKICIGNQELQVVFAPGHTDGHMGLLHVNTNTLVVGDHCVGHGSATLDSRNGGNMKDYFETTYKFMDLSPHVLIPMHGRINLWPKYMLCGYLRNRRAREASILQSIENGAQTLFDIVSKTYSDVDRKFWIPASFNVRLHVDHLNSLHKLPKDFSLENFKESCGVHFIFRWAVAYVHSRSSPAILAASAIAGGLAIACALRRN

SEQ ID NO: 5939 - DNA, 2343 bp, Sorghum bicolor
  misc_feature: Ceres ANNOT ID no. 6055346
  misc_feature: Encodes the peptide sequence at SEQ ID NO 5940
atgggcaagtccggcgcaaaaaagaagaagccggccgccgccgccgccgcggcggcgaaaccgccgcccgcctcggctgagcagaaggcgacgccgccgccttcgtcctctttacccgcggcgaacggcggcgcgtcgcctcaccaggcggtggacgccggcgtcctcttgcgccgcgcgcacgagctcaaggaggaaggcaaccgcctgttccagtcgcgcgactacgccggggcgctgcgccagtacgagctggcgctccgcctcgccccgcgcggccacccggaccgcgccgtcttccacagcaaccgcgccgcctgcctcctccagctccgccccgtggaccacgaggccgtcgcccaggagtgctccctcgcgctccaggccgagccgcgcttcccgcgcgctctcctccgccgcgcccgcgcgctcgaggcgctcggtcgccacgagctcgccctcgccgacgcgctcgcgctccttgcgctcgaccctgaccaccgcgacgccatcgacctctcctaccgactacgctcacgtgtcaacgcgtcctcggctgcctccgcttcctcggcacccgagcccaccagccggccttcccccgctgcccttggtgcctctgctgttgtcgccggacttggccattccctccccgctcgcccattccctaagaaacaaccaccaccacccccacctgctactttgcagccaaatctcgcagtgatgtcaaaatctaacccatcaccgttgcccaagctggtgccattctccaattccccgccatcttcagccaagcctttggctgcagatagctccgagaaggccatgacgctgccagtggcctctttgttaccagcaacagtggaaccgcttataaataaaaaggttgtgacgagatggaggcctctcaagctggtgtacgaccacgacattaggcttgggcaggttccagagaaatgcagcttccgtacacttcgggagtttgtagccaagaggttcccatcatccaaggcagtgttgattaagtataaggatgctgatggtgatctagttaccatcacatcgacagaagagcttcggttagctgaatcattcattgataaagttggccacgaggttgtagaaaatgggagggagggtgacaataagctcccggtgttgaggctgcatcttgttgaagtgagcccagaacaggaaccaactttgccatcagaagaggagaagttggaggaggatgaggagttgttgatcaatggtgaatatagcactttgaatacttctgcagtggtaaccaacgctgaggtgatgaagcaagatgtcgagaatggagttgctgagcaaagtatggagacaggaaagaaggattgtggccatgctgagtgcaaggaagctgagattgatgattggttgcttcaatttgcagaattgttccggaaccaggttgggattgatgcagatgcgcatctggacctgcatgagctgggcatggagctgtgctctgaggctctcgaggaaactgtgacaagcgaggaggctcaggccctttttgagatggctgcttctaaatttcaggaggttgctgccttggccttattcaattggggaaatgtgcacatgtgtgaagcaaggaagcgcatccctctcgatgaatctgctccaaaggaagtcatggctgctcagctccgcacagcttatcattgggtgaaggagaggtacgctcttgcagggcacaagtatgaggaggcccttaaaatcaagccagacttctatgaagggcttcttgctttaggccagcaacacttcgagactgcaaagcttcattggtcatttgcactggcagataaggctgacctatctacctgggattctttggagacattcaagctttttgatagcgctgagcataacatgagggctgcaacagagatgtgggagaaggtggaagaacagagaatggcagagttaaaagaaccaggtgcaggcgagaaggatgaggtactgaggaaaaggcatgcaggtggtcaaccggagttgacaccagaagaggcagctgagcaggcagcagtaatgaggcaacagattcacctcttctggggtaatatgcttttcgagcgttctcaagtggagtttaagctcagtgtcggtgactggaagacaaatcttgatgcatctgttgaaaggtttaagctggctggagcttcagaatcagatatttcgacagtgttgaaaaatcacttttctaatgcagcctctgagtgtgaagagaagaaagtcatgacttcaggcacagaaatttcacaaacaaatgacaatgttgaagataagtgtgtggttgaaacctaa

SEQ ID NO: 5940 - protein, 780 aa, Sorghum bicolor
  misc_feature: Ceres ANNOT ID no. 6055346
  misc_feature (300)..(394): Pfam Id: PB1 Pfam Desc: PB1 domain
  misc_feature (134)..(167): Pfam Id: TPR_2 Pfam Desc: Tetratricopeptide repeat
  misc_feature (134)..(167): Pfam Id: TPR_1 Pfam Desc: Tetratricopeptide repeat
  misc_feature (458)..(752): NCBI GI: 115475764 NCBI Desc: os08g0296900 [oryza sativa (japonica cultivar-group)]
  misc_feature (382)..(752): NCBI GI: 115480607 NCBI Desc: os09g0556200 [oryza sativa (japonica cultivar-group)]
  misc_feature (383)..(654): NCBI GI: 87240788 NCBI Desc: octicosapeptide/phox/bem1p [medicago truncatula]
  misc_feature (345)..(552): NCBI GI: 50261877 NCBI Desc: at1g62390 [arabidopsis lyrata subsp. petraea]
  misc_feature (339)..(746): NCBI GI: 15241328 NCBI Desc: octicosapeptide/phox/bem1p (pb1) domain-containing protein / tetratricopeptide repeat (tpr)-containing protein [arabidopsis thaliana]
MGKSGAKKKKPAAAAAAAAKPPPASAEQKATPPPSSSLPAANGGASPHQAVDAGVLLRRAHELKEEGNRLFQSRDYAGALRQYELALRLAPRGHPDRAVFHSNRAACLLQLRPVDHEAVAQECSLALQAEPRFPRALLRRARALEALGRHELALADALALLALDPDHRDAIDLSYRLRSRVNASSAASASSAPEPTSRPSPAALGASAVVAGLGHSLPARPFPKKQPPPPPPATLQPNLAVMSKSNPSPLPKLVPFSNSPPSSAKPLAADSSEKAMTLPVASLLPATVEPLINKKVVTRWRPLKLVYDHDIRLGQVPEKCSFRTLREFVAKRFPSSKAVLIKYKDADGDLVTITSTEELRLAESFIDKVGHEVVENGREGDNKLPVLRLHLVEVSPEQEPTLPSEEEKLEEDEELLINGEYSTLNTSAVVTNAEVMKQDVENGVAEQSMETGKKDCGHAECKEAEIDDWLLQFAELFRNQVGIDADAHLDLHELGMELCSEALEETVTSEEAQALFEMAASKFQEVAALALFNWGNVHMCEARKRIPLDESAPKEVMAAQLRTAYHWVKERYALAGHKYEEALKIKPDFYEGLLALGQQHFETAKLHWSFALADKADLSTWDSLETFKLFDSAEHNMRAATEMWEKVEEQRMAELKEPGAGEKDEVLRKRHAGGQPELTPEEAAEQAAVMRQQIHLFWGNMLFERSQVEFKLSVGDWKTNLDASVERFKLAGASESDISTVLKNHFSNAASECEEKKVMTSGTEISQTNDNVEDKCVVET

SEQ ID NO: 5941 - DNA, 831 bp, Sorghum bicolor
  misc_feature: Ceres ANNOT ID no. 6055349
  misc_feature: Encodes the peptide sequence at SEQ ID NO 5942
atggcggcggcggcgcacggcggcgactacctgcggcggttcgtcgcggagacggagtggtacaacgcggtcgtcctcagcgccgtggcgccaggcgactggtggcgcggcctgccgcacccggtgcagtcgtggatgcgcaactgcgtcggcggctacctcctctacttcatctccggtttcctctggtgcttcgtcatctactactggaagcgccacgcctacatccccaaagatgccattcccacaaatgaagctatgaagaagcaaatagttgtagcatcgaaggctatgcctttttactgtgctcttccaactttatctgaatatatgattgagagcggatggacccagtgttactttaatatcagtgaagttggtttttctatgtacctctgttatatggctatgtatctcatttttgtggagtttggaatttactggatgcacagagagttgcatgacataaagccattatacaaatatctgcatgcaacccatcatatttacaacaaggaaaatactttgtctccatttgctggacttgcatttcatccactggatggtattctgcaagcaataccacatgtgtttgcgctcttcctctttccaactcacttcaggacacatattgctctcttgttcttagaggccgtgtggacaacaaacatccacgactgcattcatggcaagatatggccagtcatgggcgctggatatcacaccattcaccatacaacttaccgccacaactatggccactacaccatctggatggactggatgtttagtaccctccgtgagccagaagatatcctcaagaaggattga

SEQ ID NO: 5942 - protein, 276 aa, Sorghum bicolor
  misc_feature: Ceres ANNOT ID no. 6055349
  misc_feature (135)..(246): Pfam Id: FA_hydroxylase Pfam Desc: Fatty acid hydroxylase
  misc_feature (9)..(275): NCBI GI: 4426627 NCBI Desc: sterol-c5(6)-desaturase homolog [nicotiana tabacum]
  misc_feature (9)..(275): NCBI GI: 4140398 NCBI Desc: sterol-c5(6)-desaturase [nicotiana tabacum]
  misc_feature (9)..(269): NCBI GI: 71834080 NCBI Desc: delta7 sterol c-5 desaturase [zinnia elegans]
  misc_feature (10)..(276): NCBI GI: 5031219 NCBI Desc: delta7 sterol c-5 desaturase [arabidopsis thaliana]
  misc_feature (10)..(276): NCBI GI: 105829795 NCBI Desc: at3g02580 [arabidopsis thaliana]
  misc_feature (9)..(275): SWISSPROT Homolog: EC 1.14.21.6 Delta(7)-sterol-C5(6)-desaturase
MAAAAHGGDYLRRFVAETEWYNAVVLSAVAPGDWWRGLPHPVQSWMRNCVGGYLLYFISGFLWCFVIYYWKRHAYIPKDAIPTNEAMKKQIVVASKAMPFYCALPTLSEYMIESGWTQCYFNISEVGFSMYLCYMAMYLIFVEFGIYWMHRELHDIKPLYKYLHATHHIYNKENTLSPFAGLAFHPLDGILQAIPHVFALFLFPTHFRTHIALLFLEAVWTTNIHDCIHGKIWPVMGAGYHTIHHTTYRHNYGHYTIWMDWMFSTLREPEDILKKD

SEQ ID NO: 5943 - DNA, 453 bp, Sorghum bicolor
  misc_feature: Ceres ANNOT ID no. 6055361
  misc_feature: Encodes the peptide sequence at SEQ ID NO 5944
atgtcgctggtgcgcagcagcaacgtgttcgacccgctgtcgctggacttctggacgtccgccgacccgctcggcgtcgtccggccgctggcggagcagtgccccgtgctcaccaacgtgcgcgtggactggaaggagacccccgaggcgcacgtgttcagggccgacctccccggcgtcaacaaggaggccgccagggtggaggtggaggacggcaacgtgctcgtcatcagcggcgagcgcaacagggaggagcttgccggcaagggcggcgagggcgcgtggcgcctcgtcgagcgcagcagcggcaagtttcagaggaggttccgcctgccgcgcggcgccaagcttgaccaggtgcgcgcgtccatggacaacggcgtgctcacggtcaccgtgcccaaggaggacgtcaagaagccgcaggtcagggccgtcgagatctctggttga

SEQ ID NO: 5944 - protein, 150 aa, Sorghum bicolor
  misc_feature: Ceres ANNOT ID no. 6055361
  misc_feature (43)..(149): Pfam Id: HSP20 Pfam Desc: Hsp20/alpha crystallin family
  misc_feature (1)..(150): NCBI GI: 445140 NCBI Desc: heat shock protein 16.9b
  misc_feature (1)..(150): NCBI GI: 113531486 NCBI Desc: os01g0136200 [oryza sativa (japonica cultivar-group)]
  misc_feature (1)..(150): NCBI GI: 115434394 NCBI Desc: os01g0136200 [oryza sativa (japonica cultivar-group)]
  misc_feature (1)..(150): NCBI GI: 25044839 NCBI Desc: class-1 lmw heat shock protein [ananas comosus]
  misc_feature (1)..(150): NCBI GI: 75306027 NCBI Desc: 16.9 kda class i heat shock protein 3
  misc_feature: Useful for making plants with modulated heat sensitivity
  misc_feature: Functional homolog of the protein sequence given in SEQ ID NO 13940
  misc_feature: The sequence is a functional homolog of SEQ ID NO. 374 in the 11/188,298 US application
MSLVRSSNVFDPLSLDFWTSADPLGVVRPLAEQCPVLTNVRVDWKETPEAHVFRADLPGVNKEAARVEVEDGNVLVISGERNREELAGKGGEGAWRLVERSSGKFQRRFRLPRGAKLDQVRASMDNGVLTVTVPKEDVKKPQVRAVEISG

SEQ ID NO: 5945 - DNA, 498 bp, Sorghum bicolor
  misc_feature: Ceres ANNOT ID no. 6055365
  misc_feature: Encodes the peptide sequence at SEQ ID NO 5946
atgtctctggtaaggctgttggacacgctggctctggactcgtgggtgcggaacccgttcagcatcttcggcacggcggtggccgccgacgcgtggctggccagcgacacgtcggcgttcgccaacacgtacatcgagagccgggacacggcgggggcctacgtgttcagcgccgcgctgccgcccggcgtgaggaaggaggaggtcacggtggaggtggacgagggcaacgtgctcgtcatcaccggccagcgcagcgtgtccagggaggagcgcgtcggcgacaggtggcaccacgtcgagcgctgctgcgccagcttcctcggcaggttccacctccccgaagacgccgccgtcgacggcgtcagggccgccatggacgccggcatgctcaccgtcaccgtccccaaggtcggtgccgctgctgccgctatcgccgagaagcccaacgaggtgccggcggccgtcgaggcggccgacggcggccctgcctgctga

SEQ ID NO: 5946 - protein, 165 aa, Sorghum bicolor
  misc_feature: Ceres ANNOT ID no. 6055365
  misc_feature (46)..(153): Pfam Id: HSP20 Pfam Desc: Hsp20/alpha crystallin family
  misc_feature (1)..(137): NCBI GI: 445140 NCBI Desc: heat shock protein 16.9b
  misc_feature (1)..(137): NCBI GI: 113531486 NCBI Desc: os01g0136200 [oryza sativa (japonica cultivar-group)]
  misc_feature (1)..(137): NCBI GI: 115434394 NCBI Desc: os01g0136200 [oryza sativa (japonica cultivar-group)]
  misc_feature (1)..(137): NCBI GI: 20265 NCBI Desc: 16.9 kd low molecular weight heat shock protein [oryza sativa]
  misc_feature (1)..(137): NCBI GI: 113531485 NCBI Desc: os01g0136100 [oryza sativa (japonica cultivar-group)]
  misc_feature: The sequence is a functional homolog of SEQ ID NO. 374 in the 11/188,298 US application
MSLVRLLDTLALDSWVRNPFSIFGTAVAADAWLASDTSAFANTYIESRDTAGAYVFSAALPPGVRKEEVTVEVDEGNVLVITGQRSVSREERVGDRWHHVERCCASFLGRFHLPEDAAVDGVRAAMDAGMLTVTVPKVGAAAAAIAEKPNEVPAAVEAADGGPAC

SEQ ID NO: 5947 - DNA, 1992 bp, Sorghum bicolor
  misc_feature: Ceres ANNOT ID no. 6055432
  misc_feature: Encodes the peptide sequence at SEQ ID NO 5948
  misc_feature: Up-regulated in shoot tissues in response to salicylic acid treatment
atggagccgctgccgtcggcgacggccgccggcgtggggggccccggccctgggcccgggtacccggagtccacggagtcttctccgcgcagccggggtggggattcgtgggacgagccgttcccgtcctccgcggcggcggcggccgcggctgccggcggcggtgggggccggctccgcctgatgtgcagcttcgggggccggatcgtcccgcgccccaccgacaagtcgctctgctacctcggcggggagacccggatcgtggccgtcgaccggcacgcgtcgctcgccgacgtccacgcgcgcctctcgcggtcgctgcttggcggccgccccttcacgctcaagtatcagctgcccaacgaggacctcgactccctcatctccgtctctacggacgaggacctcgacaacctcgtcgacgagtacgaccgcatcgccgcgacctcctccggtgggggatcctcgcgcacctcccggatccgcctcttcctcttccccgccaagcccgagtcctcgtcctcgctcggctccctcctcgacgactcttccaagtcggagaactggttcgtcgacgccctcaacagcgccatctccggctccctcgacggcatcccgagggggatctccaccgattcagcttccgtcaactgtcttctcggcctcgaggacgactcctccgtgcactcccgcagcggcgtgaccaactcggctcccacggaggaccagcgcgccagccagcccaagctgccggtgggcgccaccgccgccgtcgctgccgccgccggtgccgggaggcacctgcacgacgtccagtctgtgccagactcgccgatgctggataagaactcctcgttcgggtcaacctcctcggcaccatcgctatcgaatcttccgcctatacgcgtgcggccggaggaccgcccgtcggacgcccgcatcatgcaacctgccgccgtggaggatcacttcgcgcagatggggatctccgagcagcagctgccgccatacatacaacctcaacagcaggtgccgatccctgccatggccggcatgtcgccctctgaggcgtccagcagagtgttctctgacgatgataagtccgatcacggtggcggaggtcggaaaccacaacctatgaagcaggaggtcccgccggctgttgatcccagcaatagagccgtctactataacgatagatctcctcccgccgacttgaaacgagacatgcctgtgggaacggaagctgccagctaccgcctccctggatcagctccggacgctgctgcagctgccgcggcaacacaggtcccacctggatatgtccttacccagatgcatgtgcctcagccaccgcagcaacatccaccaccacagcagcaacagcaaccacaacaaccagctcctcagcagattgtttctgctggaaatcagcatttcatccacaaccctgccactggcaccttcattccaatccagtcctattaccaccatcctgttcctcagcaggcaccccagactgtgccgaggccgcaacaggcacctacattcgacccaaatacggggatgtattaccttcctatgcagcagaatgcacatcagccatatagcatgcctcctggtgcacaagtcactttgccacctcccacacttgttgacacaacgccaaagccgaccgtgccaattcctcagatggctgtaaggcctgaattacaacaacctggtgtttatcgaacaacagctgccgctacgcctgctccagcgcctaatgcagcacctggatatgctgggatggcataccaccatgtcattcaatcgcaccaccacccctcaccacagcctgttgcaaacatgggtggcaactttggatatgagtatgctgatcctacgcgcccacaagtctactactcacaagcagctgcacctccaacattgccacctcagtatcagcccatggtctctcctgatgccggacaggcagaaaaacattaa

SEQ ID NO: 5948 - protein, 663 aa, Sorghum bicolor
  misc_feature: Ceres ANNOT ID no. 6055432
  misc_feature (73)..(168): Pfam Id: PB1 Pfam Desc: PB1 domain
  misc_feature (1)..(661): NCBI GI: 115434436 NCBI Desc: os01g0139200 [oryza sativa (japonica cultivar-group)]
  misc_feature (58)..(342): NCBI GI: 87240487 NCBI Desc: octicosapeptide/phox/bem1p [medicago truncatula]
  misc_feature (58)..(306): NCBI GI: 15809940 NCBI Desc: at4g05150/c17l7_70 [arabidopsis thaliana]
  misc_feature (23)..(196): NCBI GI: 47497205 NCBI Desc: cticosapeptide/phox/bem1p (pb1) domain-containing protein-like [oryza sativa (japonica cultivar-group)]
  misc_feature (23)..(196): NCBI GI: 115449415 NCBI Desc: os02g0809100 [oryza sativa (japonica cultivar-group)]
  misc_feature: Up-regulated in shoot tissues in response to salicylic acid treatment
  misc_feature: The sequence is a functional homolog of SEQ ID NO. 426 in the 11/188,298 US application
MEPLPSATAAGVGGPGPGPGYPESTESSPRSRGGDSWDEPFPSSAAAAAAAAGGGGGRLRLMCSFGGRIVPRPTDKSLCYLGGETRIVAVDRHASLADVHARLSRSLLGGRPFTLKYQLPNEDLDSLISVSTDEDLDNLVDEYDRIAATSSGGGSSRTSRIRLFLFPAKPESSSSLGSLLDDSSKSENWFVDALNSAISGSLDGIPRGISTDSASVNCLLGLEDDSSVHSRSGVTNSAPTEDQRASQPKLPVGATAAVAAAAGAGRHLHDVQSVPDSPMLDKNSSFGSTSSAPSLSNLPPIRVRPEDRPSDARIMQPAAVEDHFAQMGISEQQLPPYIQPQQQVPIPAMAGMSPSEASSRVFSDDDKSDHGGGGRKPQPMKQEVPPAVDPSNRAVYYNDRSPPADLKRDMPVGTEAASYRLPGSAPDAAAAAAATQVPPGYVLTQMHVPQPPQQHPPPQQQQQPQQPAPQQIVSAGNQHFIHNPATGTFIPIQSYYHHPVPQQAPQTVPRPQQAPTFDPNTGMYYLPMQQNAHQPYSMPPGAQVTLPPPTLVDTTPKPTVPIPQMAVRPELQQPGVYRTTAAATPAPAPNAAPGYAGMAYHHVIQSHHHPSPQPVANMGGNFGYEYADPTRPQVYYSQAAAPPTLPPQYQPMVSPDAGQAEKH

SEQ ID NO: 5949 - DNA, 924 bp, Sorghum bicolor
  misc_feature: Ceres ANNOT ID no. 6055433
  misc_feature: Encodes the peptide sequence at SEQ ID NO 5950
atgcgggaggcacagttgggctcccacacgattcagacccacggagtgagactggccagaaagcacacgcacgactgggttgttctgattcttctggctgcgctagtggttgccctgcatttcgctccccccttcagtcgattcgtcggaaaggatatgatgactgatattaggtacccggtgaaaccaagcacggtaccagcgtgggctgtccctatgatctctatactctgtccctggatcgtcttcatatcaatatatgttgccaggagagacgtttatgatctgcataacgcggcactaggtgtccttttcgctgtgctgataactgcagtttttactgacgtgataaagactgcagtagggagaccgaggccggacttcttttggcgatgctttcctgatggaaatcagttatacgatcaggtgactggtgatgtgatttgccatggtgagaaaagcttcttgaaggatgggcgcaagagctttcctagtggccacacttcgtggtcttttgctggtcttggatttttgtcactgtacttgtcaggcaaaattaaggcctttgatcgccaaggtcatgtggccaaactttgcatagtgatccttccgcttcttcttgcatcacttgtcggggtttcaagagtagatgattatcgacaccactgggaggatgtgtttgttggcggccttattggatttatcatggcagtgctgtgttacttgcatttctttcctcctccataccatgatcaaggctggagaccgtatgcatacttccacatgctggaagaacttgaagttgaagcggcaaattcaaacaacgcacaaaaccaacagtccactggtggtcatcacattgccatgtctgagcagcagcataacaggacatcaagaaacgatttggaatctggaagcgtgtaa

SEQ ID NO: 5950 - protein, 307 aa, Sorghum bicolor
  misc_feature: Ceres ANNOT ID no. 6055433
  misc_feature (99)..(249): Pfam Id: PAP2 Pfam Desc: PAP2 superfamily
  misc_feature (2)..(307): NCBI GI: 115434438 NCBI Desc: os01g0139600 [oryza sativa (japonica cultivar-group)]
  misc_feature (53)..(307): NCBI GI: 54290302 NCBI Desc: phosphatidic acid phosphata -like [oryza sativa (japonica cultivar-group)]
  misc_feature (2)..(305): NCBI GI: 9621903 NCBI Desc: phosphatidic acid phosphatase alpha [vigna unguiculata]
  misc_feature (1)..(279): NCBI GI: 145331736 NCBI Desc: lpp3 (lipid phosphate phosphatase 3) [arabidopsis thaliana]
  misc_feature (1)..(306): NCBI GI: 23505931 NCBI Desc: at2g01180/f10a8.6 [arabidopsis thaliana]
MREAQLGSHTIQTHGVRLARKHTHDWVVLILLAALVVALHFAPPFSRFVGKDMMTDIRYPVKPSTVPAWAVPMISILCPWIVFISIYVARRDVYDLHNAALGVLFAVLITAVFTDVIKTAVGRPRPDFFWRCFPDGNQLYDQVTGDVICHGEKSFLKDGRKSFPSGHTSWSFAGLGFLSLYLSGKIKAFDRQGHVAKLCIVILPLLLASLVGVSRVDDYRHHWEDVFVGGLIGFIMAVLCYLHFFPPPYHDQGWRPYAYFHMLEELEVEAANSNNAQNQQSTGGHHIAMSEQQHNRTSRNDLESGSV

SEQ ID NO: 5951 - DNA, 474 bp, Sorghum bicolor
  misc_feature: Ceres ANNOT ID no. 6055439
  misc_feature: Encodes the peptide sequence at SEQ ID NO 5952
atgaagcgcaacccccgcgtcacgagctcccgccggaagtgccgcaaggcgcacttcacggccccgtcctccgtccgccgcgtgctcatgtccgcggcgctgtcgacggagctccgccacaagtacaacgtgcgctccatcccgatccgcaaggacgacgaggtgcaggtcgtgcgcggcacctacaagggccgtgagggcaaggttgtgcaggtgtaccgccgccgctgggtcatccacgtcgagaggatcacccgcgagaaggtgaacggctccaccgtcaacgtgggcatccacccctcgaaggtgatcgtcaccaagctgaagctcgacaaggaccgcaaggcgctcctcgaccgcaaggcccggggccgcaacgccgacaaggctaagggcaagttcaccgccgacgacgtcgccgccgctgctggtggtgccgccgccaccggtgcctctctccaggagatcgactag

SEQ ID NO: 5952 - protein, 157 aa, Sorghum bicolor
  misc_feature: Ceres ANNOT ID no. 6055439
  misc_feature (51)..(82): Pfam Id: KOW Pfam Desc: KOW motif
  misc_feature (1)..(119): NCBI GI: 3747050 NCBI Desc: ribosomal protein l26 [zea mays]
  misc_feature (1)..(139): NCBI GI: 92866965 NCBI Desc: ribosomal protein l24/l26 [medicago truncatula]
  misc_feature (1)..(139): NCBI GI: 21554514 NCBI Desc: 60s ribosomal protein l26 [arabidopsis thaliana]
  misc_feature (1)..(139): NCBI GI: 3914740 NCBI Desc: 60s ribosomal protein l26
  misc_feature (1)..(139): NCBI GI: 2160300 NCBI Desc: ribosomal protein [brassica rapa]
  misc_feature: The plant is abnormally small.
  misc_feature: Useful for making plants with modulated biomass
  misc_feature: GREAT-hit functional homolog of the protein sequence given in SEQ ID NO 13031
  misc_feature: Useful for making plants with modulated biomass
  misc_feature: Functional homolog of the protein sequence given in SEQ ID NO 13031
MKRNPRVTSSRRKCRKAHFTAPSSVRRVLMSAALSTELRHKYNVRSIPIRKDDEVQVVRGTYKGREGKVVQVYRRRWVIHVERITREKVNGSTVNVGIHPSKVIVTKLKLDKDRKALLDRKARGRNADKAKGKFTADDVAAAAGGAAATGASLQEID

SEQ ID NO: 5953 - DNA, 1167 bp, Sorghum bicolor
  misc_feature: Ceres ANNOT ID no. 6055449
  misc_feature: Encodes the peptide sequence at SEQ ID NO 5954
atgggtatcgagagcatgagccccacggcggcgccggcggaggattcctcctcctcctcctcgcgcttctccgccgcgtccacagccaccacggagtccggcgccgcgcagccacgggctgcttctgcagcaccgggcggcggcgcggtcgttgtcggccgggacgcctctctggcggacgagcaggccgtgacgtcgcagccgttggcggcgtcgacggcagcggccgtggcgcagggatcttcgcggttcaagggggtcgtgccgcagcccaacgggcggtggggcgcgcagatctacgagcgccacgcgcgggtgtggctcggcacgttcgccgacgaggaagccgcggcgcgcgcctacgacgtggccgcgctccgctaccgcggccgcgaggccgccaccaacttcccgggcgccggggcgtcggcgcccgagctcaccttcctggcggcgcactcaaaggcggagatcgtcgacatgctacggaagcacacctacgccgacgagctccgccagggcctgcggcgagggcgcggcatgggcgcccgcgcgcagcccacgccggcatgggcgcgctcgctgctgttcgagaaggcggtcacgcccagcgacgtcggcaagctcaaccgcctcgtggtccccaagcagcacgccgagaagcacttcccgctgaagcgcgcgccggaggcatcggcggcggcggccaccacaggcaagggcgtgctcctcaacttcgaggacggcgagggcaaggtgtggcggttccggtactcgtactggaacagcagccagagctacgtgctcaccaagggctggagccgcttcgtcagggagaagggcctccgagccggggacaccatcgtcttctcccactccacgtacagctcggagaagcagctcttcatcgactgcaagaagaccaagacgacgacggtcgccaccaccgacggggcgccggtgccggcaccagcggagaagaaaccgagtgaagcccgtgtagtcaggctgttcggcgtcgacatcgccggagacgggtgccagaagcgcgcacggccggtggagattgcgttcgagcatgggccgcagcaggagttgttgaagaagaagcaatgcgtgggcgtggctcatcaccgctctcctgccctaggtgccttcttgttatag

SEQ ID NO: 5954 - protein, 388 aa, Sorghum bicolor
  misc_feature: Ceres ANNOT ID no. 6055449
  misc_feature (196)..(308): Pfam Id: B3 Pfam Desc: B3 DNA binding domain
  misc_feature (82)..(131): Pfam Id: AP2 Pfam Desc: AP2 domain
  misc_feature (146)..(342): NCBI GI: 58982624 NCBI Desc: rav transcription factor [capsicum annuum]
  misc_feature (81)..(359): NCBI GI: 72140114 NCBI Desc: ap2 domain-containing protein [glycine max]
  misc_feature (81)..(342): NCBI GI: 2281641 NCBI Desc: ap2 domain containing protein rap2.8 [arabidopsis thaliana]
  misc_feature (27)..(343): NCBI GI: 21593532 NCBI Desc: ap2 domain transcription factor [arabidopsis thaliana]
  misc_feature (3)..(342): NCBI GI: 18565433 NCBI Desc: dna-binding protein rav2-like [oryza sativa (japonica cultivar-group)]
  misc_feature: The sequence is a functional homolog of SEQ ID NO 10 in the 10/838,616US patent application
  misc_feature: The sequence is a functional homolog of SEQ ID NO 1176 in the 10/374,780US patent application
  misc_feature: The sequence is a functional homolog of SEQ ID NO 1177 in the 10/374,780US patent application
  misc_feature: The sequence is a functional homolog of SEQ ID NO 1178 in the 10/374,780US patent application
  misc_feature: The sequence is a functional homolog of SEQ ID NO 1179 in the 10/374,780US patent application
  misc_feature: The sequence is a functional homolog of SEQ ID NO 1180 in the 10/374,780US patent application
  misc_feature: The sequence is a functional homolog of SEQ ID NO 1181 in the 10/374,780US patent application
  misc_feature: The sequence is a functional homolog of SEQ ID NO 1183 in the 10/374,780US patent application
  misc_feature: The sequence is a functional homolog of SEQ ID NO 1184 in the 10/374,780US patent application
  misc_feature: The sequence is a functional homolog of SEQ ID NO 1185 in the 10/374,780US patent application
  misc_feature: The sequence is a functional homolog of SEQ ID NO 1186 in the 10/374,780US patent application
  misc_feature: The sequence is a functional homolog of SEQ ID NO 1372 in the 10/412,699US patent application
  misc_feature: The sequence is a functional homolog of SEQ ID NO 1373 in the 10/412,699US patent application
  misc_feature: The sequence is a functional homolog of SEQ ID NO 1374 in the 10/412,699US patent application
  misc_feature: The sequence is a functional homolog of SEQ ID NO 16 in the 10/838,616US patent application
  misc_feature: The sequence is a functional homolog of SEQ ID NO 1781 in the 11/479,226US patent application
  misc_feature: The sequence is a functional homolog of SEQ ID NO 20 in the 10/838,616US patent application
  misc_feature: The sequence is a functional homolog of SEQ ID NO 22 in the 10/838,616US patent application
  misc_feature: The sequence is a functional homolog of SEQ ID NO 24 in the 10/838,616US patent application
  misc_feature: The sequence is a functional homolog of SEQ ID NO 270 in the 10/374,780US patent application
  misc_feature: The sequence is a functional homolog of SEQ ID NO 2894 in the 10/374,780US patent application
  misc_feature: The sequence is a functional homolog of SEQ ID NO 30 in the 10/838,616US patent application
  misc_feature: The sequence is a functional homolog of SEQ ID NO 32 in the 10/838,616US patent application
  misc_feature: The sequence is a functional homolog of SEQ ID NO 34 in the 10/838,616US patent application
  misc_feature: The sequence is a functional homolog of SEQ ID NO 36 in the 10/838,616US patent application
  misc_feature: The sequence is a functional homolog of SEQ ID NO 38 in the 10/838,616US patent application
  misc_feature: The sequence is a functional homolog of SEQ ID NO 4 in the 10/225,066US patent application
  misc_feature: The sequence is a functional homolog of SEQ ID NO 40 in the 10/838,616US patent application
  misc_feature: The sequence is a functional homolog of SEQ ID NO 42 in the 10/838,616US patent application
  misc_feature: The sequence is a functional homolog of SEQ ID NO 44 in the 10/838,616US patent application
  misc_feature: The sequence is a functional homolog of SEQ ID NO 46 in the 10/838,616US patent application
  misc_feature: The sequence is a functional homolog of SEQ ID NO 490 in the 10/225,066US patent application
  misc_feature: The sequence is a functional homolog of SEQ ID NO 496 in the 10/666,642US patent application
  misc_feature: The sequence is a functional homolog of SEQ ID NO 50 in the 10/838,616US patent application
  misc_feature: The sequence is a functional homolog of SEQ ID NO 52 in the 10/838,616US patent application
  misc_feature: The sequence is a functional homolog of SEQ ID NO 53 in the 10/838,616US patent application
  misc_feature: The sequence is a functional homolog of SEQ ID NO 732 in the 11/435,388US patent application
  misc_feature: The sequence is a functional homolog of SEQ ID NO 734 in the 11/435,388US patent application
  misc_feature: The sequence is a functional homolog of SEQ ID NO 736 in the 11/435,388US patent application
  misc_feature: The sequence is a functional homolog of SEQ ID NO 738 in the 11/435,388US patent application
  misc_feature: The sequence is a functional homolog of SEQ ID NO 740 in the 11/435,388US patent application
  misc_feature: The sequence is a functional homolog of SEQ ID NO 742 in the 11/435,388US patent application
  misc_feature: The sequence is a functional homolog of SEQ ID NO 756 in the 11/435,388US patent application
  misc_feature: The sequence is a functional homolog of SEQ ID NO 758 in the 11/435,388US patent application
  misc_feature: Useful for making plants with altered Lignin content
  misc_feature: Useful for making plants with modulated growth and phenotype characteristics
  misc_feature: Functional homolog of the protein sequence given in SEQ ID NO 12979
  misc_feature: The sequence is a functional homolog of SEQ ID NO 1372 in the 20040045049 US patent application
  misc_feature: The sequence is a functional homolog of SEQ ID NO 1373 in the 20040045049 US patent application
  misc_feature: The sequence is a functional homolog of SEQ ID NO 1374 in the 20040045049 US patent application
  misc_feature: The sequence is a functional homolog of SEQ ID NO 4 in the 20050160493 US patent application
  misc_feature: The sequence is a functional homolog of SEQ ID NO 490 in the 20050160493 US patent application
  misc_feature: The sequence is a functional homolog of SEQ ID NO 16 in the 20060008874 US patent application
  misc_feature: The sequence is a functional homolog of SEQ ID NO 20 in the 20060008874 US patent application
  misc_feature: The sequence is a functional homolog of SEQ ID NO 22 in the 20060008874 US patent application
  misc_feature: The sequence is a functional homolog of SEQ ID NO 24 in the 20060008874 US patent application
  misc_feature: The sequence is a functional homolog of SEQ ID NO 34 in the 20060008874 US patent application
  misc_feature: The sequence is a functional homolog of SEQ ID NO 36 in the 20060008874 US patent application
  misc_feature: The sequence is a functional homolog of SEQ ID NO 38 in the 20060008874 US patent application
  misc_feature: The sequence is a functional homolog of SEQ ID NO 40 in the 20060008874 US patent application
  misc_feature: The sequence is a functional homolog of SEQ ID NO 42 in the 20060008874 US patent application
  misc_feature: The sequence is a functional homolog of SEQ ID NO 44 in the 20060008874 US patent application
  misc_feature: The sequence is a functional homolog of SEQ ID NO 46 in the 20060008874 US patent application
  misc_feature: The sequence is a functional homolog of SEQ ID NO 50 in the 20060008874 US patent application
  misc_feature: The sequence is a functional homolog of SEQ ID NO 1180 in the 20060162006 US patent application
  misc_feature: The sequence is a functional homolog of SEQ ID NO 1181 in the 20060162006 US patent application
  misc_feature: The sequence is a functional homolog of SEQ ID NO 1186 in the 20060162006 US patent application
  misc_feature: The sequence is a functional homolog of SEQ ID NO 1176 in the 10/374,780 US patent application
  misc_feature: The sequence is a functional homolog of SEQ ID NO 1372 in the 10/412,699 US patent application
  misc_feature: The sequence is a functional homolog of SEQ ID NO 30 in the 10/838,616 US patent application
  misc_feature: The sequence is a functional homolog of SEQ ID NO 732 in the 11/435,388 US patent application
  misc_feature: The sequence is a functional homolog of SEQ ID NO 20 in the 10/838,616 US patent application
  misc_feature: The sequence is a functional homolog of SEQ ID NO 1177 in the 10/374,780 US patent application
  misc_feature: The sequence is a functional homolog of SEQ ID NO 1373 in the 10/412,699 US patent application
  misc_feature: The sequence is a functional homolog of SEQ ID NO 32 in the 10/838,616 US patent application
  misc_feature: The sequence is a functional homolog of SEQ ID NO 734 in the 11/435,388 US patent application
  misc_feature: The sequence is a functional homolog of SEQ ID NO 38 in the 10/838,616 US patent application
  misc_feature: The sequence is a functional homolog of SEQ ID NO 740 in the 11/435,388 US patent application
  misc_feature: The sequence is a functional homolog of SEQ ID NO 1186 in the 10/374,780 US patent application
  misc_feature: The sequence is a functional homolog of SEQ ID NO 1178 in the 10/374,780 US patent application
  misc_feature: The sequence is a functional homolog of SEQ ID NO 1374 in the 10/412,699 US patent application
  misc_feature: The sequence is a functional homolog of SEQ ID NO 53 in the 10/838,616 US patent application
  misc_feature: Useful for making plants with altered lignin content
  misc_feature: Useful for making plants with altered protein content
  misc_feature: Useful for making plants with altered terpenoid content
  misc_feature: Functional homolog of the protein sequence given in SEQ ID NO 13938
  misc_feature: The sequence is a functional homolog of SEQ ID NO 1184 in the 10/374,780 US patent application
  misc_feature: The sequence is a functional homolog of SEQ ID NO 24 in the 10/838,616 US patent application
  misc_feature: The sequence is a functional homolog of SEQ ID NO 758 in the 11/435,388 US patent application
  misc_feature: The sequence is a functional homolog of SEQ ID NO 1183 in the 10/374,780 US patent application
  misc_feature: The sequence is a functional homolog of SEQ ID NO 22 in the 10/838,616 US patent application
  misc_feature: The sequence is a functional homolog of SEQ ID NO 756 in the 11/435,388 US patent application
  misc_feature: Useful for making plants with altered alkaloid content
  misc_feature: Functional homolog of the protein sequence given in SEQ ID NO 13939
  misc_feature: The sequence is a functional homolog of SEQ ID NO 1258 in the 11/479,226 US patent application
  misc_feature: The sequence is a functional homolog of SEQ ID NO 138 in the 10/225,068 US patent application
  misc_feature: The sequence is a functional homolog of SEQ ID NO 170 in the 10/374,780 US patent application
  misc_feature: The sequence is a functional homolog of SEQ ID NO 2 in the 10/838,616 US patent application
  misc_feature: The sequence is a functional homolog of SEQ ID NO 208 in the 11/375,241 US patent application
  misc_feature: The sequence is a functional homolog of SEQ ID NO 580 in the 10/412,699 US patent application
  misc_feature: The sequence is a functional homolog of SEQ ID NO 630 in the 11/435,388 US patent application
  misc_feature: The sequence is a functional homolog of SEQ ID NO 796 in the 10/225,066 US patent application
  misc_feature: The sequence is a functional homolog of SEQ ID NO 44 in the 10/838,616 US patent application
  misc_feature: The sequence is a functional homolog of SEQ ID NO 1892 in the 10/412,699 US patent application
  misc_feature: The sequence is a functional homolog of SEQ ID NO 32 in the 11/375,241 US patent application
  misc_feature: The sequence is a functional homolog of SEQ ID NO 370 in the 10/374,780 US patent application
  misc_feature: The sequence is a functional homolog of SEQ ID NO 420 in the 10/225,066 US patent application
  misc_feature: The sequence is a functional homolog of SEQ ID NO 550 in the 11/435,388 US patent application
  misc_feature: The sequence is a functional homolog of SEQ ID NO 78 in the 10/225,068 US patent application
  misc_feature: The sequence is a functional homolog of SEQ ID NO 8 in the 10/838,616 US patent application
  misc_feature: The sequence is a functional homolog of SEQ ID NO 46 in the 10/838,616 US patent application
  misc_feature: The sequence is a functional homolog of SEQ ID NO 1185 in the 10/374,780 US patent application
  misc_feature: The sequence is a functional homolog of SEQ ID NO 40 in the 10/838,616 US patent application
  misc_feature: The sequence is a functional homolog of SEQ ID NO 742 in the 11/435,388 US patent application
  misc_feature: The sequence is a functional homolog of SEQ ID NO 42 in the 10/838,616 US patent application
  misc_feature: The sequence is a functional homolog of SEQ ID NO 48 in the 10/838,616 US patent application
  misc_feature: The sequence is a functional homolog of SEQ ID NO 64 in the 10/838,616 US patent application
MGIESMSPTAAPAEDSSSSSSRFSAASTATTESGAAQPRAASAAPGGGAVVVGRDASLADEQAVTSQPLAASTAAAVAQGSSRFKGVVPQPNGRWGAQIYERHARVWLGTFADEEAAARAYDVAALRYRGREAATNFPGAGASAPELTFLAAHSKAEIVDMLRKHTYADELRQGLRRGRGMGARAQPTPAWARSLLFEKAVTPSDVGKLNRLVVPKQHAEKHFPLKRAPEASAAAATTGKGVLLNFEDGEGKVWRFRYSYWNSSQSYVLTKGWSRFVREKGLRAGDTIVFSHSTYSSEKQLFIDCKKTKTTTVATTDGAPVPAPAEKKPSEARVVRLFGVDIAGDGCQKRARPVEIAFEHGPQQELLKKKQCVGVAHHRSPALGAFLL

SEQ ID NO: 5955 - DNA, 1752 bp, Sorghum bicolor
  misc_feature: Ceres ANNOT ID no. 6055455
  misc_feature: Encodes the peptide sequence at SEQ ID NO 5956
atgggacccacaaccggctcccgcttcgtctacaatcgccgccgccgaggcgggcggcacgccgtcgaggaggcttccgacgaggaggagcagcgggtggatagctcctcctcatcctccgacgaagaaggagatgaggaagaagatgccgaagcgtccggagaggacatcgatgacgaggaggaagaggaggcggtcgctgccgagcctgcggccaagcagtcacccgcagccgcggagacgggggagaagaggggcggaaggaagggcccgatcagcatcagcctcaagaaagtgtgcaaggtgtgcaaaaggacagggcaccaggcagggttccagggggctgtgtacatcgactgccccatgaagccttgcttcttatgcaagatgccaggtcatacaaccttgacttgcccacatagagtagcaatggagcatggtgtcatcccagcccctagaaggaatacaaacacttcactagattatgtctttcagagccaagtcaagggcaagatttccatggttaagcctaagtttctgatacccaaccaactagagtgtggaaacataaaatgtcatcagaggcgtgtgacatgcttggagtttcatccaactaagaacaatgttcttttatcaggagacaagaaagggcttctgggtatctgggattatgttaagttgcatgagaagattacatatgattctgtgcactcctgcattctgaatagcatgaagattgacaccaccaacgatgggatggtatatacagcttcctctgatggtactatcagttttaccgatttggacactggcattggctcccccttgctaaatctcaacccgaatggttggaatggtccaagctcttggcacatgatatatgggatggacttaaacactgacaaaggtcttcttttggtggcagataactttggttttctttacttcctggatagacggtcaaagacgagaattggacatccaattctgatccataaaaagggtagtaaggtaaccagcctacattgcaaccctgcacgacctgaagttcttctaagcagcggaaatgatcactatgcccgtatttgggatacaaggaagcttgaagccaactctccccttgccagccttgctcatggacgggtcgttaattcaggatacttttctccacgaagcggaaataagatcttgacaacttgtcaggacaaccgaattcgtgtatgggactatattcttggtgatctgcaatccccaagtagagaaattgtgcacagtcatgatttcaatcgtcatctgactcccttcaaagctgagtgggatccaaaggattacaccgaaaccgttgctgttattggccgttacataagtgagaactacaatggtgttgctctgcatccaattgatttcatagataccagttctgggaagcttctggctgaggtgatggaccctgacataacaaccatcagcccagtgaacaagctacatccacaagatgacatcctagctacaggaagctcaaggtctattttcatttggaaaccaaaaactgaagatgaacttactgaagaaagggccaaacagaagaccaaggaatacatctatggatcaagttcccgaaagaaagcaaatggcaagcatggcaatagtagtggtgatgactctgatggcgattctggcggaaagaacaagaaagcaaagacgactcgcttcactcatgcagtaaagggaaagggcaaatccaaagtctga

SEQ ID NO: 5956 - protein, 583 aa, Sorghum bicolor
  misc_feature: Ceres ANNOT ID no. 6055455
  misc_feature (370)..(409): Pfam Id: WD40 Pfam Desc: WD domain, G-beta repeat
  misc_feature (1)..(583): NCBI GI: 10798819 NCBI Desc: uv-damaged dna binding protein 2 [oryza sativa (japonica cultivar-group)]
  misc_feature (1)..(583): NCBI GI: 115434454 NCBI Desc: os01g0141700 [oryza sativa (japonica cultivar-group)]
  misc_feature (195)..(582): NCBI GI: 51703390 NCBI Desc: ddb2-prov protein [xenopus tropicalis]
  misc_feature (195)..(513): NCBI GI: 2134979 NCBI Desc: damage-specific dna binding protein 2 - human
  misc_feature (195)..(519): NCBI GI: 71153331 NCBI Desc: dna damage binding protein 2 (damage-specific dna-binding protein 2)
MGPTTGSRFVYNRRRRGGRHAVEEASDEEEQRVDSSSSSSDEEGDEEEDAEASGEDIDDEEEEEAVAAEPAAKQSPAAAETGEKRGGRKGPISISLKKVCKVCKRTGHQAGFQGAVYIDCPMKPCFLCKMPGHTTLTCPHRVAMEHGVIPAPRRNTNTSLDYVFQSQVKGKISMVKPKFLIPNQLECGNIKCHQRRVTCLEFHPTKNNVLLSGDKKGLLGIWDYVKLHEKITYDSVHSCILNSMKIDTTNDGMVYTASSDGTISFTDLDTGIGSPLLNLNPNGWNGPSSWHMIYGMDLNTDKGLLLVADNFGFLYFLDRRSKTRIGHPILIHKKGSKVTSLHCNPARPEVLLSSGNDHYARIWDTRKLEANSPLASLAHGRVVNSGYFSPRSGNKILTTCQDNRIRVWDYILGDLQSPSREIVHSHDFNRHLTPFKAEWDPKDYTETVAVIGRYISENYNGVALHPIDFIDTSSGKLLAEVMDPDITTISPVNKLHPQDDILATGSSRSIFIWKPKTEDELTEERAKQKTKEYIYGSSSRKKANGKHGNSSGDDSDGDSGGKNKKAKTTRFTHAVKGKGKSKV

SEQ ID NO: 5957 - DNA, 1638 bp, Sorghum bicolor
  misc_feature: Ceres ANNOT ID no. 6055461
  misc_feature: Encodes the peptide sequence at SEQ ID NO 5958
atgagttccttgccgccgtcgcaggcggccgccgcggcgtacgggtgcttccaccgcctcctgctcgcttctaccaccgtgccggcgaggagtgggtgcgtggggcgcgcacgcagactcacgctcgcgctccgctgcctaccgattgccgggcacaggctgaggagtcgaaaggttgcgtgccaagcgatgactgagaccgagtccgagggcgacggcgacaaggaggagaaaaaagagtttggagatgatgcttcatcaccttcggttgatagtgttgcagaagcaaatggacctgcagaaagtgactccagtatagacaataagaaagatgaaaccgcgaatgcagaactgctgagctccagcgacacggttcaaaatgtggatggagatgctacttctaccaatgatgtacaggaaaatgtggaagttattgaagttgttagcggatctccattgccaggaatgaagcaacagcttgatgattctgtcaggatccccaaggctacaatagacattctaaaggatcaagtttttggatttgacacattttttgtgacaagtcaggaaccttacgagggtggagtattattcaagggaaatcttcgtggtaaaccagccaaaagctatgagaagatcacaaatcggcttcagaacaaatttggtgatgaatataagctttttcttctcatcaacccagaggatgagaaaccagttgctgtggttatacccaagcagacattacagcctgaaactacagcgctcccagaatggtttgctgctgcttcatttggaatagttaccatcttcactttgctacttcgaaatgtacctgttctacaggacaacttgctatcaacatttgacaaccttgagttgttgaaagatggactatctggtgctctagtaactgcccttataataggggtccatgaaattggacatatccttgctgccagggaaagtggaatcaagcttggtgtgccatattttgttcctagttggcagataggatctttcggtgcaattaccagaattgtcaatattgtccgcaaccgtgaggacctactgaagctagcagctgctggaccattggccgggttttcctttggatttgttcttttgctgctgggcttcatcttacctccaagtgatggccttggtcttgtgatagatccaactgtcttccatgaatcattccttgttggcggtctcgcaaagcttcttcttggagatgttctaaaagaaggaacagagttatccataaacccacttgttttatgggcctgggctggtctcctgatcaatgctatcaatagcataccagctggagagcttgatggtggtcgcatagcattggccatatggggaagaaagatatcgtctcgggtcagcagccttgccattgggttgcttgggatctcggctctcttcaacgatgttgccttctactgggtggtgttgatcttcttcctgcagaggggcccgattgctcctctctctgaggaaatcacagaccctgagagcaactacattggcatcggtgttgccattttgttatttgggcttctggtctgcctgccttacccattcccctttgacccgtcgcaattaactgatatggatttcaacttttga

SEQ ID NO: 5958 - protein, 545 aa, Sorghum bicolor
  misc_feature: Ceres ANNOT ID no. 6055461
  misc_feature (299)..(480): Pfam Id: Peptidase_M50 Pfam Desc: Peptidase family M50
  misc_feature (3)..(542): NCBI GI: 115434462 NCBI Desc: os01g0142100 [oryza sativa (japonica cultivar-group)]
  misc_feature (93)..(533): NCBI GI: 42573279 NCBI Desc: peptidase m50 family protein / sterol-regulatory element binding protein (srebp) site 2 protease family protein [arabidopsis thaliana]
  misc_feature (158)..(528): NCBI GI: 67923178 NCBI Desc: peptidase m50 [crocosphaera watsonii wh 8501]
  misc_feature (162)..(528): NCBI GI: 119511518 NCBI Desc: peptidase m50 [nodularia spumigena ccy9414]
  misc_feature (139)..(528): NCBI GI: 126659579 NCBI Desc: peptidase m50 [cyanothece sp. ccy0110]
MSSLPPSQAAAAAYGCFHRLLLASTTVPARSGCVGRARRLTLALRCLPIAGHRLRSRKVACQAMTETESEGDGDKEEKKEFGDDASSPSVDSVAEANGPAESDSSIDNKKDETANAELLSSSDTVQNVDGDATSTNDVQENVEVIEVVSGSPLPGMKQQLDDSVRIPKATIDILKDQVFGFDTFFVTSQEPYEGGVLFKGNLRGKPAKSYEKITNRLQNKFGDEYKLFLLINPEDEKPVAVVIPKQTLQPETTALPEWFAAASFGIVTIFTLLLRNVPVLQDNLLSTFDNLELLKDGLSGALVTALIIGVHEIGHILAARESGIKLGVPYFVPSWQIGSFGAITRIVNIVRNREDLLKLAAAGPLAGFSFGFVLLLLGFILPPSDGLGLVIDPTVFHESFLVGGLAKLLLGDVLKEGTELSINPLVLWAWAGLLINAINSIPAGELDGGRIALAIWGRKISSRVSSLAIGLLGISALFNDVAFYWVVLIFFLQRGPIAPLSEEITDPESNYIGIGVAILLFGLLVCLPYPFPFDPSQLTDMDFNF

SEQ ID NO: 5959 - DNA, 876 bp, Sorghum bicolor
  misc_feature: Ceres ANNOT ID no. 6055595
  misc_feature: Encodes the peptide sequence at SEQ ID NO 5960
atggaggctccacccgtggcgctgttcgactccctcaaggctgccaaaccgttcttcttgctggccggtcccaacgtgattgagtcggaggagcatgtcctgaagatggccaaacacattaaaggaattacaacaaagcttggaattcctcttgtgttcaagtccagctttgataaagcaaaccgtacatcgtcaaaatcgttccgtggtcctggtcttgaagaaggcctaaagatccttgaaaaggtgaaagcaacatatgaccttccggtagtcactgatgttcatgaaagccaccagtgtgaagctgttggaagagttgctgacattatacagattccagcattcctctgtcgccagactgatcttctagtggccgctgctaagactggaaagattatcaacatcaagaaaggacaattctgtgcgccttctgttatgatgaactctgcagagaaagtaaggcttgctggaaacccaaatgtgatggtctgtgagcgtggtaccatgtttggctacaatgatctaattgttgacccaaggaactttgagtggctgagggaagccaactgcccagttgtagctgatgtcacacatgctctacaacaaccggctggaagaaagcttgatggtggaggtgttgcaagtggggggctacgagaactaataccatgcattgcaaggacttctgttgctgttggtgttgatggtattttcatggaggtacatgatgatcccttgaatgcaccatgcgacggcccaactcaatggccattgcgcaatttggaagagctattggaggaattgattgcaatcgctcgagttaccaagggaaagaagccattcaagatcgatctcactccgttccaggaataa

SEQ ID NO: 5960 - protein, 291 aa, Sorghum bicolor
  misc_feature: Ceres ANNOT ID no. 6055595
  misc_feature (11)..(278): Pfam Id: DAHP_synth_1 Pfam Desc: DAHP synthetase I family
  misc_feature (4)..(291): NCBI GI: 2695863 NCBI Desc: 3-deoxy-d-manno-2-octulosonate-8-phosphate synthase [pisum sativum]
  misc_feature (8)..(291): NCBI GI: 21360537 NCBI Desc: at5g09730/f17i14_80 [arabidopsis thaliana]
  misc_feature (8)..(291): NCBI GI: 79321478 NCBI Desc: kdsa; 3-deoxy-8-phosphooctulonate synthase [arabidopsis thaliana]
  misc_feature (8)..(291): NCBI GI: 13620976 NCBI Desc: 2-dehydro-3-deoxyphosphooctonate aldolase [arabidopsis thaliana]
  misc_feature (1)..(289): NCBI GI: 13509333 NCBI Desc: 3-desoxy-d-manno octulosonic acid-8-phosphate synthase [lycopersicon esculentum]
  misc_feature (4)..(291): SWISSPROT Homolog: EC 2.5.1.55 2-dehydro-3-deoxyphosphooctonate aldolase
MEAPPVALFDSLKAAKPFFLLAGPNVIESEEHVLKMAKHIKGITTKLGIPLVFKSSFDKANRTSSKSFRGPGLEEGLKILEKVKATYDLPVVTDVHESHQCEAVGRVADIIQIPAFLCRQTDLLVAAAKTGKIINIKKGQFCAPSVMMNSAEKVRLAGNPNVMVCERGTMFGYNDLIVDPRNFEWLREANCPVVADVTHALQQPAGRKLDGGGVASGGLRELIPCIARTSVAVGVDGIFMEVHDDPLNAPCDGPTQWPLRNLEELLEELIAIARVTKGKKPFKIDLTPFQE

SEQ ID NO: 5961 - DNA, 639 bp, Sorghum bicolor
  misc_feature: Ceres ANNOT ID no. 6055636
  misc_feature: Encodes the peptide sequence at SEQ ID NO 5962
atggcgacggcgaagcccatcctgtacaacgcttggatcagctcctgctcccaccgtgttcgcatcgcgctaaacctcaaaggtgtggattacgagtataagtcggtaaatcccaggacagatccagattatgaaaaaatcaatccaatcaaatatattccagcattagtagatggggacatagtcgtttctgattctctcgctatctcattgtatttggaagataaatatcctgagcatcctctcctgcctaaagatctcaagaggaaagctcttaatcttcagattgcaaacattgtttgttcaagcattcaacctcttcaaggctatgccgttattggtctgcatgagggtaggatgagcccagatgagggccttcatattgttcaaacttatattgacaagggattcagagcgatcgaaaagctcttggaaggatgtgagagtaaatatgctactggagatgatgtccaattgggagatgtgtttcttgaaccacagatacatgctggcataaatcgcttccaaatcgatatgtcgaagtacccaatcttggagaggctccatgatgcatacatgcaaaatccagcattcgaatctgcgcttcccaaaaatcagccagacgcaccttcatcataa
